United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 69

SEQ ID NO: 2485856 - RNA, 15 nt, Brucella suis 1330
augccggcgaucuuu

SEQ ID NO: 2485857 - RNA, 17 nt, Brucella suis 1330
augccgggcacgaaaag

SEQ ID NO: 2485858 - RNA, 16 nt, Brucella suis 1330
augccggucgcaggcg

SEQ ID NO: 2485859 - RNA, 23 nt, Brucella suis 1330
augccgugcacuucgagcaggcg

SEQ ID NO: 2485860 - RNA, 21 nt, Brucella suis 1330
auuaucuuccugcgaaaaccu

SEQ ID NO: 2485861 - RNA, 17 nt, Brucella suis 1330
auuauuuagauuugcuu

SEQ ID NO: 2485862 - RNA, 14 nt, Brucella suis 1330
auuauuuuuacaaa

SEQ ID NO: 2485863 - RNA, 15 nt, Brucella suis 1330
auuauuuuuacaaaa

SEQ ID NO: 2485864 - RNA, 16 nt, Brucella suis 1330
auuauuuuuacaaaaa

SEQ ID NO: 2485865 - RNA, 21 nt, Brucella suis 1330
auucaaccauauaaagcuuga

SEQ ID NO: 2485866 - RNA, 23 nt, Brucella suis 1330
auucaaccauauaaagcuugaac

SEQ ID NO: 2485867 - RNA, 17 nt, Brucella suis 1330
auucaaccguuuccuga

SEQ ID NO: 2485868 - RNA, 19 nt, Brucella suis 1330
auucagagcuucauugucc

SEQ ID NO: 2485869 - RNA, 15 nt, Brucella suis 1330
auucaggaucuuucc

SEQ ID NO: 2485870 - RNA, 22 nt, Brucella suis 1330
auucaggaucuuuccaaguuca

SEQ ID NO: 2485871 - RNA, 14 nt, Brucella suis 1330
auucaucguauucg

SEQ ID NO: 2485872 - RNA, 11 nt, Brucella suis 1330
auucaugcccu

SEQ ID NO: 2485873 - RNA, 19 nt, Brucella suis 1330
auuccaacauuugcucaac

SEQ ID NO: 2485874 - RNA, 12 nt, Brucella suis 1330
auuccagaaggu

SEQ ID NO: 2485875 - RNA, 14 nt, Brucella suis 1330
auuccagccgggcu

SEQ ID NO: 2485876 - RNA, 18 nt, Brucella suis 1330
auuccaucagccgggcag

SEQ ID NO: 2485877 - RNA, 16 nt, Brucella suis 1330
auuccccuaaaucacu

SEQ ID NO: 2485878 - RNA, 16 nt, Brucella suis 1330
auuccccuauuccccu

SEQ ID NO: 2485879 - RNA, 17 nt, Brucella suis 1330
auucccuuaacauacug

SEQ ID NO: 2485880 - RNA, 19 nt, Brucella suis 1330
auucccuuaacauacugcc

SEQ ID NO: 2485881 - RNA, 15 nt, Brucella suis 1330
auuccgccggggcag

SEQ ID NO: 2485882 - RNA, 18 nt, Brucella suis 1330
auuccgccggggcaggcu

SEQ ID NO: 2485883 - RNA, 21 nt, Brucella suis 1330
auuccucaagauacaaaaaau

SEQ ID NO: 2485884 - RNA, 20 nt, Brucella suis 1330
auuccugaaccacuuccgaa

SEQ ID NO: 2485885 - RNA, 16 nt, Brucella suis 1330
auuccuucuccaucug

SEQ ID NO: 2485886 - RNA, 16 nt, Brucella suis 1330
auucgcuguugcgccc

SEQ ID NO: 2485887 - RNA, 23 nt, Brucella suis 1330
auucggcgaccgccuuuuccagu

SEQ ID NO: 2485888 - RNA, 22 nt, Brucella suis 1330
auucgggcggcacccccggcag

SEQ ID NO: 2485889 - RNA, 15 nt, Brucella suis 1330
auucgucagcucgaa

SEQ ID NO: 2485890 - RNA, 18 nt, Brucella suis 1330
auucuaucgccuggcauu

SEQ ID NO: 2485891 - RNA, 16 nt, Brucella suis 1330
auucugaaugacgacc

SEQ ID NO: 2485892 - RNA, 17 nt, Brucella suis 1330
auucugccgcucggcga

SEQ ID NO: 2485893 - RNA, 20 nt, Brucella suis 1330
auucugcuuaucaaggccgg

SEQ ID NO: 2485894 - RNA, 16 nt, Brucella suis 1330
auucuuccagaaugcg

SEQ ID NO: 2485895 - RNA, 22 nt, Brucella suis 1330
auucuugcgcccuccaccgcuc

SEQ ID NO: 2485896 - RNA, 18 nt, Brucella suis 1330
auugaaaaaaaugggcgg

SEQ ID NO: 2485897 - RNA, 18 nt, Brucella suis 1330
auugaaauucuuuugggc

SEQ ID NO: 2485898 - RNA, 20 nt, Brucella suis 1330
auugaaugccagauaaccug

SEQ ID NO: 2485899 - RNA, 12 nt, Brucella suis 1330
auugagagauuu

SEQ ID NO: 2485900 - RNA, 16 nt, Brucella suis 1330
auugaugaaaaacccc

SEQ ID NO: 2485901 - RNA, 15 nt, Brucella suis 1330
auugcacagcggucg

SEQ ID NO: 2485902 - RNA, 23 nt, Brucella suis 1330
auugcacagcggucgaaaccuug

SEQ ID NO: 2485903 - RNA, 17 nt, Brucella suis 1330
auugcaucgcgguuuuc

SEQ ID NO: 2485904 - RNA, 12 nt, Brucella suis 1330
auugcccauugc

SEQ ID NO: 2485905 - RNA, 13 nt, Brucella suis 1330
auugcccgcccgu

SEQ ID NO: 2485906 - RNA, 10 nt, Brucella suis 1330
auugcccgga

SEQ ID NO: 2485907 - RNA, 17 nt, Brucella suis 1330
auugcccuaucaagaau

SEQ ID NO: 2485908 - RNA, 21 nt, Brucella suis 1330
auugccgcauaggcuuucagc

SEQ ID NO: 2485909 - RNA, 18 nt, Brucella suis 1330
auugccgcgcgcggcuuc

SEQ ID NO: 2485910 - RNA, 16 nt, Brucella suis 1330
auugccgcugccggua

SEQ ID NO: 2485911 - RNA, 22 nt, Brucella suis 1330
auugccugugccaaugacaugg

SEQ ID NO: 2485912 - RNA, 13 nt, Brucella suis 1330
auugcgcuugccg

SEQ ID NO: 2485913 - RNA, 14 nt, Brucella suis 1330
auugcggccaagcg

SEQ ID NO: 2485914 - RNA, 21 nt, Brucella suis 1330
auugcggcugauaugcgcaug

SEQ ID NO: 2485915 - RNA, 15 nt, Brucella suis 1330
auugcgggaaggcgc

SEQ ID NO: 2485916 - RNA, 13 nt, Brucella suis 1330
auugcgggcauga

SEQ ID NO: 2485917 - RNA, 22 nt, Brucella suis 1330
auugcuaaaugcaagcgucuuc

SEQ ID NO: 2485918 - RNA, 22 nt, Brucella suis 1330
auugcuguugcgcuccuauuuc

SEQ ID NO: 2485919 - RNA, 15 nt, Brucella suis 1330
auuggaucagucgac

SEQ ID NO: 2485920 - RNA, 22 nt, Brucella suis 1330
auuggcagcgccggggccaaag

SEQ ID NO: 2485921 - RNA, 14 nt, Brucella suis 1330
auuggccgcugccu

SEQ ID NO: 2485922 - RNA, 15 nt, Brucella suis 1330
auuggcguucacauu

SEQ ID NO: 2485923 - RNA, 18 nt, Brucella suis 1330
auugggagcgcagugccu

SEQ ID NO: 2485924 - RNA, 13 nt, Brucella suis 1330
auugggcagcaga

SEQ ID NO: 2485925 - RNA, 22 nt, Brucella suis 1330
auuguuccggcacucgaaaauc

SEQ ID NO: 2485926 - RNA, 15 nt, Brucella suis 1330
auuuacguuuucguc

SEQ ID NO: 2485927 - RNA, 14 nt, Brucella suis 1330
auuucaccacgcca

SEQ ID NO: 2485928 - RNA, 21 nt, Brucella suis 1330
auuucaccgcgcaagauuuug

SEQ ID NO: 2485929 - RNA, 18 nt, Brucella suis 1330
auuucaggcgcugaugug

SEQ ID NO: 2485930 - RNA, 23 nt, Brucella suis 1330
auuucagguggcggauugcagcg

SEQ ID NO: 2485931 - RNA, 13 nt, Brucella suis 1330
auuucaucucgcg

SEQ ID NO: 2485932 - RNA, 17 nt, Brucella suis 1330
auuucaugaaaaugcca

SEQ ID NO: 2485933 - RNA, 15 nt, Brucella suis 1330
auuuccaccacgcgc

SEQ ID NO: 2485934 - RNA, 17 nt, Brucella suis 1330
auuuccagcaaaaguga

SEQ ID NO: 2485935 - RNA, 22 nt, Brucella suis 1330
auuuccaucgcuugaaccucca

SEQ ID NO: 2485936 - RNA, 22 nt, Brucella suis 1330
auuuccgcgacaucaucaagga

SEQ ID NO: 2485937 - RNA, 14 nt, Brucella suis 1330
auuugaaaagcccc

SEQ ID NO: 2485938 - RNA, 18 nt, Brucella suis 1330
auuugaacaaagaugaau

SEQ ID NO: 2485939 - RNA, 21 nt, Brucella suis 1330
auuugaggauugccgccgcac

SEQ ID NO: 2485940 - RNA, 13 nt, Brucella suis 1330
auuugcaggccgu

SEQ ID NO: 2485941 - RNA, 21 nt, Brucella suis 1330
auuugccauagccuuucugcc

SEQ ID NO: 2485942 - RNA, 15 nt, Brucella suis 1330
auuugcgcaccagau

SEQ ID NO: 2485943 - RNA, 17 nt, Brucella suis 1330
auuugcuuaagugucug

SEQ ID NO: 2485944 - RNA, 19 nt, Brucella suis 1330
auuuguaguucaggccggc

SEQ ID NO: 2485945 - RNA, 14 nt, Brucella suis 1330
auuuuagcugcugu

SEQ ID NO: 2485946 - RNA, 22 nt, Brucella suis 1330
auuuucauggguaccuuccagc

SEQ ID NO: 2485947 - RNA, 17 nt, Brucella suis 1330
auuuucgagcaucgauc

SEQ ID NO: 2485948 - RNA, 14 nt, Brucella suis 1330
auuuucgagccaaa

SEQ ID NO: 2485949 - RNA, 15 nt, Brucella suis 1330
auuuucguugcuucc

SEQ ID NO: 2485950 - RNA, 12 nt, Brucella suis 1330
auuuucugcauc

SEQ ID NO: 2485951 - RNA, 10 nt, Brucella suis 1330
auuuugauug

SEQ ID NO: 2485952 - RNA, 19 nt, Brucella suis 1330
auuuuucgccgcgcacugg

SEQ ID NO: 2485953 - RNA, 23 nt, Brucella suis 1330
caaaaagcgguucgugaagccgc

SEQ ID NO: 2485954 - RNA, 18 nt, Brucella suis 1330
caaaaccacgguggcuca

SEQ ID NO: 2485955 - RNA, 20 nt, Brucella suis 1330
caaaacccggcgcaaaggcc

SEQ ID NO: 2485956 - RNA, 18 nt, Brucella suis 1330
caaaacugaucguugaag

SEQ ID NO: 2485957 - RNA, 22 nt, Brucella suis 1330
caaaacugaucguugaaggcgu

SEQ ID NO: 2485958 - RNA, 14 nt, Brucella suis 1330
caaaagaaaccccg

SEQ ID NO: 2485959 - RNA, 20 nt, Brucella suis 1330
caaaagaacggggaucagaa

SEQ ID NO: 2485960 - RNA, 16 nt, Brucella suis 1330
caaaagauuagagcgc

SEQ ID NO: 2485961 - RNA, 21 nt, Brucella suis 1330
caaaagcccgcucuccggcgg

SEQ ID NO: 2485962 - RNA, 14 nt, Brucella suis 1330
caaaagcuuuguau

SEQ ID NO: 2485963 - RNA, 17 nt, Brucella suis 1330
caaaagugcgaagcgcc

SEQ ID NO: 2485964 - RNA, 17 nt, Brucella suis 1330
caaaaguuuucagcggc

SEQ ID NO: 2485965 - RNA, 18 nt, Brucella suis 1330
caaaaguuuucagcggcg

SEQ ID NO: 2485966 - RNA, 20 nt, Brucella suis 1330
caaaaguuuucagcggcggg

SEQ ID NO: 2485967 - RNA, 18 nt, Brucella suis 1330
caaaauggugcugccaug

SEQ ID NO: 2485968 - RNA, 21 nt, Brucella suis 1330
caaaauggugcugccauggca

SEQ ID NO: 2485969 - RNA, 13 nt, Brucella suis 1330
caaaccaaaaaac

SEQ ID NO: 2485970 - RNA, 16 nt, Brucella suis 1330
caaacgaauuuggugc

SEQ ID NO: 2485971 - RNA, 13 nt, Brucella suis 1330
caaagaccagcag

SEQ ID NO: 2485972 - RNA, 15 nt, Brucella suis 1330
caaagaccagcagga

SEQ ID NO: 2485973 - RNA, 17 nt, Brucella suis 1330
caaagaccagcaggaag

SEQ ID NO: 2485974 - RNA, 14 nt, Brucella suis 1330
caaagaucaaaggu

SEQ ID NO: 2485975 - RNA, 19 nt, Brucella suis 1330
caaagaucaaagguaaggc

SEQ ID NO: 2485976 - RNA, 14 nt, Brucella suis 1330
caaagcgcgcgcca

SEQ ID NO: 2485977 - RNA, 16 nt, Brucella suis 1330
caaucgccggaaccgc

SEQ ID NO: 2485978 - RNA, 19 nt, Brucella suis 1330
caaucucaaaacgcggaag

SEQ ID NO: 2485979 - RNA, 18 nt, Brucella suis 1330
caaucucacacugcaaaa

SEQ ID NO: 2485980 - RNA, 15 nt, Brucella suis 1330
caaucuugaccuggc

SEQ ID NO: 2485981 - RNA, 19 nt, Brucella suis 1330
caaucuugccaacauggcu

SEQ ID NO: 2485982 - RNA, 21 nt, Brucella suis 1330
caaugaaagcaacgcccuuca

SEQ ID NO: 2485983 - RNA, 12 nt, Brucella suis 1330
caaugaacaaca

SEQ ID NO: 2485984 - RNA, 14 nt, Brucella suis 1330
caaugacaagcgga

SEQ ID NO: 2485985 - RNA, 17 nt, Brucella suis 1330
caaugacggcauuuugc

SEQ ID NO: 2485986 - RNA, 23 nt, Brucella suis 1330
caaugagcccgcgcaggauuuca

SEQ ID NO: 2485987 - RNA, 17 nt, Brucella suis 1330
caaugcaccgauggcca

SEQ ID NO: 2485988 - RNA, 16 nt, Brucella suis 1330
caaugcaggcgcggca

SEQ ID NO: 2485989 - RNA, 18 nt, Brucella suis 1330
caaugccgcauucagcac

SEQ ID NO: 2485990 - RNA, 19 nt, Brucella suis 1330
caauggcgggccauuucca

SEQ ID NO: 2485991 - RNA, 23 nt, Brucella suis 1330
caauggcgggccauuuccaaugc

SEQ ID NO: 2485992 - RNA, 19 nt, Brucella suis 1330
caauggcugucaaugcagc

SEQ ID NO: 2485993 - RNA, 14 nt, Brucella suis 1330
caaugggcggggcu

SEQ ID NO: 2485994 - RNA, 14 nt, Brucella suis 1330
caaugugccugaaa

SEQ ID NO: 2485995 - RNA, 20 nt, Brucella suis 1330
caaugugccugaaacaaggc

SEQ ID NO: 2485996 - RNA, 20 nt, Brucella suis 1330
caaugugcgggcuucuucca

SEQ ID NO: 2485997 - RNA, 14 nt, Brucella suis 1330
caauuccagccggg

SEQ ID NO: 2485998 - RNA, 14 nt, Brucella suis 1330
caauuccggcaucg

SEQ ID NO: 2485999 - RNA, 13 nt, Brucella suis 1330
caauuccugcgcc

SEQ ID NO: 2486000 - RNA, 14 nt, Brucella suis 1330
caauuccugcgcca

SEQ ID NO: 2486001 - RNA, 13 nt, Brucella suis 1330
caauugcgcgccu

SEQ ID NO: 2486002 - RNA, 15 nt, Brucella suis 1330
caauuuaucaugacc

SEQ ID NO: 2486003 - RNA, 14 nt, Brucella suis 1330
cacaaagaacaagc

SEQ ID NO: 2486004 - RNA, 18 nt, Brucella suis 1330
cacaaagcggcccguauc

SEQ ID NO: 2486005 - RNA, 18 nt, Brucella suis 1330
cacaagaacagccgcccc

SEQ ID NO: 2486006 - RNA, 19 nt, Brucella suis 1330
cacaagaacagccgccccg

SEQ ID NO: 2486007 - RNA, 14 nt, Brucella suis 1330
cacaagaagcaagu

SEQ ID NO: 2486008 - RNA, 18 nt, Brucella suis 1330
cacaaucgccggaaccgc

SEQ ID NO: 2486009 - RNA, 14 nt, Brucella suis 1330
cacaccgaacuggg

SEQ ID NO: 2486010 - RNA, 15 nt, Brucella suis 1330
cacacgaacagcagc

SEQ ID NO: 2486011 - RNA, 17 nt, Brucella suis 1330
cacacgaaccgaaaccg

SEQ ID NO: 2486012 - RNA, 19 nt, Brucella suis 1330
cacacuuuucgggaugcgg

SEQ ID NO: 2486013 - RNA, 13 nt, Brucella suis 1330
cacagaucaugag

SEQ ID NO: 2486014 - RNA, 16 nt, Brucella suis 1330
cacagccagaaagaag

SEQ ID NO: 2486015 - RNA, 14 nt, Brucella suis 1330
cacagccaucagga

SEQ ID NO: 2486016 - RNA, 14 nt, Brucella suis 1330
cacagccccuugcc

SEQ ID NO: 2486017 - RNA, 17 nt, Brucella suis 1330
cacagccccuugccccg

SEQ ID NO: 2486018 - RNA, 19 nt, Brucella suis 1330
cacagccccuugccccggc

SEQ ID NO: 2486019 - RNA, 22 nt, Brucella suis 1330
cacagccgguucggauccuccu

SEQ ID NO: 2486020 - RNA, 23 nt, Brucella suis 1330
cacaggcucgggcagcuugucga

SEQ ID NO: 2486021 - RNA, 15 nt, Brucella suis 1330
cacauaaucgcccuc

SEQ ID NO: 2486022 - RNA, 21 nt, Brucella suis 1330
cacauaaucgcccucgaucag

SEQ ID NO: 2486023 - RNA, 22 nt, Brucella suis 1330
cacauaaucgcccucgaucagc

SEQ ID NO: 2486024 - RNA, 22 nt, Brucella suis 1330
cacauagccugcaagcgcgaca

SEQ ID NO: 2486025 - RNA, 16 nt, Brucella suis 1330
cacauaucagcccgcu

SEQ ID NO: 2486026 - RNA, 16 nt, Brucella suis 1330
cacaucaccauugccc

SEQ ID NO: 2486027 - RNA, 18 nt, Brucella suis 1330
cacauccguuacacgccc

SEQ ID NO: 2486028 - RNA, 21 nt, Brucella suis 1330
cacauccguuacacgccccuc

SEQ ID NO: 2486029 - RNA, 21 nt, Brucella suis 1330
cacaucgagacggcgcuccau

SEQ ID NO: 2486030 - RNA, 20 nt, Brucella suis 1330
cacaucgccuugcagauaaa

SEQ ID NO: 2486031 - RNA, 18 nt, Brucella suis 1330
cacaucggcggaaaagcg

SEQ ID NO: 2486032 - RNA, 16 nt, Brucella suis 1330
cacauggcggccuuuu

SEQ ID NO: 2486033 - RNA, 18 nt, Brucella suis 1330
cacauggcggccuuuucg

SEQ ID NO: 2486034 - RNA, 20 nt, Brucella suis 1330
cacauugucugaaaacgaau

SEQ ID NO: 2486035 - RNA, 16 nt, Brucella suis 1330
cacauuucaugaaaau

SEQ ID NO: 2486036 - RNA, 19 nt, Brucella suis 1330
caccaaaagagcgcucgcg

SEQ ID NO: 2486037 - RNA, 11 nt, Brucella suis 1330
caccaagaccg

SEQ ID NO: 2486038 - RNA, 19 nt, Brucella suis 1330
caccaagaccgccgcgaug

SEQ ID NO: 2486039 - RNA, 22 nt, Brucella suis 1330
caccaauauugcaggcgacauc

SEQ ID NO: 2486040 - RNA, 13 nt, Brucella suis 1330
caccaaugcaggc

SEQ ID NO: 2486041 - RNA, 18 nt, Brucella suis 1330
caccaaugcaggcgcggc

SEQ ID NO: 2486042 - RNA, 19 nt, Brucella suis 1330
caccaaugcaggcgcggca

SEQ ID NO: 2486043 - RNA, 16 nt, Brucella suis 1330
caccacaugcuccagg

SEQ ID NO: 2486044 - RNA, 22 nt, Brucella suis 1330
caccaccgggcagucagcaccg

SEQ ID NO: 2486045 - RNA, 14 nt, Brucella suis 1330
caccaccucgccaa

SEQ ID NO: 2486046 - RNA, 22 nt, Brucella suis 1330
caccaccucgccauugcgcauu

SEQ ID NO: 2486047 - RNA, 17 nt, Brucella suis 1330
caccacgaccuggguug

SEQ ID NO: 2486048 - RNA, 22 nt, Brucella suis 1330
caccacgauuucgcccacgccc

SEQ ID NO: 2486049 - RNA, 11 nt, Brucella suis 1330
caccagaugcu

SEQ ID NO: 2486050 - RNA, 20 nt, Brucella suis 1330
caccagcacacagccaagac

SEQ ID NO: 2486051 - RNA, 23 nt, Brucella suis 1330
caccagccguuccagggcgcgcc

SEQ ID NO: 2486052 - RNA, 17 nt, Brucella suis 1330
caccagcggcacgccgc

SEQ ID NO: 2486053 - RNA, 19 nt, Brucella suis 1330
caccagcggcacgccgccc

SEQ ID NO: 2486054 - RNA, 23 nt, Brucella suis 1330
caccagcggcacgccgcccagga

SEQ ID NO: 2486055 - RNA, 21 nt, Brucella suis 1330
caccagucacgguugccuugc

SEQ ID NO: 2486056 - RNA, 15 nt, Brucella suis 1330
caccauauucgucca

SEQ ID NO: 2486057 - RNA, 19 nt, Brucella suis 1330
caccauauuugccgccaga

SEQ ID NO: 2486058 - RNA, 22 nt, Brucella suis 1330
caccaucgaggaauaggcgcca

SEQ ID NO: 2486059 - RNA, 16 nt, Brucella suis 1330
caccaucucgcccagg

SEQ ID NO: 2486060 - RNA, 20 nt, Brucella suis 1330
caccaugcggcuccaguucc

SEQ ID NO: 2486061 - RNA, 15 nt, Brucella suis 1330
caccauggccgcccc

SEQ ID NO: 2486062 - RNA, 19 nt, Brucella suis 1330
caccauggugucauagacc

SEQ ID NO: 2486063 - RNA, 21 nt, Brucella suis 1330
caccauggugucauagaccau

SEQ ID NO: 2486064 - RNA, 22 nt, Brucella suis 1330
caccauggugucauagaccaug

SEQ ID NO: 2486065 - RNA, 23 nt, Brucella suis 1330
caccauggugucauagaccauga

SEQ ID NO: 2486066 - RNA, 20 nt, Brucella suis 1330
cacccgauaaacccgccccc

SEQ ID NO: 2486067 - RNA, 19 nt, Brucella suis 1330
cacccgcgucgucugcauc

SEQ ID NO: 2486068 - RNA, 14 nt, Brucella suis 1330
cacccuauuccccu

SEQ ID NO: 2486069 - RNA, 17 nt, Brucella suis 1330
cacccuucaacagcccg

SEQ ID NO: 2486070 - RNA, 20 nt, Brucella suis 1330
cacccuugaucguauagccc

SEQ ID NO: 2486071 - RNA, 19 nt, Brucella suis 1330
cacccuuggcgacggccag

SEQ ID NO: 2486072 - RNA, 21 nt, Brucella suis 1330
caccgaacugggcggccagcu

SEQ ID NO: 2486073 - RNA, 14 nt, Brucella suis 1330
caccgaagccacga

SEQ ID NO: 2486074 - RNA, 22 nt, Brucella suis 1330
caccgaucacgccgucaaagga

SEQ ID NO: 2486075 - RNA, 19 nt, Brucella suis 1330
caccgauggagcgcccgau

SEQ ID NO: 2486076 - RNA, 15 nt, Brucella suis 1330
caccgauggccagga

SEQ ID NO: 2486077 - RNA, 12 nt, Brucella suis 1330
caccgcacuggg

SEQ ID NO: 2486078 - RNA, 20 nt, Brucella suis 1330
caccgccagcagaaccgcuu

SEQ ID NO: 2486079 - RNA, 16 nt, Brucella suis 1330
caccgccugccagccc

SEQ ID NO: 2486080 - RNA, 20 nt, Brucella suis 1330
caccgcgaaagcacccgcuu

SEQ ID NO: 2486081 - RNA, 16 nt, Brucella suis 1330
caccggaucggugcgc

SEQ ID NO: 2486082 - RNA, 16 nt, Brucella suis 1330
caccggcccaaaggcc

SEQ ID NO: 2486083 - RNA, 18 nt, Brucella suis 1330
caccggcccaaaggccgc

SEQ ID NO: 2486084 - RNA, 16 nt, Brucella suis 1330
caccggcggaaggcug

SEQ ID NO: 2486085 - RNA, 22 nt, Brucella suis 1330
caccggcugggccuuguuuucu

SEQ ID NO: 2486086 - RNA, 13 nt, Brucella suis 1330
caccgguuuucau

SEQ ID NO: 2486087 - RNA, 21 nt, Brucella suis 1330
caccguugccucugucagcuu

SEQ ID NO: 2486088 - RNA, 22 nt, Brucella suis 1330
caccguugccucugucagcuuu

SEQ ID NO: 2486089 - RNA, 22 nt, Brucella suis 1330
caccguuucggguggccuuugc

SEQ ID NO: 2486090 - RNA, 13 nt, Brucella suis 1330
caccugcggcgcc

SEQ ID NO: 2486091 - RNA, 16 nt, Brucella suis 1330
caccuucggccagcgc

SEQ ID NO: 2486092 - RNA, 21 nt, Brucella suis 1330
caccuucggguuuuuuaccgc

SEQ ID NO: 2486093 - RNA, 20 nt, Brucella suis 1330
cagaugcgcaaaacgcuuga

SEQ ID NO: 2486094 - RNA, 20 nt, Brucella suis 1330
cagaugcggcgcgcauuuuc

SEQ ID NO: 2486095 - RNA, 17 nt, Brucella suis 1330
cagauggacauagccgg

SEQ ID NO: 2486096 - RNA, 17 nt, Brucella suis 1330
cagauguuccugcggug

SEQ ID NO: 2486097 - RNA, 18 nt, Brucella suis 1330
cagauucagggcaucgaa

SEQ ID NO: 2486098 - RNA, 21 nt, Brucella suis 1330
cagauugaucgcaagccaaag

SEQ ID NO: 2486099 - RNA, 18 nt, Brucella suis 1330
cagauugaugaaaaaccc

SEQ ID NO: 2486100 - RNA, 15 nt, Brucella suis 1330
cagauugcgggcaag

SEQ ID NO: 2486101 - RNA, 14 nt, Brucella suis 1330
cagauuggcaacau

SEQ ID NO: 2486102 - RNA, 13 nt, Brucella suis 1330
cagauugucuuga

SEQ ID NO: 2486103 - RNA, 16 nt, Brucella suis 1330
cagcaaauucaaagaa

SEQ ID NO: 2486104 - RNA, 16 nt, Brucella suis 1330
cagcaaccaucaucuc

SEQ ID NO: 2486105 - RNA, 18 nt, Brucella suis 1330
cagcaaccgaaagcgccu

SEQ ID NO: 2486106 - RNA, 23 nt, Brucella suis 1330
cagcaaucucacacugcaaaacu

SEQ ID NO: 2486107 - RNA, 20 nt, Brucella suis 1330
cagcacauccugcaccggcu

SEQ ID NO: 2486108 - RNA, 13 nt, Brucella suis 1330
cagcaccgcgcca

SEQ ID NO: 2486109 - RNA, 16 nt, Brucella suis 1330
cagcaccggcaacggc

SEQ ID NO: 2486110 - RNA, 16 nt, Brucella suis 1330
cagcacgugcccguuc

SEQ ID NO: 2486111 - RNA, 15 nt, Brucella suis 1330
cagcacugaaacggg

SEQ ID NO: 2486112 - RNA, 15 nt, Brucella suis 1330
cagcacuuucgcgua

SEQ ID NO: 2486113 - RNA, 21 nt, Brucella suis 1330
cagcagaauuucagcuucccg

SEQ ID NO: 2486114 - RNA, 17 nt, Brucella suis 1330
cagcagauugcggaucg

SEQ ID NO: 2486115 - RNA, 18 nt, Brucella suis 1330
cagcagcaaccgccagau

SEQ ID NO: 2486116 - RNA, 15 nt, Brucella suis 1330
cagcagucaaaaacg

SEQ ID NO: 2486117 - RNA, 16 nt, Brucella suis 1330
cagcaucacaugggca

SEQ ID NO: 2486118 - RNA, 11 nt, Brucella suis 1330
cagcaucaugc

SEQ ID NO: 2486119 - RNA, 12 nt, Brucella suis 1330
cagcaugaacca

SEQ ID NO: 2486120 - RNA, 14 nt, Brucella suis 1330
cagcaugaucgcca

SEQ ID NO: 2486121 - RNA, 20 nt, Brucella suis 1330
cagcaugucauccgaaacca

SEQ ID NO: 2486122 - RNA, 14 nt, Brucella suis 1330
cagcauugaacgcc

SEQ ID NO: 2486123 - RNA, 23 nt, Brucella suis 1330
cagccacauucccgaagacgauc

SEQ ID NO: 2486124 - RNA, 16 nt, Brucella suis 1330
cagccacggcagagug

SEQ ID NO: 2486125 - RNA, 11 nt, Brucella suis 1330
cagccagccga

SEQ ID NO: 2486126 - RNA, 20 nt, Brucella suis 1330
cagccaggugcuggugccgc

SEQ ID NO: 2486127 - RNA, 19 nt, Brucella suis 1330
cagccaucaggauuuggga

SEQ ID NO: 2486128 - RNA, 15 nt, Brucella suis 1330
cagccauucauggcu

SEQ ID NO: 2486129 - RNA, 16 nt, Brucella suis 1330
cagccauucauggcug

SEQ ID NO: 2486130 - RNA, 18 nt, Brucella suis 1330
cagccauuucggaucggc

SEQ ID NO: 2486131 - RNA, 18 nt, Brucella suis 1330
cagccccgcaauaacgaa

SEQ ID NO: 2486132 - RNA, 15 nt, Brucella suis 1330
cagccccuugccccg

SEQ ID NO: 2486133 - RNA, 13 nt, Brucella suis 1330
cagcccgaagacc

SEQ ID NO: 2486134 - RNA, 22 nt, Brucella suis 1330
cagcccgaagcgcaaagcccgc

SEQ ID NO: 2486135 - RNA, 14 nt, Brucella suis 1330
cagcccuucaucaa

SEQ ID NO: 2486136 - RNA, 16 nt, Brucella suis 1330
cagccgaaaugagauc

SEQ ID NO: 2486137 - RNA, 20 nt, Brucella suis 1330
cagccgaaaugagaucaacc

SEQ ID NO: 2486138 - RNA, 17 nt, Brucella suis 1330
cagccgacccgguaagc

SEQ ID NO: 2486139 - RNA, 15 nt, Brucella suis 1330
cagccgcaaucagcc

SEQ ID NO: 2486140 - RNA, 15 nt, Brucella suis 1330
cagccgcagccgcca

SEQ ID NO: 2486141 - RNA, 21 nt, Brucella suis 1330
cagccgcccgccuuggaaacc

SEQ ID NO: 2486142 - RNA, 15 nt, Brucella suis 1330
cagccgccgccgcaa

SEQ ID NO: 2486143 - RNA, 15 nt, Brucella suis 1330
cagccgcgaucacag

SEQ ID NO: 2486144 - RNA, 15 nt, Brucella suis 1330
cagccgcgucagccg

SEQ ID NO: 2486145 - RNA, 22 nt, Brucella suis 1330
cagccggaaugccucccgauaa

SEQ ID NO: 2486146 - RNA, 12 nt, Brucella suis 1330
cagccgggcagu

SEQ ID NO: 2486147 - RNA, 18 nt, Brucella suis 1330
cagccgggcuuugcauug

SEQ ID NO: 2486148 - RNA, 21 nt, Brucella suis 1330
cagccguuccagggcgcgcca

SEQ ID NO: 2486149 - RNA, 14 nt, Brucella suis 1330
cagccuccugugca

SEQ ID NO: 2486150 - RNA, 15 nt, Brucella suis 1330
cagccugaacagcgu

SEQ ID NO: 2486151 - RNA, 14 nt, Brucella suis 1330
cagccugcgaggau

SEQ ID NO: 2486152 - RNA, 20 nt, Brucella suis 1330
cagccugcugcauccugcuc

SEQ ID NO: 2486153 - RNA, 22 nt, Brucella suis 1330
cagccuggcggcuauuccacuu

SEQ ID NO: 2486154 - RNA, 22 nt, Brucella suis 1330
cagccuucccgggagaaaagau

SEQ ID NO: 2486155 - RNA, 16 nt, Brucella suis 1330
cagccuugcccuggcu

SEQ ID NO: 2486156 - RNA, 17 nt, Brucella suis 1330
cagccuuuccagaaggc

SEQ ID NO: 2486157 - RNA, 16 nt, Brucella suis 1330
cagcgaauagaccaug

SEQ ID NO: 2486158 - RNA, 22 nt, Brucella suis 1330
cagcgaauagaccaugccgcca

SEQ ID NO: 2486159 - RNA, 16 nt, Brucella suis 1330
cagcgacagcggcgcg

SEQ ID NO: 2486160 - RNA, 19 nt, Brucella suis 1330
cagcgacagcggcgcgccu

SEQ ID NO: 2486161 - RNA, 21 nt, Brucella suis 1330
cagcgacgacaugaaggagag

SEQ ID NO: 2486162 - RNA, 22 nt, Brucella suis 1330
cagcgacuuccaguggaagcac

SEQ ID NO: 2486163 - RNA, 22 nt, Brucella suis 1330
cagcgauaguguccacgcgcuu

SEQ ID NO: 2486164 - RNA, 15 nt, Brucella suis 1330
cagcgaugauagcgc

SEQ ID NO: 2486165 - RNA, 18 nt, Brucella suis 1330
cagcgauugcaccauggu

SEQ ID NO: 2486166 - RNA, 18 nt, Brucella suis 1330
cagcgauugcgcauugac

SEQ ID NO: 2486167 - RNA, 22 nt, Brucella suis 1330
cagcgcaaacucgucggaaaau

SEQ ID NO: 2486168 - RNA, 17 nt, Brucella suis 1330
cagcgcaaagcgcgcgc

SEQ ID NO: 2486169 - RNA, 18 nt, Brucella suis 1330
cagcgcaaagcgcgcgcc

SEQ ID NO: 2486170 - RNA, 19 nt, Brucella suis 1330
cagcgcaaagcgcgcgcca

SEQ ID NO: 2486171 - RNA, 19 nt, Brucella suis 1330
cagcgcaaugcccucuucg

SEQ ID NO: 2486172 - RNA, 16 nt, Brucella suis 1330
cagcgcaggcgcgauc

SEQ ID NO: 2486173 - RNA, 16 nt, Brucella suis 1330
cagcgcauaaaggccg

SEQ ID NO: 2486174 - RNA, 19 nt, Brucella suis 1330
cagcgcauaaaggccgaaa

SEQ ID NO: 2486175 - RNA, 14 nt, Brucella suis 1330
cagcgccacgccuu

SEQ ID NO: 2486176 - RNA, 19 nt, Brucella suis 1330
cagcgccggggccaaaggc

SEQ ID NO: 2486177 - RNA, 14 nt, Brucella suis 1330
cagcgccucauaau

SEQ ID NO: 2486178 - RNA, 12 nt, Brucella suis 1330
cagcgcgccgau

SEQ ID NO: 2486179 - RNA, 13 nt, Brucella suis 1330
cagcggcgcgcca

SEQ ID NO: 2486180 - RNA, 22 nt, Brucella suis 1330
cagcggcgcgccugggcuuuca

SEQ ID NO: 2486181 - RNA, 14 nt, Brucella suis 1330
cagcgggagaugug

SEQ ID NO: 2486182 - RNA, 17 nt, Brucella suis 1330
cagcggugacggcggca

SEQ ID NO: 2486183 - RNA, 15 nt, Brucella suis 1330
cagcgguugcggccg

SEQ ID NO: 2486184 - RNA, 18 nt, Brucella suis 1330
cagcguaaucacuugcaa

SEQ ID NO: 2486185 - RNA, 22 nt, Brucella suis 1330
cagcguaaucacuugcaagcgc

SEQ ID NO: 2486186 - RNA, 13 nt, Brucella suis 1330
cagcgucaggaca

SEQ ID NO: 2486187 - RNA, 14 nt, Brucella suis 1330
cagcgugaugcccg

SEQ ID NO: 2486188 - RNA, 12 nt, Brucella suis 1330
cagcgugcagcc

SEQ ID NO: 2486189 - RNA, 20 nt, Brucella suis 1330
cagcguucaacuccgucaga

SEQ ID NO: 2486190 - RNA, 20 nt, Brucella suis 1330
cagcguuuugucauggccgg

SEQ ID NO: 2486191 - RNA, 23 nt, Brucella suis 1330
cagcguuuugucauggccggauc

SEQ ID NO: 2486192 - RNA, 15 nt, Brucella suis 1330
cagcucauggccacg

SEQ ID NO: 2486193 - RNA, 13 nt, Brucella suis 1330
cagcuccggguuc

SEQ ID NO: 2486194 - RNA, 20 nt, Brucella suis 1330
cagcuccggguucucgucga

SEQ ID NO: 2486195 - RNA, 16 nt, Brucella suis 1330
cagcucgaaauccagu

SEQ ID NO: 2486196 - RNA, 15 nt, Brucella suis 1330
cagcucggcuucaaa

SEQ ID NO: 2486197 - RNA, 22 nt, Brucella suis 1330
cagcucguccaugagcgcacca

SEQ ID NO: 2486198 - RNA, 17 nt, Brucella suis 1330
cagcucuauugcccggc

SEQ ID NO: 2486199 - RNA, 14 nt, Brucella suis 1330
cagcuugaccagau

SEQ ID NO: 2486200 - RNA, 21 nt, Brucella suis 1330
cagcuugccgccaauccccuc

SEQ ID NO: 2486201 - RNA, 15 nt, Brucella suis 1330
cagcuuuggcgccgu

SEQ ID NO: 2486202 - RNA, 22 nt, Brucella suis 1330
caggaaaacgccaccuuuuucg

SEQ ID NO: 2486203 - RNA, 21 nt, Brucella suis 1330
caggaaagcccggcuggaaca

SEQ ID NO: 2486204 - RNA, 16 nt, Brucella suis 1330
caggaaaucgaugaca

SEQ ID NO: 2486205 - RNA, 15 nt, Brucella suis 1330
caggaagggaaagcg

SEQ ID NO: 2486206 - RNA, 17 nt, Brucella suis 1330
caggaauacgcccugca

SEQ ID NO: 2486207 - RNA, 20 nt, Brucella suis 1330
caggaaucauuuucucaaga

SEQ ID NO: 2486208 - RNA, 19 nt, Brucella suis 1330
caggaccacgaacgacacc

SEQ ID NO: 2486209 - RNA, 23 nt, Brucella suis 1330
caggaccgcgaggaagccugcac

SEQ ID NO: 2486210 - RNA, 21 nt, Brucella suis 1330
cauagacgcgcagacgcagcg

SEQ ID NO: 2486211 - RNA, 22 nt, Brucella suis 1330
cauagagccacgagaaaauggc

SEQ ID NO: 2486212 - RNA, 15 nt, Brucella suis 1330
cauagccugcaagcg

SEQ ID NO: 2486213 - RNA, 23 nt, Brucella suis 1330
cauaggccguuccgccgaucugc

SEQ ID NO: 2486214 - RNA, 12 nt, Brucella suis 1330
cauaggcgcgcg

SEQ ID NO: 2486215 - RNA, 16 nt, Brucella suis 1330
cauauaaagcuugaac

SEQ ID NO: 2486216 - RNA, 18 nt, Brucella suis 1330
cauauacggcuugccauu

SEQ ID NO: 2486217 - RNA, 16 nt, Brucella suis 1330
cauauacuuacuagug

SEQ ID NO: 2486218 - RNA, 13 nt, Brucella suis 1330
cauauaggauucu

SEQ ID NO: 2486219 - RNA, 23 nt, Brucella suis 1330
cauauagguguuggucaugcgcg

SEQ ID NO: 2486220 - RNA, 11 nt, Brucella suis 1330
cauaucagacg

SEQ ID NO: 2486221 - RNA, 17 nt, Brucella suis 1330
cauaucguugccgauca

SEQ ID NO: 2486222 - RNA, 20 nt, Brucella suis 1330
cauaucguugccgaucaugg

SEQ ID NO: 2486223 - RNA, 20 nt, Brucella suis 1330
cauaucuuuccauuccagcc

SEQ ID NO: 2486224 - RNA, 14 nt, Brucella suis 1330
cauaugcuguuuca

SEQ ID NO: 2486225 - RNA, 18 nt, Brucella suis 1330
cauauggaugccgccgca

SEQ ID NO: 2486226 - RNA, 12 nt, Brucella suis 1330
cauauuccacau

SEQ ID NO: 2486227 - RNA, 17 nt, Brucella suis 1330
cauauuccacauugccu

SEQ ID NO: 2486228 - RNA, 15 nt, Brucella suis 1330
caucaaaaaaccggg

SEQ ID NO: 2486229 - RNA, 14 nt, Brucella suis 1330
caucaaccuuuucg

SEQ ID NO: 2486230 - RNA, 19 nt, Brucella suis 1330
caucaaggaaaaaaccggc

SEQ ID NO: 2486231 - RNA, 14 nt, Brucella suis 1330
caucaaugaaagca

SEQ ID NO: 2486232 - RNA, 18 nt, Brucella suis 1330
caucacagucacgccauc

SEQ ID NO: 2486233 - RNA, 13 nt, Brucella suis 1330
caucaccagcccc

SEQ ID NO: 2486234 - RNA, 18 nt, Brucella suis 1330
caucagaaauuugcgggc

SEQ ID NO: 2486235 - RNA, 20 nt, Brucella suis 1330
caucagcacgaaaugaaagc

SEQ ID NO: 2486236 - RNA, 19 nt, Brucella suis 1330
caucagcccauagaucaga

SEQ ID NO: 2486237 - RNA, 21 nt, Brucella suis 1330
caucagccgggcagugccgga

SEQ ID NO: 2486238 - RNA, 21 nt, Brucella suis 1330
caucagccuucgucaaaccgc

SEQ ID NO: 2486239 - RNA, 19 nt, Brucella suis 1330
caucagcgaauagggaaac

SEQ ID NO: 2486240 - RNA, 13 nt, Brucella suis 1330
caucagcuugccc

SEQ ID NO: 2486241 - RNA, 18 nt, Brucella suis 1330
caucagucgaauuucagc

SEQ ID NO: 2486242 - RNA, 15 nt, Brucella suis 1330
caucaucaaggaaaa

SEQ ID NO: 2486243 - RNA, 14 nt, Brucella suis 1330
caucaucgucuuca

SEQ ID NO: 2486244 - RNA, 21 nt, Brucella suis 1330
caucaucgucuucaagcacgc

SEQ ID NO: 2486245 - RNA, 19 nt, Brucella suis 1330
caucaucguggcggcaaaa

SEQ ID NO: 2486246 - RNA, 13 nt, Brucella suis 1330
caucauugaacug

SEQ ID NO: 2486247 - RNA, 20 nt, Brucella suis 1330
caucauuggaacaagaagcu

SEQ ID NO: 2486248 - RNA, 21 nt, Brucella suis 1330
cauccacaaaaaccggggcgg

SEQ ID NO: 2486249 - RNA, 18 nt, Brucella suis 1330
cauccagaacuucgccaa

SEQ ID NO: 2486250 - RNA, 15 nt, Brucella suis 1330
cauccagcacuucca

SEQ ID NO: 2486251 - RNA, 23 nt, Brucella suis 1330
cauccagccggcgcaucuguucu

SEQ ID NO: 2486252 - RNA, 22 nt, Brucella suis 1330
cauccagcggugacggcggcag

SEQ ID NO: 2486253 - RNA, 16 nt, Brucella suis 1330
cauccagucgaucagu

SEQ ID NO: 2486254 - RNA, 22 nt, Brucella suis 1330
cauccagucgaucagugggucc

SEQ ID NO: 2486255 - RNA, 23 nt, Brucella suis 1330
caucccgaaaaccgguucccacu

SEQ ID NO: 2486256 - RNA, 20 nt, Brucella suis 1330
caucccggaaggaaugggcg

SEQ ID NO: 2486257 - RNA, 14 nt, Brucella suis 1330
cauccgaaaccaga

SEQ ID NO: 2486258 - RNA, 13 nt, Brucella suis 1330
cauccgaggcgcg

SEQ ID NO: 2486259 - RNA, 21 nt, Brucella suis 1330
cauccgccugcgcaugggacu

SEQ ID NO: 2486260 - RNA, 19 nt, Brucella suis 1330
cauccgccuuggaugccgc

SEQ ID NO: 2486261 - RNA, 17 nt, Brucella suis 1330
cauccugcaccggcuuc

SEQ ID NO: 2486262 - RNA, 14 nt, Brucella suis 1330
cauccuugaugccc

SEQ ID NO: 2486263 - RNA, 15 nt, Brucella suis 1330
cauccuugaugccca

SEQ ID NO: 2486264 - RNA, 19 nt, Brucella suis 1330
cauccuugaugcccagcuc

SEQ ID NO: 2486265 - RNA, 15 nt, Brucella suis 1330
caucgaaagcccguc

SEQ ID NO: 2486266 - RNA, 16 nt, Brucella suis 1330
caucgaaccgcccaga

SEQ ID NO: 2486267 - RNA, 20 nt, Brucella suis 1330
caucgacaaucuccccuucc

SEQ ID NO: 2486268 - RNA, 19 nt, Brucella suis 1330
caucgagacggcgcuccau

SEQ ID NO: 2486269 - RNA, 17 nt, Brucella suis 1330
caucgagcguaacggcg

SEQ ID NO: 2486270 - RNA, 19 nt, Brucella suis 1330
caucgaggaauaggcgcca

SEQ ID NO: 2486271 - RNA, 17 nt, Brucella suis 1330
caucgaguuccgggcuc

SEQ ID NO: 2486272 - RNA, 17 nt, Brucella suis 1330
caucgaucacaugcgcg

SEQ ID NO: 2486273 - RNA, 20 nt, Brucella suis 1330
caucgaucacaugcgcgccc

SEQ ID NO: 2486274 - RNA, 19 nt, Brucella suis 1330
caucgcaauagaccaccag

SEQ ID NO: 2486275 - RNA, 21 nt, Brucella suis 1330
caucgcaguugcaccgcccgg

SEQ ID NO: 2486276 - RNA, 23 nt, Brucella suis 1330
caucgcaguugcaccgcccggau

SEQ ID NO: 2486277 - RNA, 24 nt, Brucella suis 1330
caucgcaguugcaccgcccggauc

SEQ ID NO: 2486278 - RNA, 15 nt, Brucella suis 1330
caucgcauucuggac

SEQ ID NO: 2486279 - RNA, 22 nt, Brucella suis 1330
caucgccaagcuugaucgccgc

SEQ ID NO: 2486280 - RNA, 21 nt, Brucella suis 1330
caucgccaccauggccgcccc

SEQ ID NO: 2486281 - RNA, 23 nt, Brucella suis 1330
caucgcccugaagaagcuucaca

SEQ ID NO: 2486282 - RNA, 15 nt, Brucella suis 1330
caucgccgacgcgcg

SEQ ID NO: 2486283 - RNA, 15 nt, Brucella suis 1330
caucgccuguuccuu

SEQ ID NO: 2486284 - RNA, 17 nt, Brucella suis 1330
caucgccuugcagauaa

SEQ ID NO: 2486285 - RNA, 18 nt, Brucella suis 1330
caucgcgaggcuauuuau

SEQ ID NO: 2486286 - RNA, 12 nt, Brucella suis 1330
caucgcuugaac

SEQ ID NO: 2486287 - RNA, 12 nt, Brucella suis 1330
caucggcaaauc

SEQ ID NO: 2486288 - RNA, 23 nt, Brucella suis 1330
caucggcaacaagagggcgcagc

SEQ ID NO: 2486289 - RNA, 12 nt, Brucella suis 1330
caucggcgcgcu

SEQ ID NO: 2486290 - RNA, 18 nt, Brucella suis 1330
caucggcucauccuccac

SEQ ID NO: 2486291 - RNA, 15 nt, Brucella suis 1330
caucggggcgagcgc

SEQ ID NO: 2486292 - RNA, 22 nt, Brucella suis 1330
caucgggucgaccuucgaguuc

SEQ ID NO: 2486293 - RNA, 22 nt, Brucella suis 1330
caucggguguuugcgacgggcg

SEQ ID NO: 2486294 - RNA, 17 nt, Brucella suis 1330
caucggugcgcggcgcu

SEQ ID NO: 2486295 - RNA, 16 nt, Brucella suis 1330
caucgguggcauugcc

SEQ ID NO: 2486296 - RNA, 21 nt, Brucella suis 1330
caucgucaaucacgccacugc

SEQ ID NO: 2486297 - RNA, 14 nt, Brucella suis 1330
caucgucuuccuua

SEQ ID NO: 2486298 - RNA, 20 nt, Brucella suis 1330
caucguugcggcuugccacc

SEQ ID NO: 2486299 - RNA, 15 nt, Brucella suis 1330
caucucguucacaau

SEQ ID NO: 2486300 - RNA, 22 nt, Brucella suis 1330
caucucuuccuaauggaugacg

SEQ ID NO: 2486301 - RNA, 15 nt, Brucella suis 1330
caucugccaaccauu

SEQ ID NO: 2486302 - RNA, 21 nt, Brucella suis 1330
caugaaacccgcgaucaccag

SEQ ID NO: 2486303 - RNA, 13 nt, Brucella suis 1330
caugaacagaucg

SEQ ID NO: 2486304 - RNA, 14 nt, Brucella suis 1330
caugaacaugcgcc

SEQ ID NO: 2486305 - RNA, 20 nt, Brucella suis 1330
caugaaggagaggccgauaa

SEQ ID NO: 2486306 - RNA, 15 nt, Brucella suis 1330
caugacauccaugaa

SEQ ID NO: 2486307 - RNA, 13 nt, Brucella suis 1330
caugaccggaugc

SEQ ID NO: 2486308 - RNA, 22 nt, Brucella suis 1330
caugacgcgggugaggcuuucg

SEQ ID NO: 2486309 - RNA, 18 nt, Brucella suis 1330
caugagaaggcaagcccc

SEQ ID NO: 2486310 - RNA, 16 nt, Brucella suis 1330
caugagcagacggcca

SEQ ID NO: 2486311 - RNA, 13 nt, Brucella suis 1330
caugaugccgaca

SEQ ID NO: 2486312 - RNA, 18 nt, Brucella suis 1330
caugcagacgggacgcag

SEQ ID NO: 2486313 - RNA, 22 nt, Brucella suis 1330
caugcagacgggacgcaggcgg

SEQ ID NO: 2486314 - RNA, 17 nt, Brucella suis 1330
caugcaggccgugaaga

SEQ ID NO: 2486315 - RNA, 20 nt, Brucella suis 1330
caugcaggccgugaagauug

SEQ ID NO: 2486316 - RNA, 23 nt, Brucella suis 1330
caugcaggccgugaagauugcuu

SEQ ID NO: 2486317 - RNA, 18 nt, Brucella suis 1330
caugcaguuccauccauu

SEQ ID NO: 2486318 - RNA, 16 nt, Brucella suis 1330
caugccaagagccgcu

SEQ ID NO: 2486319 - RNA, 18 nt, Brucella suis 1330
caugccauccucgccaag

SEQ ID NO: 2486320 - RNA, 14 nt, Brucella suis 1330
caugcccaugcagu

SEQ ID NO: 2486321 - RNA, 17 nt, Brucella suis 1330
caugcccgucagcgcgc

SEQ ID NO: 2486322 - RNA, 20 nt, Brucella suis 1330
caugcccgucagcgcgccgu

SEQ ID NO: 2486323 - RNA, 12 nt, Brucella suis 1330
caugccggaggu

SEQ ID NO: 2486324 - RNA, 20 nt, Brucella suis 1330
caugccugccgcagccaggg

SEQ ID NO: 2486325 - RNA, 20 nt, Brucella suis 1330
caugcgauagcggcgcggca

SEQ ID NO: 2486326 - RNA, 22 nt, Brucella suis 1330
ccaccacgauggaaggaaagcc

SEQ ID NO: 2486327 - RNA, 21 nt, Brucella suis 1330
ccaccacgcgcgcugcgacga

SEQ ID NO: 2486328 - RNA, 14 nt, Brucella suis 1330
ccaccagcacacag

SEQ ID NO: 2486329 - RNA, 17 nt, Brucella suis 1330
ccaccagcacacagcca

SEQ ID NO: 2486330 - RNA, 14 nt, Brucella suis 1330
ccaccagugcggca

SEQ ID NO: 2486331 - RNA, 22 nt, Brucella suis 1330
ccaccauauuugccgccagaaa

SEQ ID NO: 2486332 - RNA, 13 nt, Brucella suis 1330
ccaccauggaggc

SEQ ID NO: 2486333 - RNA, 13 nt, Brucella suis 1330
ccacccaccgccu

SEQ ID NO: 2486334 - RNA, 15 nt, Brucella suis 1330
ccacccaccgccugc

SEQ ID NO: 2486335 - RNA, 23 nt, Brucella suis 1330
ccaccccuuccuugccgggaaga

SEQ ID NO: 2486336 - RNA, 23 nt, Brucella suis 1330
ccacccgaaggacuggaucaccu

SEQ ID NO: 2486337 - RNA, 21 nt, Brucella suis 1330
ccacccggccgcccuugcgca

SEQ ID NO: 2486338 - RNA, 19 nt, Brucella suis 1330
ccaccgccggcgccgccaa

SEQ ID NO: 2486339 - RNA, 15 nt, Brucella suis 1330
ccaccgccugcagcc

SEQ ID NO: 2486340 - RNA, 21 nt, Brucella suis 1330
ccaccgccugcagccggaaga

SEQ ID NO: 2486341 - RNA, 15 nt, Brucella suis 1330
ccaccgcgaucaguu

SEQ ID NO: 2486342 - RNA, 18 nt, Brucella suis 1330
ccaccgcguuccgugccg

SEQ ID NO: 2486343 - RNA, 17 nt, Brucella suis 1330
ccaccggcccgcgcacg

SEQ ID NO: 2486344 - RNA, 15 nt, Brucella suis 1330
ccaccucgccaauga

SEQ ID NO: 2486345 - RNA, 14 nt, Brucella suis 1330
ccaccuggccgccg

SEQ ID NO: 2486346 - RNA, 15 nt, Brucella suis 1330
ccaccuggccgccgc

SEQ ID NO: 2486347 - RNA, 22 nt, Brucella suis 1330
ccaccuucgccgucgagcagca

SEQ ID NO: 2486348 - RNA, 14 nt, Brucella suis 1330
ccacgaaacgccug

SEQ ID NO: 2486349 - RNA, 23 nt, Brucella suis 1330
ccacgaauuccucuccgcccaua

SEQ ID NO: 2486350 - RNA, 22 nt, Brucella suis 1330
ccacgacaaaaccgugccagau

SEQ ID NO: 2486351 - RNA, 22 nt, Brucella suis 1330
ccacgagaucaauacgcucgca

SEQ ID NO: 2486352 - RNA, 15 nt, Brucella suis 1330
ccacgaugccugccg

SEQ ID NO: 2486353 - RNA, 15 nt, Brucella suis 1330
ccacgccagccgcga

SEQ ID NO: 2486354 - RNA, 17 nt, Brucella suis 1330
ccacgcccagcgcggca

SEQ ID NO: 2486355 - RNA, 12 nt, Brucella suis 1330
ccacgcgccgac

SEQ ID NO: 2486356 - RNA, 11 nt, Brucella suis 1330
ccacgcuccac

SEQ ID NO: 2486357 - RNA, 23 nt, Brucella suis 1330
ccacgcuucaugauaaggccgcu

SEQ ID NO: 2486358 - RNA, 13 nt, Brucella suis 1330
ccacggauuucca

SEQ ID NO: 2486359 - RNA, 16 nt, Brucella suis 1330
ccacggauuuccacca

SEQ ID NO: 2486360 - RNA, 12 nt, Brucella suis 1330
ccacggcauccg

SEQ ID NO: 2486361 - RNA, 14 nt, Brucella suis 1330
ccacggcuugcgcg

SEQ ID NO: 2486362 - RNA, 15 nt, Brucella suis 1330
ccacgggauggcggc

SEQ ID NO: 2486363 - RNA, 14 nt, Brucella suis 1330
ccacgguuuucgcc

SEQ ID NO: 2486364 - RNA, 12 nt, Brucella suis 1330
ccacgguuuuug

SEQ ID NO: 2486365 - RNA, 12 nt, Brucella suis 1330
ccacucuugugg

SEQ ID NO: 2486366 - RNA, 21 nt, Brucella suis 1330
ccacugcccgccuuugccgca

SEQ ID NO: 2486367 - RNA, 13 nt, Brucella suis 1330
ccacugcccugga

SEQ ID NO: 2486368 - RNA, 16 nt, Brucella suis 1330
ccagaaaaugcagcgg

SEQ ID NO: 2486369 - RNA, 19 nt, Brucella suis 1330
ccagaaagacauuuucgcc

SEQ ID NO: 2486370 - RNA, 19 nt, Brucella suis 1330
ccagaaagagcaucccucc

SEQ ID NO: 2486371 - RNA, 19 nt, Brucella suis 1330
ccagaaccaccagagcaaa

SEQ ID NO: 2486372 - RNA, 21 nt, Brucella suis 1330
ccagaaccugcccgucuuccu

SEQ ID NO: 2486373 - RNA, 15 nt, Brucella suis 1330
ccagaacuucgccaa

SEQ ID NO: 2486374 - RNA, 14 nt, Brucella suis 1330
ccagaagcccgcgc

SEQ ID NO: 2486375 - RNA, 21 nt, Brucella suis 1330
ccagaagccgcuugcauucca

SEQ ID NO: 2486376 - RNA, 17 nt, Brucella suis 1330
ccagaaggcgcggcagc

SEQ ID NO: 2486377 - RNA, 22 nt, Brucella suis 1330
ccagaagguuucagccuccugu

SEQ ID NO: 2486378 - RNA, 15 nt, Brucella suis 1330
ccagaauggcgauau

SEQ ID NO: 2486379 - RNA, 22 nt, Brucella suis 1330
ccagaauggcgauaucaccaau

SEQ ID NO: 2486380 - RNA, 20 nt, Brucella suis 1330
ccagaccaucggcaacaaga

SEQ ID NO: 2486381 - RNA, 24 nt, Brucella suis 1330
ccagaccaucggcaacaagagggc

SEQ ID NO: 2486382 - RNA, 18 nt, Brucella suis 1330
ccagaccuuccgggcaau

SEQ ID NO: 2486383 - RNA, 14 nt, Brucella suis 1330
ccagacguuccaga

SEQ ID NO: 2486384 - RNA, 22 nt, Brucella suis 1330
ccagacguuccagauugccgcg

SEQ ID NO: 2486385 - RNA, 21 nt, Brucella suis 1330
ccagagagcggcgcauaaaac

SEQ ID NO: 2486386 - RNA, 13 nt, Brucella suis 1330
ccagagcaaaaaa

SEQ ID NO: 2486387 - RNA, 18 nt, Brucella suis 1330
ccagagcauuuucgccgc

SEQ ID NO: 2486388 - RNA, 22 nt, Brucella suis 1330
ccagagccuguuccaaaagucg

SEQ ID NO: 2486389 - RNA, 21 nt, Brucella suis 1330
ccagauaccgguacuggccaa

SEQ ID NO: 2486390 - RNA, 19 nt, Brucella suis 1330
ccagauagauaaacgcacc

SEQ ID NO: 2486391 - RNA, 14 nt, Brucella suis 1330
ccagauagccuucc

SEQ ID NO: 2486392 - RNA, 20 nt, Brucella suis 1330
ccagaucaugggcggccacg

SEQ ID NO: 2486393 - RNA, 20 nt, Brucella suis 1330
ccagaucccguuuugagaug

SEQ ID NO: 2486394 - RNA, 19 nt, Brucella suis 1330
ccagaucgacagcggaagc

SEQ ID NO: 2486395 - RNA, 12 nt, Brucella suis 1330
ccagaucggccu

SEQ ID NO: 2486396 - RNA, 14 nt, Brucella suis 1330
ccagaucggccuug

SEQ ID NO: 2486397 - RNA, 20 nt, Brucella suis 1330
ccagaucguccucguggauc

SEQ ID NO: 2486398 - RNA, 12 nt, Brucella suis 1330
ccagaucuuccu

SEQ ID NO: 2486399 - RNA, 17 nt, Brucella suis 1330
ccagaugugccaccagc

SEQ ID NO: 2486400 - RNA, 14 nt, Brucella suis 1330
ccagauugcgaaug

SEQ ID NO: 2486401 - RNA, 12 nt, Brucella suis 1330
ccagauugcgcc

SEQ ID NO: 2486402 - RNA, 12 nt, Brucella suis 1330
ccagauugcggg

SEQ ID NO: 2486403 - RNA, 17 nt, Brucella suis 1330
ccagauugcgggcaagc

SEQ ID NO: 2486404 - RNA, 16 nt, Brucella suis 1330
ccagcaaaagugagaa

SEQ ID NO: 2486405 - RNA, 17 nt, Brucella suis 1330
ccagcaaaagugagaaa

SEQ ID NO: 2486406 - RNA, 18 nt, Brucella suis 1330
ccagcaacgcgcccgcca

SEQ ID NO: 2486407 - RNA, 14 nt, Brucella suis 1330
ccagcacacagcca

SEQ ID NO: 2486408 - RNA, 13 nt, Brucella suis 1330
ccagcaccagcgg

SEQ ID NO: 2486409 - RNA, 14 nt, Brucella suis 1330
ccagcaccgcgcca

SEQ ID NO: 2486410 - RNA, 14 nt, Brucella suis 1330
ccagcaccggcaac

SEQ ID NO: 2486411 - RNA, 14 nt, Brucella suis 1330
ccagcacucugcca

SEQ ID NO: 2486412 - RNA, 15 nt, Brucella suis 1330
ccagcaggccggcga

SEQ ID NO: 2486413 - RNA, 18 nt, Brucella suis 1330
ccagcauccgcucgcgca

SEQ ID NO: 2486414 - RNA, 21 nt, Brucella suis 1330
ccagcauggugcgcacuuccg

SEQ ID NO: 2486415 - RNA, 20 nt, Brucella suis 1330
ccagccgcaaugagcccgcg

SEQ ID NO: 2486416 - RNA, 17 nt, Brucella suis 1330
ccagccgccagcaggcc

SEQ ID NO: 2486417 - RNA, 20 nt, Brucella suis 1330
ccagccgcgaucacagccgc

SEQ ID NO: 2486418 - RNA, 14 nt, Brucella suis 1330
ccagccggacaaga

SEQ ID NO: 2486419 - RNA, 22 nt, Brucella suis 1330
ccagccguuccagggcgcgcca

SEQ ID NO: 2486420 - RNA, 17 nt, Brucella suis 1330
ccagccguuuugcgccc

SEQ ID NO: 2486421 - RNA, 13 nt, Brucella suis 1330
ccagccugcugca

SEQ ID NO: 2486422 - RNA, 17 nt, Brucella suis 1330
ccagccuugagggcagc

SEQ ID NO: 2486423 - RNA, 16 nt, Brucella suis 1330
ccagcgaaacggcagc

SEQ ID NO: 2486424 - RNA, 12 nt, Brucella suis 1330
ccagcgaauaga

SEQ ID NO: 2486425 - RNA, 17 nt, Brucella suis 1330
ccagcgaauagaccaug

SEQ ID NO: 2486426 - RNA, 20 nt, Brucella suis 1330
ccagcgaauagaccaugccg

SEQ ID NO: 2486427 - RNA, 21 nt, Brucella suis 1330
ccagcgaugauagcgcccgcc

SEQ ID NO: 2486428 - RNA, 20 nt, Brucella suis 1330
ccagcgauugcgcauugaca

SEQ ID NO: 2486429 - RNA, 21 nt, Brucella suis 1330
ccagcgcaaagcgcgcgccaa

SEQ ID NO: 2486430 - RNA, 20 nt, Brucella suis 1330
ccagcgcaucgucuuccuua

SEQ ID NO: 2486431 - RNA, 17 nt, Brucella suis 1330
ccagcgcauggcauggc

SEQ ID NO: 2486432 - RNA, 18 nt, Brucella suis 1330
ccagcgcauggcauggcu

SEQ ID NO: 2486433 - RNA, 18 nt, Brucella suis 1330
ccagcgccgaggcgcagg

SEQ ID NO: 2486434 - RNA, 17 nt, Brucella suis 1330
ccagcggcacgccgccc

SEQ ID NO: 2486435 - RNA, 16 nt, Brucella suis 1330
ccagcggugacgaucu

SEQ ID NO: 2486436 - RNA, 20 nt, Brucella suis 1330
ccagcggugacggcggcaga

SEQ ID NO: 2486437 - RNA, 15 nt, Brucella suis 1330
ccagcguaaaugggc

SEQ ID NO: 2486438 - RNA, 22 nt, Brucella suis 1330
ccagcgugaagggcaggaggcc

SEQ ID NO: 2486439 - RNA, 13 nt, Brucella suis 1330
ccagcgugcagcc

SEQ ID NO: 2486440 - RNA, 19 nt, Brucella suis 1330
ccagcgugcagccugaaca

SEQ ID NO: 2486441 - RNA, 18 nt, Brucella suis 1330
ccagcuaaggccggugcg

SEQ ID NO: 2486442 - RNA, 14 nt, Brucella suis 1330
ccagcucauggcca

SEQ ID NO: 2486443 - RNA, 14 nt, Brucella suis 1330
ccccggcaccgcgc

SEQ ID NO: 2486444 - RNA, 19 nt, Brucella suis 1330
ccccggcagccuucgcugc

SEQ ID NO: 2486445 - RNA, 22 nt, Brucella suis 1330
ccccggcgggugcgaaaaugau

SEQ ID NO: 2486446 - RNA, 18 nt, Brucella suis 1330
ccccgugaucuuguccag

SEQ ID NO: 2486447 - RNA, 17 nt, Brucella suis 1330
ccccgugccggacggga

SEQ ID NO: 2486448 - RNA, 13 nt, Brucella suis 1330
ccccuacucccuu

SEQ ID NO: 2486449 - RNA, 17 nt, Brucella suis 1330
ccccucaccuugccggg

SEQ ID NO: 2486450 - RNA, 21 nt, Brucella suis 1330
ccccucgaucggugcaaugcc

SEQ ID NO: 2486451 - RNA, 16 nt, Brucella suis 1330
ccccuguuucugcugg

SEQ ID NO: 2486452 - RNA, 14 nt, Brucella suis 1330
ccccuuccuucugg

SEQ ID NO: 2486453 - RNA, 19 nt, Brucella suis 1330
ccccuugauaggcgcgccc

SEQ ID NO: 2486454 - RNA, 17 nt, Brucella suis 1330
ccccuugccccggcacc

SEQ ID NO: 2486455 - RNA, 19 nt, Brucella suis 1330
cccgaauugcggcugacaa

SEQ ID NO: 2486456 - RNA, 20 nt, Brucella suis 1330
cccgagaagcucaacgccgu

SEQ ID NO: 2486457 - RNA, 21 nt, Brucella suis 1330
cccgaucaccgcagucaugcc

SEQ ID NO: 2486458 - RNA, 14 nt, Brucella suis 1330
cccgaugagccaaa

SEQ ID NO: 2486459 - RNA, 18 nt, Brucella suis 1330
cccgaugcggcugccgcg

SEQ ID NO: 2486460 - RNA, 12 nt, Brucella suis 1330
cccgcaccgaca

SEQ ID NO: 2486461 - RNA, 17 nt, Brucella suis 1330
cccgcauagccaucgcc

SEQ ID NO: 2486462 - RNA, 21 nt, Brucella suis 1330
cccgcauggucgaugccgccg

SEQ ID NO: 2486463 - RNA, 20 nt, Brucella suis 1330
cccgccaaaaagcaaagagc

SEQ ID NO: 2486464 - RNA, 22 nt, Brucella suis 1330
cccgccauucggcgggcuuuuu

SEQ ID NO: 2486465 - RNA, 14 nt, Brucella suis 1330
cccgcccgcggcca

SEQ ID NO: 2486466 - RNA, 16 nt, Brucella suis 1330
cccgccggggccggau

SEQ ID NO: 2486467 - RNA, 22 nt, Brucella suis 1330
cccgccggggccggaugcgcgg

SEQ ID NO: 2486468 - RNA, 16 nt, Brucella suis 1330
cccgccuuugccgcaa

SEQ ID NO: 2486469 - RNA, 23 nt, Brucella suis 1330
cccgcgagggugaaaccguggaa

SEQ ID NO: 2486470 - RNA, 13 nt, Brucella suis 1330
cccgcgccucacc

SEQ ID NO: 2486471 - RNA, 19 nt, Brucella suis 1330
cccgcgucaucgccaccau

SEQ ID NO: 2486472 - RNA, 21 nt, Brucella suis 1330
cccgcgugaugagccgcuucu

SEQ ID NO: 2486473 - RNA, 15 nt, Brucella suis 1330
cccgcucuccggcgg

SEQ ID NO: 2486474 - RNA, 16 nt, Brucella suis 1330
cccgcugaggcggccg

SEQ ID NO: 2486475 - RNA, 14 nt, Brucella suis 1330
cccggcaacauggu

SEQ ID NO: 2486476 - RNA, 21 nt, Brucella suis 1330
cccggcacgaacagaucgcca

SEQ ID NO: 2486477 - RNA, 20 nt, Brucella suis 1330
cccggcagccuucgcugccg

SEQ ID NO: 2486478 - RNA, 19 nt, Brucella suis 1330
cccggcauccgaggcgcgc

SEQ ID NO: 2486479 - RNA, 20 nt, Brucella suis 1330
cccggcauccgaggcgcgca

SEQ ID NO: 2486480 - RNA, 13 nt, Brucella suis 1330
cccggcaugaaca

SEQ ID NO: 2486481 - RNA, 20 nt, Brucella suis 1330
cccggccuuugcgccggguu

SEQ ID NO: 2486482 - RNA, 14 nt, Brucella suis 1330
cccggcgauuucgc

SEQ ID NO: 2486483 - RNA, 14 nt, Brucella suis 1330
cccggcgcaaaggc

SEQ ID NO: 2486484 - RNA, 21 nt, Brucella suis 1330
cccggcggccuugaugcggcg

SEQ ID NO: 2486485 - RNA, 19 nt, Brucella suis 1330
cccggcuuucgccgggguu

SEQ ID NO: 2486486 - RNA, 18 nt, Brucella suis 1330
cccgggcagcggcgcgcc

SEQ ID NO: 2486487 - RNA, 19 nt, Brucella suis 1330
cccgggcagcggcgcgcca

SEQ ID NO: 2486488 - RNA, 13 nt, Brucella suis 1330
cccggugcauuuu

SEQ ID NO: 2486489 - RNA, 22 nt, Brucella suis 1330
cccgguuuuguuuaucgggccu

SEQ ID NO: 2486490 - RNA, 17 nt, Brucella suis 1330
cccgucaccggcuggca

SEQ ID NO: 2486491 - RNA, 17 nt, Brucella suis 1330
cccguccucaucgccgg

SEQ ID NO: 2486492 - RNA, 12 nt, Brucella suis 1330
cccgucucgcag

SEQ ID NO: 2486493 - RNA, 12 nt, Brucella suis 1330
cccgucuucauu

SEQ ID NO: 2486494 - RNA, 18 nt, Brucella suis 1330
cccgugacaauggccguc

SEQ ID NO: 2486495 - RNA, 13 nt, Brucella suis 1330
cccuauuccccua

SEQ ID NO: 2486496 - RNA, 19 nt, Brucella suis 1330
cccuauuccccuaaaucac

SEQ ID NO: 2486497 - RNA, 20 nt, Brucella suis 1330
cccuauuccccuauuccccu

SEQ ID NO: 2486498 - RNA, 19 nt, Brucella suis 1330
cccucaaaacgcugccagc

SEQ ID NO: 2486499 - RNA, 19 nt, Brucella suis 1330
cccucaaccgagcagccgc

SEQ ID NO: 2486500 - RNA, 20 nt, Brucella suis 1330
cccucauggcgauaauaauu

SEQ ID NO: 2486501 - RNA, 12 nt, Brucella suis 1330
cccucgaccgcc

SEQ ID NO: 2486502 - RNA, 17 nt, Brucella suis 1330
cccucgaucagcaccau

SEQ ID NO: 2486503 - RNA, 21 nt, Brucella suis 1330
cccucgauuuuuggcagcagu

SEQ ID NO: 2486504 - RNA, 16 nt, Brucella suis 1330
cccucgccgacccugu

SEQ ID NO: 2486505 - RNA, 15 nt, Brucella suis 1330
cccucggggcggucu

SEQ ID NO: 2486506 - RNA, 21 nt, Brucella suis 1330
cccucuaaucgcgagcagcgc

SEQ ID NO: 2486507 - RNA, 21 nt, Brucella suis 1330
cccugaaaaggcucaaucgcc

SEQ ID NO: 2486508 - RNA, 22 nt, Brucella suis 1330
cccugaaaaggcucaaucgccg

SEQ ID NO: 2486509 - RNA, 14 nt, Brucella suis 1330
cccugcuucacaug

SEQ ID NO: 2486510 - RNA, 22 nt, Brucella suis 1330
cccugcuucacaugcuugccga

SEQ ID NO: 2486511 - RNA, 19 nt, Brucella suis 1330
cccuggauguacacgccaa

SEQ ID NO: 2486512 - RNA, 14 nt, Brucella suis 1330
cccuggcggcacuu

SEQ ID NO: 2486513 - RNA, 22 nt, Brucella suis 1330
cccuggcggcgugcaggcugcc

SEQ ID NO: 2486514 - RNA, 14 nt, Brucella suis 1330
cccugucagaaagu

SEQ ID NO: 2486515 - RNA, 16 nt, Brucella suis 1330
cccugucagcgccgcc

SEQ ID NO: 2486516 - RNA, 18 nt, Brucella suis 1330
cccugucagcgccgccca

SEQ ID NO: 2486517 - RNA, 15 nt, Brucella suis 1330
cccuguuucugcugg

SEQ ID NO: 2486518 - RNA, 13 nt, Brucella suis 1330
cccuuauuccccu

SEQ ID NO: 2486519 - RNA, 20 nt, Brucella suis 1330
cccuuauuccccuauucccu

SEQ ID NO: 2486520 - RNA, 14 nt, Brucella suis 1330
cccuucgcgccgcc

SEQ ID NO: 2486521 - RNA, 16 nt, Chlamydia trachomatis
agcauggaagacaaca

SEQ ID NO: 2486522 - RNA, 21 nt, Chlamydia trachomatis
agcaugggcugcaucagcaag

SEQ ID NO: 2486523 - RNA, 21 nt, Chlamydia trachomatis
agcauguacuucgccuuuaac

SEQ ID NO: 2486524 - RNA, 18 nt, Chlamydia trachomatis
agcauguuucggaauuca

SEQ ID NO: 2486525 - RNA, 19 nt, Chlamydia trachomatis
agcauucauaaacacagcu

SEQ ID NO: 2486526 - RNA, 12 nt, Chlamydia trachomatis
agcauuucucuc

SEQ ID NO: 2486527 - RNA, 13 nt, Chlamydia trachomatis
agccaaagaauuu

SEQ ID NO: 2486528 - RNA, 13 nt, Chlamydia trachomatis
agccaauccguau

SEQ ID NO: 2486529 - RNA, 13 nt, Chlamydia trachomatis
agccaauuuccau

SEQ ID NO: 2486530 - RNA, 23 nt, Chlamydia trachomatis
agccacacauguccuaccaauau

SEQ ID NO: 2486531 - RNA, 13 nt, Chlamydia trachomatis
agccauaauaaaa

SEQ ID NO: 2486532 - RNA, 18 nt, Chlamydia trachomatis
agccauacuuacuucuau

SEQ ID NO: 2486533 - RNA, 15 nt, Chlamydia trachomatis
agccauagcauccgc

SEQ ID NO: 2486534 - RNA, 13 nt, Chlamydia trachomatis
agccauagccauc

SEQ ID NO: 2486535 - RNA, 21 nt, Chlamydia trachomatis
agccaucgccuucuauagcua

SEQ ID NO: 2486536 - RNA, 15 nt, Chlamydia trachomatis
agccauuucgauauu

SEQ ID NO: 2486537 - RNA, 21 nt, Chlamydia trachomatis
agcccaugguauagaagaccu

SEQ ID NO: 2486538 - RNA, 16 nt, Chlamydia trachomatis
agccccaauagcuaag

SEQ ID NO: 2486539 - RNA, 20 nt, Chlamydia trachomatis
agccccuaaagccacacaug

SEQ ID NO: 2486540 - RNA, 18 nt, Chlamydia trachomatis
agccccuugaaaggggcu

SEQ ID NO: 2486541 - RNA, 17 nt, Chlamydia trachomatis
agcccugcuucacagcu

SEQ ID NO: 2486542 - RNA, 23 nt, Chlamydia trachomatis
agcccuuuuauuagggcucucuu

SEQ ID NO: 2486543 - RNA, 14 nt, Chlamydia trachomatis
agccguguucugaa

SEQ ID NO: 2486544 - RNA, 14 nt, Chlamydia trachomatis
agccuaaauagcuc

SEQ ID NO: 2486545 - RNA, 14 nt, Chlamydia trachomatis
agccuacaaauaaa

SEQ ID NO: 2486546 - RNA, 15 nt, Chlamydia trachomatis
agccuacaaauaaag

SEQ ID NO: 2486547 - RNA, 21 nt, Chlamydia trachomatis
agccuaugcgugucacagacu

SEQ ID NO: 2486548 - RNA, 15 nt, Chlamydia trachomatis
agccuccaucucugc

SEQ ID NO: 2486549 - RNA, 18 nt, Chlamydia trachomatis
agccucuaacucuucugg

SEQ ID NO: 2486550 - RNA, 14 nt, Chlamydia trachomatis
agccucuccagaaa

SEQ ID NO: 2486551 - RNA, 17 nt, Chlamydia trachomatis
agccucuccagaaaaac

SEQ ID NO: 2486552 - RNA, 15 nt, Chlamydia trachomatis
agccugcuuucuucu

SEQ ID NO: 2486553 - RNA, 19 nt, Chlamydia trachomatis
agccugugcauuuguggac

SEQ ID NO: 2486554 - RNA, 17 nt, Chlamydia trachomatis
agccugugccuuucguu

SEQ ID NO: 2486555 - RNA, 15 nt, Chlamydia trachomatis
agccuguuucuuauc

SEQ ID NO: 2486556 - RNA, 23 nt, Chlamydia trachomatis
agccuguuucuuaucagcauccc

SEQ ID NO: 2486557 - RNA, 18 nt, Chlamydia trachomatis
agccuuacggccccugga

SEQ ID NO: 2486558 - RNA, 12 nt, Chlamydia trachomatis
agccuucuuccu

SEQ ID NO: 2486559 - RNA, 18 nt, Chlamydia trachomatis
agccuucuuucaaaagaa

SEQ ID NO: 2486560 - RNA, 21 nt, Chlamydia trachomatis
agccuugagccuucaauucuu

SEQ ID NO: 2486561 - RNA, 18 nt, Chlamydia trachomatis
agccuuggauuucuucug

SEQ ID NO: 2486562 - RNA, 15 nt, Chlamydia trachomatis
agccuuguuucucaa

SEQ ID NO: 2486563 - RNA, 12 nt, Chlamydia trachomatis
agccuuucucua

SEQ ID NO: 2486564 - RNA, 22 nt, Chlamydia trachomatis
agccuuucucuaaaagaagagc

SEQ ID NO: 2486565 - RNA, 23 nt, Chlamydia trachomatis
agccuuucucuaaaagaagagcg

SEQ ID NO: 2486566 - RNA, 13 nt, Chlamydia trachomatis
agccuuuuauucu

SEQ ID NO: 2486567 - RNA, 16 nt, Chlamydia trachomatis
agccuuuuauucuuca

SEQ ID NO: 2486568 - RNA, 15 nt, Chlamydia trachomatis
agccuuuuguuuucu

SEQ ID NO: 2486569 - RNA, 19 nt, Chlamydia trachomatis
agcgaaaaaaaaagaacau

SEQ ID NO: 2486570 - RNA, 21 nt, Chlamydia trachomatis
agcgaaaaaucacaauuuuuc

SEQ ID NO: 2486571 - RNA, 18 nt, Chlamydia trachomatis
agcgaaguuuucuugaga

SEQ ID NO: 2486572 - RNA, 21 nt, Chlamydia trachomatis
agcgacacgacuuagcacuca

SEQ ID NO: 2486573 - RNA, 22 nt, Chlamydia trachomatis
agcgacagcccaagaucuuccg

SEQ ID NO: 2486574 - RNA, 21 nt, Chlamydia trachomatis
agcgacauucucggaaaagau

SEQ ID NO: 2486575 - RNA, 19 nt, Chlamydia trachomatis
agcgacuccaacacgaaug

SEQ ID NO: 2486576 - RNA, 16 nt, Chlamydia trachomatis
agcgacuucauacaua

SEQ ID NO: 2486577 - RNA, 17 nt, Chlamydia trachomatis
agcgaggcuucaaagaa

SEQ ID NO: 2486578 - RNA, 18 nt, Chlamydia trachomatis
agcgaguagagcucuucu

SEQ ID NO: 2486579 - RNA, 22 nt, Chlamydia trachomatis
agcgauaucucccgaaacauuu

SEQ ID NO: 2486580 - RNA, 20 nt, Chlamydia trachomatis
agcgaugagcuuaucacaaa

SEQ ID NO: 2486581 - RNA, 18 nt, Chlamydia trachomatis
agcgauugaucuaucgcu

SEQ ID NO: 2486582 - RNA, 23 nt, Chlamydia trachomatis
agcgauugaucuaucgcuugaaa

SEQ ID NO: 2486583 - RNA, 17 nt, Chlamydia trachomatis
agcgauuuucaguguug

SEQ ID NO: 2486584 - RNA, 19 nt, Chlamydia trachomatis
agcgauuuucaguguugag

SEQ ID NO: 2486585 - RNA, 21 nt, Chlamydia trachomatis
agcgauuuucugaaguucuuu

SEQ ID NO: 2486586 - RNA, 23 nt, Chlamydia trachomatis
agcgcaaccccgcauaccaaagc

SEQ ID NO: 2486587 - RNA, 16 nt, Chlamydia trachomatis
agcgcuuaucagcuuc

SEQ ID NO: 2486588 - RNA, 24 nt, Chlamydia trachomatis
agcgcuucccgcuauuuuccucuu

SEQ ID NO: 2486589 - RNA, 15 nt, Chlamydia trachomatis
agcggacauuucacu

SEQ ID NO: 2486590 - RNA, 15 nt, Chlamydia trachomatis
agcggcgaaaauuug

SEQ ID NO: 2486591 - RNA, 20 nt, Chlamydia trachomatis
agcgggcgguaaaagguauc

SEQ ID NO: 2486592 - RNA, 22 nt, Chlamydia trachomatis
agcgguugcucgauccaaagcc

SEQ ID NO: 2486593 - RNA, 15 nt, Chlamydia trachomatis
agcguaauagcucug

SEQ ID NO: 2486594 - RNA, 18 nt, Chlamydia trachomatis
agcgucuaacuaaauguc

SEQ ID NO: 2486595 - RNA, 21 nt, Chlamydia trachomatis
agcgucuaacuaaaugucucu

SEQ ID NO: 2486596 - RNA, 16 nt, Chlamydia trachomatis
agcgucuaucuaccuu

SEQ ID NO: 2486597 - RNA, 14 nt, Chlamydia trachomatis
agcgucuccaaaua

SEQ ID NO: 2486598 - RNA, 16 nt, Chlamydia trachomatis
agcgucuccaaauaau

SEQ ID NO: 2486599 - RNA, 14 nt, Chlamydia trachomatis
agcgugcauuugag

SEQ ID NO: 2486600 - RNA, 21 nt, Chlamydia trachomatis
agcgugucuaccaauuucacc

SEQ ID NO: 2486601 - RNA, 20 nt, Chlamydia trachomatis
agcgugugaccaucuucacc

SEQ ID NO: 2486602 - RNA, 19 nt, Chlamydia trachomatis
agcguucguucgguaaguc

SEQ ID NO: 2486603 - RNA, 14 nt, Chlamydia trachomatis
agcguuuuccccuu

SEQ ID NO: 2486604 - RNA, 17 nt, Chlamydia trachomatis
agcguuuuccccuugca

SEQ ID NO: 2486605 - RNA, 19 nt, Chlamydia trachomatis
agcuaaccaugcuccuuuc

SEQ ID NO: 2486606 - RNA, 17 nt, Chlamydia trachomatis
agcuaagaaaauaaaca

SEQ ID NO: 2486607 - RNA, 19 nt, Chlamydia trachomatis
agcuaagaaaauaaacaca

SEQ ID NO: 2486608 - RNA, 13 nt, Chlamydia trachomatis
agcuaagagaagc

SEQ ID NO: 2486609 - RNA, 23 nt, Chlamydia trachomatis
agcuaaggauugugcuuuuaucu

SEQ ID NO: 2486610 - RNA, 22 nt, Chlamydia trachomatis
agcuaagggcuguguagcaaau

SEQ ID NO: 2486611 - RNA, 20 nt, Chlamydia trachomatis
agcuaagguaacaaucacag

SEQ ID NO: 2486612 - RNA, 13 nt, Chlamydia trachomatis
agcuaauaacccg

SEQ ID NO: 2486613 - RNA, 19 nt, Chlamydia trachomatis
agcuaaucaugaugaugag

SEQ ID NO: 2486614 - RNA, 22 nt, Chlamydia trachomatis
agcuaaucaugaugaugagagc

SEQ ID NO: 2486615 - RNA, 22 nt, Chlamydia trachomatis
agcuaaugccguuacuaacauc

SEQ ID NO: 2486616 - RNA, 22 nt, Chlamydia trachomatis
agcuaauuccauaaucguggaa

SEQ ID NO: 2486617 - RNA, 20 nt, Chlamydia trachomatis
agcuacgguuucaagagcau

SEQ ID NO: 2486618 - RNA, 23 nt, Chlamydia trachomatis
agcuacuaaacgauucaauccag

SEQ ID NO: 2486619 - RNA, 15 nt, Chlamydia trachomatis
agcuacuagauagau

SEQ ID NO: 2486620 - RNA, 17 nt, Chlamydia trachomatis
agcuacuagauagaugg

SEQ ID NO: 2486621 - RNA, 23 nt, Chlamydia trachomatis
agcuagaaaauagcaucucugua

SEQ ID NO: 2486622 - RNA, 19 nt, Chlamydia trachomatis
agcuagaacauacccuaaa

SEQ ID NO: 2486623 - RNA, 14 nt, Chlamydia trachomatis
agcuagaagaauca

SEQ ID NO: 2486624 - RNA, 22 nt, Chlamydia trachomatis
agcuagguaaagguuucuggaa

SEQ ID NO: 2486625 - RNA, 17 nt, Chlamydia trachomatis
agcuauaaaauacgcag

SEQ ID NO: 2486626 - RNA, 12 nt, Chlamydia trachomatis
agcuauauaugc

SEQ ID NO: 2486627 - RNA, 19 nt, Chlamydia trachomatis
agcuaucaauaaagaagcc

SEQ ID NO: 2486628 - RNA, 18 nt, Chlamydia trachomatis
agcuauucccacuacauu

SEQ ID NO: 2486629 - RNA, 14 nt, Chlamydia trachomatis
agcuauuucuuuuu

SEQ ID NO: 2486630 - RNA, 17 nt, Chlamydia trachomatis
agcuauuuucuuccugc

SEQ ID NO: 2486631 - RNA, 13 nt, Chlamydia trachomatis
agcucaucaaaua

SEQ ID NO: 2486632 - RNA, 14 nt, Chlamydia trachomatis
aggauaaggaagaa

SEQ ID NO: 2486633 - RNA, 15 nt, Chlamydia trachomatis
aggauaaggaagaag

SEQ ID NO: 2486634 - RNA, 16 nt, Chlamydia trachomatis
aggauaaggaagaaga

SEQ ID NO: 2486635 - RNA, 13 nt, Chlamydia trachomatis
aggauacgaagga

SEQ ID NO: 2486636 - RNA, 16 nt, Chlamydia trachomatis
aggauagccaaagguu

SEQ ID NO: 2486637 - RNA, 15 nt, Chlamydia trachomatis
aggauaguauucuuu

SEQ ID NO: 2486638 - RNA, 22 nt, Chlamydia trachomatis
aggauaguuucgaguaauucca

SEQ ID NO: 2486639 - RNA, 16 nt, Chlamydia trachomatis
aggauccaggagaugu

SEQ ID NO: 2486640 - RNA, 21 nt, Chlamydia trachomatis
aggaucccucuguccauucua

SEQ ID NO: 2486641 - RNA, 18 nt, Chlamydia trachomatis
aggauccuaaccaaaaaa

SEQ ID NO: 2486642 - RNA, 18 nt, Chlamydia trachomatis
aggauccuuaguuagcug

SEQ ID NO: 2486643 - RNA, 16 nt, Chlamydia trachomatis
aggaugcaaauaagaa

SEQ ID NO: 2486644 - RNA, 18 nt, Chlamydia trachomatis
aggaugcaaauaagaaag

SEQ ID NO: 2486645 - RNA, 20 nt, Chlamydia trachomatis
aggauguggacgaacaaaaa

SEQ ID NO: 2486646 - RNA, 18 nt, Chlamydia trachomatis
aggauuacagcaagaaga

SEQ ID NO: 2486647 - RNA, 19 nt, Chlamydia trachomatis
aggauuacagcaagaagaa

SEQ ID NO: 2486648 - RNA, 17 nt, Chlamydia trachomatis
aggauuacuuuuucuac

SEQ ID NO: 2486649 - RNA, 20 nt, Chlamydia trachomatis
aggauuacuuuuucuacuuu

SEQ ID NO: 2486650 - RNA, 19 nt, Chlamydia trachomatis
aggauucgguaucugagcu

SEQ ID NO: 2486651 - RNA, 22 nt, Chlamydia trachomatis
aggauucgguaucugagcuuug

SEQ ID NO: 2486652 - RNA, 16 nt, Chlamydia trachomatis
aggauucucaucuugc

SEQ ID NO: 2486653 - RNA, 16 nt, Chlamydia trachomatis
aggauucucugcacaa

SEQ ID NO: 2486654 - RNA, 18 nt, Chlamydia trachomatis
aggauuggaaaauccaaa

SEQ ID NO: 2486655 - RNA, 15 nt, Chlamydia trachomatis
aggauuuucuucuuu

SEQ ID NO: 2486656 - RNA, 22 nt, Chlamydia trachomatis
aggauuuucuucuuuuuuacau

SEQ ID NO: 2486657 - RNA, 22 nt, Chlamydia trachomatis
aggauuuuuuucccacaaacaa

SEQ ID NO: 2486658 - RNA, 21 nt, Chlamydia trachomatis
aggcaacaaauaacccuccga

SEQ ID NO: 2486659 - RNA, 20 nt, Chlamydia trachomatis
aggcaacccucgcagagaaa

SEQ ID NO: 2486660 - RNA, 13 nt, Chlamydia trachomatis
aggcaaugcuaag

SEQ ID NO: 2486661 - RNA, 17 nt, Chlamydia trachomatis
aggcaccccuaaaagag

SEQ ID NO: 2486662 - RNA, 16 nt, Chlamydia trachomatis
aggcagucucugaggc

SEQ ID NO: 2486663 - RNA, 14 nt, Chlamydia trachomatis
aggcauaaaagaga

SEQ ID NO: 2486664 - RNA, 18 nt, Chlamydia trachomatis
aggcauaaaagagaagaa

SEQ ID NO: 2486665 - RNA, 22 nt, Chlamydia trachomatis
aggcauuccuuggcaaagagcu

SEQ ID NO: 2486666 - RNA, 14 nt, Chlamydia trachomatis
aggcccuucuugag

SEQ ID NO: 2486667 - RNA, 14 nt, Chlamydia trachomatis
aggccuccauuucc

SEQ ID NO: 2486668 - RNA, 18 nt, Chlamydia trachomatis
aggccuuuuuuuauaaag

SEQ ID NO: 2486669 - RNA, 16 nt, Chlamydia trachomatis
aggcgaacagugacag

SEQ ID NO: 2486670 - RNA, 19 nt, Chlamydia trachomatis
aggcgaauuucucuaucug

SEQ ID NO: 2486671 - RNA, 20 nt, Chlamydia trachomatis
aggcgaucacgccuccaucc

SEQ ID NO: 2486672 - RNA, 20 nt, Chlamydia trachomatis
aggcggagagaauaccaaaa

SEQ ID NO: 2486673 - RNA, 15 nt, Chlamydia trachomatis
aggcggcuuuucuau

SEQ ID NO: 2486674 - RNA, 16 nt, Chlamydia trachomatis
aggcguaaaccuucuu

SEQ ID NO: 2486675 - RNA, 19 nt, Chlamydia trachomatis
aggcgugaagagagacacu

SEQ ID NO: 2486676 - RNA, 20 nt, Chlamydia trachomatis
aggcuaagaaaaaccuuucu

SEQ ID NO: 2486677 - RNA, 19 nt, Chlamydia trachomatis
aggcuaguaaugugucuaa

SEQ ID NO: 2486678 - RNA, 19 nt, Chlamydia trachomatis
aggcucaugaacagcaaga

SEQ ID NO: 2486679 - RNA, 16 nt, Chlamydia trachomatis
aggcuccccagaaaaa

SEQ ID NO: 2486680 - RNA, 21 nt, Chlamydia trachomatis
aggcuccgccuucugcaauga

SEQ ID NO: 2486681 - RNA, 22 nt, Chlamydia trachomatis
aggcuccgccuucugcaaugag

SEQ ID NO: 2486682 - RNA, 16 nt, Chlamydia trachomatis
aggcuccugcaaggga

SEQ ID NO: 2486683 - RNA, 23 nt, Chlamydia trachomatis
aggcuccugcaagggaacaaacc

SEQ ID NO: 2486684 - RNA, 20 nt, Chlamydia trachomatis
aggcucuaucggaauagcaa

SEQ ID NO: 2486685 - RNA, 22 nt, Chlamydia trachomatis
aggcucuccuaaugaugagaau

SEQ ID NO: 2486686 - RNA, 17 nt, Chlamydia trachomatis
aggcucucgcaguuucu

SEQ ID NO: 2486687 - RNA, 16 nt, Chlamydia trachomatis
aggcucuucaguacuu

SEQ ID NO: 2486688 - RNA, 16 nt, Chlamydia trachomatis
aggcucuugaaaagga

SEQ ID NO: 2486689 - RNA, 21 nt, Chlamydia trachomatis
aggcugagcaucggagugagu

SEQ ID NO: 2486690 - RNA, 19 nt, Chlamydia trachomatis
aggcugaucaauaccuagc

SEQ ID NO: 2486691 - RNA, 21 nt, Chlamydia trachomatis
aggcugcauuacucguuaucu

SEQ ID NO: 2486692 - RNA, 13 nt, Chlamydia trachomatis
aggcuguaacuaa

SEQ ID NO: 2486693 - RNA, 22 nt, Chlamydia trachomatis
aggcuguuucgcauacacauaa

SEQ ID NO: 2486694 - RNA, 16 nt, Chlamydia trachomatis
aggcuucaaagaacau

SEQ ID NO: 2486695 - RNA, 14 nt, Chlamydia trachomatis
aggcuuccaaaucu

SEQ ID NO: 2486696 - RNA, 21 nt, Chlamydia trachomatis
aggcuuccaaaucugcaagaa

SEQ ID NO: 2486697 - RNA, 16 nt, Chlamydia trachomatis
aggcuucucuuuucga

SEQ ID NO: 2486698 - RNA, 23 nt, Chlamydia trachomatis
aggcuucucuuuucgaacaaaac

SEQ ID NO: 2486699 - RNA, 13 nt, Chlamydia trachomatis
aggcuucuucuuc

SEQ ID NO: 2486700 - RNA, 11 nt, Chlamydia trachomatis
aggcuugggug

SEQ ID NO: 2486701 - RNA, 21 nt, Chlamydia trachomatis
aggcuuguugccaaccaccug

SEQ ID NO: 2486702 - RNA, 17 nt, Chlamydia trachomatis
aggcuuucaaaaagagc

SEQ ID NO: 2486703 - RNA, 20 nt, Chlamydia trachomatis
aggcuuuuccauuccuccua

SEQ ID NO: 2486704 - RNA, 16 nt, Chlamydia trachomatis
aggcuuuuuuuuucau

SEQ ID NO: 2486705 - RNA, 19 nt, Chlamydia trachomatis
aggcuuuuuuuuucauaaa

SEQ ID NO: 2486706 - RNA, 20 nt, Chlamydia trachomatis
agggaaaaaacuagaaggga

SEQ ID NO: 2486707 - RNA, 14 nt, Chlamydia trachomatis
agggaaaaacuuuu

SEQ ID NO: 2486708 - RNA, 21 nt, Chlamydia trachomatis
agggaaacguaaaagaguaag

SEQ ID NO: 2486709 - RNA, 12 nt, Chlamydia trachomatis
agggaagagaaa

SEQ ID NO: 2486710 - RNA, 13 nt, Chlamydia trachomatis
agggaagagaaac

SEQ ID NO: 2486711 - RNA, 17 nt, Chlamydia trachomatis
agggaagauaggagcau

SEQ ID NO: 2486712 - RNA, 13 nt, Chlamydia trachomatis
agggaaugacuua

SEQ ID NO: 2486713 - RNA, 15 nt, Chlamydia trachomatis
agggacuucuucuag

SEQ ID NO: 2486714 - RNA, 14 nt, Chlamydia trachomatis
agggagaaggggaa

SEQ ID NO: 2486715 - RNA, 19 nt, Chlamydia trachomatis
agggagaaggggaaggaau

SEQ ID NO: 2486716 - RNA, 16 nt, Chlamydia trachomatis
agggagaauuuuaaac

SEQ ID NO: 2486717 - RNA, 14 nt, Chlamydia trachomatis
agggagagcuuagg

SEQ ID NO: 2486718 - RNA, 22 nt, Chlamydia trachomatis
agggagauguuuacugagaaua

SEQ ID NO: 2486719 - RNA, 23 nt, Chlamydia trachomatis
agggagcagcuuuucuaacguuc

SEQ ID NO: 2486720 - RNA, 13 nt, Chlamydia trachomatis
agggauaacaucu

SEQ ID NO: 2486721 - RNA, 16 nt, Chlamydia trachomatis
agggauagaaacuccg

SEQ ID NO: 2486722 - RNA, 15 nt, Chlamydia trachomatis
agggauaguaaaaac

SEQ ID NO: 2486723 - RNA, 17 nt, Chlamydia trachomatis
agggauauuucuuccug

SEQ ID NO: 2486724 - RNA, 19 nt, Chlamydia trachomatis
agggaucccacaaagaaag

SEQ ID NO: 2486725 - RNA, 16 nt, Chlamydia trachomatis
agggaucucagcuggc

SEQ ID NO: 2486726 - RNA, 18 nt, Chlamydia trachomatis
agggauggucucacacaa

SEQ ID NO: 2486727 - RNA, 23 nt, Chlamydia trachomatis
agggccucccauacaaaagcgaa

SEQ ID NO: 2486728 - RNA, 18 nt, Chlamydia trachomatis
agggcuguguagcaaaua

SEQ ID NO: 2486729 - RNA, 17 nt, Chlamydia trachomatis
agggcuuuugcaaacaa

SEQ ID NO: 2486730 - RNA, 19 nt, Chlamydia trachomatis
aggggauugcaauccuuuu

SEQ ID NO: 2486731 - RNA, 17 nt, Chlamydia trachomatis
aggggcaucuggagaua

SEQ ID NO: 2486732 - RNA, 15 nt, Chlamydia trachomatis
agggggcuuuagcag

SEQ ID NO: 2486733 - RNA, 15 nt, Chlamydia trachomatis
aggguagaaaaagag

SEQ ID NO: 2486734 - RNA, 17 nt, Chlamydia trachomatis
aggguccaaacauaaga

SEQ ID NO: 2486735 - RNA, 20 nt, Chlamydia trachomatis
agggucuucucugugcacaa

SEQ ID NO: 2486736 - RNA, 15 nt, Chlamydia trachomatis
aggguguuuuucgcu

SEQ ID NO: 2486737 - RNA, 12 nt, Chlamydia trachomatis
aggguucucuuu

SEQ ID NO: 2486738 - RNA, 22 nt, Chlamydia trachomatis
aggguucucuuuuuaaaaggcu

SEQ ID NO: 2486739 - RNA, 16 nt, Chlamydia trachomatis
agguaaagaaguuuaa

SEQ ID NO: 2486740 - RNA, 20 nt, Chlamydia trachomatis
agguaacuguggguuuuuuu

SEQ ID NO: 2486741 - RNA, 17 nt, Chlamydia trachomatis
agguaagggacaacagg

SEQ ID NO: 2486742 - RNA, 22 nt, Chlamydia trachomatis
agguaaucuguagagagcccca

SEQ ID NO: 2486743 - RNA, 20 nt, Chlamydia trachomatis
agugaaugcuccauacgcug

SEQ ID NO: 2486744 - RNA, 15 nt, Chlamydia trachomatis
agugacauuuccaac

SEQ ID NO: 2486745 - RNA, 16 nt, Chlamydia trachomatis
agugacauuuccaaca

SEQ ID NO: 2486746 - RNA, 15 nt, Chlamydia trachomatis
agugacuaagaucca

SEQ ID NO: 2486747 - RNA, 16 nt, Chlamydia trachomatis
agugacuauuuccuac

SEQ ID NO: 2486748 - RNA, 14 nt, Chlamydia trachomatis
agugacuugaguaa

SEQ ID NO: 2486749 - RNA, 21 nt, Chlamydia trachomatis
agugagaugcuccucucuuug

SEQ ID NO: 2486750 - RNA, 17 nt, Chlamydia trachomatis
agugaucuacagcugua

SEQ ID NO: 2486751 - RNA, 14 nt, Chlamydia trachomatis
agugaucuuuuuag

SEQ ID NO: 2486752 - RNA, 13 nt, Chlamydia trachomatis
agugauguauucc

SEQ ID NO: 2486753 - RNA, 16 nt, Chlamydia trachomatis
agugauuuuaaaccaa

SEQ ID NO: 2486754 - RNA, 23 nt, Chlamydia trachomatis
agugcagcguucugagaugaaaa

SEQ ID NO: 2486755 - RNA, 16 nt, Chlamydia trachomatis
agugcaucauuuugua

SEQ ID NO: 2486756 - RNA, 16 nt, Chlamydia trachomatis
agugccaauugucaag

SEQ ID NO: 2486757 - RNA, 20 nt, Chlamydia trachomatis
agugccagacccuuccaaau

SEQ ID NO: 2486758 - RNA, 14 nt, Chlamydia trachomatis
agugccagcauuca

SEQ ID NO: 2486759 - RNA, 15 nt, Chlamydia trachomatis
agugcguccuucuuu

SEQ ID NO: 2486760 - RNA, 16 nt, Chlamydia trachomatis
agugcuaauaacggaa

SEQ ID NO: 2486761 - RNA, 14 nt, Chlamydia trachomatis
agugcucaaagauu

SEQ ID NO: 2486762 - RNA, 16 nt, Chlamydia trachomatis
agugcuccugcagaca

SEQ ID NO: 2486763 - RNA, 13 nt, Chlamydia trachomatis
aguggaagauaga

SEQ ID NO: 2486764 - RNA, 17 nt, Chlamydia trachomatis
aguggacgcugaucaac

SEQ ID NO: 2486765 - RNA, 14 nt, Chlamydia trachomatis
aguggcaaggggga

SEQ ID NO: 2486766 - RNA, 17 nt, Chlamydia trachomatis
aguggcaagggggagca

SEQ ID NO: 2486767 - RNA, 22 nt, Chlamydia trachomatis
aguggcaagggggagcauguuu

SEQ ID NO: 2486768 - RNA, 13 nt, Chlamydia trachomatis
aguggcaucuggu

SEQ ID NO: 2486769 - RNA, 23 nt, Chlamydia trachomatis
aguggcuguaauguuaauggaau

SEQ ID NO: 2486770 - RNA, 17 nt, Chlamydia trachomatis
agugggcucguggaggg

SEQ ID NO: 2486771 - RNA, 14 nt, Chlamydia trachomatis
aguguaaggagaga

SEQ ID NO: 2486772 - RNA, 17 nt, Chlamydia trachomatis
aguguaaggagagaaaa

SEQ ID NO: 2486773 - RNA, 19 nt, Chlamydia trachomatis
aguguaaggagagaaaaga

SEQ ID NO: 2486774 - RNA, 14 nt, Chlamydia trachomatis
aguguaaucauuuu

SEQ ID NO: 2486775 - RNA, 16 nt, Chlamydia trachomatis
agugugccagcucuaa

SEQ ID NO: 2486776 - RNA, 22 nt, Chlamydia trachomatis
agugugccagcucuaauuaaua

SEQ ID NO: 2486777 - RNA, 22 nt, Chlamydia trachomatis
agugugcgaggaauucuucuuc

SEQ ID NO: 2486778 - RNA, 16 nt, Chlamydia trachomatis
agugugcuucuggacu

SEQ ID NO: 2486779 - RNA, 15 nt, Chlamydia trachomatis
aguguguaguuaucu

SEQ ID NO: 2486780 - RNA, 16 nt, Chlamydia trachomatis
aguguuagugagccgc

SEQ ID NO: 2486781 - RNA, 17 nt, Chlamydia trachomatis
aguguuugcauucuuuu

SEQ ID NO: 2486782 - RNA, 16 nt, Chlamydia trachomatis
aguuaaaacuccagaa

SEQ ID NO: 2486783 - RNA, 22 nt, Chlamydia trachomatis
aguuaaauguugaugguuucua

SEQ ID NO: 2486784 - RNA, 20 nt, Chlamydia trachomatis
aguuaaucaauugaaagucu

SEQ ID NO: 2486785 - RNA, 17 nt, Chlamydia trachomatis
aguuagcauguucagaa

SEQ ID NO: 2486786 - RNA, 16 nt, Chlamydia trachomatis
aguuagccguaucucc

SEQ ID NO: 2486787 - RNA, 14 nt, Chlamydia trachomatis
aguuaggcauuccu

SEQ ID NO: 2486788 - RNA, 22 nt, Chlamydia trachomatis
aguuaggcauuccuuucuucca

SEQ ID NO: 2486789 - RNA, 21 nt, Chlamydia trachomatis
aguuauauugcuucauaaaaa

SEQ ID NO: 2486790 - RNA, 18 nt, Chlamydia trachomatis
aguucagacagagaagaa

SEQ ID NO: 2486791 - RNA, 20 nt, Chlamydia trachomatis
aguucccuuuacaaugauga

SEQ ID NO: 2486792 - RNA, 23 nt, Chlamydia trachomatis
aguucccuuuacaaugaugagaa

SEQ ID NO: 2486793 - RNA, 20 nt, Chlamydia trachomatis
aguucccuuuuguuccagaa

SEQ ID NO: 2486794 - RNA, 17 nt, Chlamydia trachomatis
aguuccgcagagaucua

SEQ ID NO: 2486795 - RNA, 17 nt, Chlamydia trachomatis
aguuccgguauauucuu

SEQ ID NO: 2486796 - RNA, 19 nt, Chlamydia trachomatis
aguuccgguauauucuuca

SEQ ID NO: 2486797 - RNA, 20 nt, Chlamydia trachomatis
aguuccgguauauucuucac

SEQ ID NO: 2486798 - RNA, 15 nt, Chlamydia trachomatis
aguucgcgucaguuc

SEQ ID NO: 2486799 - RNA, 19 nt, Chlamydia trachomatis
aguucgcuauaaucccaaa

SEQ ID NO: 2486800 - RNA, 23 nt, Chlamydia trachomatis
aguucgcuauaaucccaaaaaca

SEQ ID NO: 2486801 - RNA, 17 nt, Chlamydia trachomatis
aguucuaacacuuuuuu

SEQ ID NO: 2486802 - RNA, 16 nt, Chlamydia trachomatis
aguucuccuucuugug

SEQ ID NO: 2486803 - RNA, 21 nt, Chlamydia trachomatis
aguucucugcauagagaacuc

SEQ ID NO: 2486804 - RNA, 12 nt, Chlamydia trachomatis
aguucugcugcc

SEQ ID NO: 2486805 - RNA, 20 nt, Chlamydia trachomatis
aguucugcugccaaagcuuc

SEQ ID NO: 2486806 - RNA, 22 nt, Chlamydia trachomatis
aguucuguuauuuguucucuua

SEQ ID NO: 2486807 - RNA, 14 nt, Chlamydia trachomatis
aguucuucuuccac

SEQ ID NO: 2486808 - RNA, 16 nt, Chlamydia trachomatis
aguucuuggaaaaaag

SEQ ID NO: 2486809 - RNA, 16 nt, Chlamydia trachomatis
aguucuuuauaacucu

SEQ ID NO: 2486810 - RNA, 20 nt, Chlamydia trachomatis
aguucuuuauaacucucagc

SEQ ID NO: 2486811 - RNA, 18 nt, Chlamydia trachomatis
aguugccccuuauuuacc

SEQ ID NO: 2486812 - RNA, 11 nt, Chlamydia trachomatis
aguugcuccca

SEQ ID NO: 2486813 - RNA, 14 nt, Chlamydia trachomatis
aguugcuccuccgu

SEQ ID NO: 2486814 - RNA, 19 nt, Chlamydia trachomatis
aguuggccagcucaaagau

SEQ ID NO: 2486815 - RNA, 24 nt, Chlamydia trachomatis
aguuggccagcucaaagaugagua

SEQ ID NO: 2486816 - RNA, 18 nt, Chlamydia trachomatis
aguugguacacuucuuua

SEQ ID NO: 2486817 - RNA, 21 nt, Chlamydia trachomatis
aguugguagagcaacgcauuc

SEQ ID NO: 2486818 - RNA, 16 nt, Chlamydia trachomatis
aguugguagaggagaa

SEQ ID NO: 2486819 - RNA, 17 nt, Chlamydia trachomatis
aguugguagaggagaac

SEQ ID NO: 2486820 - RNA, 19 nt, Chlamydia trachomatis
aguuguggggcuccuaaca

SEQ ID NO: 2486821 - RNA, 20 nt, Chlamydia trachomatis
aguuguuggaguuaauucuu

SEQ ID NO: 2486822 - RNA, 17 nt, Chlamydia trachomatis
aguuguugggagagggu

SEQ ID NO: 2486823 - RNA, 19 nt, Chlamydia trachomatis
aguuuaacagcaagcuugu

SEQ ID NO: 2486824 - RNA, 16 nt, Chlamydia trachomatis
aguuuacgaguaucug

SEQ ID NO: 2486825 - RNA, 22 nt, Chlamydia trachomatis
aguuucccguuguuuucuuaga

SEQ ID NO: 2486826 - RNA, 13 nt, Chlamydia trachomatis
aguuuccuuuaaa

SEQ ID NO: 2486827 - RNA, 14 nt, Chlamydia trachomatis
aguuucgaguaauu

SEQ ID NO: 2486828 - RNA, 18 nt, Chlamydia trachomatis
aguuucuuccagacaaaa

SEQ ID NO: 2486829 - RNA, 22 nt, Chlamydia trachomatis
aguuucuuccagacaaaaagaa

SEQ ID NO: 2486830 - RNA, 16 nt, Chlamydia trachomatis
aguuucuucgauagaa

SEQ ID NO: 2486831 - RNA, 22 nt, Chlamydia trachomatis
aguuucuucgauagaaaugguu

SEQ ID NO: 2486832 - RNA, 11 nt, Chlamydia trachomatis
aguuucuucua

SEQ ID NO: 2486833 - RNA, 23 nt, Chlamydia trachomatis
aguuucuuuguucacagaaaguc

SEQ ID NO: 2486834 - RNA, 12 nt, Chlamydia trachomatis
aguuugaaucac

SEQ ID NO: 2486835 - RNA, 14 nt, Chlamydia trachomatis
aguuugaaucacag

SEQ ID NO: 2486836 - RNA, 15 nt, Chlamydia trachomatis
aguuugaaucacaga

SEQ ID NO: 2486837 - RNA, 20 nt, Chlamydia trachomatis
aguuugaaucacagaaacuu

SEQ ID NO: 2486838 - RNA, 20 nt, Chlamydia trachomatis
aguuugccaguaaucaaauu

SEQ ID NO: 2486839 - RNA, 14 nt, Chlamydia trachomatis
aguuuggagcagcu

SEQ ID NO: 2486840 - RNA, 15 nt, Chlamydia trachomatis
aguuuguucagaaag

SEQ ID NO: 2486841 - RNA, 20 nt, Chlamydia trachomatis
aguuuuaggcguuccugcau

SEQ ID NO: 2486842 - RNA, 21 nt, Chlamydia trachomatis
aguuuucgaauuuuuuucuuu

SEQ ID NO: 2486843 - RNA, 19 nt, Chlamydia trachomatis
aguuuugaggaagaaaugu

SEQ ID NO: 2486844 - RNA, 19 nt, Chlamydia trachomatis
aguuuuguaaaguaacuac

SEQ ID NO: 2486845 - RNA, 20 nt, Chlamydia trachomatis
aguuuuucuccucucucuuu

SEQ ID NO: 2486846 - RNA, 12 nt, Chlamydia trachomatis
auaaaaaagagg

SEQ ID NO: 2486847 - RNA, 22 nt, Chlamydia trachomatis
auaaaaaccuugauaagagucu

SEQ ID NO: 2486848 - RNA, 21 nt, Chlamydia trachomatis
auaaaaacuggagaauccaua

SEQ ID NO: 2486849 - RNA, 17 nt, Chlamydia trachomatis
auaaaacccucaaguuc

SEQ ID NO: 2486850 - RNA, 21 nt, Chlamydia trachomatis
auaaaacucuccaaacucuau

SEQ ID NO: 2486851 - RNA, 20 nt, Chlamydia trachomatis
auaaaacuuguuccuaauuu

SEQ ID NO: 2486852 - RNA, 13 nt, Chlamydia trachomatis
auaaaagaagcag

SEQ ID NO: 2486853 - RNA, 22 nt, Chlamydia trachomatis
auaaaagaagcagcgcuuauca

SEQ ID NO: 2486854 - RNA, 21 nt, Chlamydia trachomatis
auaaucuauuuuauacuucuu

SEQ ID NO: 2486855 - RNA, 24 nt, Chlamydia trachomatis
auaaucugugccagcugcugcuug

SEQ ID NO: 2486856 - RNA, 22 nt, Chlamydia trachomatis
auaaucuuggacuuucuaccgc

SEQ ID NO: 2486857 - RNA, 21 nt, Chlamydia trachomatis
auaaugauucccagggagagu

SEQ ID NO: 2486858 - RNA, 18 nt, Chlamydia trachomatis
auaaugccuauagccaua

SEQ ID NO: 2486859 - RNA, 18 nt, Chlamydia trachomatis
auaaugcuuagaaacugu

SEQ ID NO: 2486860 - RNA, 16 nt, Chlamydia trachomatis
auaauggacugguugu

SEQ ID NO: 2486861 - RNA, 16 nt, Chlamydia trachomatis
auaaugggcuccuuca

SEQ ID NO: 2486862 - RNA, 12 nt, Chlamydia trachomatis
auaauuccaccu

SEQ ID NO: 2486863 - RNA, 18 nt, Chlamydia trachomatis
auaauuccuaggaaugag

SEQ ID NO: 2486864 - RNA, 18 nt, Chlamydia trachomatis
auaauucucgcaaagaau

SEQ ID NO: 2486865 - RNA, 12 nt, Chlamydia trachomatis
auaauuuccccu

SEQ ID NO: 2486866 - RNA, 18 nt, Chlamydia trachomatis
auaauuugacuaggauua

SEQ ID NO: 2486867 - RNA, 13 nt, Chlamydia trachomatis
auaauuuuccaca

SEQ ID NO: 2486868 - RNA, 14 nt, Chlamydia trachomatis
auaauuuuccuuuu

SEQ ID NO: 2486869 - RNA, 21 nt, Chlamydia trachomatis
auaauuuucuucacuuccucu

SEQ ID NO: 2486870 - RNA, 22 nt, Chlamydia trachomatis
auaauuuucuucacuuccucuc

SEQ ID NO: 2486871 - RNA, 21 nt, Chlamydia trachomatis
auacaaaccgaagagggaaga

SEQ ID NO: 2486872 - RNA, 22 nt, Chlamydia trachomatis
auacaaaggagcccaagcuuuc

SEQ ID NO: 2486873 - RNA, 13 nt, Chlamydia trachomatis
auacaagagagaa

SEQ ID NO: 2486874 - RNA, 15 nt, Chlamydia trachomatis
auacaagagagaaca

SEQ ID NO: 2486875 - RNA, 17 nt, Chlamydia trachomatis
auacaaguauuucuugu

SEQ ID NO: 2486876 - RNA, 13 nt, Chlamydia trachomatis
auacaauuccugc

SEQ ID NO: 2486877 - RNA, 14 nt, Chlamydia trachomatis
auacacagcaucaa

SEQ ID NO: 2486878 - RNA, 20 nt, Chlamydia trachomatis
auacaccgcaucagccccaa

SEQ ID NO: 2486879 - RNA, 21 nt, Chlamydia trachomatis
auacaccgcaucagccccaaa

SEQ ID NO: 2486880 - RNA, 15 nt, Chlamydia trachomatis
auacacuaucagcca

SEQ ID NO: 2486881 - RNA, 16 nt, Chlamydia trachomatis
auacagaacauuucuc

SEQ ID NO: 2486882 - RNA, 23 nt, Chlamydia trachomatis
auacagagcaaggugaccucugc

SEQ ID NO: 2486883 - RNA, 22 nt, Chlamydia trachomatis
auacagagccuuuuauucuuca

SEQ ID NO: 2486884 - RNA, 16 nt, Chlamydia trachomatis
auacagccuuggauuu

SEQ ID NO: 2486885 - RNA, 22 nt, Chlamydia trachomatis
auacaucacugcaacuaauauu

SEQ ID NO: 2486886 - RNA, 14 nt, Chlamydia trachomatis
auacaucagagcaa

SEQ ID NO: 2486887 - RNA, 21 nt, Chlamydia trachomatis
auacaucagagcaauagacac

SEQ ID NO: 2486888 - RNA, 15 nt, Chlamydia trachomatis
auacaucaucucuca

SEQ ID NO: 2486889 - RNA, 16 nt, Chlamydia trachomatis
auaccaaaauaucaua

SEQ ID NO: 2486890 - RNA, 11 nt, Chlamydia trachomatis
auaccaaaauc

SEQ ID NO: 2486891 - RNA, 11 nt, Chlamydia trachomatis
auaccaaagca

SEQ ID NO: 2486892 - RNA, 20 nt, Chlamydia trachomatis
auaccacaauuuuucuugua

SEQ ID NO: 2486893 - RNA, 22 nt, Chlamydia trachomatis
auaccagcguaauaauuaagga

SEQ ID NO: 2486894 - RNA, 14 nt, Chlamydia trachomatis
auaccccaaauguu

SEQ ID NO: 2486895 - RNA, 15 nt, Chlamydia trachomatis
auaccccaaauguug

SEQ ID NO: 2486896 - RNA, 19 nt, Chlamydia trachomatis
auaccccuaaaggaaguag

SEQ ID NO: 2486897 - RNA, 23 nt, Chlamydia trachomatis
auaccccuaaaggaaguagagaa

SEQ ID NO: 2486898 - RNA, 16 nt, Chlamydia trachomatis
auacccgacuaaaaaa

SEQ ID NO: 2486899 - RNA, 23 nt, Chlamydia trachomatis
auacccgacuaaaaaauuuugag

SEQ ID NO: 2486900 - RNA, 12 nt, Chlamydia trachomatis
auacccuaaauu

SEQ ID NO: 2486901 - RNA, 20 nt, Chlamydia trachomatis
auaccgaggauccuaaccaa

SEQ ID NO: 2486902 - RNA, 20 nt, Chlamydia trachomatis
auaccuacacgauauaucca

SEQ ID NO: 2486903 - RNA, 16 nt, Chlamydia trachomatis
auaccuagcaauucau

SEQ ID NO: 2486904 - RNA, 14 nt, Chlamydia trachomatis
auaccuauuccaaa

SEQ ID NO: 2486905 - RNA, 15 nt, Chlamydia trachomatis
auaccuucuuacaua

SEQ ID NO: 2486906 - RNA, 22 nt, Chlamydia trachomatis
auaccuuguuuuuuaagaguuu

SEQ ID NO: 2486907 - RNA, 23 nt, Chlamydia trachomatis
auaccuuuugcaaucauuugugu

SEQ ID NO: 2486908 - RNA, 18 nt, Chlamydia trachomatis
auacgaaauaacaaagca

SEQ ID NO: 2486909 - RNA, 15 nt, Chlamydia trachomatis
auacgaaaugacaca

SEQ ID NO: 2486910 - RNA, 13 nt, Chlamydia trachomatis
auacgaauaagag

SEQ ID NO: 2486911 - RNA, 21 nt, Chlamydia trachomatis
auacgcaaguauuggagacaa

SEQ ID NO: 2486912 - RNA, 15 nt, Chlamydia trachomatis
auacgccgcauaaca

SEQ ID NO: 2486913 - RNA, 13 nt, Chlamydia trachomatis
auacgcucuuuca

SEQ ID NO: 2486914 - RNA, 20 nt, Chlamydia trachomatis
auacguuuaccgcucuucca

SEQ ID NO: 2486915 - RNA, 20 nt, Chlamydia trachomatis
auacuaaacuaucuaaaauc

SEQ ID NO: 2486916 - RNA, 18 nt, Chlamydia trachomatis
auacucagagauauaaga

SEQ ID NO: 2486917 - RNA, 18 nt, Chlamydia trachomatis
auacucccauagcuucuu

SEQ ID NO: 2486918 - RNA, 19 nt, Chlamydia trachomatis
auacucuaaaaguuuucuu

SEQ ID NO: 2486919 - RNA, 22 nt, Chlamydia trachomatis
auacugggaggacuaacaugcu

SEQ ID NO: 2486920 - RNA, 17 nt, Chlamydia trachomatis
auacuucuuacuuaaaa

SEQ ID NO: 2486921 - RNA, 15 nt, Chlamydia trachomatis
auacuuguccccuac

SEQ ID NO: 2486922 - RNA, 21 nt, Chlamydia trachomatis
auacuuuagauuuguuuaaaa

SEQ ID NO: 2486923 - RNA, 13 nt, Chlamydia trachomatis
auacuuuucaauu

SEQ ID NO: 2486924 - RNA, 21 nt, Chlamydia trachomatis
auacuuuuccgaauucuuuca

SEQ ID NO: 2486925 - RNA, 14 nt, Chlamydia trachomatis
auacuuuucucccu

SEQ ID NO: 2486926 - RNA, 17 nt, Chlamydia trachomatis
auagaaggucugaacaa

SEQ ID NO: 2486927 - RNA, 19 nt, Chlamydia trachomatis
auagaaguuacuuuucuca

SEQ ID NO: 2486928 - RNA, 12 nt, Chlamydia trachomatis
auagaauggcgc

SEQ ID NO: 2486929 - RNA, 13 nt, Chlamydia trachomatis
auagaauggcgcu

SEQ ID NO: 2486930 - RNA, 15 nt, Chlamydia trachomatis
auagaauuucuuccu

SEQ ID NO: 2486931 - RNA, 20 nt, Chlamydia trachomatis
auagaauuuuucuaaaaucu

SEQ ID NO: 2486932 - RNA, 16 nt, Chlamydia trachomatis
auagacaagacuucuu

SEQ ID NO: 2486933 - RNA, 21 nt, Chlamydia trachomatis
auagacaagacuucuucuaaa

SEQ ID NO: 2486934 - RNA, 12 nt, Chlamydia trachomatis
auagacuucuuc

SEQ ID NO: 2486935 - RNA, 17 nt, Chlamydia trachomatis
auagagaacucgugaau

SEQ ID NO: 2486936 - RNA, 18 nt, Chlamydia trachomatis
auagaggcgccuacuucu

SEQ ID NO: 2486937 - RNA, 23 nt, Chlamydia trachomatis
auagauaacuuugaacaaauuua

SEQ ID NO: 2486938 - RNA, 13 nt, Chlamydia trachomatis
auagauagcucca

SEQ ID NO: 2486939 - RNA, 14 nt, Chlamydia trachomatis
auagaucuaaagca

SEQ ID NO: 2486940 - RNA, 20 nt, Chlamydia trachomatis
auagaugcgauguaaaugau

SEQ ID NO: 2486941 - RNA, 22 nt, Chlamydia trachomatis
auagcaaagaagacauggcucu

SEQ ID NO: 2486942 - RNA, 16 nt, Chlamydia trachomatis
auagcacccuuuuuau

SEQ ID NO: 2486943 - RNA, 18 nt, Chlamydia trachomatis
auagcacccuuuuuauaa

SEQ ID NO: 2486944 - RNA, 19 nt, Chlamydia trachomatis
auagcaggaacuucuucau

SEQ ID NO: 2486945 - RNA, 14 nt, Chlamydia trachomatis
auagcaggauuuuc

SEQ ID NO: 2486946 - RNA, 19 nt, Chlamydia trachomatis
auagcagggaacacagagu

SEQ ID NO: 2486947 - RNA, 15 nt, Chlamydia trachomatis
auagcaucuggaaca

SEQ ID NO: 2486948 - RNA, 16 nt, Chlamydia trachomatis
auagccauuaacaaca

SEQ ID NO: 2486949 - RNA, 18 nt, Chlamydia trachomatis
auagcgaaaaaucacaau

SEQ ID NO: 2486950 - RNA, 23 nt, Chlamydia trachomatis
auagcgcaguuuacugcaauaag

SEQ ID NO: 2486951 - RNA, 16 nt, Chlamydia trachomatis
auagcuacagcaauag

SEQ ID NO: 2486952 - RNA, 18 nt, Chlamydia trachomatis
auagcuacagcaauagag

SEQ ID NO: 2486953 - RNA, 16 nt, Chlamydia trachomatis
auagcucgcauuugua

SEQ ID NO: 2486954 - RNA, 20 nt, Chlamydia trachomatis
auagcuuaccucaauagcag

SEQ ID NO: 2486955 - RNA, 20 nt, Chlamydia trachomatis
auagcuuaucguuuggagaa

SEQ ID NO: 2486956 - RNA, 21 nt, Chlamydia trachomatis
auagcuucuaauuucuuucuc

SEQ ID NO: 2486957 - RNA, 19 nt, Chlamydia trachomatis
auagcuucuuaaauauaua

SEQ ID NO: 2486958 - RNA, 14 nt, Chlamydia trachomatis
auagcuugcacagc

SEQ ID NO: 2486959 - RNA, 16 nt, Chlamydia trachomatis
auaggaaaaagcuauc

SEQ ID NO: 2486960 - RNA, 20 nt, Chlamydia trachomatis
auaggaauacgaaaugacac

SEQ ID NO: 2486961 - RNA, 12 nt, Chlamydia trachomatis
auaggaauagcc

SEQ ID NO: 2486962 - RNA, 20 nt, Chlamydia trachomatis
auaggaauccaacgcuugca

SEQ ID NO: 2486963 - RNA, 16 nt, Chlamydia trachomatis
auaggcaggagaccac

SEQ ID NO: 2486964 - RNA, 16 nt, Chlamydia trachomatis
auaggcccguuuuuag

SEQ ID NO: 2486965 - RNA, 18 nt, Chlamydia trachomatis
auauuggaagauaacaau

SEQ ID NO: 2486966 - RNA, 22 nt, Chlamydia trachomatis
auauuggagccuacguccugau

SEQ ID NO: 2486967 - RNA, 13 nt, Chlamydia trachomatis
auauuuaagauag

SEQ ID NO: 2486968 - RNA, 19 nt, Chlamydia trachomatis
auauuucuuguguugaaua

SEQ ID NO: 2486969 - RNA, 20 nt, Chlamydia trachomatis
auauuucuuguguugaauaa

SEQ ID NO: 2486970 - RNA, 15 nt, Chlamydia trachomatis
auauuuugaagauaa

SEQ ID NO: 2486971 - RNA, 18 nt, Chlamydia trachomatis
auauuuuugggaaaaaau

SEQ ID NO: 2486972 - RNA, 21 nt, Chlamydia trachomatis
auauuuuugggaaaaaauuaa

SEQ ID NO: 2486973 - RNA, 13 nt, Chlamydia trachomatis
aucaaaaaguucu

SEQ ID NO: 2486974 - RNA, 18 nt, Chlamydia trachomatis
aucaaaacgcucagaaaa

SEQ ID NO: 2486975 - RNA, 20 nt, Chlamydia trachomatis
aucaaaacgcucagaaaacu

SEQ ID NO: 2486976 - RNA, 16 nt, Chlamydia trachomatis
aucaaaaucaauaaug

SEQ ID NO: 2486977 - RNA, 19 nt, Chlamydia trachomatis
aucaaaaucaauaaugucu

SEQ ID NO: 2486978 - RNA, 21 nt, Chlamydia trachomatis
aucaaagaaucuuugucuuug

SEQ ID NO: 2486979 - RNA, 19 nt, Chlamydia trachomatis
aucaaagagugugcuucug

SEQ ID NO: 2486980 - RNA, 18 nt, Chlamydia trachomatis
aucaaagaucuuucuaca

SEQ ID NO: 2486981 - RNA, 20 nt, Chlamydia trachomatis
aucaaagaucuuucuacauu

SEQ ID NO: 2486982 - RNA, 16 nt, Chlamydia trachomatis
aucaaaguagcaauca

SEQ ID NO: 2486983 - RNA, 17 nt, Chlamydia trachomatis
aucaaauuuuucagaaa

SEQ ID NO: 2486984 - RNA, 13 nt, Chlamydia trachomatis
aucaacagaagaa

SEQ ID NO: 2486985 - RNA, 17 nt, Chlamydia trachomatis
aucaacagaagaaggca

SEQ ID NO: 2486986 - RNA, 15 nt, Chlamydia trachomatis
aucaacguuuucacu

SEQ ID NO: 2486987 - RNA, 15 nt, Chlamydia trachomatis
aucaaggauaugugc

SEQ ID NO: 2486988 - RNA, 13 nt, Chlamydia trachomatis
aucaauaaagaag

SEQ ID NO: 2486989 - RNA, 14 nt, Chlamydia trachomatis
aucaauaaagaagc

SEQ ID NO: 2486990 - RNA, 16 nt, Chlamydia trachomatis
aucaauaaugucucca

SEQ ID NO: 2486991 - RNA, 16 nt, Chlamydia trachomatis
aucaauccgccuccgg

SEQ ID NO: 2486992 - RNA, 21 nt, Chlamydia trachomatis
aucaauuguucugcgaaagaa

SEQ ID NO: 2486993 - RNA, 22 nt, Chlamydia trachomatis
aucaauuguucugcgaaagaaa

SEQ ID NO: 2486994 - RNA, 23 nt, Chlamydia trachomatis
aucaauuguucugcgaaagaaac

SEQ ID NO: 2486995 - RNA, 23 nt, Chlamydia trachomatis
aucacaauuuuucuuugagaaag

SEQ ID NO: 2486996 - RNA, 14 nt, Chlamydia trachomatis
aucacagaaacgga

SEQ ID NO: 2486997 - RNA, 15 nt, Chlamydia trachomatis
aucacagauaaucag

SEQ ID NO: 2486998 - RNA, 20 nt, Chlamydia trachomatis
aucacagaucucaucaggau

SEQ ID NO: 2486999 - RNA, 18 nt, Chlamydia trachomatis
aucacagcaauagccauu

SEQ ID NO: 2487000 - RNA, 23 nt, Chlamydia trachomatis
aucacagcaauagccauuaacaa

SEQ ID NO: 2487001 - RNA, 23 nt, Chlamydia trachomatis
aucacaggcugugauggaaaugu

SEQ ID NO: 2487002 - RNA, 16 nt, Chlamydia trachomatis
aucacaugguuuucug

SEQ ID NO: 2487003 - RNA, 16 nt, Chlamydia trachomatis
aucaccgaacaaccuu

SEQ ID NO: 2487004 - RNA, 22 nt, Chlamydia trachomatis
aucacguaaugagaggugugaa

SEQ ID NO: 2487005 - RNA, 22 nt, Chlamydia trachomatis
aucacuaaaaguaguccuauca

SEQ ID NO: 2487006 - RNA, 19 nt, Chlamydia trachomatis
aucacuaucugcaaaagca

SEQ ID NO: 2487007 - RNA, 15 nt, Chlamydia trachomatis
aucacuccaagaaga

SEQ ID NO: 2487008 - RNA, 17 nt, Chlamydia trachomatis
aucacuccaagaagagu

SEQ ID NO: 2487009 - RNA, 15 nt, Chlamydia trachomatis
aucacuccuccuccu

SEQ ID NO: 2487010 - RNA, 20 nt, Chlamydia trachomatis
aucacugcaacuaauauuag

SEQ ID NO: 2487011 - RNA, 14 nt, Chlamydia trachomatis
aucacuuccuuuuc

SEQ ID NO: 2487012 - RNA, 17 nt, Chlamydia trachomatis
aucacuuccuuuucaau

SEQ ID NO: 2487013 - RNA, 21 nt, Chlamydia trachomatis
aucagaagauaguacccacug

SEQ ID NO: 2487014 - RNA, 16 nt, Chlamydia trachomatis
aucagaaguugagcaa

SEQ ID NO: 2487015 - RNA, 20 nt, Chlamydia trachomatis
aucagaaguugagcaacuau

SEQ ID NO: 2487016 - RNA, 13 nt, Chlamydia trachomatis
aucagagcaauag

SEQ ID NO: 2487017 - RNA, 22 nt, Chlamydia trachomatis
aucagcaaccauauauuuaggg

SEQ ID NO: 2487018 - RNA, 20 nt, Chlamydia trachomatis
aucagcacagcggacaauag

SEQ ID NO: 2487019 - RNA, 22 nt, Chlamydia trachomatis
aucagcagauauggaagaacag

SEQ ID NO: 2487020 - RNA, 16 nt, Chlamydia trachomatis
aucagccccaaaaaca

SEQ ID NO: 2487021 - RNA, 17 nt, Chlamydia trachomatis
aucagcgaaguuuucuu

SEQ ID NO: 2487022 - RNA, 23 nt, Chlamydia trachomatis
aucagcgcucauaggacaauuau

SEQ ID NO: 2487023 - RNA, 16 nt, Chlamydia trachomatis
aucagcguugggauag

SEQ ID NO: 2487024 - RNA, 22 nt, Chlamydia trachomatis
aucagcguugggauagaggaaa

SEQ ID NO: 2487025 - RNA, 16 nt, Chlamydia trachomatis
aucagcuguuccuuuu

SEQ ID NO: 2487026 - RNA, 17 nt, Chlamydia trachomatis
aucagcuguuccuuuua

SEQ ID NO: 2487027 - RNA, 21 nt, Chlamydia trachomatis
aucaggaaucacuaagucugu

SEQ ID NO: 2487028 - RNA, 16 nt, Chlamydia trachomatis
aucaggaucagcaugu

SEQ ID NO: 2487029 - RNA, 19 nt, Chlamydia trachomatis
aucaggaucagcauguacu

SEQ ID NO: 2487030 - RNA, 14 nt, Chlamydia trachomatis
aucaguaaaaauaa

SEQ ID NO: 2487031 - RNA, 14 nt, Chlamydia trachomatis
aucaguaaacacuu

SEQ ID NO: 2487032 - RNA, 14 nt, Chlamydia trachomatis
aucagucgcucugc

SEQ ID NO: 2487033 - RNA, 20 nt, Chlamydia trachomatis
aucaguggaacugcuucccu

SEQ ID NO: 2487034 - RNA, 21 nt, Chlamydia trachomatis
aucaguggaacugcuucccuc

SEQ ID NO: 2487035 - RNA, 13 nt, Chlamydia trachomatis
aucauaaaaagau

SEQ ID NO: 2487036 - RNA, 13 nt, Chlamydia trachomatis
aucauaaggaaga

SEQ ID NO: 2487037 - RNA, 13 nt, Chlamydia trachomatis
aucauaccaauau

SEQ ID NO: 2487038 - RNA, 19 nt, Chlamydia trachomatis
aucauagaaacgaggagau

SEQ ID NO: 2487039 - RNA, 15 nt, Chlamydia trachomatis
aucauagaaaugaug

SEQ ID NO: 2487040 - RNA, 21 nt, Chlamydia trachomatis
aucaucaaccgcgacagccac

SEQ ID NO: 2487041 - RNA, 22 nt, Chlamydia trachomatis
aucaucauggaaaauauggcuc

SEQ ID NO: 2487042 - RNA, 21 nt, Chlamydia trachomatis
aucauccauaaaaacugcugc

SEQ ID NO: 2487043 - RNA, 20 nt, Chlamydia trachomatis
aucaucucaagucuccacug

SEQ ID NO: 2487044 - RNA, 17 nt, Chlamydia trachomatis
aucaucuucaagagcug

SEQ ID NO: 2487045 - RNA, 15 nt, Chlamydia trachomatis
aucaugggaaauaaa

SEQ ID NO: 2487046 - RNA, 18 nt, Chlamydia trachomatis
aucaugggaaauaaauaa

SEQ ID NO: 2487047 - RNA, 15 nt, Chlamydia trachomatis
aucauguugcguuug

SEQ ID NO: 2487048 - RNA, 18 nt, Chlamydia trachomatis
aucauuauccauaaaaau

SEQ ID NO: 2487049 - RNA, 21 nt, Chlamydia trachomatis
aucauuauccauaaaaauaau

SEQ ID NO: 2487050 - RNA, 13 nt, Chlamydia trachomatis
aucauucaaaauc

SEQ ID NO: 2487051 - RNA, 15 nt, Chlamydia trachomatis
aucauucaucuuuac

SEQ ID NO: 2487052 - RNA, 16 nt, Chlamydia trachomatis
aucauucaucuuuacu

SEQ ID NO: 2487053 - RNA, 21 nt, Chlamydia trachomatis
aucauugggucugauccacca

SEQ ID NO: 2487054 - RNA, 13 nt, Chlamydia trachomatis
aucauuugccaaa

SEQ ID NO: 2487055 - RNA, 22 nt, Chlamydia trachomatis
aucauuuucuguaauuuuaaau

SEQ ID NO: 2487056 - RNA, 22 nt, Chlamydia trachomatis
auccaaaaaagaaucuaaaaag

SEQ ID NO: 2487057 - RNA, 20 nt, Chlamydia trachomatis
auccaaaaauugaaagagau

SEQ ID NO: 2487058 - RNA, 15 nt, Chlamydia trachomatis
auccaaggaaaccaa

SEQ ID NO: 2487059 - RNA, 16 nt, Chlamydia trachomatis
auccaaggaaaccaag

SEQ ID NO: 2487060 - RNA, 15 nt, Chlamydia trachomatis
auccaauccuuggca

SEQ ID NO: 2487061 - RNA, 16 nt, Chlamydia trachomatis
auccaauguaaaauga

SEQ ID NO: 2487062 - RNA, 23 nt, Chlamydia trachomatis
auccaccguacgauauccaucau

SEQ ID NO: 2487063 - RNA, 17 nt, Chlamydia trachomatis
auccacuacugucagac

SEQ ID NO: 2487064 - RNA, 18 nt, Chlamydia trachomatis
auccacuuuuaggauagu

SEQ ID NO: 2487065 - RNA, 14 nt, Chlamydia trachomatis
auccagaaagagcg

SEQ ID NO: 2487066 - RNA, 17 nt, Chlamydia trachomatis
auccagaaguuuuaaca

SEQ ID NO: 2487067 - RNA, 22 nt, Chlamydia trachomatis
auccagauccguuaaagagucu

SEQ ID NO: 2487068 - RNA, 20 nt, Chlamydia trachomatis
auccaguucuggagcaacaa

SEQ ID NO: 2487069 - RNA, 22 nt, Chlamydia trachomatis
auccauaauuuucuucacuucc

SEQ ID NO: 2487070 - RNA, 12 nt, Chlamydia trachomatis
auccauauauuc

SEQ ID NO: 2487071 - RNA, 21 nt, Chlamydia trachomatis
auccauauauucagaagaaga

SEQ ID NO: 2487072 - RNA, 15 nt, Chlamydia trachomatis
auccauauccaugaa

SEQ ID NO: 2487073 - RNA, 15 nt, Chlamydia trachomatis
auccaucauaaaaag

SEQ ID NO: 2487074 - RNA, 16 nt, Chlamydia trachomatis
auccaucauaaaaaga

SEQ ID NO: 2487075 - RNA, 11 nt, Chlamydia trachomatis
auccaucucuc

SEQ ID NO: 2487076 - RNA, 21 nt, Chlamydia trachomatis
aucuagacauagcuuguuccg

SEQ ID NO: 2487077 - RNA, 17 nt, Chlamydia trachomatis
aucuagaggaaugugaa

SEQ ID NO: 2487078 - RNA, 12 nt, Chlamydia trachomatis
aucuauaggaug

SEQ ID NO: 2487079 - RNA, 21 nt, Chlamydia trachomatis
aucuaucuggaucuugggaac

SEQ ID NO: 2487080 - RNA, 15 nt, Chlamydia trachomatis
aucuauuuuauacuu

SEQ ID NO: 2487081 - RNA, 15 nt, Chlamydia trachomatis
aucucaaaaacacua

SEQ ID NO: 2487082 - RNA, 17 nt, Chlamydia trachomatis
aucucaaaguuuuuguu

SEQ ID NO: 2487083 - RNA, 15 nt, Chlamydia trachomatis
aucucaagucuccac

SEQ ID NO: 2487084 - RNA, 22 nt, Chlamydia trachomatis
aucucaaugagcgcuuuuucuu

SEQ ID NO: 2487085 - RNA, 16 nt, Chlamydia trachomatis
aucucaggauaaaacc

SEQ ID NO: 2487086 - RNA, 13 nt, Chlamydia trachomatis
aucuccaaagaca

SEQ ID NO: 2487087 - RNA, 15 nt, Chlamydia trachomatis
aucuccaacagugac

SEQ ID NO: 2487088 - RNA, 13 nt, Chlamydia trachomatis
aucuccaaucaca

SEQ ID NO: 2487089 - RNA, 19 nt, Chlamydia trachomatis
aucuccaaucacagcaaua

SEQ ID NO: 2487090 - RNA, 18 nt, Chlamydia trachomatis
aucuccaugauccccuac

SEQ ID NO: 2487091 - RNA, 19 nt, Chlamydia trachomatis
aucucccucaccucuugcc

SEQ ID NO: 2487092 - RNA, 20 nt, Chlamydia trachomatis
aucucccucaccucuugccu

SEQ ID NO: 2487093 - RNA, 15 nt, Chlamydia trachomatis
aucucccucauuuaa

SEQ ID NO: 2487094 - RNA, 23 nt, Chlamydia trachomatis
aucuccgcuaggcaaauauccua

SEQ ID NO: 2487095 - RNA, 14 nt, Chlamydia trachomatis
aucuccuaagacaa

SEQ ID NO: 2487096 - RNA, 15 nt, Chlamydia trachomatis
aucuccuaagacaag

SEQ ID NO: 2487097 - RNA, 14 nt, Chlamydia trachomatis
aucuccucauccuu

SEQ ID NO: 2487098 - RNA, 16 nt, Chlamydia trachomatis
aucuccucauccuuuu

SEQ ID NO: 2487099 - RNA, 13 nt, Chlamydia trachomatis
aucuccuccuauu

SEQ ID NO: 2487100 - RNA, 20 nt, Chlamydia trachomatis
aucuccucuggagccgucug

SEQ ID NO: 2487101 - RNA, 22 nt, Chlamydia trachomatis
aucuccuuccucuuuaaccaga

SEQ ID NO: 2487102 - RNA, 17 nt, Chlamydia trachomatis
aucuccuuugcuaacaa

SEQ ID NO: 2487103 - RNA, 18 nt, Chlamydia trachomatis
aucuccuuugcuaacaaa

SEQ ID NO: 2487104 - RNA, 20 nt, Chlamydia trachomatis
aucuccuuugcuaacaaaga

SEQ ID NO: 2487105 - RNA, 21 nt, Chlamydia trachomatis
aucuccuuugcuaacaaagaa

SEQ ID NO: 2487106 - RNA, 13 nt, Chlamydia trachomatis
aucucgaaagacu

SEQ ID NO: 2487107 - RNA, 18 nt, Chlamydia trachomatis
aucucgagcuaagaaaau

SEQ ID NO: 2487108 - RNA, 15 nt, Chlamydia trachomatis
aucucgagucaagaa

SEQ ID NO: 2487109 - RNA, 16 nt, Chlamydia trachomatis
aucucguucuacagga

SEQ ID NO: 2487110 - RNA, 13 nt, Chlamydia trachomatis
aucucucagcaga

SEQ ID NO: 2487111 - RNA, 22 nt, Chlamydia trachomatis
aucucuccagaguucauuuuuu

SEQ ID NO: 2487112 - RNA, 15 nt, Chlamydia trachomatis
aucucugaaagagcu

SEQ ID NO: 2487113 - RNA, 19 nt, Chlamydia trachomatis
aucucugaaagagcuucuu

SEQ ID NO: 2487114 - RNA, 20 nt, Chlamydia trachomatis
aucucugcaacaaagaguuu

SEQ ID NO: 2487115 - RNA, 15 nt, Chlamydia trachomatis
aucucugcagaagaa

SEQ ID NO: 2487116 - RNA, 24 nt, Chlamydia trachomatis
aucucugguaaaaauagaaaacgu

SEQ ID NO: 2487117 - RNA, 16 nt, Chlamydia trachomatis
aucucuucacagguau

SEQ ID NO: 2487118 - RNA, 20 nt, Chlamydia trachomatis
aucucuuuaagcugggaaag

SEQ ID NO: 2487119 - RNA, 15 nt, Chlamydia trachomatis
aucucuuuuaccucu

SEQ ID NO: 2487120 - RNA, 18 nt, Chlamydia trachomatis
aucugaaaagagaagaag

SEQ ID NO: 2487121 - RNA, 13 nt, Chlamydia trachomatis
aucugagaaagcu

SEQ ID NO: 2487122 - RNA, 18 nt, Chlamydia trachomatis
aucugaugcaccauaaua

SEQ ID NO: 2487123 - RNA, 22 nt, Chlamydia trachomatis
aucugcaacaaauaccaaaaua

SEQ ID NO: 2487124 - RNA, 15 nt, Chlamydia trachomatis
aucugcaucuuuaua

SEQ ID NO: 2487125 - RNA, 16 nt, Chlamydia trachomatis
aucugcgguauccaua

SEQ ID NO: 2487126 - RNA, 17 nt, Chlamydia trachomatis
aucugcgguauccauac

SEQ ID NO: 2487127 - RNA, 21 nt, Chlamydia trachomatis
aucugcuaauaguucucugca

SEQ ID NO: 2487128 - RNA, 20 nt, Chlamydia trachomatis
aucugcuaguccuccuguag

SEQ ID NO: 2487129 - RNA, 18 nt, Chlamydia trachomatis
aucugcuauagaaagcaa

SEQ ID NO: 2487130 - RNA, 19 nt, Chlamydia trachomatis
aucugcuuccguaacaaua

SEQ ID NO: 2487131 - RNA, 14 nt, Chlamydia trachomatis
aucuggaguggcau

SEQ ID NO: 2487132 - RNA, 22 nt, Chlamydia trachomatis
aucugggaggagaacucuuucc

SEQ ID NO: 2487133 - RNA, 14 nt, Chlamydia trachomatis
aucugggauauaua

SEQ ID NO: 2487134 - RNA, 18 nt, Chlamydia trachomatis
aucugggauggaaauaau

SEQ ID NO: 2487135 - RNA, 12 nt, Chlamydia trachomatis
aucugguauucu

SEQ ID NO: 2487136 - RNA, 16 nt, Chlamydia trachomatis
aucuguaaugugaugc

SEQ ID NO: 2487137 - RNA, 21 nt, Chlamydia trachomatis
aucuguaaugugaugcggagc

SEQ ID NO: 2487138 - RNA, 19 nt, Chlamydia trachomatis
aucuguagagagccccacc

SEQ ID NO: 2487139 - RNA, 16 nt, Chlamydia trachomatis
aucuguaggggaggga

SEQ ID NO: 2487140 - RNA, 23 nt, Chlamydia trachomatis
aucuguauggcagacaaaacaag

SEQ ID NO: 2487141 - RNA, 15 nt, Chlamydia trachomatis
aucugucagucuucu

SEQ ID NO: 2487142 - RNA, 15 nt, Chlamydia trachomatis
aucuguccaaagaga

SEQ ID NO: 2487143 - RNA, 22 nt, Chlamydia trachomatis
aucuuaaacaagaucuaucuau

SEQ ID NO: 2487144 - RNA, 17 nt, Chlamydia trachomatis
aucuuauguucagcauc

SEQ ID NO: 2487145 - RNA, 15 nt, Chlamydia trachomatis
aucuucaaagaacaa

SEQ ID NO: 2487146 - RNA, 14 nt, Chlamydia trachomatis
aucuucaacaagau

SEQ ID NO: 2487147 - RNA, 16 nt, Chlamydia trachomatis
aucuucaacaagauuu

SEQ ID NO: 2487148 - RNA, 20 nt, Chlamydia trachomatis
aucuucaauggcaaaacuuc

SEQ ID NO: 2487149 - RNA, 18 nt, Chlamydia trachomatis
aucuucagaagcggcaug

SEQ ID NO: 2487150 - RNA, 21 nt, Chlamydia trachomatis
aucuuccaaaggauauacaga

SEQ ID NO: 2487151 - RNA, 16 nt, Chlamydia trachomatis
aucuuccggaaggaug

SEQ ID NO: 2487152 - RNA, 21 nt, Chlamydia trachomatis
aucuucggacauugaacauuu

SEQ ID NO: 2487153 - RNA, 16 nt, Chlamydia trachomatis
aucuucuaaaugcugu

SEQ ID NO: 2487154 - RNA, 16 nt, Chlamydia trachomatis
aucuucucgaaagaga

SEQ ID NO: 2487155 - RNA, 23 nt, Chlamydia trachomatis
aucuucucgaaagagaacacgua

SEQ ID NO: 2487156 - RNA, 14 nt, Chlamydia trachomatis
aucuucugaaaaau

SEQ ID NO: 2487157 - RNA, 23 nt, Chlamydia trachomatis
aucuucuggagcaacuucuaaga

SEQ ID NO: 2487158 - RNA, 11 nt, Chlamydia trachomatis
aucuucuucua

SEQ ID NO: 2487159 - RNA, 17 nt, Chlamydia trachomatis
aucuucuugagaaaacu

SEQ ID NO: 2487160 - RNA, 16 nt, Chlamydia trachomatis
aucuugcacauuuucu

SEQ ID NO: 2487161 - RNA, 19 nt, Chlamydia trachomatis
aucuugguuauacagagca

SEQ ID NO: 2487162 - RNA, 14 nt, Chlamydia trachomatis
aucuuguguaguau

SEQ ID NO: 2487163 - RNA, 13 nt, Chlamydia trachomatis
aucuuuaagcucu

SEQ ID NO: 2487164 - RNA, 16 nt, Chlamydia trachomatis
aucuuuagaauccaaa

SEQ ID NO: 2487165 - RNA, 19 nt, Chlamydia trachomatis
aucuuuauagaauuuuucu

SEQ ID NO: 2487166 - RNA, 16 nt, Chlamydia trachomatis
aucuuuauuuuuuccg

SEQ ID NO: 2487167 - RNA, 18 nt, Chlamydia trachomatis
aucuuuccaauaucuuca

SEQ ID NO: 2487168 - RNA, 19 nt, Chlamydia trachomatis
aucuuucgaauuggaucuc

SEQ ID NO: 2487169 - RNA, 21 nt, Chlamydia trachomatis
aucuuugaagguaagaaaguc

SEQ ID NO: 2487170 - RNA, 22 nt, Chlamydia trachomatis
aucuuugauagcaacaguuuug

SEQ ID NO: 2487171 - RNA, 15 nt, Chlamydia trachomatis
aucuuuguucucuaa

SEQ ID NO: 2487172 - RNA, 17 nt, Chlamydia trachomatis
aucuuuuugauuuuucu

SEQ ID NO: 2487173 - RNA, 15 nt, Chlamydia trachomatis
augaaaaagccugug

SEQ ID NO: 2487174 - RNA, 13 nt, Chlamydia trachomatis
augaaaaauccuu

SEQ ID NO: 2487175 - RNA, 13 nt, Chlamydia trachomatis
augaaaagcuuuc

SEQ ID NO: 2487176 - RNA, 22 nt, Chlamydia trachomatis
augaaaccuaauagaaauagcu

SEQ ID NO: 2487177 - RNA, 22 nt, Chlamydia trachomatis
augaaacucuuuuuaaaucaau

SEQ ID NO: 2487178 - RNA, 14 nt, Chlamydia trachomatis
augaaagagcuuag

SEQ ID NO: 2487179 - RNA, 13 nt, Chlamydia trachomatis
augaaagcgugca

SEQ ID NO: 2487180 - RNA, 16 nt, Chlamydia trachomatis
augaaauaucauuccc

SEQ ID NO: 2487181 - RNA, 18 nt, Chlamydia trachomatis
augaaauaucguaaccag

SEQ ID NO: 2487182 - RNA, 14 nt, Chlamydia trachomatis
augaacaacauaaa

SEQ ID NO: 2487183 - RNA, 15 nt, Chlamydia trachomatis
augaacagcaagagg

SEQ ID NO: 2487184 - RNA, 17 nt, Chlamydia trachomatis
augaaccgcagcaacau

SEQ ID NO: 2487185 - RNA, 19 nt, Chlamydia trachomatis
augaagacccguuuucucu

SEQ ID NO: 2487186 - RNA, 15 nt, Chlamydia trachomatis
augaagcuaaaaaau

SEQ ID NO: 2487187 - RNA, 20 nt, Chlamydia trachomatis
augaaggccaaagaaauagc

SEQ ID NO: 2487188 - RNA, 14 nt, Chlamydia trachomatis
augguauagaagac

SEQ ID NO: 2487189 - RNA, 17 nt, Chlamydia trachomatis
augguccaugauuucuu

SEQ ID NO: 2487190 - RNA, 22 nt, Chlamydia trachomatis
auggucgucucagcuucaaccu

SEQ ID NO: 2487191 - RNA, 17 nt, Chlamydia trachomatis
auggucuccuaaauccu

SEQ ID NO: 2487192 - RNA, 15 nt, Chlamydia trachomatis
auggugaaacuuucc

SEQ ID NO: 2487193 - RNA, 19 nt, Chlamydia trachomatis
auggugcggagcaucccac

SEQ ID NO: 2487194 - RNA, 15 nt, Chlamydia trachomatis
augguuacuugccuc

SEQ ID NO: 2487195 - RNA, 21 nt, Chlamydia trachomatis
auguaaaaugagaaauaaaaa

SEQ ID NO: 2487196 - RNA, 21 nt, Chlamydia trachomatis
auguaaacaauauucuuuucc

SEQ ID NO: 2487197 - RNA, 20 nt, Chlamydia trachomatis
auguaaacguauagcaaugc

SEQ ID NO: 2487198 - RNA, 13 nt, Chlamydia trachomatis
auguaaauauuuu

SEQ ID NO: 2487199 - RNA, 12 nt, Chlamydia trachomatis
auguaaaugaug

SEQ ID NO: 2487200 - RNA, 23 nt, Chlamydia trachomatis
auguaaauuuucaauagcaauga

SEQ ID NO: 2487201 - RNA, 12 nt, Chlamydia trachomatis
auguaagaguuu

SEQ ID NO: 2487202 - RNA, 16 nt, Chlamydia trachomatis
auguaagcgagauaag

SEQ ID NO: 2487203 - RNA, 19 nt, Chlamydia trachomatis
auguaagcgagauaaggac

SEQ ID NO: 2487204 - RNA, 21 nt, Chlamydia trachomatis
auguaagguuugucuucagau

SEQ ID NO: 2487205 - RNA, 20 nt, Chlamydia trachomatis
auguaagucuauaauaugaa

SEQ ID NO: 2487206 - RNA, 23 nt, Chlamydia trachomatis
auguaauugggggacuucauuaa

SEQ ID NO: 2487207 - RNA, 14 nt, Chlamydia trachomatis
auguacgcucuuuc

SEQ ID NO: 2487208 - RNA, 13 nt, Chlamydia trachomatis
auguagaaauuuu

SEQ ID NO: 2487209 - RNA, 17 nt, Chlamydia trachomatis
auguagaaauuuuaaau

SEQ ID NO: 2487210 - RNA, 15 nt, Chlamydia trachomatis
auguagccaaggaag

SEQ ID NO: 2487211 - RNA, 16 nt, Chlamydia trachomatis
auguagccaaggaaga

SEQ ID NO: 2487212 - RNA, 20 nt, Chlamydia trachomatis
auguaggagcgaaaucgaaa

SEQ ID NO: 2487213 - RNA, 11 nt, Chlamydia trachomatis
auguaggguuu

SEQ ID NO: 2487214 - RNA, 22 nt, Chlamydia trachomatis
auguccacaaggagauauuucc

SEQ ID NO: 2487215 - RNA, 12 nt, Chlamydia trachomatis
auguccucuuua

SEQ ID NO: 2487216 - RNA, 21 nt, Chlamydia trachomatis
auguccucuuuaucuaaagaa

SEQ ID NO: 2487217 - RNA, 22 nt, Chlamydia trachomatis
augucuccaggagagucugcua

SEQ ID NO: 2487218 - RNA, 18 nt, Chlamydia trachomatis
augucugcgguacaggca

SEQ ID NO: 2487219 - RNA, 16 nt, Chlamydia trachomatis
augucuguugaaagcu

SEQ ID NO: 2487220 - RNA, 12 nt, Chlamydia trachomatis
augucuuuuuca

SEQ ID NO: 2487221 - RNA, 22 nt, Chlamydia trachomatis
augugaugcggagcgaugagcu

SEQ ID NO: 2487222 - RNA, 15 nt, Chlamydia trachomatis
augugcaagauauuc

SEQ ID NO: 2487223 - RNA, 21 nt, Chlamydia trachomatis
augugcaagauauucccuaaa

SEQ ID NO: 2487224 - RNA, 20 nt, Chlamydia trachomatis
augugcuaguauuaaacuuc

SEQ ID NO: 2487225 - RNA, 15 nt, Chlamydia trachomatis
augugcucauuuccu

SEQ ID NO: 2487226 - RNA, 19 nt, Chlamydia trachomatis
auguggguaugucugugau

SEQ ID NO: 2487227 - RNA, 12 nt, Chlamydia trachomatis
auguuaaagccc

SEQ ID NO: 2487228 - RNA, 15 nt, Chlamydia trachomatis
auguuccaucuuuuc

SEQ ID NO: 2487229 - RNA, 14 nt, Chlamydia trachomatis
auguuccccauuca

SEQ ID NO: 2487230 - RNA, 21 nt, Chlamydia trachomatis
auguucuauauacauuaugua

SEQ ID NO: 2487231 - RNA, 15 nt, Chlamydia trachomatis
auguucugugaaaua

SEQ ID NO: 2487232 - RNA, 22 nt, Chlamydia trachomatis
auguucugugggauagaaacuc

SEQ ID NO: 2487233 - RNA, 19 nt, Chlamydia trachomatis
auguucuuaauaaucugug

SEQ ID NO: 2487234 - RNA, 15 nt, Chlamydia trachomatis
auguugugugaugaa

SEQ ID NO: 2487235 - RNA, 22 nt, Chlamydia trachomatis
auguuuacgaggagguuaccac

SEQ ID NO: 2487236 - RNA, 22 nt, Chlamydia trachomatis
auguuucccuucuuucuucuaa

SEQ ID NO: 2487237 - RNA, 16 nt, Chlamydia trachomatis
auguuucuuauuugcc

SEQ ID NO: 2487238 - RNA, 19 nt, Chlamydia trachomatis
auguuugaucugagaaagc

SEQ ID NO: 2487239 - RNA, 23 nt, Chlamydia trachomatis
auuaaaaaggcuagagauaucac

SEQ ID NO: 2487240 - RNA, 16 nt, Chlamydia trachomatis
auuaaaacaauaguga

SEQ ID NO: 2487241 - RNA, 17 nt, Chlamydia trachomatis
auuaaaagaccucuuuu

SEQ ID NO: 2487242 - RNA, 20 nt, Chlamydia trachomatis
auuaaaagaccucuuuuuuu

SEQ ID NO: 2487243 - RNA, 20 nt, Chlamydia trachomatis
auuaaaccacccuucccaac

SEQ ID NO: 2487244 - RNA, 21 nt, Chlamydia trachomatis
auuaaacuaugcaaaguuucu

SEQ ID NO: 2487245 - RNA, 23 nt, Chlamydia trachomatis
auuaaacuaugcaaaguuucuga

SEQ ID NO: 2487246 - RNA, 12 nt, Chlamydia trachomatis
auuaaagcuuua

SEQ ID NO: 2487247 - RNA, 17 nt, Chlamydia trachomatis
auuaaaucgugagcguc

SEQ ID NO: 2487248 - RNA, 14 nt, Chlamydia trachomatis
auuaacaacaaugu

SEQ ID NO: 2487249 - RNA, 14 nt, Chlamydia trachomatis
auuaacaggaagaa

SEQ ID NO: 2487250 - RNA, 17 nt, Chlamydia trachomatis
auuaacaggaagaauau

SEQ ID NO: 2487251 - RNA, 21 nt, Chlamydia trachomatis
auuaacccaaaagauccauuu

SEQ ID NO: 2487252 - RNA, 15 nt, Chlamydia trachomatis
auuaagaaucuuuga

SEQ ID NO: 2487253 - RNA, 16 nt, Chlamydia trachomatis
auuaauaacgcccucu

SEQ ID NO: 2487254 - RNA, 16 nt, Chlamydia trachomatis
auuacaauaauacaaa

SEQ ID NO: 2487255 - RNA, 19 nt, Chlamydia trachomatis
auuacacaacucuuuuccu

SEQ ID NO: 2487256 - RNA, 17 nt, Chlamydia trachomatis
auuacagcaagaagaag

SEQ ID NO: 2487257 - RNA, 20 nt, Chlamydia trachomatis
auuacagcaagaagaagaga

SEQ ID NO: 2487258 - RNA, 16 nt, Chlamydia trachomatis
auuacauugcaguaca

SEQ ID NO: 2487259 - RNA, 20 nt, Chlamydia trachomatis
auuacauugcaguacaucug

SEQ ID NO: 2487260 - RNA, 16 nt, Chlamydia trachomatis
auuaccauaucaaaaa

SEQ ID NO: 2487261 - RNA, 13 nt, Chlamydia trachomatis
auuacgaauagcc

SEQ ID NO: 2487262 - RNA, 14 nt, Chlamydia trachomatis
auuacuacaacagg

SEQ ID NO: 2487263 - RNA, 23 nt, Chlamydia trachomatis
auuacucguuaucuaggaagaag

SEQ ID NO: 2487264 - RNA, 21 nt, Chlamydia trachomatis
auuacugacugguuccccaag

SEQ ID NO: 2487265 - RNA, 13 nt, Chlamydia trachomatis
auuacuucagcaa

SEQ ID NO: 2487266 - RNA, 19 nt, Chlamydia trachomatis
auuacuucagcaacauuca

SEQ ID NO: 2487267 - RNA, 16 nt, Chlamydia trachomatis
auuacuugagaacaaa

SEQ ID NO: 2487268 - RNA, 13 nt, Chlamydia trachomatis
auuacuuuuucua

SEQ ID NO: 2487269 - RNA, 20 nt, Chlamydia trachomatis
auuagaaaaagggagaggau

SEQ ID NO: 2487270 - RNA, 13 nt, Chlamydia trachomatis
auuagacacuaaa

SEQ ID NO: 2487271 - RNA, 17 nt, Chlamydia trachomatis
auuagcgggagaaggau

SEQ ID NO: 2487272 - RNA, 17 nt, Chlamydia trachomatis
auuagggaaaaacuuuu

SEQ ID NO: 2487273 - RNA, 17 nt, Chlamydia trachomatis
auuaguaauaaaggaaa

SEQ ID NO: 2487274 - RNA, 18 nt, Chlamydia trachomatis
auuaguaauaaaggaaac

SEQ ID NO: 2487275 - RNA, 13 nt, Chlamydia trachomatis
auuaucuaaaaaa

SEQ ID NO: 2487276 - RNA, 19 nt, Chlamydia trachomatis
auuaucuagaaaagagcag

SEQ ID NO: 2487277 - RNA, 16 nt, Chlamydia trachomatis
auuaucuccuaagaca

SEQ ID NO: 2487278 - RNA, 20 nt, Chlamydia trachomatis
auuaugauuccgcugcucua

SEQ ID NO: 2487279 - RNA, 15 nt, Chlamydia trachomatis
auucaaaauagcagu

SEQ ID NO: 2487280 - RNA, 17 nt, Chlamydia trachomatis
auucaaaucuucuucua

SEQ ID NO: 2487281 - RNA, 13 nt, Chlamydia trachomatis
auucaaccucuca

SEQ ID NO: 2487282 - RNA, 17 nt, Chlamydia trachomatis
auucaagaccaaaagua

SEQ ID NO: 2487283 - RNA, 20 nt, Chlamydia trachomatis
auucaagguuuuaagaccua

SEQ ID NO: 2487284 - RNA, 15 nt, Chlamydia trachomatis
auucaauccagacuc

SEQ ID NO: 2487285 - RNA, 16 nt, Chlamydia trachomatis
auucaauccagacucu

SEQ ID NO: 2487286 - RNA, 17 nt, Chlamydia trachomatis
auucacacuuaaaaaga

SEQ ID NO: 2487287 - RNA, 19 nt, Chlamydia trachomatis
auucacacuuaaaaagaaa

SEQ ID NO: 2487288 - RNA, 15 nt, Chlamydia trachomatis
auucacccaaauaua

SEQ ID NO: 2487289 - RNA, 21 nt, Chlamydia trachomatis
auucacccaaauauacucaac

SEQ ID NO: 2487290 - RNA, 13 nt, Chlamydia trachomatis
auucacuucaacu

SEQ ID NO: 2487291 - RNA, 17 nt, Chlamydia trachomatis
auucagaacaagugcag

SEQ ID NO: 2487292 - RNA, 18 nt, Chlamydia trachomatis
auucagaacaagugcagc

SEQ ID NO: 2487293 - RNA, 13 nt, Chlamydia trachomatis
auucagcaaaaaa

SEQ ID NO: 2487294 - RNA, 16 nt, Chlamydia trachomatis
auucaggcucuuucag

SEQ ID NO: 2487295 - RNA, 20 nt, Chlamydia trachomatis
auucaggcucuuucagagaa

SEQ ID NO: 2487296 - RNA, 16 nt, Chlamydia trachomatis
auucaguucgaaguuc

SEQ ID NO: 2487297 - RNA, 15 nt, Chlamydia trachomatis
auucaucaaaauauu

SEQ ID NO: 2487298 - RNA, 17 nt, Chlamydia trachomatis
auucaucaaaauauuuu

SEQ ID NO: 2487299 - RNA, 15 nt, Chlamydia trachomatis
auucaucuauuuuua

SEQ ID NO: 2487300 - RNA, 15 nt, Chlamydia trachomatis
auuuaauaaguuuuu

SEQ ID NO: 2487301 - RNA, 18 nt, Chlamydia trachomatis
auuuacaaacgaagcugc

SEQ ID NO: 2487302 - RNA, 17 nt, Chlamydia trachomatis
auuuacgaaguauuuuc

SEQ ID NO: 2487303 - RNA, 10 nt, Chlamydia trachomatis
auuuauauca

SEQ ID NO: 2487304 - RNA, 17 nt, Chlamydia trachomatis
auuuauaucaucgaaug

SEQ ID NO: 2487305 - RNA, 19 nt, Chlamydia trachomatis
auuuaucggcuaacgaguu

SEQ ID NO: 2487306 - RNA, 18 nt, Chlamydia trachomatis
auuuaucugcuaaagaaa

SEQ ID NO: 2487307 - RNA, 13 nt, Chlamydia trachomatis
auuuaucugcuau

SEQ ID NO: 2487308 - RNA, 23 nt, Chlamydia trachomatis
auuuauuggcggcaguuucuagg

SEQ ID NO: 2487309 - RNA, 15 nt, Chlamydia trachomatis
auuucagcaucaaua

SEQ ID NO: 2487310 - RNA, 18 nt, Chlamydia trachomatis
auuuccaacaaaaagcgc

SEQ ID NO: 2487311 - RNA, 17 nt, Chlamydia trachomatis
auuuccagcauuuuaaa

SEQ ID NO: 2487312 - RNA, 19 nt, Chlamydia trachomatis
auuuccagccucuccagaa

SEQ ID NO: 2487313 - RNA, 17 nt, Chlamydia trachomatis
auuuccauagaaagaua

SEQ ID NO: 2487314 - RNA, 11 nt, Chlamydia trachomatis
auuuccaugaa

SEQ ID NO: 2487315 - RNA, 15 nt, Chlamydia trachomatis
auuuccauggagcuu

SEQ ID NO: 2487316 - RNA, 14 nt, Chlamydia trachomatis
auuuccccuacaaa

SEQ ID NO: 2487317 - RNA, 16 nt, Chlamydia trachomatis
auuuccccuacaaaca

SEQ ID NO: 2487318 - RNA, 23 nt, Chlamydia trachomatis
auuuccuaccaucaauccuggaa

SEQ ID NO: 2487319 - RNA, 21 nt, Chlamydia trachomatis
auuuccuacucggccagagcu

SEQ ID NO: 2487320 - RNA, 13 nt, Chlamydia trachomatis
auuuccucuucua

SEQ ID NO: 2487321 - RNA, 14 nt, Chlamydia trachomatis
auuuccugcaagca

SEQ ID NO: 2487322 - RNA, 18 nt, Chlamydia trachomatis
auuuccuuagaaagaauu

SEQ ID NO: 2487323 - RNA, 14 nt, Chlamydia trachomatis
auuucuaaauauuu

SEQ ID NO: 2487324 - RNA, 19 nt, Chlamydia trachomatis
auuucuauagaagaauucg

SEQ ID NO: 2487325 - RNA, 21 nt, Chlamydia trachomatis
auuucuccagcaucuuuucuu

SEQ ID NO: 2487326 - RNA, 17 nt, Chlamydia trachomatis
auuucucgucaggggau

SEQ ID NO: 2487327 - RNA, 11 nt, Chlamydia trachomatis
auuucucucca

SEQ ID NO: 2487328 - RNA, 13 nt, Chlamydia trachomatis
auuucucuccaaa

SEQ ID NO: 2487329 - RNA, 22 nt, Chlamydia trachomatis
auuucucucgcugcgagagagc

SEQ ID NO: 2487330 - RNA, 21 nt, Chlamydia trachomatis
auuucugggaaaauuaaaagg

SEQ ID NO: 2487331 - RNA, 18 nt, Chlamydia trachomatis
auuucuguaaggcaggau

SEQ ID NO: 2487332 - RNA, 23 nt, Chlamydia trachomatis
auuucugucuuagcaaagaaaua

SEQ ID NO: 2487333 - RNA, 23 nt, Chlamydia trachomatis
auuucuuaaaagcacaauaacag

SEQ ID NO: 2487334 - RNA, 12 nt, Chlamydia trachomatis
auuucuuccucu

SEQ ID NO: 2487335 - RNA, 22 nt, Chlamydia trachomatis
auuucuucuggcgaaucaauuu

SEQ ID NO: 2487336 - RNA, 15 nt, Chlamydia trachomatis
auuucuucuguagcc

SEQ ID NO: 2487337 - RNA, 12 nt, Chlamydia trachomatis
auuucuucuuug

SEQ ID NO: 2487338 - RNA, 15 nt, Chlamydia trachomatis
auuucuuucucaugc

SEQ ID NO: 2487339 - RNA, 13 nt, Chlamydia trachomatis
auuugaaaucaaa

SEQ ID NO: 2487340 - RNA, 22 nt, Chlamydia trachomatis
auuugacucucauaagaauaca

SEQ ID NO: 2487341 - RNA, 18 nt, Chlamydia trachomatis
auuugaucuucuggaaug

SEQ ID NO: 2487342 - RNA, 18 nt, Chlamydia trachomatis
auuugcccagucaagagc

SEQ ID NO: 2487343 - RNA, 15 nt, Chlamydia trachomatis
auuugcguuacagau

SEQ ID NO: 2487344 - RNA, 17 nt, Chlamydia trachomatis
auuugcguuacagaugc

SEQ ID NO: 2487345 - RNA, 18 nt, Chlamydia trachomatis
auuugcuacaguaucugc

SEQ ID NO: 2487346 - RNA, 21 nt, Chlamydia trachomatis
auuugcucgcaauagauaguc

SEQ ID NO: 2487347 - RNA, 20 nt, Chlamydia trachomatis
auuugcucuuccaacaauuu

SEQ ID NO: 2487348 - RNA, 14 nt, Chlamydia trachomatis
auuuggaucucuua

SEQ ID NO: 2487349 - RNA, 15 nt, Chlamydia trachomatis
auuuggauuagaaaa

SEQ ID NO: 2487350 - RNA, 17 nt, Chlamydia trachomatis
auuuggcaauggcaaaa

SEQ ID NO: 2487351 - RNA, 21 nt, Chlamydia trachomatis
auuuggcaauggcaaaaucuu

SEQ ID NO: 2487352 - RNA, 17 nt, Chlamydia trachomatis
auuuggcguauuucuug

SEQ ID NO: 2487353 - RNA, 15 nt, Chlamydia trachomatis
auuuguaccaaccca

SEQ ID NO: 2487354 - RNA, 24 nt, Chlamydia trachomatis
auuugucuucgcaaacugcucuuc

SEQ ID NO: 2487355 - RNA, 12 nt, Chlamydia trachomatis
auuugugugcaa

SEQ ID NO: 2487356 - RNA, 13 nt, Chlamydia trachomatis
auuugugugccaa

SEQ ID NO: 2487357 - RNA, 14 nt, Chlamydia trachomatis
auuuuaaaaucacu

SEQ ID NO: 2487358 - RNA, 21 nt, Chlamydia trachomatis
auuuuaaacauucgaaucauu

SEQ ID NO: 2487359 - RNA, 18 nt, Chlamydia trachomatis
auuuuacacagauaggaa

SEQ ID NO: 2487360 - RNA, 13 nt, Chlamydia trachomatis
auuuuagagaaaa

SEQ ID NO: 2487361 - RNA, 15 nt, Chlamydia trachomatis
auuuuagagaaaaga

SEQ ID NO: 2487362 - RNA, 19 nt, Chlamydia trachomatis
auuuuagagaaaagaaaag

SEQ ID NO: 2487363 - RNA, 17 nt, Chlamydia trachomatis
auuuuagauaaaagaag

SEQ ID NO: 2487364 - RNA, 16 nt, Chlamydia trachomatis
auuuuauucaaaucuu

SEQ ID NO: 2487365 - RNA, 19 nt, Chlamydia trachomatis
auuuuauucaaaucuucuu

SEQ ID NO: 2487366 - RNA, 15 nt, Chlamydia trachomatis
auuuuauugagcugg

SEQ ID NO: 2487367 - RNA, 21 nt, Chlamydia trachomatis
auuuucaaaaccuugaugaau

SEQ ID NO: 2487368 - RNA, 18 nt, Chlamydia trachomatis
auuuucagcaaaagaaga

SEQ ID NO: 2487369 - RNA, 15 nt, Chlamydia trachomatis
auuuucaguguugag

SEQ ID NO: 2487370 - RNA, 18 nt, Chlamydia trachomatis
auuuucauauaguuuucg

SEQ ID NO: 2487371 - RNA, 15 nt, Chlamydia trachomatis
auuuucaucaaaaua

SEQ ID NO: 2487372 - RNA, 14 nt, Chlamydia trachomatis
auuuucaucuucca

SEQ ID NO: 2487373 - RNA, 17 nt, Chlamydia trachomatis
auuuuccaagaaaaaua

SEQ ID NO: 2487374 - RNA, 13 nt, Chlamydia trachomatis
auuuuccacaaau

SEQ ID NO: 2487375 - RNA, 14 nt, Chlamydia trachomatis
auuuuccuuuuucc

SEQ ID NO: 2487376 - RNA, 23 nt, Chlamydia trachomatis
auuuucggcaggccuuccaccuu

SEQ ID NO: 2487377 - RNA, 18 nt, Chlamydia trachomatis
auuuucguaagcauagcu

SEQ ID NO: 2487378 - RNA, 18 nt, Chlamydia trachomatis
auuuucguuguuguaaag

SEQ ID NO: 2487379 - RNA, 15 nt, Chlamydia trachomatis
auuuucuaggagaag

SEQ ID NO: 2487380 - RNA, 14 nt, Chlamydia trachomatis
auuuucucucuagc

SEQ ID NO: 2487381 - RNA, 22 nt, Chlamydia trachomatis
auuuucugguuucuuaaacaaa

SEQ ID NO: 2487382 - RNA, 24 nt, Chlamydia trachomatis
auuuucuucacuuccucucucuca

SEQ ID NO: 2487383 - RNA, 14 nt, Chlamydia trachomatis
auuuucuuccugcu

SEQ ID NO: 2487384 - RNA, 15 nt, Chlamydia trachomatis
auuuugaagauaaaa

SEQ ID NO: 2487385 - RNA, 15 nt, Chlamydia trachomatis
auuuugaggcucucu

SEQ ID NO: 2487386 - RNA, 12 nt, Chlamydia trachomatis
auuuugaggcuu

SEQ ID NO: 2487387 - RNA, 18 nt, Chlamydia trachomatis
auuuuucaaaaauagcaa

SEQ ID NO: 2487388 - RNA, 18 nt, Chlamydia trachomatis
auuuuucagaaaaaguaa

SEQ ID NO: 2487389 - RNA, 18 nt, Chlamydia trachomatis
auuuuucagccugucuau

SEQ ID NO: 2487390 - RNA, 12 nt, Chlamydia trachomatis
auuuuuccauuu

SEQ ID NO: 2487391 - RNA, 15 nt, Chlamydia trachomatis
auuuuuccauuucca

SEQ ID NO: 2487392 - RNA, 19 nt, Chlamydia trachomatis
auuuuuuacgcucuuucuu

SEQ ID NO: 2487393 - RNA, 13 nt, Chlamydia trachomatis
auuuuuugagcaa

SEQ ID NO: 2487394 - RNA, 14 nt, Chlamydia trachomatis
auuuuuuuauccaa

SEQ ID NO: 2487395 - RNA, 20 nt, Chlamydia trachomatis
auuuuuuuauccaaaaaagu

SEQ ID NO: 2487396 - RNA, 21 nt, Chlamydia trachomatis
auuuuuuuuguguaauagcua

SEQ ID NO: 2487397 - RNA, 20 nt, Chlamydia trachomatis
caaaaaagaaucuaaaaagc

SEQ ID NO: 2487398 - RNA, 14 nt, Chlamydia trachomatis
caaaaaagauuucc

SEQ ID NO: 2487399 - RNA, 23 nt, Chlamydia trachomatis
caaaaaagcgucuccaaaagugu

SEQ ID NO: 2487400 - RNA, 18 nt, Chlamydia trachomatis
caaaaacaaucaaagcac

SEQ ID NO: 2487401 - RNA, 16 nt, Chlamydia trachomatis
caaaaacacuacgcua

SEQ ID NO: 2487402 - RNA, 12 nt, Chlamydia trachomatis
caaaaagaaagc

SEQ ID NO: 2487403 - RNA, 13 nt, Chlamydia trachomatis
caaaaagaaagcc

SEQ ID NO: 2487404 - RNA, 16 nt, Chlamydia trachomatis
caaaaagacuacaguc

SEQ ID NO: 2487405 - RNA, 17 nt, Chlamydia trachomatis
caaaaagaucuucaaca

SEQ ID NO: 2487406 - RNA, 19 nt, Chlamydia trachomatis
caaaaauaacgauucuuga

SEQ ID NO: 2487407 - RNA, 16 nt, Chlamydia trachomatis
caaaaauacuucuuuu

SEQ ID NO: 2487408 - RNA, 16 nt, Chlamydia trachomatis
caaaaauauggggcca

SEQ ID NO: 2487409 - RNA, 19 nt, Chlamydia trachomatis
caaaaauauggggccagca

SEQ ID NO: 2487410 - RNA, 13 nt, Chlamydia trachomatis
caaaaaucugcaa

SEQ ID NO: 2487411 - RNA, 15 nt, Chlamydia trachomatis
caaaacaaacaauaa

SEQ ID NO: 2487412 - RNA, 18 nt, Chlamydia trachomatis
caaauccugcgcgcaaau

SEQ ID NO: 2487413 - RNA, 12 nt, Chlamydia trachomatis
caaauccugcuu

SEQ ID NO: 2487414 - RNA, 14 nt, Chlamydia trachomatis
caaaucugcaagaa

SEQ ID NO: 2487415 - RNA, 16 nt, Chlamydia trachomatis
caaaucugcaagaaca

SEQ ID NO: 2487416 - RNA, 21 nt, Chlamydia trachomatis
caaaucugcaagaacaaagaa

SEQ ID NO: 2487417 - RNA, 19 nt, Chlamydia trachomatis
caaaucuucuucuaagcua

SEQ ID NO: 2487418 - RNA, 20 nt, Chlamydia trachomatis
caaaucuuucuuucuaagaa

SEQ ID NO: 2487419 - RNA, 20 nt, Chlamydia trachomatis
caaaugcguuaaacuuucuu

SEQ ID NO: 2487420 - RNA, 22 nt, Chlamydia trachomatis
caaaugcguuaaacuuucuugc

SEQ ID NO: 2487421 - RNA, 19 nt, Chlamydia trachomatis
caaauuacgcgucuaaaac

SEQ ID NO: 2487422 - RNA, 17 nt, Chlamydia trachomatis
caaauuccucuguagau

SEQ ID NO: 2487423 - RNA, 20 nt, Chlamydia trachomatis
caaauucgaggcuucuucuu

SEQ ID NO: 2487424 - RNA, 15 nt, Chlamydia trachomatis
caaauucgcuaccaa

SEQ ID NO: 2487425 - RNA, 17 nt, Chlamydia trachomatis
caaauucgcuaccaaaa

SEQ ID NO: 2487426 - RNA, 22 nt, Chlamydia trachomatis
caaauucuacuccugcaacaag

SEQ ID NO: 2487427 - RNA, 18 nt, Chlamydia trachomatis
caaauucuucaugcaauu

SEQ ID NO: 2487428 - RNA, 22 nt, Chlamydia trachomatis
caaauucuucaugcaauugauu

SEQ ID NO: 2487429 - RNA, 18 nt, Chlamydia trachomatis
caaauuuaucugcuaaag

SEQ ID NO: 2487430 - RNA, 19 nt, Chlamydia trachomatis
caaauuucuauagaagaau

SEQ ID NO: 2487431 - RNA, 16 nt, Chlamydia trachomatis
caaauuucucuaggaa

SEQ ID NO: 2487432 - RNA, 14 nt, Chlamydia trachomatis
caaauuugcagaag

SEQ ID NO: 2487433 - RNA, 13 nt, Chlamydia trachomatis
caaauuuuguuua

SEQ ID NO: 2487434 - RNA, 20 nt, Chlamydia trachomatis
caacaaauaccaaaauauca

SEQ ID NO: 2487435 - RNA, 18 nt, Chlamydia trachomatis
caacaaccaacucuccuu

SEQ ID NO: 2487436 - RNA, 22 nt, Chlamydia trachomatis
caacaaguuccuggauccaaaa

SEQ ID NO: 2487437 - RNA, 18 nt, Chlamydia trachomatis
caacaaguugauacaaga

SEQ ID NO: 2487438 - RNA, 16 nt, Chlamydia trachomatis
caacaauauccuccau

SEQ ID NO: 2487439 - RNA, 17 nt, Chlamydia trachomatis
caacaauccacccacaa

SEQ ID NO: 2487440 - RNA, 14 nt, Chlamydia trachomatis
caacacuccugaaa

SEQ ID NO: 2487441 - RNA, 15 nt, Chlamydia trachomatis
caacaggaccagaga

SEQ ID NO: 2487442 - RNA, 18 nt, Chlamydia trachomatis
caacaggagaucccaaaa

SEQ ID NO: 2487443 - RNA, 13 nt, Chlamydia trachomatis
caacaguucuuca

SEQ ID NO: 2487444 - RNA, 18 nt, Chlamydia trachomatis
caacauaaaauccuucug

SEQ ID NO: 2487445 - RNA, 18 nt, Chlamydia trachomatis
caacauaauaaauauuau

SEQ ID NO: 2487446 - RNA, 13 nt, Chlamydia trachomatis
caacaucaaaauu

SEQ ID NO: 2487447 - RNA, 15 nt, Chlamydia trachomatis
caacaucaaaauucu

SEQ ID NO: 2487448 - RNA, 20 nt, Chlamydia trachomatis
caacaugggcauagucuccc

SEQ ID NO: 2487449 - RNA, 18 nt, Chlamydia trachomatis
caaccacuguauccaaaa

SEQ ID NO: 2487450 - RNA, 13 nt, Chlamydia trachomatis
caaccagcgcauu

SEQ ID NO: 2487451 - RNA, 18 nt, Chlamydia trachomatis
caaccagcgcauuaauaa

SEQ ID NO: 2487452 - RNA, 15 nt, Chlamydia trachomatis
caaccaucaaagcag

SEQ ID NO: 2487453 - RNA, 20 nt, Chlamydia trachomatis
caacccucgcagagaaagag

SEQ ID NO: 2487454 - RNA, 23 nt, Chlamydia trachomatis
caacccucgcagagaaagagcca

SEQ ID NO: 2487455 - RNA, 20 nt, Chlamydia trachomatis
caaccgauucuucacagcac

SEQ ID NO: 2487456 - RNA, 22 nt, Chlamydia trachomatis
caaccucucaucaguaaacacu

SEQ ID NO: 2487457 - RNA, 15 nt, Chlamydia trachomatis
caaccucucuaaaaa

SEQ ID NO: 2487458 - RNA, 16 nt, Chlamydia trachomatis
caaccucucuaaaaac

SEQ ID NO: 2487459 - RNA, 13 nt, Chlamydia trachomatis
caaccuucuccaa

SEQ ID NO: 2487460 - RNA, 21 nt, Chlamydia trachomatis
caaccuucugacugagagagc

SEQ ID NO: 2487461 - RNA, 21 nt, Chlamydia trachomatis
caaccuuuccuguauaagaaa

SEQ ID NO: 2487462 - RNA, 22 nt, Chlamydia trachomatis
caaccuuuccuguauaagaaaa

SEQ ID NO: 2487463 - RNA, 17 nt, Chlamydia trachomatis
caacgaaaccaaaauau

SEQ ID NO: 2487464 - RNA, 19 nt, Chlamydia trachomatis
caacgaaaccaaaauaucu

SEQ ID NO: 2487465 - RNA, 18 nt, Chlamydia trachomatis
caacgaguugaucuuccu

SEQ ID NO: 2487466 - RNA, 13 nt, Chlamydia trachomatis
caacgcaucucca

SEQ ID NO: 2487467 - RNA, 19 nt, Chlamydia trachomatis
caacgcaucuccaaagaca

SEQ ID NO: 2487468 - RNA, 12 nt, Chlamydia trachomatis
caacggcccuuc

SEQ ID NO: 2487469 - RNA, 14 nt, Chlamydia trachomatis
caacuaaaggaaac

SEQ ID NO: 2487470 - RNA, 14 nt, Chlamydia trachomatis
caacuaguuuacgc

SEQ ID NO: 2487471 - RNA, 18 nt, Chlamydia trachomatis
caacuaguuuacgcacuu

SEQ ID NO: 2487472 - RNA, 21 nt, Chlamydia trachomatis
caacuaguuuacgcacuucug

SEQ ID NO: 2487473 - RNA, 17 nt, Chlamydia trachomatis
caacuaucagaagauag

SEQ ID NO: 2487474 - RNA, 19 nt, Chlamydia trachomatis
caacucuccuaauucaaca

SEQ ID NO: 2487475 - RNA, 15 nt, Chlamydia trachomatis
caacucugaacaacu

SEQ ID NO: 2487476 - RNA, 21 nt, Chlamydia trachomatis
caacucuuucauaaaacccuc

SEQ ID NO: 2487477 - RNA, 16 nt, Chlamydia trachomatis
caacucuuuuccuaaa

SEQ ID NO: 2487478 - RNA, 11 nt, Chlamydia trachomatis
caacugauucg

SEQ ID NO: 2487479 - RNA, 23 nt, Chlamydia trachomatis
caacuucaauagcaggaacuucu

SEQ ID NO: 2487480 - RNA, 17 nt, Chlamydia trachomatis
caacuucucuuguucug

SEQ ID NO: 2487481 - RNA, 17 nt, Chlamydia trachomatis
caacuugcguuuucuug

SEQ ID NO: 2487482 - RNA, 19 nt, Chlamydia trachomatis
caacuuggugcagaagaau

SEQ ID NO: 2487483 - RNA, 15 nt, Chlamydia trachomatis
caacuuucuuuugug

SEQ ID NO: 2487484 - RNA, 13 nt, Chlamydia trachomatis
caacuuuucagca

SEQ ID NO: 2487485 - RNA, 12 nt, Chlamydia trachomatis
caagaaaauaag

SEQ ID NO: 2487486 - RNA, 21 nt, Chlamydia trachomatis
caagaaaauagguaaagaagu

SEQ ID NO: 2487487 - RNA, 14 nt, Chlamydia trachomatis
caagaaacuguaau

SEQ ID NO: 2487488 - RNA, 22 nt, Chlamydia trachomatis
caagaaacuguaauguccucuu

SEQ ID NO: 2487489 - RNA, 18 nt, Chlamydia trachomatis
caagaaacuuuucugcag

SEQ ID NO: 2487490 - RNA, 20 nt, Chlamydia trachomatis
caagaaaggccuauccaagg

SEQ ID NO: 2487491 - RNA, 23 nt, Chlamydia trachomatis
caagaacagauugagaauaaaua

SEQ ID NO: 2487492 - RNA, 12 nt, Chlamydia trachomatis
caagaagaacuc

SEQ ID NO: 2487493 - RNA, 13 nt, Chlamydia trachomatis
caagaagaacucu

SEQ ID NO: 2487494 - RNA, 21 nt, Chlamydia trachomatis
caagaagagucucuaacaaca

SEQ ID NO: 2487495 - RNA, 15 nt, Chlamydia trachomatis
caagaagcugcaguu

SEQ ID NO: 2487496 - RNA, 15 nt, Chlamydia trachomatis
caagaauacaagaaa

SEQ ID NO: 2487497 - RNA, 22 nt, Chlamydia trachomatis
caagacaucuauugagaagacu

SEQ ID NO: 2487498 - RNA, 22 nt, Chlamydia trachomatis
caagaccucuccauccugcgug

SEQ ID NO: 2487499 - RNA, 14 nt, Chlamydia trachomatis
caagagagaacaaa

SEQ ID NO: 2487500 - RNA, 16 nt, Chlamydia trachomatis
caagagagaucuauga

SEQ ID NO: 2487501 - RNA, 22 nt, Chlamydia trachomatis
caagagagaucuaugaaaaaag

SEQ ID NO: 2487502 - RNA, 15 nt, Chlamydia trachomatis
caagaggcuuaaaga

SEQ ID NO: 2487503 - RNA, 17 nt, Chlamydia trachomatis
caagagucucgaaggaa

SEQ ID NO: 2487504 - RNA, 17 nt, Chlamydia trachomatis
caagauacaaggcuccu

SEQ ID NO: 2487505 - RNA, 16 nt, Chlamydia trachomatis
caagauauucccuaaa

SEQ ID NO: 2487506 - RNA, 21 nt, Chlamydia trachomatis
caagauauucccuaaaugcuc

SEQ ID NO: 2487507 - RNA, 18 nt, Chlamydia trachomatis
caagaucuuccggaagga

SEQ ID NO: 2487508 - RNA, 19 nt, Chlamydia trachomatis
caagaugccgaacucuccu

SEQ ID NO: 2487509 - RNA, 13 nt, Chlamydia trachomatis
caagcaaaacaua

SEQ ID NO: 2487510 - RNA, 15 nt, Chlamydia trachomatis
caagcaaaacauaaa

SEQ ID NO: 2487511 - RNA, 18 nt, Chlamydia trachomatis
caagcaaacggggcuagc

SEQ ID NO: 2487512 - RNA, 23 nt, Chlamydia trachomatis
caagcacacuugauaaauagcaa

SEQ ID NO: 2487513 - RNA, 14 nt, Chlamydia trachomatis
caagcagacaagca

SEQ ID NO: 2487514 - RNA, 22 nt, Chlamydia trachomatis
caagcgauuaugaaaaagccug

SEQ ID NO: 2487515 - RNA, 14 nt, Chlamydia trachomatis
caagcguauuugca

SEQ ID NO: 2487516 - RNA, 22 nt, Chlamydia trachomatis
caagcucgucuuuagaagaaaa

SEQ ID NO: 2487517 - RNA, 23 nt, Chlamydia trachomatis
caagcucgucuuuagaagaaaag

SEQ ID NO: 2487518 - RNA, 18 nt, Chlamydia trachomatis
caagcugacaaagcuucc

SEQ ID NO: 2487519 - RNA, 22 nt, Chlamydia trachomatis
caagcugcacccgcggauccca

SEQ ID NO: 2487520 - RNA, 13 nt, Chlamydia trachomatis
caagcuugucucc

SEQ ID NO: 2487521 - RNA, 16 nt, Chlamydia trachomatis
caagcuuucaucuccu

SEQ ID NO: 2487522 - RNA, 13 nt, Chlamydia trachomatis
caaggaaaagaug

SEQ ID NO: 2487523 - RNA, 15 nt, Chlamydia trachomatis
cacaaaagcauugaa

SEQ ID NO: 2487524 - RNA, 15 nt, Chlamydia trachomatis
cacaaacaaaaaaga

SEQ ID NO: 2487525 - RNA, 17 nt, Chlamydia trachomatis
cacaaagagaaggccuu

SEQ ID NO: 2487526 - RNA, 22 nt, Chlamydia trachomatis
cacaaaggaacaucgagaaaau

SEQ ID NO: 2487527 - RNA, 15 nt, Chlamydia trachomatis
cacaaauaacagaaa

SEQ ID NO: 2487528 - RNA, 15 nt, Chlamydia trachomatis
cacaaauauacucuu

SEQ ID NO: 2487529 - RNA, 23 nt, Chlamydia trachomatis
cacaaaucuuucuuucuaagaaa

SEQ ID NO: 2487530 - RNA, 23 nt, Chlamydia trachomatis
cacaacgcccaggucuuaauaau

SEQ ID NO: 2487531 - RNA, 19 nt, Chlamydia trachomatis
cacaacuaguuuacgcacu

SEQ ID NO: 2487532 - RNA, 15 nt, Chlamydia trachomatis
cacaacucuuuuccu

SEQ ID NO: 2487533 - RNA, 11 nt, Chlamydia trachomatis
cacaagaacau

SEQ ID NO: 2487534 - RNA, 18 nt, Chlamydia trachomatis
cacaagauuuugaauacg

SEQ ID NO: 2487535 - RNA, 20 nt, Chlamydia trachomatis
cacaagcugacaaagcuucc

SEQ ID NO: 2487536 - RNA, 16 nt, Chlamydia trachomatis
cacaagcuuuuuucug

SEQ ID NO: 2487537 - RNA, 13 nt, Chlamydia trachomatis
cacaauauuaucu

SEQ ID NO: 2487538 - RNA, 17 nt, Chlamydia trachomatis
cacaauauuaucuacag

SEQ ID NO: 2487539 - RNA, 17 nt, Chlamydia trachomatis
cacaaucucuuuaagcu

SEQ ID NO: 2487540 - RNA, 21 nt, Chlamydia trachomatis
cacaaugcguagucucuagca

SEQ ID NO: 2487541 - RNA, 20 nt, Chlamydia trachomatis
cacaauuuuucuuugagaaa

SEQ ID NO: 2487542 - RNA, 12 nt, Chlamydia trachomatis
cacaauuuuugu

SEQ ID NO: 2487543 - RNA, 19 nt, Chlamydia trachomatis
cacaauuuuuguuccuuuc

SEQ ID NO: 2487544 - RNA, 16 nt, Chlamydia trachomatis
cacacaagcugacaaa

SEQ ID NO: 2487545 - RNA, 18 nt, Chlamydia trachomatis
cacacauccuucugcuau

SEQ ID NO: 2487546 - RNA, 23 nt, Chlamydia trachomatis
cacacuggguaucugaacaagaa

SEQ ID NO: 2487547 - RNA, 19 nt, Chlamydia trachomatis
cacacuugauaaauagcaa

SEQ ID NO: 2487548 - RNA, 16 nt, Chlamydia trachomatis
cacagaaacuucuucu

SEQ ID NO: 2487549 - RNA, 12 nt, Chlamydia trachomatis
cacagaaagucc

SEQ ID NO: 2487550 - RNA, 16 nt, Chlamydia trachomatis
cacagagcuucucuaa

SEQ ID NO: 2487551 - RNA, 19 nt, Chlamydia trachomatis
cacagcaaauaaagagguu

SEQ ID NO: 2487552 - RNA, 16 nt, Chlamydia trachomatis
cacagcaagcgaaaua

SEQ ID NO: 2487553 - RNA, 18 nt, Chlamydia trachomatis
cacagcacgacacuccuc

SEQ ID NO: 2487554 - RNA, 16 nt, Chlamydia trachomatis
cacagcaugaacagcu

SEQ ID NO: 2487555 - RNA, 14 nt, Chlamydia trachomatis
cacagcuaagggcu

SEQ ID NO: 2487556 - RNA, 15 nt, Chlamydia trachomatis
cacaggucauaucca

SEQ ID NO: 2487557 - RNA, 13 nt, Chlamydia trachomatis
cacaucacagauc

SEQ ID NO: 2487558 - RNA, 15 nt, Chlamydia trachomatis
cacauccuucugcua

SEQ ID NO: 2487559 - RNA, 20 nt, Chlamydia trachomatis
cacaugccaucguugauauu

SEQ ID NO: 2487560 - RNA, 15 nt, Chlamydia trachomatis
cacaugcucaucaaa

SEQ ID NO: 2487561 - RNA, 15 nt, Chlamydia trachomatis
cacaugucauccuua

SEQ ID NO: 2487562 - RNA, 15 nt, Chlamydia trachomatis
cacauguccuaccaa

SEQ ID NO: 2487563 - RNA, 14 nt, Chlamydia trachomatis
cacauuauucacac

SEQ ID NO: 2487564 - RNA, 17 nt, Chlamydia trachomatis
cacauucccuaaauaua

SEQ ID NO: 2487565 - RNA, 12 nt, Chlamydia trachomatis
caccaaucaccg

SEQ ID NO: 2487566 - RNA, 21 nt, Chlamydia trachomatis
caccacuaaucccaccuuaaa

SEQ ID NO: 2487567 - RNA, 15 nt, Chlamydia trachomatis
caccagccacauccu

SEQ ID NO: 2487568 - RNA, 16 nt, Chlamydia trachomatis
caccagccacauccug

SEQ ID NO: 2487569 - RNA, 16 nt, Chlamydia trachomatis
caccagcuaauaaguu

SEQ ID NO: 2487570 - RNA, 24 nt, Chlamydia trachomatis
caccagcuaauaaguucacugacu

SEQ ID NO: 2487571 - RNA, 22 nt, Chlamydia trachomatis
caccaggcaaugcuaaggcgau

SEQ ID NO: 2487572 - RNA, 18 nt, Chlamydia trachomatis
caccauagguagaaaagg

SEQ ID NO: 2487573 - RNA, 21 nt, Chlamydia trachomatis
caccauauccauaacuuuaau

SEQ ID NO: 2487574 - RNA, 23 nt, Chlamydia trachomatis
caccauuuaauauggacuucccu

SEQ ID NO: 2487575 - RNA, 16 nt, Chlamydia trachomatis
cacccaaauauacuca

SEQ ID NO: 2487576 - RNA, 20 nt, Chlamydia trachomatis
caccccaucccuugcaaaaa

SEQ ID NO: 2487577 - RNA, 15 nt, Chlamydia trachomatis
caccccuaaaagagc

SEQ ID NO: 2487578 - RNA, 20 nt, Chlamydia trachomatis
cacccuuucuuacuccuucu

SEQ ID NO: 2487579 - RNA, 21 nt, Chlamydia trachomatis
cacccuuucuuacuccuucuc

SEQ ID NO: 2487580 - RNA, 18 nt, Chlamydia trachomatis
caccgaacaaccuucuga

SEQ ID NO: 2487581 - RNA, 14 nt, Chlamydia trachomatis
caccgagcauucug

SEQ ID NO: 2487582 - RNA, 20 nt, Chlamydia trachomatis
caccguagaauuucuucuuu

SEQ ID NO: 2487583 - RNA, 16 nt, Chlamydia trachomatis
caccuaaugagcagaa

SEQ ID NO: 2487584 - RNA, 18 nt, Chlamydia trachomatis
caccucuccuugaacaau

SEQ ID NO: 2487585 - RNA, 12 nt, Chlamydia trachomatis
caccucuuuuug

SEQ ID NO: 2487586 - RNA, 16 nt, Chlamydia trachomatis
caccuguauugggaua

SEQ ID NO: 2487587 - RNA, 18 nt, Chlamydia trachomatis
caccuucauuucaagaga

SEQ ID NO: 2487588 - RNA, 17 nt, Chlamydia trachomatis
caccuuuacaaucaucu

SEQ ID NO: 2487589 - RNA, 13 nt, Chlamydia trachomatis
caccuuucguuuc

SEQ ID NO: 2487590 - RNA, 19 nt, Chlamydia trachomatis
caccuuuuuugcuaaaaga

SEQ ID NO: 2487591 - RNA, 20 nt, Chlamydia trachomatis
caccuuuuuugcuaaaagaa

SEQ ID NO: 2487592 - RNA, 21 nt, Chlamydia trachomatis
caccuuuuuugcuaaaagaaa

SEQ ID NO: 2487593 - RNA, 22 nt, Chlamydia trachomatis
cacgacuuagcacucaaacacu

SEQ ID NO: 2487594 - RNA, 23 nt, Chlamydia trachomatis
cacgaguucgccccucuuuuuca

SEQ ID NO: 2487595 - RNA, 17 nt, Chlamydia trachomatis
cacgauaaaagacagaa

SEQ ID NO: 2487596 - RNA, 14 nt, Chlamydia trachomatis
cacgauguucccca

SEQ ID NO: 2487597 - RNA, 13 nt, Chlamydia trachomatis
cacgcaaaacauc

SEQ ID NO: 2487598 - RNA, 15 nt, Chlamydia trachomatis
cacgcacuuuuuguu

SEQ ID NO: 2487599 - RNA, 16 nt, Chlamydia trachomatis
cacgcuacaugcagga

SEQ ID NO: 2487600 - RNA, 14 nt, Chlamydia trachomatis
cacgcuacuaacga

SEQ ID NO: 2487601 - RNA, 18 nt, Chlamydia trachomatis
cacgcugaguuuccuuua

SEQ ID NO: 2487602 - RNA, 16 nt, Chlamydia trachomatis
cacggcuucugucccu

SEQ ID NO: 2487603 - RNA, 14 nt, Chlamydia trachomatis
cacguagucauuga

SEQ ID NO: 2487604 - RNA, 23 nt, Chlamydia trachomatis
cacguagucauugauucuaugag

SEQ ID NO: 2487605 - RNA, 12 nt, Chlamydia trachomatis
cacgucggcuuu

SEQ ID NO: 2487606 - RNA, 14 nt, Chlamydia trachomatis
cacgugcaacacaa

SEQ ID NO: 2487607 - RNA, 16 nt, Chlamydia trachomatis
cacguuaggauccgcu

SEQ ID NO: 2487608 - RNA, 14 nt, Chlamydia trachomatis
cacguuccagucuu

SEQ ID NO: 2487609 - RNA, 20 nt, Chlamydia trachomatis
cacuaccccaccuauggcau

SEQ ID NO: 2487610 - RNA, 16 nt, Chlamydia trachomatis
cacuacgcuacagagu

SEQ ID NO: 2487611 - RNA, 13 nt, Chlamydia trachomatis
cacuauccaaagc

SEQ ID NO: 2487612 - RNA, 21 nt, Chlamydia trachomatis
cacuaucuccuauugagcgca

SEQ ID NO: 2487613 - RNA, 13 nt, Chlamydia trachomatis
cacuaugaacaaa

SEQ ID NO: 2487614 - RNA, 18 nt, Chlamydia trachomatis
cacuaugaacaaacagcu

SEQ ID NO: 2487615 - RNA, 17 nt, Chlamydia trachomatis
cacucaaauuucucuag

SEQ ID NO: 2487616 - RNA, 19 nt, Chlamydia trachomatis
cacucauuaccauacagac

SEQ ID NO: 2487617 - RNA, 13 nt, Chlamydia trachomatis
cacuccuccuccu

SEQ ID NO: 2487618 - RNA, 20 nt, Chlamydia trachomatis
cacuccuccuccuaaacaaa

SEQ ID NO: 2487619 - RNA, 21 nt, Chlamydia trachomatis
cacuccugaaaguuuuuuccc

SEQ ID NO: 2487620 - RNA, 19 nt, Chlamydia trachomatis
cacucgagucaugcaaagg

SEQ ID NO: 2487621 - RNA, 11 nt, Chlamydia trachomatis
cacucuucagg

SEQ ID NO: 2487622 - RNA, 17 nt, Chlamydia trachomatis
cacugaccgaagaacuc

SEQ ID NO: 2487623 - RNA, 19 nt, Chlamydia trachomatis
cacugaccgaagaacucaa

SEQ ID NO: 2487624 - RNA, 22 nt, Chlamydia trachomatis
cacugaccgaagaacucaaaag

SEQ ID NO: 2487625 - RNA, 23 nt, Chlamydia trachomatis
cacugaccgaagaacucaaaagc

SEQ ID NO: 2487626 - RNA, 21 nt, Chlamydia trachomatis
cacugacuguagaaaaucaua

SEQ ID NO: 2487627 - RNA, 21 nt, Chlamydia trachomatis
cacugcguauuugaaaucaaa

SEQ ID NO: 2487628 - RNA, 18 nt, Chlamydia trachomatis
cacuggguaucugaacaa

SEQ ID NO: 2487629 - RNA, 21 nt, Chlamydia trachomatis
cacugguauucugcagaaaaa

SEQ ID NO: 2487630 - RNA, 14 nt, Chlamydia trachomatis
cacuguugagaaaa

SEQ ID NO: 2487631 - RNA, 20 nt, Chlamydia trachomatis
cacuuaaaaagaaacaaaac

SEQ ID NO: 2487632 - RNA, 20 nt, Chlamydia trachomatis
cacuucaaucacuccuccuc

SEQ ID NO: 2487633 - RNA, 15 nt, Chlamydia trachomatis
cacuuccccauucuu

SEQ ID NO: 2487634 - RNA, 18 nt, Chlamydia trachomatis
cacuuccccauucuucuc

SEQ ID NO: 2487635 - RNA, 17 nt, Chlamydia trachomatis
cagauuugaguuuauca

SEQ ID NO: 2487636 - RNA, 22 nt, Chlamydia trachomatis
cagauuugaguuuaucauugaa

SEQ ID NO: 2487637 - RNA, 16 nt, Chlamydia trachomatis
cagauuuuucaaaaau

SEQ ID NO: 2487638 - RNA, 18 nt, Chlamydia trachomatis
cagauuuuucaaaaauag

SEQ ID NO: 2487639 - RNA, 14 nt, Chlamydia trachomatis
cagcaaaaagagga

SEQ ID NO: 2487640 - RNA, 16 nt, Chlamydia trachomatis
cagcaaaaagaggaga

SEQ ID NO: 2487641 - RNA, 21 nt, Chlamydia trachomatis
cagcaaaaccuuuuacaguuc

SEQ ID NO: 2487642 - RNA, 20 nt, Chlamydia trachomatis
cagcaagaacagauugagaa

SEQ ID NO: 2487643 - RNA, 13 nt, Chlamydia trachomatis
cagcaagaagaag

SEQ ID NO: 2487644 - RNA, 19 nt, Chlamydia trachomatis
cagcaagaagaagagagaa

SEQ ID NO: 2487645 - RNA, 15 nt, Chlamydia trachomatis
cagcaagagagauug

SEQ ID NO: 2487646 - RNA, 19 nt, Chlamydia trachomatis
cagcaagagagauugauag

SEQ ID NO: 2487647 - RNA, 20 nt, Chlamydia trachomatis
cagcaagcuugucuccuucu

SEQ ID NO: 2487648 - RNA, 21 nt, Chlamydia trachomatis
cagcaagcuugucuccuucuu

SEQ ID NO: 2487649 - RNA, 13 nt, Chlamydia trachomatis
cagcacccacauu

SEQ ID NO: 2487650 - RNA, 18 nt, Chlamydia trachomatis
cagcacgacacuccucug

SEQ ID NO: 2487651 - RNA, 23 nt, Chlamydia trachomatis
cagcacuucuucuuuggaaaaaa

SEQ ID NO: 2487652 - RNA, 14 nt, Chlamydia trachomatis
cagcagaaggugug

SEQ ID NO: 2487653 - RNA, 21 nt, Chlamydia trachomatis
cagcagaucauccauaaaaac

SEQ ID NO: 2487654 - RNA, 21 nt, Chlamydia trachomatis
cagcaggcgaacagugacagc

SEQ ID NO: 2487655 - RNA, 23 nt, Chlamydia trachomatis
cagcaggcgaacagugacagcau

SEQ ID NO: 2487656 - RNA, 17 nt, Chlamydia trachomatis
cagcauccaauagaguu

SEQ ID NO: 2487657 - RNA, 21 nt, Chlamydia trachomatis
cagcauccucaaaaaaggcau

SEQ ID NO: 2487658 - RNA, 19 nt, Chlamydia trachomatis
cagcauccugaacccgcug

SEQ ID NO: 2487659 - RNA, 19 nt, Chlamydia trachomatis
cagcaugccuucuuccuuc

SEQ ID NO: 2487660 - RNA, 17 nt, Chlamydia trachomatis
cagcauucauaaacaca

SEQ ID NO: 2487661 - RNA, 12 nt, Chlamydia trachomatis
cagcauucucua

SEQ ID NO: 2487662 - RNA, 14 nt, Chlamydia trachomatis
cagcauucucuaga

SEQ ID NO: 2487663 - RNA, 13 nt, Chlamydia trachomatis
cagccaagcaaga

SEQ ID NO: 2487664 - RNA, 14 nt, Chlamydia trachomatis
cagccaagcaagau

SEQ ID NO: 2487665 - RNA, 16 nt, Chlamydia trachomatis
cagccaauuucucuac

SEQ ID NO: 2487666 - RNA, 14 nt, Chlamydia trachomatis
cagccacuccugca

SEQ ID NO: 2487667 - RNA, 18 nt, Chlamydia trachomatis
cagccacuugcuccacac

SEQ ID NO: 2487668 - RNA, 12 nt, Chlamydia trachomatis
cagccgaaacag

SEQ ID NO: 2487669 - RNA, 22 nt, Chlamydia trachomatis
cagccgaaacagacuaaguugu

SEQ ID NO: 2487670 - RNA, 15 nt, Chlamydia trachomatis
cagccuacaaauaaa

SEQ ID NO: 2487671 - RNA, 16 nt, Chlamydia trachomatis
cagccuacaaauaaag

SEQ ID NO: 2487672 - RNA, 15 nt, Chlamydia trachomatis
cagccucaucauuaa

SEQ ID NO: 2487673 - RNA, 15 nt, Chlamydia trachomatis
cagccucuccagaaa

SEQ ID NO: 2487674 - RNA, 14 nt, Chlamydia trachomatis
cagccugaggaucc

SEQ ID NO: 2487675 - RNA, 14 nt, Chlamydia trachomatis
cagccugcuuucuu

SEQ ID NO: 2487676 - RNA, 17 nt, Chlamydia trachomatis
cagccugcuuucuucug

SEQ ID NO: 2487677 - RNA, 21 nt, Chlamydia trachomatis
cagccugcuuucuucugccug

SEQ ID NO: 2487678 - RNA, 19 nt, Chlamydia trachomatis
cagccuucccgacagagga

SEQ ID NO: 2487679 - RNA, 19 nt, Chlamydia trachomatis
cagccuuggauuucuucug

SEQ ID NO: 2487680 - RNA, 20 nt, Chlamydia trachomatis
cagcgaaauacgguauacac

SEQ ID NO: 2487681 - RNA, 20 nt, Chlamydia trachomatis
cagcgcuuucuaaagcagcu

SEQ ID NO: 2487682 - RNA, 22 nt, Chlamydia trachomatis
cagcuaaagaaucuccuguaca

SEQ ID NO: 2487683 - RNA, 14 nt, Chlamydia trachomatis
cagcuaacagcucu

SEQ ID NO: 2487684 - RNA, 18 nt, Chlamydia trachomatis
cagcuaagggcuguguag

SEQ ID NO: 2487685 - RNA, 14 nt, Chlamydia trachomatis
cagcuaauaaguuc

SEQ ID NO: 2487686 - RNA, 16 nt, Chlamydia trachomatis
cagcuaauuccauaau

SEQ ID NO: 2487687 - RNA, 23 nt, Chlamydia trachomatis
cagcuaauuccauaaucguggaa

SEQ ID NO: 2487688 - RNA, 13 nt, Chlamydia trachomatis
cagcucaccagcu

SEQ ID NO: 2487689 - RNA, 18 nt, Chlamydia trachomatis
cagcucaccagcuuccca

SEQ ID NO: 2487690 - RNA, 20 nt, Chlamydia trachomatis
cagcuccuaucacucccugc

SEQ ID NO: 2487691 - RNA, 11 nt, Chlamydia trachomatis
cagcucuaaag

SEQ ID NO: 2487692 - RNA, 19 nt, Chlamydia trachomatis
cagcucuaaagagccaaaa

SEQ ID NO: 2487693 - RNA, 21 nt, Chlamydia trachomatis
cagcucuccucgugaggcaug

SEQ ID NO: 2487694 - RNA, 13 nt, Chlamydia trachomatis
cagcugcuuggaa

SEQ ID NO: 2487695 - RNA, 11 nt, Chlamydia trachomatis
cagcuucaacu

SEQ ID NO: 2487696 - RNA, 20 nt, Chlamydia trachomatis
cagcuucaacuggccuuuuu

SEQ ID NO: 2487697 - RNA, 22 nt, Chlamydia trachomatis
cagcuucaacuggccuuuuucg

SEQ ID NO: 2487698 - RNA, 20 nt, Chlamydia trachomatis
cagcuucuucuucucuuucg

SEQ ID NO: 2487699 - RNA, 12 nt, Chlamydia trachomatis
cagcuuuaaaga

SEQ ID NO: 2487700 - RNA, 15 nt, Chlamydia trachomatis
cagcuuucacaggga

SEQ ID NO: 2487701 - RNA, 13 nt, Chlamydia trachomatis
cagcuuucguuga

SEQ ID NO: 2487702 - RNA, 19 nt, Chlamydia trachomatis
caggaaagugcauaccuuu

SEQ ID NO: 2487703 - RNA, 13 nt, Chlamydia trachomatis
caggaacuucuuc

SEQ ID NO: 2487704 - RNA, 21 nt, Chlamydia trachomatis
caggaauauuaagauccauuu

SEQ ID NO: 2487705 - RNA, 17 nt, Chlamydia trachomatis
caggaaucacaguaaua

SEQ ID NO: 2487706 - RNA, 15 nt, Chlamydia trachomatis
caggaauucguccuc

SEQ ID NO: 2487707 - RNA, 21 nt, Chlamydia trachomatis
caggaccagagaucauaaagu

SEQ ID NO: 2487708 - RNA, 15 nt, Chlamydia trachomatis
caggagaaaggcuuu

SEQ ID NO: 2487709 - RNA, 18 nt, Chlamydia trachomatis
caggagaccacucaucau

SEQ ID NO: 2487710 - RNA, 21 nt, Chlamydia trachomatis
caggagaccacucaucaugcu

SEQ ID NO: 2487711 - RNA, 22 nt, Chlamydia trachomatis
caggagaguguuugcauucuuu

SEQ ID NO: 2487712 - RNA, 19 nt, Chlamydia trachomatis
caggaguaaauccugcuug

SEQ ID NO: 2487713 - RNA, 18 nt, Chlamydia trachomatis
caggauaacaaacaacac

SEQ ID NO: 2487714 - RNA, 20 nt, Chlamydia trachomatis
caggauaggacuugaaccua

SEQ ID NO: 2487715 - RNA, 17 nt, Chlamydia trachomatis
caggaucccucugucca

SEQ ID NO: 2487716 - RNA, 22 nt, Chlamydia trachomatis
caggaucccucuguccauucua

SEQ ID NO: 2487717 - RNA, 19 nt, Chlamydia trachomatis
caggaucgcuaucaauaaa

SEQ ID NO: 2487718 - RNA, 21 nt, Chlamydia trachomatis
caggaucgcuaucaauaaaaa

SEQ ID NO: 2487719 - RNA, 20 nt, Chlamydia trachomatis
caggauuggaaaauccaaag

SEQ ID NO: 2487720 - RNA, 18 nt, Chlamydia trachomatis
caggccucccuaucaauu

SEQ ID NO: 2487721 - RNA, 23 nt, Chlamydia trachomatis
caggccucccuaucaauuccugg

SEQ ID NO: 2487722 - RNA, 15 nt, Chlamydia trachomatis
caggccuuccaccuu

SEQ ID NO: 2487723 - RNA, 20 nt, Chlamydia trachomatis
caggcgaacagugacagcau

SEQ ID NO: 2487724 - RNA, 21 nt, Chlamydia trachomatis
caggcgcuucucuuugaaaga

SEQ ID NO: 2487725 - RNA, 15 nt, Chlamydia trachomatis
caggcuaucacaaaa

SEQ ID NO: 2487726 - RNA, 18 nt, Chlamydia trachomatis
cagggaaacguaaaagag

SEQ ID NO: 2487727 - RNA, 14 nt, Chlamydia trachomatis
cagggagaagggga

SEQ ID NO: 2487728 - RNA, 21 nt, Chlamydia trachomatis
cagggagaaggggaaggaaug

SEQ ID NO: 2487729 - RNA, 12 nt, Chlamydia trachomatis
cagggagagaga

SEQ ID NO: 2487730 - RNA, 21 nt, Chlamydia trachomatis
cagggauaguaaaaacuauaa

SEQ ID NO: 2487731 - RNA, 20 nt, Chlamydia trachomatis
cagggcugacuaaauacaaa

SEQ ID NO: 2487732 - RNA, 14 nt, Chlamydia trachomatis
cagggcuguauuca

SEQ ID NO: 2487733 - RNA, 21 nt, Chlamydia trachomatis
caggggaauucgcuaaugauu

SEQ ID NO: 2487734 - RNA, 20 nt, Chlamydia trachomatis
cagguauuuccugcaagcac

SEQ ID NO: 2487735 - RNA, 23 nt, Chlamydia trachomatis
caggucuaggggaagaaucaaua

SEQ ID NO: 2487736 - RNA, 13 nt, Chlamydia trachomatis
caggucuuaauaa

SEQ ID NO: 2487737 - RNA, 21 nt, Chlamydia trachomatis
caggugaauucuccaggagau

SEQ ID NO: 2487738 - RNA, 23 nt, Chlamydia trachomatis
cagguugcaucaacaauaguauc

SEQ ID NO: 2487739 - RNA, 20 nt, Chlamydia trachomatis
cagguuuacggucacuccuc

SEQ ID NO: 2487740 - RNA, 22 nt, Chlamydia trachomatis
cagguuuacggucacuccucca

SEQ ID NO: 2487741 - RNA, 15 nt, Chlamydia trachomatis
caguaaaaucuaaaa

SEQ ID NO: 2487742 - RNA, 18 nt, Chlamydia trachomatis
caguaaaaucuaaaauau

SEQ ID NO: 2487743 - RNA, 12 nt, Chlamydia trachomatis
caguaaagaaaa

SEQ ID NO: 2487744 - RNA, 17 nt, Chlamydia trachomatis
caguaacaagcacagaa

SEQ ID NO: 2487745 - RNA, 15 nt, Chlamydia trachomatis
caguaagucaccauu

SEQ ID NO: 2487746 - RNA, 13 nt, Chlamydia trachomatis
caucaacagaaga

SEQ ID NO: 2487747 - RNA, 16 nt, Chlamydia trachomatis
caucaagguggccauu

SEQ ID NO: 2487748 - RNA, 13 nt, Chlamydia trachomatis
caucaaucacucu

SEQ ID NO: 2487749 - RNA, 23 nt, Chlamydia trachomatis
caucaauccuggaaucacaugcu

SEQ ID NO: 2487750 - RNA, 15 nt, Chlamydia trachomatis
caucacgaagaguuu

SEQ ID NO: 2487751 - RNA, 16 nt, Chlamydia trachomatis
caucacuccaagaaga

SEQ ID NO: 2487752 - RNA, 22 nt, Chlamydia trachomatis
caucacuccaagaagagucucu

SEQ ID NO: 2487753 - RNA, 19 nt, Chlamydia trachomatis
caucacugaccgaagaacu

SEQ ID NO: 2487754 - RNA, 11 nt, Chlamydia trachomatis
caucagcaaga

SEQ ID NO: 2487755 - RNA, 17 nt, Chlamydia trachomatis
caucagccccaaaaaca

SEQ ID NO: 2487756 - RNA, 14 nt, Chlamydia trachomatis
caucaguaaaaaua

SEQ ID NO: 2487757 - RNA, 22 nt, Chlamydia trachomatis
caucaguccugucguaaugaag

SEQ ID NO: 2487758 - RNA, 13 nt, Chlamydia trachomatis
caucauaaaaaga

SEQ ID NO: 2487759 - RNA, 22 nt, Chlamydia trachomatis
caucaucgagaacggcaauaaa

SEQ ID NO: 2487760 - RNA, 12 nt, Chlamydia trachomatis
caucauuuugua

SEQ ID NO: 2487761 - RNA, 18 nt, Chlamydia trachomatis
cauccaaaacaucccagc

SEQ ID NO: 2487762 - RNA, 19 nt, Chlamydia trachomatis
cauccauauauucagaaga

SEQ ID NO: 2487763 - RNA, 24 nt, Chlamydia trachomatis
cauccauggcaauggcuaagccau

SEQ ID NO: 2487764 - RNA, 15 nt, Chlamydia trachomatis
caucccacucuucuu

SEQ ID NO: 2487765 - RNA, 23 nt, Chlamydia trachomatis
caucccuugaacuagaaauaaaa

SEQ ID NO: 2487766 - RNA, 14 nt, Chlamydia trachomatis
cauccgcuaaagga

SEQ ID NO: 2487767 - RNA, 22 nt, Chlamydia trachomatis
cauccugcguguacauuagcaa

SEQ ID NO: 2487768 - RNA, 13 nt, Chlamydia trachomatis
cauccuucugcua

SEQ ID NO: 2487769 - RNA, 14 nt, Chlamydia trachomatis
cauccuucugcuau

SEQ ID NO: 2487770 - RNA, 17 nt, Chlamydia trachomatis
cauccuugcccaagcuu

SEQ ID NO: 2487771 - RNA, 13 nt, Chlamydia trachomatis
cauccuuggcuuu

SEQ ID NO: 2487772 - RNA, 19 nt, Chlamydia trachomatis
cauccuuuaucuugagaga

SEQ ID NO: 2487773 - RNA, 16 nt, Chlamydia trachomatis
caucgaaaacaaagag

SEQ ID NO: 2487774 - RNA, 21 nt, Chlamydia trachomatis
caucgagaaaaugaugaaaaa

SEQ ID NO: 2487775 - RNA, 15 nt, Chlamydia trachomatis
caucguuuaugaagc

SEQ ID NO: 2487776 - RNA, 23 nt, Chlamydia trachomatis
caucuaaagggagaauuuuaaac

SEQ ID NO: 2487777 - RNA, 13 nt, Chlamydia trachomatis
caucuaacagaac

SEQ ID NO: 2487778 - RNA, 17 nt, Chlamydia trachomatis
caucuacgaguuucucg

SEQ ID NO: 2487779 - RNA, 18 nt, Chlamydia trachomatis
caucuagagguauuuuau

SEQ ID NO: 2487780 - RNA, 17 nt, Chlamydia trachomatis
caucuauugagaagacu

SEQ ID NO: 2487781 - RNA, 23 nt, Chlamydia trachomatis
caucuauugagaagacuuacucu

SEQ ID NO: 2487782 - RNA, 18 nt, Chlamydia trachomatis
caucuauuuucucuuuaa

SEQ ID NO: 2487783 - RNA, 16 nt, Chlamydia trachomatis
caucucaagucuccac

SEQ ID NO: 2487784 - RNA, 18 nt, Chlamydia trachomatis
caucuccaaucacagcaa

SEQ ID NO: 2487785 - RNA, 19 nt, Chlamydia trachomatis
caucuccauccgaauuagc

SEQ ID NO: 2487786 - RNA, 13 nt, Chlamydia trachomatis
caucuccugauuc

SEQ ID NO: 2487787 - RNA, 22 nt, Chlamydia trachomatis
caucucggaucgagaagagcca

SEQ ID NO: 2487788 - RNA, 17 nt, Chlamydia trachomatis
caucucgguauucucaa

SEQ ID NO: 2487789 - RNA, 19 nt, Chlamydia trachomatis
caucucuaccagggauaaa

SEQ ID NO: 2487790 - RNA, 16 nt, Chlamydia trachomatis
caucucuauacggaga

SEQ ID NO: 2487791 - RNA, 17 nt, Chlamydia trachomatis
caucugcgauacggaag

SEQ ID NO: 2487792 - RNA, 16 nt, Chlamydia trachomatis
caucugguugguugug

SEQ ID NO: 2487793 - RNA, 21 nt, Chlamydia trachomatis
caucuguaaagcuucgcuuug

SEQ ID NO: 2487794 - RNA, 22 nt, Chlamydia trachomatis
caucuguauggcagacaaaaca

SEQ ID NO: 2487795 - RNA, 23 nt, Chlamydia trachomatis
caucugugucauaagcucuaacu

SEQ ID NO: 2487796 - RNA, 17 nt, Chlamydia trachomatis
caucuguugucgauuuu

SEQ ID NO: 2487797 - RNA, 20 nt, Chlamydia trachomatis
caucuuacuugcugcagauu

SEQ ID NO: 2487798 - RNA, 20 nt, Chlamydia trachomatis
caucuuaggaucuaacgcau

SEQ ID NO: 2487799 - RNA, 17 nt, Chlamydia trachomatis
caucuucaagagcugua

SEQ ID NO: 2487800 - RNA, 15 nt, Chlamydia trachomatis
caucuuccaaaggau

SEQ ID NO: 2487801 - RNA, 20 nt, Chlamydia trachomatis
caucuuccaaaggauauaca

SEQ ID NO: 2487802 - RNA, 20 nt, Chlamydia trachomatis
caucuucccaauauauuccu

SEQ ID NO: 2487803 - RNA, 20 nt, Chlamydia trachomatis
caucuucggacauugaacau

SEQ ID NO: 2487804 - RNA, 18 nt, Chlamydia trachomatis
caucuugcacauuuucuu

SEQ ID NO: 2487805 - RNA, 22 nt, Chlamydia trachomatis
caucuugcauaaggaagcaaaa

SEQ ID NO: 2487806 - RNA, 23 nt, Chlamydia trachomatis
caucuuuacuaggagcaaaaagu

SEQ ID NO: 2487807 - RNA, 14 nt, Chlamydia trachomatis
caucuuuauagaau

SEQ ID NO: 2487808 - RNA, 19 nt, Chlamydia trachomatis
caucuuugaagguaagaaa

SEQ ID NO: 2487809 - RNA, 10 nt, Chlamydia trachomatis
caucuuuucg

SEQ ID NO: 2487810 - RNA, 11 nt, Chlamydia trachomatis
caucuuuucgc

SEQ ID NO: 2487811 - RNA, 22 nt, Chlamydia trachomatis
caucuuuugccuauagagcaau

SEQ ID NO: 2487812 - RNA, 15 nt, Chlamydia trachomatis
caugaaaagcuuuca

SEQ ID NO: 2487813 - RNA, 18 nt, Chlamydia trachomatis
caugaagacccguuuucu

SEQ ID NO: 2487814 - RNA, 22 nt, Chlamydia trachomatis
caugaaucagcuuuuccacauu

SEQ ID NO: 2487815 - RNA, 13 nt, Chlamydia trachomatis
caugaauggaaag

SEQ ID NO: 2487816 - RNA, 21 nt, Chlamydia trachomatis
caugacagcuucuugaaugcc

SEQ ID NO: 2487817 - RNA, 15 nt, Chlamydia trachomatis
caugacauucaguuc

SEQ ID NO: 2487818 - RNA, 21 nt, Chlamydia trachomatis
caugaccaagguuguuaugua

SEQ ID NO: 2487819 - RNA, 21 nt, Chlamydia trachomatis
caugaccagguuuacggucac

SEQ ID NO: 2487820 - RNA, 23 nt, Chlamydia trachomatis
caugaccucagauuuaucugcua

SEQ ID NO: 2487821 - RNA, 22 nt, Chlamydia trachomatis
caugagaaaccaauuguugagc

SEQ ID NO: 2487822 - RNA, 20 nt, Chlamydia trachomatis
caugagaccgucaaaaagau

SEQ ID NO: 2487823 - RNA, 20 nt, Chlamydia trachomatis
caugagccucuaacucuucu

SEQ ID NO: 2487824 - RNA, 14 nt, Chlamydia trachomatis
caugaguugcucaa

SEQ ID NO: 2487825 - RNA, 19 nt, Chlamydia trachomatis
caugauaaugaguuccgaa

SEQ ID NO: 2487826 - RNA, 20 nt, Chlamydia trachomatis
caugauauuuugaagauaaa

SEQ ID NO: 2487827 - RNA, 14 nt, Chlamydia trachomatis
caugaucucugcag

SEQ ID NO: 2487828 - RNA, 16 nt, Chlamydia trachomatis
caugaucucugcagaa

SEQ ID NO: 2487829 - RNA, 23 nt, Chlamydia trachomatis
caugaugaugagagcagcuacaa

SEQ ID NO: 2487830 - RNA, 23 nt, Chlamydia trachomatis
caugaugcugcgauguggucaaa

SEQ ID NO: 2487831 - RNA, 13 nt, Chlamydia trachomatis
caugauuucuuua

SEQ ID NO: 2487832 - RNA, 16 nt, Chlamydia trachomatis
caugauuucuuuaaca

SEQ ID NO: 2487833 - RNA, 20 nt, Chlamydia trachomatis
caugauuucuuuaacaucuu

SEQ ID NO: 2487834 - RNA, 15 nt, Chlamydia trachomatis
caugcaauccuucuu

SEQ ID NO: 2487835 - RNA, 14 nt, Chlamydia trachomatis
caugccagaagcua

SEQ ID NO: 2487836 - RNA, 16 nt, Chlamydia trachomatis
caugccaucguugaua

SEQ ID NO: 2487837 - RNA, 20 nt, Chlamydia trachomatis
caugccgcgaagcacuggau

SEQ ID NO: 2487838 - RNA, 22 nt, Chlamydia trachomatis
caugcggauuaaagaaggaaaa

SEQ ID NO: 2487839 - RNA, 23 nt, Chlamydia trachomatis
caugcguuaauuaauaagccuuu

SEQ ID NO: 2487840 - RNA, 15 nt, Chlamydia trachomatis
cauggaagacaacau

SEQ ID NO: 2487841 - RNA, 21 nt, Chlamydia trachomatis
cauggcguuagaauaccaacu

SEQ ID NO: 2487842 - RNA, 19 nt, Chlamydia trachomatis
cauggcugcaauucuuagc

SEQ ID NO: 2487843 - RNA, 17 nt, Chlamydia trachomatis
caugguuaccugugaag

SEQ ID NO: 2487844 - RNA, 21 nt, Chlamydia trachomatis
cauguaaauuggcucgcagua

SEQ ID NO: 2487845 - RNA, 18 nt, Chlamydia trachomatis
cauguacuucgccuuuaa

SEQ ID NO: 2487846 - RNA, 18 nt, Chlamydia trachomatis
cauguauucuccuuuuug

SEQ ID NO: 2487847 - RNA, 17 nt, Chlamydia trachomatis
cauguccuaccaauauu

SEQ ID NO: 2487848 - RNA, 12 nt, Chlamydia trachomatis
caugugaacaga

SEQ ID NO: 2487849 - RNA, 17 nt, Chlamydia trachomatis
cauguguuucuggaaag

SEQ ID NO: 2487850 - RNA, 15 nt, Chlamydia trachomatis
cauguuuuggcuccu

SEQ ID NO: 2487851 - RNA, 21 nt, Chlamydia trachomatis
cauguuuuuaguaccauaaca

SEQ ID NO: 2487852 - RNA, 14 nt, Chlamydia trachomatis
cauguuuuucagau

SEQ ID NO: 2487853 - RNA, 18 nt, Chlamydia trachomatis
cauuaaagacuacaaaac

SEQ ID NO: 2487854 - RNA, 22 nt, Chlamydia trachomatis
cauuaaagggaaaaaacuagaa

SEQ ID NO: 2487855 - RNA, 20 nt, Chlamydia trachomatis
cauuaauagcggguucuuuu

SEQ ID NO: 2487856 - RNA, 21 nt, Chlamydia trachomatis
cauuacacaacucuuuuccua

SEQ ID NO: 2487857 - RNA, 19 nt, Chlamydia trachomatis
ccaauuuuuuuauccaaaa

SEQ ID NO: 2487858 - RNA, 21 nt, Chlamydia trachomatis
ccacaaaccauccuucugauu

SEQ ID NO: 2487859 - RNA, 14 nt, Chlamydia trachomatis
ccacaagauuuuga

SEQ ID NO: 2487860 - RNA, 16 nt, Chlamydia trachomatis
ccacaauuuuucuugu

SEQ ID NO: 2487861 - RNA, 14 nt, Chlamydia trachomatis
ccacacuuccccau

SEQ ID NO: 2487862 - RNA, 22 nt, Chlamydia trachomatis
ccacagguugcaucaacaauag

SEQ ID NO: 2487863 - RNA, 22 nt, Chlamydia trachomatis
ccacauccugagcccaaggaga

SEQ ID NO: 2487864 - RNA, 17 nt, Chlamydia trachomatis
ccacauuauucacacuu

SEQ ID NO: 2487865 - RNA, 12 nt, Chlamydia trachomatis
ccacauucuuuc

SEQ ID NO: 2487866 - RNA, 19 nt, Chlamydia trachomatis
ccaccagacuauuucuucu

SEQ ID NO: 2487867 - RNA, 14 nt, Chlamydia trachomatis
ccaccagccacauc

SEQ ID NO: 2487868 - RNA, 14 nt, Chlamydia trachomatis
ccaccauagguaga

SEQ ID NO: 2487869 - RNA, 23 nt, Chlamydia trachomatis
ccaccauagguagaaaaggauag

SEQ ID NO: 2487870 - RNA, 15 nt, Chlamydia trachomatis
ccaccuaauucccca

SEQ ID NO: 2487871 - RNA, 16 nt, Chlamydia trachomatis
ccaccuuaaaugcagu

SEQ ID NO: 2487872 - RNA, 18 nt, Chlamydia trachomatis
ccacgaaaagacucuccc

SEQ ID NO: 2487873 - RNA, 15 nt, Chlamydia trachomatis
ccacgaauuuucucu

SEQ ID NO: 2487874 - RNA, 14 nt, Chlamydia trachomatis
ccacgaccacaaac

SEQ ID NO: 2487875 - RNA, 15 nt, Chlamydia trachomatis
ccacgccauaucaaa

SEQ ID NO: 2487876 - RNA, 18 nt, Chlamydia trachomatis
ccacgugcaacacaacuu

SEQ ID NO: 2487877 - RNA, 22 nt, Chlamydia trachomatis
ccacgugcaacacaacuucugc

SEQ ID NO: 2487878 - RNA, 18 nt, Chlamydia trachomatis
ccacguuucguaguuuuc

SEQ ID NO: 2487879 - RNA, 14 nt, Chlamydia trachomatis
ccacuacugucaga

SEQ ID NO: 2487880 - RNA, 21 nt, Chlamydia trachomatis
ccacuacugucagaccuacaa

SEQ ID NO: 2487881 - RNA, 21 nt, Chlamydia trachomatis
ccacugauggcuucgcaagca

SEQ ID NO: 2487882 - RNA, 16 nt, Chlamydia trachomatis
ccacugguucucuuua

SEQ ID NO: 2487883 - RNA, 23 nt, Chlamydia trachomatis
ccacuugcuccacacaacauaac

SEQ ID NO: 2487884 - RNA, 23 nt, Chlamydia trachomatis
ccacuuuuaggauagugacguga

SEQ ID NO: 2487885 - RNA, 14 nt, Chlamydia trachomatis
ccagaaacaggaga

SEQ ID NO: 2487886 - RNA, 15 nt, Chlamydia trachomatis
ccagaacaacuucuc

SEQ ID NO: 2487887 - RNA, 16 nt, Chlamydia trachomatis
ccagaacaacuucucu

SEQ ID NO: 2487888 - RNA, 10 nt, Chlamydia trachomatis
ccagaaggga

SEQ ID NO: 2487889 - RNA, 21 nt, Chlamydia trachomatis
ccagaaucaucugguauucua

SEQ ID NO: 2487890 - RNA, 19 nt, Chlamydia trachomatis
ccagaauccuuuucagaau

SEQ ID NO: 2487891 - RNA, 12 nt, Chlamydia trachomatis
ccagacaaaaag

SEQ ID NO: 2487892 - RNA, 13 nt, Chlamydia trachomatis
ccagacccuucca

SEQ ID NO: 2487893 - RNA, 17 nt, Chlamydia trachomatis
ccagacgcccuccuccu

SEQ ID NO: 2487894 - RNA, 15 nt, Chlamydia trachomatis
ccagauacugcucca

SEQ ID NO: 2487895 - RNA, 14 nt, Chlamydia trachomatis
ccagaucauagaaa

SEQ ID NO: 2487896 - RNA, 20 nt, Chlamydia trachomatis
ccagauuuuucaaaaauagc

SEQ ID NO: 2487897 - RNA, 16 nt, Chlamydia trachomatis
ccagcaagaagacgcu

SEQ ID NO: 2487898 - RNA, 19 nt, Chlamydia trachomatis
ccagcaauaccgaaucuaa

SEQ ID NO: 2487899 - RNA, 23 nt, Chlamydia trachomatis
ccagcaggccucuguuuugaaau

SEQ ID NO: 2487900 - RNA, 20 nt, Chlamydia trachomatis
ccagcaucucgguauucuca

SEQ ID NO: 2487901 - RNA, 13 nt, Chlamydia trachomatis
ccagcaucuuuuc

SEQ ID NO: 2487902 - RNA, 14 nt, Chlamydia trachomatis
ccagcauucauaaa

SEQ ID NO: 2487903 - RNA, 17 nt, Chlamydia trachomatis
ccagcauucauaaacac

SEQ ID NO: 2487904 - RNA, 15 nt, Chlamydia trachomatis
ccagccacauccuga

SEQ ID NO: 2487905 - RNA, 16 nt, Chlamydia trachomatis
ccagccuacaaauaaa

SEQ ID NO: 2487906 - RNA, 19 nt, Chlamydia trachomatis
ccagcgaggcuucaauaau

SEQ ID NO: 2487907 - RNA, 23 nt, Chlamydia trachomatis
ccagcgucuccaaauaaucccac

SEQ ID NO: 2487908 - RNA, 21 nt, Chlamydia trachomatis
ccagcgugucuaccaauuuca

SEQ ID NO: 2487909 - RNA, 15 nt, Chlamydia trachomatis
ccagcucauuagaga

SEQ ID NO: 2487910 - RNA, 13 nt, Chlamydia trachomatis
ccagcucuuccau

SEQ ID NO: 2487911 - RNA, 19 nt, Chlamydia trachomatis
ccaggauaacaaacaacac

SEQ ID NO: 2487912 - RNA, 19 nt, Chlamydia trachomatis
ccaggauaggacuugaacc

SEQ ID NO: 2487913 - RNA, 20 nt, Chlamydia trachomatis
ccaggaucccucuguccauu

SEQ ID NO: 2487914 - RNA, 22 nt, Chlamydia trachomatis
ccaggggugacagcuuucacag

SEQ ID NO: 2487915 - RNA, 18 nt, Chlamydia trachomatis
ccagguaaacucaagggc

SEQ ID NO: 2487916 - RNA, 20 nt, Chlamydia trachomatis
ccagguauuuccugcaagca

SEQ ID NO: 2487917 - RNA, 19 nt, Chlamydia trachomatis
ccaguaauuuaucuagaaa

SEQ ID NO: 2487918 - RNA, 12 nt, Chlamydia trachomatis
ccagucuacagc

SEQ ID NO: 2487919 - RNA, 17 nt, Chlamydia trachomatis
ccagucuacagccuccu

SEQ ID NO: 2487920 - RNA, 22 nt, Chlamydia trachomatis
accugggcauacaccugcaaga

SEQ ID NO: 2487921 - RNA, 16 nt, Chlamydia trachomatis
accuguaggaggacaa

SEQ ID NO: 2487922 - RNA, 21 nt, Chlamydia trachomatis
accuguaggaggacaagcgac

SEQ ID NO: 2487923 - RNA, 16 nt, Chlamydia trachomatis
accugugaagaaacuu

SEQ ID NO: 2487924 - RNA, 23 nt, Chlamydia trachomatis
accuguuguguaucaaaaucaau

SEQ ID NO: 2487925 - RNA, 21 nt, Chlamydia trachomatis
accuguuuaucuucaucagcu

SEQ ID NO: 2487926 - RNA, 12 nt, Chlamydia trachomatis
accuuaaaagca

SEQ ID NO: 2487927 - RNA, 18 nt, Chlamydia trachomatis
accuuaaaagcaaggcuu

SEQ ID NO: 2487928 - RNA, 18 nt, Chlamydia trachomatis
accuuaaaugcaguggaa

SEQ ID NO: 2487929 - RNA, 19 nt, Chlamydia trachomatis
accuuagcuccuaaucuuu

SEQ ID NO: 2487930 - RNA, 15 nt, Chlamydia trachomatis
accuuaggaauaugu

SEQ ID NO: 2487931 - RNA, 23 nt, Chlamydia trachomatis
accuuaucuuggguaagaccaaa

SEQ ID NO: 2487932 - RNA, 21 nt, Chlamydia trachomatis
accuucaaucuguaggggagg

SEQ ID NO: 2487933 - RNA, 14 nt, Chlamydia trachomatis
accuucccgaagua

SEQ ID NO: 2487934 - RNA, 12 nt, Chlamydia trachomatis
accuucucaaau

SEQ ID NO: 2487935 - RNA, 11 nt, Chlamydia trachomatis
accuucuuaca

SEQ ID NO: 2487936 - RNA, 22 nt, Chlamydia trachomatis
accuucuuugggauagauagcu

SEQ ID NO: 2487937 - RNA, 19 nt, Chlamydia trachomatis
accuugaguccgcaaacaa

SEQ ID NO: 2487938 - RNA, 20 nt, Chlamydia trachomatis
accuugaguccgcaaacaaa

SEQ ID NO: 2487939 - RNA, 22 nt, Chlamydia trachomatis
accuugccaucauuaucuucuu

SEQ ID NO: 2487940 - RNA, 19 nt, Chlamydia trachomatis
accuugcuuaacacuucuu

SEQ ID NO: 2487941 - RNA, 17 nt, Chlamydia trachomatis
accuugggaaucuucuu

SEQ ID NO: 2487942 - RNA, 16 nt, Chlamydia trachomatis
accuuuaccaaagaau

SEQ ID NO: 2487943 - RNA, 23 nt, Chlamydia trachomatis
accuuuaccaaagaauucuugcu

SEQ ID NO: 2487944 - RNA, 13 nt, Chlamydia trachomatis
accuuuucccagu

SEQ ID NO: 2487945 - RNA, 12 nt, Chlamydia trachomatis
accuuuucuccg

SEQ ID NO: 2487946 - RNA, 17 nt, Chlamydia trachomatis
accuuuugaaacaucuu

SEQ ID NO: 2487947 - RNA, 17 nt, Chlamydia trachomatis
accuuuuguuuuuuuau

SEQ ID NO: 2487948 - RNA, 17 nt, Chlamydia trachomatis
acgaaaaacagaaagaa

SEQ ID NO: 2487949 - RNA, 23 nt, Chlamydia trachomatis
acgaaagauuugaucuucuggaa

SEQ ID NO: 2487950 - RNA, 16 nt, Chlamydia trachomatis
acgaaagcauccccaa

SEQ ID NO: 2487951 - RNA, 19 nt, Chlamydia trachomatis
acgaaagcauccccaaaag

SEQ ID NO: 2487952 - RNA, 19 nt, Chlamydia trachomatis
acgaaauaggauuuguguu

SEQ ID NO: 2487953 - RNA, 13 nt, Chlamydia trachomatis
acgaacaaaaagu

SEQ ID NO: 2487954 - RNA, 14 nt, Chlamydia trachomatis
acgaacaagaugac

SEQ ID NO: 2487955 - RNA, 24 nt, Chlamydia trachomatis
acgaacuuuccauagcaugggcug

SEQ ID NO: 2487956 - RNA, 12 nt, Chlamydia trachomatis
acgaagcaaaac

SEQ ID NO: 2487957 - RNA, 15 nt, Chlamydia trachomatis
acgaauaagcaucca

SEQ ID NO: 2487958 - RNA, 17 nt, Chlamydia trachomatis
acgaaucgcaccauuua

SEQ ID NO: 2487959 - RNA, 18 nt, Chlamydia trachomatis
acgaaucgccuauagaag

SEQ ID NO: 2487960 - RNA, 21 nt, Chlamydia trachomatis
acgaauuucugggaaaauuaa

SEQ ID NO: 2487961 - RNA, 13 nt, Chlamydia trachomatis
acgagaagucgug

SEQ ID NO: 2487962 - RNA, 14 nt, Chlamydia trachomatis
acgagaucugcauc

SEQ ID NO: 2487963 - RNA, 20 nt, Chlamydia trachomatis
acgagaucugcaucuuuaua

SEQ ID NO: 2487964 - RNA, 16 nt, Chlamydia trachomatis
acgaggcuucucuuuu

SEQ ID NO: 2487965 - RNA, 14 nt, Chlamydia trachomatis
acgaguacagaaua

SEQ ID NO: 2487966 - RNA, 24 nt, Chlamydia trachomatis
acgaguaucuguuaguagcuucuc

SEQ ID NO: 2487967 - RNA, 17 nt, Chlamydia trachomatis
acgagugccgaauaaug

SEQ ID NO: 2487968 - RNA, 22 nt, Chlamydia trachomatis
acgaguucgccccucuuuuuca

SEQ ID NO: 2487969 - RNA, 16 nt, Chlamydia trachomatis
acgaguuuuaggauua

SEQ ID NO: 2487970 - RNA, 15 nt, Chlamydia trachomatis
acgauaaaagacaga

SEQ ID NO: 2487971 - RNA, 20 nt, Chlamydia trachomatis
acgauaaaagacagaacaaa

SEQ ID NO: 2487972 - RNA, 13 nt, Chlamydia trachomatis
acgauaaacagau

SEQ ID NO: 2487973 - RNA, 15 nt, Chlamydia trachomatis
acgauaaccaguacc

SEQ ID NO: 2487974 - RNA, 20 nt, Chlamydia trachomatis
acgauagcuaaucuuuuuga

SEQ ID NO: 2487975 - RNA, 14 nt, Chlamydia trachomatis
acgauauaaagaag

SEQ ID NO: 2487976 - RNA, 15 nt, Chlamydia trachomatis
acgauauaaagaaga

SEQ ID NO: 2487977 - RNA, 17 nt, Chlamydia trachomatis
acgauguacucugcaaa

SEQ ID NO: 2487978 - RNA, 18 nt, Chlamydia trachomatis
acgauuaucuaaagccau

SEQ ID NO: 2487979 - RNA, 18 nt, Chlamydia trachomatis
acgcaaacgaucaaacuc

SEQ ID NO: 2487980 - RNA, 20 nt, Chlamydia trachomatis
acgcaacccuaaaucuccuc

SEQ ID NO: 2487981 - RNA, 14 nt, Chlamydia trachomatis
acgcacaaagauuu

SEQ ID NO: 2487982 - RNA, 20 nt, Chlamydia trachomatis
acgcacaaagauuucuucuu

SEQ ID NO: 2487983 - RNA, 17 nt, Chlamydia trachomatis
acgcacuuuuuguuuua

SEQ ID NO: 2487984 - RNA, 17 nt, Chlamydia trachomatis
acgcauaagcacuauau

SEQ ID NO: 2487985 - RNA, 16 nt, Chlamydia trachomatis
acgcaucccaaaauag

SEQ ID NO: 2487986 - RNA, 12 nt, Chlamydia trachomatis
acgcaucuccaa

SEQ ID NO: 2487987 - RNA, 17 nt, Chlamydia trachomatis
acgcaucuccaaagaca

SEQ ID NO: 2487988 - RNA, 19 nt, Chlamydia trachomatis
acgcaucuccaaagacaca

SEQ ID NO: 2487989 - RNA, 17 nt, Chlamydia trachomatis
acgcauuugcucuucca

SEQ ID NO: 2487990 - RNA, 21 nt, Chlamydia trachomatis
acgccaagaauugacagcacc

SEQ ID NO: 2487991 - RNA, 16 nt, Chlamydia trachomatis
acgccagcuaagagaa

SEQ ID NO: 2487992 - RNA, 22 nt, Chlamydia trachomatis
acgccauaucaaagcuaacuca

SEQ ID NO: 2487993 - RNA, 15 nt, Chlamydia trachomatis
acgccugaucaaauc

SEQ ID NO: 2487994 - RNA, 17 nt, Chlamydia trachomatis
acgccuguuuucuugua

SEQ ID NO: 2487995 - RNA, 14 nt, Chlamydia trachomatis
acgcgauauccuuu

SEQ ID NO: 2487996 - RNA, 16 nt, Chlamydia trachomatis
acgcgauauccuuuuu

SEQ ID NO: 2487997 - RNA, 17 nt, Chlamydia trachomatis
acgcuagaaacagccug

SEQ ID NO: 2487998 - RNA, 19 nt, Chlamydia trachomatis
acgcucaggcuaucacaaa

SEQ ID NO: 2487999 - RNA, 17 nt, Chlamydia trachomatis
acgcucauagauuucag

SEQ ID NO: 2488000 - RNA, 21 nt, Chlamydia trachomatis
acgcuccaaauaaaacgaaaa

SEQ ID NO: 2488001 - RNA, 17 nt, Chlamydia trachomatis
acgcucuuuuucuucca

SEQ ID NO: 2488002 - RNA, 16 nt, Chlamydia trachomatis
acgcuuggugagggac

SEQ ID NO: 2488003 - RNA, 16 nt, Chlamydia trachomatis
acggaacucuuuauua

SEQ ID NO: 2488004 - RNA, 15 nt, Chlamydia trachomatis
acggaauuuuucuca

SEQ ID NO: 2488005 - RNA, 12 nt, Chlamydia trachomatis
acggagagaaag

SEQ ID NO: 2488006 - RNA, 14 nt, Chlamydia trachomatis
acggauaaagaaag

SEQ ID NO: 2488007 - RNA, 17 nt, Chlamydia trachomatis
acggauaaagaaagccg

SEQ ID NO: 2488008 - RNA, 18 nt, Chlamydia trachomatis
acggcaauaaagaaauaa

SEQ ID NO: 2488009 - RNA, 14 nt, Chlamydia trachomatis
acggcaggaaagug

SEQ ID NO: 2488010 - RNA, 15 nt, Chlamydia trachomatis
acggcuaacuccagu

SEQ ID NO: 2488011 - RNA, 18 nt, Chlamydia trachomatis
acggcuucauggaauagu

SEQ ID NO: 2488012 - RNA, 22 nt, Chlamydia trachomatis
acgguagcgauuuucugaaguu

SEQ ID NO: 2488013 - RNA, 20 nt, Chlamydia trachomatis
acgguggaacagcucuaaag

SEQ ID NO: 2488014 - RNA, 23 nt, Chlamydia trachomatis
acguacauaggcauacaggagag

SEQ ID NO: 2488015 - RNA, 23 nt, Chlamydia trachomatis
acguauagcaaugcgaucagaaa

SEQ ID NO: 2488016 - RNA, 12 nt, Chlamydia trachomatis
acgucaauuuuu

SEQ ID NO: 2488017 - RNA, 18 nt, Chlamydia trachomatis
acguccgcuccuucuuuc

SEQ ID NO: 2488018 - RNA, 14 nt, Chlamydia trachomatis
acgucgaaaagcuu

SEQ ID NO: 2488019 - RNA, 18 nt, Chlamydia trachomatis
acgugaggaaguucugcu

SEQ ID NO: 2488020 - RNA, 21 nt, Chlamydia trachomatis
acgugcaacacaacuucugcu

SEQ ID NO: 2488021 - RNA, 13 nt, Chlamydia trachomatis
acguguuaucaaa

SEQ ID NO: 2488022 - RNA, 20 nt, Chlamydia trachomatis
acguuagcaaagacauaaaa

SEQ ID NO: 2488023 - RNA, 17 nt, Chlamydia trachomatis
acguucaacauaugcuc

SEQ ID NO: 2488024 - RNA, 14 nt, Chlamydia trachomatis
acguuggagaaaca

SEQ ID NO: 2488025 - RNA, 20 nt, Chlamydia trachomatis
acugucgaacgcuucuuccc

SEQ ID NO: 2488026 - RNA, 21 nt, Chlamydia trachomatis
acugucgaacgcuucuuccca

SEQ ID NO: 2488027 - RNA, 23 nt, Chlamydia trachomatis
acugucgaacgcuucuucccaac

SEQ ID NO: 2488028 - RNA, 17 nt, Chlamydia trachomatis
acuguucauucucagga

SEQ ID NO: 2488029 - RNA, 13 nt, Chlamydia trachomatis
acuguugagaaaa

SEQ ID NO: 2488030 - RNA, 19 nt, Chlamydia trachomatis
acuuaaaaaacaaaacuac

SEQ ID NO: 2488031 - RNA, 21 nt, Chlamydia trachomatis
acuuaauaagggcuuuugcaa

SEQ ID NO: 2488032 - RNA, 15 nt, Chlamydia trachomatis
acuuacucucuaacu

SEQ ID NO: 2488033 - RNA, 13 nt, Chlamydia trachomatis
acuuacuuuucuu

SEQ ID NO: 2488034 - RNA, 13 nt, Chlamydia trachomatis
acuuagcacucaa

SEQ ID NO: 2488035 - RNA, 22 nt, Chlamydia trachomatis
acuuagcaguuacauuuuucgc

SEQ ID NO: 2488036 - RNA, 14 nt, Chlamydia trachomatis
acuucaauagcagg

SEQ ID NO: 2488037 - RNA, 16 nt, Chlamydia trachomatis
acuucagcaacauuca

SEQ ID NO: 2488038 - RNA, 19 nt, Chlamydia trachomatis
acuucaucgagaagaucuu

SEQ ID NO: 2488039 - RNA, 21 nt, Chlamydia trachomatis
acuucaucgagaagaucuuuc

SEQ ID NO: 2488040 - RNA, 16 nt, Chlamydia trachomatis
acuucauuuuugcuaa

SEQ ID NO: 2488041 - RNA, 14 nt, Chlamydia trachomatis
acuucccacauacu

SEQ ID NO: 2488042 - RNA, 20 nt, Chlamydia trachomatis
acuucccacauacuuggauc

SEQ ID NO: 2488043 - RNA, 16 nt, Chlamydia trachomatis
acuuccccauucuucu

SEQ ID NO: 2488044 - RNA, 18 nt, Chlamydia trachomatis
acuucccuaauacaauca

SEQ ID NO: 2488045 - RNA, 22 nt, Chlamydia trachomatis
acuuccguaccaaggauuuuuu

SEQ ID NO: 2488046 - RNA, 20 nt, Chlamydia trachomatis
acuuccucuggcuuaucaac

SEQ ID NO: 2488047 - RNA, 13 nt, Chlamydia trachomatis
acuucuagauaga

SEQ ID NO: 2488048 - RNA, 15 nt, Chlamydia trachomatis
acuucuccaguuaau

SEQ ID NO: 2488049 - RNA, 22 nt, Chlamydia trachomatis
acuucucgaaaaaaugccucca

SEQ ID NO: 2488050 - RNA, 15 nt, Chlamydia trachomatis
acuucucuuguucug

SEQ ID NO: 2488051 - RNA, 15 nt, Chlamydia trachomatis
acuucugcuaaaaau

SEQ ID NO: 2488052 - RNA, 18 nt, Chlamydia trachomatis
acuucugcuaaaaaugcu

SEQ ID NO: 2488053 - RNA, 20 nt, Chlamydia trachomatis
acuucuggagauugaauaaa

SEQ ID NO: 2488054 - RNA, 18 nt, Chlamydia trachomatis
acuucuuacuuaaaaaac

SEQ ID NO: 2488055 - RNA, 21 nt, Chlamydia trachomatis
acuucuuacuuaaaaaacaaa

SEQ ID NO: 2488056 - RNA, 19 nt, Chlamydia trachomatis
acuucuucuaaguauucuu

SEQ ID NO: 2488057 - RNA, 21 nt, Chlamydia trachomatis
acuucuuuaaagccuuucucu

SEQ ID NO: 2488058 - RNA, 20 nt, Chlamydia trachomatis
acuucuuuauguaaggaaau

SEQ ID NO: 2488059 - RNA, 11 nt, Chlamydia trachomatis
acuucuuuucc

SEQ ID NO: 2488060 - RNA, 18 nt, Chlamydia trachomatis
acuucuuuuccaucuuua

SEQ ID NO: 2488061 - RNA, 20 nt, Chlamydia trachomatis
acuucuuuuccaucuuuaaa

SEQ ID NO: 2488062 - RNA, 16 nt, Chlamydia trachomatis
acuugagaacaaacca

SEQ ID NO: 2488063 - RNA, 15 nt, Chlamydia trachomatis
acuugaguaaucagu

SEQ ID NO: 2488064 - RNA, 21 nt, Chlamydia trachomatis
acuugcaggagauaauuuucu

SEQ ID NO: 2488065 - RNA, 15 nt, Chlamydia trachomatis
acuugcguuuucuug

SEQ ID NO: 2488066 - RNA, 19 nt, Chlamydia trachomatis
acuugcuacggaaaccaau

SEQ ID NO: 2488067 - RNA, 13 nt, Chlamydia trachomatis
acuugucuaaaag

SEQ ID NO: 2488068 - RNA, 22 nt, Chlamydia trachomatis
acuuuagauuuguuuaaaagaa

SEQ ID NO: 2488069 - RNA, 14 nt, Chlamydia trachomatis
acuuuauuauugaa

SEQ ID NO: 2488070 - RNA, 16 nt, Chlamydia trachomatis
acuuucacauuaucuc

SEQ ID NO: 2488071 - RNA, 19 nt, Chlamydia trachomatis
acuuucucgauucucuugc

SEQ ID NO: 2488072 - RNA, 16 nt, Chlamydia trachomatis
acuuucucuucaagau

SEQ ID NO: 2488073 - RNA, 11 nt, Chlamydia trachomatis
acuuugaaaug

SEQ ID NO: 2488074 - RNA, 13 nt, Chlamydia trachomatis
acuuugaaauguc

SEQ ID NO: 2488075 - RNA, 18 nt, Chlamydia trachomatis
acuuugaaauguccacaa

SEQ ID NO: 2488076 - RNA, 13 nt, Chlamydia trachomatis
acuuugacaagca

SEQ ID NO: 2488077 - RNA, 20 nt, Chlamydia trachomatis
acuuugauaauacucuucua

SEQ ID NO: 2488078 - RNA, 15 nt, Chlamydia trachomatis
acuuuguuauuuuuu

SEQ ID NO: 2488079 - RNA, 16 nt, Chlamydia trachomatis
acuuuuagcaaauaau

SEQ ID NO: 2488080 - RNA, 16 nt, Chlamydia trachomatis
acuuuucaacaaucca

SEQ ID NO: 2488081 - RNA, 18 nt, Chlamydia trachomatis
acuuuucagcuuuucuuu

SEQ ID NO: 2488082 - RNA, 20 nt, Chlamydia trachomatis
acuuuucucccuaagaucuc

SEQ ID NO: 2488083 - RNA, 19 nt, Chlamydia trachomatis
acuuuucugcagagcacaa

SEQ ID NO: 2488084 - RNA, 12 nt, Chlamydia trachomatis
acuuuuuagcau

SEQ ID NO: 2488085 - RNA, 14 nt, Chlamydia trachomatis
acuuuuucuacuuu

SEQ ID NO: 2488086 - RNA, 13 nt, Chlamydia trachomatis
agaaaaaaacagc

SEQ ID NO: 2488087 - RNA, 14 nt, Chlamydia trachomatis
agaaaaaaacagcu

SEQ ID NO: 2488088 - RNA, 12 nt, Chlamydia trachomatis
agaaaaaaagag

SEQ ID NO: 2488089 - RNA, 13 nt, Chlamydia trachomatis
agaaaaaauaaug

SEQ ID NO: 2488090 - RNA, 18 nt, Chlamydia trachomatis
agaaaaaccuaagggccg

SEQ ID NO: 2488091 - RNA, 21 nt, Chlamydia trachomatis
agaaaaacgguguuagaaaau

SEQ ID NO: 2488092 - RNA, 19 nt, Chlamydia trachomatis
agaaaaaguaagcgaagaa

SEQ ID NO: 2488093 - RNA, 12 nt, Chlamydia trachomatis
agaaaaauaaaa

SEQ ID NO: 2488094 - RNA, 19 nt, Chlamydia trachomatis
agaaaaaucuagacaagca

SEQ ID NO: 2488095 - RNA, 20 nt, Chlamydia trachomatis
agaaaacagccaagcaagau

SEQ ID NO: 2488096 - RNA, 22 nt, Chlamydia trachomatis
agaaaacagccaagcaagauau

SEQ ID NO: 2488097 - RNA, 23 nt, Chlamydia trachomatis
agaaaacaucgccauucccaaau

SEQ ID NO: 2488098 - RNA, 13 nt, Chlamydia trachomatis
agaaaagagcagc

SEQ ID NO: 2488099 - RNA, 15 nt, Chlamydia trachomatis
agaaaagaggaguug

SEQ ID NO: 2488100 - RNA, 11 nt, Chlamydia trachomatis
agaaaaggccg

SEQ ID NO: 2488101 - RNA, 20 nt, Chlamydia trachomatis
agaaaauacggaagagucug

SEQ ID NO: 2488102 - RNA, 18 nt, Chlamydia trachomatis
agaaaauagguaaagaag

SEQ ID NO: 2488103 - RNA, 15 nt, Chlamydia trachomatis
agaaaaucauagaua

SEQ ID NO: 2488104 - RNA, 9 nt, Chlamydia trachomatis
agaaaaucu

SEQ ID NO: 2488105 - RNA, 17 nt, Chlamydia trachomatis
agaaaaugaugaaaaag

SEQ ID NO: 2488106 - RNA, 13 nt, Chlamydia trachomatis
agaaaauucuucu

SEQ ID NO: 2488107 - RNA, 14 nt, Chlamydia trachomatis
agaaaauuucucuu

SEQ ID NO: 2488108 - RNA, 19 nt, Chlamydia trachomatis
agaaacaacaaagaacucu

SEQ ID NO: 2488109 - RNA, 22 nt, Chlamydia trachomatis
agaaacaaggcuaagaaagguu

SEQ ID NO: 2488110 - RNA, 21 nt, Chlamydia trachomatis
agaaacaauuucaucacagau

SEQ ID NO: 2488111 - RNA, 16 nt, Chlamydia trachomatis
agaaacaggagaaaga

SEQ ID NO: 2488112 - RNA, 18 nt, Chlamydia trachomatis
agaaacaggagaaagaac

SEQ ID NO: 2488113 - RNA, 15 nt, Chlamydia trachomatis
agaaaccgaaaaaaa

SEQ ID NO: 2488114 - RNA, 18 nt, Chlamydia trachomatis
agaaacguguaauuuccu

SEQ ID NO: 2488115 - RNA, 14 nt, Chlamydia trachomatis
agaaacugaaagau

SEQ ID NO: 2488116 - RNA, 16 nt, Chlamydia trachomatis
agaaacuguaaugucc

SEQ ID NO: 2488117 - RNA, 17 nt, Chlamydia trachomatis
agaaacuguaauguccu

SEQ ID NO: 2488118 - RNA, 19 nt, Chlamydia trachomatis
agaaacuguccuuuauuca

SEQ ID NO: 2488119 - RNA, 16 nt, Chlamydia trachomatis
agaaacuuacuuuucu

SEQ ID NO: 2488120 - RNA, 18 nt, Chlamydia trachomatis
agaaacuuacuuuucuua

SEQ ID NO: 2488121 - RNA, 15 nt, Chlamydia trachomatis
agaaacuucuucuaa

SEQ ID NO: 2488122 - RNA, 14 nt, Chlamydia trachomatis
agaaagaaccacaa

SEQ ID NO: 2488123 - RNA, 17 nt, Chlamydia trachomatis
agaaagagccaacgaau

SEQ ID NO: 2488124 - RNA, 21 nt, Chlamydia trachomatis
agaaagagcgaugauuaucac

SEQ ID NO: 2488125 - RNA, 23 nt, Chlamydia trachomatis
agaaagagggguuucauuuauag

SEQ ID NO: 2488126 - RNA, 18 nt, Chlamydia trachomatis
agaaagcccuauuuccua

SEQ ID NO: 2488127 - RNA, 22 nt, Chlamydia trachomatis
agaaagccuucucuuuucacaa

SEQ ID NO: 2488128 - RNA, 22 nt, Chlamydia trachomatis
agaaagcucgaauacgaggagc

SEQ ID NO: 2488129 - RNA, 14 nt, Chlamydia trachomatis
agaaagcugggaaa

SEQ ID NO: 2488130 - RNA, 17 nt, Chlamydia trachomatis
agaaagggcuuuauacu

SEQ ID NO: 2488131 - RNA, 22 nt, Chlamydia trachomatis
agaaaguaauucuucuugaucg

SEQ ID NO: 2488132 - RNA, 15 nt, Chlamydia trachomatis
agaaaguuuuuuuca

SEQ ID NO: 2488133 - RNA, 20 nt, Chlamydia trachomatis
agaaauaaccggaacaauca

SEQ ID NO: 2488134 - RNA, 23 nt, Chlamydia trachomatis
agaaauagcuucguagagcaaga

SEQ ID NO: 2488135 - RNA, 21 nt, Chlamydia trachomatis
agaaauaugacagagcccuuc

SEQ ID NO: 2488136 - RNA, 16 nt, Chlamydia trachomatis
agaaaugcaaauuugc

SEQ ID NO: 2488137 - RNA, 17 nt, Chlamydia trachomatis
agacagagaauagcugc

SEQ ID NO: 2488138 - RNA, 18 nt, Chlamydia trachomatis
agacagccauaucaggac

SEQ ID NO: 2488139 - RNA, 15 nt, Chlamydia trachomatis
agacagcucuugcau

SEQ ID NO: 2488140 - RNA, 15 nt, Chlamydia trachomatis
agacauaaaagcugu

SEQ ID NO: 2488141 - RNA, 18 nt, Chlamydia trachomatis
agaccaggauuccccguc

SEQ ID NO: 2488142 - RNA, 14 nt, Chlamydia trachomatis
agaccauaguugca

SEQ ID NO: 2488143 - RNA, 19 nt, Chlamydia trachomatis
agaccauuggaauuuucau

SEQ ID NO: 2488144 - RNA, 20 nt, Chlamydia trachomatis
agacccuuccaaauuucccu

SEQ ID NO: 2488145 - RNA, 21 nt, Chlamydia trachomatis
agacccuuccaaauuucccuc

SEQ ID NO: 2488146 - RNA, 20 nt, Chlamydia trachomatis
agaccgaaauuaguaauaaa

SEQ ID NO: 2488147 - RNA, 15 nt, Chlamydia trachomatis
agaccgcucucuuuu

SEQ ID NO: 2488148 - RNA, 18 nt, Chlamydia trachomatis
agaccgcucucuuuucug

SEQ ID NO: 2488149 - RNA, 15 nt, Chlamydia trachomatis
agaccuacaaagaua

SEQ ID NO: 2488150 - RNA, 21 nt, Chlamydia trachomatis
accaagauuagauacacagaa

SEQ ID NO: 2488151 - RNA, 16 nt, Chlamydia trachomatis
accaagccauuuccag

SEQ ID NO: 2488152 - RNA, 14 nt, Chlamydia trachomatis
accaagcugcaccc

SEQ ID NO: 2488153 - RNA, 23 nt, Chlamydia trachomatis
accaagcuuagcagauaauucuc

SEQ ID NO: 2488154 - RNA, 11 nt, Chlamydia trachomatis
accaagcuucu

SEQ ID NO: 2488155 - RNA, 14 nt, Chlamydia trachomatis
accaaguucuucuu

SEQ ID NO: 2488156 - RNA, 22 nt, Chlamydia trachomatis
accaauaaugacacacguucca

SEQ ID NO: 2488157 - RNA, 20 nt, Chlamydia trachomatis
accaauagagaccgcucucu

SEQ ID NO: 2488158 - RNA, 14 nt, Chlamydia trachomatis
accaaucaaaaacg

SEQ ID NO: 2488159 - RNA, 19 nt, Chlamydia trachomatis
accaaugaagcaaaucccu

SEQ ID NO: 2488160 - RNA, 12 nt, Chlamydia trachomatis
accaauucucug

SEQ ID NO: 2488161 - RNA, 19 nt, Chlamydia trachomatis
accaauuguugagcagcaa

SEQ ID NO: 2488162 - RNA, 20 nt, Chlamydia trachomatis
accaauuguugagcagcaaa

SEQ ID NO: 2488163 - RNA, 13 nt, Chlamydia trachomatis
accaauuucacca

SEQ ID NO: 2488164 - RNA, 15 nt, Chlamydia trachomatis
accacaaaccauccu

SEQ ID NO: 2488165 - RNA, 19 nt, Chlamydia trachomatis
accacacuucucgaaaaaa

SEQ ID NO: 2488166 - RNA, 17 nt, Chlamydia trachomatis
accacauucuuucugga

SEQ ID NO: 2488167 - RNA, 13 nt, Chlamydia trachomatis
accaccugggcau

SEQ ID NO: 2488168 - RNA, 23 nt, Chlamydia trachomatis
accaccuguugcuuuucgaauga

SEQ ID NO: 2488169 - RNA, 20 nt, Chlamydia trachomatis
accacgagcauaagaauaaa

SEQ ID NO: 2488170 - RNA, 21 nt, Chlamydia trachomatis
accacgugcaacacaacuucu

SEQ ID NO: 2488171 - RNA, 17 nt, Chlamydia trachomatis
accacuaaucccaccuu

SEQ ID NO: 2488172 - RNA, 18 nt, Chlamydia trachomatis
accacuaaucccaccuua

SEQ ID NO: 2488173 - RNA, 15 nt, Chlamydia trachomatis
accagaauauaagca

SEQ ID NO: 2488174 - RNA, 15 nt, Chlamydia trachomatis
accagcagacccaaa

SEQ ID NO: 2488175 - RNA, 21 nt, Chlamydia trachomatis
accagcuaauaaguucacuga

SEQ ID NO: 2488176 - RNA, 21 nt, Chlamydia trachomatis
accagcuucccaggcggagag

SEQ ID NO: 2488177 - RNA, 12 nt, Chlamydia trachomatis
accaguugcuaa

SEQ ID NO: 2488178 - RNA, 22 nt, Chlamydia trachomatis
accaguugcuaaggagaauucu

SEQ ID NO: 2488179 - RNA, 20 nt, Chlamydia trachomatis
accauaacaucuaacagaac

SEQ ID NO: 2488180 - RNA, 16 nt, Chlamydia trachomatis
accauaggaucuggaa

SEQ ID NO: 2488181 - RNA, 12 nt, Chlamydia trachomatis
accaucaaagca

SEQ ID NO: 2488182 - RNA, 15 nt, Chlamydia trachomatis
accauccaauccugu

SEQ ID NO: 2488183 - RNA, 12 nt, Chlamydia trachomatis
accauccuucug

SEQ ID NO: 2488184 - RNA, 23 nt, Chlamydia trachomatis
accaucuucaccaacuccaagca

SEQ ID NO: 2488185 - RNA, 17 nt, Chlamydia trachomatis
accaugcuccuuucacu

SEQ ID NO: 2488186 - RNA, 16 nt, Chlamydia trachomatis
accauuacuacaacag

SEQ ID NO: 2488187 - RNA, 16 nt, Chlamydia trachomatis
accauuggaauuuuca

SEQ ID NO: 2488188 - RNA, 21 nt, Chlamydia trachomatis
accauuggaauuuucaucaaa

SEQ ID NO: 2488189 - RNA, 23 nt, Chlamydia trachomatis
accauugugaacaauaauucagg

SEQ ID NO: 2488190 - RNA, 14 nt, Chlamydia trachomatis
accauuuccacagg

SEQ ID NO: 2488191 - RNA, 18 nt, Chlamydia trachomatis
acccaaaugcggcccaca

SEQ ID NO: 2488192 - RNA, 12 nt, Chlamydia trachomatis
acccaaucuucu

SEQ ID NO: 2488193 - RNA, 15 nt, Chlamydia trachomatis
acccacgaaaagacu

SEQ ID NO: 2488194 - RNA, 16 nt, Chlamydia trachomatis
acccaggcuuuucuuu

SEQ ID NO: 2488195 - RNA, 20 nt, Chlamydia trachomatis
acccauaagauauugccaaa

SEQ ID NO: 2488196 - RNA, 14 nt, Chlamydia trachomatis
acccaugaacagca

SEQ ID NO: 2488197 - RNA, 14 nt, Chlamydia trachomatis
acccauuugccaua

SEQ ID NO: 2488198 - RNA, 16 nt, Chlamydia trachomatis
accccaauguuuccca

SEQ ID NO: 2488199 - RNA, 22 nt, Chlamydia trachomatis
accccaucccuugcaaaaaucu

SEQ ID NO: 2488200 - RNA, 13 nt, Chlamydia trachomatis
accccgccuccaa

SEQ ID NO: 2488201 - RNA, 20 nt, Chlamydia trachomatis
accccuaaaggaaguagaga

SEQ ID NO: 2488202 - RNA, 19 nt, Chlamydia trachomatis
accccuccuccacuuacuc

SEQ ID NO: 2488203 - RNA, 19 nt, Chlamydia trachomatis
acccgauucaaaaaucgcu

SEQ ID NO: 2488204 - RNA, 15 nt, Chlamydia trachomatis
acccgcggaucccaa

SEQ ID NO: 2488205 - RNA, 16 nt, Chlamydia trachomatis
acccgcggaucccaaa

SEQ ID NO: 2488206 - RNA, 18 nt, Chlamydia trachomatis
acccgguauauguauacc

SEQ ID NO: 2488207 - RNA, 18 nt, Chlamydia trachomatis
acccguuuucucuugaaa

SEQ ID NO: 2488208 - RNA, 17 nt, Chlamydia trachomatis
acccuaaaucuccuccu

SEQ ID NO: 2488209 - RNA, 16 nt, Chlamydia trachomatis
acccuaacgaggcaca

SEQ ID NO: 2488210 - RNA, 21 nt, Chlamydia trachomatis
acccuaaucgaauuacucugc

SEQ ID NO: 2488211 - RNA, 16 nt, Chlamydia trachomatis
acccuccgacccaaga

SEQ ID NO: 2488212 - RNA, 16 nt, Chlamydia trachomatis
acccucuucauaaaac

SEQ ID NO: 2488213 - RNA, 21 nt, Chlamydia trachomatis
acccucuuuagccaauuucca

SEQ ID NO: 2488214 - RNA, 15 nt, Chlamydia trachomatis
acccuggaugcacau

SEQ ID NO: 2488215 - RNA, 19 nt, Chlamydia trachomatis
acccuguaaaaggcgcaga

SEQ ID NO: 2488216 - RNA, 16 nt, Chlamydia trachomatis
acccuucaggaaagcc

SEQ ID NO: 2488217 - RNA, 14 nt, Chlamydia trachomatis
acccuuuuuauaau

SEQ ID NO: 2488218 - RNA, 15 nt, Chlamydia trachomatis
accgaacaaccuucu

SEQ ID NO: 2488219 - RNA, 18 nt, Chlamydia trachomatis
accgaagagggaagagaa

SEQ ID NO: 2488220 - RNA, 17 nt, Chlamydia trachomatis
accgaagguucuucuuc

SEQ ID NO: 2488221 - RNA, 12 nt, Chlamydia trachomatis
accgagcauucu

SEQ ID NO: 2488222 - RNA, 14 nt, Chlamydia trachomatis
accgauaauuuuac

SEQ ID NO: 2488223 - RNA, 18 nt, Chlamydia trachomatis
accgaugaaauaucguaa

SEQ ID NO: 2488224 - RNA, 17 nt, Chlamydia trachomatis
accgcaugaaaguagcu

SEQ ID NO: 2488225 - RNA, 15 nt, Chlamydia trachomatis
accgccucaaacaau

SEQ ID NO: 2488226 - RNA, 19 nt, Chlamydia trachomatis
accgccucaaacaaucuaa

SEQ ID NO: 2488227 - RNA, 20 nt, Chlamydia trachomatis
accgcucuuccauaauuucu

SEQ ID NO: 2488228 - RNA, 17 nt, Chlamydia trachomatis
accgggagcauggucuc

SEQ ID NO: 2488229 - RNA, 13 nt, Chlamydia trachomatis
accguagaacaau

SEQ ID NO: 2488230 - RNA, 18 nt, Chlamydia trachomatis
accguagauccuuucggu

SEQ ID NO: 2488231 - RNA, 12 nt, Chlamydia trachomatis
accgugcagagg

SEQ ID NO: 2488232 - RNA, 13 nt, Chlamydia trachomatis
accguuagcauag

SEQ ID NO: 2488233 - RNA, 15 nt, Chlamydia trachomatis
accguucuugacaaa

SEQ ID NO: 2488234 - RNA, 20 nt, Chlamydia trachomatis
accuaagcgcaagaaacuga

SEQ ID NO: 2488235 - RNA, 22 nt, Chlamydia trachomatis
accuaaguagcaaauuaacaga

SEQ ID NO: 2488236 - RNA, 15 nt, Chlamydia trachomatis
accuaauagaaauag

SEQ ID NO: 2488237 - RNA, 12 nt, Chlamydia trachomatis
accuaauaugca

SEQ ID NO: 2488238 - RNA, 13 nt, Chlamydia trachomatis
accuaauaugcag

SEQ ID NO: 2488239 - RNA, 14 nt, Chlamydia trachomatis
accuaauuccccaa

SEQ ID NO: 2488240 - RNA, 23 nt, Chlamydia trachomatis
accuacaaagauaaucaaaccua

SEQ ID NO: 2488241 - RNA, 20 nt, Chlamydia trachomatis
accuaggagcauuccuucua

SEQ ID NO: 2488242 - RNA, 12 nt, Chlamydia trachomatis
accuauggcauu

SEQ ID NO: 2488243 - RNA, 19 nt, Chlamydia trachomatis
accuauuccaaauccuccu

SEQ ID NO: 2488244 - RNA, 18 nt, Chlamydia trachomatis
accucagauuuaucugcu

SEQ ID NO: 2488245 - RNA, 20 nt, Chlamydia trachomatis
accucagauuuaucugcuau

SEQ ID NO: 2488246 - RNA, 20 nt, Chlamydia trachomatis
accuccuuuauauucuucuu

SEQ ID NO: 2488247 - RNA, 21 nt, Chlamydia trachomatis
accuccuuuauauucuucuuc

SEQ ID NO: 2488248 - RNA, 15 nt, Chlamydia trachomatis
accucucaucaguaa

SEQ ID NO: 2488249 - RNA, 21 nt, Chlamydia trachomatis
accucuccauuuuccuguucc

SEQ ID NO: 2488250 - RNA, 11 nt, Chlamydia trachomatis
accucuccuug

SEQ ID NO: 2488251 - RNA, 17 nt, Chlamydia trachomatis
accucugcaagaaaaua

SEQ ID NO: 2488252 - RNA, 18 nt, Chlamydia trachomatis
accucugcaagaaaauaa

SEQ ID NO: 2488253 - RNA, 21 nt, Chlamydia trachomatis
accucuuccguauggguuuuu

SEQ ID NO: 2488254 - RNA, 15 nt, Chlamydia trachomatis
accucuugaggaaga

SEQ ID NO: 2488255 - RNA, 18 nt, Chlamydia trachomatis
accucuugccugcaaaua

SEQ ID NO: 2488256 - RNA, 17 nt, Chlamydia trachomatis
accucuuuacgcacaaa

SEQ ID NO: 2488257 - RNA, 20 nt, Chlamydia trachomatis
accucuuuacgcacaaagau

SEQ ID NO: 2488258 - RNA, 19 nt, Chlamydia trachomatis
accucuuuuuuucccuaga

SEQ ID NO: 2488259 - RNA, 11 nt, Chlamydia trachomatis
aaagaaaaauc

SEQ ID NO: 2488260 - RNA, 14 nt, Chlamydia trachomatis
aaagaaaagcuuuc

SEQ ID NO: 2488261 - RNA, 17 nt, Chlamydia trachomatis
aaagaaagccuucucuu

SEQ ID NO: 2488262 - RNA, 15 nt, Chlamydia trachomatis
aaagaaauagcuauc

SEQ ID NO: 2488263 - RNA, 17 nt, Chlamydia trachomatis
aaagaacaagauccuuc

SEQ ID NO: 2488264 - RNA, 22 nt, Chlamydia trachomatis
aaagaacauauuaggagcaaga

SEQ ID NO: 2488265 - RNA, 19 nt, Chlamydia trachomatis
aaagaacucccuccaaaaa

SEQ ID NO: 2488266 - RNA, 21 nt, Chlamydia trachomatis
aaagaacuuccuauuagggaa

SEQ ID NO: 2488267 - RNA, 20 nt, Chlamydia trachomatis
aaagaagaaucuucuucgaa

SEQ ID NO: 2488268 - RNA, 20 nt, Chlamydia trachomatis
aaagaagaucccauaaucuc

SEQ ID NO: 2488269 - RNA, 21 nt, Chlamydia trachomatis
aaagaagccauaguagaaauu

SEQ ID NO: 2488270 - RNA, 13 nt, Chlamydia trachomatis
aaagaauaguaug

SEQ ID NO: 2488271 - RNA, 12 nt, Chlamydia trachomatis
aaagaaucaaaa

SEQ ID NO: 2488272 - RNA, 22 nt, Chlamydia trachomatis
aaagaaucccucuagcaaccaa

SEQ ID NO: 2488273 - RNA, 18 nt, Chlamydia trachomatis
aaagaaucuaaaaagcca

SEQ ID NO: 2488274 - RNA, 16 nt, Chlamydia trachomatis
aaagaaucuccuguac

SEQ ID NO: 2488275 - RNA, 17 nt, Chlamydia trachomatis
aaagaauggaucucccu

SEQ ID NO: 2488276 - RNA, 13 nt, Chlamydia trachomatis
aaagaauuugcuu

SEQ ID NO: 2488277 - RNA, 17 nt, Chlamydia trachomatis
aaagaauuuuuagggaa

SEQ ID NO: 2488278 - RNA, 15 nt, Chlamydia trachomatis
aaagacagaacaaac

SEQ ID NO: 2488279 - RNA, 21 nt, Chlamydia trachomatis
aaagacagaacaaacgaagga

SEQ ID NO: 2488280 - RNA, 16 nt, Chlamydia trachomatis
aaagaccauaguugca

SEQ ID NO: 2488281 - RNA, 14 nt, Chlamydia trachomatis
aaagacuacagucu

SEQ ID NO: 2488282 - RNA, 18 nt, Chlamydia trachomatis
aaagacuucacugccuuu

SEQ ID NO: 2488283 - RNA, 16 nt, Chlamydia trachomatis
aaagagaagaaggcuu

SEQ ID NO: 2488284 - RNA, 12 nt, Chlamydia trachomatis
aaagagaaggcc

SEQ ID NO: 2488285 - RNA, 17 nt, Chlamydia trachomatis
aaagagaaucaucggcu

SEQ ID NO: 2488286 - RNA, 23 nt, Chlamydia trachomatis
aaagagagaggagaaaaacuccu

SEQ ID NO: 2488287 - RNA, 14 nt, Chlamydia trachomatis
aaagagagcaacga

SEQ ID NO: 2488288 - RNA, 20 nt, Chlamydia trachomatis
aaagagcuaaacuucuuguu

SEQ ID NO: 2488289 - RNA, 17 nt, Chlamydia trachomatis
aaagagcuucuagaaau

SEQ ID NO: 2488290 - RNA, 14 nt, Chlamydia trachomatis
aaagaggagaacau

SEQ ID NO: 2488291 - RNA, 15 nt, Chlamydia trachomatis
aaagaggucuuuuaa

SEQ ID NO: 2488292 - RNA, 15 nt, Chlamydia trachomatis
aaagaguaagugcua

SEQ ID NO: 2488293 - RNA, 17 nt, Chlamydia trachomatis
aaagagucgcuucuggc

SEQ ID NO: 2488294 - RNA, 18 nt, Chlamydia trachomatis
aaagagucuucaucaaua

SEQ ID NO: 2488295 - RNA, 23 nt, Chlamydia trachomatis
aaagaguggacuuuagauagucu

SEQ ID NO: 2488296 - RNA, 13 nt, Chlamydia trachomatis
aaagaguuucuuu

SEQ ID NO: 2488297 - RNA, 17 nt, Chlamydia trachomatis
aaagaguuucuuuguuc

SEQ ID NO: 2488298 - RNA, 22 nt, Chlamydia trachomatis
aaagauaacacucucaucuaaa

SEQ ID NO: 2488299 - RNA, 17 nt, Chlamydia trachomatis
aaagauagugcagaaga

SEQ ID NO: 2488300 - RNA, 18 nt, Chlamydia trachomatis
aaagauccucuuucgcuu

SEQ ID NO: 2488301 - RNA, 19 nt, Chlamydia trachomatis
aaagaucgguucauaaaau

SEQ ID NO: 2488302 - RNA, 12 nt, Chlamydia trachomatis
aaagaucuucaa

SEQ ID NO: 2488303 - RNA, 13 nt, Chlamydia trachomatis
aaagaucuucaac

SEQ ID NO: 2488304 - RNA, 23 nt, Chlamydia trachomatis
aaagaugcgaucuccucauccuu

SEQ ID NO: 2488305 - RNA, 15 nt, Chlamydia trachomatis
aaagauuucuucuuu

SEQ ID NO: 2488306 - RNA, 16 nt, Chlamydia trachomatis
aaagcaaaacauccau

SEQ ID NO: 2488307 - RNA, 13 nt, Chlamydia trachomatis
aaagcacaauaac

SEQ ID NO: 2488308 - RNA, 16 nt, Chlamydia trachomatis
aaagcacgauaaaaga

SEQ ID NO: 2488309 - RNA, 15 nt, Chlamydia trachomatis
aaagccauagccauc

SEQ ID NO: 2488310 - RNA, 15 nt, Chlamydia trachomatis
aaagccccuacucuu

SEQ ID NO: 2488311 - RNA, 23 nt, Chlamydia trachomatis
aaagccccuccgcugauuagaaa

SEQ ID NO: 2488312 - RNA, 17 nt, Chlamydia trachomatis
aaagccguucccaauaa

SEQ ID NO: 2488313 - RNA, 17 nt, Chlamydia trachomatis
aaagccucuuguugaau

SEQ ID NO: 2488314 - RNA, 13 nt, Chlamydia trachomatis
aaagccuucucuu

SEQ ID NO: 2488315 - RNA, 21 nt, Chlamydia trachomatis
aaagccuucucuuuucacaaa

SEQ ID NO: 2488316 - RNA, 23 nt, Chlamydia trachomatis
aaagccuuucucuaaaagaagag

SEQ ID NO: 2488317 - RNA, 20 nt, Chlamydia trachomatis
aaagcgaggcuucaaagaac

SEQ ID NO: 2488318 - RNA, 15 nt, Chlamydia trachomatis
aaagcgaucuuugaa

SEQ ID NO: 2488319 - RNA, 13 nt, Chlamydia trachomatis
aaagcguucuccg

SEQ ID NO: 2488320 - RNA, 18 nt, Chlamydia trachomatis
aaagcuaacucaccuaaa

SEQ ID NO: 2488321 - RNA, 21 nt, Chlamydia trachomatis
aaagcuaagauuccucuugaa

SEQ ID NO: 2488322 - RNA, 19 nt, Chlamydia trachomatis
aaagcuacagucuguccag

SEQ ID NO: 2488323 - RNA, 12 nt, Chlamydia trachomatis
aaagcuccuaaa

SEQ ID NO: 2488324 - RNA, 20 nt, Chlamydia trachomatis
aaagcugcuuuacaucccuu

SEQ ID NO: 2488325 - RNA, 23 nt, Chlamydia trachomatis
aaagcugcuuuagcugcuuuaaa

SEQ ID NO: 2488326 - RNA, 18 nt, Chlamydia trachomatis
aaagcugggcagcaagag

SEQ ID NO: 2488327 - RNA, 19 nt, Chlamydia trachomatis
aaagcugggcagcaagaga

SEQ ID NO: 2488328 - RNA, 23 nt, Chlamydia trachomatis
aaagcugguuucagcgguugccu

SEQ ID NO: 2488329 - RNA, 20 nt, Chlamydia trachomatis
aaagcugguuuuuuuugaaa

SEQ ID NO: 2488330 - RNA, 14 nt, Chlamydia trachomatis
aaagcuucccuucu

SEQ ID NO: 2488331 - RNA, 15 nt, Chlamydia trachomatis
aaagcuuucccguau

SEQ ID NO: 2488332 - RNA, 14 nt, Chlamydia trachomatis
aaagcuuuguugca

SEQ ID NO: 2488333 - RNA, 19 nt, Chlamydia trachomatis
aaagcuuuucuccuucuuu

SEQ ID NO: 2488334 - RNA, 20 nt, Chlamydia trachomatis
aaagcuuuuguuaaccaagc

SEQ ID NO: 2488335 - RNA, 19 nt, Chlamydia trachomatis
aaagcuuuuucuacuguag

SEQ ID NO: 2488336 - RNA, 20 nt, Chlamydia trachomatis
aaagcuuuuucuacuguagc

SEQ ID NO: 2488337 - RNA, 13 nt, Chlamydia trachomatis
aaaggaaacaaau

SEQ ID NO: 2488338 - RNA, 14 nt, Chlamydia trachomatis
aaaggaaacaagca

SEQ ID NO: 2488339 - RNA, 17 nt, Chlamydia trachomatis
aaaggaaacaagcagau

SEQ ID NO: 2488340 - RNA, 16 nt, Chlamydia trachomatis
aaaggaaaucacugaa

SEQ ID NO: 2488341 - RNA, 17 nt, Chlamydia trachomatis
aaaggaacaucgagaaa

SEQ ID NO: 2488342 - RNA, 21 nt, Chlamydia trachomatis
aaaggaacaucgagaaaauga

SEQ ID NO: 2488343 - RNA, 18 nt, Chlamydia trachomatis
aaaggaaguugagaagcg

SEQ ID NO: 2488344 - RNA, 18 nt, Chlamydia trachomatis
aaaggagcccaagcuuuc

SEQ ID NO: 2488345 - RNA, 18 nt, Chlamydia trachomatis
aaaggauauacagaacau

SEQ ID NO: 2488346 - RNA, 17 nt, Chlamydia trachomatis
aaaggcaacaaaggcga

SEQ ID NO: 2488347 - RNA, 23 nt, Chlamydia trachomatis
aaaggcaacucucucuccccaua

SEQ ID NO: 2488348 - RNA, 22 nt, Chlamydia trachomatis
aaaggcggcuauuaaccgccau

SEQ ID NO: 2488349 - RNA, 19 nt, Chlamydia trachomatis
aaaggcuguugugggagau

SEQ ID NO: 2488350 - RNA, 19 nt, Chlamydia trachomatis
aaaggcuuugucuauaagg

SEQ ID NO: 2488351 - RNA, 12 nt, Chlamydia trachomatis
aaagggaaaaaa

SEQ ID NO: 2488352 - RNA, 17 nt, Chlamydia trachomatis
aaagggaaaaaacuaga

SEQ ID NO: 2488353 - RNA, 16 nt, Chlamydia trachomatis
aaagggagaggauucc

SEQ ID NO: 2488354 - RNA, 23 nt, Chlamydia trachomatis
aaaggggaaguccgauaggaaaa

SEQ ID NO: 2488355 - RNA, 16 nt, Chlamydia trachomatis
aaagggggacaaaaau

SEQ ID NO: 2488356 - RNA, 18 nt, Chlamydia trachomatis
aaagggggacaaaaauac

SEQ ID NO: 2488357 - RNA, 21 nt, Chlamydia trachomatis
aaaggucucccaagaaacuuu

SEQ ID NO: 2488358 - RNA, 13 nt, Chlamydia trachomatis
aaaggucucucuu

SEQ ID NO: 2488359 - RNA, 20 nt, Chlamydia trachomatis
aaagguguguucccagagaa

SEQ ID NO: 2488360 - RNA, 20 nt, Chlamydia trachomatis
aaagguguuuucuacggaaa

SEQ ID NO: 2488361 - RNA, 14 nt, Chlamydia trachomatis
aaagguuguugcca

SEQ ID NO: 2488362 - RNA, 21 nt, Chlamydia trachomatis
aaagguuuguuuccucucucu

SEQ ID NO: 2488363 - RNA, 22 nt, Chlamydia trachomatis
aaagguuuguuuccucucucug

SEQ ID NO: 2488364 - RNA, 19 nt, Chlamydia trachomatis
aaaguaacuacggaaaaag

SEQ ID NO: 2488365 - RNA, 20 nt, Chlamydia trachomatis
aaaguaacuacggaaaaaga

SEQ ID NO: 2488366 - RNA, 13 nt, Chlamydia trachomatis
aaaguaaucucuu

SEQ ID NO: 2488367 - RNA, 15 nt, Chlamydia trachomatis
aaaguaaucucuuaa

SEQ ID NO: 2488368 - RNA, 20 nt, Chlamydia trachomatis
aaaguaaucucuuaauccuu

SEQ ID NO: 2488369 - RNA, 19 nt, Chlamydia trachomatis
aaaguacucagucaaucca

SEQ ID NO: 2488370 - RNA, 20 nt, Chlamydia trachomatis
aaaugauaauccucgcaauc

SEQ ID NO: 2488371 - RNA, 13 nt, Chlamydia trachomatis
aaaugaucgccuc

SEQ ID NO: 2488372 - RNA, 16 nt, Chlamydia trachomatis
aaaugaugaaaaagaa

SEQ ID NO: 2488373 - RNA, 15 nt, Chlamydia trachomatis
aaaugcaaagcuuuu

SEQ ID NO: 2488374 - RNA, 13 nt, Chlamydia trachomatis
aaaugcaaauuug

SEQ ID NO: 2488375 - RNA, 17 nt, Chlamydia trachomatis
aaaugcaaauuugcaga

SEQ ID NO: 2488376 - RNA, 21 nt, Chlamydia trachomatis
aaaugcgcucuuuaggcaccc

SEQ ID NO: 2488377 - RNA, 19 nt, Chlamydia trachomatis
aaaugcgugaacuguucau

SEQ ID NO: 2488378 - RNA, 21 nt, Chlamydia trachomatis
aaaugcguuucuucugcugau

SEQ ID NO: 2488379 - RNA, 15 nt, Chlamydia trachomatis
aaaugcucucgcauu

SEQ ID NO: 2488380 - RNA, 21 nt, Chlamydia trachomatis
aaaugcucucgcauuugagau

SEQ ID NO: 2488381 - RNA, 16 nt, Chlamydia trachomatis
aaaugcuguaaaacau

SEQ ID NO: 2488382 - RNA, 18 nt, Chlamydia trachomatis
aaaugcuguaaaacauuu

SEQ ID NO: 2488383 - RNA, 15 nt, Chlamydia trachomatis
aaauggaaauaaaaa

SEQ ID NO: 2488384 - RNA, 14 nt, Chlamydia trachomatis
aaauggucucuucu

SEQ ID NO: 2488385 - RNA, 13 nt, Chlamydia trachomatis
aaauggugaaacu

SEQ ID NO: 2488386 - RNA, 15 nt, Chlamydia trachomatis
aaauggugaaacuuu

SEQ ID NO: 2488387 - RNA, 15 nt, Chlamydia trachomatis
aaauguugaugguuu

SEQ ID NO: 2488388 - RNA, 22 nt, Chlamydia trachomatis
aaauguuuuugaugaggcuugu

SEQ ID NO: 2488389 - RNA, 13 nt, Chlamydia trachomatis
aaauuaaaaggcg

SEQ ID NO: 2488390 - RNA, 12 nt, Chlamydia trachomatis
aaauuaacaauc

SEQ ID NO: 2488391 - RNA, 13 nt, Chlamydia trachomatis
aaauuaauguaau

SEQ ID NO: 2488392 - RNA, 21 nt, Chlamydia trachomatis
aaauuacaauaauacaaagca

SEQ ID NO: 2488393 - RNA, 22 nt, Chlamydia trachomatis
aaauuagaacggcauucccauu

SEQ ID NO: 2488394 - RNA, 16 nt, Chlamydia trachomatis
aaauuagggaaaaacu

SEQ ID NO: 2488395 - RNA, 22 nt, Chlamydia trachomatis
aaauuagggaaaaacuuuucuu

SEQ ID NO: 2488396 - RNA, 17 nt, Chlamydia trachomatis
aaauuauaaugaaagag

SEQ ID NO: 2488397 - RNA, 16 nt, Chlamydia trachomatis
aaauuaucgccaaaaa

SEQ ID NO: 2488398 - RNA, 19 nt, Chlamydia trachomatis
aaauucagaucccauccuu

SEQ ID NO: 2488399 - RNA, 19 nt, Chlamydia trachomatis
aaauucauaacaccugcau

SEQ ID NO: 2488400 - RNA, 22 nt, Chlamydia trachomatis
aaauucuaaacgagcuagcucu

SEQ ID NO: 2488401 - RNA, 15 nt, Chlamydia trachomatis
aaauucuucaucuau

SEQ ID NO: 2488402 - RNA, 15 nt, Chlamydia trachomatis
aaauucuucugauaa

SEQ ID NO: 2488403 - RNA, 18 nt, Chlamydia trachomatis
aaauucuucugauaaaug

SEQ ID NO: 2488404 - RNA, 12 nt, Chlamydia trachomatis
aaauugcaaaga

SEQ ID NO: 2488405 - RNA, 20 nt, Chlamydia trachomatis
aaauugugauuuuucgcuau

SEQ ID NO: 2488406 - RNA, 20 nt, Chlamydia trachomatis
aaauuuaucugcuaaagaaa

SEQ ID NO: 2488407 - RNA, 21 nt, Chlamydia trachomatis
aaauuuaucugcuaaagaaaa

SEQ ID NO: 2488408 - RNA, 18 nt, Chlamydia trachomatis
aaauuuaucugcuuccgu

SEQ ID NO: 2488409 - RNA, 15 nt, Chlamydia trachomatis
aaauuucaucccaca

SEQ ID NO: 2488410 - RNA, 16 nt, Chlamydia trachomatis
aaauuucccucuuccc

SEQ ID NO: 2488411 - RNA, 20 nt, Chlamydia trachomatis
aaauuucuauagaagaauuc

SEQ ID NO: 2488412 - RNA, 12 nt, Chlamydia trachomatis
aaauuucucuag

SEQ ID NO: 2488413 - RNA, 16 nt, Chlamydia trachomatis
aaauuucucuaggaac

SEQ ID NO: 2488414 - RNA, 18 nt, Chlamydia trachomatis
aaauuuggcaauggcaaa

SEQ ID NO: 2488415 - RNA, 16 nt, Chlamydia trachomatis
aaauuuuaaaucccag

SEQ ID NO: 2488416 - RNA, 11 nt, Chlamydia trachomatis
aaauuuucaca

SEQ ID NO: 2488417 - RNA, 18 nt, Chlamydia trachomatis
aaauuuucacacauccuu

SEQ ID NO: 2488418 - RNA, 19 nt, Chlamydia trachomatis
aaauuuucaugaaaagcuu

SEQ ID NO: 2488419 - RNA, 22 nt, Chlamydia trachomatis
aaauuuuguuuaaucagugugu

SEQ ID NO: 2488420 - RNA, 13 nt, Chlamydia trachomatis
aacaaaaagcgcu

SEQ ID NO: 2488421 - RNA, 12 nt, Chlamydia trachomatis
aacaaaaauaac

SEQ ID NO: 2488422 - RNA, 12 nt, Chlamydia trachomatis
aacaaaaccaaa

SEQ ID NO: 2488423 - RNA, 16 nt, Chlamydia trachomatis
aacaaaacuugucuaa

SEQ ID NO: 2488424 - RNA, 12 nt, Chlamydia trachomatis
aacaaaagagau

SEQ ID NO: 2488425 - RNA, 12 nt, Chlamydia trachomatis
aacaaacaacac

SEQ ID NO: 2488426 - RNA, 11 nt, Chlamydia trachomatis
aacaaaccaau

SEQ ID NO: 2488427 - RNA, 21 nt, Chlamydia trachomatis
aacaaagcacuguccacauua

SEQ ID NO: 2488428 - RNA, 17 nt, Chlamydia trachomatis
aacaaauaccaaaauau

SEQ ID NO: 2488429 - RNA, 19 nt, Chlamydia trachomatis
aacaaauuccucuguagau

SEQ ID NO: 2488430 - RNA, 14 nt, Chlamydia trachomatis
aacaacaaagaacu

SEQ ID NO: 2488431 - RNA, 12 nt, Chlamydia trachomatis
aacaacaaucaa

SEQ ID NO: 2488432 - RNA, 17 nt, Chlamydia trachomatis
aacaacaaucaaacguc

SEQ ID NO: 2488433 - RNA, 16 nt, Chlamydia trachomatis
aacaacauaaaauccu

SEQ ID NO: 2488434 - RNA, 19 nt, Chlamydia trachomatis
aacaacaugggcauagucu

SEQ ID NO: 2488435 - RNA, 18 nt, Chlamydia trachomatis
aacaaccauaauacgaau

SEQ ID NO: 2488436 - RNA, 15 nt, Chlamydia trachomatis
aacaaccaucaaagc

SEQ ID NO: 2488437 - RNA, 15 nt, Chlamydia trachomatis
aacaaccuucugacu

SEQ ID NO: 2488438 - RNA, 15 nt, Chlamydia trachomatis
aacaacugcucugcc

SEQ ID NO: 2488439 - RNA, 21 nt, Chlamydia trachomatis
aacaacugcugauaaauuucu

SEQ ID NO: 2488440 - RNA, 16 nt, Chlamydia trachomatis
aacaacuucaauagca

SEQ ID NO: 2488441 - RNA, 16 nt, Chlamydia trachomatis
aacaagauuuuuuaca

SEQ ID NO: 2488442 - RNA, 15 nt, Chlamydia trachomatis
aacaagcaaaacaua

SEQ ID NO: 2488443 - RNA, 18 nt, Chlamydia trachomatis
aacaaggcuaagaaaaac

SEQ ID NO: 2488444 - RNA, 14 nt, Chlamydia trachomatis
aacaaggcuuuucc

SEQ ID NO: 2488445 - RNA, 19 nt, Chlamydia trachomatis
aacaaggcuuuuccauucc

SEQ ID NO: 2488446 - RNA, 19 nt, Chlamydia trachomatis
aacaagguucuucaacaac

SEQ ID NO: 2488447 - RNA, 20 nt, Chlamydia trachomatis
aacaagguucuucaacaacu

SEQ ID NO: 2488448 - RNA, 22 nt, Chlamydia trachomatis
aacaagguucuucaacaacuuc

SEQ ID NO: 2488449 - RNA, 20 nt, Chlamydia trachomatis
aacaaguuucuuccagacaa

SEQ ID NO: 2488450 - RNA, 19 nt, Chlamydia trachomatis
aacaauacuacuaagguga

SEQ ID NO: 2488451 - RNA, 15 nt, Chlamydia trachomatis
aacaauauagucccu

SEQ ID NO: 2488452 - RNA, 13 nt, Chlamydia trachomatis
aacaaucaaagca

SEQ ID NO: 2488453 - RNA, 14 nt, Chlamydia trachomatis
aacaaucaaagcac

SEQ ID NO: 2488454 - RNA, 15 nt, Chlamydia trachomatis
aacaaucacaggcug

SEQ ID NO: 2488455 - RNA, 17 nt, Chlamydia trachomatis
aacaaucuaaaaaauua

SEQ ID NO: 2488456 - RNA, 15 nt, Chlamydia trachomatis
aacaaugacucaaaa

SEQ ID NO: 2488457 - RNA, 20 nt, Chlamydia trachomatis
aacaaugauauucuaauccu

SEQ ID NO: 2488458 - RNA, 21 nt, Chlamydia trachomatis
aacaaugccgcccaaggaaaa

SEQ ID NO: 2488459 - RNA, 20 nt, Chlamydia trachomatis
aacaaugcugauaaaaauaa

SEQ ID NO: 2488460 - RNA, 21 nt, Chlamydia trachomatis
aacaauuuccuuagaaagaau

SEQ ID NO: 2488461 - RNA, 19 nt, Chlamydia trachomatis
aacaauuugugauuucuga

SEQ ID NO: 2488462 - RNA, 14 nt, Chlamydia trachomatis
aacaauuuuaaaau

SEQ ID NO: 2488463 - RNA, 18 nt, Chlamydia trachomatis
aacacaagcagacaagca

SEQ ID NO: 2488464 - RNA, 21 nt, Chlamydia trachomatis
aacacaaguaugagaggaaga

SEQ ID NO: 2488465 - RNA, 13 nt, Chlamydia trachomatis
aacacaauuuuug

SEQ ID NO: 2488466 - RNA, 21 nt, Chlamydia trachomatis
aacacauaucuccaaaaauau

SEQ ID NO: 2488467 - RNA, 13 nt, Chlamydia trachomatis
aacaccaaauccu

SEQ ID NO: 2488468 - RNA, 17 nt, Chlamydia trachomatis
aacaccccccucugcac

SEQ ID NO: 2488469 - RNA, 21 nt, Chlamydia trachomatis
aacaccucuccuugaacaauu

SEQ ID NO: 2488470 - RNA, 14 nt, Chlamydia trachomatis
aacaccucuucugg

SEQ ID NO: 2488471 - RNA, 12 nt, Chlamydia trachomatis
aacaccugcaua

SEQ ID NO: 2488472 - RNA, 22 nt, Chlamydia trachomatis
aacacgaaugccuguggcaacu

SEQ ID NO: 2488473 - RNA, 22 nt, Chlamydia trachomatis
aacacgcucauagauuucagca

SEQ ID NO: 2488474 - RNA, 20 nt, Chlamydia trachomatis
aacacguagucauugauucu

SEQ ID NO: 2488475 - RNA, 16 nt, Chlamydia trachomatis
aacacgucuuaaaggu

SEQ ID NO: 2488476 - RNA, 23 nt, Chlamydia trachomatis
aacacucgugaaauaaaucacaa

SEQ ID NO: 2488477 - RNA, 16 nt, Chlamydia trachomatis
aacacugaaaaucgcu

SEQ ID NO: 2488478 - RNA, 17 nt, Chlamydia trachomatis
aacagaaagaaaugcgu

SEQ ID NO: 2488479 - RNA, 21 nt, Chlamydia trachomatis
aacagaaggaguuuuucuccu

SEQ ID NO: 2488480 - RNA, 23 nt, Chlamydia trachomatis
aacagacuaaguuguaaaacaac

SEQ ID NO: 2488481 - RNA, 16 nt, Chlamydia trachomatis
aacagaucuuuuucau

SEQ ID NO: 2488482 - RNA, 16 nt, Chlamydia trachomatis
aacgcauuacauauag

SEQ ID NO: 2488483 - RNA, 16 nt, Chlamydia trachomatis
aacgcauuucuuuguu

SEQ ID NO: 2488484 - RNA, 20 nt, Chlamydia trachomatis
aacgccguguucggaaugga

SEQ ID NO: 2488485 - RNA, 23 nt, Chlamydia trachomatis
aacgccguguucggaauggauac

SEQ ID NO: 2488486 - RNA, 19 nt, Chlamydia trachomatis
aacgcuguuggaccagcgc

SEQ ID NO: 2488487 - RNA, 14 nt, Chlamydia trachomatis
aacgcuucuuccca

SEQ ID NO: 2488488 - RNA, 14 nt, Chlamydia trachomatis
aacgcuugcacagc

SEQ ID NO: 2488489 - RNA, 18 nt, Chlamydia trachomatis
aacggaacucuacaaaau

SEQ ID NO: 2488490 - RNA, 22 nt, Chlamydia trachomatis
aacggaacucuacaaaauaaaa

SEQ ID NO: 2488491 - RNA, 14 nt, Chlamydia trachomatis
aacggaauccuaag

SEQ ID NO: 2488492 - RNA, 22 nt, Chlamydia trachomatis
aacggaaucucgagcuaagaaa

SEQ ID NO: 2488493 - RNA, 14 nt, Chlamydia trachomatis
aacggacgacugca

SEQ ID NO: 2488494 - RNA, 14 nt, Chlamydia trachomatis
aacggaggauaguu

SEQ ID NO: 2488495 - RNA, 21 nt, Chlamydia trachomatis
aacggcacucaaauuucucua

SEQ ID NO: 2488496 - RNA, 21 nt, Chlamydia trachomatis
aacggcauaggcgugaagaga

SEQ ID NO: 2488497 - RNA, 14 nt, Chlamydia trachomatis
aacguaaaagagua

SEQ ID NO: 2488498 - RNA, 18 nt, Chlamydia trachomatis
aacguacuuuaggagaaa

SEQ ID NO: 2488499 - RNA, 21 nt, Chlamydia trachomatis
aacguagauaucuuuacucuu

SEQ ID NO: 2488500 - RNA, 14 nt, Chlamydia trachomatis
aacgucccuguguc

SEQ ID NO: 2488501 - RNA, 15 nt, Chlamydia trachomatis
aacguccgcuccuuc

SEQ ID NO: 2488502 - RNA, 16 nt, Chlamydia trachomatis
aacguccgcuccuucu

SEQ ID NO: 2488503 - RNA, 19 nt, Chlamydia trachomatis
aacgucgaaaagcuucugc

SEQ ID NO: 2488504 - RNA, 20 nt, Chlamydia trachomatis
aacgucgaaaagcuucugcc

SEQ ID NO: 2488505 - RNA, 22 nt, Chlamydia trachomatis
aacgucgugccaccgaagggac

SEQ ID NO: 2488506 - RNA, 19 nt, Chlamydia trachomatis
aacgugucgaaaaugguuu

SEQ ID NO: 2488507 - RNA, 22 nt, Chlamydia trachomatis
aacguguuguuugguucuugua

SEQ ID NO: 2488508 - RNA, 14 nt, Chlamydia trachomatis
aacguuucuguuca

SEQ ID NO: 2488509 - RNA, 11 nt, Chlamydia trachomatis
aacuaaaaagg

SEQ ID NO: 2488510 - RNA, 13 nt, Chlamydia trachomatis
aacuaaacuccau

SEQ ID NO: 2488511 - RNA, 14 nt, Chlamydia trachomatis
aacuaaaggaaaca

SEQ ID NO: 2488512 - RNA, 18 nt, Chlamydia trachomatis
aacuaaaggaaacaagca

SEQ ID NO: 2488513 - RNA, 20 nt, Chlamydia trachomatis
aacuaaaggaaacaagcaga

SEQ ID NO: 2488514 - RNA, 14 nt, Chlamydia trachomatis
aacuaaaugucucu

SEQ ID NO: 2488515 - RNA, 21 nt, Chlamydia trachomatis
aacuaagcuucucaacacuga

SEQ ID NO: 2488516 - RNA, 12 nt, Chlamydia trachomatis
aacuaauuuuug

SEQ ID NO: 2488517 - RNA, 16 nt, Chlamydia trachomatis
aacuacaacaaguucc

SEQ ID NO: 2488518 - RNA, 17 nt, Chlamydia trachomatis
aacuacagaaagaguca

SEQ ID NO: 2488519 - RNA, 18 nt, Chlamydia trachomatis
aacuacagaaagagucac

SEQ ID NO: 2488520 - RNA, 21 nt, Chlamydia trachomatis
aacuaccaaaccuuaaaagca

SEQ ID NO: 2488521 - RNA, 23 nt, Chlamydia trachomatis
aacuacccgauucaaaaaucgcu

SEQ ID NO: 2488522 - RNA, 17 nt, Chlamydia trachomatis
aacuacggaaaaagaag

SEQ ID NO: 2488523 - RNA, 14 nt, Chlamydia trachomatis
aacuacucaacaaa

SEQ ID NO: 2488524 - RNA, 16 nt, Chlamydia trachomatis
aacuacucaacaaauu

SEQ ID NO: 2488525 - RNA, 22 nt, Chlamydia trachomatis
aacuacucccaaaucaaaccaa

SEQ ID NO: 2488526 - RNA, 21 nt, Chlamydia trachomatis
aacuagcaaauucgcuaccaa

SEQ ID NO: 2488527 - RNA, 17 nt, Chlamydia trachomatis
aacuaggcaaucuccuu

SEQ ID NO: 2488528 - RNA, 20 nt, Chlamydia trachomatis
aacuagucuacucauccuaa

SEQ ID NO: 2488529 - RNA, 15 nt, Chlamydia trachomatis
aacuagucucuucug

SEQ ID NO: 2488530 - RNA, 17 nt, Chlamydia trachomatis
aacuaucagaagauagu

SEQ ID NO: 2488531 - RNA, 19 nt, Chlamydia trachomatis
aacucaaaagcuuuuccgc

SEQ ID NO: 2488532 - RNA, 13 nt, Chlamydia trachomatis
aacucaaaauaaa

SEQ ID NO: 2488533 - RNA, 19 nt, Chlamydia trachomatis
aacuccaagcauuaccaua

SEQ ID NO: 2488534 - RNA, 11 nt, Chlamydia trachomatis
aacuccagaaa

SEQ ID NO: 2488535 - RNA, 18 nt, Chlamydia trachomatis
aacuccauaaaaagccaa

SEQ ID NO: 2488536 - RNA, 15 nt, Chlamydia trachomatis
aacucccccuuucaa

SEQ ID NO: 2488537 - RNA, 13 nt, Chlamydia trachomatis
aacucccucauua

SEQ ID NO: 2488538 - RNA, 15 nt, Chlamydia trachomatis
aacuccguaguccac

SEQ ID NO: 2488539 - RNA, 19 nt, Chlamydia trachomatis
aacucggguuuuaaaugcu

SEQ ID NO: 2488540 - RNA, 20 nt, Chlamydia trachomatis
aacucgugaauguuaacauc

SEQ ID NO: 2488541 - RNA, 17 nt, Chlamydia trachomatis
aacucuaaauaccucuu

SEQ ID NO: 2488542 - RNA, 15 nt, Chlamydia trachomatis
aacucuauuaagaau

SEQ ID NO: 2488543 - RNA, 20 nt, Chlamydia trachomatis
aacucuccuaauucaacaua

SEQ ID NO: 2488544 - RNA, 21 nt, Chlamydia trachomatis
aacucucgggccaaaaagacu

SEQ ID NO: 2488545 - RNA, 23 nt, Chlamydia trachomatis
aacucucgggccaaaaagacuac

SEQ ID NO: 2488546 - RNA, 13 nt, Chlamydia trachomatis
aacucucucuccc

SEQ ID NO: 2488547 - RNA, 14 nt, Chlamydia trachomatis
aacucuuaaaaggc

SEQ ID NO: 2488548 - RNA, 11 nt, Chlamydia trachomatis
aacucuugaaa

SEQ ID NO: 2488549 - RNA, 19 nt, Chlamydia trachomatis
aacucuuuuccuaaacaaa

SEQ ID NO: 2488550 - RNA, 18 nt, Chlamydia trachomatis
aacugcagcaucuauuuu

SEQ ID NO: 2488551 - RNA, 14 nt, Chlamydia trachomatis
aacugcagugacau

SEQ ID NO: 2488552 - RNA, 19 nt, Chlamydia trachomatis
aacugcgacguaacaccaa

SEQ ID NO: 2488553 - RNA, 16 nt, Chlamydia trachomatis
aacugcucuucuaacu

SEQ ID NO: 2488554 - RNA, 16 nt, Chlamydia trachomatis
aacuggagaauccaua

SEQ ID NO: 2488555 - RNA, 22 nt, Chlamydia trachomatis
aacuguccuuuauucaauauca

SEQ ID NO: 2488556 - RNA, 15 nt, Chlamydia trachomatis
aacugucuucuuuca

SEQ ID NO: 2488557 - RNA, 13 nt, Chlamydia trachomatis
aacugugaagaau

SEQ ID NO: 2488558 - RNA, 17 nt, Chlamydia trachomatis
aacugugaagaaugaaa

SEQ ID NO: 2488559 - RNA, 20 nt, Chlamydia trachomatis
aacuuaugaaaacuuuguau

SEQ ID NO: 2488560 - RNA, 17 nt, Chlamydia trachomatis
aacuucauauucccugu

SEQ ID NO: 2488561 - RNA, 15 nt, Chlamydia trachomatis
aacuucccacucauc

SEQ ID NO: 2488562 - RNA, 16 nt, Chlamydia trachomatis
aacuucuccaguuaau

SEQ ID NO: 2488563 - RNA, 21 nt, Chlamydia trachomatis
aacuucuggagauugaauaaa

SEQ ID NO: 2488564 - RNA, 18 nt, Chlamydia trachomatis
aacuucuggcaguaacaa

SEQ ID NO: 2488565 - RNA, 21 nt, Chlamydia trachomatis
aacuucuggcaguaacaagca

SEQ ID NO: 2488566 - RNA, 14 nt, Chlamydia trachomatis
aacuucuucauccu

SEQ ID NO: 2488567 - RNA, 22 nt, Chlamydia trachomatis
aacuugcaggagauaauuuucu

SEQ ID NO: 2488568 - RNA, 20 nt, Chlamydia trachomatis
aacuuggucagcucauuaga

SEQ ID NO: 2488569 - RNA, 19 nt, Chlamydia trachomatis
aacuugucuaaaagaauau

SEQ ID NO: 2488570 - RNA, 20 nt, Chlamydia trachomatis
aacuuguuccuaauuuaaaa

SEQ ID NO: 2488571 - RNA, 12 nt, Chlamydia trachomatis
aacuuucuucca

SEQ ID NO: 2488572 - RNA, 16 nt, Chlamydia trachomatis
aacuuugaacaaauuu

SEQ ID NO: 2488573 - RNA, 17 nt, Chlamydia trachomatis
aacuuugacaagcagua

SEQ ID NO: 2488574 - RNA, 20 nt, Chlamydia trachomatis
aacuuuguuauuuuuuaaga

SEQ ID NO: 2488575 - RNA, 12 nt, Chlamydia trachomatis
aacuuuucugca

SEQ ID NO: 2488576 - RNA, 13 nt, Chlamydia trachomatis
aacuuuucuuccu

SEQ ID NO: 2488577 - RNA, 15 nt, Chlamydia trachomatis
aacuuuuucucuugc

SEQ ID NO: 2488578 - RNA, 15 nt, Chlamydia trachomatis
aagaaaaaaaaccaa

SEQ ID NO: 2488579 - RNA, 15 nt, Chlamydia trachomatis
aagaaaaaaagaggu

SEQ ID NO: 2488580 - RNA, 23 nt, Chlamydia trachomatis
aagaaaaaaagaggucugugcua

SEQ ID NO: 2488581 - RNA, 14 nt, Chlamydia trachomatis
aagaaaaauaaaaa

SEQ ID NO: 2488582 - RNA, 16 nt, Chlamydia trachomatis
aagaaaauagguaaag

SEQ ID NO: 2488583 - RNA, 19 nt, Chlamydia trachomatis
aagaaaauagguaaagaag

SEQ ID NO: 2488584 - RNA, 15 nt, Chlamydia trachomatis
aagaaacuguaaugu

SEQ ID NO: 2488585 - RNA, 15 nt, Chlamydia trachomatis
aagaaacuuuucugc

SEQ ID NO: 2488586 - RNA, 16 nt, Chlamydia trachomatis
aagaaacuuuucugca

SEQ ID NO: 2488587 - RNA, 18 nt, Chlamydia trachomatis
aagaaagcccuauuuccu

SEQ ID NO: 2488588 - RNA, 19 nt, Chlamydia trachomatis
aagaaagcuucuuguucgu

SEQ ID NO: 2488589 - RNA, 18 nt, Chlamydia trachomatis
aagaaaggccuauccaag

SEQ ID NO: 2488590 - RNA, 23 nt, Chlamydia trachomatis
aagaaagucguacagaucuugau

SEQ ID NO: 2488591 - RNA, 21 nt, Chlamydia trachomatis
aagaaauaaccggaacaauca

SEQ ID NO: 2488592 - RNA, 12 nt, Chlamydia trachomatis
aagaaauagcuu

SEQ ID NO: 2488593 - RNA, 20 nt, Chlamydia trachomatis
aagaaauauucccaaagcua

SEQ ID NO: 2488594 - RNA, 19 nt, Chlamydia trachomatis
aagaucucuuucucuagaa

SEQ ID NO: 2488595 - RNA, 20 nt, Chlamydia trachomatis
aagaucucuuucucuagaau

SEQ ID NO: 2488596 - RNA, 14 nt, Chlamydia trachomatis
aagaucuguagcaa

SEQ ID NO: 2488597 - RNA, 13 nt, Chlamydia trachomatis
aagaucuucaaca

SEQ ID NO: 2488598 - RNA, 17 nt, Chlamydia trachomatis
aagaucuucagaaaucu

SEQ ID NO: 2488599 - RNA, 18 nt, Chlamydia trachomatis
aagaucuucagaaaucuu

SEQ ID NO: 2488600 - RNA, 12 nt, Chlamydia trachomatis
aagaucuuuacu

SEQ ID NO: 2488601 - RNA, 15 nt, Chlamydia trachomatis
aagaucuuuacuuuc

SEQ ID NO: 2488602 - RNA, 13 nt, Chlamydia trachomatis
aagaugaagaagu

SEQ ID NO: 2488603 - RNA, 14 nt, Chlamydia trachomatis
aagaugaagaaguu

SEQ ID NO: 2488604 - RNA, 17 nt, Chlamydia trachomatis
aagaugaauccaccgua

SEQ ID NO: 2488605 - RNA, 22 nt, Chlamydia trachomatis
aagauuccucuugaaccaguuu

SEQ ID NO: 2488606 - RNA, 23 nt, Chlamydia trachomatis
aagauucgauauacgcucuuuca

SEQ ID NO: 2488607 - RNA, 15 nt, Chlamydia trachomatis
aagauuuccccuuuu

SEQ ID NO: 2488608 - RNA, 20 nt, Chlamydia trachomatis
aagauuuucaacgggaacaa

SEQ ID NO: 2488609 - RNA, 13 nt, Chlamydia trachomatis
aagauuuucaucu

SEQ ID NO: 2488610 - RNA, 20 nt, Chlamydia trachomatis
aagauuuucaucuuccaacg

SEQ ID NO: 2488611 - RNA, 14 nt, Chlamydia trachomatis
aagauuuugaauac

SEQ ID NO: 2488612 - RNA, 21 nt, Chlamydia trachomatis
aagauuuuuagaaggaaagcu

SEQ ID NO: 2488613 - RNA, 19 nt, Chlamydia trachomatis
aagcaaacuucauauuccc

SEQ ID NO: 2488614 - RNA, 19 nt, Chlamydia trachomatis
aagcaaauagauaacuuug

SEQ ID NO: 2488615 - RNA, 18 nt, Chlamydia trachomatis
aagcaaaucccugugcua

SEQ ID NO: 2488616 - RNA, 20 nt, Chlamydia trachomatis
aagcaauagcgcaaaaggcu

SEQ ID NO: 2488617 - RNA, 18 nt, Chlamydia trachomatis
aagcaauauaacuagaag

SEQ ID NO: 2488618 - RNA, 22 nt, Chlamydia trachomatis
aagcacaauaacagcacaaaca

SEQ ID NO: 2488619 - RNA, 17 nt, Chlamydia trachomatis
aagcaccuuuacaauca

SEQ ID NO: 2488620 - RNA, 18 nt, Chlamydia trachomatis
aagcaccuuuacaaucau

SEQ ID NO: 2488621 - RNA, 17 nt, Chlamydia trachomatis
aagcacgauaaaagaca

SEQ ID NO: 2488622 - RNA, 15 nt, Chlamydia trachomatis
aagcacguuuaacuu

SEQ ID NO: 2488623 - RNA, 19 nt, Chlamydia trachomatis
aagcacuauaucuccaaca

SEQ ID NO: 2488624 - RNA, 16 nt, Chlamydia trachomatis
aagcacuccucagcau

SEQ ID NO: 2488625 - RNA, 13 nt, Chlamydia trachomatis
aagcagaaacaau

SEQ ID NO: 2488626 - RNA, 14 nt, Chlamydia trachomatis
aagcagcagaaggu

SEQ ID NO: 2488627 - RNA, 22 nt, Chlamydia trachomatis
aagcagugaagaaugaucacuu

SEQ ID NO: 2488628 - RNA, 18 nt, Chlamydia trachomatis
aagcauagggcuaagaau

SEQ ID NO: 2488629 - RNA, 13 nt, Chlamydia trachomatis
aagcauccaagac

SEQ ID NO: 2488630 - RNA, 15 nt, Chlamydia trachomatis
aagcauccccaaaag

SEQ ID NO: 2488631 - RNA, 21 nt, Chlamydia trachomatis
aagcaucuuuaccauuuccac

SEQ ID NO: 2488632 - RNA, 17 nt, Chlamydia trachomatis
aagcaugauauuuugaa

SEQ ID NO: 2488633 - RNA, 19 nt, Chlamydia trachomatis
aagcaugcaauccuucuug

SEQ ID NO: 2488634 - RNA, 22 nt, Chlamydia trachomatis
aagcaugucgagauaaaaaccu

SEQ ID NO: 2488635 - RNA, 18 nt, Chlamydia trachomatis
aagccaauguucuauaua

SEQ ID NO: 2488636 - RNA, 23 nt, Chlamydia trachomatis
aagccagccccucccugcgaauu

SEQ ID NO: 2488637 - RNA, 15 nt, Chlamydia trachomatis
aagccauaauaaaag

SEQ ID NO: 2488638 - RNA, 13 nt, Chlamydia trachomatis
aagccauacaaag

SEQ ID NO: 2488639 - RNA, 15 nt, Chlamydia trachomatis
aagccauagccauca

SEQ ID NO: 2488640 - RNA, 15 nt, Chlamydia trachomatis
aagccauaguagaaa

SEQ ID NO: 2488641 - RNA, 23 nt, Chlamydia trachomatis
aagccccaauagcuaagguaaca

SEQ ID NO: 2488642 - RNA, 21 nt, Chlamydia trachomatis
aagccccuacucuuccuugau

SEQ ID NO: 2488643 - RNA, 21 nt, Chlamydia trachomatis
aagccccuuacgaggcuucuc

SEQ ID NO: 2488644 - RNA, 20 nt, Chlamydia trachomatis
aagccuccgguuuccaaaua

SEQ ID NO: 2488645 - RNA, 21 nt, Chlamydia trachomatis
aagccuccugcguuagcaaga

SEQ ID NO: 2488646 - RNA, 21 nt, Chlamydia trachomatis
aagccuucucuuuucacaaag

SEQ ID NO: 2488647 - RNA, 23 nt, Chlamydia trachomatis
aagccuugagccuucaauucuug

SEQ ID NO: 2488648 - RNA, 17 nt, Chlamydia trachomatis
aagccuuggguucuucu

SEQ ID NO: 2488649 - RNA, 20 nt, Chlamydia trachomatis
aagccuuggguucuucugag

SEQ ID NO: 2488650 - RNA, 21 nt, Chlamydia trachomatis
aagccuuucucuaaaagaaga

SEQ ID NO: 2488651 - RNA, 23 nt, Chlamydia trachomatis
aagccuuuuguuuucuugauucc

SEQ ID NO: 2488652 - RNA, 15 nt, Chlamydia trachomatis
aagcgaaaaaaaaag

SEQ ID NO: 2488653 - RNA, 19 nt, Chlamydia trachomatis
aagcgaaaaaaaaagaaca

SEQ ID NO: 2488654 - RNA, 13 nt, Chlamydia trachomatis
aagcgaagcauuc

SEQ ID NO: 2488655 - RNA, 20 nt, Chlamydia trachomatis
aagcgaggcuucaaagaaca

SEQ ID NO: 2488656 - RNA, 23 nt, Chlamydia trachomatis
aagcgcuccuagugauaaacagg

SEQ ID NO: 2488657 - RNA, 17 nt, Chlamydia trachomatis
aagcggauucaagacca

SEQ ID NO: 2488658 - RNA, 14 nt, Chlamydia trachomatis
aagcgucuccaaaa

SEQ ID NO: 2488659 - RNA, 23 nt, Chlamydia trachomatis
aagcguuccuauacaagaaaaca

SEQ ID NO: 2488660 - RNA, 20 nt, Chlamydia trachomatis
aagcguucuccgaguuuauc

SEQ ID NO: 2488661 - RNA, 16 nt, Chlamydia trachomatis
aagcguuuaagugacu

SEQ ID NO: 2488662 - RNA, 17 nt, Chlamydia trachomatis
aagcuaagauuccucuu

SEQ ID NO: 2488663 - RNA, 15 nt, Chlamydia trachomatis
aagcuacagucuguc

SEQ ID NO: 2488664 - RNA, 21 nt, Chlamydia trachomatis
aagcuacugaugacuuucggc

SEQ ID NO: 2488665 - RNA, 17 nt, Chlamydia trachomatis
aagcuagaaaauagcau

SEQ ID NO: 2488666 - RNA, 16 nt, Chlamydia trachomatis
aagcuagaagaagagg

SEQ ID NO: 2488667 - RNA, 17 nt, Chlamydia trachomatis
aagcuagaagaagagga

SEQ ID NO: 2488668 - RNA, 19 nt, Chlamydia trachomatis
aagcuagaagaagaggagg

SEQ ID NO: 2488669 - RNA, 13 nt, Chlamydia trachomatis
aagcuagaagaau

SEQ ID NO: 2488670 - RNA, 14 nt, Chlamydia trachomatis
aagcuagaagaauc

SEQ ID NO: 2488671 - RNA, 16 nt, Chlamydia trachomatis
aagcuagguaaagguu

SEQ ID NO: 2488672 - RNA, 18 nt, Chlamydia trachomatis
aagcuagguaaagguuuc

SEQ ID NO: 2488673 - RNA, 18 nt, Chlamydia trachomatis
aagcuaucaucgcacagc

SEQ ID NO: 2488674 - RNA, 16 nt, Chlamydia trachomatis
aagcuauccauguuuc

SEQ ID NO: 2488675 - RNA, 15 nt, Chlamydia trachomatis
aagcuauuugcaaga

SEQ ID NO: 2488676 - RNA, 16 nt, Chlamydia trachomatis
aagcuauuuucuuccu

SEQ ID NO: 2488677 - RNA, 18 nt, Chlamydia trachomatis
aagcuauuuucuuccugc

SEQ ID NO: 2488678 - RNA, 15 nt, Chlamydia trachomatis
aagcucgaauacgag

SEQ ID NO: 2488679 - RNA, 18 nt, Chlamydia trachomatis
aagcucggucucauuaua

SEQ ID NO: 2488680 - RNA, 13 nt, Chlamydia trachomatis
aagcucgucuuua

SEQ ID NO: 2488681 - RNA, 19 nt, Chlamydia trachomatis
aagcucgucuuuagaagaa

SEQ ID NO: 2488682 - RNA, 22 nt, Chlamydia trachomatis
aagcucgucuuuagaagaaaag

SEQ ID NO: 2488683 - RNA, 15 nt, Chlamydia trachomatis
aagcucuaacucuuc

SEQ ID NO: 2488684 - RNA, 19 nt, Chlamydia trachomatis
aagcucuaacucuucuuua

SEQ ID NO: 2488685 - RNA, 23 nt, Chlamydia trachomatis
aagcucugaguuaaaggaaggga

SEQ ID NO: 2488686 - RNA, 12 nt, Chlamydia trachomatis
aagcucuucgag

SEQ ID NO: 2488687 - RNA, 20 nt, Chlamydia trachomatis
aagcucuucgagucuucccu

SEQ ID NO: 2488688 - RNA, 22 nt, Chlamydia trachomatis
aagcucuugucgauaaaguaaa

SEQ ID NO: 2488689 - RNA, 15 nt, Chlamydia trachomatis
aagcugacaaagcuu

SEQ ID NO: 2488690 - RNA, 23 nt, Chlamydia trachomatis
aagcugacgcgccuguguuaacu

SEQ ID NO: 2488691 - RNA, 21 nt, Chlamydia trachomatis
aagcugagcuucucgcuacaa

SEQ ID NO: 2488692 - RNA, 21 nt, Chlamydia trachomatis
aagcugcuuuacaucccuuga

SEQ ID NO: 2488693 - RNA, 17 nt, Chlamydia trachomatis
aagcugggaaagcugca

SEQ ID NO: 2488694 - RNA, 11 nt, Chlamydia trachomatis
aagcugggcag

SEQ ID NO: 2488695 - RNA, 18 nt, Chlamydia trachomatis
aagcugggcagcaagaga

SEQ ID NO: 2488696 - RNA, 20 nt, Chlamydia trachomatis
aagcugggcagcaagagaga

SEQ ID NO: 2488697 - RNA, 22 nt, Chlamydia trachomatis
aagcuguaggucgcuugauucu

SEQ ID NO: 2488698 - RNA, 15 nt, Chlamydia trachomatis
aagcuguucuuccau

SEQ ID NO: 2488699 - RNA, 22 nt, Chlamydia trachomatis
aagcuuaguuacaagacaauaa

SEQ ID NO: 2488700 - RNA, 14 nt, Chlamydia trachomatis
aagcuucccuucuc

SEQ ID NO: 2488701 - RNA, 15 nt, Chlamydia trachomatis
aagcuucuaagaaca

SEQ ID NO: 2488702 - RNA, 15 nt, Chlamydia trachomatis
aagcuucucaacacu

SEQ ID NO: 2488703 - RNA, 19 nt, Chlamydia trachomatis
aagcuucugccauuucuaa

SEQ ID NO: 2488704 - RNA, 20 nt, Chlamydia trachomatis
aagcuucuugggauaugccu

SEQ ID NO: 2488705 - RNA, 21 nt, Chlamydia trachomatis
aaguucguucaauuaaagaag

SEQ ID NO: 2488706 - RNA, 14 nt, Chlamydia trachomatis
aaguucuccuucuu

SEQ ID NO: 2488707 - RNA, 14 nt, Chlamydia trachomatis
aaguucuucuucca

SEQ ID NO: 2488708 - RNA, 21 nt, Chlamydia trachomatis
aaguucuucuuuagaaacuaa

SEQ ID NO: 2488709 - RNA, 21 nt, Chlamydia trachomatis
aaguucuuuuuccucuucaga

SEQ ID NO: 2488710 - RNA, 16 nt, Chlamydia trachomatis
aaguuggucgcagaau

SEQ ID NO: 2488711 - RNA, 15 nt, Chlamydia trachomatis
aaguuguuggaguua

SEQ ID NO: 2488712 - RNA, 12 nt, Chlamydia trachomatis
aaguuuccuuaa

SEQ ID NO: 2488713 - RNA, 14 nt, Chlamydia trachomatis
aaguuucuaauaau

SEQ ID NO: 2488714 - RNA, 24 nt, Chlamydia trachomatis
aaguuuuacuauucgagaaugaau

SEQ ID NO: 2488715 - RNA, 18 nt, Chlamydia trachomatis
aaguuuuuguuuuuuuca

SEQ ID NO: 2488716 - RNA, 12 nt, Chlamydia trachomatis
aauaaaaagccc

SEQ ID NO: 2488717 - RNA, 19 nt, Chlamydia trachomatis
aauaaaaagcccagaacaa

SEQ ID NO: 2488718 - RNA, 16 nt, Chlamydia trachomatis
aauaaaacgaaaaaca

SEQ ID NO: 2488719 - RNA, 17 nt, Chlamydia trachomatis
aauaaaacgaaaaacag

SEQ ID NO: 2488720 - RNA, 12 nt, Chlamydia trachomatis
aauaaaagcucc

SEQ ID NO: 2488721 - RNA, 20 nt, Chlamydia trachomatis
aauaaaagcuccuaaagaag

SEQ ID NO: 2488722 - RNA, 18 nt, Chlamydia trachomatis
aauaaaagcugguuuuuu

SEQ ID NO: 2488723 - RNA, 19 nt, Chlamydia trachomatis
aauaaaaguacuucuagau

SEQ ID NO: 2488724 - RNA, 16 nt, Chlamydia trachomatis
aauaaaaucaaauaaa

SEQ ID NO: 2488725 - RNA, 22 nt, Chlamydia trachomatis
aauaaacagaucuuuuucauuu

SEQ ID NO: 2488726 - RNA, 16 nt, Chlamydia trachomatis
aauaaacagguaaaaa

SEQ ID NO: 2488727 - RNA, 13 nt, Chlamydia trachomatis
aauaaaccaaagg

SEQ ID NO: 2488728 - RNA, 14 nt, Chlamydia trachomatis
aauaaaccaaaggc

SEQ ID NO: 2488729 - RNA, 19 nt, Chlamydia trachomatis
aauaaacccuggaugcaca

SEQ ID NO: 2488730 - RNA, 13 nt, Chlamydia trachomatis
aauaaagaagccu

SEQ ID NO: 2488731 - RNA, 19 nt, Chlamydia trachomatis
aauaaagcggcuaaagaag

SEQ ID NO: 2488732 - RNA, 12 nt, Chlamydia trachomatis
aauaaaggaaac

SEQ ID NO: 2488733 - RNA, 15 nt, Chlamydia trachomatis
aauaaaggaaacaaa

SEQ ID NO: 2488734 - RNA, 21 nt, Chlamydia trachomatis
aauaaagucucuuaagcguuu

SEQ ID NO: 2488735 - RNA, 12 nt, Chlamydia trachomatis
aauaaaucacaa

SEQ ID NO: 2488736 - RNA, 15 nt, Chlamydia trachomatis
aauaaaucuauccau

SEQ ID NO: 2488737 - RNA, 17 nt, Chlamydia trachomatis
aauaaaucuauccauaa

SEQ ID NO: 2488738 - RNA, 15 nt, Chlamydia trachomatis
aauaaaucucuucca

SEQ ID NO: 2488739 - RNA, 12 nt, Chlamydia trachomatis
aauaaaucugcu

SEQ ID NO: 2488740 - RNA, 14 nt, Chlamydia trachomatis
aauaaauuagggaa

SEQ ID NO: 2488741 - RNA, 23 nt, Chlamydia trachomatis
aauaaauuagggaagagcaauau

SEQ ID NO: 2488742 - RNA, 18 nt, Chlamydia trachomatis
aauaacacucgcaucauc

SEQ ID NO: 2488743 - RNA, 18 nt, Chlamydia trachomatis
aauaacagcacaaacaaa

SEQ ID NO: 2488744 - RNA, 17 nt, Chlamydia trachomatis
aauaaccugaagauuuu

SEQ ID NO: 2488745 - RNA, 20 nt, Chlamydia trachomatis
aauaaccugaagauuuuuua

SEQ ID NO: 2488746 - RNA, 16 nt, Chlamydia trachomatis
aauaacgauaguacaa

SEQ ID NO: 2488747 - RNA, 23 nt, Chlamydia trachomatis
aauaacgauucuugauaaauaau

SEQ ID NO: 2488748 - RNA, 16 nt, Chlamydia trachomatis
aauaacgcccucuuuu

SEQ ID NO: 2488749 - RNA, 17 nt, Chlamydia trachomatis
aauaacguagauaucuu

SEQ ID NO: 2488750 - RNA, 21 nt, Chlamydia trachomatis
aauaacguagauaucuuuacu

SEQ ID NO: 2488751 - RNA, 19 nt, Chlamydia trachomatis
aauaacugagccaagaaca

SEQ ID NO: 2488752 - RNA, 23 nt, Chlamydia trachomatis
aauaacugagccaagaacaaagc

SEQ ID NO: 2488753 - RNA, 18 nt, Chlamydia trachomatis
aauaacuggaguuuuccu

SEQ ID NO: 2488754 - RNA, 19 nt, Chlamydia trachomatis
aauaacuggaguuuuccug

SEQ ID NO: 2488755 - RNA, 13 nt, Chlamydia trachomatis
aauaagaaaguuu

SEQ ID NO: 2488756 - RNA, 23 nt, Chlamydia trachomatis
aauaagaaaguuuuuuucaggag

SEQ ID NO: 2488757 - RNA, 18 nt, Chlamydia trachomatis
aauaagaaauuaacccaa

SEQ ID NO: 2488758 - RNA, 20 nt, Chlamydia trachomatis
aauaagaaauuaacccaaga

SEQ ID NO: 2488759 - RNA, 16 nt, Chlamydia trachomatis
aauaagaccucuuuuu

SEQ ID NO: 2488760 - RNA, 23 nt, Chlamydia trachomatis
aauaagaugaugaguggauacgc

SEQ ID NO: 2488761 - RNA, 14 nt, Chlamydia trachomatis
aauaagcgaaaaaa

SEQ ID NO: 2488762 - RNA, 19 nt, Chlamydia trachomatis
aauaagcgaaaaaaaaaga

SEQ ID NO: 2488763 - RNA, 19 nt, Chlamydia trachomatis
aauaagcuugaucaaagaa

SEQ ID NO: 2488764 - RNA, 17 nt, Chlamydia trachomatis
aauaagggcuuuugcaa

SEQ ID NO: 2488765 - RNA, 18 nt, Chlamydia trachomatis
aauaaggggaagaaauau

SEQ ID NO: 2488766 - RNA, 21 nt, Chlamydia trachomatis
aauaagguauccaacaauauu

SEQ ID NO: 2488767 - RNA, 23 nt, Chlamydia trachomatis
aauaagugcuccugcagacaagc

SEQ ID NO: 2488768 - RNA, 16 nt, Chlamydia trachomatis
aauaaguuaccucuuu

SEQ ID NO: 2488769 - RNA, 17 nt, Chlamydia trachomatis
aauaaguuguaaagcau

SEQ ID NO: 2488770 - RNA, 15 nt, Chlamydia trachomatis
aauaaguuuuucaaa

SEQ ID NO: 2488771 - RNA, 14 nt, Chlamydia trachomatis
aauaauacaaagca

SEQ ID NO: 2488772 - RNA, 15 nt, Chlamydia trachomatis
aauaauacaaagcac

SEQ ID NO: 2488773 - RNA, 16 nt, Chlamydia trachomatis
aauaauacaaagcacg

SEQ ID NO: 2488774 - RNA, 22 nt, Chlamydia trachomatis
aauaauaccuuaauaagcuuuu

SEQ ID NO: 2488775 - RNA, 23 nt, Chlamydia trachomatis
aauaauaucgagcucauuuucua

SEQ ID NO: 2488776 - RNA, 19 nt, Chlamydia trachomatis
aauaauauuuuuucccuuu

SEQ ID NO: 2488777 - RNA, 13 nt, Chlamydia trachomatis
aauaaucgaguga

SEQ ID NO: 2488778 - RNA, 19 nt, Chlamydia trachomatis
aauaaucgcucguuccuca

SEQ ID NO: 2488779 - RNA, 22 nt, Chlamydia trachomatis
aauaaucgcucguuccucagcu

SEQ ID NO: 2488780 - RNA, 22 nt, Chlamydia trachomatis
aauaaucuuguaauaucaaaga

SEQ ID NO: 2488781 - RNA, 11 nt, Chlamydia trachomatis
aauaaugaaau

SEQ ID NO: 2488782 - RNA, 20 nt, Chlamydia trachomatis
aauaaugauucccagggaga

SEQ ID NO: 2488783 - RNA, 21 nt, Chlamydia trachomatis
aauaauggacugguuguuccc

SEQ ID NO: 2488784 - RNA, 18 nt, Chlamydia trachomatis
aauaaugggccguuuuuc

SEQ ID NO: 2488785 - RNA, 14 nt, Chlamydia trachomatis
aauaaugggcuccu

SEQ ID NO: 2488786 - RNA, 20 nt, Chlamydia trachomatis
aauaauucaggcucuuucag

SEQ ID NO: 2488787 - RNA, 12 nt, Chlamydia trachomatis
aauaauuucuga

SEQ ID NO: 2488788 - RNA, 23 nt, Chlamydia trachomatis
aauaauuugcgcgucuagcgcau

SEQ ID NO: 2488789 - RNA, 13 nt, Chlamydia trachomatis
aauaauuuuccac

SEQ ID NO: 2488790 - RNA, 21 nt, Chlamydia trachomatis
aauaauuuuccacaaauauuu

SEQ ID NO: 2488791 - RNA, 16 nt, Chlamydia trachomatis
aauacaaaccgaagag

SEQ ID NO: 2488792 - RNA, 19 nt, Chlamydia trachomatis
aauacaaaccgaagaggga

SEQ ID NO: 2488793 - RNA, 19 nt, Chlamydia trachomatis
aauacaaagcacgauaaaa

SEQ ID NO: 2488794 - RNA, 21 nt, Chlamydia trachomatis
aauacaaaucuuuuaucuucu

SEQ ID NO: 2488795 - RNA, 16 nt, Chlamydia trachomatis
aauacaagaaaggccu

SEQ ID NO: 2488796 - RNA, 17 nt, Chlamydia trachomatis
aauacacagcaucaaga

SEQ ID NO: 2488797 - RNA, 18 nt, Chlamydia trachomatis
aauacaucacugcaacua

SEQ ID NO: 2488798 - RNA, 13 nt, Chlamydia trachomatis
aauaccaaaauau

SEQ ID NO: 2488799 - RNA, 15 nt, Chlamydia trachomatis
aauacccagaaguau

SEQ ID NO: 2488800 - RNA, 22 nt, Chlamydia trachomatis
aauacccaggguagcuguagca

SEQ ID NO: 2488801 - RNA, 23 nt, Chlamydia trachomatis
aauacccaggguagcuguagcaa

SEQ ID NO: 2488802 - RNA, 14 nt, Chlamydia trachomatis
aauaccuuaauaag

SEQ ID NO: 2488803 - RNA, 17 nt, Chlamydia trachomatis
aauaccuucuuacauaa

SEQ ID NO: 2488804 - RNA, 13 nt, Chlamydia trachomatis
aauacgaacaugu

SEQ ID NO: 2488805 - RNA, 19 nt, Chlamydia trachomatis
aauacggaagagucuguuu

SEQ ID NO: 2488806 - RNA, 15 nt, Chlamydia trachomatis
aauacgguauacacu

SEQ ID NO: 2488807 - RNA, 20 nt, Chlamydia trachomatis
aauacucuuaucguagagau

SEQ ID NO: 2488808 - RNA, 21 nt, Chlamydia trachomatis
aauacugacccauccaaaaca

SEQ ID NO: 2488809 - RNA, 17 nt, Chlamydia trachomatis
aauacugggaaaucauu

SEQ ID NO: 2488810 - RNA, 17 nt, Chlamydia trachomatis
aauacuugauuuuuuuc

SEQ ID NO: 2488811 - RNA, 17 nt, Chlamydia trachomatis
aauacuuguccccuacu

SEQ ID NO: 2488812 - RNA, 12 nt, Chlamydia trachomatis
aauagaaaaacu

SEQ ID NO: 2488813 - RNA, 16 nt, Chlamydia trachomatis
aauagaaauuuucaua

SEQ ID NO: 2488814 - RNA, 21 nt, Chlamydia trachomatis
aauagaaguuacuuuucucaa

SEQ ID NO: 2488815 - RNA, 16 nt, Chlamydia trachomatis
aauagaauaaaaggcu

SEQ ID NO: 2488816 - RNA, 17 nt, Chlamydia trachomatis
aauagauagucugcauu

SEQ ID NO: 2488817 - RNA, 15 nt, Chlamydia trachomatis
aauagcaaagaagac

SEQ ID NO: 2488818 - RNA, 19 nt, Chlamydia trachomatis
aauagcaaagcgaucagcu

SEQ ID NO: 2488819 - RNA, 18 nt, Chlamydia trachomatis
aauagcaacucuuucaua

SEQ ID NO: 2488820 - RNA, 22 nt, Chlamydia trachomatis
aauagcaacucuuucauaaaac

SEQ ID NO: 2488821 - RNA, 17 nt, Chlamydia trachomatis
aauagcacgcaaaacau

SEQ ID NO: 2488822 - RNA, 22 nt, Chlamydia trachomatis
aauagcacgcaaaacaucuaga

SEQ ID NO: 2488823 - RNA, 14 nt, Chlamydia trachomatis
aauagcagcauucu

SEQ ID NO: 2488824 - RNA, 14 nt, Chlamydia trachomatis
aauagcaggaacuu

SEQ ID NO: 2488825 - RNA, 15 nt, Chlamydia trachomatis
aauagcauuucugcc

SEQ ID NO: 2488826 - RNA, 21 nt, Chlamydia trachomatis
aauagccauuaacaacaaugu

SEQ ID NO: 2488827 - RNA, 23 nt, Chlamydia trachomatis
aauagccgccuuugcuaggguuc

SEQ ID NO: 2488828 - RNA, 19 nt, Chlamydia trachomatis
aauagccuaugguuuuuuc

SEQ ID NO: 2488829 - RNA, 19 nt, Chlamydia trachomatis
aauagccuccuuaaucaaa

SEQ ID NO: 2488830 - RNA, 22 nt, Chlamydia trachomatis
aauagcggguucuuuugcaaaa

SEQ ID NO: 2488831 - RNA, 19 nt, Chlamydia trachomatis
aauagcuaagguaacaauc

SEQ ID NO: 2488832 - RNA, 17 nt, Chlamydia trachomatis
aauagcuacagcaauag

SEQ ID NO: 2488833 - RNA, 22 nt, Chlamydia trachomatis
aauagcucaguugguagagcaa

SEQ ID NO: 2488834 - RNA, 11 nt, Chlamydia trachomatis
aauagcucugc

SEQ ID NO: 2488835 - RNA, 18 nt, Chlamydia trachomatis
aauagcucugcagauuuu

SEQ ID NO: 2488836 - RNA, 16 nt, Chlamydia trachomatis
aauagcugacuuugaa

SEQ ID NO: 2488837 - RNA, 20 nt, Chlamydia trachomatis
aauagcugccagugcucaaa

SEQ ID NO: 2488838 - RNA, 22 nt, Chlamydia trachomatis
aauagcugccagugcucaaaga

SEQ ID NO: 2488839 - RNA, 19 nt, Chlamydia trachomatis
aauagcuucguagagcaag

SEQ ID NO: 2488840 - RNA, 20 nt, Chlamydia trachomatis
aauagcuucguagagcaaga

SEQ ID NO: 2488841 - RNA, 20 nt, Chlamydia trachomatis
aauagcuugcacagcaagcg

SEQ ID NO: 2488842 - RNA, 12 nt, Chlamydia trachomatis
aauaggaagaau

SEQ ID NO: 2488843 - RNA, 22 nt, Chlamydia trachomatis
aauaggagcgauaacuccauca

SEQ ID NO: 2488844 - RNA, 20 nt, Chlamydia trachomatis
aauaggauaggaaaugagag

SEQ ID NO: 2488845 - RNA, 16 nt, Chlamydia trachomatis
aauaggcaggagacca

SEQ ID NO: 2488846 - RNA, 22 nt, Chlamydia trachomatis
aauaggguuaggaaagcacuuu

SEQ ID NO: 2488847 - RNA, 14 nt, Chlamydia trachomatis
aauagguaaagaag

SEQ ID NO: 2488848 - RNA, 20 nt, Chlamydia trachomatis
aauagguaugugcucauuuc

SEQ ID NO: 2488849 - RNA, 14 nt, Chlamydia trachomatis
aauaguaccuucaa

SEQ ID NO: 2488850 - RNA, 24 nt, Chlamydia trachomatis
aauaguaucuauaaucuauuuuau

SEQ ID NO: 2488851 - RNA, 19 nt, Chlamydia trachomatis
aauaguguaaggagagaaa

SEQ ID NO: 2488852 - RNA, 21 nt, Chlamydia trachomatis
aauaguuaaaacacaaaagca

SEQ ID NO: 2488853 - RNA, 17 nt, Chlamydia trachomatis
aauauaccccgaacaau

SEQ ID NO: 2488854 - RNA, 12 nt, Chlamydia trachomatis
aauauacucaac

SEQ ID NO: 2488855 - RNA, 15 nt, Chlamydia trachomatis
aauauacucuuugug

SEQ ID NO: 2488856 - RNA, 12 nt, Chlamydia trachomatis
aauauagagcau

SEQ ID NO: 2488857 - RNA, 19 nt, Chlamydia trachomatis
aauauaggguccaaacaua

SEQ ID NO: 2488858 - RNA, 22 nt, Chlamydia trachomatis
aauauagucccuaccuucagca

SEQ ID NO: 2488859 - RNA, 18 nt, Chlamydia trachomatis
aauaucaaagagugugcu

SEQ ID NO: 2488860 - RNA, 21 nt, Chlamydia trachomatis
aauaucaaaguagcaaucacu

SEQ ID NO: 2488861 - RNA, 13 nt, Chlamydia trachomatis
aauauccacuuuu

SEQ ID NO: 2488862 - RNA, 17 nt, Chlamydia trachomatis
aauauccccauccugaa

SEQ ID NO: 2488863 - RNA, 15 nt, Chlamydia trachomatis
aauauccuccaaaga

SEQ ID NO: 2488864 - RNA, 22 nt, Chlamydia trachomatis
aauaucuagguugaagaggcaa

SEQ ID NO: 2488865 - RNA, 17 nt, Chlamydia trachomatis
aauaucucaggauaaaa

SEQ ID NO: 2488866 - RNA, 15 nt, Chlamydia trachomatis
aauaucugcucuaaa

SEQ ID NO: 2488867 - RNA, 21 nt, Chlamydia trachomatis
aauaucuguuuuuccccauaa

SEQ ID NO: 2488868 - RNA, 14 nt, Chlamydia trachomatis
aauaucuucagaag

SEQ ID NO: 2488869 - RNA, 15 nt, Chlamydia trachomatis
aauaucuucagaagc

SEQ ID NO: 2488870 - RNA, 20 nt, Chlamydia trachomatis
aauaucuucagaagcggcau

SEQ ID NO: 2488871 - RNA, 16 nt, Chlamydia trachomatis
aauaucuucugggcuu

SEQ ID NO: 2488872 - RNA, 21 nt, Chlamydia trachomatis
aauaugaagaacuuuagaaga

SEQ ID NO: 2488873 - RNA, 13 nt, Chlamydia trachomatis
aauaugacagagc

SEQ ID NO: 2488874 - RNA, 21 nt, Chlamydia trachomatis
aauaugacagagcccuucuuu

SEQ ID NO: 2488875 - RNA, 17 nt, Chlamydia trachomatis
aauauggacuucccuaa

SEQ ID NO: 2488876 - RNA, 21 nt, Chlamydia trachomatis
aauauguugcgcgucuuguuu

SEQ ID NO: 2488877 - RNA, 13 nt, Chlamydia trachomatis
aauauuaaaccac

SEQ ID NO: 2488878 - RNA, 16 nt, Chlamydia trachomatis
aauauuaagauccauu

SEQ ID NO: 2488879 - RNA, 17 nt, Chlamydia trachomatis
aauauucgcaauauaga

SEQ ID NO: 2488880 - RNA, 14 nt, Chlamydia trachomatis
aauauucuuuucca

SEQ ID NO: 2488881 - RNA, 23 nt, Chlamydia trachomatis
aauauugagaaauaaucaucuca

SEQ ID NO: 2488882 - RNA, 21 nt, Chlamydia trachomatis
aauauuuuaggcggcuuuucu

SEQ ID NO: 2488883 - RNA, 17 nt, Chlamydia trachomatis
aauauuuuugggaaaaa

SEQ ID NO: 2488884 - RNA, 19 nt, Chlamydia trachomatis
aauauuuuugggaaaaaau

SEQ ID NO: 2488885 - RNA, 23 nt, Chlamydia trachomatis
aauauuuuuucccuuucauaaua

SEQ ID NO: 2488886 - RNA, 23 nt, Chlamydia trachomatis
aaucaaaaacgcgauauccuuuu

SEQ ID NO: 2488887 - RNA, 22 nt, Chlamydia trachomatis
aaucaaaaaguucucucccuuc

SEQ ID NO: 2488888 - RNA, 17 nt, Chlamydia trachomatis
aaucaaaacgcucagaa

SEQ ID NO: 2488889 - RNA, 15 nt, Chlamydia trachomatis
aaucaaaccaaaaau

SEQ ID NO: 2488890 - RNA, 16 nt, Chlamydia trachomatis
aaucaaaccaaaaaua

SEQ ID NO: 2488891 - RNA, 17 nt, Chlamydia trachomatis
aaucaaaccaaaaauau

SEQ ID NO: 2488892 - RNA, 21 nt, Chlamydia trachomatis
aaucaaacgucgaaaagcuuc

SEQ ID NO: 2488893 - RNA, 13 nt, Chlamydia trachomatis
aaucaaagacuuc

SEQ ID NO: 2488894 - RNA, 12 nt, Chlamydia trachomatis
aaucaaauaaag

SEQ ID NO: 2488895 - RNA, 19 nt, Chlamydia trachomatis
aaucaacgcuucauaagcc

SEQ ID NO: 2488896 - RNA, 21 nt, Chlamydia trachomatis
aaucaauauccacuuuuagga

SEQ ID NO: 2488897 - RNA, 14 nt, Chlamydia trachomatis
aaucaauuucuaga

SEQ ID NO: 2488898 - RNA, 13 nt, Chlamydia trachomatis
aaucacaauuuuu

SEQ ID NO: 2488899 - RNA, 18 nt, Chlamydia trachomatis
aaucacacgggucucuau

SEQ ID NO: 2488900 - RNA, 14 nt, Chlamydia trachomatis
aaucacagaaacuu

SEQ ID NO: 2488901 - RNA, 17 nt, Chlamydia trachomatis
aaucacagaaacuucuu

SEQ ID NO: 2488902 - RNA, 19 nt, Chlamydia trachomatis
aaucacagauaacgauucc

SEQ ID NO: 2488903 - RNA, 13 nt, Chlamydia trachomatis
aaucacagcaaua

SEQ ID NO: 2488904 - RNA, 18 nt, Chlamydia trachomatis
aaucacagcaauagccau

SEQ ID NO: 2488905 - RNA, 19 nt, Chlamydia trachomatis
aaucacaugcucaucaaac

SEQ ID NO: 2488906 - RNA, 12 nt, Chlamydia trachomatis
aaucacuuucug

SEQ ID NO: 2488907 - RNA, 15 nt, Chlamydia trachomatis
aaucagcuuuuccac

SEQ ID NO: 2488908 - RNA, 17 nt, Chlamydia trachomatis
aaucaguaagucaccau

SEQ ID NO: 2488909 - RNA, 20 nt, Chlamydia trachomatis
aaucaguagugguaaggggu

SEQ ID NO: 2488910 - RNA, 22 nt, Chlamydia trachomatis
aaucaguggaacugcuucccuc

SEQ ID NO: 2488911 - RNA, 15 nt, Chlamydia trachomatis
aaucauaucaagaau

SEQ ID NO: 2488912 - RNA, 21 nt, Chlamydia trachomatis
aaucaucugguauucuaaaua

SEQ ID NO: 2488913 - RNA, 18 nt, Chlamydia trachomatis
aaucaugaugaugagagc

SEQ ID NO: 2488914 - RNA, 14 nt, Chlamydia trachomatis
aaucauucaucuuu

SEQ ID NO: 2488915 - RNA, 17 nt, Chlamydia trachomatis
aaucauucaucuuuacu

SEQ ID NO: 2488916 - RNA, 20 nt, Chlamydia trachomatis
aaucauugggaaaacgauaa

SEQ ID NO: 2488917 - RNA, 18 nt, Chlamydia trachomatis
aauccaaucacugcguca

SEQ ID NO: 2488918 - RNA, 21 nt, Chlamydia trachomatis
aauccacgaauuuucucucua

SEQ ID NO: 2488919 - RNA, 23 nt, Chlamydia trachomatis
aauccacgaauuuucucucuagc

SEQ ID NO: 2488920 - RNA, 15 nt, Chlamydia trachomatis
aauccagaaagagcg

SEQ ID NO: 2488921 - RNA, 16 nt, Chlamydia trachomatis
aauccagaaagagcga

SEQ ID NO: 2488922 - RNA, 18 nt, Chlamydia trachomatis
aauccaugcaucuccucu

SEQ ID NO: 2488923 - RNA, 21 nt, Chlamydia trachomatis
aauccauuccggcucucuuca

SEQ ID NO: 2488924 - RNA, 17 nt, Chlamydia trachomatis
aauccauucgcauuaaa

SEQ ID NO: 2488925 - RNA, 22 nt, Chlamydia trachomatis
aauccauuggugguaacaccaa

SEQ ID NO: 2488926 - RNA, 21 nt, Chlamydia trachomatis
aaucccaaaaacaaucaaagc

SEQ ID NO: 2488927 - RNA, 17 nt, Chlamydia trachomatis
aaucccaucuccaauca

SEQ ID NO: 2488928 - RNA, 15 nt, Chlamydia trachomatis
aauccccagucucuc

SEQ ID NO: 2488929 - RNA, 16 nt, Chlamydia trachomatis
aauccgagcauuuucc

SEQ ID NO: 2488930 - RNA, 17 nt, Chlamydia trachomatis
aauccgagcauuuucca

SEQ ID NO: 2488931 - RNA, 23 nt, Chlamydia trachomatis
aauccgcuccccuuccuguucuu

SEQ ID NO: 2488932 - RNA, 20 nt, Chlamydia trachomatis
aauccuaaaaaaaaccauuc

SEQ ID NO: 2488933 - RNA, 12 nt, Chlamydia trachomatis
aauccuaaaauc

SEQ ID NO: 2488934 - RNA, 22 nt, Chlamydia trachomatis
aauccuauacccgacuaaaaaa

SEQ ID NO: 2488935 - RNA, 20 nt, Chlamydia trachomatis
aauccuaugcaguaaagaaa

SEQ ID NO: 2488936 - RNA, 20 nt, Chlamydia trachomatis
aauccucuagagccugcaag

SEQ ID NO: 2488937 - RNA, 18 nt, Chlamydia trachomatis
aauccugcgcgcaaauca

SEQ ID NO: 2488938 - RNA, 22 nt, Chlamydia trachomatis
aauccugcgcgcaaaucaggaa

SEQ ID NO: 2488939 - RNA, 21 nt, Chlamydia trachomatis
aauccuggaguauuuucaaaa

SEQ ID NO: 2488940 - RNA, 16 nt, Chlamydia trachomatis
aauccuguagggaaga

SEQ ID NO: 2488941 - RNA, 19 nt, Chlamydia trachomatis
aauccuguagggaagauag

SEQ ID NO: 2488942 - RNA, 18 nt, Chlamydia trachomatis
aauccuugcacuaagaau

SEQ ID NO: 2488943 - RNA, 19 nt, Chlamydia trachomatis
aauccuugcacuaagaaua

SEQ ID NO: 2488944 - RNA, 22 nt, Chlamydia trachomatis
aauccuuugacgacaacaugaa

SEQ ID NO: 2488945 - RNA, 21 nt, Chlamydia trachomatis
aauccuuuuaagauauccaua

SEQ ID NO: 2488946 - RNA, 22 nt, Chlamydia trachomatis
aauccuuuuaagauauccauag

SEQ ID NO: 2488947 - RNA, 15 nt, Chlamydia trachomatis
aauccuuuugauucu

SEQ ID NO: 2488948 - RNA, 16 nt, Chlamydia trachomatis
aauccuuuuuccuuaa

SEQ ID NO: 2488949 - RNA, 19 nt, Chlamydia trachomatis
aaucgaggugauuuucuuu

SEQ ID NO: 2488950 - RNA, 14 nt, Chlamydia trachomatis
aaucgcggaagaaa

SEQ ID NO: 2488951 - RNA, 21 nt, Chlamydia trachomatis
aaucgcugacggauccugcug

SEQ ID NO: 2488952 - RNA, 20 nt, Chlamydia trachomatis
aaucgcugagcucuuuccuc

SEQ ID NO: 2488953 - RNA, 20 nt, Chlamydia trachomatis
aaucgcuucugcugaauauu

SEQ ID NO: 2488954 - RNA, 20 nt, Chlamydia trachomatis
aaucggauagagaagaauug

SEQ ID NO: 2488955 - RNA, 19 nt, Chlamydia trachomatis
aaucguauaaguuuuaaga

SEQ ID NO: 2488956 - RNA, 22 nt, Chlamydia trachomatis
aaucguauaaguuuuaagaaga

SEQ ID NO: 2488957 - RNA, 17 nt, Chlamydia trachomatis
aaucgugcuaugcauuu

SEQ ID NO: 2488958 - RNA, 15 nt, Chlamydia trachomatis
aaucuaaaaagccau

SEQ ID NO: 2488959 - RNA, 17 nt, Chlamydia trachomatis
aaucuaaagacaaaacu

SEQ ID NO: 2488960 - RNA, 23 nt, Chlamydia trachomatis
aaucuacaccauuacgaggaagc

SEQ ID NO: 2488961 - RNA, 16 nt, Chlamydia trachomatis
aaucuauccauaauuu

SEQ ID NO: 2488962 - RNA, 19 nt, Chlamydia trachomatis
aaucuauuuuauacuucuu

SEQ ID NO: 2488963 - RNA, 17 nt, Chlamydia trachomatis
aaucucaaaguuuuugu

SEQ ID NO: 2488964 - RNA, 17 nt, Chlamydia trachomatis
aaucuccaaaauucugu

SEQ ID NO: 2488965 - RNA, 14 nt, Chlamydia trachomatis
aaucuccuccuauu

SEQ ID NO: 2488966 - RNA, 21 nt, Chlamydia trachomatis
aaucuccuuaauuggagauug

SEQ ID NO: 2488967 - RNA, 21 nt, Chlamydia trachomatis
aaucucguugauuaaaguuuc

SEQ ID NO: 2488968 - RNA, 22 nt, Chlamydia trachomatis
aaucucguuucuguuacacaga

SEQ ID NO: 2488969 - RNA, 12 nt, Chlamydia trachomatis
aaucucugaaag

SEQ ID NO: 2488970 - RNA, 16 nt, Chlamydia trachomatis
aaucucugaaagagcu

SEQ ID NO: 2488971 - RNA, 14 nt, Chlamydia trachomatis
aaucucuuggagag

SEQ ID NO: 2488972 - RNA, 20 nt, Chlamydia trachomatis
aaucucuuggagagaaugaa

SEQ ID NO: 2488973 - RNA, 21 nt, Chlamydia trachomatis
aaucucuuggagagaaugaag

SEQ ID NO: 2488974 - RNA, 23 nt, Chlamydia trachomatis
aaucugcaacaaauaccaaaaua

SEQ ID NO: 2488975 - RNA, 22 nt, Chlamydia trachomatis
aaucugcuccuagguuagaagu

SEQ ID NO: 2488976 - RNA, 18 nt, Chlamydia trachomatis
aaucugcuuaucuccgcu

SEQ ID NO: 2488977 - RNA, 12 nt, Chlamydia trachomatis
aaucuggcugaa

SEQ ID NO: 2488978 - RNA, 19 nt, Chlamydia trachomatis
aaucuggcugaagaaguug

SEQ ID NO: 2488979 - RNA, 22 nt, Chlamydia trachomatis
aaucuggcugaagaaguugauc

SEQ ID NO: 2488980 - RNA, 20 nt, Chlamydia trachomatis
aaucugggaggagaacucuu

SEQ ID NO: 2488981 - RNA, 19 nt, Chlamydia trachomatis
aaucugucuaagauuuuca

SEQ ID NO: 2488982 - RNA, 20 nt, Chlamydia trachomatis
aaucugucuaagauuuucau

SEQ ID NO: 2488983 - RNA, 17 nt, Chlamydia trachomatis
aaucuguucagaacuca

SEQ ID NO: 2488984 - RNA, 20 nt, Chlamydia trachomatis
aaucuguucagaacucaaaa

SEQ ID NO: 2488985 - RNA, 21 nt, Chlamydia trachomatis
aaucuguucagaacucaaaau

SEQ ID NO: 2488986 - RNA, 22 nt, Chlamydia trachomatis
aaucuuaaacaagaucuaucua

SEQ ID NO: 2488987 - RNA, 18 nt, Chlamydia trachomatis
aaucuucacggagagaaa

SEQ ID NO: 2488988 - RNA, 23 nt, Chlamydia trachomatis
aaucuucacggagagaaagaggg

SEQ ID NO: 2488989 - RNA, 19 nt, Chlamydia trachomatis
aaucuucggcagaagcugc

SEQ ID NO: 2488990 - RNA, 21 nt, Chlamydia trachomatis
aaucuucuucggaaagcacuu

SEQ ID NO: 2488991 - RNA, 23 nt, Chlamydia trachomatis
aaucuucuucuaagcuagaaaau

SEQ ID NO: 2488992 - RNA, 19 nt, Chlamydia trachomatis
aaucuuguaauaucaaaga

SEQ ID NO: 2488993 - RNA, 18 nt, Chlamydia trachomatis
aaucuugucguuccucua

SEQ ID NO: 2488994 - RNA, 14 nt, Chlamydia trachomatis
aaucuugugcuaag

SEQ ID NO: 2488995 - RNA, 17 nt, Chlamydia trachomatis
aaucuuucuuucuaaga

SEQ ID NO: 2488996 - RNA, 17 nt, Chlamydia trachomatis
aaucuuuuacuggagaa

SEQ ID NO: 2488997 - RNA, 18 nt, Chlamydia trachomatis
aaucuuuuugauuuuucu

SEQ ID NO: 2488998 - RNA, 14 nt, Chlamydia trachomatis
aaugaaacaccucu

SEQ ID NO: 2488999 - RNA, 17 nt, Chlamydia trachomatis
aaugaaacggaaugaca

SEQ ID NO: 2489000 - RNA, 20 nt, Chlamydia trachomatis
aaugaaggccaaagaaauag

SEQ ID NO: 2489001 - RNA, 16 nt, Chlamydia trachomatis
aaugaagguuucuaaa

SEQ ID NO: 2489002 - RNA, 22 nt, Chlamydia trachomatis
aaugaagguuucuaaaaaacuu

SEQ ID NO: 2489003 - RNA, 22 nt, Chlamydia trachomatis
aaugaauuuccccugcagccuc

SEQ ID NO: 2489004 - RNA, 16 nt, Chlamydia trachomatis
aaugacaaacuuucuc

SEQ ID NO: 2489005 - RNA, 23 nt, Chlamydia trachomatis
aaugaccaguuugucuuagaaga

SEQ ID NO: 2489006 - RNA, 13 nt, Chlamydia trachomatis
aaugaccuuuccc

SEQ ID NO: 2489007 - RNA, 19 nt, Chlamydia trachomatis
aaugagaaauaaaaaccuu

SEQ ID NO: 2489008 - RNA, 17 nt, Chlamydia trachomatis
aaugagaggugugaaua

SEQ ID NO: 2489009 - RNA, 23 nt, Chlamydia trachomatis
aaugaggauguggacgaacaaaa

SEQ ID NO: 2489010 - RNA, 12 nt, Chlamydia trachomatis
aaugauagcacc

SEQ ID NO: 2489011 - RNA, 21 nt, Chlamydia trachomatis
aaugauagcacccuuuuuaua

SEQ ID NO: 2489012 - RNA, 18 nt, Chlamydia trachomatis
aaugaucacuugaaucac

SEQ ID NO: 2489013 - RNA, 21 nt, Chlamydia trachomatis
aaugaucgccucuaaagcuuc

SEQ ID NO: 2489014 - RNA, 18 nt, Chlamydia trachomatis
aaugaucuaaaggaaaaa

SEQ ID NO: 2489015 - RNA, 15 nt, Chlamydia trachomatis
aaugaugaaaaagaa

SEQ ID NO: 2489016 - RNA, 18 nt, Chlamydia trachomatis
aaugauucuugaagauuu

SEQ ID NO: 2489017 - RNA, 19 nt, Chlamydia trachomatis
aaugauucuugaagauuug

SEQ ID NO: 2489018 - RNA, 19 nt, Chlamydia trachomatis
aaugcagaucauaucugca

SEQ ID NO: 2489019 - RNA, 15 nt, Chlamydia trachomatis
aaugcaguggaagau

SEQ ID NO: 2489020 - RNA, 14 nt, Chlamydia trachomatis
aaugcccaaagccg

SEQ ID NO: 2489021 - RNA, 13 nt, Chlamydia trachomatis
aaugccgaaacca

SEQ ID NO: 2489022 - RNA, 21 nt, Chlamydia trachomatis
aaugccguuacuaacaucaaa

SEQ ID NO: 2489023 - RNA, 23 nt, Chlamydia trachomatis
aaugccuuuuguuuucaaaagcu

SEQ ID NO: 2489024 - RNA, 15 nt, Chlamydia trachomatis
aaugcgugaacuguu

SEQ ID NO: 2489025 - RNA, 16 nt, Chlamydia trachomatis
aaugcguuaaacuuuc

SEQ ID NO: 2489026 - RNA, 22 nt, Chlamydia trachomatis
aaugcguugcucuaccaacuga

SEQ ID NO: 2489027 - RNA, 14 nt, Chlamydia trachomatis
aaugcguuucuucu

SEQ ID NO: 2489028 - RNA, 13 nt, Chlamydia trachomatis
aaugcugauaaaa

SEQ ID NO: 2489029 - RNA, 14 nt, Chlamydia trachomatis
aaugcuggauugga

SEQ ID NO: 2489030 - RNA, 15 nt, Chlamydia trachomatis
aaugcuguaaaacau

SEQ ID NO: 2489031 - RNA, 13 nt, Chlamydia trachomatis
aauggaaauaaaa

SEQ ID NO: 2489032 - RNA, 18 nt, Chlamydia trachomatis
aauggaccagaucauaga

SEQ ID NO: 2489033 - RNA, 21 nt, Chlamydia trachomatis
aauggacugguuguucccgau

SEQ ID NO: 2489034 - RNA, 13 nt, Chlamydia trachomatis
aauggcaaaacuu

SEQ ID NO: 2489035 - RNA, 18 nt, Chlamydia trachomatis
aauggcaaaaucuucaua

SEQ ID NO: 2489036 - RNA, 16 nt, Chlamydia trachomatis
aauggccgggaaaaag

SEQ ID NO: 2489037 - RNA, 15 nt, Chlamydia trachomatis
aauggugaaacuuuc

SEQ ID NO: 2489038 - RNA, 17 nt, Chlamydia trachomatis
aaugguuauaagaccua

SEQ ID NO: 2489039 - RNA, 16 nt, Chlamydia trachomatis
aauguacgcuaaaaac

SEQ ID NO: 2489040 - RNA, 17 nt, Chlamydia trachomatis
aauguacgcuaaaaacu

SEQ ID NO: 2489041 - RNA, 23 nt, Chlamydia trachomatis
aauguacgcuaaaaacucuuuca

SEQ ID NO: 2489042 - RNA, 13 nt, Chlamydia trachomatis
aauguagaaauuu

SEQ ID NO: 2489043 - RNA, 19 nt, Chlamydia trachomatis
aauguagaaauuuuaaauc

SEQ ID NO: 2489044 - RNA, 17 nt, Chlamydia trachomatis
aaugugauugacaacuu

SEQ ID NO: 2489045 - RNA, 19 nt, Chlamydia trachomatis
aaugugauugacaacuuuc

SEQ ID NO: 2489046 - RNA, 22 nt, Chlamydia trachomatis
aaugugauugacaacuuucuuu

SEQ ID NO: 2489047 - RNA, 14 nt, Chlamydia trachomatis
aaugugucuaaaga

SEQ ID NO: 2489048 - RNA, 18 nt, Chlamydia trachomatis
aauguuaacaucuuccca

SEQ ID NO: 2489049 - RNA, 24 nt, Chlamydia trachomatis
aauguucaugaaacccaucucuau

SEQ ID NO: 2489050 - RNA, 21 nt, Chlamydia trachomatis
aauguuccucguuuuuuuaga

SEQ ID NO: 2489051 - RNA, 17 nt, Chlamydia trachomatis
aauuaaaacaauaguga

SEQ ID NO: 2489052 - RNA, 14 nt, Chlamydia trachomatis
aauuaaagaaguug

SEQ ID NO: 2489053 - RNA, 14 nt, Chlamydia trachomatis
aauuaaagagaugu

SEQ ID NO: 2489054 - RNA, 17 nt, Chlamydia trachomatis
aauuaaagguuucccaa

SEQ ID NO: 2489055 - RNA, 21 nt, Chlamydia trachomatis
aauuacaacuaaaggaaacaa

SEQ ID NO: 2489056 - RNA, 16 nt, Chlamydia trachomatis
aauuacaauaauacaa

SEQ ID NO: 2489057 - RNA, 21 nt, Chlamydia trachomatis
aauuagggaaaaacuuuucuu

SEQ ID NO: 2489058 - RNA, 20 nt, Chlamydia trachomatis
aauuaguaaaucgaagggaa

SEQ ID NO: 2489059 - RNA, 18 nt, Chlamydia trachomatis
aauuaguaauaaaggaaa

SEQ ID NO: 2489060 - RNA, 23 nt, Chlamydia trachomatis
aauuaguaauaaaggaaacaaau

SEQ ID NO: 2489061 - RNA, 18 nt, Chlamydia trachomatis
aauuauacaauuuauagc

SEQ ID NO: 2489062 - RNA, 14 nt, Chlamydia trachomatis
aauuaucuaaaaaa

SEQ ID NO: 2489063 - RNA, 16 nt, Chlamydia trachomatis
aauuaugaucacuaau

SEQ ID NO: 2489064 - RNA, 23 nt, Chlamydia trachomatis
aauucaucagcacccacauuacc

SEQ ID NO: 2489065 - RNA, 17 nt, Chlamydia trachomatis
aauuccaaauaauacuc

SEQ ID NO: 2489066 - RNA, 13 nt, Chlamydia trachomatis
aauuccaucuuuu

SEQ ID NO: 2489067 - RNA, 22 nt, Chlamydia trachomatis
aauucgagccuguuuugcaaag

SEQ ID NO: 2489068 - RNA, 21 nt, Chlamydia trachomatis
aauucguaugcaacuuguaua

SEQ ID NO: 2489069 - RNA, 22 nt, Chlamydia trachomatis
aauucuaaacgagcuagcucuu

SEQ ID NO: 2489070 - RNA, 22 nt, Chlamydia trachomatis
aauucuaaaguaagaccgagau

SEQ ID NO: 2489071 - RNA, 22 nt, Chlamydia trachomatis
aauucuacuccugcaacaagaa

SEQ ID NO: 2489072 - RNA, 23 nt, Chlamydia trachomatis
aauucuacuccugcaacaagaac

SEQ ID NO: 2489073 - RNA, 13 nt, Chlamydia trachomatis
aauucuaucaaca

SEQ ID NO: 2489074 - RNA, 17 nt, Chlamydia trachomatis
aauucuaucaacaucug

SEQ ID NO: 2489075 - RNA, 15 nt, Chlamydia trachomatis
aauucuugccaccgc

SEQ ID NO: 2489076 - RNA, 21 nt, Chlamydia trachomatis
aauucuuugaucuguaaaaau

SEQ ID NO: 2489077 - RNA, 18 nt, Chlamydia trachomatis
aauucuuuuacagaggua

SEQ ID NO: 2489078 - RNA, 19 nt, Chlamydia trachomatis
aauugagcacaagcuguuc

SEQ ID NO: 2489079 - RNA, 15 nt, Chlamydia trachomatis
aauugccgaaucaaa

SEQ ID NO: 2489080 - RNA, 18 nt, Chlamydia trachomatis
aauugccgaaucaaagac

SEQ ID NO: 2489081 - RNA, 24 nt, Chlamydia trachomatis
aauugcgaagguucaagaugcgcu

SEQ ID NO: 2489082 - RNA, 16 nt, Chlamydia trachomatis
aauuggagauugccuu

SEQ ID NO: 2489083 - RNA, 15 nt, Chlamydia trachomatis
aauuggcguuccauu

SEQ ID NO: 2489084 - RNA, 16 nt, Chlamydia trachomatis
aauuguccaagcucga

SEQ ID NO: 2489085 - RNA, 17 nt, Chlamydia trachomatis
aauugucgaauuuuucu

SEQ ID NO: 2489086 - RNA, 22 nt, Chlamydia trachomatis
aauugucgauaacgaagcaaaa

SEQ ID NO: 2489087 - RNA, 14 nt, Chlamydia trachomatis
aauuguuggacaaa

SEQ ID NO: 2489088 - RNA, 17 nt, Chlamydia trachomatis
aauuuaaaaucuaugua

SEQ ID NO: 2489089 - RNA, 17 nt, Chlamydia trachomatis
aauuuaauuaaagagau

SEQ ID NO: 2489090 - RNA, 15 nt, Chlamydia trachomatis
aauuuacgaaguauu

SEQ ID NO: 2489091 - RNA, 21 nt, Chlamydia trachomatis
aauuuagacucggaaucucug

SEQ ID NO: 2489092 - RNA, 19 nt, Chlamydia trachomatis
aauuuaucugcuaaagaaa

SEQ ID NO: 2489093 - RNA, 20 nt, Chlamydia trachomatis
aauuuaucugcuaaagaaaa

SEQ ID NO: 2489094 - RNA, 20 nt, Chlamydia trachomatis
aauuucaggaguaggaaggu

SEQ ID NO: 2489095 - RNA, 16 nt, Chlamydia trachomatis
aauuucaucacagaua

SEQ ID NO: 2489096 - RNA, 16 nt, Chlamydia trachomatis
aauuucccucuucccg

SEQ ID NO: 2489097 - RNA, 18 nt, Chlamydia trachomatis
aauuuccggacacacucu

SEQ ID NO: 2489098 - RNA, 15 nt, Chlamydia trachomatis
aauuuccuuagaaag

SEQ ID NO: 2489099 - RNA, 14 nt, Chlamydia trachomatis
aauuucuaaauauu

SEQ ID NO: 2489100 - RNA, 16 nt, Chlamydia trachomatis
aauuucucuaggaaca

SEQ ID NO: 2489101 - RNA, 23 nt, Chlamydia trachomatis
aauuucugggaaaauuaaaaggc

SEQ ID NO: 2489102 - RNA, 13 nt, Chlamydia trachomatis
aauuucuucuuuu

SEQ ID NO: 2489103 - RNA, 22 nt, Chlamydia trachomatis
aauuugcgcgucuagcgcauaa

SEQ ID NO: 2489104 - RNA, 11 nt, Chlamydia trachomatis
aauuuggauua

SEQ ID NO: 2489105 - RNA, 12 nt, Chlamydia trachomatis
aauuuguagcaa

SEQ ID NO: 2489106 - RNA, 19 nt, Chlamydia trachomatis
aauuuguagcaaaagauuu

SEQ ID NO: 2489107 - RNA, 19 nt, Chlamydia trachomatis
aauuuguguuaaaucauuc

SEQ ID NO: 2489108 - RNA, 14 nt, Chlamydia trachomatis
aauuuuaaaaucuc

SEQ ID NO: 2489109 - RNA, 20 nt, Chlamydia trachomatis
aauuuuacacagauaggaac

SEQ ID NO: 2489110 - RNA, 16 nt, Chlamydia trachomatis
aauuuuaucuaaaaag

SEQ ID NO: 2489111 - RNA, 13 nt, Chlamydia trachomatis
aauuuucaucaaa

SEQ ID NO: 2489112 - RNA, 13 nt, Chlamydia trachomatis
aauuuucaugaaa

SEQ ID NO: 2489113 - RNA, 16 nt, Chlamydia trachomatis
aauuuuccacaaauau

SEQ ID NO: 2489114 - RNA, 18 nt, Chlamydia trachomatis
aauuuuccacaaauauuu

SEQ ID NO: 2489115 - RNA, 19 nt, Chlamydia trachomatis
aauuuucuagcuucuuguc

SEQ ID NO: 2489116 - RNA, 19 nt, Chlamydia trachomatis
aauuuucucucuagcgaua

SEQ ID NO: 2489117 - RNA, 16 nt, Chlamydia trachomatis
aauuuuguuaagaauu

SEQ ID NO: 2489118 - RNA, 14 nt, Chlamydia trachomatis
aauuuuuagggaau

SEQ ID NO: 2489119 - RNA, 13 nt, Chlamydia trachomatis
aauuuuucagaaa

SEQ ID NO: 2489120 - RNA, 22 nt, Chlamydia trachomatis
aauuuuucucuaauaguugcaa

SEQ ID NO: 2489121 - RNA, 14 nt, Chlamydia trachomatis
aauuuuugauacaa

SEQ ID NO: 2489122 - RNA, 15 nt, Chlamydia trachomatis
aauuuuuuucuuugc

SEQ ID NO: 2489123 - RNA, 14 nt, Chlamydia trachomatis
acaaaaaaaaagag

SEQ ID NO: 2489124 - RNA, 17 nt, Chlamydia trachomatis
acaaaaaaugcgcucuu

SEQ ID NO: 2489125 - RNA, 12 nt, Chlamydia trachomatis
acaaaaagccua

SEQ ID NO: 2489126 - RNA, 11 nt, Chlamydia trachomatis
acaaaaauacu

SEQ ID NO: 2489127 - RNA, 21 nt, Chlamydia trachomatis
acaaaaauacuucuuuuuguu

SEQ ID NO: 2489128 - RNA, 14 nt, Chlamydia trachomatis
acaaaacaagccuu

SEQ ID NO: 2489129 - RNA, 22 nt, Chlamydia trachomatis
acaaaacuugucuaaaagaaua

SEQ ID NO: 2489130 - RNA, 22 nt, Chlamydia trachomatis
acaaaagcauugaacaccauau

SEQ ID NO: 2489131 - RNA, 20 nt, Chlamydia trachomatis
acaaaaucagcaaaugugga

SEQ ID NO: 2489132 - RNA, 22 nt, Chlamydia trachomatis
acaaacaaauccuagaagagcu

SEQ ID NO: 2489133 - RNA, 16 nt, Chlamydia trachomatis
acaaaccagcucauca

SEQ ID NO: 2489134 - RNA, 17 nt, Chlamydia trachomatis
acaaaccgaagagggaa

SEQ ID NO: 2489135 - RNA, 14 nt, Chlamydia trachomatis
acaaagccccuacu

SEQ ID NO: 2489136 - RNA, 12 nt, Chlamydia trachomatis
acaaaggaacau

SEQ ID NO: 2489137 - RNA, 21 nt, Chlamydia trachomatis
acaaaguggcguuguuucuaa

SEQ ID NO: 2489138 - RNA, 16 nt, Chlamydia trachomatis
acaaauaccaaaauau

SEQ ID NO: 2489139 - RNA, 15 nt, Chlamydia trachomatis
acaaauauacucuuu

SEQ ID NO: 2489140 - RNA, 21 nt, Chlamydia trachomatis
acaaauauuuuugggaaaaaa

SEQ ID NO: 2489141 - RNA, 17 nt, Chlamydia trachomatis
acaaauccagcugcugc

SEQ ID NO: 2489142 - RNA, 19 nt, Chlamydia trachomatis
acaaauccuagaagagcug

SEQ ID NO: 2489143 - RNA, 12 nt, Chlamydia trachomatis
acaaaucuuucu

SEQ ID NO: 2489144 - RNA, 20 nt, Chlamydia trachomatis
acaaaucuuucuuucuaaga

SEQ ID NO: 2489145 - RNA, 21 nt, Chlamydia trachomatis
acaaaucuuucuuucuaagaa

SEQ ID NO: 2489146 - RNA, 17 nt, Chlamydia trachomatis
acaaaucuuuuaucuuc

SEQ ID NO: 2489147 - RNA, 21 nt, Chlamydia trachomatis
acaaauuuaucugcuaaagaa

SEQ ID NO: 2489148 - RNA, 20 nt, Chlamydia trachomatis
acaaauuucuauagaagaau

SEQ ID NO: 2489149 - RNA, 22 nt, Chlamydia trachomatis
acaacaaguugauacaagagag

SEQ ID NO: 2489150 - RNA, 23 nt, Chlamydia trachomatis
acaacaaguugauacaagagaga

SEQ ID NO: 2489151 - RNA, 21 nt, Chlamydia trachomatis
acaacaaugucaacauaauag

SEQ ID NO: 2489152 - RNA, 15 nt, Chlamydia trachomatis
acaacacgucuuaaa

SEQ ID NO: 2489153 - RNA, 16 nt, Chlamydia trachomatis
acaacacgucuuaaag

SEQ ID NO: 2489154 - RNA, 14 nt, Chlamydia trachomatis
acaacccaaguuug

SEQ ID NO: 2489155 - RNA, 23 nt, Chlamydia trachomatis
acaaccuucccuuccaaguuuug

SEQ ID NO: 2489156 - RNA, 14 nt, Chlamydia trachomatis
acaaccuugguaau

SEQ ID NO: 2489157 - RNA, 17 nt, Chlamydia trachomatis
acaacgaguugaucuuc

SEQ ID NO: 2489158 - RNA, 20 nt, Chlamydia trachomatis
acaacgaguugaucuuccuc

SEQ ID NO: 2489159 - RNA, 17 nt, Chlamydia trachomatis
acaacgauauaaagaag

SEQ ID NO: 2489160 - RNA, 17 nt, Chlamydia trachomatis
acaacguuuaaugaaua

SEQ ID NO: 2489161 - RNA, 18 nt, Chlamydia trachomatis
acaacuaaaggaaacaag

SEQ ID NO: 2489162 - RNA, 23 nt, Chlamydia trachomatis
acaacuaaaggaaacaagcagau

SEQ ID NO: 2489163 - RNA, 24 nt, Chlamydia trachomatis
acaacuaaaggaaacaagcagauu

SEQ ID NO: 2489164 - RNA, 13 nt, Chlamydia trachomatis
acaacuacaacaa

SEQ ID NO: 2489165 - RNA, 22 nt, Chlamydia trachomatis
acaacucuccuaauucaacaua

SEQ ID NO: 2489166 - RNA, 12 nt, Chlamydia trachomatis
acaacugcugau

SEQ ID NO: 2489167 - RNA, 20 nt, Chlamydia trachomatis
acaacugcugauaaauuucu

SEQ ID NO: 2489168 - RNA, 14 nt, Chlamydia trachomatis
acaacuucucuugu

SEQ ID NO: 2489169 - RNA, 20 nt, Chlamydia trachomatis
acaacuugaucuacagcaaa

SEQ ID NO: 2489170 - RNA, 13 nt, Chlamydia trachomatis
acaacuugcguuu

SEQ ID NO: 2489171 - RNA, 16 nt, Chlamydia trachomatis
acaacuugcguuuucu

SEQ ID NO: 2489172 - RNA, 12 nt, Chlamydia trachomatis
acaagaauaaua

SEQ ID NO: 2489173 - RNA, 18 nt, Chlamydia trachomatis
acaagacuucuucuaaag

SEQ ID NO: 2489174 - RNA, 12 nt, Chlamydia trachomatis
acaagccuuuaa

SEQ ID NO: 2489175 - RNA, 18 nt, Chlamydia trachomatis
acaagccuuuaagguacu

SEQ ID NO: 2489176 - RNA, 19 nt, Chlamydia trachomatis
acaagcgacuccaacacga

SEQ ID NO: 2489177 - RNA, 20 nt, Chlamydia trachomatis
acaagcgacuccaacacgaa

SEQ ID NO: 2489178 - RNA, 14 nt, Chlamydia trachomatis
acaaggauuuucuu

SEQ ID NO: 2489179 - RNA, 21 nt, Chlamydia trachomatis
acaaggauuuuuuucugcaau

SEQ ID NO: 2489180 - RNA, 20 nt, Chlamydia trachomatis
acaaggcucuugaaaaggag

SEQ ID NO: 2489181 - RNA, 23 nt, Chlamydia trachomatis
acaagggcacucgcgcuucucuu

SEQ ID NO: 2489182 - RNA, 14 nt, Chlamydia trachomatis
acaagguucuucaa

SEQ ID NO: 2489183 - RNA, 14 nt, Chlamydia trachomatis
acaaguauauaccc

SEQ ID NO: 2489184 - RNA, 16 nt, Chlamydia trachomatis
acaaguaugagaggaa

SEQ ID NO: 2489185 - RNA, 18 nt, Chlamydia trachomatis
acaaguaugagaggaaga

SEQ ID NO: 2489186 - RNA, 21 nt, Chlamydia trachomatis
acaagucugcuaggucucccu

SEQ ID NO: 2489187 - RNA, 16 nt, Chlamydia trachomatis
acaagugacauuucca

SEQ ID NO: 2489188 - RNA, 22 nt, Chlamydia trachomatis
acaaguuccuggauccaaaaaa

SEQ ID NO: 2489189 - RNA, 21 nt, Chlamydia trachomatis
acaauaaacaugauuaauucu

SEQ ID NO: 2489190 - RNA, 18 nt, Chlamydia trachomatis
acaauaacgcaccuuuaa

SEQ ID NO: 2489191 - RNA, 16 nt, Chlamydia trachomatis
acaauaauacaaagca

SEQ ID NO: 2489192 - RNA, 18 nt, Chlamydia trachomatis
acaauaauacaaagcacg

SEQ ID NO: 2489193 - RNA, 20 nt, Chlamydia trachomatis
acaauaauacaaagcacgau

SEQ ID NO: 2489194 - RNA, 15 nt, Chlamydia trachomatis
acaauaguaccuuca

SEQ ID NO: 2489195 - RNA, 13 nt, Chlamydia trachomatis
acaauauuacgaa

SEQ ID NO: 2489196 - RNA, 16 nt, Chlamydia trachomatis
acaaucaaagcaccac

SEQ ID NO: 2489197 - RNA, 20 nt, Chlamydia trachomatis
acaaucacacgaucauauuc

SEQ ID NO: 2489198 - RNA, 22 nt, Chlamydia trachomatis
acaaucauuauccauaaaaaua

SEQ ID NO: 2489199 - RNA, 18 nt, Chlamydia trachomatis
acaauccuagacgauuaa

SEQ ID NO: 2489200 - RNA, 12 nt, Chlamydia trachomatis
acaaucggaaau

SEQ ID NO: 2489201 - RNA, 17 nt, Chlamydia trachomatis
acaaucucaaaaacacu

SEQ ID NO: 2489202 - RNA, 21 nt, Chlamydia trachomatis
acaauggcgacguuagaacua

SEQ ID NO: 2489203 - RNA, 14 nt, Chlamydia trachomatis
acaauguaaacaau

SEQ ID NO: 2489204 - RNA, 15 nt, Chlamydia trachomatis
acaauguaaacaaua

SEQ ID NO: 2489205 - RNA, 19 nt, Chlamydia trachomatis
acaauuucaucacagauaa

SEQ ID NO: 2489206 - RNA, 19 nt, Chlamydia trachomatis
acaauuuuaaaaucuccuc

SEQ ID NO: 2489207 - RNA, 20 nt, Chlamydia trachomatis
acaauuuuaaaaucuccucg

SEQ ID NO: 2489208 - RNA, 17 nt, Chlamydia trachomatis
acacaaaaaaaagagag

SEQ ID NO: 2489209 - RNA, 16 nt, Chlamydia trachomatis
acacaaaagcauugaa

SEQ ID NO: 2489210 - RNA, 19 nt, Chlamydia trachomatis
acacaacucuuuuccuaaa

SEQ ID NO: 2489211 - RNA, 23 nt, Chlamydia trachomatis
acacaacuucugcuaaaaaugcu

SEQ ID NO: 2489212 - RNA, 12 nt, Chlamydia trachomatis
acacaagcagac

SEQ ID NO: 2489213 - RNA, 15 nt, Chlamydia trachomatis
acacaagcagacaag

SEQ ID NO: 2489214 - RNA, 19 nt, Chlamydia trachomatis
acacaaguaugagaggaag

SEQ ID NO: 2489215 - RNA, 18 nt, Chlamydia trachomatis
acacacuggguaucugaa

SEQ ID NO: 2489216 - RNA, 22 nt, Chlamydia trachomatis
acacacuggguaucugaacaag

SEQ ID NO: 2489217 - RNA, 15 nt, Chlamydia trachomatis
acacagcaucaagaa

SEQ ID NO: 2489218 - RNA, 16 nt, Chlamydia trachomatis
acacagcaucaagaau

SEQ ID NO: 2489219 - RNA, 13 nt, Chlamydia trachomatis
acacaucaaaaug

SEQ ID NO: 2489220 - RNA, 18 nt, Chlamydia trachomatis
acaccauuacgaggaagc

SEQ ID NO: 2489221 - RNA, 18 nt, Chlamydia trachomatis
acaccauucagcaaaaaa

SEQ ID NO: 2489222 - RNA, 20 nt, Chlamydia trachomatis
acaccauucguucuuuaaga

SEQ ID NO: 2489223 - RNA, 12 nt, Chlamydia trachomatis
acaccucuccuu

SEQ ID NO: 2489224 - RNA, 16 nt, Chlamydia trachomatis
acacgauguuccccau

SEQ ID NO: 2489225 - RNA, 20 nt, Chlamydia trachomatis
acacgauuaucuaaagccau

SEQ ID NO: 2489226 - RNA, 18 nt, Chlamydia trachomatis
acacuaucacuguugaga

SEQ ID NO: 2489227 - RNA, 23 nt, Chlamydia trachomatis
acacuaucacuguugagaaaaac

SEQ ID NO: 2489228 - RNA, 12 nt, Chlamydia trachomatis
acacuccaucuc

SEQ ID NO: 2489229 - RNA, 14 nt, Chlamydia trachomatis
acacuccucugaau

SEQ ID NO: 2489230 - RNA, 23 nt, Chlamydia trachomatis
acacuccugaaaguuuuuucccc

SEQ ID NO: 2489231 - RNA, 21 nt, Chlamydia trachomatis
acacucgugaaauaaaucaca

SEQ ID NO: 2489232 - RNA, 23 nt, Chlamydia trachomatis
acacugcgugaccguuaauaucc

SEQ ID NO: 2489233 - RNA, 22 nt, Chlamydia trachomatis
acacuggguaucugaacaagaa

SEQ ID NO: 2489234 - RNA, 21 nt, Chlamydia trachomatis
acacuuaaaaagaaacaaaac

SEQ ID NO: 2489235 - RNA, 17 nt, Chlamydia trachomatis
acacuucuuuaaagccu

SEQ ID NO: 2489236 - RNA, 18 nt, Chlamydia trachomatis
acacuuuaucagcgucau

SEQ ID NO: 2489237 - RNA, 14 nt, Chlamydia trachomatis
acacuuuucagcuu

SEQ ID NO: 2489238 - RNA, 19 nt, Chlamydia trachomatis
acacuuuucagcuuuucuu

SEQ ID NO: 2489239 - RNA, 13 nt, Chlamydia trachomatis
acagaaacguuua

SEQ ID NO: 2489240 - RNA, 14 nt, Chlamydia trachomatis
acagaaacuucuuc

SEQ ID NO: 2489241 - RNA, 21 nt, Chlamydia trachomatis
acagaaagaaaugcguuucuu

SEQ ID NO: 2489242 - RNA, 15 nt, Chlamydia trachomatis
acagaaccuuuuuaa

SEQ ID NO: 2489243 - RNA, 20 nt, Chlamydia trachomatis
acagaagaaggcauuuuugc

SEQ ID NO: 2489244 - RNA, 19 nt, Chlamydia trachomatis
acagaagcugucagaucau

SEQ ID NO: 2489245 - RNA, 15 nt, Chlamydia trachomatis
acagaaucagguuug

SEQ ID NO: 2489246 - RNA, 17 nt, Chlamydia trachomatis
acagaaucguuuaagug

SEQ ID NO: 2489247 - RNA, 17 nt, Chlamydia trachomatis
acagaaucuguuuugau

SEQ ID NO: 2489248 - RNA, 21 nt, Chlamydia trachomatis
acagacuaaguuguaaaacaa

SEQ ID NO: 2489249 - RNA, 13 nt, Chlamydia trachomatis
acagagaaaaaga

SEQ ID NO: 2489250 - RNA, 14 nt, Chlamydia trachomatis
acagagaaaaagau

SEQ ID NO: 2489251 - RNA, 19 nt, Chlamydia trachomatis
acagagcccuucuuuuccu

SEQ ID NO: 2489252 - RNA, 22 nt, Chlamydia trachomatis
acagagccuuuuauucuucagu

SEQ ID NO: 2489253 - RNA, 19 nt, Chlamydia trachomatis
acagagcuucaucucaaua

SEQ ID NO: 2489254 - RNA, 12 nt, Chlamydia trachomatis
acagagcuucuc

SEQ ID NO: 2489255 - RNA, 16 nt, Chlamydia trachomatis
acagaguuaccaauca

SEQ ID NO: 2489256 - RNA, 14 nt, Chlamydia trachomatis
acagaucauaggcu

SEQ ID NO: 2489257 - RNA, 17 nt, Chlamydia trachomatis
acagaucauaggcuccu

SEQ ID NO: 2489258 - RNA, 13 nt, Chlamydia trachomatis
acagauugagaau

SEQ ID NO: 2489259 - RNA, 14 nt, Chlamydia trachomatis
acagauuugaguuu

SEQ ID NO: 2489260 - RNA, 13 nt, Chlamydia trachomatis
acagcaaaaccuu

SEQ ID NO: 2489261 - RNA, 16 nt, Chlamydia trachomatis
acagcaaauaaagagg

SEQ ID NO: 2489262 - RNA, 17 nt, Chlamydia trachomatis
acagcaaauaaagaggu

SEQ ID NO: 2489263 - RNA, 14 nt, Chlamydia trachomatis
acagcaagaagaag

SEQ ID NO: 2489264 - RNA, 15 nt, Chlamydia trachomatis
acagcaagaagaaga

SEQ ID NO: 2489265 - RNA, 18 nt, Chlamydia trachomatis
acagcaagcuugucuccu

SEQ ID NO: 2489266 - RNA, 15 nt, Chlamydia trachomatis
acagcaauagagaua

SEQ ID NO: 2489267 - RNA, 22 nt, Chlamydia trachomatis
acagcaauagagauaucaaucg

SEQ ID NO: 2489268 - RNA, 17 nt, Chlamydia trachomatis
acagcaauagcaacugc

SEQ ID NO: 2489269 - RNA, 14 nt, Chlamydia trachomatis
acagcaauagccau

SEQ ID NO: 2489270 - RNA, 18 nt, Chlamydia trachomatis
acagcacaaacaaauccu

SEQ ID NO: 2489271 - RNA, 22 nt, Chlamydia trachomatis
acagcacgagugaugauagaca

SEQ ID NO: 2489272 - RNA, 12 nt, Chlamydia trachomatis
acagcacuucuu

SEQ ID NO: 2489273 - RNA, 18 nt, Chlamydia trachomatis
acagcacuucuucuuugg

SEQ ID NO: 2489274 - RNA, 14 nt, Chlamydia trachomatis
acagcaucaagaau

SEQ ID NO: 2489275 - RNA, 15 nt, Chlamydia trachomatis
acagccaagcaagau

SEQ ID NO: 2489276 - RNA, 19 nt, Chlamydia trachomatis
acagccaagcaagauauaa

SEQ ID NO: 2489277 - RNA, 18 nt, Chlamydia trachomatis
acagccauaucaggaccu

SEQ ID NO: 2489278 - RNA, 15 nt, Chlamydia trachomatis
acagcguuuuccccu

SEQ ID NO: 2489279 - RNA, 19 nt, Chlamydia trachomatis
acagcguuuuccccuugca

SEQ ID NO: 2489280 - RNA, 20 nt, Chlamydia trachomatis
acagcuaaucauagccauca

SEQ ID NO: 2489281 - RNA, 15 nt, Chlamydia trachomatis
acagcuagaauagca

SEQ ID NO: 2489282 - RNA, 22 nt, Chlamydia trachomatis
acagcucuaaagagccaaaaua

SEQ ID NO: 2489283 - RNA, 15 nt, Chlamydia trachomatis
acagcucuugcauuu

SEQ ID NO: 2489284 - RNA, 15 nt, Chlamydia trachomatis
acagcuguauuuaca

SEQ ID NO: 2489285 - RNA, 14 nt, Chlamydia trachomatis
acagcuucuucuuc

SEQ ID NO: 2489286 - RNA, 17 nt, Chlamydia trachomatis
acagcuuucacagggac

SEQ ID NO: 2489287 - RNA, 13 nt, Chlamydia trachomatis
acaggaagaauau

SEQ ID NO: 2489288 - RNA, 12 nt, Chlamydia trachomatis
acaggagaaaga

SEQ ID NO: 2489289 - RNA, 19 nt, Chlamydia trachomatis
acaggauccgcaccaauca

SEQ ID NO: 2489290 - RNA, 17 nt, Chlamydia trachomatis
acaggcagcagagccaa

SEQ ID NO: 2489291 - RNA, 21 nt, Chlamydia trachomatis
acaggccgucaauaucuaggu

SEQ ID NO: 2489292 - RNA, 16 nt, Chlamydia trachomatis
acaggcugugauggaa

SEQ ID NO: 2489293 - RNA, 19 nt, Chlamydia trachomatis
acagggacaucgaaaauca

SEQ ID NO: 2489294 - RNA, 20 nt, Chlamydia trachomatis
acagggacaucgaaaaucac

SEQ ID NO: 2489295 - RNA, 19 nt, Chlamydia trachomatis
acagggauggucucacaca

SEQ ID NO: 2489296 - RNA, 20 nt, Chlamydia trachomatis
acaggucaagccuacagcua

SEQ ID NO: 2489297 - RNA, 14 nt, Chlamydia trachomatis
acaggucauaucca

SEQ ID NO: 2489298 - RNA, 14 nt, Chlamydia trachomatis
acagguuucaugac

SEQ ID NO: 2489299 - RNA, 18 nt, Chlamydia trachomatis
acaguaggucguugauaa

SEQ ID NO: 2489300 - RNA, 17 nt, Chlamydia trachomatis
acagucccguaacgcau

SEQ ID NO: 2489301 - RNA, 16 nt, Chlamydia trachomatis
acagucuguccagggg

SEQ ID NO: 2489302 - RNA, 19 nt, Chlamydia trachomatis
acagucuguguuugcacaa

SEQ ID NO: 2489303 - RNA, 14 nt, Chlamydia trachomatis
acauaaaaaagccg

SEQ ID NO: 2489304 - RNA, 18 nt, Chlamydia trachomatis
acauaaacgguggaacag

SEQ ID NO: 2489305 - RNA, 18 nt, Chlamydia trachomatis
acauaacacauaucucca

SEQ ID NO: 2489306 - RNA, 17 nt, Chlamydia trachomatis
acauaacacccuguaaa

SEQ ID NO: 2489307 - RNA, 17 nt, Chlamydia trachomatis
acauaacuaucccuacu

SEQ ID NO: 2489308 - RNA, 22 nt, Chlamydia trachomatis
acauaagaggcaccucuuuuug

SEQ ID NO: 2489309 - RNA, 19 nt, Chlamydia trachomatis
acauaagauccaucucucc

SEQ ID NO: 2489310 - RNA, 22 nt, Chlamydia trachomatis
acauacaggucaagccuacagc

SEQ ID NO: 2489311 - RNA, 13 nt, Chlamydia trachomatis
acauacguuuucu

SEQ ID NO: 2489312 - RNA, 13 nt, Chlamydia trachomatis
acauaucuccaaa

SEQ ID NO: 2489313 - RNA, 17 nt, Chlamydia trachomatis
acauauguccauacaaa

SEQ ID NO: 2489314 - RNA, 19 nt, Chlamydia trachomatis
acauauguccauacaaagg

SEQ ID NO: 2489315 - RNA, 12 nt, Chlamydia trachomatis
acaucaacagaa

SEQ ID NO: 2489316 - RNA, 14 nt, Chlamydia trachomatis
acaucaacagaaga

SEQ ID NO: 2489317 - RNA, 16 nt, Chlamydia trachomatis
acaucaggggaauucg

SEQ ID NO: 2489318 - RNA, 13 nt, Chlamydia trachomatis
acaucauaaccaa

SEQ ID NO: 2489319 - RNA, 13 nt, Chlamydia trachomatis
acaucaucucuca

SEQ ID NO: 2489320 - RNA, 12 nt, Chlamydia trachomatis
acauccaaaaau

SEQ ID NO: 2489321 - RNA, 13 nt, Chlamydia trachomatis
acaucccagcaau

SEQ ID NO: 2489322 - RNA, 14 nt, Chlamydia trachomatis
acaucccagcaaua

SEQ ID NO: 2489323 - RNA, 22 nt, Chlamydia trachomatis
acauccuacaacgaguugaucu

SEQ ID NO: 2489324 - RNA, 16 nt, Chlamydia trachomatis
acaucgaauaaaaauu

SEQ ID NO: 2489325 - RNA, 13 nt, Chlamydia trachomatis
acaucgagaaaau

SEQ ID NO: 2489326 - RNA, 14 nt, Chlamydia trachomatis
acaucuaaaagagu

SEQ ID NO: 2489327 - RNA, 23 nt, Chlamydia trachomatis
acaucuaaagucugaauauaccc

SEQ ID NO: 2489328 - RNA, 17 nt, Chlamydia trachomatis
acaucuacgaguuucuc

SEQ ID NO: 2489329 - RNA, 19 nt, Chlamydia trachomatis
acaucuauugagaagacuu

SEQ ID NO: 2489330 - RNA, 16 nt, Chlamydia trachomatis
acaucucggucuuaga

SEQ ID NO: 2489331 - RNA, 21 nt, Chlamydia trachomatis
acaucugugucauaagcucua

SEQ ID NO: 2489332 - RNA, 15 nt, Chlamydia trachomatis
acaucuucccaauau

SEQ ID NO: 2489333 - RNA, 18 nt, Chlamydia trachomatis
acaucuuuagaauccaaa

SEQ ID NO: 2489334 - RNA, 19 nt, Chlamydia trachomatis
acaucuuuagaauccaaag

SEQ ID NO: 2489335 - RNA, 22 nt, Chlamydia trachomatis
acaucuuuagaauccaaagucu

SEQ ID NO: 2489336 - RNA, 22 nt, Chlamydia trachomatis
acaugauaaugaguuccgaaca

SEQ ID NO: 2489337 - RNA, 19 nt, Chlamydia trachomatis
acaugauagucagaauaau

SEQ ID NO: 2489338 - RNA, 16 nt, Chlamydia trachomatis
acaugauucaaaauaa

SEQ ID NO: 2489339 - RNA, 17 nt, Chlamydia trachomatis
acaugauucaaaauaau

SEQ ID NO: 2489340 - RNA, 21 nt, Chlamydia trachomatis
acaugccagaagcuaugagaa

SEQ ID NO: 2489341 - RNA, 20 nt, Chlamydia trachomatis
acaugggcauagucucccaa

SEQ ID NO: 2489342 - RNA, 18 nt, Chlamydia trachomatis
acaugggcgucucuuuuu

SEQ ID NO: 2489343 - RNA, 16 nt, Chlamydia trachomatis
acaugguucaaacaua

SEQ ID NO: 2489344 - RNA, 17 nt, Chlamydia trachomatis
acauguccuaccaauau

SEQ ID NO: 2489345 - RNA, 15 nt, Chlamydia trachomatis
acauuaccauucaca

SEQ ID NO: 2489346 - RNA, 21 nt, Chlamydia trachomatis
acauuaguggugaguagcaaa

SEQ ID NO: 2489347 - RNA, 22 nt, Chlamydia trachomatis
acauuauucacacuuaaaaaga

SEQ ID NO: 2489348 - RNA, 21 nt, Chlamydia trachomatis
acauuauuccgcuucuauuuc

SEQ ID NO: 2489349 - RNA, 16 nt, Chlamydia trachomatis
acauucagaauauagc

SEQ ID NO: 2489350 - RNA, 12 nt, Chlamydia trachomatis
acauuccaaaua

SEQ ID NO: 2489351 - RNA, 13 nt, Chlamydia trachomatis
acauuccaaauau

SEQ ID NO: 2489352 - RNA, 15 nt, Chlamydia trachomatis
acauucccuaaauau

SEQ ID NO: 2489353 - RNA, 17 nt, Chlamydia trachomatis
acauucgccucuucucu

SEQ ID NO: 2489354 - RNA, 20 nt, Chlamydia trachomatis
acauucgccucuucucuuuu

SEQ ID NO: 2489355 - RNA, 16 nt, Chlamydia trachomatis
acauucucggaaaaga

SEQ ID NO: 2489356 - RNA, 20 nt, Chlamydia trachomatis
acauucugccgacuccuguc

SEQ ID NO: 2489357 - RNA, 15 nt, Chlamydia trachomatis
acauuuccaacaaaa

SEQ ID NO: 2489358 - RNA, 17 nt, Chlamydia trachomatis
acauuucugcaacucuc

SEQ ID NO: 2489359 - RNA, 17 nt, Chlamydia trachomatis
acauuugcgugauaaaa

SEQ ID NO: 2489360 - RNA, 23 nt, Chlamydia trachomatis
acauuuucugguuucuuaaacaa

SEQ ID NO: 2489361 - RNA, 13 nt, Chlamydia trachomatis
accaaaaaaucca

SEQ ID NO: 2489362 - RNA, 14 nt, Chlamydia trachomatis
accaaaaaauccac

SEQ ID NO: 2489363 - RNA, 13 nt, Chlamydia trachomatis
accaaaaauauca

SEQ ID NO: 2489364 - RNA, 14 nt, Chlamydia trachomatis
accaaaaaugaaca

SEQ ID NO: 2489365 - RNA, 21 nt, Chlamydia trachomatis
accaaaauaucauaauuacau

SEQ ID NO: 2489366 - RNA, 18 nt, Chlamydia trachomatis
accaaaccuuaaaagcaa

SEQ ID NO: 2489367 - RNA, 19 nt, Chlamydia trachomatis
accaaagaauucuugcuau

SEQ ID NO: 2489368 - RNA, 13 nt, Chlamydia trachomatis
accaaagcauuuu

SEQ ID NO: 2489369 - RNA, 16 nt, Chlamydia trachomatis
accaaaugaccuuucc

SEQ ID NO: 2489370 - RNA, 21 nt, Chlamydia trachomatis
accaacgagugccgaauaaug

SEQ ID NO: 2489371 - RNA, 22 nt, Chlamydia trachomatis
accaacuugcaacucuuauaac

SEQ ID NO: 2489372 - RNA, 12 nt, Chlamydia trachomatis
aaaaaaaaagag

SEQ ID NO: 2489373 - RNA, 12 nt, Chlamydia trachomatis
aaaaaaaaccaa

SEQ ID NO: 2489374 - RNA, 14 nt, Chlamydia trachomatis
aaaaaaaaccaaac

SEQ ID NO: 2489375 - RNA, 14 nt, Chlamydia trachomatis
aaaaaaaagaacau

SEQ ID NO: 2489376 - RNA, 21 nt, Chlamydia trachomatis
aaaaaaagagggguucuauaa

SEQ ID NO: 2489377 - RNA, 12 nt, Chlamydia trachomatis
aaaaaaagaggu

SEQ ID NO: 2489378 - RNA, 11 nt, Chlamydia trachomatis
aaaaaaccaaa

SEQ ID NO: 2489379 - RNA, 16 nt, Chlamydia trachomatis
aaaaaacuucuuccaa

SEQ ID NO: 2489380 - RNA, 23 nt, Chlamydia trachomatis
aaaaaagagaccgagccuccgcu

SEQ ID NO: 2489381 - RNA, 21 nt, Chlamydia trachomatis
aaaaaagaggucuuauuaaaa

SEQ ID NO: 2489382 - RNA, 15 nt, Chlamydia trachomatis
aaaaaaggcauaaaa

SEQ ID NO: 2489383 - RNA, 13 nt, Chlamydia trachomatis
aaaaaauccagga

SEQ ID NO: 2489384 - RNA, 17 nt, Chlamydia trachomatis
aaaaacaacaaucaaac

SEQ ID NO: 2489385 - RNA, 15 nt, Chlamydia trachomatis
aaaaacaaucaaagc

SEQ ID NO: 2489386 - RNA, 14 nt, Chlamydia trachomatis
aaaaacagaaagaa

SEQ ID NO: 2489387 - RNA, 11 nt, Chlamydia trachomatis
aaaaacagcuc

SEQ ID NO: 2489388 - RNA, 15 nt, Chlamydia trachomatis
aaaaaccaaaccaga

SEQ ID NO: 2489389 - RNA, 13 nt, Chlamydia trachomatis
aaaaaccauucca

SEQ ID NO: 2489390 - RNA, 16 nt, Chlamydia trachomatis
aaaaaccuuucuuagc

SEQ ID NO: 2489391 - RNA, 18 nt, Chlamydia trachomatis
aaaaacgcuccaaauaaa

SEQ ID NO: 2489392 - RNA, 22 nt, Chlamydia trachomatis
aaaaacgcuccaaauaaaacga

SEQ ID NO: 2489393 - RNA, 22 nt, Chlamydia trachomatis
aaaaacgguccguugauuucau

SEQ ID NO: 2489394 - RNA, 19 nt, Chlamydia trachomatis
aaaaacgguguuagaaaau

SEQ ID NO: 2489395 - RNA, 20 nt, Chlamydia trachomatis
aaaaacgguguuagaaaaua

SEQ ID NO: 2489396 - RNA, 22 nt, Chlamydia trachomatis
aaaaacgguguuagaaaauacg

SEQ ID NO: 2489397 - RNA, 12 nt, Chlamydia trachomatis
aaaaacucuaaa

SEQ ID NO: 2489398 - RNA, 16 nt, Chlamydia trachomatis
aaaaacucuaaaucgu

SEQ ID NO: 2489399 - RNA, 21 nt, Chlamydia trachomatis
aaaaacucuuuuucuaacugg

SEQ ID NO: 2489400 - RNA, 20 nt, Chlamydia trachomatis
aaaaacugcugcuaucaucu

SEQ ID NO: 2489401 - RNA, 22 nt, Chlamydia trachomatis
aaaaacuggagaauccauaacg

SEQ ID NO: 2489402 - RNA, 19 nt, Chlamydia trachomatis
aaaaacuucuuccaaauag

SEQ ID NO: 2489403 - RNA, 17 nt, Chlamydia trachomatis
aaaaacuuugacaagca

SEQ ID NO: 2489404 - RNA, 16 nt, Chlamydia trachomatis
aaaaacuuuucuuccu

SEQ ID NO: 2489405 - RNA, 11 nt, Chlamydia trachomatis
aaaaagaaaaa

SEQ ID NO: 2489406 - RNA, 10 nt, Chlamydia trachomatis
aaaaagaaac

SEQ ID NO: 2489407 - RNA, 15 nt, Chlamydia trachomatis
aaaaagaaacaaaac

SEQ ID NO: 2489408 - RNA, 14 nt, Chlamydia trachomatis
aaaaagaagcuuuu

SEQ ID NO: 2489409 - RNA, 13 nt, Chlamydia trachomatis
aaaaagaaucuaa

SEQ ID NO: 2489410 - RNA, 18 nt, Chlamydia trachomatis
aaaaagaaucuaaaaagc

SEQ ID NO: 2489411 - RNA, 24 nt, Chlamydia trachomatis
aaaaagacccagcucauuagagau

SEQ ID NO: 2489412 - RNA, 18 nt, Chlamydia trachomatis
aaaaagagcauaauaucc

SEQ ID NO: 2489413 - RNA, 12 nt, Chlamydia trachomatis
aaaaagaggaga

SEQ ID NO: 2489414 - RNA, 16 nt, Chlamydia trachomatis
aaaaagaggagaacau

SEQ ID NO: 2489415 - RNA, 14 nt, Chlamydia trachomatis
aaaaagaucuucaa

SEQ ID NO: 2489416 - RNA, 23 nt, Chlamydia trachomatis
aaaaagaucuucaacaagauuuc

SEQ ID NO: 2489417 - RNA, 20 nt, Chlamydia trachomatis
aaaaagccauacaaagauug

SEQ ID NO: 2489418 - RNA, 17 nt, Chlamydia trachomatis
aaaaagcgucuccaaaa

SEQ ID NO: 2489419 - RNA, 13 nt, Chlamydia trachomatis
aaaaagcguucuc

SEQ ID NO: 2489420 - RNA, 13 nt, Chlamydia trachomatis
aaaaagcuaucau

SEQ ID NO: 2489421 - RNA, 11 nt, Chlamydia trachomatis
aaaaagcuggu

SEQ ID NO: 2489422 - RNA, 23 nt, Chlamydia trachomatis
aaaaaggaaaucacugaaucagg

SEQ ID NO: 2489423 - RNA, 17 nt, Chlamydia trachomatis
aaaaaggcauaaaagag

SEQ ID NO: 2489424 - RNA, 15 nt, Chlamydia trachomatis
aaaaaggcuuacaga

SEQ ID NO: 2489425 - RNA, 17 nt, Chlamydia trachomatis
aaaaaggucucucuuua

SEQ ID NO: 2489426 - RNA, 17 nt, Chlamydia trachomatis
aaaaaguaagcgaagaa

SEQ ID NO: 2489427 - RNA, 20 nt, Chlamydia trachomatis
aaaaagugugccagcucuaa

SEQ ID NO: 2489428 - RNA, 20 nt, Chlamydia trachomatis
aaaaaguuugccaguaauca

SEQ ID NO: 2489429 - RNA, 13 nt, Chlamydia trachomatis
aaaaauaaaaaua

SEQ ID NO: 2489430 - RNA, 15 nt, Chlamydia trachomatis
aaaaauaaaaauagu

SEQ ID NO: 2489431 - RNA, 14 nt, Chlamydia trachomatis
aaaaauaauuuccu

SEQ ID NO: 2489432 - RNA, 19 nt, Chlamydia trachomatis
aaaaauaccaaaaaacauu

SEQ ID NO: 2489433 - RNA, 13 nt, Chlamydia trachomatis
aaaaauagaaaac

SEQ ID NO: 2489434 - RNA, 14 nt, Chlamydia trachomatis
aaaaauagaaaacg

SEQ ID NO: 2489435 - RNA, 18 nt, Chlamydia trachomatis
aaaaauaguaucuauaau

SEQ ID NO: 2489436 - RNA, 12 nt, Chlamydia trachomatis
aaaaauccuucc

SEQ ID NO: 2489437 - RNA, 20 nt, Chlamydia trachomatis
aaaaaucgcugagcucuuuc

SEQ ID NO: 2489438 - RNA, 23 nt, Chlamydia trachomatis
aaaaaucgcugagcucuuuccuc

SEQ ID NO: 2489439 - RNA, 13 nt, Chlamydia trachomatis
aaaaaucucuuua

SEQ ID NO: 2489440 - RNA, 20 nt, Chlamydia trachomatis
aaaaaucucuuuagcaugca

SEQ ID NO: 2489441 - RNA, 22 nt, Chlamydia trachomatis
aaaaaucugcaacaaauaccaa

SEQ ID NO: 2489442 - RNA, 23 nt, Chlamydia trachomatis
aaaaaucuugucguuccucuaga

SEQ ID NO: 2489443 - RNA, 21 nt, Chlamydia trachomatis
aaaaaugaacauaugcucuuu

SEQ ID NO: 2489444 - RNA, 16 nt, Chlamydia trachomatis
aaaaauugaaagagau

SEQ ID NO: 2489445 - RNA, 14 nt, Chlamydia trachomatis
aaaaauuuucacac

SEQ ID NO: 2489446 - RNA, 12 nt, Chlamydia trachomatis
aaaaauuuugag

SEQ ID NO: 2489447 - RNA, 13 nt, Chlamydia trachomatis
aaaacaaaacuac

SEQ ID NO: 2489448 - RNA, 21 nt, Chlamydia trachomatis
aaaacaaccauaauacgaaua

SEQ ID NO: 2489449 - RNA, 18 nt, Chlamydia trachomatis
aaaacaaugauauucuaa

SEQ ID NO: 2489450 - RNA, 22 nt, Chlamydia trachomatis
aaaacaauuuccuuagaaagaa

SEQ ID NO: 2489451 - RNA, 13 nt, Chlamydia trachomatis
aaaacacaaaagc

SEQ ID NO: 2489452 - RNA, 10 nt, Chlamydia trachomatis
aaaacagcuc

SEQ ID NO: 2489453 - RNA, 16 nt, Chlamydia trachomatis
aaaacauuccugccaa

SEQ ID NO: 2489454 - RNA, 21 nt, Chlamydia trachomatis
aaaacauuccugccaaaaacc

SEQ ID NO: 2489455 - RNA, 22 nt, Chlamydia trachomatis
aaaacauuccugccaaaaacca

SEQ ID NO: 2489456 - RNA, 14 nt, Chlamydia trachomatis
aaaacauuucugca

SEQ ID NO: 2489457 - RNA, 23 nt, Chlamydia trachomatis
aaaaccaccuucugcaugcaaau

SEQ ID NO: 2489458 - RNA, 19 nt, Chlamydia trachomatis
aaaaccuuuugaaacaucu

SEQ ID NO: 2489459 - RNA, 20 nt, Chlamydia trachomatis
aaaaccuuuugaaacaucuu

SEQ ID NO: 2489460 - RNA, 16 nt, Chlamydia trachomatis
aaaacgcccuccaaga

SEQ ID NO: 2489461 - RNA, 16 nt, Chlamydia trachomatis
aaaacgcucagaaaac

SEQ ID NO: 2489462 - RNA, 17 nt, Chlamydia trachomatis
aaaacgcucagaaaacu

SEQ ID NO: 2489463 - RNA, 17 nt, Chlamydia trachomatis
aaaacgcucuccaaaga

SEQ ID NO: 2489464 - RNA, 19 nt, Chlamydia trachomatis
aaaacgcucuccaaagaau

SEQ ID NO: 2489465 - RNA, 23 nt, Chlamydia trachomatis
aaaacgguccguugauuucauaa

SEQ ID NO: 2489466 - RNA, 19 nt, Chlamydia trachomatis
aaaacgguguuagaaaaua

SEQ ID NO: 2489467 - RNA, 21 nt, Chlamydia trachomatis
aaaacuaccuagugauuuuaa

SEQ ID NO: 2489468 - RNA, 22 nt, Chlamydia trachomatis
aaaacuaccuagugauuuuaaa

SEQ ID NO: 2489469 - RNA, 23 nt, Chlamydia trachomatis
aaaacuccaagcacuugaucuau

SEQ ID NO: 2489470 - RNA, 19 nt, Chlamydia trachomatis
aaaacucuccgguguaucc

SEQ ID NO: 2489471 - RNA, 11 nt, Chlamydia trachomatis
aaaacucucuu

SEQ ID NO: 2489472 - RNA, 17 nt, Chlamydia trachomatis
aaaacuucgggauaaga

SEQ ID NO: 2489473 - RNA, 15 nt, Chlamydia trachomatis
aaaacuuuacuucaa

SEQ ID NO: 2489474 - RNA, 12 nt, Chlamydia trachomatis
aaaacuuuucuu

SEQ ID NO: 2489475 - RNA, 17 nt, Chlamydia trachomatis
aaaagaaaaaaagaggu

SEQ ID NO: 2489476 - RNA, 12 nt, Chlamydia trachomatis
aaaagaaaaauc

SEQ ID NO: 2489477 - RNA, 16 nt, Chlamydia trachomatis
aaaagaaaaaucuccu

SEQ ID NO: 2489478 - RNA, 14 nt, Chlamydia trachomatis
aaaagaaacaaaac

SEQ ID NO: 2489479 - RNA, 22 nt, Chlamydia trachomatis
aaaagaaaccgaucccugaaua

SEQ ID NO: 2489480 - RNA, 17 nt, Chlamydia trachomatis
aaaagaaucuaaaaagc

SEQ ID NO: 2489481 - RNA, 15 nt, Chlamydia trachomatis
aaaagaccucuuuuu

SEQ ID NO: 2489482 - RNA, 19 nt, Chlamydia trachomatis
aaaagagagcccuaauaaa

SEQ ID NO: 2489483 - RNA, 16 nt, Chlamydia trachomatis
aaaagagcuaaacuuc

SEQ ID NO: 2489484 - RNA, 14 nt, Chlamydia trachomatis
aaaagaggagaaca

SEQ ID NO: 2489485 - RNA, 20 nt, Chlamydia trachomatis
aaaagagguauuuaggaacu

SEQ ID NO: 2489486 - RNA, 19 nt, Chlamydia trachomatis
aaaagauagugcagaagau

SEQ ID NO: 2489487 - RNA, 15 nt, Chlamydia trachomatis
aaaagaucuucaaca

SEQ ID NO: 2489488 - RNA, 9 nt, Chlamydia trachomatis
aaaagauuu

SEQ ID NO: 2489489 - RNA, 13 nt, Chlamydia trachomatis
aaaagauuucaga

SEQ ID NO: 2489490 - RNA, 14 nt, Chlamydia trachomatis
aaaagauuucagag

SEQ ID NO: 2489491 - RNA, 16 nt, Chlamydia trachomatis
aaaagauuuccccuuu

SEQ ID NO: 2489492 - RNA, 15 nt, Chlamydia trachomatis
aaaagccauacaaag

SEQ ID NO: 2489493 - RNA, 16 nt, Chlamydia trachomatis
aaaagcccagaacaac

SEQ ID NO: 2489494 - RNA, 23 nt, Chlamydia trachomatis
aaaagcccagaacaacuucucuu

SEQ ID NO: 2489495 - RNA, 20 nt, Chlamydia trachomatis
aaaagcgaggcuucaaagaa

SEQ ID NO: 2489496 - RNA, 14 nt, Chlamydia trachomatis
aaaagcucuugucg

SEQ ID NO: 2489497 - RNA, 23 nt, Chlamydia trachomatis
aaaagcugcuuuauccaaagaua

SEQ ID NO: 2489498 - RNA, 13 nt, Chlamydia trachomatis
aaaagcugggcag

SEQ ID NO: 2489499 - RNA, 21 nt, Chlamydia trachomatis
aaaagcugggcagcaagagag

SEQ ID NO: 2489500 - RNA, 22 nt, Chlamydia trachomatis
aaaagcugggcagcaagagaga

SEQ ID NO: 2489501 - RNA, 21 nt, Chlamydia trachomatis
aaaagcuucugccauuucuaa

SEQ ID NO: 2489502 - RNA, 13 nt, Chlamydia trachomatis
aaaagcuuucaaa

SEQ ID NO: 2489503 - RNA, 12 nt, Chlamydia trachomatis
aaaagcuuuucc

SEQ ID NO: 2489504 - RNA, 16 nt, Chlamydia trachomatis
aaaagcuuuuuaauca

SEQ ID NO: 2489505 - RNA, 16 nt, Chlamydia trachomatis
aaaaggcguaaaccuu

SEQ ID NO: 2489506 - RNA, 16 nt, Chlamydia trachomatis
aaaaggcuagagauau

SEQ ID NO: 2489507 - RNA, 16 nt, Chlamydia trachomatis
aaaagggcaaaacucc

SEQ ID NO: 2489508 - RNA, 13 nt, Chlamydia trachomatis
aaaaggguagaaa

SEQ ID NO: 2489509 - RNA, 17 nt, Chlamydia trachomatis
aaaaggguagaaaaaga

SEQ ID NO: 2489510 - RNA, 18 nt, Chlamydia trachomatis
aaaaggguagaaaaagag

SEQ ID NO: 2489511 - RNA, 22 nt, Chlamydia trachomatis
aaaaguaagcgaagaaggagau

SEQ ID NO: 2489512 - RNA, 22 nt, Chlamydia trachomatis
aaaagucucuaaagcuuuuguu

SEQ ID NO: 2489513 - RNA, 16 nt, Chlamydia trachomatis
aaaagucuguuccuaa

SEQ ID NO: 2489514 - RNA, 12 nt, Chlamydia trachomatis
aaaaguucauag

SEQ ID NO: 2489515 - RNA, 21 nt, Chlamydia trachomatis
aaaaguuugccaguaaucaaa

SEQ ID NO: 2489516 - RNA, 15 nt, Chlamydia trachomatis
aaaauaaaaaaaaag

SEQ ID NO: 2489517 - RNA, 20 nt, Chlamydia trachomatis
aaaauaaagaaauaaaaagc

SEQ ID NO: 2489518 - RNA, 17 nt, Chlamydia trachomatis
aaaauaaagaaauuauc

SEQ ID NO: 2489519 - RNA, 20 nt, Chlamydia trachomatis
aaaauaacgauucuugauaa

SEQ ID NO: 2489520 - RNA, 13 nt, Chlamydia trachomatis
aaaauaaguuacc

SEQ ID NO: 2489521 - RNA, 18 nt, Chlamydia trachomatis
aaaauaaguuaccucuuu

SEQ ID NO: 2489522 - RNA, 21 nt, Chlamydia trachomatis
aaaauaaucggcaaaagaucu

SEQ ID NO: 2489523 - RNA, 16 nt, Chlamydia trachomatis
aaaauaaucuuguaau

SEQ ID NO: 2489524 - RNA, 23 nt, Chlamydia trachomatis
aaaauacagcggauuagucgugu

SEQ ID NO: 2489525 - RNA, 20 nt, Chlamydia trachomatis
aaaauaccaaaaaacauucc

SEQ ID NO: 2489526 - RNA, 21 nt, Chlamydia trachomatis
aaaauagcacgcaaaacaucu

SEQ ID NO: 2489527 - RNA, 19 nt, Chlamydia trachomatis
aaaauagcaucuggaacau

SEQ ID NO: 2489528 - RNA, 17 nt, Chlamydia trachomatis
aaaauagguaaagaagu

SEQ ID NO: 2489529 - RNA, 15 nt, Chlamydia trachomatis
aaaauaugauuacug

SEQ ID NO: 2489530 - RNA, 20 nt, Chlamydia trachomatis
aaaauauggggccagcauau

SEQ ID NO: 2489531 - RNA, 13 nt, Chlamydia trachomatis
aaaauauuuugcu

SEQ ID NO: 2489532 - RNA, 18 nt, Chlamydia trachomatis
aaaaucaaggauaugugc

SEQ ID NO: 2489533 - RNA, 20 nt, Chlamydia trachomatis
aaaaucacaauuuuucuuug

SEQ ID NO: 2489534 - RNA, 18 nt, Chlamydia trachomatis
aaaaucacacaagcugac

SEQ ID NO: 2489535 - RNA, 14 nt, Chlamydia trachomatis
aaaaucagcaaaug

SEQ ID NO: 2489536 - RNA, 18 nt, Chlamydia trachomatis
aaaaucagcaaaugugga

SEQ ID NO: 2489537 - RNA, 14 nt, Chlamydia trachomatis
aaaaucagcuugau

SEQ ID NO: 2489538 - RNA, 11 nt, Chlamydia trachomatis
aaaauccaaag

SEQ ID NO: 2489539 - RNA, 13 nt, Chlamydia trachomatis
aaaauccaaagua

SEQ ID NO: 2489540 - RNA, 15 nt, Chlamydia trachomatis
aaaauccaaaguacu

SEQ ID NO: 2489541 - RNA, 18 nt, Chlamydia trachomatis
aaaauccaauguaaaaug

SEQ ID NO: 2489542 - RNA, 20 nt, Chlamydia trachomatis
aaaaucccgguaauagaagu

SEQ ID NO: 2489543 - RNA, 12 nt, Chlamydia trachomatis
aaaaucccuucc

SEQ ID NO: 2489544 - RNA, 19 nt, Chlamydia trachomatis
aaaauccuucugccucuuu

SEQ ID NO: 2489545 - RNA, 14 nt, Chlamydia trachomatis
aaaaucgugcuaug

SEQ ID NO: 2489546 - RNA, 15 nt, Chlamydia trachomatis
aaaaucuucaaugcu

SEQ ID NO: 2489547 - RNA, 18 nt, Chlamydia trachomatis
aaaaucuucauaagaaaa

SEQ ID NO: 2489548 - RNA, 19 nt, Chlamydia trachomatis
aaaaucuucauaagaaaau

SEQ ID NO: 2489549 - RNA, 17 nt, Chlamydia trachomatis
aaaaucuuccauaaaau

SEQ ID NO: 2489550 - RNA, 16 nt, Chlamydia trachomatis
aaaaugagaaauaaaa

SEQ ID NO: 2489551 - RNA, 21 nt, Chlamydia trachomatis
aaaaugaucuaaaggaaaaau

SEQ ID NO: 2489552 - RNA, 18 nt, Chlamydia trachomatis
aaaaugaugaaaaagaag

SEQ ID NO: 2489553 - RNA, 23 nt, Chlamydia trachomatis
aaaaugccgcgucgguuguauaa

SEQ ID NO: 2489554 - RNA, 20 nt, Chlamydia trachomatis
aaaaugcgcucuuuaggcac

SEQ ID NO: 2489555 - RNA, 22 nt, Chlamydia trachomatis
aaaaugcuugcguauagagcau

SEQ ID NO: 2489556 - RNA, 21 nt, Chlamydia trachomatis
aaaauuaacgcuguuggacca

SEQ ID NO: 2489557 - RNA, 21 nt, Chlamydia trachomatis
aaaauuacaauaauacaaagc

SEQ ID NO: 2489558 - RNA, 18 nt, Chlamydia trachomatis
aaaauuagggaaaaacuu

SEQ ID NO: 2489559 - RNA, 22 nt, Chlamydia trachomatis
aaaauuagggaaaaacuuuucu

SEQ ID NO: 2489560 - RNA, 17 nt, Chlamydia trachomatis
aaaauuaucuaaaaaaa

SEQ ID NO: 2489561 - RNA, 22 nt, Chlamydia trachomatis
aaaauuccucauucaagugacu

SEQ ID NO: 2489562 - RNA, 14 nt, Chlamydia trachomatis
aaaauucuacaaca

SEQ ID NO: 2489563 - RNA, 23 nt, Chlamydia trachomatis
aaaauucuucugauaaauguccc

SEQ ID NO: 2489564 - RNA, 12 nt, Chlamydia trachomatis
aaaauugcaaag

SEQ ID NO: 2489565 - RNA, 14 nt, Chlamydia trachomatis
aaaauugcaaagag

SEQ ID NO: 2489566 - RNA, 19 nt, Chlamydia trachomatis
aaaauuugucgugccagca

SEQ ID NO: 2489567 - RNA, 23 nt, Chlamydia trachomatis
aaaauuuugaggcucucuagcaa

SEQ ID NO: 2489568 - RNA, 15 nt, Chlamydia trachomatis
aaacaaaaacucuca

SEQ ID NO: 2489569 - RNA, 12 nt, Chlamydia trachomatis
aaacaaaaauaa

SEQ ID NO: 2489570 - RNA, 12 nt, Chlamydia trachomatis
aaacaaaauaau

SEQ ID NO: 2489571 - RNA, 13 nt, Chlamydia trachomatis
aaacaaaauaauc

SEQ ID NO: 2489572 - RNA, 12 nt, Chlamydia trachomatis
aaacaaacaaua

SEQ ID NO: 2489573 - RNA, 19 nt, Chlamydia trachomatis
aaacaaacaauaaguuacu

SEQ ID NO: 2489574 - RNA, 19 nt, Chlamydia trachomatis
aaacaaauccuagaagagc

SEQ ID NO: 2489575 - RNA, 13 nt, Chlamydia trachomatis
aaacaacaaagaa

SEQ ID NO: 2489576 - RNA, 16 nt, Chlamydia trachomatis
aaacaacaaagaacuc

SEQ ID NO: 2489577 - RNA, 13 nt, Chlamydia trachomatis
aaacaaccauaau

SEQ ID NO: 2489578 - RNA, 17 nt, Chlamydia trachomatis
aaacaaggauuuucuuc

SEQ ID NO: 2489579 - RNA, 21 nt, Chlamydia trachomatis
aaacaaggauuuucuucuuuu

SEQ ID NO: 2489580 - RNA, 16 nt, Chlamydia trachomatis
aaacaagguucuucaa

SEQ ID NO: 2489581 - RNA, 22 nt, Chlamydia trachomatis
aaacaagguucuucaacaacuu

SEQ ID NO: 2489582 - RNA, 18 nt, Chlamydia trachomatis
aaacaauauucuuuucca

SEQ ID NO: 2489583 - RNA, 19 nt, Chlamydia trachomatis
aaacaauauucuuuuccau

SEQ ID NO: 2489584 - RNA, 20 nt, Chlamydia trachomatis
aaacaauauucuuuuccaua

SEQ ID NO: 2489585 - RNA, 15 nt, Chlamydia trachomatis
aaacaaucaaagcac

SEQ ID NO: 2489586 - RNA, 13 nt, Chlamydia trachomatis
aaacaaucuaaaa

SEQ ID NO: 2489587 - RNA, 18 nt, Chlamydia trachomatis
aaacaauuuccuuagaaa

SEQ ID NO: 2489588 - RNA, 15 nt, Chlamydia trachomatis
aaacacaaaagcauu

SEQ ID NO: 2489589 - RNA, 16 nt, Chlamydia trachomatis
aaacaccucaacgccu

SEQ ID NO: 2489590 - RNA, 17 nt, Chlamydia trachomatis
aaacacuacgcuacaga

SEQ ID NO: 2489591 - RNA, 16 nt, Chlamydia trachomatis
aaacagaaagaaaugc

SEQ ID NO: 2489592 - RNA, 19 nt, Chlamydia trachomatis
aaacagaaccuuuuuaaaa

SEQ ID NO: 2489593 - RNA, 22 nt, Chlamydia trachomatis
aaacagaaccuuuuuaaaauaa

SEQ ID NO: 2489594 - RNA, 20 nt, Chlamydia trachomatis
aaacagaucuuuuucauuuu

SEQ ID NO: 2489595 - RNA, 21 nt, Chlamydia trachomatis
aaacagaucuuuuucauuuua

SEQ ID NO: 2489596 - RNA, 22 nt, Chlamydia trachomatis
aaacaggagaaagaaccucaau

SEQ ID NO: 2489597 - RNA, 11 nt, Chlamydia trachomatis
aaacaguucuu

SEQ ID NO: 2489598 - RNA, 13 nt, Chlamydia trachomatis
aaacauaacaccc

SEQ ID NO: 2489599 - RNA, 12 nt, Chlamydia trachomatis
aaacauccagua

SEQ ID NO: 2489600 - RNA, 20 nt, Chlamydia trachomatis
aaacaucccagcaauaccga

SEQ ID NO: 2489601 - RNA, 21 nt, Chlamydia trachomatis
aaacaucccagcaauaccgaa

SEQ ID NO: 2489602 - RNA, 18 nt, Chlamydia trachomatis
aaacaucgccauucccaa

SEQ ID NO: 2489603 - RNA, 15 nt, Chlamydia trachomatis
aaacaucuuuuaaag

SEQ ID NO: 2489604 - RNA, 16 nt, Chlamydia trachomatis
aaacaucuuuuaaagu

SEQ ID NO: 2489605 - RNA, 14 nt, Chlamydia trachomatis
aaacauuccaaaua

SEQ ID NO: 2489606 - RNA, 16 nt, Chlamydia trachomatis
aaacauucgaaucauu

SEQ ID NO: 2489607 - RNA, 14 nt, Chlamydia trachomatis
aaacauuucugcaa

SEQ ID NO: 2489608 - RNA, 18 nt, Chlamydia trachomatis
aaacauuucugcaacucu

SEQ ID NO: 2489609 - RNA, 21 nt, Chlamydia trachomatis
aaacauuugcgugauaaaaac

SEQ ID NO: 2489610 - RNA, 12 nt, Chlamydia trachomatis
aaacauuuugag

SEQ ID NO: 2489611 - RNA, 12 nt, Chlamydia trachomatis
aaaccaauuaag

SEQ ID NO: 2489612 - RNA, 20 nt, Chlamydia trachomatis
aaaccaauuguugagcagca

SEQ ID NO: 2489613 - RNA, 17 nt, Chlamydia trachomatis
aaaccacagacucaggu

SEQ ID NO: 2489614 - RNA, 15 nt, Chlamydia trachomatis
aaaccacccuuccca

SEQ ID NO: 2489615 - RNA, 15 nt, Chlamydia trachomatis
aaaccaguuucuucu

SEQ ID NO: 2489616 - RNA, 15 nt, Chlamydia trachomatis
aaaccccaauguuuc

SEQ ID NO: 2489617 - RNA, 18 nt, Chlamydia trachomatis
aaacccucugcauagcua

SEQ ID NO: 2489618 - RNA, 23 nt, Chlamydia trachomatis
aaacccucugcauagcuauaaaa

SEQ ID NO: 2489619 - RNA, 17 nt, Chlamydia trachomatis
aaaccgaagagggaaga

SEQ ID NO: 2489620 - RNA, 14 nt, Chlamydia trachomatis
aaaccgaauguuag

SEQ ID NO: 2489621 - RNA, 19 nt, Chlamydia trachomatis
aaaccuaauagaaauagcu

SEQ ID NO: 2489622 - RNA, 16 nt, Chlamydia trachomatis
aaaccuccagaaggga

SEQ ID NO: 2489623 - RNA, 17 nt, Chlamydia trachomatis
aaaccuccuaaauacca

SEQ ID NO: 2489624 - RNA, 20 nt, Chlamydia trachomatis
aaaccuucuugaaagcuuag

SEQ ID NO: 2489625 - RNA, 12 nt, Chlamydia trachomatis
aaaccuugauaa

SEQ ID NO: 2489626 - RNA, 15 nt, Chlamydia trachomatis
aaacgaagccaaaag

SEQ ID NO: 2489627 - RNA, 17 nt, Chlamydia trachomatis
aaacgagcuagcucuug

SEQ ID NO: 2489628 - RNA, 17 nt, Chlamydia trachomatis
aaacgauuauguucugu

SEQ ID NO: 2489629 - RNA, 16 nt, Chlamydia trachomatis
aaacgcucagaaaacu

SEQ ID NO: 2489630 - RNA, 18 nt, Chlamydia trachomatis
aaacgcuccaaauaaaac

SEQ ID NO: 2489631 - RNA, 23 nt, Chlamydia trachomatis
aaacggaagugguuaaugucucu

SEQ ID NO: 2489632 - RNA, 17 nt, Chlamydia trachomatis
aaacgguggaacagcuc

SEQ ID NO: 2489633 - RNA, 19 nt, Chlamydia trachomatis
aaacgucgaaaagcuucug

SEQ ID NO: 2489634 - RNA, 18 nt, Chlamydia trachomatis
aaacuaaaaguugcucuu

SEQ ID NO: 2489635 - RNA, 19 nt, Chlamydia trachomatis
aaacuacccgauucaaaaa

SEQ ID NO: 2489636 - RNA, 15 nt, Chlamydia trachomatis
aaacuagaagggaac

SEQ ID NO: 2489637 - RNA, 21 nt, Chlamydia trachomatis
aaacuagucucuucugugcaa

SEQ ID NO: 2489638 - RNA, 20 nt, Chlamydia trachomatis
aaacuaucuaaaaucccuaa

SEQ ID NO: 2489639 - RNA, 16 nt, Chlamydia trachomatis
aaacuauggagagggu

SEQ ID NO: 2489640 - RNA, 20 nt, Chlamydia trachomatis
aaacucacaaauaacagaaa

SEQ ID NO: 2489641 - RNA, 15 nt, Chlamydia trachomatis
aaacuccaagcacuu

SEQ ID NO: 2489642 - RNA, 16 nt, Chlamydia trachomatis
aaacuccauugcugau

SEQ ID NO: 2489643 - RNA, 21 nt, Chlamydia trachomatis
aaacucucgggccaaaaagac

SEQ ID NO: 2489644 - RNA, 20 nt, Chlamydia trachomatis
aaacucuuacgagcuuucuu

SEQ ID NO: 2489645 - RNA, 16 nt, Chlamydia trachomatis
aaacugcucaaggaaa

SEQ ID NO: 2489646 - RNA, 16 nt, Chlamydia trachomatis
aaacugucgaagaaug

SEQ ID NO: 2489647 - RNA, 22 nt, Chlamydia trachomatis
aaacugucuauuggacucagaa

SEQ ID NO: 2489648 - RNA, 23 nt, Chlamydia trachomatis
aaacugucuauuggacucagaau

SEQ ID NO: 2489649 - RNA, 16 nt, Chlamydia trachomatis
aaacugugaagaauga

SEQ ID NO: 2489650 - RNA, 15 nt, Chlamydia trachomatis
aaacuuacuuuucuu

SEQ ID NO: 2489651 - RNA, 16 nt, Chlamydia trachomatis
aaacuuagaggccgau

SEQ ID NO: 2489652 - RNA, 22 nt, Chlamydia trachomatis
aaacuuagaggccgaugguucu

SEQ ID NO: 2489653 - RNA, 21 nt, Chlamydia trachomatis
aaacuuagcuaaauucaacug

SEQ ID NO: 2489654 - RNA, 14 nt, Chlamydia trachomatis
aaacuucaaacucg

SEQ ID NO: 2489655 - RNA, 14 nt, Chlamydia trachomatis
aaacuucuggagau

SEQ ID NO: 2489656 - RNA, 13 nt, Chlamydia trachomatis
aaacuucuuccaa

SEQ ID NO: 2489657 - RNA, 22 nt, Chlamydia trachomatis
aaacuucuuccaaauagggucu

SEQ ID NO: 2489658 - RNA, 23 nt, Chlamydia trachomatis
aaacuucuucgucugugagagag

SEQ ID NO: 2489659 - RNA, 20 nt, Chlamydia trachomatis
aaacuucuucuaaguauucu

SEQ ID NO: 2489660 - RNA, 20 nt, Chlamydia trachomatis
aaacuuuaccgacuucaacu

SEQ ID NO: 2489661 - RNA, 11 nt, Chlamydia trachomatis
aaacuuucuug

SEQ ID NO: 2489662 - RNA, 22 nt, Chlamydia trachomatis
aaacuuuucugcagagcacaaa

SEQ ID NO: 2489663 - RNA, 15 nt, Chlamydia trachomatis
aaacuuuucuuccuc

SEQ ID NO: 2489664 - RNA, 11 nt, Chlamydia trachomatis
aaagaaaaaaa

SEQ ID NO: 2489665 - RNA, 18 nt, Chlamydia trachomatis
aaagaaaaaaagaggucu

SEQ ID NO: 2489666 - RNA, 19 nt, Chlamydia trachomatis
aaagaaaaauaaaaauagu

SEQ ID NO: 2489667 - RNA, 13 nt, Chlamydia trachomatis
aaagaaaaggcug

SEQ ID NO: 2489668 - RNA, 14 nt, Chlamydia trachomatis
aaagaaacaaaacg

SEQ ID NO: 2489669 - RNA, 18 nt, Chlamydia trachomatis
aaagaaagccguucccaa

SEQ ID NO: 2489670 - RNA, 13 nt, Chlamydia trachomatis
aaagaaagcuuau

SEQ ID NO: 2489671 - RNA, 20 nt, Chlamydia trachomatis
aaagaaaugcguuucuucug

SEQ ID NO: 2489672 - RNA, 23 nt, Chlamydia trachomatis
aaagaaccucaauagcugacuuu

SEQ ID NO: 2489673 - RNA, 20 nt, Chlamydia trachomatis
aaagaacguuucgucucuuu

SEQ ID NO: 2489674 - RNA, 22 nt, Chlamydia trachomatis
aaagaacguuucgucucuuuaa

SEQ ID NO: 2489675 - RNA, 22 nt, Chlamydia trachomatis
aaagaacucccuccaaaaaaga

SEQ ID NO: 2489676 - RNA, 19 nt, Chlamydia trachomatis
aaagaagccuucuuccuug

SEQ ID NO: 2489677 - RNA, 12 nt, Chlamydia trachomatis
aaagaagcuuuu

SEQ ID NO: 2489678 - RNA, 14 nt, Chlamydia trachomatis
aaagaaucuaaaaa

SEQ ID NO: 2489679 - RNA, 15 nt, Chlamydia trachomatis
aaagaaucuuugucu

SEQ ID NO: 2489680 - RNA, 16 nt, Chlamydia trachomatis
aaagaaugaccaguuu

SEQ ID NO: 2489681 - RNA, 12 nt, Chlamydia trachomatis
aaagaauuugcu

SEQ ID NO: 2489682 - RNA, 14 nt, Chlamydia trachomatis
aaagacaaaacuuc

SEQ ID NO: 2489683 - RNA, 15 nt, Chlamydia trachomatis
aaagacaaaacuucu

SEQ ID NO: 2489684 - RNA, 13 nt, Chlamydia trachomatis
aaagacuaucugu

SEQ ID NO: 2489685 - RNA, 14 nt, Chlamydia trachomatis
aaagacuuguucug

SEQ ID NO: 2489686 - RNA, 11 nt, Chlamydia trachomatis
aaagagaacac

SEQ ID NO: 2489687 - RNA, 14 nt, Chlamydia trachomatis
aaagagaagaaggc

SEQ ID NO: 2489688 - RNA, 15 nt, Chlamydia trachomatis
aaagagaagaaggcu

SEQ ID NO: 2489689 - RNA, 20 nt, Chlamydia trachomatis
aaagagagaggagaaaaacu

SEQ ID NO: 2489690 - RNA, 17 nt, Chlamydia trachomatis
aaagagagcaacgagca

SEQ ID NO: 2489691 - RNA, 16 nt, Chlamydia trachomatis
aaagagaugucagagu

SEQ ID NO: 2489692 - RNA, 14 nt, Chlamydia trachomatis
aaagagauucuuug

SEQ ID NO: 2489693 - RNA, 19 nt, Chlamydia trachomatis
aaagagcauaauaucccca

SEQ ID NO: 2489694 - RNA, 22 nt, Chlamydia trachomatis
aaagagccguucucucuaaaau

SEQ ID NO: 2489695 - RNA, 20 nt, Chlamydia trachomatis
aaagagcuaggguguauugg

SEQ ID NO: 2489696 - RNA, 14 nt, Chlamydia trachomatis
aaagagcuuuucuu

SEQ ID NO: 2489697 - RNA, 15 nt, Chlamydia trachomatis
aaagaggacgagcga

SEQ ID NO: 2489698 - RNA, 19 nt, Chlamydia trachomatis
aaagaggcuucgauaagaa

SEQ ID NO: 2489699 - RNA, 23 nt, Chlamydia trachomatis
aaagaggcuucgauaagaaaaaa

SEQ ID NO: 2489700 - RNA, 21 nt, Chlamydia trachomatis
aaagagggguucuauaaauga

SEQ ID NO: 2489701 - RNA, 19 nt, Chlamydia trachomatis
aaagagucgcuucuggcga

SEQ ID NO: 2489702 - RNA, 14 nt, Chlamydia trachomatis
aaagaguuucuuug

SEQ ID NO: 2489703 - RNA, 23 nt, Chlamydia trachomatis
aaagaguuugugauuuagacaca

SEQ ID NO: 2489704 - RNA, 14 nt, Chlamydia trachomatis
aaagauaacacucu

SEQ ID NO: 2489705 - RNA, 20 nt, Chlamydia trachomatis
aaagaucgguucauaaaauu

SEQ ID NO: 2489706 - RNA, 20 nt, Chlamydia trachomatis
aaagaucuucaacaagauuu

SEQ ID NO: 2489707 - RNA, 21 nt, Chlamydia trachomatis
aaagaucuucaacaagauuuc

SEQ ID NO: 2489708 - RNA, 15 nt, Chlamydia trachomatis
aaagaugaagaaguu

SEQ ID NO: 2489709 - RNA, 16 nt, Chlamydia trachomatis
aaagaugaagaaguuu

SEQ ID NO: 2489710 - RNA, 14 nt, Chlamydia trachomatis
aaagauuuccccaa

SEQ ID NO: 2489711 - RNA, 21 nt, Chlamydia trachomatis
aaagauuuccccuuuucaaua

SEQ ID NO: 2489712 - RNA, 18 nt, Chlamydia trachomatis
aaagauuucuucuguagc

SEQ ID NO: 2489713 - RNA, 20 nt, Chlamydia trachomatis
aaagcaauccgcuuggaaua

SEQ ID NO: 2489714 - RNA, 18 nt, Chlamydia trachomatis
aaagcacaauaacagcac

SEQ ID NO: 2489715 - RNA, 20 nt, Chlamydia trachomatis
aaagcacgauaaaagacaga

SEQ ID NO: 2489716 - RNA, 20 nt, Chlamydia trachomatis
aaagcacugcguauuugaaa

SEQ ID NO: 2489717 - RNA, 23 nt, Chlamydia trachomatis
aaagcacugcguauuugaaauca

SEQ ID NO: 2489718 - RNA, 15 nt, Chlamydia trachomatis
aaagcagaaacagcu

SEQ ID NO: 2489719 - RNA, 20 nt, Chlamydia trachomatis
aaagcagccacuccugcagc

SEQ ID NO: 2489720 - RNA, 13 nt, Chlamydia trachomatis
aaagcagcggcaa

SEQ ID NO: 2489721 - RNA, 21 nt, Chlamydia trachomatis
aaagcagcuaaccaugcuccu

SEQ ID NO: 2489722 - RNA, 16 nt, Chlamydia trachomatis
aaagcagcuaauucca

SEQ ID NO: 2489723 - RNA, 14 nt, Chlamydia trachomatis
aaagcauccccaaa

SEQ ID NO: 2489724 - RNA, 22 nt, Chlamydia trachomatis
aaagcauccccaaaaggauuga

SEQ ID NO: 2489725 - RNA, 17 nt, Chlamydia trachomatis
aaagcaucuuuaccauu

SEQ ID NO: 2489726 - RNA, 21 nt, Chlamydia trachomatis
aaagcaucuuuaccauuucca

SEQ ID NO: 2489727 - RNA, 19 nt, Chlamydia trachomatis
aaagcauguuucggaauuc

SEQ ID NO: 2489728 - RNA, 18 nt, Chlamydia trachomatis
aaagcauucguuaucaau

SEQ ID NO: 2489729 - RNA, 20 nt, Chlamydia trachomatis
aaagcauucguuaucaauaa

SEQ ID NO: 2489730 - RNA, 17 nt, Chlamydia trachomatis
aaagccauacaaagauu

SEQ ID NO: 2489731 - RNA, 22 nt, Chlamydia trachomatis
aaagcccagaacaacuucucuu

SEQ ID NO: 2489732 - RNA, 17 nt, Chlamydia trachomatis
aaagcccaguuaaccuu

SEQ ID NO: 2489733 - RNA, 18 nt, Chlamydia trachomatis
aaagcccaguuaaccuug

SEQ ID NO: 2489734 - RNA, 17 nt, Chlamydia trachomatis
aaagccgucaaucaguu

SEQ ID NO: 2489735 - RNA, 22 nt, Chlamydia trachomatis
aaagccuaucgcacacaauaaa

SEQ ID NO: 2489736 - RNA, 13 nt, Chlamydia trachomatis
aaagccugugccu

SEQ ID NO: 2489737 - RNA, 14 nt, Chlamydia trachomatis
aaagccuuucucua

SEQ ID NO: 2489738 - RNA, 18 nt, Chlamydia trachomatis
aaagcgaggcuucaaaga

SEQ ID NO: 2489739 - RNA, 22 nt, Chlamydia trachomatis
aaagcgaggcuucaaagaacau

SEQ ID NO: 2489740 - RNA, 17 nt, Chlamydia trachomatis
aaagcgaucagcucucc

SEQ ID NO: 2489741 - RNA, 14 nt, Chlamydia trachomatis
aaagcgaucuuuga

SEQ ID NO: 2489742 - RNA, 13 nt, Chlamydia trachomatis
aaagcgucuccaa

SEQ ID NO: 2489743 - RNA, 13 nt, Chlamydia trachomatis
aaagcuagaagaa

SEQ ID NO: 2489744 - RNA, 18 nt, Chlamydia trachomatis
aaagcuaucccaaaagaa

SEQ ID NO: 2489745 - RNA, 19 nt, Chlamydia trachomatis
aaagcuaucccaaaagaau

SEQ ID NO: 2489746 - RNA, 21 nt, Chlamydia trachomatis
aaagcuaugcccaggauagga

SEQ ID NO: 2489747 - RNA, 16 nt, Chlamydia trachomatis
aaagcuauucccacua

SEQ ID NO: 2489748 - RNA, 16 nt, Chlamydia trachomatis
aaagcuauuugcaaga

SEQ ID NO: 2489749 - RNA, 14 nt, Chlamydia trachomatis
aaagcuauuuucuu

SEQ ID NO: 2489750 - RNA, 22 nt, Chlamydia trachomatis
aaagcuauuuucuuccugcuuc

SEQ ID NO: 2489751 - RNA, 21 nt, Chlamydia trachomatis
aaagcucugaguuaaaggaag

SEQ ID NO: 2489752 - RNA, 10 nt, Chlamydia trachomatis
aaagcugcuu

SEQ ID NO: 2489753 - RNA, 16 nt, Chlamydia trachomatis
aaagcugcuuuacauc

SEQ ID NO: 2489754 - RNA, 20 nt, Chlamydia trachomatis
aaagcugcuuuauccaaaga

SEQ ID NO: 2489755 - RNA, 15 nt, Chlamydia trachomatis
aaagcugggaaaucu

SEQ ID NO: 2489756 - RNA, 12 nt, Chlamydia trachomatis
aaagcuucccuu

SEQ ID NO: 2489757 - RNA, 19 nt, Chlamydia trachomatis
aaagcuucccuucucugcu

SEQ ID NO: 2489758 - RNA, 19 nt, Chlamydia trachomatis
aaagcuucuaagaacaacg

SEQ ID NO: 2489759 - RNA, 20 nt, Chlamydia trachomatis
aaagcuuucccguauuuacc

SEQ ID NO: 2489760 - RNA, 20 nt, Chlamydia trachomatis
aaagcuuucuuccccaaagc

SEQ ID NO: 2489761 - RNA, 17 nt, Chlamydia trachomatis
aaagcuuuuuccaaagc

SEQ ID NO: 2489762 - RNA, 19 nt, Chlamydia trachomatis
aaagcuuuuuccaaagcuu

SEQ ID NO: 2489763 - RNA, 23 nt, Chlamydia trachomatis
aaagcuuuuuccaaagcuucuaa

SEQ ID NO: 2489764 - RNA, 19 nt, Chlamydia trachomatis
aaaggaacaucgagaaaau

SEQ ID NO: 2489765 - RNA, 20 nt, Chlamydia trachomatis
aaaggaacaucgagaaaaug

SEQ ID NO: 2489766 - RNA, 13 nt, Chlamydia trachomatis
aaaggaaguagag

SEQ ID NO: 2489767 - RNA, 14 nt, Chlamydia trachomatis
aaaggaaguugaga

SEQ ID NO: 2489768 - RNA, 12 nt, Chlamydia trachomatis
aaaggaauccuu

SEQ ID NO: 2489769 - RNA, 21 nt, Chlamydia trachomatis
aaaggaaucuguccaaagaga

SEQ ID NO: 2489770 - RNA, 18 nt, Chlamydia trachomatis
aaaggauaaggaagaaga

SEQ ID NO: 2489771 - RNA, 16 nt, Chlamydia trachomatis
aaaggauagacuggca

SEQ ID NO: 2489772 - RNA, 17 nt, Chlamydia trachomatis
aaaggauauacagaaca

SEQ ID NO: 2489773 - RNA, 19 nt, Chlamydia trachomatis
aaaggaugucuaucuagau

SEQ ID NO: 2489774 - RNA, 19 nt, Chlamydia trachomatis
aaaggcauaaaagagaaga

SEQ ID NO: 2489775 - RNA, 12 nt, Chlamydia trachomatis
aaaggccaggcu

SEQ ID NO: 2489776 - RNA, 19 nt, Chlamydia trachomatis
aaaggccuauccaaggaaa

SEQ ID NO: 2489777 - RNA, 15 nt, Chlamydia trachomatis
aaaggcgcagcuuuc

SEQ ID NO: 2489778 - RNA, 21 nt, Chlamydia trachomatis
aaaggcucuaucggaauagca

SEQ ID NO: 2489779 - RNA, 15 nt, Chlamydia trachomatis
aaaggcuuauucucu

SEQ ID NO: 2489780 - RNA, 22 nt, Chlamydia trachomatis
aaaggcuuauucucuuuauaga

SEQ ID NO: 2489781 - RNA, 23 nt, Chlamydia trachomatis
aaagggaggaggaaagaguucuc

SEQ ID NO: 2489782 - RNA, 14 nt, Chlamydia trachomatis
aaaggggcuuuuuu

SEQ ID NO: 2489783 - RNA, 19 nt, Chlamydia trachomatis
aaagggggacaaaaauacu

SEQ ID NO: 2489784 - RNA, 14 nt, Chlamydia trachomatis
aaaggguagaaaaa

SEQ ID NO: 2489785 - RNA, 15 nt, Chlamydia trachomatis
aaagguuucccaaaa

SEQ ID NO: 2489786 - RNA, 19 nt, Chlamydia trachomatis
aaagguuucuggaaaaucu

SEQ ID NO: 2489787 - RNA, 13 nt, Chlamydia trachomatis
aaagguuuuucuu

SEQ ID NO: 2489788 - RNA, 19 nt, Chlamydia trachomatis
aaaguaagaccgagauuau

SEQ ID NO: 2489789 - RNA, 15 nt, Chlamydia trachomatis
aaaguaagcgaagaa

SEQ ID NO: 2489790 - RNA, 13 nt, Chlamydia trachomatis
aaaguaaguaaaa

SEQ ID NO: 2489791 - RNA, 15 nt, Chlamydia trachomatis
aaaguacucagucaa

SEQ ID NO: 2489792 - RNA, 18 nt, Chlamydia trachomatis
aaaguagaccauuuagac

SEQ ID NO: 2489793 - RNA, 19 nt, Chlamydia trachomatis
aaaguagcuacuuucgcuu

SEQ ID NO: 2489794 - RNA, 20 nt, Chlamydia trachomatis
aaaguauucuguaaaaggaa

SEQ ID NO: 2489795 - RNA, 23 nt, Chlamydia trachomatis
aaagucagagauauugucuacuu

SEQ ID NO: 2489796 - RNA, 20 nt, Chlamydia trachomatis
aaaguccgcuaauccaugca

SEQ ID NO: 2489797 - RNA, 13 nt, Chlamydia trachomatis
aaagucuccauaa

SEQ ID NO: 2489798 - RNA, 17 nt, Chlamydia trachomatis
aaagucucgaauucuau

SEQ ID NO: 2489799 - RNA, 14 nt, Chlamydia trachomatis
aaagucucuaaagc

SEQ ID NO: 2489800 - RNA, 20 nt, Chlamydia trachomatis
aaagucuguuccuaauacua

SEQ ID NO: 2489801 - RNA, 23 nt, Chlamydia trachomatis
aaagugcauaccuuuugcaauca

SEQ ID NO: 2489802 - RNA, 17 nt, Chlamydia trachomatis
aaaguggcguuguuucu

SEQ ID NO: 2489803 - RNA, 17 nt, Chlamydia trachomatis
aaaguuccaucuccuga

SEQ ID NO: 2489804 - RNA, 23 nt, Chlamydia trachomatis
aaaguuccaucuccugauuccga

SEQ ID NO: 2489805 - RNA, 17 nt, Chlamydia trachomatis
aaaguugguagaggaga

SEQ ID NO: 2489806 - RNA, 19 nt, Chlamydia trachomatis
aaaguuggucgcagaauaa

SEQ ID NO: 2489807 - RNA, 22 nt, Chlamydia trachomatis
aaaguuuccuuaaaguuugcug

SEQ ID NO: 2489808 - RNA, 18 nt, Chlamydia trachomatis
aaaguuugcuggguuuua

SEQ ID NO: 2489809 - RNA, 18 nt, Chlamydia trachomatis
aaaguuuucuugguuucu

SEQ ID NO: 2489810 - RNA, 14 nt, Chlamydia trachomatis
aaaguuuuuucccc

SEQ ID NO: 2489811 - RNA, 15 nt, Chlamydia trachomatis
aaauaaagaaauuau

SEQ ID NO: 2489812 - RNA, 12 nt, Chlamydia trachomatis
aaauaaagaggu

SEQ ID NO: 2489813 - RNA, 12 nt, Chlamydia trachomatis
aaauaacaaagc

SEQ ID NO: 2489814 - RNA, 18 nt, Chlamydia trachomatis
aaauaaccggaacaauca

SEQ ID NO: 2489815 - RNA, 19 nt, Chlamydia trachomatis
aaauaacgauucuugauaa

SEQ ID NO: 2489816 - RNA, 23 nt, Chlamydia trachomatis
aaauaacgauucuugauaaauaa

SEQ ID NO: 2489817 - RNA, 14 nt, Chlamydia trachomatis
aaauaagaaaguuu

SEQ ID NO: 2489818 - RNA, 22 nt, Chlamydia trachomatis
aaauaagucuuuuacuuugaaa

SEQ ID NO: 2489819 - RNA, 14 nt, Chlamydia trachomatis
aaauaaucucguug

SEQ ID NO: 2489820 - RNA, 20 nt, Chlamydia trachomatis
aaauaaucuuguaauaucaa

SEQ ID NO: 2489821 - RNA, 18 nt, Chlamydia trachomatis
aaauaauuuccugacucg

SEQ ID NO: 2489822 - RNA, 13 nt, Chlamydia trachomatis
aaauacaaaucuu

SEQ ID NO: 2489823 - RNA, 22 nt, Chlamydia trachomatis
aaauacaaaucuuuuaucuucu

SEQ ID NO: 2489824 - RNA, 13 nt, Chlamydia trachomatis
aaauacacagcau

SEQ ID NO: 2489825 - RNA, 16 nt, Chlamydia trachomatis
aaauacuucuuuuugu

SEQ ID NO: 2489826 - RNA, 16 nt, Chlamydia trachomatis
aaauacuugauuuuuu

SEQ ID NO: 2489827 - RNA, 23 nt, Chlamydia trachomatis
aaauagccauucccuaaagcagc

SEQ ID NO: 2489828 - RNA, 23 nt, Chlamydia trachomatis
aaauagcucaguugguagagcaa

SEQ ID NO: 2489829 - RNA, 21 nt, Chlamydia trachomatis
aaauagcuucguagagcaaga

SEQ ID NO: 2489830 - RNA, 19 nt, Chlamydia trachomatis
aaauaggcgaauuucucua

SEQ ID NO: 2489831 - RNA, 21 nt, Chlamydia trachomatis
aaauagguaugugcucauuuc

SEQ ID NO: 2489832 - RNA, 14 nt, Chlamydia trachomatis
aaauauacucagag

SEQ ID NO: 2489833 - RNA, 15 nt, Chlamydia trachomatis
aaauauacucagaga

SEQ ID NO: 2489834 - RNA, 16 nt, Chlamydia trachomatis
aaauaucauucccuac

SEQ ID NO: 2489835 - RNA, 15 nt, Chlamydia trachomatis
aaauauccagaguca

SEQ ID NO: 2489836 - RNA, 18 nt, Chlamydia trachomatis
aaauaucuacuucuuguu

SEQ ID NO: 2489837 - RNA, 19 nt, Chlamydia trachomatis
aaauauugaucuccccauc

SEQ ID NO: 2489838 - RNA, 15 nt, Chlamydia trachomatis
aaaucaaaaggccaa

SEQ ID NO: 2489839 - RNA, 13 nt, Chlamydia trachomatis
aaaucaaaccaaa

SEQ ID NO: 2489840 - RNA, 14 nt, Chlamydia trachomatis
aaaucaaaccaaaa

SEQ ID NO: 2489841 - RNA, 13 nt, Chlamydia trachomatis
aaaucaauaaugu

SEQ ID NO: 2489842 - RNA, 19 nt, Chlamydia trachomatis
aaaucaauaaugucuccag

SEQ ID NO: 2489843 - RNA, 15 nt, Chlamydia trachomatis
aaaucacaaugcgcu

SEQ ID NO: 2489844 - RNA, 16 nt, Chlamydia trachomatis
aaaucacaauuuuucu

SEQ ID NO: 2489845 - RNA, 13 nt, Chlamydia trachomatis
aaaucacacaagc

SEQ ID NO: 2489846 - RNA, 18 nt, Chlamydia trachomatis
aaaucacgcacuuuuugu

SEQ ID NO: 2489847 - RNA, 17 nt, Chlamydia trachomatis
aaaucacugagaggagu

SEQ ID NO: 2489848 - RNA, 21 nt, Chlamydia trachomatis
aaaucagcuugauauucccuu

SEQ ID NO: 2489849 - RNA, 18 nt, Chlamydia trachomatis
aaaucaugaauuguuucu

SEQ ID NO: 2489850 - RNA, 20 nt, Chlamydia trachomatis
aaaucauggauguacgcucu

SEQ ID NO: 2489851 - RNA, 20 nt, Chlamydia trachomatis
aaaucauuuccacaagauuu

SEQ ID NO: 2489852 - RNA, 18 nt, Chlamydia trachomatis
aaauccaauguaaaauga

SEQ ID NO: 2489853 - RNA, 14 nt, Chlamydia trachomatis
aaauccauucccag

SEQ ID NO: 2489854 - RNA, 23 nt, Chlamydia trachomatis
aaauccauuggugguaacaccaa

SEQ ID NO: 2489855 - RNA, 23 nt, Chlamydia trachomatis
aaaucccaguacaucaaauaauu

SEQ ID NO: 2489856 - RNA, 15 nt, Chlamydia trachomatis
aaaucccuaacucuu

SEQ ID NO: 2489857 - RNA, 15 nt, Chlamydia trachomatis
aaaucccuucccagc

SEQ ID NO: 2489858 - RNA, 15 nt, Chlamydia trachomatis
aaauccuacacaagc

SEQ ID NO: 2489859 - RNA, 22 nt, Chlamydia trachomatis
aaauccuauacccgacuaaaaa

SEQ ID NO: 2489860 - RNA, 22 nt, Chlamydia trachomatis
aaauccuccugcaggaggcauu

SEQ ID NO: 2489861 - RNA, 20 nt, Chlamydia trachomatis
aaauccucuuugaauauccg

SEQ ID NO: 2489862 - RNA, 22 nt, Chlamydia trachomatis
aaauccucuuugaauauccgaa

SEQ ID NO: 2489863 - RNA, 19 nt, Chlamydia trachomatis
aaauccugcgcgcaaauca

SEQ ID NO: 2489864 - RNA, 15 nt, Chlamydia trachomatis
aaaucgcugagcucu

SEQ ID NO: 2489865 - RNA, 12 nt, Chlamydia trachomatis
aaaucgugcuau

SEQ ID NO: 2489866 - RNA, 18 nt, Chlamydia trachomatis
aaaucucuuggagagaau

SEQ ID NO: 2489867 - RNA, 19 nt, Chlamydia trachomatis
aaaucucuuuuaccucuaa

SEQ ID NO: 2489868 - RNA, 14 nt, Chlamydia trachomatis
aaaucugcaagaac

SEQ ID NO: 2489869 - RNA, 15 nt, Chlamydia trachomatis
aaaucuucauaagaa

SEQ ID NO: 2489870 - RNA, 16 nt, Chlamydia trachomatis
aaaucuucauaagaaa

SEQ ID NO: 2489871 - RNA, 17 nt, Chlamydia trachomatis
aaaucuucauaagaaaa

SEQ ID NO: 2489872 - RNA, 20 nt, Chlamydia trachomatis
aaaucuuccauaaaauccaa

SEQ ID NO: 2489873 - RNA, 12 nt, Chlamydia trachomatis
aaaucuucuucu

SEQ ID NO: 2489874 - RNA, 14 nt, Chlamydia trachomatis
aaaucuucuucuaa

SEQ ID NO: 2489875 - RNA, 21 nt, Chlamydia trachomatis
aaaucuucuucuaagcuagaa

SEQ ID NO: 2489876 - RNA, 22 nt, Chlamydia trachomatis
aaaucuucuucuaagcuagaaa

SEQ ID NO: 2489877 - RNA, 14 nt, Chlamydia trachomatis
aaaucuuucuuucu

SEQ ID NO: 2489878 - RNA, 21 nt, Chlamydia trachomatis
aaaucuuucuuucuaagaaau

SEQ ID NO: 2489879 - RNA, 14 nt, Chlamydia trachomatis
aaaugaacauaugc

SEQ ID NO: 2489880 - RNA, 17 nt, Chlamydia trachomatis
aaaugaaggccaaagaa

SEQ ID NO: 2489881 - RNA, 23 nt, Chlamydia trachomatis
aaaugaaggccaaagaaauagcu

SEQ ID NO: 2489882 - RNA, 13 nt, Chlamydia trachomatis
aaaugaauuccaa

SEQ ID NO: 2489883 - RNA, 15 nt, Chlamydia trachomatis
aaaugaccuuucccu

SEQ ID NO: 2489884 - RNA, 16 nt, Chlamydia trachomatis
aaaugagaaauaaaaa

SEQ ID NO: 2489885 - RNA, 21 nt, Chlamydia trachomatis
aaaugaggacagaguucucug

SEQ ID NO: 2489886 - RNA, 21 nt, Chlamydia trachomatis
aaaugaucuaaaggaaaaauu

SEQ ID NO: 2489887 - RNA, 21 nt, Chlamydia trachomatis
aaaugcaaagcuuuucuccuu

SEQ ID NO: 2489888 - RNA, 21 nt, Chlamydia trachomatis
aaaugcguuaaacuuucuugc

SEQ ID NO: 2489889 - RNA, 23 nt, Chlamydia trachomatis
aaaugcguuaaacuuucuugcau

SEQ ID NO: 2489890 - RNA, 17 nt, Chlamydia trachomatis
aaaugcguuucuucugc

SEQ ID NO: 2489891 - RNA, 20 nt, Chlamydia trachomatis
aaaugcucucgcauuugaga

SEQ ID NO: 2489892 - RNA, 15 nt, Chlamydia trachomatis
aaaugcuguaaaaca

SEQ ID NO: 2489893 - RNA, 16 nt, Chlamydia trachomatis
aaauggucucuucucc

SEQ ID NO: 2489894 - RNA, 17 nt, Chlamydia trachomatis
aaaugucccugaacauc

SEQ ID NO: 2489895 - RNA, 13 nt, Chlamydia trachomatis
aaauguuccucgu

SEQ ID NO: 2489896 - RNA, 21 nt, Chlamydia trachomatis
aaauguuugaucugagaaagc

SEQ ID NO: 2489897 - RNA, 12 nt, Chlamydia trachomatis
aaauguuuuuga

SEQ ID NO: 2489898 - RNA, 16 nt, Chlamydia trachomatis
aaauuaauguaauuuu

SEQ ID NO: 2489899 - RNA, 12 nt, Chlamydia trachomatis
aaauuacaauaa

SEQ ID NO: 2489900 - RNA, 20 nt, Chlamydia trachomatis
aaauuaguaauaaaggaaac

SEQ ID NO: 2489901 - RNA, 17 nt, Chlamydia trachomatis
aaauuaucuaaaaaaau

SEQ ID NO: 2489902 - RNA, 23 nt, Chlamydia trachomatis
aaauuccauguugucauagaucg

SEQ ID NO: 2489903 - RNA, 17 nt, Chlamydia trachomatis
aaauucgaggcuucuuc

SEQ ID NO: 2489904 - RNA, 23 nt, Chlamydia trachomatis
aaauucgcuaccaaaaauuuuuu

SEQ ID NO: 2489905 - RNA, 12 nt, Chlamydia trachomatis
aaauucuaaagu

SEQ ID NO: 2489906 - RNA, 16 nt, Chlamydia trachomatis
aaauucuaaaguaaga

SEQ ID NO: 2489907 - RNA, 18 nt, Chlamydia trachomatis
aaauucuacaacagcaaa

SEQ ID NO: 2489908 - RNA, 20 nt, Chlamydia trachomatis
aaauucuucaugcaauugau

SEQ ID NO: 2489909 - RNA, 23 nt, Chlamydia trachomatis
aaauucuucugauaaaugucccu

SEQ ID NO: 2489910 - RNA, 15 nt, Chlamydia trachomatis
aaauugagaacauaa

SEQ ID NO: 2489911 - RNA, 17 nt, Chlamydia trachomatis
aaauugauagugaaaua

SEQ ID NO: 2489912 - RNA, 15 nt, Chlamydia trachomatis
aaauugucgaauuuu

SEQ ID NO: 2489913 - RNA, 22 nt, Chlamydia trachomatis
aaauuucauacgcacagcauga

SEQ ID NO: 2489914 - RNA, 11 nt, Chlamydia trachomatis
aaauuucccuc

SEQ ID NO: 2489915 - RNA, 11 nt, Chlamydia trachomatis
aaauuucucua

SEQ ID NO: 2489916 - RNA, 22 nt, Chlamydia trachomatis
aaauuuggcaauggcaaaaucu

SEQ ID NO: 2489917 - RNA, 21 nt, Chlamydia trachomatis
aaauuuuacguaauucaugau

SEQ ID NO: 2489918 - RNA, 12 nt, Chlamydia trachomatis
aaauuuucacac

SEQ ID NO: 2489919 - RNA, 13 nt, Chlamydia trachomatis
aaauuuucaugaa

SEQ ID NO: 2489920 - RNA, 19 nt, Chlamydia trachomatis
aaauuuuucagaaaaagua

SEQ ID NO: 2489921 - RNA, 13 nt, Chlamydia trachomatis
aacaaaaacucuc

SEQ ID NO: 2489922 - RNA, 13 nt, Chlamydia trachomatis
aacaaaaccaaaa

SEQ ID NO: 2489923 - RNA, 15 nt, Chlamydia trachomatis
aacaaaaccaaaauc

SEQ ID NO: 2489924 - RNA, 21 nt, Chlamydia trachomatis
aacaaaacgaagccaaaagau

SEQ ID NO: 2489925 - RNA, 15 nt, Chlamydia trachomatis
aacaaacgcagauaa

SEQ ID NO: 2489926 - RNA, 19 nt, Chlamydia trachomatis
aacaaagcaucuuuaccau

SEQ ID NO: 2489927 - RNA, 20 nt, Chlamydia trachomatis
aacaaagcucuagcaauaga

SEQ ID NO: 2489928 - RNA, 22 nt, Chlamydia trachomatis
aacaaagcucuagcaauagaga

SEQ ID NO: 2489929 - RNA, 14 nt, Chlamydia trachomatis
aacaaauaacuuuu

SEQ ID NO: 2489930 - RNA, 15 nt, Chlamydia trachomatis
aacaaauaccaaaau

SEQ ID NO: 2489931 - RNA, 16 nt, Chlamydia trachomatis
aacaaauaccaaaaua

SEQ ID NO: 2489932 - RNA, 20 nt, Chlamydia trachomatis
aacaacacugacuauuccug

SEQ ID NO: 2489933 - RNA, 16 nt, Chlamydia trachomatis
aacaacaguucuucau

SEQ ID NO: 2489934 - RNA, 20 nt, Chlamydia trachomatis
aacaacucuccuaauucaac

SEQ ID NO: 2489935 - RNA, 15 nt, Chlamydia trachomatis
aacaacugcugauaa

SEQ ID NO: 2489936 - RNA, 23 nt, Chlamydia trachomatis
aacaacuucaauagcaggaacuu

SEQ ID NO: 2489937 - RNA, 13 nt, Chlamydia trachomatis
aacaacuucucuu

SEQ ID NO: 2489938 - RNA, 15 nt, Chlamydia trachomatis
aacaacuucucuugu

SEQ ID NO: 2489939 - RNA, 20 nt, Chlamydia trachomatis
aacaacuugaucuacagcaa

SEQ ID NO: 2489940 - RNA, 21 nt, Chlamydia trachomatis
aacaacuugaucuacagcaaa

SEQ ID NO: 2489941 - RNA, 19 nt, Chlamydia trachomatis
aacaagaacgcuuuccgaa

SEQ ID NO: 2489942 - RNA, 12 nt, Chlamydia trachomatis
aacaagaauaau

SEQ ID NO: 2489943 - RNA, 12 nt, Chlamydia trachomatis
aacaagagccaa

SEQ ID NO: 2489944 - RNA, 14 nt, Chlamydia trachomatis
aacaagcaaaacau

SEQ ID NO: 2489945 - RNA, 14 nt, Chlamydia trachomatis
aacaagccuuuaag

SEQ ID NO: 2489946 - RNA, 19 nt, Chlamydia trachomatis
aacaagccuuuaagguacu

SEQ ID NO: 2489947 - RNA, 16 nt, Chlamydia trachomatis
aacaagggaaugaaau

SEQ ID NO: 2489948 - RNA, 17 nt, Chlamydia trachomatis
aacaagguucuucaaca

SEQ ID NO: 2489949 - RNA, 13 nt, Chlamydia trachomatis
aacaagucucuga

SEQ ID NO: 2489950 - RNA, 22 nt, Chlamydia trachomatis
aacaaguuccuggauccaaaaa

SEQ ID NO: 2489951 - RNA, 14 nt, Chlamydia trachomatis
aacaauaaguuacu

SEQ ID NO: 2489952 - RNA, 21 nt, Chlamydia trachomatis
aacaauaauucaggcucuuuc

SEQ ID NO: 2489953 - RNA, 12 nt, Chlamydia trachomatis
aacaauauccuc

SEQ ID NO: 2489954 - RNA, 15 nt, Chlamydia trachomatis
aacaaucaaagcacc

SEQ ID NO: 2489955 - RNA, 22 nt, Chlamydia trachomatis
aacaaucacaggcugugaugga

SEQ ID NO: 2489956 - RNA, 20 nt, Chlamydia trachomatis
aacaauccccaaaccaguuu

SEQ ID NO: 2489957 - RNA, 15 nt, Chlamydia trachomatis
aacaaucuaaaaaau

SEQ ID NO: 2489958 - RNA, 18 nt, Chlamydia trachomatis
aacaaucuaaaaaauuag

SEQ ID NO: 2489959 - RNA, 18 nt, Chlamydia trachomatis
aacaaugcugauaaaaau

SEQ ID NO: 2489960 - RNA, 22 nt, Chlamydia trachomatis
aacaauugguuugauagcuuca

SEQ ID NO: 2489961 - RNA, 16 nt, Chlamydia trachomatis
aacaauuuccuuagaa

SEQ ID NO: 2489962 - RNA, 16 nt, Chlamydia trachomatis
aacaauuuuaaaaucu

SEQ ID NO: 2489963 - RNA, 12 nt, Chlamydia trachomatis
aacacaagcaga

SEQ ID NO: 2489964 - RNA, 17 nt, Chlamydia trachomatis
aacacaagcagacaagc

SEQ ID NO: 2489965 - RNA, 12 nt, Chlamydia trachomatis
aacacaauuuuu

SEQ ID NO: 2489966 - RNA, 14 nt, Chlamydia trachomatis
aacacaauuuuugu

SEQ ID NO: 2489967 - RNA, 14 nt, Chlamydia trachomatis
aacacauaucucca

SEQ ID NO: 2489968 - RNA, 12 nt, Chlamydia trachomatis
aacaccaaaaaa

SEQ ID NO: 2489969 - RNA, 14 nt, Chlamydia trachomatis
aacaccaaaaaauc

SEQ ID NO: 2489970 - RNA, 18 nt, Chlamydia trachomatis
aacacccucuuccuuccc

SEQ ID NO: 2489971 - RNA, 12 nt, Chlamydia trachomatis
aacacccuguaa

SEQ ID NO: 2489972 - RNA, 20 nt, Chlamydia trachomatis
aacaccguauguaagccuaa

SEQ ID NO: 2489973 - RNA, 22 nt, Chlamydia trachomatis
aacaccguauguaagccuaaaa

SEQ ID NO: 2489974 - RNA, 15 nt, Chlamydia trachomatis
aacaccucuccuuga

SEQ ID NO: 2489975 - RNA, 20 nt, Chlamydia trachomatis
aacacuacgcuacagaguua

SEQ ID NO: 2489976 - RNA, 23 nt, Chlamydia trachomatis
aacacuagagucagaagcuauuc

SEQ ID NO: 2489977 - RNA, 17 nt, Chlamydia trachomatis
aacacugacuauuccug

SEQ ID NO: 2489978 - RNA, 22 nt, Chlamydia trachomatis
aacacugacuauuccugaagga

SEQ ID NO: 2489979 - RNA, 19 nt, Chlamydia trachomatis
aacagacuaaguuguaaaa

SEQ ID NO: 2489980 - RNA, 22 nt, Chlamydia trachomatis
aacagacuaaguuguaaaacaa

SEQ ID NO: 2489981 - RNA, 13 nt, Chlamydia trachomatis
aacagagcuucau

SEQ ID NO: 2489982 - RNA, 14 nt, Chlamydia trachomatis
aacagauauaacaa

SEQ ID NO: 2489983 - RNA, 12 nt, Chlamydia trachomatis
aacagaugacuc

SEQ ID NO: 2489984 - RNA, 16 nt, Chlamydia trachomatis
aacagauugagaauaa

SEQ ID NO: 2489985 - RNA, 18 nt, Chlamydia trachomatis
aacagauugagaauaaau

SEQ ID NO: 2489986 - RNA, 16 nt, Chlamydia trachomatis
aacagcagaacucaac

SEQ ID NO: 2489987 - RNA, 17 nt, Chlamydia trachomatis
aacagcauuuacuccua

SEQ ID NO: 2489988 - RNA, 23 nt, Chlamydia trachomatis
aacagcucgccggaaaccuguuu

SEQ ID NO: 2489989 - RNA, 11 nt, Chlamydia trachomatis
aacagcucuag

SEQ ID NO: 2489990 - RNA, 14 nt, Chlamydia trachomatis
aacagcucuucuuc

SEQ ID NO: 2489991 - RNA, 22 nt, Chlamydia trachomatis
aacagcuucuucuucucuuucg

SEQ ID NO: 2489992 - RNA, 22 nt, Chlamydia trachomatis
aacagggauggucucacacaac

SEQ ID NO: 2489993 - RNA, 16 nt, Chlamydia trachomatis
aacaggggaccaaaaa

SEQ ID NO: 2489994 - RNA, 13 nt, Chlamydia trachomatis
aacaguagaaacu

SEQ ID NO: 2489995 - RNA, 22 nt, Chlamydia trachomatis
aacagucucuuauaaucuggau

SEQ ID NO: 2489996 - RNA, 20 nt, Chlamydia trachomatis
aacauaacaaggcuuuucca

SEQ ID NO: 2489997 - RNA, 21 nt, Chlamydia trachomatis
aacauaacaaggcuuuuccau

SEQ ID NO: 2489998 - RNA, 13 nt, Chlamydia trachomatis
aacauaacacaua

SEQ ID NO: 2489999 - RNA, 19 nt, Chlamydia trachomatis
aacauaagaggcaccucuu

SEQ ID NO: 2490000 - RNA, 14 nt, Chlamydia trachomatis
aacauaauaaauau

SEQ ID NO: 2490001 - RNA, 15 nt, Chlamydia trachomatis
aacauaauaaauauu

SEQ ID NO: 2490002 - RNA, 18 nt, Chlamydia trachomatis
aacauacaauuuagacuc

SEQ ID NO: 2490003 - RNA, 14 nt, Chlamydia trachomatis
aacauacacagaua

SEQ ID NO: 2490004 - RNA, 18 nt, Chlamydia trachomatis
aacauacacagauacuga

SEQ ID NO: 2490005 - RNA, 20 nt, Chlamydia trachomatis
aacauacaggucaagccuac

SEQ ID NO: 2490006 - RNA, 20 nt, Chlamydia trachomatis
aacauaccguagauccuuuc

SEQ ID NO: 2490007 - RNA, 19 nt, Chlamydia trachomatis
aacauaugaauccuugaac

SEQ ID NO: 2490008 - RNA, 12 nt, Chlamydia trachomatis
aacaucaaaauu

SEQ ID NO: 2490009 - RNA, 16 nt, Chlamydia trachomatis
aacaucaaaauucuau

SEQ ID NO: 2490010 - RNA, 13 nt, Chlamydia trachomatis
aacaucaaagauc

SEQ ID NO: 2490011 - RNA, 20 nt, Chlamydia trachomatis
aacaucuacacgcucaggcu

SEQ ID NO: 2490012 - RNA, 23 nt, Chlamydia trachomatis
aacaucugugucauaagcucuaa

SEQ ID NO: 2490013 - RNA, 14 nt, Chlamydia trachomatis
aacaucuuuagaau

SEQ ID NO: 2490014 - RNA, 16 nt, Chlamydia trachomatis
aacaugauuaauucua

SEQ ID NO: 2490015 - RNA, 20 nt, Chlamydia trachomatis
aacaugauucaaaauaaugu

SEQ ID NO: 2490016 - RNA, 21 nt, Chlamydia trachomatis
aacauuauuccgcuucuauuu

SEQ ID NO: 2490017 - RNA, 12 nt, Chlamydia trachomatis
aacauuccaaau

SEQ ID NO: 2490018 - RNA, 21 nt, Chlamydia trachomatis
aacauuccugccaaaaaccag

SEQ ID NO: 2490019 - RNA, 14 nt, Chlamydia trachomatis
aacauuucugcaac

SEQ ID NO: 2490020 - RNA, 17 nt, Chlamydia trachomatis
aaccaaaaaaaggcucu

SEQ ID NO: 2490021 - RNA, 14 nt, Chlamydia trachomatis
aaccaaaaccacac

SEQ ID NO: 2490022 - RNA, 20 nt, Chlamydia trachomatis
aaccaaaauaucuacuucuu

SEQ ID NO: 2490023 - RNA, 12 nt, Chlamydia trachomatis
aaccaaaccaga

SEQ ID NO: 2490024 - RNA, 16 nt, Chlamydia trachomatis
aaccaaaggcaacaaa

SEQ ID NO: 2490025 - RNA, 20 nt, Chlamydia trachomatis
aaccaaaugaccuuucccuc

SEQ ID NO: 2490026 - RNA, 21 nt, Chlamydia trachomatis
aaccaacgagugccgaauaau

SEQ ID NO: 2490027 - RNA, 13 nt, Chlamydia trachomatis
aaccaacucucug

SEQ ID NO: 2490028 - RNA, 19 nt, Chlamydia trachomatis
aaccaauuguugagcagca

SEQ ID NO: 2490029 - RNA, 20 nt, Chlamydia trachomatis
aaccaauuguugagcagcaa

SEQ ID NO: 2490030 - RNA, 21 nt, Chlamydia trachomatis
aaccacagacucagguuaucc

SEQ ID NO: 2490031 - RNA, 14 nt, Chlamydia trachomatis
aaccacccuuccca

SEQ ID NO: 2490032 - RNA, 21 nt, Chlamydia trachomatis
aaccaccuguugcuuuucgaa

SEQ ID NO: 2490033 - RNA, 19 nt, Chlamydia trachomatis
aaccacuguauccaaaaca

SEQ ID NO: 2490034 - RNA, 19 nt, Chlamydia trachomatis
aaccagaauauaagcaccc

SEQ ID NO: 2490035 - RNA, 14 nt, Chlamydia trachomatis
aaccagcgcauuaa

SEQ ID NO: 2490036 - RNA, 15 nt, Chlamydia trachomatis
aaccagcggcaaaaa

SEQ ID NO: 2490037 - RNA, 15 nt, Chlamydia trachomatis
aaccauccuucugau

SEQ ID NO: 2490038 - RNA, 19 nt, Chlamydia trachomatis
aaccaucuguaaagcuucg

SEQ ID NO: 2490039 - RNA, 19 nt, Chlamydia trachomatis
aacccaagcguauuugcau

SEQ ID NO: 2490040 - RNA, 22 nt, Chlamydia trachomatis
aacccaaggcgguaccugcuuc

SEQ ID NO: 2490041 - RNA, 13 nt, Chlamydia trachomatis
aaccccucagguu

SEQ ID NO: 2490042 - RNA, 20 nt, Chlamydia trachomatis
aacccucgcagagaaagagc

SEQ ID NO: 2490043 - RNA, 18 nt, Chlamydia trachomatis
aacccucuucucucaugu

SEQ ID NO: 2490044 - RNA, 18 nt, Chlamydia trachomatis
aacccuggaugcacaucc

SEQ ID NO: 2490045 - RNA, 16 nt, Chlamydia trachomatis
aacccuucaggaaagc

SEQ ID NO: 2490046 - RNA, 16 nt, Chlamydia trachomatis
aaccgaauuuguagau

SEQ ID NO: 2490047 - RNA, 19 nt, Chlamydia trachomatis
aaccgcaagucucugccac

SEQ ID NO: 2490048 - RNA, 21 nt, Chlamydia trachomatis
aaccgcaagucucugccaccu

SEQ ID NO: 2490049 - RNA, 15 nt, Chlamydia trachomatis
aaccgcgacagccac

SEQ ID NO: 2490050 - RNA, 16 nt, Chlamydia trachomatis
aaccgcgacagccaca

SEQ ID NO: 2490051 - RNA, 22 nt, Chlamydia trachomatis
aaccggagauacggcuaacucc

SEQ ID NO: 2490052 - RNA, 22 nt, Chlamydia trachomatis
aaccuaagggccgaacuaauau

SEQ ID NO: 2490053 - RNA, 21 nt, Chlamydia trachomatis
aaccuaaguagcaaauuaaca

SEQ ID NO: 2490054 - RNA, 18 nt, Chlamydia trachomatis
aaccuacaugccgcgaag

SEQ ID NO: 2490055 - RNA, 20 nt, Chlamydia trachomatis
aaccuacaugccgcgaagca

SEQ ID NO: 2490056 - RNA, 15 nt, Chlamydia trachomatis
aaccuccauaagaaa

SEQ ID NO: 2490057 - RNA, 14 nt, Chlamydia trachomatis
aaccucuauagcca

SEQ ID NO: 2490058 - RNA, 12 nt, Chlamydia trachomatis
aaccucugcaag

SEQ ID NO: 2490059 - RNA, 23 nt, Chlamydia trachomatis
aaccucugcaagaaaauaaguua

SEQ ID NO: 2490060 - RNA, 15 nt, Chlamydia trachomatis
aaccuguuucugaau

SEQ ID NO: 2490061 - RNA, 19 nt, Chlamydia trachomatis
aaccuugggaaucuucuuc

SEQ ID NO: 2490062 - RNA, 19 nt, Chlamydia trachomatis
aaccuuuaccaaagaauuc

SEQ ID NO: 2490063 - RNA, 16 nt, Chlamydia trachomatis
aaccuuugacucauca

SEQ ID NO: 2490064 - RNA, 15 nt, Chlamydia trachomatis
aaccuuugcauuuaa

SEQ ID NO: 2490065 - RNA, 19 nt, Chlamydia trachomatis
aaccuuugcauuuaaauga

SEQ ID NO: 2490066 - RNA, 16 nt, Chlamydia trachomatis
aacgaaaaacagaaag

SEQ ID NO: 2490067 - RNA, 17 nt, Chlamydia trachomatis
aacgaaaaacagaaaga

SEQ ID NO: 2490068 - RNA, 19 nt, Chlamydia trachomatis
aacgaaagcauccccaaaa

SEQ ID NO: 2490069 - RNA, 21 nt, Chlamydia trachomatis
aacgaagcaaaacgcccucca

SEQ ID NO: 2490070 - RNA, 24 nt, Chlamydia trachomatis
aacgaagccuguuuugcuaugaaa

SEQ ID NO: 2490071 - RNA, 20 nt, Chlamydia trachomatis
aacgaaguuagcauguucag

SEQ ID NO: 2490072 - RNA, 23 nt, Chlamydia trachomatis
aacgaaguuagcauguucagaau

SEQ ID NO: 2490073 - RNA, 13 nt, Chlamydia trachomatis
aacgagaaaaagg

SEQ ID NO: 2490074 - RNA, 17 nt, Chlamydia trachomatis
aacgaguugaucuuccu

SEQ ID NO: 2490075 - RNA, 19 nt, Chlamydia trachomatis
aacgauagcuaaucuuuuu

SEQ ID NO: 2490076 - RNA, 17 nt, Chlamydia trachomatis
aacgauauaaagaagac

SEQ ID NO: 2490077 - RNA, 19 nt, Chlamydia trachomatis
aacgauauaaagaagacuu

SEQ ID NO: 2490078 - RNA, 21 nt, Chlamydia trachomatis
aacgaucugcgaugccaaaga

SEQ ID NO: 2490079 - RNA, 23 nt, Chlamydia trachomatis
aacgauguucacacuuucuucca

SEQ ID NO: 2490080 - RNA, 16 nt, Chlamydia trachomatis
aacgauucaauccaga

SEQ ID NO: 2490081 - RNA, 22 nt, Chlamydia trachomatis
aacgcaauguuuuacaaagugg

SEQ ID NO: 2490082 - RNA, 15 nt, Chlamydia trachomatis
aacgcauuacauaua

SEQ ID NO: 2490083 - RNA, 17 nt, Chlamydia trachomatis
aacgcauuccaaucauu

SEQ ID NO: 2490084 - RNA, 22 nt, Chlamydia trachomatis
aacgccuguuuucuuguagaaa

SEQ ID NO: 2490085 - RNA, 14 nt, Chlamydia trachomatis
aacggauuucuuua

SEQ ID NO: 2490086 - RNA, 16 nt, Chlamydia trachomatis
aacggcauucccauuu

SEQ ID NO: 2490087 - RNA, 14 nt, Chlamydia trachomatis
aacgggaacaaaac

SEQ ID NO: 2490088 - RNA, 15 nt, Chlamydia trachomatis
aacgggagcgggaga

SEQ ID NO: 2490089 - RNA, 21 nt, Chlamydia trachomatis
aacggugagaaaaagaagaac

SEQ ID NO: 2490090 - RNA, 16 nt, Chlamydia trachomatis
aacgguggaacagcuc

SEQ ID NO: 2490091 - RNA, 16 nt, Chlamydia trachomatis
aacgguguuagaaaau

SEQ ID NO: 2490092 - RNA, 24 nt, Chlamydia trachomatis
aacguacuuuaggagaaagaauga

SEQ ID NO: 2490093 - RNA, 18 nt, Chlamydia trachomatis
aacguccgcuccuucuuu

SEQ ID NO: 2490094 - RNA, 19 nt, Chlamydia trachomatis
aacguccgcuccuucuuuc

SEQ ID NO: 2490095 - RNA, 15 nt, Chlamydia trachomatis
aacgucgaaaagcuu

SEQ ID NO: 2490096 - RNA, 16 nt, Chlamydia trachomatis
aacgucgaaaagcuuc

SEQ ID NO: 2490097 - RNA, 17 nt, Chlamydia trachomatis
aacgucgaaaagcuucu

SEQ ID NO: 2490098 - RNA, 12 nt, Chlamydia trachomatis
aacgucuccccc

SEQ ID NO: 2490099 - RNA, 15 nt, Chlamydia trachomatis
aacguuccuccucca

SEQ ID NO: 2490100 - RNA, 14 nt, Chlamydia trachomatis
aacguuuaaugaau

SEQ ID NO: 2490101 - RNA, 11 nt, Chlamydia trachomatis
aacuaaacucc

SEQ ID NO: 2490102 - RNA, 19 nt, Chlamydia trachomatis
aacuaagcuucucaacacu

SEQ ID NO: 2490103 - RNA, 15 nt, Chlamydia trachomatis
aacuacagaaagagu

SEQ ID NO: 2490104 - RNA, 15 nt, Chlamydia trachomatis
aacuacggaaaaaga

SEQ ID NO: 2490105 - RNA, 16 nt, Chlamydia trachomatis
aacuacucccaaauca

SEQ ID NO: 2490106 - RNA, 18 nt, Chlamydia trachomatis
aacuacucccaaaucaaa

SEQ ID NO: 2490107 - RNA, 16 nt, Chlamydia trachomatis
aacuagaagggaacag

SEQ ID NO: 2490108 - RNA, 18 nt, Chlamydia trachomatis
aacuagagaucccgaaua

SEQ ID NO: 2490109 - RNA, 23 nt, Chlamydia trachomatis
aacuaucccuacugaaguagcua

SEQ ID NO: 2490110 - RNA, 17 nt, Chlamydia trachomatis
aacuauccguuguagac

SEQ ID NO: 2490111 - RNA, 17 nt, Chlamydia trachomatis
aacucaaaauaaagaaa

SEQ ID NO: 2490112 - RNA, 15 nt, Chlamydia trachomatis
aacucaacgaaagca

SEQ ID NO: 2490113 - RNA, 14 nt, Chlamydia trachomatis
aacuccaagcacuu

SEQ ID NO: 2490114 - RNA, 17 nt, Chlamydia trachomatis
aacucccucauuaagaa

SEQ ID NO: 2490115 - RNA, 18 nt, Chlamydia trachomatis
aacucccucauuaagaau

SEQ ID NO: 2490116 - RNA, 14 nt, Chlamydia trachomatis
aacucccuccaaaa

SEQ ID NO: 2490117 - RNA, 16 nt, Chlamydia trachomatis
aacucccuccaaaaaa

SEQ ID NO: 2490118 - RNA, 18 nt, Chlamydia trachomatis
aacucgauccaucauaga

SEQ ID NO: 2490119 - RNA, 16 nt, Chlamydia trachomatis
aacucgcguauuuuug

SEQ ID NO: 2490120 - RNA, 21 nt, Chlamydia trachomatis
aacucucaaaucguucuacca

SEQ ID NO: 2490121 - RNA, 15 nt, Chlamydia trachomatis
aacucuccaaacucu

SEQ ID NO: 2490122 - RNA, 14 nt, Chlamydia trachomatis
aacucuccuuuaaa

SEQ ID NO: 2490123 - RNA, 11 nt, Chlamydia trachomatis
aacucucuguu

SEQ ID NO: 2490124 - RNA, 18 nt, Chlamydia trachomatis
aacucugcggcuccuucu

SEQ ID NO: 2490125 - RNA, 19 nt, Chlamydia trachomatis
aacucuuauaacauuauuc

SEQ ID NO: 2490126 - RNA, 18 nt, Chlamydia trachomatis
aacucuugccaguaaaga

SEQ ID NO: 2490127 - RNA, 19 nt, Chlamydia trachomatis
aacucuuuauuaaacuccc

SEQ ID NO: 2490128 - RNA, 23 nt, Chlamydia trachomatis
aacucuuuccuccucccuuucca

SEQ ID NO: 2490129 - RNA, 15 nt, Chlamydia trachomatis
aacucuuuuucagac

SEQ ID NO: 2490130 - RNA, 22 nt, Chlamydia trachomatis
aacugagccaagaacaaagcau

SEQ ID NO: 2490131 - RNA, 14 nt, Chlamydia trachomatis
aacugcagcaucua

SEQ ID NO: 2490132 - RNA, 15 nt, Chlamydia trachomatis
aacugcucaaggaaa

SEQ ID NO: 2490133 - RNA, 14 nt, Chlamydia trachomatis
aacugcucugccau

SEQ ID NO: 2490134 - RNA, 14 nt, Chlamydia trachomatis
aacugcucuucuaa

SEQ ID NO: 2490135 - RNA, 15 nt, Chlamydia trachomatis
aacugcucuucuaac

SEQ ID NO: 2490136 - RNA, 13 nt, Chlamydia trachomatis
aacugcuuuccuu

SEQ ID NO: 2490137 - RNA, 23 nt, Chlamydia trachomatis
aacugcuuuccuuaguuuuaauu

SEQ ID NO: 2490138 - RNA, 18 nt, Chlamydia trachomatis
aacuggaguuuuccugaa

SEQ ID NO: 2490139 - RNA, 22 nt, Chlamydia trachomatis
aacugguguggguaagaauaaa

SEQ ID NO: 2490140 - RNA, 22 nt, Chlamydia trachomatis
aacuguacacagggugccaaua

SEQ ID NO: 2490141 - RNA, 19 nt, Chlamydia trachomatis
aacuguaucggcagcuccu

SEQ ID NO: 2490142 - RNA, 21 nt, Chlamydia trachomatis
aacugucuauuggacucagaa

SEQ ID NO: 2490143 - RNA, 14 nt, Chlamydia trachomatis
aacugugaagaaug

SEQ ID NO: 2490144 - RNA, 14 nt, Chlamydia trachomatis
aacuuacuuuucuu

SEQ ID NO: 2490145 - RNA, 16 nt, Chlamydia trachomatis
aacuuacuuuucuuag

SEQ ID NO: 2490146 - RNA, 12 nt, Chlamydia trachomatis
aacuuaucuguu

SEQ ID NO: 2490147 - RNA, 15 nt, Chlamydia trachomatis
aacuuauuggugagu

SEQ ID NO: 2490148 - RNA, 17 nt, Chlamydia trachomatis
aacuucaauagcaggaa

SEQ ID NO: 2490149 - RNA, 16 nt, Chlamydia trachomatis
aacuucaguuuguuca

SEQ ID NO: 2490150 - RNA, 18 nt, Chlamydia trachomatis
aacuucugcuaaaaaugc

SEQ ID NO: 2490151 - RNA, 19 nt, Chlamydia trachomatis
aacuucugcuaaaaaugcu

SEQ ID NO: 2490152 - RNA, 21 nt, Chlamydia trachomatis
aacuucugcuaaaaaugcuug

SEQ ID NO: 2490153 - RNA, 20 nt, Chlamydia trachomatis
aacuucuggagauugaauaa

SEQ ID NO: 2490154 - RNA, 15 nt, Chlamydia trachomatis
aacuucuuccaaaua

SEQ ID NO: 2490155 - RNA, 22 nt, Chlamydia trachomatis
aacuucuucuaaguauucuucu

SEQ ID NO: 2490156 - RNA, 15 nt, Chlamydia trachomatis
aacuugcguuuucuu

SEQ ID NO: 2490157 - RNA, 14 nt, Chlamydia trachomatis
aacuuuaauagcca

SEQ ID NO: 2490158 - RNA, 15 nt, Chlamydia trachomatis
aacuuuaauagccac

SEQ ID NO: 2490159 - RNA, 13 nt, Chlamydia trachomatis
aacuuuagaagac

SEQ ID NO: 2490160 - RNA, 17 nt, Chlamydia trachomatis
aacuuuauuauugaaaa

SEQ ID NO: 2490161 - RNA, 15 nt, Chlamydia trachomatis
aacuuugaacaaauu

SEQ ID NO: 2490162 - RNA, 16 nt, Chlamydia trachomatis
aacuuuguuauuuuuu

SEQ ID NO: 2490163 - RNA, 16 nt, Chlamydia trachomatis
aacuuuuuguagguaa

SEQ ID NO: 2490164 - RNA, 17 nt, Chlamydia trachomatis
aagaaaaaucuccuccg

SEQ ID NO: 2490165 - RNA, 18 nt, Chlamydia trachomatis
aagaaaacagccaagcaa

SEQ ID NO: 2490166 - RNA, 20 nt, Chlamydia trachomatis
aagaaaacagccaagcaaga

SEQ ID NO: 2490167 - RNA, 14 nt, Chlamydia trachomatis
aagaaaacuuuacu

SEQ ID NO: 2490168 - RNA, 17 nt, Chlamydia trachomatis
aagaaaagagcuuuucu

SEQ ID NO: 2490169 - RNA, 22 nt, Chlamydia trachomatis
aagaaaagagcuuuucuucccu

SEQ ID NO: 2490170 - RNA, 17 nt, Chlamydia trachomatis
aagaaaagauaguuuag

SEQ ID NO: 2490171 - RNA, 15 nt, Chlamydia trachomatis
aagaaaauaaacaca

SEQ ID NO: 2490172 - RNA, 22 nt, Chlamydia trachomatis
aagaaaauagguaaagaaguuu

SEQ ID NO: 2490173 - RNA, 13 nt, Chlamydia trachomatis
aagaaaaucagaa

SEQ ID NO: 2490174 - RNA, 22 nt, Chlamydia trachomatis
aagaaacuguaauguccucuuu

SEQ ID NO: 2490175 - RNA, 22 nt, Chlamydia trachomatis
aagaaagaagggaaacauuccc

SEQ ID NO: 2490176 - RNA, 17 nt, Chlamydia trachomatis
aagaaagcccuauuucc

SEQ ID NO: 2490177 - RNA, 20 nt, Chlamydia trachomatis
aagaaagccguucccaauaa

SEQ ID NO: 2490178 - RNA, 14 nt, Chlamydia trachomatis
aagaaagccuucuc

SEQ ID NO: 2490179 - RNA, 16 nt, Chlamydia trachomatis
aagaaagcuuauaacu

SEQ ID NO: 2490180 - RNA, 20 nt, Chlamydia trachomatis
aagaaagcuuauaacuaaga

SEQ ID NO: 2490181 - RNA, 23 nt, Chlamydia trachomatis
aagaaaggccuauccaaggaaac

SEQ ID NO: 2490182 - RNA, 22 nt, Chlamydia trachomatis
aagaaauaaaaagcccuuuccu

SEQ ID NO: 2490183 - RNA, 12 nt, Chlamydia trachomatis
aagaaauaaccu

SEQ ID NO: 2490184 - RNA, 19 nt, Chlamydia trachomatis
aagaaauccccagucucuc

SEQ ID NO: 2490185 - RNA, 21 nt, Chlamydia trachomatis
aagaaauccccagucucucca

SEQ ID NO: 2490186 - RNA, 23 nt, Chlamydia trachomatis
aagaaauugucgaauuuuucugc

SEQ ID NO: 2490187 - RNA, 13 nt, Chlamydia trachomatis
aagaacaaagaau

SEQ ID NO: 2490188 - RNA, 22 nt, Chlamydia trachomatis
aagaacaaagaauggaucuccc

SEQ ID NO: 2490189 - RNA, 13 nt, Chlamydia trachomatis
aagaacaaagcau

SEQ ID NO: 2490190 - RNA, 14 nt, Chlamydia trachomatis
aagaacagauugag

SEQ ID NO: 2490191 - RNA, 16 nt, Chlamydia trachomatis
aagaacauauuaggag

SEQ ID NO: 2490192 - RNA, 22 nt, Chlamydia trachomatis
aagaacauauuaggagcaagaa

SEQ ID NO: 2490193 - RNA, 21 nt, Chlamydia trachomatis
aagaaccacaaaaucagcaaa

SEQ ID NO: 2490194 - RNA, 23 nt, Chlamydia trachomatis
aagaacccuuuguacggagcgau

SEQ ID NO: 2490195 - RNA, 17 nt, Chlamydia trachomatis
aagaaccucaauagcug

SEQ ID NO: 2490196 - RNA, 20 nt, Chlamydia trachomatis
aagaaccuccauaagaaauu

SEQ ID NO: 2490197 - RNA, 16 nt, Chlamydia trachomatis
aagaaccuccuuuaua

SEQ ID NO: 2490198 - RNA, 17 nt, Chlamydia trachomatis
aagaacucaaaagcuuu

SEQ ID NO: 2490199 - RNA, 20 nt, Chlamydia trachomatis
aagaacucccuccaaaaaag

SEQ ID NO: 2490200 - RNA, 21 nt, Chlamydia trachomatis
aagaacucccuccaaaaaaga

SEQ ID NO: 2490201 - RNA, 11 nt, Chlamydia trachomatis
aagaacugcag

SEQ ID NO: 2490202 - RNA, 21 nt, Chlamydia trachomatis
aagaacugucuucuuucaaag

SEQ ID NO: 2490203 - RNA, 23 nt, Chlamydia trachomatis
aagaacugucuucuuucaaagaa

SEQ ID NO: 2490204 - RNA, 20 nt, Chlamydia trachomatis
aagaacuucauugacuguag

SEQ ID NO: 2490205 - RNA, 19 nt, Chlamydia trachomatis
aagaagaacgccugaucaa

SEQ ID NO: 2490206 - RNA, 15 nt, Chlamydia trachomatis
aagaagaacugcagu

SEQ ID NO: 2490207 - RNA, 12 nt, Chlamydia trachomatis
aagaagaagaga

SEQ ID NO: 2490208 - RNA, 13 nt, Chlamydia trachomatis
aagaagaagagag

SEQ ID NO: 2490209 - RNA, 13 nt, Chlamydia trachomatis
aagaagaggagga

SEQ ID NO: 2490210 - RNA, 19 nt, Chlamydia trachomatis
aagaagaucuguaacuaca

SEQ ID NO: 2490211 - RNA, 22 nt, Chlamydia trachomatis
aagaagauuuuuagaaggaaag

SEQ ID NO: 2490212 - RNA, 14 nt, Chlamydia trachomatis
aagaagccuucuuc

SEQ ID NO: 2490213 - RNA, 17 nt, Chlamydia trachomatis
aagaagcgaagcauucu

SEQ ID NO: 2490214 - RNA, 23 nt, Chlamydia trachomatis
aagaagcgaagcauucucucaua

SEQ ID NO: 2490215 - RNA, 24 nt, Chlamydia trachomatis
aagaagcuccuuuaccuuucacua

SEQ ID NO: 2490216 - RNA, 15 nt, Chlamydia trachomatis
aagaagcugcaguuu

SEQ ID NO: 2490217 - RNA, 23 nt, Chlamydia trachomatis
aagaagcugcaguuucugagaaa

SEQ ID NO: 2490218 - RNA, 22 nt, Chlamydia trachomatis
aagaaggcuuuucuauuuuuag

SEQ ID NO: 2490219 - RNA, 12 nt, Chlamydia trachomatis
aagaagggagug

SEQ ID NO: 2490220 - RNA, 16 nt, Chlamydia trachomatis
aagaagguugaauuuc

SEQ ID NO: 2490221 - RNA, 13 nt, Chlamydia trachomatis
aagaaguuuaaaa

SEQ ID NO: 2490222 - RNA, 21 nt, Chlamydia trachomatis
aagaaguuuacgaacaagaug

SEQ ID NO: 2490223 - RNA, 15 nt, Chlamydia trachomatis
aagaaguuuuuuguc

SEQ ID NO: 2490224 - RNA, 22 nt, Chlamydia trachomatis
aagaaguuuuuugucuuuagca

SEQ ID NO: 2490225 - RNA, 14 nt, Chlamydia trachomatis
aagaauaaacaaca

SEQ ID NO: 2490226 - RNA, 15 nt, Chlamydia trachomatis
aagaauaaacaacau

SEQ ID NO: 2490227 - RNA, 15 nt, Chlamydia trachomatis
aagaauaaagaugaa

SEQ ID NO: 2490228 - RNA, 12 nt, Chlamydia trachomatis
aagaauacaaag

SEQ ID NO: 2490229 - RNA, 15 nt, Chlamydia trachomatis
aagaauacaagaaag

SEQ ID NO: 2490230 - RNA, 17 nt, Chlamydia trachomatis
aagaauacaagaaaggc

SEQ ID NO: 2490231 - RNA, 23 nt, Chlamydia trachomatis
aagaauaucaucuucaagagcug

SEQ ID NO: 2490232 - RNA, 14 nt, Chlamydia trachomatis
aagaaucaaaaagu

SEQ ID NO: 2490233 - RNA, 20 nt, Chlamydia trachomatis
aagaaucaaaggaugucuau

SEQ ID NO: 2490234 - RNA, 17 nt, Chlamydia trachomatis
aagaaucuaaaaagcca

SEQ ID NO: 2490235 - RNA, 20 nt, Chlamydia trachomatis
aagaaugaaacuuggucagc

SEQ ID NO: 2490236 - RNA, 22 nt, Chlamydia trachomatis
aagaaugaaacuuggucagcuc

SEQ ID NO: 2490237 - RNA, 15 nt, Chlamydia trachomatis
aagaaugaccaguuu

SEQ ID NO: 2490238 - RNA, 20 nt, Chlamydia trachomatis
aagaaugagguaaugcccac

SEQ ID NO: 2490239 - RNA, 17 nt, Chlamydia trachomatis
aagaaugcgguaauaga

SEQ ID NO: 2490240 - RNA, 13 nt, Chlamydia trachomatis
aagaaugcuugau

SEQ ID NO: 2490241 - RNA, 21 nt, Chlamydia trachomatis
aagaauguggguguagguuuu

SEQ ID NO: 2490242 - RNA, 13 nt, Chlamydia trachomatis
aagaauucuugcu

SEQ ID NO: 2490243 - RNA, 14 nt, Chlamydia trachomatis
aagaauucuugcua

SEQ ID NO: 2490244 - RNA, 23 nt, Chlamydia trachomatis
aagacauggcucuacauucagaa

SEQ ID NO: 2490245 - RNA, 20 nt, Chlamydia trachomatis
aagaccaaaaaugaacauau

SEQ ID NO: 2490246 - RNA, 13 nt, Chlamydia trachomatis
aagaccucuucaa

SEQ ID NO: 2490247 - RNA, 19 nt, Chlamydia trachomatis
aagacgauucucaugcacu

SEQ ID NO: 2490248 - RNA, 14 nt, Chlamydia trachomatis
aagacguucuugcu

SEQ ID NO: 2490249 - RNA, 19 nt, Chlamydia trachomatis
aagacucaaauuuucauga

SEQ ID NO: 2490250 - RNA, 23 nt, Chlamydia trachomatis
aagacucacagcaaauaaagagg

SEQ ID NO: 2490251 - RNA, 12 nt, Chlamydia trachomatis
aagacucuuuca

SEQ ID NO: 2490252 - RNA, 22 nt, Chlamydia trachomatis
aagacuuguucugcugcucgaa

SEQ ID NO: 2490253 - RNA, 17 nt, Chlamydia trachomatis
aagacuuugugcaaccu

SEQ ID NO: 2490254 - RNA, 15 nt, Chlamydia trachomatis
aagagaaaaauugca

SEQ ID NO: 2490255 - RNA, 19 nt, Chlamydia trachomatis
aagagaaaaauugcaaaga

SEQ ID NO: 2490256 - RNA, 17 nt, Chlamydia trachomatis
aagagaaaccaacgagu

SEQ ID NO: 2490257 - RNA, 16 nt, Chlamydia trachomatis
aagagaaggccuuuuu

SEQ ID NO: 2490258 - RNA, 20 nt, Chlamydia trachomatis
aagagaaucaucggcuugcc

SEQ ID NO: 2490259 - RNA, 19 nt, Chlamydia trachomatis
aagagagacacuauuaaaa

SEQ ID NO: 2490260 - RNA, 13 nt, Chlamydia trachomatis
aagagagaucuau

SEQ ID NO: 2490261 - RNA, 16 nt, Chlamydia trachomatis
aagagagcaacgagca

SEQ ID NO: 2490262 - RNA, 20 nt, Chlamydia trachomatis
aagagagcuuugaucuuugu

SEQ ID NO: 2490263 - RNA, 17 nt, Chlamydia trachomatis
aagagaucguacaauga

SEQ ID NO: 2490264 - RNA, 21 nt, Chlamydia trachomatis
aagagaucguacaaugaccga

SEQ ID NO: 2490265 - RNA, 12 nt, Chlamydia trachomatis
aagagauguuug

SEQ ID NO: 2490266 - RNA, 23 nt, Chlamydia trachomatis
aagagauguuuguguuucuaaaa

SEQ ID NO: 2490267 - RNA, 17 nt, Chlamydia trachomatis
aagagauuuuuugagca

SEQ ID NO: 2490268 - RNA, 18 nt, Chlamydia trachomatis
aagagcagagcuuuuacu

SEQ ID NO: 2490269 - RNA, 22 nt, Chlamydia trachomatis
aagagcaugaccucagauuuau

SEQ ID NO: 2490270 - RNA, 23 nt, Chlamydia trachomatis
aagagccguucucucuaaaauca

SEQ ID NO: 2490271 - RNA, 18 nt, Chlamydia trachomatis
aagagcuaaacuucuugu

SEQ ID NO: 2490272 - RNA, 21 nt, Chlamydia trachomatis
aagagcuguauugaccuccaa

SEQ ID NO: 2490273 - RNA, 21 nt, Chlamydia trachomatis
aagagcuuugcacaccugcuu

SEQ ID NO: 2490274 - RNA, 13 nt, Chlamydia trachomatis
aagagcuuuucuu

SEQ ID NO: 2490275 - RNA, 23 nt, Chlamydia trachomatis
aagaggacuuucuuuaagcaaca

SEQ ID NO: 2490276 - RNA, 15 nt, Chlamydia trachomatis
aagaggcaaaaaucu

SEQ ID NO: 2490277 - RNA, 16 nt, Chlamydia trachomatis
aagaggcaccucuuuu

SEQ ID NO: 2490278 - RNA, 20 nt, Chlamydia trachomatis
aagaggcuucgauaagaaaa

SEQ ID NO: 2490279 - RNA, 17 nt, Chlamydia trachomatis
aagaggguuuggaugga

SEQ ID NO: 2490280 - RNA, 22 nt, Chlamydia trachomatis
aagaggucuuauuaaaagaccu

SEQ ID NO: 2490281 - RNA, 16 nt, Chlamydia trachomatis
aagaguagggagcaaa

SEQ ID NO: 2490282 - RNA, 14 nt, Chlamydia trachomatis
aagagugugcuucu

SEQ ID NO: 2490283 - RNA, 18 nt, Chlamydia trachomatis
aagaguucuccucccaga

SEQ ID NO: 2490284 - RNA, 14 nt, Chlamydia trachomatis
aagauaacaauccu

SEQ ID NO: 2490285 - RNA, 21 nt, Chlamydia trachomatis
aagauaacaauccuagacgau

SEQ ID NO: 2490286 - RNA, 15 nt, Chlamydia trachomatis
aagauaagcagcaau

SEQ ID NO: 2490287 - RNA, 13 nt, Chlamydia trachomatis
aagauaaucaaac

SEQ ID NO: 2490288 - RNA, 22 nt, Chlamydia trachomatis
aagauaauggcaaaaauaccaa

SEQ ID NO: 2490289 - RNA, 17 nt, Chlamydia trachomatis
aagauagauaggcagga

SEQ ID NO: 2490290 - RNA, 17 nt, Chlamydia trachomatis
aagauaguagagaauua

SEQ ID NO: 2490291 - RNA, 19 nt, Chlamydia trachomatis
aagauagugcagaagauaa

SEQ ID NO: 2490292 - RNA, 12 nt, Chlamydia trachomatis
aagauauucaug

SEQ ID NO: 2490293 - RNA, 14 nt, Chlamydia trachomatis
aagauauucccuaa

SEQ ID NO: 2490294 - RNA, 18 nt, Chlamydia trachomatis
aagaucaaggauccagga

SEQ ID NO: 2490295 - RNA, 15 nt, Chlamydia trachomatis
aagaucaugggaaau

SEQ ID NO: 2490296 - RNA, 18 nt, Chlamydia trachomatis
aagaucaugggaaauaaa

SEQ ID NO: 2490297 - RNA, 11 nt, Chlamydia trachomatis
aagauccaucu

SEQ ID NO: 2490298 - RNA, 14 nt, Chlamydia trachomatis
aagauccauuugau

SEQ ID NO: 2490299 - RNA, 13 nt, Chlamydia trachomatis
aagaucucuuucu

SEQ ID NO: 2490300 - RNA, 16 nt, Chlamydia trachomatis
aagaucucuuucucua

SEQ ID NO: 2490301 - RNA, 23 nt, Chlamydia trachomatis
aagaucucuuucucuagaauuuc

SEQ ID NO: 2490302 - RNA, 22 nt, Chlamydia trachomatis
aagaucuguaacuacaucuaaa

SEQ ID NO: 2490303 - RNA, 14 nt, Chlamydia trachomatis
aagaucuucagaaa

SEQ ID NO: 2490304 - RNA, 21 nt, Chlamydia trachomatis
aagaucuuccggaaggauguu

SEQ ID NO: 2490305 - RNA, 20 nt, Chlamydia trachomatis
aagaucuuuacuuucuuugc

SEQ ID NO: 2490306 - RNA, 16 nt, Chlamydia trachomatis
aagaucuuuccuugug

SEQ ID NO: 2490307 - RNA, 12 nt, Chlamydia trachomatis
aagaugaagaag

SEQ ID NO: 2490308 - RNA, 23 nt, Chlamydia trachomatis
aagaugacuugcccgacaguaua

SEQ ID NO: 2490309 - RNA, 20 nt, Chlamydia trachomatis
aagaugccgaacucuccucu

SEQ ID NO: 2490310 - RNA, 17 nt, Chlamydia trachomatis
aagaugcgaucuccuca

SEQ ID NO: 2490311 - RNA, 18 nt, Chlamydia trachomatis
aagaugcuccuacaaaau

SEQ ID NO: 2490312 - RNA, 21 nt, Chlamydia trachomatis
aagauggacuggaguuagccg

SEQ ID NO: 2490313 - RNA, 18 nt, Chlamydia trachomatis
aagaugggcauaacgagu

SEQ ID NO: 2490314 - RNA, 18 nt, Chlamydia trachomatis
aagauguuguuaaagcuu

SEQ ID NO: 2490315 - RNA, 21 nt, Chlamydia trachomatis
aagauuauaccagcagaccca

SEQ ID NO: 2490316 - RNA, 16 nt, Chlamydia trachomatis
aagauuaucacauucu

SEQ ID NO: 2490317 - RNA, 17 nt, Chlamydia trachomatis
aagauucgcugcugucu

SEQ ID NO: 2490318 - RNA, 14 nt, Chlamydia trachomatis
aagauugaugacaa

SEQ ID NO: 2490319 - RNA, 18 nt, Chlamydia trachomatis
aagauugaugacaacuac

SEQ ID NO: 2490320 - RNA, 15 nt, Chlamydia trachomatis
aagauuucagagcca

SEQ ID NO: 2490321 - RNA, 16 nt, Chlamydia trachomatis
aagauuuccccuuuuc

SEQ ID NO: 2490322 - RNA, 12 nt, Chlamydia trachomatis
aagauuucuucu

SEQ ID NO: 2490323 - RNA, 21 nt, Chlamydia trachomatis
aagauuucuucuguagcccca

SEQ ID NO: 2490324 - RNA, 18 nt, Chlamydia trachomatis
aagauuugaucuucugga

SEQ ID NO: 2490325 - RNA, 21 nt, Chlamydia trachomatis
aagauuuucaacgggaacaaa

SEQ ID NO: 2490326 - RNA, 22 nt, Chlamydia trachomatis
aagauuuucaacgggaacaaaa

SEQ ID NO: 2490327 - RNA, 17 nt, Chlamydia trachomatis
aagauuuucaucuucca

SEQ ID NO: 2490328 - RNA, 18 nt, Chlamydia trachomatis
aagauuuuucagccuguc

SEQ ID NO: 2490329 - RNA, 19 nt, Chlamydia trachomatis
aagauuuuucagccugucu

SEQ ID NO: 2490330 - RNA, 12 nt, Chlamydia trachomatis
aagcaacaauau

SEQ ID NO: 2490331 - RNA, 19 nt, Chlamydia trachomatis
aagcaacgaaaccaaaaua

SEQ ID NO: 2490332 - RNA, 14 nt, Chlamydia trachomatis
aagcaagaaucaaa

SEQ ID NO: 2490333 - RNA, 17 nt, Chlamydia trachomatis
aagcaagaaucaaagga

SEQ ID NO: 2490334 - RNA, 22 nt, Chlamydia trachomatis
aagcaaguuccucaaaagaacu

SEQ ID NO: 2490335 - RNA, 19 nt, Chlamydia trachomatis
aagcaauacgauugguuua

SEQ ID NO: 2490336 - RNA, 13 nt, Chlamydia trachomatis
aagcaauccgcuu

SEQ ID NO: 2490337 - RNA, 14 nt, Chlamydia trachomatis
aagcacaauaacag

SEQ ID NO: 2490338 - RNA, 13 nt, Chlamydia trachomatis
aagcacacagcgu

SEQ ID NO: 2490339 - RNA, 18 nt, Chlamydia trachomatis
aagcacgauaaaagacag

SEQ ID NO: 2490340 - RNA, 12 nt, Chlamydia trachomatis
aagcacuccuca

SEQ ID NO: 2490341 - RNA, 17 nt, Chlamydia trachomatis
aagcacuccucagcaua

SEQ ID NO: 2490342 - RNA, 23 nt, Chlamydia trachomatis
aagcacugcguauuugaaaucaa

SEQ ID NO: 2490343 - RNA, 16 nt, Chlamydia trachomatis
aagcacuggauccuaa

SEQ ID NO: 2490344 - RNA, 23 nt, Chlamydia trachomatis
aagcacuguccacauuauucaca

SEQ ID NO: 2490345 - RNA, 18 nt, Chlamydia trachomatis
aagcagaaacaauuucau

SEQ ID NO: 2490346 - RNA, 14 nt, Chlamydia trachomatis
aagcagaaacagcu

SEQ ID NO: 2490347 - RNA, 15 nt, Chlamydia trachomatis
aagcagaaacagcuu

SEQ ID NO: 2490348 - RNA, 16 nt, Chlamydia trachomatis
aagcagaaagaaugcu

SEQ ID NO: 2490349 - RNA, 14 nt, Chlamydia trachomatis
aagcagacaagcaa

SEQ ID NO: 2490350 - RNA, 21 nt, Chlamydia trachomatis
aagcagaugccggaagauuag

SEQ ID NO: 2490351 - RNA, 14 nt, Chlamydia trachomatis
aagcagcggcaaug

SEQ ID NO: 2490352 - RNA, 15 nt, Chlamydia trachomatis
aagcagcuaaccaug

SEQ ID NO: 2490353 - RNA, 14 nt, Chlamydia trachomatis
aagcagucuagagg

SEQ ID NO: 2490354 - RNA, 11 nt, Chlamydia trachomatis
aagcauagcuu

SEQ ID NO: 2490355 - RNA, 13 nt, Chlamydia trachomatis
aagcauccccaaa

SEQ ID NO: 2490356 - RNA, 19 nt, Chlamydia trachomatis
aagcaucuuuaccauuucc

SEQ ID NO: 2490357 - RNA, 15 nt, Chlamydia trachomatis
aagcaugauauuuug

SEQ ID NO: 2490358 - RNA, 20 nt, Chlamydia trachomatis
aagcaugauauuuugaagau

SEQ ID NO: 2490359 - RNA, 12 nt, Chlamydia trachomatis
aagcauucguua

SEQ ID NO: 2490360 - RNA, 15 nt, Chlamydia trachomatis
aagcauucucucaua

SEQ ID NO: 2490361 - RNA, 16 nt, Chlamydia trachomatis
aagcauugaacaccau

SEQ ID NO: 2490362 - RNA, 18 nt, Chlamydia trachomatis
aagcauuucgucguguuc

SEQ ID NO: 2490363 - RNA, 15 nt, Chlamydia trachomatis
aagcauuucucucca

SEQ ID NO: 2490364 - RNA, 15 nt, Chlamydia trachomatis
aagccaccagccaca

SEQ ID NO: 2490365 - RNA, 15 nt, Chlamydia trachomatis
aagccauacaaagau

SEQ ID NO: 2490366 - RNA, 18 nt, Chlamydia trachomatis
aagccauacaaagauugc

SEQ ID NO: 2490367 - RNA, 21 nt, Chlamydia trachomatis
aagccaucucggaucgagaag

SEQ ID NO: 2490368 - RNA, 22 nt, Chlamydia trachomatis
aagccaucucggaucgagaaga

SEQ ID NO: 2490369 - RNA, 24 nt, Chlamydia trachomatis
aagccaucucggaucgagaagagc

SEQ ID NO: 2490370 - RNA, 20 nt, Chlamydia trachomatis
aagccccuccgcugauuaga

SEQ ID NO: 2490371 - RNA, 21 nt, Chlamydia trachomatis
aagccccuccgcugauuagaa

SEQ ID NO: 2490372 - RNA, 19 nt, Chlamydia trachomatis
aagcccuugagagcaagcc

SEQ ID NO: 2490373 - RNA, 15 nt, Chlamydia trachomatis
aagccuacagcuagc

SEQ ID NO: 2490374 - RNA, 12 nt, Chlamydia trachomatis
aagccugugccu

SEQ ID NO: 2490375 - RNA, 20 nt, Chlamydia trachomatis
aagccugugccuuucguuag

SEQ ID NO: 2490376 - RNA, 22 nt, Chlamydia trachomatis
aagccuguuuugcuaugaaaaa

SEQ ID NO: 2490377 - RNA, 23 nt, Chlamydia trachomatis
aagccuucuccagaaguggcugu

SEQ ID NO: 2490378 - RNA, 15 nt, Chlamydia trachomatis
aagccuucuuccuug

SEQ ID NO: 2490379 - RNA, 15 nt, Chlamydia trachomatis
aagccuucuuucaaa

SEQ ID NO: 2490380 - RNA, 21 nt, Chlamydia trachomatis
aagccuugagccuucaauucu

SEQ ID NO: 2490381 - RNA, 20 nt, Chlamydia trachomatis
aagccuuucucuaaaagaag

SEQ ID NO: 2490382 - RNA, 22 nt, Chlamydia trachomatis
aagccuuucucuaaaagaagag

SEQ ID NO: 2490383 - RNA, 16 nt, Chlamydia trachomatis
aagccuuugcuaucag

SEQ ID NO: 2490384 - RNA, 13 nt, Chlamydia trachomatis
aagcgaaaaaaaa

SEQ ID NO: 2490385 - RNA, 16 nt, Chlamydia trachomatis
aagcgaaaaaaaaaga

SEQ ID NO: 2490386 - RNA, 13 nt, Chlamydia trachomatis
aagcgagauaagg

SEQ ID NO: 2490387 - RNA, 16 nt, Chlamydia trachomatis
aagcggcuaaagaaga

SEQ ID NO: 2490388 - RNA, 19 nt, Chlamydia trachomatis
aagcguaguaagacccaga

SEQ ID NO: 2490389 - RNA, 20 nt, Chlamydia trachomatis
aagcguuccuauacaagaaa

SEQ ID NO: 2490390 - RNA, 13 nt, Chlamydia trachomatis
aagcuaauagcuu

SEQ ID NO: 2490391 - RNA, 19 nt, Chlamydia trachomatis
aagcuaauagcuugaagaa

SEQ ID NO: 2490392 - RNA, 13 nt, Chlamydia trachomatis
aagcuaauuuuuc

SEQ ID NO: 2490393 - RNA, 23 nt, Chlamydia trachomatis
aagcuaauuuuucucuaauaguu

SEQ ID NO: 2490394 - RNA, 20 nt, Chlamydia trachomatis
aagcuagaaaauagcaucuc

SEQ ID NO: 2490395 - RNA, 14 nt, Chlamydia trachomatis
aagcuagaagaaga

SEQ ID NO: 2490396 - RNA, 14 nt, Chlamydia trachomatis
aagcuaucccaaaa

SEQ ID NO: 2490397 - RNA, 16 nt, Chlamydia trachomatis
aagcuaucuaauauua

SEQ ID NO: 2490398 - RNA, 20 nt, Chlamydia trachomatis
aagcuauuuucuuccugcuu

SEQ ID NO: 2490399 - RNA, 21 nt, Chlamydia trachomatis
aagcuauuuucuuccugcuuc

SEQ ID NO: 2490400 - RNA, 11 nt, Chlamydia trachomatis
aagcuccaaag

SEQ ID NO: 2490401 - RNA, 13 nt, Chlamydia trachomatis
aagcuccaaagaa

SEQ ID NO: 2490402 - RNA, 14 nt, Chlamydia trachomatis
aagcuccaaagaac

SEQ ID NO: 2490403 - RNA, 21 nt, Chlamydia trachomatis
aagcuccacaggugaauucuc

SEQ ID NO: 2490404 - RNA, 18 nt, Chlamydia trachomatis
aagcucgaaucgucucuc

SEQ ID NO: 2490405 - RNA, 16 nt, Chlamydia trachomatis
aagcucggucucauua

SEQ ID NO: 2490406 - RNA, 19 nt, Chlamydia trachomatis
aagcucggucucauuauau

SEQ ID NO: 2490407 - RNA, 17 nt, Chlamydia trachomatis
aagcucuagcaauagag

SEQ ID NO: 2490408 - RNA, 19 nt, Chlamydia trachomatis
aagcucuagcaauagagau

SEQ ID NO: 2490409 - RNA, 14 nt, Chlamydia trachomatis
aagcugcagagaua

SEQ ID NO: 2490410 - RNA, 17 nt, Chlamydia trachomatis
aagcugcagagauauaa

SEQ ID NO: 2490411 - RNA, 17 nt, Chlamydia trachomatis
aagcuguucuuccauau

SEQ ID NO: 2490412 - RNA, 18 nt, Chlamydia trachomatis
aagcuuagccacugcaca

SEQ ID NO: 2490413 - RNA, 15 nt, Chlamydia trachomatis
aagcuucuaacgcuu

SEQ ID NO: 2490414 - RNA, 23 nt, Chlamydia trachomatis
aagcuucucaacacugaaaaucg

SEQ ID NO: 2490415 - RNA, 17 nt, Chlamydia trachomatis
aagcuugaucaaagaau

SEQ ID NO: 2490416 - RNA, 18 nt, Chlamydia trachomatis
aagcuugucuccuucuuu

SEQ ID NO: 2490417 - RNA, 21 nt, Chlamydia trachomatis
aagcuuuuuccaaagcuucua

SEQ ID NO: 2490418 - RNA, 13 nt, Chlamydia trachomatis
aaggaaaaagaaa

SEQ ID NO: 2490419 - RNA, 14 nt, Chlamydia trachomatis
aaggaaaaagaaaa

SEQ ID NO: 2490420 - RNA, 21 nt, Chlamydia trachomatis
aaggaaaaagaaaaaaagagg

SEQ ID NO: 2490421 - RNA, 15 nt, Chlamydia trachomatis
aaggaaacaagcaga

SEQ ID NO: 2490422 - RNA, 16 nt, Chlamydia trachomatis
aaggaaaccaagggaa

SEQ ID NO: 2490423 - RNA, 14 nt, Chlamydia trachomatis
aaggaaauaaagau

SEQ ID NO: 2490424 - RNA, 16 nt, Chlamydia trachomatis
aaggaaauaaagaucu

SEQ ID NO: 2490425 - RNA, 12 nt, Chlamydia trachomatis
aaggaagaagau

SEQ ID NO: 2490426 - RNA, 23 nt, Chlamydia trachomatis
aaggaagaggagggagaauuaau

SEQ ID NO: 2490427 - RNA, 23 nt, Chlamydia trachomatis
aaggaagaugggcauaacgagug

SEQ ID NO: 2490428 - RNA, 13 nt, Chlamydia trachomatis
aaggaagccagcc

SEQ ID NO: 2490429 - RNA, 16 nt, Chlamydia trachomatis
aaggaagggagcuuag

SEQ ID NO: 2490430 - RNA, 15 nt, Chlamydia trachomatis
aaggaaguagagaau

SEQ ID NO: 2490431 - RNA, 19 nt, Chlamydia trachomatis
aaggaauaaacagguaaaa

SEQ ID NO: 2490432 - RNA, 14 nt, Chlamydia trachomatis
aaggaauaauuuuc

SEQ ID NO: 2490433 - RNA, 19 nt, Chlamydia trachomatis
aaggaaucuguccaaagag

SEQ ID NO: 2490434 - RNA, 21 nt, Chlamydia trachomatis
aaggaaucuguccaaagagau

SEQ ID NO: 2490435 - RNA, 15 nt, Chlamydia trachomatis
aaggacuaguccuga

SEQ ID NO: 2490436 - RNA, 20 nt, Chlamydia trachomatis
aaggacuaguccugaagcaa

SEQ ID NO: 2490437 - RNA, 13 nt, Chlamydia trachomatis
aaggacuucaaca

SEQ ID NO: 2490438 - RNA, 17 nt, Chlamydia trachomatis
aaggagaauaccaccau

SEQ ID NO: 2490439 - RNA, 15 nt, Chlamydia trachomatis
aaggagacaaguuca

SEQ ID NO: 2490440 - RNA, 17 nt, Chlamydia trachomatis
aaggagagaaaagagga

SEQ ID NO: 2490441 - RNA, 17 nt, Chlamydia trachomatis
aaggagauauuuccaua

SEQ ID NO: 2490442 - RNA, 18 nt, Chlamydia trachomatis
aaggagauguuaucucug

SEQ ID NO: 2490443 - RNA, 17 nt, Chlamydia trachomatis
aaggagcgacuaauucu

SEQ ID NO: 2490444 - RNA, 15 nt, Chlamydia trachomatis
aaggagcuucuuuau

SEQ ID NO: 2490445 - RNA, 15 nt, Chlamydia trachomatis
aaggauaaauauuuu

SEQ ID NO: 2490446 - RNA, 16 nt, Chlamydia trachomatis
aaggaucuuccagccu

SEQ ID NO: 2490447 - RNA, 21 nt, Chlamydia trachomatis
aaggauucauauguucuuuga

SEQ ID NO: 2490448 - RNA, 19 nt, Chlamydia trachomatis
aaggauugacagcuguuuc

SEQ ID NO: 2490449 - RNA, 16 nt, Chlamydia trachomatis
aaggauuuuuuuccca

SEQ ID NO: 2490450 - RNA, 17 nt, Chlamydia trachomatis
aaggauuuuuuucugca

SEQ ID NO: 2490451 - RNA, 22 nt, Chlamydia trachomatis
aaggcaggaaaaggcaucaaca

SEQ ID NO: 2490452 - RNA, 17 nt, Chlamydia trachomatis
aaggcauaaaagagaag

SEQ ID NO: 2490453 - RNA, 16 nt, Chlamydia trachomatis
aaggcaucaacagccu

SEQ ID NO: 2490454 - RNA, 17 nt, Chlamydia trachomatis
aaggcgaauucuuugau

SEQ ID NO: 2490455 - RNA, 20 nt, Chlamydia trachomatis
aaggcgaguucgggaauaau

SEQ ID NO: 2490456 - RNA, 19 nt, Chlamydia trachomatis
aaggcuaagaaaaaccuuu

SEQ ID NO: 2490457 - RNA, 20 nt, Chlamydia trachomatis
aaggcucuauacagagccuu

SEQ ID NO: 2490458 - RNA, 17 nt, Chlamydia trachomatis
aaggcuuauucucuuua

SEQ ID NO: 2490459 - RNA, 17 nt, Chlamydia trachomatis
aaggcuuucaaaaagag

SEQ ID NO: 2490460 - RNA, 18 nt, Chlamydia trachomatis
aaggcuuucaaaaagagc

SEQ ID NO: 2490461 - RNA, 15 nt, Chlamydia trachomatis
aaggcuuugucuaua

SEQ ID NO: 2490462 - RNA, 15 nt, Chlamydia trachomatis
aagggaauaaaaacg

SEQ ID NO: 2490463 - RNA, 21 nt, Chlamydia trachomatis
aagggaauaaaaacgcuccaa

SEQ ID NO: 2490464 - RNA, 15 nt, Chlamydia trachomatis
aagggaauagccuau

SEQ ID NO: 2490465 - RNA, 20 nt, Chlamydia trachomatis
aagggaauguuucccuucuu

SEQ ID NO: 2490466 - RNA, 13 nt, Chlamydia trachomatis
aagggagaggauu

SEQ ID NO: 2490467 - RNA, 20 nt, Chlamydia trachomatis
aagggaugaagcuaaaaaau

SEQ ID NO: 2490468 - RNA, 16 nt, Chlamydia trachomatis
aagggcugagccguuc

SEQ ID NO: 2490469 - RNA, 17 nt, Chlamydia trachomatis
aagggggacaaaaauac

SEQ ID NO: 2490470 - RNA, 21 nt, Chlamydia trachomatis
aagggguuuucuuggcaggcg

SEQ ID NO: 2490471 - RNA, 15 nt, Chlamydia trachomatis
aaggguagaaaaaga

SEQ ID NO: 2490472 - RNA, 17 nt, Chlamydia trachomatis
aaggguagaaaaagaga

SEQ ID NO: 2490473 - RNA, 20 nt, Chlamydia trachomatis
aaggguagaaaaagagaaau

SEQ ID NO: 2490474 - RNA, 14 nt, Chlamydia trachomatis
aagggugcacaagu

SEQ ID NO: 2490475 - RNA, 21 nt, Chlamydia trachomatis
aagggugcuaacuuucuucca

SEQ ID NO: 2490476 - RNA, 15 nt, Chlamydia trachomatis
aaggguugcgcuggc

SEQ ID NO: 2490477 - RNA, 17 nt, Chlamydia trachomatis
aaggguuuugaagcuug

SEQ ID NO: 2490478 - RNA, 18 nt, Chlamydia trachomatis
aagguauuuuagagaaaa

SEQ ID NO: 2490479 - RNA, 22 nt, Chlamydia trachomatis
aagguauuuuagagaaaagaaa

SEQ ID NO: 2490480 - RNA, 23 nt, Chlamydia trachomatis
aaggucgagcucccauuucuggc

SEQ ID NO: 2490481 - RNA, 14 nt, Chlamydia trachomatis
aaggucugaacaac

SEQ ID NO: 2490482 - RNA, 16 nt, Chlamydia trachomatis
aaggugaguuucccuu

SEQ ID NO: 2490483 - RNA, 20 nt, Chlamydia trachomatis
aaggugaguuucccuucguc

SEQ ID NO: 2490484 - RNA, 19 nt, Chlamydia trachomatis
aagguguguucccagagaa

SEQ ID NO: 2490485 - RNA, 19 nt, Chlamydia trachomatis
aagguucgaaaucaugaau

SEQ ID NO: 2490486 - RNA, 15 nt, Chlamydia trachomatis
aagguucuucuucga

SEQ ID NO: 2490487 - RNA, 17 nt, Chlamydia trachomatis
aagguuguuauguagau

SEQ ID NO: 2490488 - RNA, 16 nt, Chlamydia trachomatis
aagguuucuggaaaau

SEQ ID NO: 2490489 - RNA, 12 nt, Chlamydia trachomatis
aaguaaccauuc

SEQ ID NO: 2490490 - RNA, 16 nt, Chlamydia trachomatis
aaguaacuacggaaaa

SEQ ID NO: 2490491 - RNA, 19 nt, Chlamydia trachomatis
aaguaagaccgagauuauc

SEQ ID NO: 2490492 - RNA, 16 nt, Chlamydia trachomatis
aaguaagcgcuuccau

SEQ ID NO: 2490493 - RNA, 15 nt, Chlamydia trachomatis
aaguaaugaagguuu

SEQ ID NO: 2490494 - RNA, 15 nt, Chlamydia trachomatis
aaguaaugacacugg

SEQ ID NO: 2490495 - RNA, 17 nt, Chlamydia trachomatis
aaguaguccuaucacca

SEQ ID NO: 2490496 - RNA, 14 nt, Chlamydia trachomatis
aaguauaauccgag

SEQ ID NO: 2490497 - RNA, 18 nt, Chlamydia trachomatis
aaguaucguaaacaaaag

SEQ ID NO: 2490498 - RNA, 19 nt, Chlamydia trachomatis
aaguauuggagacaacaag

SEQ ID NO: 2490499 - RNA, 14 nt, Chlamydia trachomatis
aaguauuucuuguu

SEQ ID NO: 2490500 - RNA, 13 nt, Chlamydia trachomatis
aagucaaaagaau

SEQ ID NO: 2490501 - RNA, 15 nt, Chlamydia trachomatis
aagucagaugaguuu

SEQ ID NO: 2490502 - RNA, 22 nt, Chlamydia trachomatis
aagucaugcggauuaaagaagg

SEQ ID NO: 2490503 - RNA, 23 nt, Chlamydia trachomatis
aaguccaagauuaucacauucuu

SEQ ID NO: 2490504 - RNA, 19 nt, Chlamydia trachomatis
aaguccaucuaaagggaga

SEQ ID NO: 2490505 - RNA, 16 nt, Chlamydia trachomatis
aaguccggacuuuccu

SEQ ID NO: 2490506 - RNA, 11 nt, Chlamydia trachomatis
aaguccugcuu

SEQ ID NO: 2490507 - RNA, 22 nt, Chlamydia trachomatis
aaguccugcuucuuuuucccgc

SEQ ID NO: 2490508 - RNA, 22 nt, Chlamydia trachomatis
aaguccuucuccaccuaauucc

SEQ ID NO: 2490509 - RNA, 21 nt, Chlamydia trachomatis
aagucguacagaucuugaucu

SEQ ID NO: 2490510 - RNA, 15 nt, Chlamydia trachomatis
aagucgugucaggcg

SEQ ID NO: 2490511 - RNA, 21 nt, Chlamydia trachomatis
aagucuaccguauuaucugca

SEQ ID NO: 2490512 - RNA, 16 nt, Chlamydia trachomatis
aagucuccauaagaau

SEQ ID NO: 2490513 - RNA, 21 nt, Chlamydia trachomatis
aagucuccauaagaauguuuc

SEQ ID NO: 2490514 - RNA, 12 nt, Chlamydia trachomatis
aagucucugcca

SEQ ID NO: 2490515 - RNA, 13 nt, Chlamydia trachomatis
aagucucugccac

SEQ ID NO: 2490516 - RNA, 17 nt, Chlamydia trachomatis
aagucucuuaagcguuu

SEQ ID NO: 2490517 - RNA, 15 nt, Chlamydia trachomatis
aagucuguuccuaau

SEQ ID NO: 2490518 - RNA, 20 nt, Chlamydia trachomatis
aagucuguuccuaauacuaa

SEQ ID NO: 2490519 - RNA, 22 nt, Chlamydia trachomatis
aagucuuuaauaccuucuuaca

SEQ ID NO: 2490520 - RNA, 18 nt, Chlamydia trachomatis
aagucuuuuacuuugaaa

SEQ ID NO: 2490521 - RNA, 23 nt, Chlamydia trachomatis
aagucuuuuccuccauaggaaua

SEQ ID NO: 2490522 - RNA, 19 nt, Chlamydia trachomatis
aagugacuggcgagaagca

SEQ ID NO: 2490523 - RNA, 21 nt, Chlamydia trachomatis
aagugacuuuuagcaaauaau

SEQ ID NO: 2490524 - RNA, 16 nt, Chlamydia trachomatis
aagugagcccugcuuc

SEQ ID NO: 2490525 - RNA, 22 nt, Chlamydia trachomatis
aagugagcccugcuucacagcu

SEQ ID NO: 2490526 - RNA, 16 nt, Chlamydia trachomatis
aagugccaacaucaaa

SEQ ID NO: 2490527 - RNA, 17 nt, Chlamydia trachomatis
aagugccaacaucaaaa

SEQ ID NO: 2490528 - RNA, 17 nt, Chlamydia trachomatis
aagugcuaacgcuucuu

SEQ ID NO: 2490529 - RNA, 17 nt, Chlamydia trachomatis
aagugcuguaugccaag

SEQ ID NO: 2490530 - RNA, 18 nt, Chlamydia trachomatis
aagugcuguaugccaaga

SEQ ID NO: 2490531 - RNA, 15 nt, Chlamydia trachomatis
aaguguaaucauuuu

SEQ ID NO: 2490532 - RNA, 15 nt, Chlamydia trachomatis
aagugugccagcucu

SEQ ID NO: 2490533 - RNA, 20 nt, Chlamydia trachomatis
aaguuagcauguucagaauc

SEQ ID NO: 2490534 - RNA, 21 nt, Chlamydia trachomatis
aaguucacugacuguagaaaa

SEQ ID NO: 2490535 - RNA, 16 nt, Chlamydia trachomatis
aaguucauugguaaga

SEQ ID NO: 2490536 - RNA, 21 nt, Chlamydia trachomatis
aaguucccuuuacaaugauga

SEQ ID NO: 2490537 - RNA, 21 nt, Chlamydia trachomatis
aaguucccuuuuguuccagaa

SEQ ID NO: 2490538 - RNA, 17 nt, Chlamydia trachomatis
aaguuccgguauauucu

SEQ ID NO: 2490539 - RNA, 20 nt, Chlamydia trachomatis
aaguuccgguauauucuuca

SEQ ID NO: 2490540 - RNA, 18 nt, Chlamydia trachomatis
aaguucuucuuccacaga

SEQ ID NO: 2490541 - RNA, 18 nt, Chlamydia trachomatis
aaguucuuuuuccucuuc

SEQ ID NO: 2490542 - RNA, 23 nt, Chlamydia trachomatis
aaguucuuuuuccucuucagaca

SEQ ID NO: 2490543 - RNA, 18 nt, Chlamydia trachomatis
aaguucuuuuuguugcuc

SEQ ID NO: 2490544 - RNA, 18 nt, Chlamydia trachomatis
aaguuggucgcagaauaa

SEQ ID NO: 2490545 - RNA, 19 nt, Chlamydia trachomatis
aaguuucugaaaagucgcc

SEQ ID NO: 2490546 - RNA, 16 nt, Chlamydia trachomatis
aaguuuuaacaugagu

SEQ ID NO: 2490547 - RNA, 23 nt, Chlamydia trachomatis
aauaaaaacuggagaauccauaa

SEQ ID NO: 2490548 - RNA, 13 nt, Chlamydia trachomatis
aauaaaaagccca

SEQ ID NO: 2490549 - RNA, 14 nt, Chlamydia trachomatis
aauaaaaagcccuu

SEQ ID NO: 2490550 - RNA, 19 nt, Chlamydia trachomatis
aauaaaacgaaaaacagaa

SEQ ID NO: 2490551 - RNA, 18 nt, Chlamydia trachomatis
aauaaaauggaaauaaaa

SEQ ID NO: 2490552 - RNA, 12 nt, Chlamydia trachomatis
aauaaacaacau

SEQ ID NO: 2490553 - RNA, 20 nt, Chlamydia trachomatis
aauaaacagaucuuuuucau

SEQ ID NO: 2490554 - RNA, 21 nt, Chlamydia trachomatis
aauaaacgcgauguaagguuu

SEQ ID NO: 2490555 - RNA, 11 nt, Chlamydia trachomatis
aauaaagauag

SEQ ID NO: 2490556 - RNA, 17 nt, Chlamydia trachomatis
aauaaagauagcaucuu

SEQ ID NO: 2490557 - RNA, 13 nt, Chlamydia trachomatis
aauaaaggaaaca

SEQ ID NO: 2490558 - RNA, 20 nt, Chlamydia trachomatis
aauaaaggccaggcuugcuu

SEQ ID NO: 2490559 - RNA, 20 nt, Chlamydia trachomatis
aauaaauauuaucagaccuu

SEQ ID NO: 2490560 - RNA, 21 nt, Chlamydia trachomatis
aauaaauuagggaagagcaau

SEQ ID NO: 2490561 - RNA, 12 nt, Chlamydia trachomatis
aauaacaaagca

SEQ ID NO: 2490562 - RNA, 22 nt, Chlamydia trachomatis
aauaacccgcuuugaaaguuag

SEQ ID NO: 2490563 - RNA, 15 nt, Chlamydia trachomatis
aauaacgauaguaca

SEQ ID NO: 2490564 - RNA, 21 nt, Chlamydia trachomatis
aauaacgauucuugauaaaua

SEQ ID NO: 2490565 - RNA, 17 nt, Chlamydia trachomatis
aauaacgcccucuuuuc

SEQ ID NO: 2490566 - RNA, 13 nt, Chlamydia trachomatis
aauaacguuuuaa

SEQ ID NO: 2490567 - RNA, 14 nt, Chlamydia trachomatis
aauaacuaauauag

SEQ ID NO: 2490568 - RNA, 11 nt, Chlamydia trachomatis
aauaacugcau

SEQ ID NO: 2490569 - RNA, 14 nt, Chlamydia trachomatis
aauaagaccucuuu

SEQ ID NO: 2490570 - RNA, 21 nt, Chlamydia trachomatis
aauaagagcaucgaagcguuu

SEQ ID NO: 2490571 - RNA, 18 nt, Chlamydia trachomatis
aauaagaugaugagugga

SEQ ID NO: 2490572 - RNA, 14 nt, Chlamydia trachomatis
aauaagcauccaag

SEQ ID NO: 2490573 - RNA, 11 nt, Chlamydia trachomatis
aauaagcgaaa

SEQ ID NO: 2490574 - RNA, 15 nt, Chlamydia trachomatis
aauaagcgaaaaaaa

SEQ ID NO: 2490575 - RNA, 23 nt, Chlamydia trachomatis
aauaagcgaaaaaaaaagaacau

SEQ ID NO: 2490576 - RNA, 17 nt, Chlamydia trachomatis
aauaagcuuuuuccgga

SEQ ID NO: 2490577 - RNA, 15 nt, Chlamydia trachomatis
aauaaggggaagaaa

SEQ ID NO: 2490578 - RNA, 19 nt, Chlamydia trachomatis
aauaagguauccaacaaua

SEQ ID NO: 2490579 - RNA, 21 nt, Chlamydia trachomatis
aauaagucugccacuacuuca

SEQ ID NO: 2490580 - RNA, 21 nt, Chlamydia trachomatis
aauaagucuuuuacuuugaaa

SEQ ID NO: 2490581 - RNA, 14 nt, Chlamydia trachomatis
aauaaguuguaaag

SEQ ID NO: 2490582 - RNA, 15 nt, Chlamydia trachomatis
aauaauaaaccaaag

SEQ ID NO: 2490583 - RNA, 12 nt, Chlamydia trachomatis
aauaauaaagau

SEQ ID NO: 2490584 - RNA, 13 nt, Chlamydia trachomatis
aauaauacaaagg

SEQ ID NO: 2490585 - RNA, 13 nt, Chlamydia trachomatis
aauaauacagauu

SEQ ID NO: 2490586 - RNA, 14 nt, Chlamydia trachomatis
aauaauacagauuu

SEQ ID NO: 2490587 - RNA, 23 nt, Chlamydia trachomatis
aauaauacagauuuuucgaaaau

SEQ ID NO: 2490588 - RNA, 15 nt, Chlamydia trachomatis
aauaauacuccaccu

SEQ ID NO: 2490589 - RNA, 21 nt, Chlamydia trachomatis
aauaauagaaaccgaaaaaaa

SEQ ID NO: 2490590 - RNA, 18 nt, Chlamydia trachomatis
aauaauaucgagcucauu

SEQ ID NO: 2490591 - RNA, 21 nt, Chlamydia trachomatis
aauaaucggcaaaagaucuca

SEQ ID NO: 2490592 - RNA, 15 nt, Chlamydia trachomatis
aauaaugaaacccca

SEQ ID NO: 2490593 - RNA, 13 nt, Chlamydia trachomatis
aauaaugauuuuu

SEQ ID NO: 2490594 - RNA, 20 nt, Chlamydia trachomatis
aauaaugggccguuuuucuc

SEQ ID NO: 2490595 - RNA, 17 nt, Chlamydia trachomatis
aauaaugggcuccuuca

SEQ ID NO: 2490596 - RNA, 16 nt, Chlamydia trachomatis
aauaauguugaagucu

SEQ ID NO: 2490597 - RNA, 18 nt, Chlamydia trachomatis
aauaauguuuuguaguuu

SEQ ID NO: 2490598 - RNA, 12 nt, Chlamydia trachomatis
aauaauucaggc

SEQ ID NO: 2490599 - RNA, 13 nt, Chlamydia trachomatis
aauaauucaggcu

SEQ ID NO: 2490600 - RNA, 14 nt, Chlamydia trachomatis
aauaauuuccccua

SEQ ID NO: 2490601 - RNA, 13 nt, Chlamydia trachomatis
aauaauuucugag

SEQ ID NO: 2490602 - RNA, 12 nt, Chlamydia trachomatis
auuuagacacau

SEQ ID NO: 2490603 - RNA, 15 nt, Chlamydia trachomatis
auuuagagaauaauc

SEQ ID NO: 2490604 - RNA, 17 nt, Chlamydia trachomatis
auuuagaguuccuaaau

SEQ ID NO: 2490605 - RNA, 23 nt, Chlamydia trachomatis
auuuauagaaccccucuuuuuuu

SEQ ID NO: 2490606 - RNA, 13 nt, Chlamydia trachomatis
auuuauccacagg

SEQ ID NO: 2490607 - RNA, 17 nt, Chlamydia trachomatis
auuuaucugcuaaagaa

SEQ ID NO: 2490608 - RNA, 13 nt, Chlamydia trachomatis
auuuaugaagccu

SEQ ID NO: 2490609 - RNA, 15 nt, Chlamydia trachomatis
auuuaugucgcagcu

SEQ ID NO: 2490610 - RNA, 20 nt, Chlamydia trachomatis
auuucagagccagcuuuaaa

SEQ ID NO: 2490611 - RNA, 13 nt, Chlamydia trachomatis
auuucagcaucaa

SEQ ID NO: 2490612 - RNA, 16 nt, Chlamydia trachomatis
auuucagcaucaauaa

SEQ ID NO: 2490613 - RNA, 17 nt, Chlamydia trachomatis
auuucaggaguaggaag

SEQ ID NO: 2490614 - RNA, 10 nt, Chlamydia trachomatis
auuucauuua

SEQ ID NO: 2490615 - RNA, 16 nt, Chlamydia trachomatis
auuuccaaaaucuuca

SEQ ID NO: 2490616 - RNA, 21 nt, Chlamydia trachomatis
auuuccagcauuuuaaaauca

SEQ ID NO: 2490617 - RNA, 13 nt, Chlamydia trachomatis
auuuccccaagau

SEQ ID NO: 2490618 - RNA, 15 nt, Chlamydia trachomatis
auuuccccuacaaac

SEQ ID NO: 2490619 - RNA, 14 nt, Chlamydia trachomatis
auuuccccugcagc

SEQ ID NO: 2490620 - RNA, 13 nt, Chlamydia trachomatis
auuuccccuuuuc

SEQ ID NO: 2490621 - RNA, 14 nt, Chlamydia trachomatis
auuucccucuuccc

SEQ ID NO: 2490622 - RNA, 15 nt, Chlamydia trachomatis
auuuccguaaaaggu

SEQ ID NO: 2490623 - RNA, 19 nt, Chlamydia trachomatis
auuuccguaaugaucagca

SEQ ID NO: 2490624 - RNA, 21 nt, Chlamydia trachomatis
auuuccguaaugaucagcaaa

SEQ ID NO: 2490625 - RNA, 16 nt, Chlamydia trachomatis
auuuccguuccgucag

SEQ ID NO: 2490626 - RNA, 13 nt, Chlamydia trachomatis
auuuccuaccauc

SEQ ID NO: 2490627 - RNA, 15 nt, Chlamydia trachomatis
auuuccucuucuaga

SEQ ID NO: 2490628 - RNA, 15 nt, Chlamydia trachomatis
auuuccugcaagcac

SEQ ID NO: 2490629 - RNA, 17 nt, Chlamydia trachomatis
auuucggauacaauaca

SEQ ID NO: 2490630 - RNA, 19 nt, Chlamydia trachomatis
auuucggauacaauacagc

SEQ ID NO: 2490631 - RNA, 24 nt, Chlamydia trachomatis
auuucguugcuaacacaagcagac

SEQ ID NO: 2490632 - RNA, 19 nt, Chlamydia trachomatis
auuucuaggcugacuuuca

SEQ ID NO: 2490633 - RNA, 17 nt, Chlamydia trachomatis
auuucuauagaagaauu

SEQ ID NO: 2490634 - RNA, 23 nt, Chlamydia trachomatis
auuucucuacccaggcuuuucuu

SEQ ID NO: 2490635 - RNA, 13 nt, Chlamydia trachomatis
auuucucuaggaa

SEQ ID NO: 2490636 - RNA, 18 nt, Chlamydia trachomatis
auuucucuaggaacauuu

SEQ ID NO: 2490637 - RNA, 21 nt, Chlamydia trachomatis
auuucucuaucuguuaagcgu

SEQ ID NO: 2490638 - RNA, 17 nt, Chlamydia trachomatis
auuucucuuccugaaua

SEQ ID NO: 2490639 - RNA, 18 nt, Chlamydia trachomatis
auuucugccaaaggaucc

SEQ ID NO: 2490640 - RNA, 17 nt, Chlamydia trachomatis
auuucugggaaaauuaa

SEQ ID NO: 2490641 - RNA, 15 nt, Chlamydia trachomatis
auuucuuccucuaau

SEQ ID NO: 2490642 - RNA, 20 nt, Chlamydia trachomatis
auuucuuccugugacuuggu

SEQ ID NO: 2490643 - RNA, 13 nt, Chlamydia trachomatis
auuucuuguugua

SEQ ID NO: 2490644 - RNA, 14 nt, Chlamydia trachomatis
auuucuuuguucag

SEQ ID NO: 2490645 - RNA, 16 nt, Chlamydia trachomatis
auuugaauagggggag

SEQ ID NO: 2490646 - RNA, 21 nt, Chlamydia trachomatis
auuugacuaggauuacagcaa

SEQ ID NO: 2490647 - RNA, 16 nt, Chlamydia trachomatis
auuugaguuuaucauu

SEQ ID NO: 2490648 - RNA, 21 nt, Chlamydia trachomatis
auuugcagaagcuccaaagaa

SEQ ID NO: 2490649 - RNA, 20 nt, Chlamydia trachomatis
auuugcauugacuaucugcu

SEQ ID NO: 2490650 - RNA, 15 nt, Chlamydia trachomatis
auuugccaaugaaau

SEQ ID NO: 2490651 - RNA, 16 nt, Chlamydia trachomatis
auuugccaaugaaaua

SEQ ID NO: 2490652 - RNA, 17 nt, Chlamydia trachomatis
auuugccaaugaaauau

SEQ ID NO: 2490653 - RNA, 16 nt, Chlamydia trachomatis
auuugcgugauaaaaa

SEQ ID NO: 2490654 - RNA, 19 nt, Chlamydia trachomatis
auuugcuacaguaucugcu

SEQ ID NO: 2490655 - RNA, 18 nt, Chlamydia trachomatis
auuugcucguuagcagaa

SEQ ID NO: 2490656 - RNA, 21 nt, Chlamydia trachomatis
auuugcuuguuuagcauuucu

SEQ ID NO: 2490657 - RNA, 15 nt, Chlamydia trachomatis
auuuggauaugccug

SEQ ID NO: 2490658 - RNA, 16 nt, Chlamydia trachomatis
auuuggaucucuuaga

SEQ ID NO: 2490659 - RNA, 22 nt, Chlamydia trachomatis
auuuggcaauggcaaaaucuuc

SEQ ID NO: 2490660 - RNA, 18 nt, Chlamydia trachomatis
auuuguagcaaaagauuu

SEQ ID NO: 2490661 - RNA, 20 nt, Chlamydia trachomatis
auuuguaguucuaacaucaa

SEQ ID NO: 2490662 - RNA, 18 nt, Chlamydia trachomatis
auuuguguauggaaguag

SEQ ID NO: 2490663 - RNA, 18 nt, Chlamydia trachomatis
auuuguuguggagaggcu

SEQ ID NO: 2490664 - RNA, 16 nt, Chlamydia trachomatis
auuuguuuaaaagaag

SEQ ID NO: 2490665 - RNA, 16 nt, Chlamydia trachomatis
auuuuaaaaucuccuc

SEQ ID NO: 2490666 - RNA, 12 nt, Chlamydia trachomatis
auuuuaaauccc

SEQ ID NO: 2490667 - RNA, 13 nt, Chlamydia trachomatis
auuuuaauaagau

SEQ ID NO: 2490668 - RNA, 12 nt, Chlamydia trachomatis
auuuuagagaaa

SEQ ID NO: 2490669 - RNA, 17 nt, Chlamydia trachomatis
auuuuagagaaaagaaa

SEQ ID NO: 2490670 - RNA, 19 nt, Chlamydia trachomatis
auuuuagauaaaagaagca

SEQ ID NO: 2490671 - RNA, 15 nt, Chlamydia trachomatis
auuuuaucuaaaaag

SEQ ID NO: 2490672 - RNA, 19 nt, Chlamydia trachomatis
auuuuaugacccagaauca

SEQ ID NO: 2490673 - RNA, 18 nt, Chlamydia trachomatis
auuuuauucaaaucuucu

SEQ ID NO: 2490674 - RNA, 17 nt, Chlamydia trachomatis
auuuucagcaaaagaag

SEQ ID NO: 2490675 - RNA, 23 nt, Chlamydia trachomatis
auuuucagcaaaagaagaaucuu

SEQ ID NO: 2490676 - RNA, 19 nt, Chlamydia trachomatis
auuuucaucauaacauggu

SEQ ID NO: 2490677 - RNA, 15 nt, Chlamydia trachomatis
auuuucaucuuccaa

SEQ ID NO: 2490678 - RNA, 17 nt, Chlamydia trachomatis
auuuucaugaaaagcuu

SEQ ID NO: 2490679 - RNA, 12 nt, Chlamydia trachomatis
auuuuccaagaa

SEQ ID NO: 2490680 - RNA, 19 nt, Chlamydia trachomatis
auuuuccgaauaaaaucaa

SEQ ID NO: 2490681 - RNA, 18 nt, Chlamydia trachomatis
auuuuccucuucacagag

SEQ ID NO: 2490682 - RNA, 19 nt, Chlamydia trachomatis
auuuucguaagcauagcuu

SEQ ID NO: 2490683 - RNA, 15 nt, Chlamydia trachomatis
auuuucguauugauc

SEQ ID NO: 2490684 - RNA, 17 nt, Chlamydia trachomatis
auuuucguuguuguaaa

SEQ ID NO: 2490685 - RNA, 18 nt, Chlamydia trachomatis
auuuucuuuaggcauuaa

SEQ ID NO: 2490686 - RNA, 23 nt, Chlamydia trachomatis
auuuugaauaauagaaaaacuau

SEQ ID NO: 2490687 - RNA, 13 nt, Chlamydia trachomatis
auuuugaauacga

SEQ ID NO: 2490688 - RNA, 17 nt, Chlamydia trachomatis
auuuugucgauaagaag

SEQ ID NO: 2490689 - RNA, 16 nt, Chlamydia trachomatis
auuuuguuaagaauua

SEQ ID NO: 2490690 - RNA, 16 nt, Chlamydia trachomatis
auuuuguuuaaucagu

SEQ ID NO: 2490691 - RNA, 20 nt, Chlamydia trachomatis
auuuuuaccaaaccuuucaa

SEQ ID NO: 2490692 - RNA, 15 nt, Chlamydia trachomatis
auuuuuagaaggaaa

SEQ ID NO: 2490693 - RNA, 16 nt, Chlamydia trachomatis
auuuuucagaaaaagu

SEQ ID NO: 2490694 - RNA, 16 nt, Chlamydia trachomatis
auuuuucugcuagaua

SEQ ID NO: 2490695 - RNA, 18 nt, Chlamydia trachomatis
auuuuucuguaauaagug

SEQ ID NO: 2490696 - RNA, 22 nt, Chlamydia trachomatis
auuuuucuuugagaaaguuaaa

SEQ ID NO: 2490697 - RNA, 15 nt, Chlamydia trachomatis
auuuuuuaagaaguc

SEQ ID NO: 2490698 - RNA, 16 nt, Chlamydia trachomatis
auuuuuuagauagcgc

SEQ ID NO: 2490699 - RNA, 20 nt, Chlamydia trachomatis
auuuuuuucgauagaaaaaa

SEQ ID NO: 2490700 - RNA, 23 nt, Chlamydia trachomatis
caaaaaagaaucuaaaaagccau

SEQ ID NO: 2490701 - RNA, 13 nt, Chlamydia trachomatis
caaaaaagaggga

SEQ ID NO: 2490702 - RNA, 15 nt, Chlamydia trachomatis
caaaaaagagggagu

SEQ ID NO: 2490703 - RNA, 13 nt, Chlamydia trachomatis
caaaaaaucagcu

SEQ ID NO: 2490704 - RNA, 13 nt, Chlamydia trachomatis
caaaaacagcaga

SEQ ID NO: 2490705 - RNA, 18 nt, Chlamydia trachomatis
caaaaacagcuucuauag

SEQ ID NO: 2490706 - RNA, 20 nt, Chlamydia trachomatis
caaaaaccagccuauuagau

SEQ ID NO: 2490707 - RNA, 15 nt, Chlamydia trachomatis
caaaaagaaagccuu

SEQ ID NO: 2490708 - RNA, 20 nt, Chlamydia trachomatis
caaaaagacuacagucuucu

SEQ ID NO: 2490709 - RNA, 23 nt, Chlamydia trachomatis
caaaaagagcauaauauccccau

SEQ ID NO: 2490710 - RNA, 13 nt, Chlamydia trachomatis
caaaaagaucuuc

SEQ ID NO: 2490711 - RNA, 16 nt, Chlamydia trachomatis
caaaaagcgugucaau

SEQ ID NO: 2490712 - RNA, 13 nt, Chlamydia trachomatis
caaaaauagcaau

SEQ ID NO: 2490713 - RNA, 15 nt, Chlamydia trachomatis
caaaaauagcaucug

SEQ ID NO: 2490714 - RNA, 17 nt, Chlamydia trachomatis
caaaaauagcaucugga

SEQ ID NO: 2490715 - RNA, 20 nt, Chlamydia trachomatis
caaaaaucgcugagcucuuu

SEQ ID NO: 2490716 - RNA, 13 nt, Chlamydia trachomatis
cuguauagauuag

SEQ ID NO: 2490717 - RNA, 18 nt, Chlamydia trachomatis
cuguauccuaacuaaaaa

SEQ ID NO: 2490718 - RNA, 11 nt, Chlamydia trachomatis
cuguauuuccu

SEQ ID NO: 2490719 - RNA, 15 nt, Chlamydia trachomatis
cuguauuuccuucga

SEQ ID NO: 2490720 - RNA, 19 nt, Chlamydia trachomatis
cugucaacaucauaaccaa

SEQ ID NO: 2490721 - RNA, 23 nt, Chlamydia trachomatis
cugucaacaucauaaccaaucga

SEQ ID NO: 2490722 - RNA, 11 nt, Chlamydia trachomatis
cugucaauaaa

SEQ ID NO: 2490723 - RNA, 12 nt, Chlamydia trachomatis
cugucagaccua

SEQ ID NO: 2490724 - RNA, 20 nt, Chlamydia trachomatis
cugucaggauuuaaagccuu

SEQ ID NO: 2490725 - RNA, 14 nt, Chlamydia trachomatis
cugucauaccaaga

SEQ ID NO: 2490726 - RNA, 17 nt, Chlamydia trachomatis
cugucaucacugaccga

SEQ ID NO: 2490727 - RNA, 23 nt, Chlamydia trachomatis
cugucaucacugaccgaagaacu

SEQ ID NO: 2490728 - RNA, 16 nt, Chlamydia trachomatis
cugucccccagauaac

SEQ ID NO: 2490729 - RNA, 14 nt, Chlamydia trachomatis
cuguccuuuauuca

SEQ ID NO: 2490730 - RNA, 20 nt, Chlamydia trachomatis
cugucgaacgcuucuuccca

SEQ ID NO: 2490731 - RNA, 22 nt, Chlamydia trachomatis
cugucuaagauuuucaucuucc

SEQ ID NO: 2490732 - RNA, 14 nt, Chlamydia trachomatis
cugucuucuuucaa

SEQ ID NO: 2490733 - RNA, 14 nt, Chlamydia trachomatis
cugucuugucuuug

SEQ ID NO: 2490734 - RNA, 15 nt, Chlamydia trachomatis
cugugaaaugcguga

SEQ ID NO: 2490735 - RNA, 23 nt, Chlamydia trachomatis
cugugaaaugcgugaacuguuca

SEQ ID NO: 2490736 - RNA, 15 nt, Chlamydia trachomatis
cugugaagaaugaaa

SEQ ID NO: 2490737 - RNA, 23 nt, Chlamydia trachomatis
cugugagagagccguuuucaggu

SEQ ID NO: 2490738 - RNA, 18 nt, Chlamydia trachomatis
cugugcaaucagcucucg

SEQ ID NO: 2490739 - RNA, 19 nt, Chlamydia trachomatis
cuguggaaaaauuagggaa

SEQ ID NO: 2490740 - RNA, 24 nt, Chlamydia trachomatis
cuguggacucgcuacauguaguaa

SEQ ID NO: 2490741 - RNA, 23 nt, Chlamydia trachomatis
cuguggagauaaugccuuuugca

SEQ ID NO: 2490742 - RNA, 14 nt, Chlamydia trachomatis
cugugggauagaaa

SEQ ID NO: 2490743 - RNA, 15 nt, Chlamydia trachomatis
cuguguacaaacacu

SEQ ID NO: 2490744 - RNA, 23 nt, Chlamydia trachomatis
cuguguagcaaauaggcgaauuu

SEQ ID NO: 2490745 - RNA, 20 nt, Chlamydia trachomatis
cuguguauuuauauaggcuu

SEQ ID NO: 2490746 - RNA, 17 nt, Chlamydia trachomatis
cugugucucgguuuucu

SEQ ID NO: 2490747 - RNA, 15 nt, Chlamydia trachomatis
cuguguuugauaacg

SEQ ID NO: 2490748 - RNA, 15 nt, Chlamydia trachomatis
cuguuaacugacaau

SEQ ID NO: 2490749 - RNA, 21 nt, Chlamydia trachomatis
cuguuaguagcuucucuucac

SEQ ID NO: 2490750 - RNA, 17 nt, Chlamydia trachomatis
cuguuagugaagagcag

SEQ ID NO: 2490751 - RNA, 21 nt, Chlamydia trachomatis
cuguuauuuguucucuuagaa

SEQ ID NO: 2490752 - RNA, 21 nt, Chlamydia trachomatis
cuguucagaacucaaaauaaa

SEQ ID NO: 2490753 - RNA, 18 nt, Chlamydia trachomatis
cuguuccuaauacuaaac

SEQ ID NO: 2490754 - RNA, 19 nt, Chlamydia trachomatis
cuguuccuaauagaucuac

SEQ ID NO: 2490755 - RNA, 12 nt, Chlamydia trachomatis
cuguuccugaaa

SEQ ID NO: 2490756 - RNA, 15 nt, Chlamydia trachomatis
cuguugacuuuagca

SEQ ID NO: 2490757 - RNA, 16 nt, Chlamydia trachomatis
cuguugugggagauuc

SEQ ID NO: 2490758 - RNA, 21 nt, Chlamydia trachomatis
cuguuuaggaggucgcccucu

SEQ ID NO: 2490759 - RNA, 16 nt, Chlamydia trachomatis
cuguuuaucuucauca

SEQ ID NO: 2490760 - RNA, 17 nt, Chlamydia trachomatis
cuguuucugggaauuca

SEQ ID NO: 2490761 - RNA, 21 nt, Chlamydia trachomatis
cuguuuguuuguuuuuuucaa

SEQ ID NO: 2490762 - RNA, 21 nt, Chlamydia trachomatis
cuguuuuugcaacaaagcuuu

SEQ ID NO: 2490763 - RNA, 15 nt, Chlamydia trachomatis
cuguuuuugcagccu

SEQ ID NO: 2490764 - RNA, 12 nt, Chlamydia trachomatis
cuuaaacaaaaa

SEQ ID NO: 2490765 - RNA, 14 nt, Chlamydia trachomatis
cuuaaacaaaaaua

SEQ ID NO: 2490766 - RNA, 22 nt, Chlamydia trachomatis
cuuaaaggucgagcucccauuu

SEQ ID NO: 2490767 - RNA, 15 nt, Chlamydia trachomatis
cuuaaauauucauau

SEQ ID NO: 2490768 - RNA, 23 nt, Chlamydia trachomatis
cuuaacugcagcaucuauuuucu

SEQ ID NO: 2490769 - RNA, 14 nt, Chlamydia trachomatis
cuuaagcuguucuu

SEQ ID NO: 2490770 - RNA, 22 nt, Chlamydia trachomatis
cuuaauaaagccauacuuacuu

SEQ ID NO: 2490771 - RNA, 20 nt, Chlamydia trachomatis
cuuaauaagggcuuuugcaa

SEQ ID NO: 2490772 - RNA, 16 nt, Chlamydia trachomatis
cuuaaugcuugaacaa

SEQ ID NO: 2490773 - RNA, 23 nt, Chlamydia trachomatis
cuuaauugcagguacuuacccuu

SEQ ID NO: 2490774 - RNA, 19 nt, Chlamydia trachomatis
cuuaauuggagauugccuu

SEQ ID NO: 2490775 - RNA, 23 nt, Chlamydia trachomatis
cuuaauuggagauugccuuuucu

SEQ ID NO: 2490776 - RNA, 19 nt, Chlamydia trachomatis
cuuacaauguaaacaauau

SEQ ID NO: 2490777 - RNA, 20 nt, Chlamydia trachomatis
cuuacaucaggggaauucgc

SEQ ID NO: 2490778 - RNA, 22 nt, Chlamydia trachomatis
cuuacaucaggggaauucgcua

SEQ ID NO: 2490779 - RNA, 16 nt, Chlamydia trachomatis
cuuacaucgagugugu

SEQ ID NO: 2490780 - RNA, 17 nt, Chlamydia trachomatis
cuuacgaccguauuuuu

SEQ ID NO: 2490781 - RNA, 14 nt, Chlamydia trachomatis
cuuacgagcuuucu

SEQ ID NO: 2490782 - RNA, 22 nt, Chlamydia trachomatis
cuuacggaaaguuccaucuccu

SEQ ID NO: 2490783 - RNA, 12 nt, Chlamydia trachomatis
cuuacuccuucu

SEQ ID NO: 2490784 - RNA, 16 nt, Chlamydia trachomatis
cuuacuuaaaaaacaa

SEQ ID NO: 2490785 - RNA, 14 nt, Chlamydia trachomatis
cuuagaauuuuguc

SEQ ID NO: 2490786 - RNA, 14 nt, Chlamydia trachomatis
cuuagagacauuua

SEQ ID NO: 2490787 - RNA, 17 nt, Chlamydia trachomatis
cuuagagacauuuaguu

SEQ ID NO: 2490788 - RNA, 13 nt, Chlamydia trachomatis
cuuagcaaagaaa

SEQ ID NO: 2490789 - RNA, 15 nt, Chlamydia trachomatis
cuuagcccagauuuu

SEQ ID NO: 2490790 - RNA, 13 nt, Chlamydia trachomatis
cuuagcuauauau

SEQ ID NO: 2490791 - RNA, 22 nt, Chlamydia trachomatis
cuuagcuccuaaucuuucuaau

SEQ ID NO: 2490792 - RNA, 19 nt, Chlamydia trachomatis
cuuaggaacucccucauua

SEQ ID NO: 2490793 - RNA, 16 nt, Chlamydia trachomatis
cuuaggaauauguugg

SEQ ID NO: 2490794 - RNA, 21 nt, Chlamydia trachomatis
cuuaggaccuaauaucugcuc

SEQ ID NO: 2490795 - RNA, 21 nt, Chlamydia trachomatis
cuuagugucuucgaauccuaa

SEQ ID NO: 2490796 - RNA, 17 nt, Chlamydia trachomatis
cuuaguuaaaacuccag

SEQ ID NO: 2490797 - RNA, 14 nt, Chlamydia trachomatis
cuuauaacuaagau

SEQ ID NO: 2490798 - RNA, 22 nt, Chlamydia trachomatis
cuuauaacuaagaucuccauga

SEQ ID NO: 2490799 - RNA, 16 nt, Chlamydia trachomatis
cuuauaaucuggauag

SEQ ID NO: 2490800 - RNA, 15 nt, Chlamydia trachomatis
cuuaucguagagauc

SEQ ID NO: 2490801 - RNA, 19 nt, Chlamydia trachomatis
cuuaucguuuggagaauug

SEQ ID NO: 2490802 - RNA, 23 nt, Chlamydia trachomatis
cuuaucuuggguaagaccaaaaa

SEQ ID NO: 2490803 - RNA, 12 nt, Chlamydia trachomatis
cuuauuaaaaga

SEQ ID NO: 2490804 - RNA, 16 nt, Chlamydia trachomatis
cuuauuaaccaacucu

SEQ ID NO: 2490805 - RNA, 18 nt, Chlamydia trachomatis
cuuauuaaccaacucucu

SEQ ID NO: 2490806 - RNA, 18 nt, Chlamydia trachomatis
cuuauuaauuucuagaug

SEQ ID NO: 2490807 - RNA, 21 nt, Chlamydia trachomatis
cuuauuauuacgaacagcaau

SEQ ID NO: 2490808 - RNA, 16 nt, Chlamydia trachomatis
cuuauucucgccccca

SEQ ID NO: 2490809 - RNA, 14 nt, Chlamydia trachomatis
cuuauuuaccuuga

SEQ ID NO: 2490810 - RNA, 16 nt, Chlamydia trachomatis
cuuauuuacgaugauc

SEQ ID NO: 2490811 - RNA, 20 nt, Chlamydia trachomatis
cuuauuugcccagucaagag

SEQ ID NO: 2490812 - RNA, 14 nt, Chlamydia trachomatis
cuucaaaaaagauu

SEQ ID NO: 2490813 - RNA, 17 nt, Chlamydia trachomatis
cuucaaaaaagauuucc

SEQ ID NO: 2490814 - RNA, 18 nt, Chlamydia trachomatis
cuucaaaaaagauuuccc

SEQ ID NO: 2490815 - RNA, 19 nt, Chlamydia trachomatis
cuucaaaaaagauuucccc

SEQ ID NO: 2490816 - RNA, 12 nt, Chlamydia trachomatis
cuucaaaacuaa

SEQ ID NO: 2490817 - RNA, 20 nt, Chlamydia trachomatis
cuucaaccuagauauugacg

SEQ ID NO: 2490818 - RNA, 21 nt, Chlamydia trachomatis
cuucaacuggccuuuuucguu

SEQ ID NO: 2490819 - RNA, 14 nt, Chlamydia trachomatis
cuucaacuucucca

SEQ ID NO: 2490820 - RNA, 16 nt, Chlamydia trachomatis
cuucaagagcuguauu

SEQ ID NO: 2490821 - RNA, 15 nt, Chlamydia trachomatis
cuucaaguucuucuu

SEQ ID NO: 2490822 - RNA, 21 nt, Chlamydia trachomatis
cuucaauaauguugaagucuc

SEQ ID NO: 2490823 - RNA, 18 nt, Chlamydia trachomatis
cuucaauacgacagcaca

SEQ ID NO: 2490824 - RNA, 23 nt, Chlamydia trachomatis
cuucaauagcaggaacuucuuca

SEQ ID NO: 2490825 - RNA, 20 nt, Chlamydia trachomatis
cuucaaucacuccuccuccu

SEQ ID NO: 2490826 - RNA, 13 nt, Chlamydia trachomatis
cuucaaucuguag

SEQ ID NO: 2490827 - RNA, 20 nt, Chlamydia trachomatis
cuucacaaauuuaucugcua

SEQ ID NO: 2490828 - RNA, 21 nt, Chlamydia trachomatis
cuucaccaacuccaagcauua

SEQ ID NO: 2490829 - RNA, 17 nt, Chlamydia trachomatis
cuucacccauaaaaaag

SEQ ID NO: 2490830 - RNA, 22 nt, Chlamydia trachomatis
cuucacccauaaaaaagaggua

SEQ ID NO: 2490831 - RNA, 15 nt, Chlamydia trachomatis
cuucacggagagaaa

SEQ ID NO: 2490832 - RNA, 15 nt, Chlamydia trachomatis
cuucacuuccucucu

SEQ ID NO: 2490833 - RNA, 22 nt, Chlamydia trachomatis
cuucacuuccucucucucaccg

SEQ ID NO: 2490834 - RNA, 17 nt, Chlamydia trachomatis
cuucagaaaucuucuua

SEQ ID NO: 2490835 - RNA, 18 nt, Chlamydia trachomatis
cuucagaaaucuucuuau

SEQ ID NO: 2490836 - RNA, 15 nt, Chlamydia trachomatis
cuucagagguagcca

SEQ ID NO: 2490837 - RNA, 21 nt, Chlamydia trachomatis
cuucagagguagccaaagaau

SEQ ID NO: 2490838 - RNA, 16 nt, Chlamydia trachomatis
cuucagcaacauucac

SEQ ID NO: 2490839 - RNA, 17 nt, Chlamydia trachomatis
cuucagcaacauucacg

SEQ ID NO: 2490840 - RNA, 13 nt, Chlamydia trachomatis
cuucaggaaagcc

SEQ ID NO: 2490841 - RNA, 15 nt, Chlamydia trachomatis
cuucaggauuggaaa

SEQ ID NO: 2490842 - RNA, 14 nt, Chlamydia trachomatis
cuucaggggagaaa

SEQ ID NO: 2490843 - RNA, 19 nt, Chlamydia trachomatis
cuucaggggagaaaacauc

SEQ ID NO: 2490844 - RNA, 23 nt, Chlamydia trachomatis
cuucauaaaacuauggagagggu

SEQ ID NO: 2490845 - RNA, 21 nt, Chlamydia trachomatis
cuucaucaauauucgcaauau

SEQ ID NO: 2490846 - RNA, 24 nt, Chlamydia trachomatis
cuucaucaauauucgcaauauaga

SEQ ID NO: 2490847 - RNA, 15 nt, Chlamydia trachomatis
cuucaugcaauugau

SEQ ID NO: 2490848 - RNA, 20 nt, Chlamydia trachomatis
cuuccaaaggauauacagaa

SEQ ID NO: 2490849 - RNA, 17 nt, Chlamydia trachomatis
cuuccaaauagggucuu

SEQ ID NO: 2490850 - RNA, 21 nt, Chlamydia trachomatis
cuuccaaaucugcaagaacaa

SEQ ID NO: 2490851 - RNA, 16 nt, Chlamydia trachomatis
cuuccaaauuucccuc

SEQ ID NO: 2490852 - RNA, 18 nt, Chlamydia trachomatis
cuuccaaauuucccucuu

SEQ ID NO: 2490853 - RNA, 21 nt, Chlamydia trachomatis
cuuccaaauuucccucuuccc

SEQ ID NO: 2490854 - RNA, 22 nt, Chlamydia trachomatis
cuuccacagaaguuguuggagu

SEQ ID NO: 2490855 - RNA, 21 nt, Chlamydia trachomatis
cuuccaccuugcuuaacacuu

SEQ ID NO: 2490856 - RNA, 17 nt, Chlamydia trachomatis
cuuccagacaaaaagaa

SEQ ID NO: 2490857 - RNA, 17 nt, Chlamydia trachomatis
cuuccagacgcccuccu

SEQ ID NO: 2490858 - RNA, 19 nt, Chlamydia trachomatis
cuuccagccuacaaauaaa

SEQ ID NO: 2490859 - RNA, 20 nt, Chlamydia trachomatis
cuuccagccuacaaauaaag

SEQ ID NO: 2490860 - RNA, 20 nt, Chlamydia trachomatis
cuuccagguucguuauucuc

SEQ ID NO: 2490861 - RNA, 20 nt, Chlamydia trachomatis
cuuccaucguaagcaacaau

SEQ ID NO: 2490862 - RNA, 15 nt, Chlamydia trachomatis
cuuccauggauaaaa

SEQ ID NO: 2490863 - RNA, 15 nt, Chlamydia trachomatis
cuucccacucauccu

SEQ ID NO: 2490864 - RNA, 19 nt, Chlamydia trachomatis
cuucccagcgucuccaaau

SEQ ID NO: 2490865 - RNA, 13 nt, Chlamydia trachomatis
cuuccccaaagca

SEQ ID NO: 2490866 - RNA, 15 nt, Chlamydia trachomatis
cuuccccaaagcagu

SEQ ID NO: 2490867 - RNA, 16 nt, Chlamydia trachomatis
cuuccccauucuucuc

SEQ ID NO: 2490868 - RNA, 22 nt, Chlamydia trachomatis
cuucccgcuauuuuccucuuca

SEQ ID NO: 2490869 - RNA, 18 nt, Chlamydia trachomatis
cuucccuccuagaaagaa

SEQ ID NO: 2490870 - RNA, 20 nt, Chlamydia trachomatis
cuucccuuaaacauacacag

SEQ ID NO: 2490871 - RNA, 18 nt, Chlamydia trachomatis
cuuccgaguaaucaaaaa

SEQ ID NO: 2490872 - RNA, 21 nt, Chlamydia trachomatis
cuuccggauuaucgagaacca

SEQ ID NO: 2490873 - RNA, 16 nt, Chlamydia trachomatis
cuuccguaacaauauu

SEQ ID NO: 2490874 - RNA, 15 nt, Chlamydia trachomatis
cuuccuacagcuaga

SEQ ID NO: 2490875 - RNA, 18 nt, Chlamydia trachomatis
cuuccucuccuucuacaa

SEQ ID NO: 2490876 - RNA, 16 nt, Chlamydia trachomatis
cuuccugagggccuuc

SEQ ID NO: 2490877 - RNA, 12 nt, Chlamydia trachomatis
cuuccugcuuca

SEQ ID NO: 2490878 - RNA, 22 nt, Chlamydia trachomatis
cuuccuuaucuaauuccuucaa

SEQ ID NO: 2490879 - RNA, 12 nt, Chlamydia trachomatis
cuuccuucauac

SEQ ID NO: 2490880 - RNA, 13 nt, Chlamydia trachomatis
cuucgagaauauu

SEQ ID NO: 2490881 - RNA, 12 nt, Chlamydia trachomatis
cuucgagcuguu

SEQ ID NO: 2490882 - RNA, 16 nt, Chlamydia trachomatis
cuucgaggcuccccag

SEQ ID NO: 2490883 - RNA, 15 nt, Chlamydia trachomatis
cuucgauaagaaaaa

SEQ ID NO: 2490884 - RNA, 17 nt, Chlamydia trachomatis
cuucgauaagaaaaaaa

SEQ ID NO: 2490885 - RNA, 17 nt, Chlamydia trachomatis
cuucgcaggggaauaca

SEQ ID NO: 2490886 - RNA, 20 nt, Chlamydia trachomatis
cuucgccgggggagccaaaa

SEQ ID NO: 2490887 - RNA, 17 nt, Chlamydia trachomatis
cuucgcuuccugcauga

SEQ ID NO: 2490888 - RNA, 21 nt, Chlamydia trachomatis
cuucggacauugaacauuuuc

SEQ ID NO: 2490889 - RNA, 18 nt, Chlamydia trachomatis
cuucguuaugagcauuug

SEQ ID NO: 2490890 - RNA, 15 nt, Chlamydia trachomatis
cuucuaacuuuucaa

SEQ ID NO: 2490891 - RNA, 13 nt, Chlamydia trachomatis
cuucuaagaacaa

SEQ ID NO: 2490892 - RNA, 18 nt, Chlamydia trachomatis
cuucuaaguauucuucug

SEQ ID NO: 2490893 - RNA, 19 nt, Chlamydia trachomatis
cuucuaaguauucuucugc

SEQ ID NO: 2490894 - RNA, 22 nt, Chlamydia trachomatis
cuucuagaagaccaaaaaugaa

SEQ ID NO: 2490895 - RNA, 14 nt, Chlamydia trachomatis
cuucuagagauauc

SEQ ID NO: 2490896 - RNA, 15 nt, Chlamydia trachomatis
cuucuauagaaacac

SEQ ID NO: 2490897 - RNA, 20 nt, Chlamydia trachomatis
cuucucccgcuaauuuuuua

SEQ ID NO: 2490898 - RNA, 14 nt, Chlamydia trachomatis
cuucucgcaaaaga

SEQ ID NO: 2490899 - RNA, 16 nt, Chlamydia trachomatis
cuucucgcuacaaauc

SEQ ID NO: 2490900 - RNA, 19 nt, Chlamydia trachomatis
cuucucuaaaugagcgauc

SEQ ID NO: 2490901 - RNA, 15 nt, Chlamydia trachomatis
cuucucuuguucugg

SEQ ID NO: 2490902 - RNA, 20 nt, Chlamydia trachomatis
cuucucuuuucgaacaaaac

SEQ ID NO: 2490903 - RNA, 21 nt, Chlamydia trachomatis
cuucugauaaaugucccugaa

SEQ ID NO: 2490904 - RNA, 13 nt, Chlamydia trachomatis
cuucugcaagaga

SEQ ID NO: 2490905 - RNA, 23 nt, Chlamydia trachomatis
cuucugcaggcucaugaacagca

SEQ ID NO: 2490906 - RNA, 18 nt, Chlamydia trachomatis
cuucugccgaaggcaauu

SEQ ID NO: 2490907 - RNA, 9 nt, Chlamydia trachomatis
cuucugcug

SEQ ID NO: 2490908 - RNA, 13 nt, Chlamydia trachomatis
cuucugcugaaua

SEQ ID NO: 2490909 - RNA, 19 nt, Chlamydia trachomatis
cuucuggaaugcgcaaucc

SEQ ID NO: 2490910 - RNA, 22 nt, Chlamydia trachomatis
cuucuggaaugcgcaauccuuu

SEQ ID NO: 2490911 - RNA, 21 nt, Chlamydia trachomatis
cuucuggagguuuaggagaga

SEQ ID NO: 2490912 - RNA, 18 nt, Chlamydia trachomatis
cuucuguagccccagucu

SEQ ID NO: 2490913 - RNA, 17 nt, Chlamydia trachomatis
cuucugucccuauacga

SEQ ID NO: 2490914 - RNA, 15 nt, Chlamydia trachomatis
cuucuguuuuuucag

SEQ ID NO: 2490915 - RNA, 23 nt, Chlamydia trachomatis
cuucuuacauaagauccaucucu

SEQ ID NO: 2490916 - RNA, 15 nt, Chlamydia trachomatis
cuucuucacccauaa

SEQ ID NO: 2490917 - RNA, 10 nt, Chlamydia trachomatis
cuucuucauc

SEQ ID NO: 2490918 - RNA, 19 nt, Chlamydia trachomatis
cuucuucauguucugugaa

SEQ ID NO: 2490919 - RNA, 14 nt, Chlamydia trachomatis
cuucuuccacagaa

SEQ ID NO: 2490920 - RNA, 13 nt, Chlamydia trachomatis
cuucuuccuucau

SEQ ID NO: 2490921 - RNA, 16 nt, Chlamydia trachomatis
cuucuucgaaaucuuc

SEQ ID NO: 2490922 - RNA, 19 nt, Chlamydia trachomatis
cuucuucuaagcuagaaaa

SEQ ID NO: 2490923 - RNA, 20 nt, Chlamydia trachomatis
cuucuugaaugccuaacgau

SEQ ID NO: 2490924 - RNA, 21 nt, Chlamydia trachomatis
cuucuugaauggcaaggacaa

SEQ ID NO: 2490925 - RNA, 17 nt, Chlamydia trachomatis
cuucuugggauaugccu

SEQ ID NO: 2490926 - RNA, 23 nt, Chlamydia trachomatis
cuucuugucggcaagacucuuuc

SEQ ID NO: 2490927 - RNA, 15 nt, Chlamydia trachomatis
cuucuuguuuuauac

SEQ ID NO: 2490928 - RNA, 18 nt, Chlamydia trachomatis
cuucuuuaaagccuuucu

SEQ ID NO: 2490929 - RNA, 22 nt, Chlamydia trachomatis
cuucuuuagcucgcuucaaaac

SEQ ID NO: 2490930 - RNA, 21 nt, Chlamydia trachomatis
cuucuuuauaaucgaucacag

SEQ ID NO: 2490931 - RNA, 23 nt, Chlamydia trachomatis
cuucuuuauaaucgaucacagaa

SEQ ID NO: 2490932 - RNA, 21 nt, Chlamydia trachomatis
cuucuuucaaagaagcuccuu

SEQ ID NO: 2490933 - RNA, 22 nt, Chlamydia trachomatis
cuucuuucuggaaucauucauc

SEQ ID NO: 2490934 - RNA, 12 nt, Chlamydia trachomatis
cuucuuuuccug

SEQ ID NO: 2490935 - RNA, 13 nt, Chlamydia trachomatis
cuugaaaagaacc

SEQ ID NO: 2490936 - RNA, 23 nt, Chlamydia trachomatis
cuugaaaaggagccuuguaucuu

SEQ ID NO: 2490937 - RNA, 13 nt, Chlamydia trachomatis
cuugaaauucaau

SEQ ID NO: 2490938 - RNA, 20 nt, Chlamydia trachomatis
cuugaagauauucaugugaa

SEQ ID NO: 2490939 - RNA, 13 nt, Chlamydia trachomatis
cuugaaucaaaaa

SEQ ID NO: 2490940 - RNA, 20 nt, Chlamydia trachomatis
cuugaaucaaaaaguucaua

SEQ ID NO: 2490941 - RNA, 20 nt, Chlamydia trachomatis
cuugaauuagguaagcaagu

SEQ ID NO: 2490942 - RNA, 19 nt, Chlamydia trachomatis
cuugagaacaaaccaucug

SEQ ID NO: 2490943 - RNA, 22 nt, Chlamydia trachomatis
cuugagaacaaaccaucuguaa

SEQ ID NO: 2490944 - RNA, 19 nt, Chlamydia trachomatis
cuugagaauccaaauuuug

SEQ ID NO: 2490945 - RNA, 18 nt, Chlamydia trachomatis
cuugagagaccugcuuca

SEQ ID NO: 2490946 - RNA, 16 nt, Chlamydia trachomatis
cuugagagcauucuuc

SEQ ID NO: 2490947 - RNA, 22 nt, Chlamydia trachomatis
cuugagagcauucuucugaaca

SEQ ID NO: 2490948 - RNA, 23 nt, Chlamydia trachomatis
cuugagagccuaugcgugucaca

SEQ ID NO: 2490949 - RNA, 13 nt, Chlamydia trachomatis
cuugagauacaac

SEQ ID NO: 2490950 - RNA, 21 nt, Chlamydia trachomatis
cuugagcgucuuuaaguccag

SEQ ID NO: 2490951 - RNA, 20 nt, Chlamydia trachomatis
cuugaggaagagagaacaaa

SEQ ID NO: 2490952 - RNA, 23 nt, Chlamydia trachomatis
cuugaggaagauaaguccuccua

SEQ ID NO: 2490953 - RNA, 21 nt, Chlamydia trachomatis
cuugaguccgcaaacaaaaua

SEQ ID NO: 2490954 - RNA, 23 nt, Chlamydia trachomatis
cuugaguccgcaaacaaaauaau

SEQ ID NO: 2490955 - RNA, 13 nt, Chlamydia trachomatis
cuugauaaauaau

SEQ ID NO: 2490956 - RNA, 23 nt, Chlamydia trachomatis
cuugauauucccuucuauuucuc

SEQ ID NO: 2490957 - RNA, 21 nt, Chlamydia trachomatis
cuugaucggagucugcuccac

SEQ ID NO: 2490958 - RNA, 22 nt, Chlamydia trachomatis
cuugaugaauuuuaucuaaaaa

SEQ ID NO: 2490959 - RNA, 14 nt, Chlamydia trachomatis
cuugauucuugaau

SEQ ID NO: 2490960 - RNA, 13 nt, Chlamydia trachomatis
cuugauuucuuuc

SEQ ID NO: 2490961 - RNA, 18 nt, Chlamydia trachomatis
cuugcaacucuuauaaca

SEQ ID NO: 2490962 - RNA, 17 nt, Chlamydia trachomatis
cuugcagaacagcucua

SEQ ID NO: 2490963 - RNA, 18 nt, Chlamydia trachomatis
cuugcagagggccuccca

SEQ ID NO: 2490964 - RNA, 12 nt, Chlamydia trachomatis
cuugccucuuca

SEQ ID NO: 2490965 - RNA, 19 nt, Chlamydia trachomatis
cuugcgaugccucuaacac

SEQ ID NO: 2490966 - RNA, 22 nt, Chlamydia trachomatis
cuugcgaugccucuaacacuuu

SEQ ID NO: 2490967 - RNA, 16 nt, Chlamydia trachomatis
cuugcguuuucuugug

SEQ ID NO: 2490968 - RNA, 18 nt, Chlamydia trachomatis
cuugcuauccugcucaac

SEQ ID NO: 2490969 - RNA, 17 nt, Chlamydia trachomatis
cuugcugguccauggaa

SEQ ID NO: 2490970 - RNA, 21 nt, Chlamydia trachomatis
cuugcugguccauggaacgau

SEQ ID NO: 2490971 - RNA, 14 nt, Chlamydia trachomatis
cuuggaauacauca

SEQ ID NO: 2490972 - RNA, 20 nt, Chlamydia trachomatis
cuuggaauagguugccuuua

SEQ ID NO: 2490973 - RNA, 22 nt, Chlamydia trachomatis
cuuggaccauaaaacuuguucc

SEQ ID NO: 2490974 - RNA, 13 nt, Chlamydia trachomatis
cuuggauuucuuc

SEQ ID NO: 2490975 - RNA, 10 nt, Chlamydia trachomatis
cuuggcaggc

SEQ ID NO: 2490976 - RNA, 19 nt, Chlamydia trachomatis
cuuggcggauaucuucuug

SEQ ID NO: 2490977 - RNA, 17 nt, Chlamydia trachomatis
cuuggcgguuuuuuucg

SEQ ID NO: 2490978 - RNA, 23 nt, Chlamydia trachomatis
cuuggcuugcgcaaucauaucaa

SEQ ID NO: 2490979 - RNA, 20 nt, Chlamydia trachomatis
cuuggggcgggcgacaugcu

SEQ ID NO: 2490980 - RNA, 22 nt, Chlamydia trachomatis
cuugguaaaguaguugaauaua

SEQ ID NO: 2490981 - RNA, 15 nt, Chlamydia trachomatis
cuuggucgcauuuga

SEQ ID NO: 2490982 - RNA, 23 nt, Chlamydia trachomatis
cuuggugagggacgcgucucccu

SEQ ID NO: 2490983 - RNA, 14 nt, Chlamydia trachomatis
cuuguacagcgaca

SEQ ID NO: 2490984 - RNA, 23 nt, Chlamydia trachomatis
cuuguacagcgacacguuuuccu

SEQ ID NO: 2490985 - RNA, 14 nt, Chlamydia trachomatis
cuuguagaaaaaga

SEQ ID NO: 2490986 - RNA, 17 nt, Chlamydia trachomatis
cuuguagaaaaagaugg

SEQ ID NO: 2490987 - RNA, 18 nt, Chlamydia trachomatis
cuuguagagaggcaaaca

SEQ ID NO: 2490988 - RNA, 14 nt, Chlamydia trachomatis
cuuguauagcuuca

SEQ ID NO: 2490989 - RNA, 20 nt, Chlamydia trachomatis
cuuguaucgcaagguugacu

SEQ ID NO: 2490990 - RNA, 18 nt, Chlamydia trachomatis
cuugucaaacuaggcaau

SEQ ID NO: 2490991 - RNA, 18 nt, Chlamydia trachomatis
cuugucggucgcauucca

SEQ ID NO: 2490992 - RNA, 16 nt, Chlamydia trachomatis
cuugucguuccucuag

SEQ ID NO: 2490993 - RNA, 13 nt, Chlamydia trachomatis
cuugucuccuucu

SEQ ID NO: 2490994 - RNA, 16 nt, Chlamydia trachomatis
cuugucuccuucuuug

SEQ ID NO: 2490995 - RNA, 20 nt, Chlamydia trachomatis
cuugucucucgaauagcucc

SEQ ID NO: 2490996 - RNA, 23 nt, Chlamydia trachomatis
cuuguguugagccccuugaaagg

SEQ ID NO: 2490997 - RNA, 20 nt, Chlamydia trachomatis
cuuguucgguauugaaagca

SEQ ID NO: 2490998 - RNA, 14 nt, Chlamydia trachomatis
cuuguucugcugcu

SEQ ID NO: 2490999 - RNA, 14 nt, Chlamydia trachomatis
cuuguuucaaagau

SEQ ID NO: 2491000 - RNA, 20 nt, Chlamydia trachomatis
cuuguuuuauacucuaaaag

SEQ ID NO: 2491001 - RNA, 17 nt, Chlamydia trachomatis
cuuuaaaagcugcuuua

SEQ ID NO: 2491002 - RNA, 14 nt, Chlamydia trachomatis
cuuuaaagaaagcc

SEQ ID NO: 2491003 - RNA, 13 nt, Chlamydia trachomatis
cuuuaaaugcugc

SEQ ID NO: 2491004 - RNA, 14 nt, Chlamydia trachomatis
cuuuaacaagacaa

SEQ ID NO: 2491005 - RNA, 12 nt, Chlamydia trachomatis
cuuuaacaucuu

SEQ ID NO: 2491006 - RNA, 16 nt, Chlamydia trachomatis
cuuuaagguacuucua

SEQ ID NO: 2491007 - RNA, 14 nt, Chlamydia trachomatis
cuuuaauauuuccc

SEQ ID NO: 2491008 - RNA, 15 nt, Chlamydia trachomatis
cuuuaauauuuccca

SEQ ID NO: 2491009 - RNA, 18 nt, Chlamydia trachomatis
cuuuacaaugaugagaau

SEQ ID NO: 2491010 - RNA, 20 nt, Chlamydia trachomatis
cuuuacaaugaugagaaugu

SEQ ID NO: 2491011 - RNA, 23 nt, Chlamydia trachomatis
cuuuacaucccuugaacuagaaa

SEQ ID NO: 2491012 - RNA, 15 nt, Chlamydia trachomatis
cuuuaccaaagaauu

SEQ ID NO: 2491013 - RNA, 17 nt, Chlamydia trachomatis
cuuuacuuucuuugcua

SEQ ID NO: 2491014 - RNA, 16 nt, Chlamydia trachomatis
cuuuagaaauaguaaa

SEQ ID NO: 2491015 - RNA, 14 nt, Chlamydia trachomatis
cuuuagaagaaaag

SEQ ID NO: 2491016 - RNA, 18 nt, Chlamydia trachomatis
cuuuagaauccaaagucu

SEQ ID NO: 2491017 - RNA, 17 nt, Chlamydia trachomatis
cuuuagauuuguuuaaa

SEQ ID NO: 2491018 - RNA, 16 nt, Chlamydia trachomatis
cuuuagcgcacuuaau

SEQ ID NO: 2491019 - RNA, 16 nt, Chlamydia trachomatis
cuuuaggagaaagaau

SEQ ID NO: 2491020 - RNA, 23 nt, Chlamydia trachomatis
cuuuaggcgaauaagcucgcccu

SEQ ID NO: 2491021 - RNA, 16 nt, Chlamydia trachomatis
cuuuauccaaagauag

SEQ ID NO: 2491022 - RNA, 14 nt, Chlamydia trachomatis
cuuuaucucccccu

SEQ ID NO: 2491023 - RNA, 23 nt, Chlamydia trachomatis
cuuuaugacuguugaugaugucc

SEQ ID NO: 2491024 - RNA, 15 nt, Chlamydia trachomatis
cuuuauuaaacuccc

SEQ ID NO: 2491025 - RNA, 21 nt, Chlamydia trachomatis
cuuucaaagagaucugcauuc

SEQ ID NO: 2491026 - RNA, 16 nt, Chlamydia trachomatis
cuuucaauagcauuuc

SEQ ID NO: 2491027 - RNA, 17 nt, Chlamydia trachomatis
cuuucacauuaucucga

SEQ ID NO: 2491028 - RNA, 15 nt, Chlamydia trachomatis
cuuucaugcgaagca

SEQ ID NO: 2491029 - RNA, 18 nt, Chlamydia trachomatis
cuuucauucguuucuucc

SEQ ID NO: 2491030 - RNA, 12 nt, Chlamydia trachomatis
cuuucauucuuu

SEQ ID NO: 2491031 - RNA, 20 nt, Chlamydia trachomatis
cuuuccaagaaucaaaaagu

SEQ ID NO: 2491032 - RNA, 21 nt, Chlamydia trachomatis
cuuuccaagaaucaaaaaguu

SEQ ID NO: 2491033 - RNA, 21 nt, Chlamydia trachomatis
cuuuccaauaucuucagaagc

SEQ ID NO: 2491034 - RNA, 11 nt, Chlamydia trachomatis
cuuuccauaca

SEQ ID NO: 2491035 - RNA, 18 nt, Chlamydia trachomatis
cuuucccccaccuuuucu

SEQ ID NO: 2491036 - RNA, 18 nt, Chlamydia trachomatis
cuuucccguauuuaccaa

SEQ ID NO: 2491037 - RNA, 13 nt, Chlamydia trachomatis
cuuucccuauuuu

SEQ ID NO: 2491038 - RNA, 24 nt, Chlamydia trachomatis
cuuuccuagcgaagucuucuauca

SEQ ID NO: 2491039 - RNA, 18 nt, Chlamydia trachomatis
cuuuccucacacacaaaa

SEQ ID NO: 2491040 - RNA, 15 nt, Chlamydia trachomatis
cuuucguuagaaagg

SEQ ID NO: 2491041 - RNA, 16 nt, Chlamydia trachomatis
cuuucguuucuccaga

SEQ ID NO: 2491042 - RNA, 24 nt, Chlamydia trachomatis
cuuucuaaagcagcuaaccaugcu

SEQ ID NO: 2491043 - RNA, 22 nt, Chlamydia trachomatis
cuuucucgcaauauauccaucu

SEQ ID NO: 2491044 - RNA, 21 nt, Chlamydia trachomatis
cuuucucuaaaagaagagcgg

SEQ ID NO: 2491045 - RNA, 19 nt, Chlamydia trachomatis
cuuucucuagaauuucccu

SEQ ID NO: 2491046 - RNA, 20 nt, Chlamydia trachomatis
cuuucuuacgaccguauuuu

SEQ ID NO: 2491047 - RNA, 22 nt, Chlamydia trachomatis
cuuucuuacgaccguauuuuuu

SEQ ID NO: 2491048 - RNA, 16 nt, Chlamydia trachomatis
cuuucuuacuccuucu

SEQ ID NO: 2491049 - RNA, 21 nt, Chlamydia trachomatis
cuuucuuaguuugugaugagg

SEQ ID NO: 2491050 - RNA, 22 nt, Chlamydia trachomatis
cuuucuuaguuugugaugaggc

SEQ ID NO: 2491051 - RNA, 16 nt, Chlamydia trachomatis
cuuucuuugcuauuug

SEQ ID NO: 2491052 - RNA, 13 nt, Chlamydia trachomatis
cuuugaacauuua

SEQ ID NO: 2491053 - RNA, 15 nt, Chlamydia trachomatis
cuuugaacauuuauc

SEQ ID NO: 2491054 - RNA, 21 nt, Chlamydia trachomatis
cuuugaagccucgcuuuugcg

SEQ ID NO: 2491055 - RNA, 13 nt, Chlamydia trachomatis
cuuugaagcgcuu

SEQ ID NO: 2491056 - RNA, 16 nt, Chlamydia trachomatis
cuuugacgacaacaug

SEQ ID NO: 2491057 - RNA, 19 nt, Chlamydia trachomatis
cuuugaggacugacagaag

SEQ ID NO: 2491058 - RNA, 21 nt, Chlamydia trachomatis
cuuugauaauacucuucuauc

SEQ ID NO: 2491059 - RNA, 16 nt, Chlamydia trachomatis
cuuugaucuuuguucu

SEQ ID NO: 2491060 - RNA, 16 nt, Chlamydia trachomatis
cuuugauuaaccaaaa

SEQ ID NO: 2491061 - RNA, 15 nt, Chlamydia trachomatis
cuuugcacaccugcu

SEQ ID NO: 2491062 - RNA, 21 nt, Chlamydia trachomatis
cuuugcauuuaaaugaaugug

SEQ ID NO: 2491063 - RNA, 20 nt, Chlamydia trachomatis
cuuugcuaucagcauacaga

SEQ ID NO: 2491064 - RNA, 20 nt, Chlamydia trachomatis
cuuugcucuuggucuuuauu

SEQ ID NO: 2491065 - RNA, 22 nt, Chlamydia trachomatis
cuuuggaagcagaaagaaugcu

SEQ ID NO: 2491066 - RNA, 23 nt, Chlamydia trachomatis
cuuuggauuugugugcaaaucac

SEQ ID NO: 2491067 - RNA, 19 nt, Chlamydia trachomatis
cuuugggauagauagcucc

SEQ ID NO: 2491068 - RNA, 17 nt, Chlamydia trachomatis
cuuugguaagaucucua

SEQ ID NO: 2491069 - RNA, 16 nt, Chlamydia trachomatis
cuuuguaaaauaccua

SEQ ID NO: 2491070 - RNA, 23 nt, Chlamydia trachomatis
cuuuguaaaauaccuaaagaagc

SEQ ID NO: 2491071 - RNA, 16 nt, Chlamydia trachomatis
cuuuguacaugauaau

SEQ ID NO: 2491072 - RNA, 23 nt, Chlamydia trachomatis
cuuugucaugacucggaauaaga

SEQ ID NO: 2491073 - RNA, 14 nt, Chlamydia trachomatis
cuuugucuauaagg

SEQ ID NO: 2491074 - RNA, 15 nt, Chlamydia trachomatis
cuuugugcaaccucu

SEQ ID NO: 2491075 - RNA, 20 nt, Chlamydia trachomatis
cuuuguuauuuuuuaagaag

SEQ ID NO: 2491076 - RNA, 13 nt, Chlamydia trachomatis
cuuuguucacaga

SEQ ID NO: 2491077 - RNA, 18 nt, Chlamydia trachomatis
cuuuguucacagaaaguc

SEQ ID NO: 2491078 - RNA, 19 nt, Chlamydia trachomatis
cuuuguucacagaaagucc

SEQ ID NO: 2491079 - RNA, 19 nt, Chlamydia trachomatis
cuuuguucucuaaagauuc

SEQ ID NO: 2491080 - RNA, 14 nt, Chlamydia trachomatis
cuuuuaauacuuua

SEQ ID NO: 2491081 - RNA, 17 nt, Chlamydia trachomatis
cuuuuacuuccguuucu

SEQ ID NO: 2491082 - RNA, 18 nt, Chlamydia trachomatis
cuuuuacuuugaaauguc

SEQ ID NO: 2491083 - RNA, 20 nt, Chlamydia trachomatis
cuuuuagcccuccuacucca

SEQ ID NO: 2491084 - RNA, 17 nt, Chlamydia trachomatis
cuuuuaggcaacagcuc

SEQ ID NO: 2491085 - RNA, 16 nt, Chlamydia trachomatis
cuuuuaggugcgcaua

SEQ ID NO: 2491086 - RNA, 12 nt, Chlamydia trachomatis
cuuuuaucuucu

SEQ ID NO: 2491087 - RNA, 14 nt, Chlamydia trachomatis
cuuuuaucuucuua

SEQ ID NO: 2491088 - RNA, 13 nt, Chlamydia trachomatis
cuuuucaaaauga

SEQ ID NO: 2491089 - RNA, 23 nt, Chlamydia trachomatis
cuuuucaacaauccacccacaac

SEQ ID NO: 2491090 - RNA, 14 nt, Chlamydia trachomatis
cuuuucaaguucua

SEQ ID NO: 2491091 - RNA, 15 nt, Chlamydia trachomatis
cuuuucaauauaagc

SEQ ID NO: 2491092 - RNA, 21 nt, Chlamydia trachomatis
cuuuucacaagguguccugua

SEQ ID NO: 2491093 - RNA, 14 nt, Chlamydia trachomatis
cuuuucagcaagaa

SEQ ID NO: 2491094 - RNA, 15 nt, Chlamydia trachomatis
cuuuucagcuuuucu

SEQ ID NO: 2491095 - RNA, 16 nt, Chlamydia trachomatis
cuuuucagcuuuucuu

SEQ ID NO: 2491096 - RNA, 13 nt, Chlamydia trachomatis
cuuuuccacauua

SEQ ID NO: 2491097 - RNA, 18 nt, Chlamydia trachomatis
cuuuuccauauucuugcu

SEQ ID NO: 2491098 - RNA, 23 nt, Chlamydia trachomatis
cuuuuccaucuuuaaagaggauc

SEQ ID NO: 2491099 - RNA, 10 nt, Chlamydia trachomatis
cuuuuccauu

SEQ ID NO: 2491100 - RNA, 16 nt, Chlamydia trachomatis
cuuuuccauuccuccu

SEQ ID NO: 2491101 - RNA, 17 nt, Chlamydia trachomatis
cuuuuccauuccuccua

SEQ ID NO: 2491102 - RNA, 23 nt, Chlamydia trachomatis
cuuuuccgaauuaaaucugcucc

SEQ ID NO: 2491103 - RNA, 13 nt, Chlamydia trachomatis
cuuuuccuccaua

SEQ ID NO: 2491104 - RNA, 23 nt, Chlamydia trachomatis
cuuuuccugggaggacuucuacg

SEQ ID NO: 2491105 - RNA, 21 nt, Chlamydia trachomatis
cuuuucgaacaaaacuugucu

SEQ ID NO: 2491106 - RNA, 18 nt, Chlamydia trachomatis
cuuuucggugaggaaggc

SEQ ID NO: 2491107 - RNA, 19 nt, Chlamydia trachomatis
cuuuucuaacguuccuccu

SEQ ID NO: 2491108 - RNA, 22 nt, Chlamydia trachomatis
cuuuucuagagaagagagcauc

SEQ ID NO: 2491109 - RNA, 17 nt, Chlamydia trachomatis
cuuuucuauuucauuua

SEQ ID NO: 2491110 - RNA, 12 nt, Chlamydia trachomatis
cuuuucuauuuu

SEQ ID NO: 2491111 - RNA, 13 nt, Chlamydia trachomatis
cuuuucuauuuuu

SEQ ID NO: 2491112 - RNA, 22 nt, Chlamydia trachomatis
cuuuucugagacuccagcuucu

SEQ ID NO: 2491113 - RNA, 23 nt, Chlamydia trachomatis
cuuuucugagacuccagcuucuc

SEQ ID NO: 2491114 - RNA, 14 nt, Chlamydia trachomatis
cuuuucuucccuga

SEQ ID NO: 2491115 - RNA, 22 nt, Chlamydia trachomatis
cuuuucuuuuuuguguuucuug

SEQ ID NO: 2491116 - RNA, 20 nt, Chlamydia trachomatis
cuuuugaaacaucuuuuaaa

SEQ ID NO: 2491117 - RNA, 22 nt, Chlamydia trachomatis
cuuuugaagauggagauggagu

SEQ ID NO: 2491118 - RNA, 15 nt, Chlamydia trachomatis
cuuuugcaaaaauuu

SEQ ID NO: 2491119 - RNA, 17 nt, Chlamydia trachomatis
cuuuugcaaaaauuuuc

SEQ ID NO: 2491120 - RNA, 14 nt, Chlamydia trachomatis
cuuuugcauuucca

SEQ ID NO: 2491121 - RNA, 13 nt, Chlamydia trachomatis
cuuuugcugcuuc

SEQ ID NO: 2491122 - RNA, 21 nt, Chlamydia trachomatis
cuuuuggaagaucucuuucuc

SEQ ID NO: 2491123 - RNA, 23 nt, Chlamydia trachomatis
cuuuugguucugccaguuaauca

SEQ ID NO: 2491124 - RNA, 15 nt, Chlamydia trachomatis
cuuuuguuugcacaa

SEQ ID NO: 2491125 - RNA, 13 nt, Chlamydia trachomatis
cuuuuguuuucuu

SEQ ID NO: 2491126 - RNA, 15 nt, Chlamydia trachomatis
cuuuuuaaaucaauu

SEQ ID NO: 2491127 - RNA, 15 nt, Chlamydia trachomatis
cuuuuuaauuuucug

SEQ ID NO: 2491128 - RNA, 16 nt, Chlamydia trachomatis
cuuuuuaggauucaua

SEQ ID NO: 2491129 - RNA, 22 nt, Chlamydia trachomatis
cuuuuuauccuacgguaucaau

SEQ ID NO: 2491130 - RNA, 15 nt, Chlamydia trachomatis
cuuuuuccucagcau

SEQ ID NO: 2491131 - RNA, 17 nt, Chlamydia trachomatis
cuuuuucuacuguagca

SEQ ID NO: 2491132 - RNA, 16 nt, Chlamydia trachomatis
cuuuuucucuggaaca

SEQ ID NO: 2491133 - RNA, 12 nt, Chlamydia trachomatis
cuuuuucuucuc

SEQ ID NO: 2491134 - RNA, 13 nt, Chlamydia trachomatis
cuuuuugcacaaa

SEQ ID NO: 2491135 - RNA, 15 nt, Chlamydia trachomatis
cuuuuugcacaaaaa

SEQ ID NO: 2491136 - RNA, 21 nt, Chlamydia trachomatis
cuuuuuggacgaggguuuaaa

SEQ ID NO: 2491137 - RNA, 15 nt, Chlamydia trachomatis
cuuuuuuuauaaagg

SEQ ID NO: 2491138 - RNA, 24 nt, Chlamydia trachomatis
cuuuuuuucccuagaaaaucuauu

SEQ ID NO: 2491139 - RNA, 14 nt, Chlamydia trachomatis
cuuuuuuuuuagaa

SEQ ID NO: 2491140 - RNA, 22 nt, Chlamydia trachomatis
cuuuuuuuuugugcaaaaagca

SEQ ID NO: 2491141 - RNA, 14 nt, Chlamydia trachomatis
gaaaaaaacagcuc

SEQ ID NO: 2491142 - RNA, 11 nt, Chlamydia trachomatis
gaaaaaaagag

SEQ ID NO: 2491143 - RNA, 13 nt, Chlamydia trachomatis
gaaaaaauaaugg

SEQ ID NO: 2491144 - RNA, 16 nt, Chlamydia trachomatis
gaaaaacagaaagaaa

SEQ ID NO: 2491145 - RNA, 17 nt, Chlamydia trachomatis
gaaaaacagaaagaaau

SEQ ID NO: 2491146 - RNA, 12 nt, Chlamydia trachomatis
gaaaaagagaaa

SEQ ID NO: 2491147 - RNA, 13 nt, Chlamydia trachomatis
gaaaaagagaaau

SEQ ID NO: 2491148 - RNA, 13 nt, Chlamydia trachomatis
gaaaaagguauua

SEQ ID NO: 2491149 - RNA, 12 nt, Chlamydia trachomatis
gaaaaagucaag

SEQ ID NO: 2491150 - RNA, 13 nt, Chlamydia trachomatis
gaaaaaucuccuc

SEQ ID NO: 2491151 - RNA, 19 nt, Chlamydia trachomatis
gaaaagaguuugugauuua

SEQ ID NO: 2491152 - RNA, 23 nt, Chlamydia trachomatis
gaaaagccuucuuucaaaagaag

SEQ ID NO: 2491153 - RNA, 18 nt, Chlamydia trachomatis
gaaaagcuccuagagcca

SEQ ID NO: 2491154 - RNA, 17 nt, Chlamydia trachomatis
gaaaauacacagcauca

SEQ ID NO: 2491155 - RNA, 21 nt, Chlamydia trachomatis
gaaaauacacagcaucaagaa

SEQ ID NO: 2491156 - RNA, 20 nt, Chlamydia trachomatis
gaaaauacgcgcgcuaagac

SEQ ID NO: 2491157 - RNA, 16 nt, Chlamydia trachomatis
gaaaauacggaagagu

SEQ ID NO: 2491158 - RNA, 14 nt, Chlamydia trachomatis
gaaaauagcaucuc

SEQ ID NO: 2491159 - RNA, 18 nt, Chlamydia trachomatis
gaaaauagcaucucugua

SEQ ID NO: 2491160 - RNA, 16 nt, Chlamydia trachomatis
gaaaauagguaaagaa

SEQ ID NO: 2491161 - RNA, 17 nt, Chlamydia trachomatis
gaaaauagguaaagaag

SEQ ID NO: 2491162 - RNA, 22 nt, Chlamydia trachomatis
gaaaauauggcucccagagaau

SEQ ID NO: 2491163 - RNA, 19 nt, Chlamydia trachomatis
gaaaaucauacauccuaca

SEQ ID NO: 2491164 - RNA, 18 nt, Chlamydia trachomatis
gaaaauccccuccuucuu

SEQ ID NO: 2491165 - RNA, 16 nt, Chlamydia trachomatis
gaaaaucuauuuucga

SEQ ID NO: 2491166 - RNA, 18 nt, Chlamydia trachomatis
gaaacaaggcuaagaaag

SEQ ID NO: 2491167 - RNA, 17 nt, Chlamydia trachomatis
gaaacacaccgggagca

SEQ ID NO: 2491168 - RNA, 12 nt, Chlamydia trachomatis
gaaacaggagaa

SEQ ID NO: 2491169 - RNA, 11 nt, Chlamydia trachomatis
gaaacauucca

SEQ ID NO: 2491170 - RNA, 13 nt, Chlamydia trachomatis
gaaaccaacaaga

SEQ ID NO: 2491171 - RNA, 13 nt, Chlamydia trachomatis
gaaacccaacgca

SEQ ID NO: 2491172 - RNA, 23 nt, Chlamydia trachomatis
gaaacccaacgcaucuccaaaga

SEQ ID NO: 2491173 - RNA, 18 nt, Chlamydia trachomatis
gaaaccccucuuucucuc

SEQ ID NO: 2491174 - RNA, 20 nt, Chlamydia trachomatis
gaaaccgcaagucucugcca

SEQ ID NO: 2491175 - RNA, 22 nt, Chlamydia trachomatis
gaaacgacaggcuauugauacu

SEQ ID NO: 2491176 - RNA, 18 nt, Chlamydia trachomatis
gaaacuaaaucucuugga

SEQ ID NO: 2491177 - RNA, 22 nt, Chlamydia trachomatis
gaaacuaaaucucuuggagaga

SEQ ID NO: 2491178 - RNA, 12 nt, Chlamydia trachomatis
gaaacucaucuu

SEQ ID NO: 2491179 - RNA, 19 nt, Chlamydia trachomatis
gaaacucaucuucggacau

SEQ ID NO: 2491180 - RNA, 20 nt, Chlamydia trachomatis
gaaacucuuacgagcuuucu

SEQ ID NO: 2491181 - RNA, 22 nt, Chlamydia trachomatis
gaaacucuuacgagcuuucuua

SEQ ID NO: 2491182 - RNA, 13 nt, Chlamydia trachomatis
gaaacucuuuuua

SEQ ID NO: 2491183 - RNA, 12 nt, Chlamydia trachomatis
gaaacugaaaga

SEQ ID NO: 2491184 - RNA, 13 nt, Chlamydia trachomatis
gaaacuguaaugu

SEQ ID NO: 2491185 - RNA, 20 nt, Chlamydia trachomatis
gaaacuguaauguccucuuu

SEQ ID NO: 2491186 - RNA, 19 nt, Chlamydia trachomatis
gaaacugucggugaaagcu

SEQ ID NO: 2491187 - RNA, 23 nt, Chlamydia trachomatis
gaaacugucggugaaagcuagaa

SEQ ID NO: 2491188 - RNA, 19 nt, Chlamydia trachomatis
gaaacuuacuuuucuuagu

SEQ ID NO: 2491189 - RNA, 15 nt, Chlamydia trachomatis
gaaacuucccacgga

SEQ ID NO: 2491190 - RNA, 14 nt, Chlamydia trachomatis
gaaacuuggucagc

SEQ ID NO: 2491191 - RNA, 17 nt, Chlamydia trachomatis
gaaagaaccucaauagc

SEQ ID NO: 2491192 - RNA, 21 nt, Chlamydia trachomatis
gaaagagcuuagcucccugcu

SEQ ID NO: 2491193 - RNA, 23 nt, Chlamydia trachomatis
gaaagaggauagaucaagaaaag

SEQ ID NO: 2491194 - RNA, 19 nt, Chlamydia trachomatis
gaaagaggcuucgauaaga

SEQ ID NO: 2491195 - RNA, 18 nt, Chlamydia trachomatis
gaaagagggguuucauuu

SEQ ID NO: 2491196 - RNA, 22 nt, Chlamydia trachomatis
gaaagauuugaucuucuggaau

SEQ ID NO: 2491197 - RNA, 16 nt, Chlamydia trachomatis
gaaagcauccccaaaa

SEQ ID NO: 2491198 - RNA, 13 nt, Chlamydia trachomatis
gaaagccuaucgc

SEQ ID NO: 2491199 - RNA, 19 nt, Chlamydia trachomatis
gaaaggucugcauauuuaa

SEQ ID NO: 2491200 - RNA, 17 nt, Chlamydia trachomatis
gaaaguaaaauuccuga

SEQ ID NO: 2491201 - RNA, 14 nt, Chlamydia trachomatis
gaaaguagcuacuu

SEQ ID NO: 2491202 - RNA, 15 nt, Chlamydia trachomatis
gaaaguccaagauua

SEQ ID NO: 2491203 - RNA, 17 nt, Chlamydia trachomatis
gaaagucguacagaucu

SEQ ID NO: 2491204 - RNA, 19 nt, Chlamydia trachomatis
gaaaguuccgguauauucu

SEQ ID NO: 2491205 - RNA, 21 nt, Chlamydia trachomatis
gaaaguugcucccaauauaca

SEQ ID NO: 2491206 - RNA, 15 nt, Chlamydia trachomatis
gaaauaaaaaccuug

SEQ ID NO: 2491207 - RNA, 19 nt, Chlamydia trachomatis
gaaauacgguauacacuau

SEQ ID NO: 2491208 - RNA, 14 nt, Chlamydia trachomatis
gaaauaggauuuaa

SEQ ID NO: 2491209 - RNA, 15 nt, Chlamydia trachomatis
gaaauaugacagagc

SEQ ID NO: 2491210 - RNA, 16 nt, Chlamydia trachomatis
gaaaucagaugccauc

SEQ ID NO: 2491211 - RNA, 20 nt, Chlamydia trachomatis
gaaaucauuaccagcggcuu

SEQ ID NO: 2491212 - RNA, 20 nt, Chlamydia trachomatis
gaaauccccagucucuccau

SEQ ID NO: 2491213 - RNA, 19 nt, Chlamydia trachomatis
gaaauccuaaaaaaaacca

SEQ ID NO: 2491214 - RNA, 23 nt, Chlamydia trachomatis
gaaaucuucggcagaagcugcag

SEQ ID NO: 2491215 - RNA, 20 nt, Chlamydia trachomatis
gaaaucuuuuacuggagaac

SEQ ID NO: 2491216 - RNA, 14 nt, Chlamydia trachomatis
gaaaugaaggccaa

SEQ ID NO: 2491217 - RNA, 16 nt, Chlamydia trachomatis
gaaaugaauuccaagu

SEQ ID NO: 2491218 - RNA, 14 nt, Chlamydia trachomatis
gaaaugacacacau

SEQ ID NO: 2491219 - RNA, 14 nt, Chlamydia trachomatis
gaaaugaggacaga

SEQ ID NO: 2491220 - RNA, 14 nt, Chlamydia trachomatis
gaaauggucucuuc

SEQ ID NO: 2491221 - RNA, 19 nt, Chlamydia trachomatis
gaaauguugugugaugaac

SEQ ID NO: 2491222 - RNA, 17 nt, Chlamydia trachomatis
gaaauuaguaauaaagg

SEQ ID NO: 2491223 - RNA, 23 nt, Chlamydia trachomatis
gaaauucucggccuuaacaugau

SEQ ID NO: 2491224 - RNA, 16 nt, Chlamydia trachomatis
gaaauucuucaucuau

SEQ ID NO: 2491225 - RNA, 16 nt, Chlamydia trachomatis
gaaauugcucaggaau

SEQ ID NO: 2491226 - RNA, 16 nt, Chlamydia trachomatis
gaacaaaccaucugua

SEQ ID NO: 2491227 - RNA, 20 nt, Chlamydia trachomatis
gaacaaaccaucuguaaagc

SEQ ID NO: 2491228 - RNA, 17 nt, Chlamydia trachomatis
gaacaaccuucugacug

SEQ ID NO: 2491229 - RNA, 14 nt, Chlamydia trachomatis
gaacaacuucucuu

SEQ ID NO: 2491230 - RNA, 21 nt, Chlamydia trachomatis
gaacaacuugaucuacagcaa

SEQ ID NO: 2491231 - RNA, 14 nt, Chlamydia trachomatis
gaacaagauaaaga

SEQ ID NO: 2491232 - RNA, 12 nt, Chlamydia trachomatis
gaacaagauccu

SEQ ID NO: 2491233 - RNA, 13 nt, Chlamydia trachomatis
gaacaagcaaaac

SEQ ID NO: 2491234 - RNA, 16 nt, Chlamydia trachomatis
gaacaagcaaaacaua

SEQ ID NO: 2491235 - RNA, 12 nt, Chlamydia trachomatis
gaacaauauagu

SEQ ID NO: 2491236 - RNA, 14 nt, Chlamydia trachomatis
gaacaauaucuguu

SEQ ID NO: 2491237 - RNA, 19 nt, Chlamydia trachomatis
gaacaauaucuguuuuucc

SEQ ID NO: 2491238 - RNA, 23 nt, Chlamydia trachomatis
gaacaauaucuguuuuuccccau

SEQ ID NO: 2491239 - RNA, 14 nt, Chlamydia trachomatis
gaacaauuugugau

SEQ ID NO: 2491240 - RNA, 13 nt, Chlamydia trachomatis
gaacagagcuuca

SEQ ID NO: 2491241 - RNA, 21 nt, Chlamydia trachomatis
gaacagauugagaauaaauau

SEQ ID NO: 2491242 - RNA, 20 nt, Chlamydia trachomatis
gaacagauuuagagaauaau

SEQ ID NO: 2491243 - RNA, 21 nt, Chlamydia trachomatis
gaacagauuuagagaauaauc

SEQ ID NO: 2491244 - RNA, 17 nt, Chlamydia trachomatis
gaacagcaagaggcccu

SEQ ID NO: 2491245 - RNA, 16 nt, Chlamydia trachomatis
gaacagcagcagugcc

SEQ ID NO: 2491246 - RNA, 19 nt, Chlamydia trachomatis
gaacagcgacauucucgga

SEQ ID NO: 2491247 - RNA, 21 nt, Chlamydia trachomatis
gaacagcucuagcuaaaccca

SEQ ID NO: 2491248 - RNA, 21 nt, Chlamydia trachomatis
gaacaggggaccaaaaaagcg

SEQ ID NO: 2491249 - RNA, 14 nt, Chlamydia trachomatis
gaacagguuauaga

SEQ ID NO: 2491250 - RNA, 22 nt, Chlamydia trachomatis
gaacauaacaaggcuuuuccau

SEQ ID NO: 2491251 - RNA, 23 nt, Chlamydia trachomatis
gaacauaacaaggcuuuuccauu

SEQ ID NO: 2491252 - RNA, 15 nt, Chlamydia trachomatis
gaacauccaccagca

SEQ ID NO: 2491253 - RNA, 18 nt, Chlamydia trachomatis
gaacauccaccagcaguc

SEQ ID NO: 2491254 - RNA, 13 nt, Chlamydia trachomatis
gaacaucgagaaa

SEQ ID NO: 2491255 - RNA, 15 nt, Chlamydia trachomatis
gaacaucgagaaaau

SEQ ID NO: 2491256 - RNA, 18 nt, Chlamydia trachomatis
gaacaucgagaaaaugau

SEQ ID NO: 2491257 - RNA, 19 nt, Chlamydia trachomatis
gaacaucggaccacauucu

SEQ ID NO: 2491258 - RNA, 23 nt, Chlamydia trachomatis
gaacaucucggucuuagaaggau

SEQ ID NO: 2491259 - RNA, 17 nt, Chlamydia trachomatis
gaacaugggcgucucuu

SEQ ID NO: 2491260 - RNA, 21 nt, Chlamydia trachomatis
gaaccacaaaccauccuucug

SEQ ID NO: 2491261 - RNA, 14 nt, Chlamydia trachomatis
gaaccauuuucaug

SEQ ID NO: 2491262 - RNA, 13 nt, Chlamydia trachomatis
gaacccauagauu

SEQ ID NO: 2491263 - RNA, 15 nt, Chlamydia trachomatis
gaaccccucuuuuuu

SEQ ID NO: 2491264 - RNA, 22 nt, Chlamydia trachomatis
gaacccuaauaaaggccaggcu

SEQ ID NO: 2491265 - RNA, 12 nt, Chlamydia trachomatis
gaacccucuuca

SEQ ID NO: 2491266 - RNA, 20 nt, Chlamydia trachomatis
gaaccgggauugcugaaaca

SEQ ID NO: 2491267 - RNA, 21 nt, Chlamydia trachomatis
gaaccgggauugcugaaacac

SEQ ID NO: 2491268 - RNA, 14 nt, Chlamydia trachomatis
gaaccuccauaaga

SEQ ID NO: 2491269 - RNA, 21 nt, Chlamydia trachomatis
gaaccuuuaccaaagaauucu

SEQ ID NO: 2491270 - RNA, 13 nt, Chlamydia trachomatis
gaacgagaaaaag

SEQ ID NO: 2491271 - RNA, 19 nt, Chlamydia trachomatis
gaacgaucgcaagccacca

SEQ ID NO: 2491272 - RNA, 23 nt, Chlamydia trachomatis
gaacgccuguuuucuuguagaaa

SEQ ID NO: 2491273 - RNA, 14 nt, Chlamydia trachomatis
gaacgggaaaugcu

SEQ ID NO: 2491274 - RNA, 22 nt, Chlamydia trachomatis
gaacgugaaaacgucucccccu

SEQ ID NO: 2491275 - RNA, 14 nt, Chlamydia trachomatis
gaacucuacaaaau

SEQ ID NO: 2491276 - RNA, 17 nt, Chlamydia trachomatis
gaacucuacaaaauaaa

SEQ ID NO: 2491277 - RNA, 12 nt, Chlamydia trachomatis
gaacucuuuccu

SEQ ID NO: 2491278 - RNA, 15 nt, Chlamydia trachomatis
gaacucuuuccuccu

SEQ ID NO: 2491279 - RNA, 20 nt, Chlamydia trachomatis
gaacuuauuggugagugcau

SEQ ID NO: 2491280 - RNA, 16 nt, Chlamydia trachomatis
gaacuuuauuauugaa

SEQ ID NO: 2491281 - RNA, 23 nt, Chlamydia trachomatis
gaagaaaagagcuuuucuucccu

SEQ ID NO: 2491282 - RNA, 20 nt, Chlamydia trachomatis
gaagaacacacuuuccccau

SEQ ID NO: 2491283 - RNA, 12 nt, Chlamydia trachomatis
gaagaacagcag

SEQ ID NO: 2491284 - RNA, 13 nt, Chlamydia trachomatis
gaagaaccgaauu

SEQ ID NO: 2491285 - RNA, 20 nt, Chlamydia trachomatis
gaagaacucccccuuucaaa

SEQ ID NO: 2491286 - RNA, 14 nt, Chlamydia trachomatis
gaagaacugcagug

SEQ ID NO: 2491287 - RNA, 23 nt, Chlamydia trachomatis
gaagaacugucuucuuucaaaga

SEQ ID NO: 2491288 - RNA, 15 nt, Chlamydia trachomatis
gaagaagaacugcag

SEQ ID NO: 2491289 - RNA, 13 nt, Chlamydia trachomatis
gaagaagaagaac

SEQ ID NO: 2491290 - RNA, 15 nt, Chlamydia trachomatis
gaagaagagcugcug

SEQ ID NO: 2491291 - RNA, 16 nt, Chlamydia trachomatis
gaagaagauguuguua

SEQ ID NO: 2491292 - RNA, 20 nt, Chlamydia trachomatis
gaagaagauguuguuaaagc

SEQ ID NO: 2491293 - RNA, 12 nt, Chlamydia trachomatis
gaagaaggagau

SEQ ID NO: 2491294 - RNA, 21 nt, Chlamydia trachomatis
gaagacccguuuucucuugaa

SEQ ID NO: 2491295 - RNA, 17 nt, Chlamydia trachomatis
gaagacgcucauaaaga

SEQ ID NO: 2491296 - RNA, 17 nt, Chlamydia trachomatis
gaagacgcuuuagcuaa

SEQ ID NO: 2491297 - RNA, 18 nt, Chlamydia trachomatis
gaagagaaaaauugcaaa

SEQ ID NO: 2491298 - RNA, 15 nt, Chlamydia trachomatis
gaagagagagccucc

SEQ ID NO: 2491299 - RNA, 14 nt, Chlamydia trachomatis
gaagagagcaucua

SEQ ID NO: 2491300 - RNA, 14 nt, Chlamydia trachomatis
gaagagauguuugu

SEQ ID NO: 2491301 - RNA, 23 nt, Chlamydia trachomatis
gaagagcagagguaugcagacuc

SEQ ID NO: 2491302 - RNA, 21 nt, Chlamydia trachomatis
gaagagcugcugucagaagaa

SEQ ID NO: 2491303 - RNA, 15 nt, Chlamydia trachomatis
gaagagcuguuguua

SEQ ID NO: 2491304 - RNA, 20 nt, Chlamydia trachomatis
gaagaggcgcccacagaaca

SEQ ID NO: 2491305 - RNA, 21 nt, Chlamydia trachomatis
gaagaggcgcccacagaacau

SEQ ID NO: 2491306 - RNA, 20 nt, Chlamydia trachomatis
gaagaggguuuggauggagg

SEQ ID NO: 2491307 - RNA, 16 nt, Chlamydia trachomatis
gaagaguuuguagaug

SEQ ID NO: 2491308 - RNA, 14 nt, Chlamydia trachomatis
gaagauaggagcau

SEQ ID NO: 2491309 - RNA, 21 nt, Chlamydia trachomatis
gaagauauucaugugaacaga

SEQ ID NO: 2491310 - RNA, 22 nt, Chlamydia trachomatis
gaagaucaaggauccaggagau

SEQ ID NO: 2491311 - RNA, 15 nt, Chlamydia trachomatis
gaagaucucuuucuc

SEQ ID NO: 2491312 - RNA, 19 nt, Chlamydia trachomatis
gaagaucucuuucucuaga

SEQ ID NO: 2491313 - RNA, 20 nt, Chlamydia trachomatis
gaagaucuguaacuacaucu

SEQ ID NO: 2491314 - RNA, 23 nt, Chlamydia trachomatis
gaagaucuucagaaaucuucuua

SEQ ID NO: 2491315 - RNA, 17 nt, Chlamydia trachomatis
gaagauguuguuaaagc

SEQ ID NO: 2491316 - RNA, 16 nt, Chlamydia trachomatis
gaagauucgauauacg

SEQ ID NO: 2491317 - RNA, 13 nt, Chlamydia trachomatis
gaagauucuaaaa

SEQ ID NO: 2491318 - RNA, 13 nt, Chlamydia trachomatis
gaagauuugcaaa

SEQ ID NO: 2491319 - RNA, 20 nt, Chlamydia trachomatis
gaagauuugcaaauucuuca

SEQ ID NO: 2491320 - RNA, 20 nt, Chlamydia trachomatis
gaagauuuuuagaaggaaag

SEQ ID NO: 2491321 - RNA, 22 nt, Chlamydia trachomatis
gaagcaaaaacugucugagccu

SEQ ID NO: 2491322 - RNA, 21 nt, Chlamydia trachomatis
gaagcaaaucccugugcuauc

SEQ ID NO: 2491323 - RNA, 18 nt, Chlamydia trachomatis
gaagcauuucucuccaaa

SEQ ID NO: 2491324 - RNA, 21 nt, Chlamydia trachomatis
gaagccaaaagaucuugaucu

SEQ ID NO: 2491325 - RNA, 19 nt, Chlamydia trachomatis
gaagcccaaacccuauuuc

SEQ ID NO: 2491326 - RNA, 23 nt, Chlamydia trachomatis
gaagcgauuugauccaguucugg

SEQ ID NO: 2491327 - RNA, 14 nt, Chlamydia trachomatis
gaagcgcucuccuc

SEQ ID NO: 2491328 - RNA, 15 nt, Chlamydia trachomatis
gaagcggagcaucuu

SEQ ID NO: 2491329 - RNA, 20 nt, Chlamydia trachomatis
gaagcggcauggaucuccag

SEQ ID NO: 2491330 - RNA, 22 nt, Chlamydia trachomatis
gaagcuaaaaaauccaggauuc

SEQ ID NO: 2491331 - RNA, 20 nt, Chlamydia trachomatis
gaagcuacugaugacuuucg

SEQ ID NO: 2491332 - RNA, 22 nt, Chlamydia trachomatis
gaagcuagaagaagaggaggau

SEQ ID NO: 2491333 - RNA, 22 nt, Chlamydia trachomatis
gaagcucuucgagucuucccuu

SEQ ID NO: 2491334 - RNA, 21 nt, Chlamydia trachomatis
gaagcuuaguuacaagacaau

SEQ ID NO: 2491335 - RNA, 15 nt, Chlamydia trachomatis
gaaggaaaaagaaaa

SEQ ID NO: 2491336 - RNA, 21 nt, Chlamydia trachomatis
gaaggaaaaagaaaaaaagag

SEQ ID NO: 2491337 - RNA, 22 nt, Chlamydia trachomatis
gaaggaguuuuucuccucucuc

SEQ ID NO: 2491338 - RNA, 17 nt, Chlamydia trachomatis
gaaggccaaagaaauag

SEQ ID NO: 2491339 - RNA, 22 nt, Chlamydia trachomatis
gaaggcuuuuuaauuuucugca

SEQ ID NO: 2491340 - RNA, 18 nt, Chlamydia trachomatis
gaagggcugagccguucg

SEQ ID NO: 2491341 - RNA, 17 nt, Chlamydia trachomatis
gaaggguuuugaagcuu

SEQ ID NO: 2491342 - RNA, 13 nt, Chlamydia trachomatis
gaagguaagaaag

SEQ ID NO: 2491343 - RNA, 20 nt, Chlamydia trachomatis
gaagguauuuuagagaaaag

SEQ ID NO: 2491344 - RNA, 21 nt, Chlamydia trachomatis
gaagguauuuuagagaaaaga

SEQ ID NO: 2491345 - RNA, 18 nt, Chlamydia trachomatis
gaaggugugaaagaaaaa

SEQ ID NO: 2491346 - RNA, 19 nt, Chlamydia trachomatis
gaaggugugaaagaaaaau

SEQ ID NO: 2491347 - RNA, 20 nt, Chlamydia trachomatis
gaagucaugcggauuaaaga

SEQ ID NO: 2491348 - RNA, 20 nt, Chlamydia trachomatis
gaagucccuccuacuaagga

SEQ ID NO: 2491349 - RNA, 21 nt, Chlamydia trachomatis
gaaguccgauaggaaaaaaga

SEQ ID NO: 2491350 - RNA, 16 nt, Chlamydia trachomatis
gaagucgugucuuuau

SEQ ID NO: 2491351 - RNA, 17 nt, Chlamydia trachomatis
gaagucuucaggagcau

SEQ ID NO: 2491352 - RNA, 16 nt, Chlamydia trachomatis
gaaguucccuuuuguu

SEQ ID NO: 2491353 - RNA, 18 nt, Chlamydia trachomatis
gaaguucuuuuuccucuu

SEQ ID NO: 2491354 - RNA, 22 nt, Chlamydia trachomatis
gaaguucuuuuuccucuucaga

SEQ ID NO: 2491355 - RNA, 23 nt, Chlamydia trachomatis
gaaguucuuuuuccucuucagac

SEQ ID NO: 2491356 - RNA, 13 nt, Chlamydia trachomatis
gaaguugagaagc

SEQ ID NO: 2491357 - RNA, 20 nt, Chlamydia trachomatis
gaaguugagcaacuauauuu

SEQ ID NO: 2491358 - RNA, 22 nt, Chlamydia trachomatis
gaauaaaaacgcuccaaauaaa

SEQ ID NO: 2491359 - RNA, 18 nt, Chlamydia trachomatis
gaauaaaacauuuuauua

SEQ ID NO: 2491360 - RNA, 17 nt, Chlamydia trachomatis
gaauaaaaguacuucua

SEQ ID NO: 2491361 - RNA, 13 nt, Chlamydia trachomatis
gaauaaaaucaaa

SEQ ID NO: 2491362 - RNA, 18 nt, Chlamydia trachomatis
gaauaaaaucaaauaaag

SEQ ID NO: 2491363 - RNA, 19 nt, Chlamydia trachomatis
gaauaaaaucaaauaaagc

SEQ ID NO: 2491364 - RNA, 22 nt, Chlamydia trachomatis
gaauaaagguaaucuguagaga

SEQ ID NO: 2491365 - RNA, 18 nt, Chlamydia trachomatis
gaauaaauccucuuugaa

SEQ ID NO: 2491366 - RNA, 17 nt, Chlamydia trachomatis
gaauaacguagauaucu

SEQ ID NO: 2491367 - RNA, 16 nt, Chlamydia trachomatis
gaauaacuaauauagc

SEQ ID NO: 2491368 - RNA, 17 nt, Chlamydia trachomatis
gaauaagcgaaaaaaaa

SEQ ID NO: 2491369 - RNA, 21 nt, Chlamydia trachomatis
gaauaagcgaaaaaaaaagaa

SEQ ID NO: 2491370 - RNA, 22 nt, Chlamydia trachomatis
gaauaaucgagugaucuacagc

SEQ ID NO: 2491371 - RNA, 23 nt, Chlamydia trachomatis
gaauaaugauucccagggagagu

SEQ ID NO: 2491372 - RNA, 15 nt, Chlamydia trachomatis
gaauacaguuagaga

SEQ ID NO: 2491373 - RNA, 21 nt, Chlamydia trachomatis
gaauacaucacugcaacuaau

SEQ ID NO: 2491374 - RNA, 15 nt, Chlamydia trachomatis
gaauaccaaaauccu

SEQ ID NO: 2491375 - RNA, 15 nt, Chlamydia trachomatis
gaauaccaacuugca

SEQ ID NO: 2491376 - RNA, 14 nt, Chlamydia trachomatis
gaauacgaaaugac

SEQ ID NO: 2491377 - RNA, 18 nt, Chlamydia trachomatis
gaauacuguuuguuaucu

SEQ ID NO: 2491378 - RNA, 23 nt, Chlamydia trachomatis
gaauagauucccuuuaaagaaag

SEQ ID NO: 2491379 - RNA, 16 nt, Chlamydia trachomatis
gaauagcaacucuuuc

SEQ ID NO: 2491380 - RNA, 17 nt, Chlamydia trachomatis
gaauagggggaguucua

SEQ ID NO: 2491381 - RNA, 20 nt, Chlamydia trachomatis
gaauagguugccuuuaucuc

SEQ ID NO: 2491382 - RNA, 13 nt, Chlamydia trachomatis
gaauaguauacuu

SEQ ID NO: 2491383 - RNA, 14 nt, Chlamydia trachomatis
gaauauaagcaccc

SEQ ID NO: 2491384 - RNA, 20 nt, Chlamydia trachomatis
gaauauaagcacccuuucuu

SEQ ID NO: 2491385 - RNA, 19 nt, Chlamydia trachomatis
gaauaucaucuucaagagc

SEQ ID NO: 2491386 - RNA, 20 nt, Chlamydia trachomatis
gaauaucguaaacaaccaaa

SEQ ID NO: 2491387 - RNA, 12 nt, Chlamydia trachomatis
gaaucaaaaagu

SEQ ID NO: 2491388 - RNA, 14 nt, Chlamydia trachomatis
gaaucaaaaaguuc

SEQ ID NO: 2491389 - RNA, 15 nt, Chlamydia trachomatis
gaaucaaaggauguc

SEQ ID NO: 2491390 - RNA, 20 nt, Chlamydia trachomatis
gaaucaaaggaugucuaucu

SEQ ID NO: 2491391 - RNA, 16 nt, Chlamydia trachomatis
gaaucaauuucuagaa

SEQ ID NO: 2491392 - RNA, 16 nt, Chlamydia trachomatis
gaaucacagaaacuuc

SEQ ID NO: 2491393 - RNA, 20 nt, Chlamydia trachomatis
gaaucacagaaacuucuucu

SEQ ID NO: 2491394 - RNA, 14 nt, Chlamydia trachomatis
gaaucacaugcuca

SEQ ID NO: 2491395 - RNA, 22 nt, Chlamydia trachomatis
gaaucaggaauauuaagaucca

SEQ ID NO: 2491396 - RNA, 16 nt, Chlamydia trachomatis
gaaucagguuugauaa

SEQ ID NO: 2491397 - RNA, 14 nt, Chlamydia trachomatis
gaaucauaaggaag

SEQ ID NO: 2491398 - RNA, 16 nt, Chlamydia trachomatis
gaaucauaaggaagau

SEQ ID NO: 2491399 - RNA, 22 nt, Chlamydia trachomatis
gaaucaucugguauucuaaaua

SEQ ID NO: 2491400 - RNA, 19 nt, Chlamydia trachomatis
gaaucauuugccaaaaagg

SEQ ID NO: 2491401 - RNA, 13 nt, Chlamydia trachomatis
gaauccaaagucu

SEQ ID NO: 2491402 - RNA, 17 nt, Chlamydia trachomatis
gaauccuagucuauaga

SEQ ID NO: 2491403 - RNA, 21 nt, Chlamydia trachomatis
gaauccucuaauaaacagauc

SEQ ID NO: 2491404 - RNA, 15 nt, Chlamydia trachomatis
gaauccucuuccgaa

SEQ ID NO: 2491405 - RNA, 23 nt, Chlamydia trachomatis
gaauccuuaaccgugaacugcuc

SEQ ID NO: 2491406 - RNA, 13 nt, Chlamydia trachomatis
gaauccuuuucag

SEQ ID NO: 2491407 - RNA, 21 nt, Chlamydia trachomatis
gaaucgccuauagaagacuaa

SEQ ID NO: 2491408 - RNA, 16 nt, Chlamydia trachomatis
gaaucggauccuucga

SEQ ID NO: 2491409 - RNA, 13 nt, Chlamydia trachomatis
gaaucggaugagg

SEQ ID NO: 2491410 - RNA, 16 nt, Chlamydia trachomatis
gaaucgucucucuggc

SEQ ID NO: 2491411 - RNA, 13 nt, Chlamydia trachomatis
gaaucuaaaaagc

SEQ ID NO: 2491412 - RNA, 16 nt, Chlamydia trachomatis
gaaucuaaaaagccau

SEQ ID NO: 2491413 - RNA, 23 nt, Chlamydia trachomatis
gaaucucgagcuaagaaaauaaa

SEQ ID NO: 2491414 - RNA, 18 nt, Chlamydia trachomatis
gaaucucgguaauaucca

SEQ ID NO: 2491415 - RNA, 20 nt, Chlamydia trachomatis
gaaucuguccaaagagauug

SEQ ID NO: 2491416 - RNA, 14 nt, Chlamydia trachomatis
gaaucugucuaaga

SEQ ID NO: 2491417 - RNA, 20 nt, Chlamydia trachomatis
gaaucuguguugcaaagaga

SEQ ID NO: 2491418 - RNA, 15 nt, Chlamydia trachomatis
gaaucuguuuugauu

SEQ ID NO: 2491419 - RNA, 14 nt, Chlamydia trachomatis
gaaucuuugaagcg

SEQ ID NO: 2491420 - RNA, 22 nt, Chlamydia trachomatis
gaaugaauuuccccugcagccu

SEQ ID NO: 2491421 - RNA, 21 nt, Chlamydia trachomatis
gaaugacuuaacgugucgaaa

SEQ ID NO: 2491422 - RNA, 15 nt, Chlamydia trachomatis
gaaugauaagggaau

SEQ ID NO: 2491423 - RNA, 19 nt, Chlamydia trachomatis
gaaugcagaucauaucugc

SEQ ID NO: 2491424 - RNA, 21 nt, Chlamydia trachomatis
gaaugcagaucauaucugcag

SEQ ID NO: 2491425 - RNA, 17 nt, Chlamydia trachomatis
gaaugcuguacagacug

SEQ ID NO: 2491426 - RNA, 14 nt, Chlamydia trachomatis
gaauggauacuuuu

SEQ ID NO: 2491427 - RNA, 14 nt, Chlamydia trachomatis
gaauggaucucccu

SEQ ID NO: 2491428 - RNA, 21 nt, Chlamydia trachomatis
gaaugggaagcucggucucau

SEQ ID NO: 2491429 - RNA, 17 nt, Chlamydia trachomatis
gaauggggaggaauacu

SEQ ID NO: 2491430 - RNA, 12 nt, Chlamydia trachomatis
gaaugguggcau

SEQ ID NO: 2491431 - RNA, 14 nt, Chlamydia trachomatis
gaauguauaaacac

SEQ ID NO: 2491432 - RNA, 22 nt, Chlamydia trachomatis
gaauguggagcuaucauuucca

SEQ ID NO: 2491433 - RNA, 20 nt, Chlamydia trachomatis
gaauguggguguagguuuug

SEQ ID NO: 2491434 - RNA, 12 nt, Chlamydia trachomatis
gaauuaaaucug

SEQ ID NO: 2491435 - RNA, 14 nt, Chlamydia trachomatis
gaauuaauaauucc

SEQ ID NO: 2491436 - RNA, 19 nt, Chlamydia trachomatis
gaauuacccugaaagacuu

SEQ ID NO: 2491437 - RNA, 23 nt, Chlamydia trachomatis
gaauuacccugaaagacuuucca

SEQ ID NO: 2491438 - RNA, 21 nt, Chlamydia trachomatis
gaauuacucugccuaggaaug

SEQ ID NO: 2491439 - RNA, 12 nt, Chlamydia trachomatis
gaauuauuugcc

SEQ ID NO: 2491440 - RNA, 14 nt, Chlamydia trachomatis
gaauucauagaagu

SEQ ID NO: 2491441 - RNA, 18 nt, Chlamydia trachomatis
gaauucuccaggagauug

SEQ ID NO: 2491442 - RNA, 23 nt, Chlamydia trachomatis
gaauucuucuucuguaucaaauu

SEQ ID NO: 2491443 - RNA, 14 nt, Chlamydia trachomatis
gaauucuuucauuc

SEQ ID NO: 2491444 - RNA, 20 nt, Chlamydia trachomatis
gaauucuuucauucguuucu

SEQ ID NO: 2491445 - RNA, 14 nt, Chlamydia trachomatis
gaauugacgaaucg

SEQ ID NO: 2491446 - RNA, 20 nt, Chlamydia trachomatis
gaauuuccagcuuaaugaua

SEQ ID NO: 2491447 - RNA, 16 nt, Chlamydia trachomatis
gaauuucuucuuuuag

SEQ ID NO: 2491448 - RNA, 12 nt, Chlamydia trachomatis
gaauuucuugaa

SEQ ID NO: 2491449 - RNA, 18 nt, Chlamydia trachomatis
gaauuugacucucauaag

SEQ ID NO: 2491450 - RNA, 21 nt, Chlamydia trachomatis
gaauuugacucucauaagaau

SEQ ID NO: 2491451 - RNA, 15 nt, Chlamydia trachomatis
gaauuuuaucuaaaa

SEQ ID NO: 2491452 - RNA, 13 nt, Chlamydia trachomatis
gaauuuuucucac

SEQ ID NO: 2491453 - RNA, 14 nt, Chlamydia trachomatis
gacaaagucagaga

SEQ ID NO: 2491454 - RNA, 22 nt, Chlamydia trachomatis
gacaaagucagagauauugucu

SEQ ID NO: 2491455 - RNA, 14 nt, Chlamydia trachomatis
gacaaauggauacg

SEQ ID NO: 2491456 - RNA, 21 nt, Chlamydia trachomatis
gacaaauugcacuaaagagcu

SEQ ID NO: 2491457 - RNA, 20 nt, Chlamydia trachomatis
gacaacaaguugauacaaga

SEQ ID NO: 2491458 - RNA, 19 nt, Chlamydia trachomatis
gacaacguuacuaccgaua

SEQ ID NO: 2491459 - RNA, 18 nt, Chlamydia trachomatis
gacaacguuuaaugaaua

SEQ ID NO: 2491460 - RNA, 14 nt, Chlamydia trachomatis
gacaagccuucagg

SEQ ID NO: 2491461 - RNA, 18 nt, Chlamydia trachomatis
gacaaugucaacauacag

SEQ ID NO: 2491462 - RNA, 17 nt, Chlamydia trachomatis
gacaccauucguucuuu

SEQ ID NO: 2491463 - RNA, 21 nt, Chlamydia trachomatis
gacacuaucacuguugagaaa

SEQ ID NO: 2491464 - RNA, 16 nt, Chlamydia trachomatis
gacacuauuaaaaagg

SEQ ID NO: 2491465 - RNA, 21 nt, Chlamydia trachomatis
gacagaacaaacgaaggagcu

SEQ ID NO: 2491466 - RNA, 19 nt, Chlamydia trachomatis
gacagaaguuagaaucugc

SEQ ID NO: 2491467 - RNA, 18 nt, Chlamydia trachomatis
gacagagcccuucuuuuc

SEQ ID NO: 2491468 - RNA, 21 nt, Chlamydia trachomatis
gacagagcccuucuuuuccug

SEQ ID NO: 2491469 - RNA, 16 nt, Chlamydia trachomatis
gacagcccaagaucuu

SEQ ID NO: 2491470 - RNA, 22 nt, Chlamydia trachomatis
gacagcuucuuguagauagacu

SEQ ID NO: 2491471 - RNA, 18 nt, Chlamydia trachomatis
gacagcuuucacagggac

SEQ ID NO: 2491472 - RNA, 12 nt, Chlamydia trachomatis
gacaggcagcag

SEQ ID NO: 2491473 - RNA, 15 nt, Chlamydia trachomatis
gacaggcuauugaua

SEQ ID NO: 2491474 - RNA, 17 nt, Chlamydia trachomatis
gacagguuucaugacau

SEQ ID NO: 2491475 - RNA, 14 nt, Chlamydia trachomatis
gacauaaaagcugu

SEQ ID NO: 2491476 - RNA, 14 nt, Chlamydia trachomatis
gacaucuaaagucu

SEQ ID NO: 2491477 - RNA, 20 nt, Chlamydia trachomatis
gacaugccagaagcuaugag

SEQ ID NO: 2491478 - RNA, 16 nt, Chlamydia trachomatis
gacauuaguauagucu

SEQ ID NO: 2491479 - RNA, 15 nt, Chlamydia trachomatis
gacauuccaaaccca

SEQ ID NO: 2491480 - RNA, 16 nt, Chlamydia trachomatis
gacauucucggaaaag

SEQ ID NO: 2491481 - RNA, 19 nt, Chlamydia trachomatis
gaccaauaccuacacgaua

SEQ ID NO: 2491482 - RNA, 16 nt, Chlamydia trachomatis
gaccagaucauagaaa

SEQ ID NO: 2491483 - RNA, 18 nt, Chlamydia trachomatis
gaccagaucauagaaaug

SEQ ID NO: 2491484 - RNA, 12 nt, Chlamydia trachomatis
gaccaucuucac

SEQ ID NO: 2491485 - RNA, 15 nt, Chlamydia trachomatis
gacccagcucauuag

SEQ ID NO: 2491486 - RNA, 13 nt, Chlamydia trachomatis
gacccauaagaua

SEQ ID NO: 2491487 - RNA, 16 nt, Chlamydia trachomatis
gacccaugaacagcau

SEQ ID NO: 2491488 - RNA, 22 nt, Chlamydia trachomatis
gaccguuaauaucccacucuuc

SEQ ID NO: 2491489 - RNA, 13 nt, Chlamydia trachomatis
gaccuacaaagau

SEQ ID NO: 2491490 - RNA, 15 nt, Chlamydia trachomatis
gaccuaguaagugca

SEQ ID NO: 2491491 - RNA, 14 nt, Chlamydia trachomatis
gaccugugcagauc

SEQ ID NO: 2491492 - RNA, 20 nt, Chlamydia trachomatis
gaccuugccaucauuaucuu

SEQ ID NO: 2491493 - RNA, 21 nt, Chlamydia trachomatis
gaccuuucccucguaauaacu

SEQ ID NO: 2491494 - RNA, 20 nt, Chlamydia trachomatis
gacgaaauagguccucuaau

SEQ ID NO: 2491495 - RNA, 16 nt, Chlamydia trachomatis
gacgaacgaagaacga

SEQ ID NO: 2491496 - RNA, 14 nt, Chlamydia trachomatis
gacgaacgcuagaa

SEQ ID NO: 2491497 - RNA, 17 nt, Chlamydia trachomatis
gacgaauccagaaagag

SEQ ID NO: 2491498 - RNA, 16 nt, Chlamydia trachomatis
gacgauauuuaagaua

SEQ ID NO: 2491499 - RNA, 12 nt, Chlamydia trachomatis
gacgauuaauag

SEQ ID NO: 2491500 - RNA, 21 nt, Chlamydia trachomatis
gacgcaucacggcuucugucc

SEQ ID NO: 2491501 - RNA, 14 nt, Chlamydia trachomatis
gacgcccuccuccu

SEQ ID NO: 2491502 - RNA, 17 nt, Chlamydia trachomatis
gacgcccuccuccucgc

SEQ ID NO: 2491503 - RNA, 18 nt, Chlamydia trachomatis
gacgcuagcuuuccucac

SEQ ID NO: 2491504 - RNA, 20 nt, Chlamydia trachomatis
gacgcugaucaacaagagcu

SEQ ID NO: 2491505 - RNA, 23 nt, Chlamydia trachomatis
gacgcuguccaaucguauaauaa

SEQ ID NO: 2491506 - RNA, 17 nt, Chlamydia trachomatis
gacggaacucuuuauua

SEQ ID NO: 2491507 - RNA, 19 nt, Chlamydia trachomatis
gacguuuagccuccaucuc

SEQ ID NO: 2491508 - RNA, 12 nt, Chlamydia trachomatis
gacuaaagacug

SEQ ID NO: 2491509 - RNA, 15 nt, Chlamydia trachomatis
gacuaaguuguaaaa

SEQ ID NO: 2491510 - RNA, 13 nt, Chlamydia trachomatis
gacuacagucuuc

SEQ ID NO: 2491511 - RNA, 21 nt, Chlamydia trachomatis
gacucaaacugugaagaauga

SEQ ID NO: 2491512 - RNA, 15 nt, Chlamydia trachomatis
gacuccagcuucucc

SEQ ID NO: 2491513 - RNA, 18 nt, Chlamydia trachomatis
gacuccagcuucuccauc

SEQ ID NO: 2491514 - RNA, 19 nt, Chlamydia trachomatis
gacucgaaggagcuaagaa

SEQ ID NO: 2491515 - RNA, 13 nt, Chlamydia trachomatis
gacucuaaagaau

SEQ ID NO: 2491516 - RNA, 12 nt, Chlamydia trachomatis
gacucuaauaaa

SEQ ID NO: 2491517 - RNA, 11 nt, Chlamydia trachomatis
gacucuuucaa

SEQ ID NO: 2491518 - RNA, 19 nt, Chlamydia trachomatis
gacugacagaaguuagaau

SEQ ID NO: 2491519 - RNA, 20 nt, Chlamydia trachomatis
gacugcaagaucaugggaaa

SEQ ID NO: 2491520 - RNA, 20 nt, Chlamydia trachomatis
gacugcggcagcugcuugga

SEQ ID NO: 2491521 - RNA, 22 nt, Chlamydia trachomatis
gacugcuccuaacccuuguaca

SEQ ID NO: 2491522 - RNA, 21 nt, Chlamydia trachomatis
gacuguugaugauguccaaag

SEQ ID NO: 2491523 - RNA, 17 nt, Chlamydia trachomatis
gacuucaacuucuccag

SEQ ID NO: 2491524 - RNA, 19 nt, Chlamydia trachomatis
gacuucacugccuuuagga

SEQ ID NO: 2491525 - RNA, 14 nt, Chlamydia trachomatis
gacuugagcgucuu

SEQ ID NO: 2491526 - RNA, 15 nt, Chlamydia trachomatis
gacuuugugcaaccu

SEQ ID NO: 2491527 - RNA, 20 nt, Chlamydia trachomatis
gacuuugugcaaccucuaua

SEQ ID NO: 2491528 - RNA, 18 nt, Chlamydia trachomatis
gagaaaaagguauuagau

SEQ ID NO: 2491529 - RNA, 16 nt, Chlamydia trachomatis
gagaaaagaaaagggg

SEQ ID NO: 2491530 - RNA, 21 nt, Chlamydia trachomatis
gagaaaaucccgguaauagaa

SEQ ID NO: 2491531 - RNA, 16 nt, Chlamydia trachomatis
gagaaaaugaugaaaa

SEQ ID NO: 2491532 - RNA, 14 nt, Chlamydia trachomatis
gagaaagagggguu

SEQ ID NO: 2491533 - RNA, 18 nt, Chlamydia trachomatis
gagaaagagggguuucau

SEQ ID NO: 2491534 - RNA, 15 nt, Chlamydia trachomatis
gagaaaguuaaagaa

SEQ ID NO: 2491535 - RNA, 13 nt, Chlamydia trachomatis
gagaaauaaaaac

SEQ ID NO: 2491536 - RNA, 22 nt, Chlamydia trachomatis
gagaacaucucggucuuagaag

SEQ ID NO: 2491537 - RNA, 17 nt, Chlamydia trachomatis
gagaacggcaauaaaga

SEQ ID NO: 2491538 - RNA, 20 nt, Chlamydia trachomatis
gagaacggcuguuguccuua

SEQ ID NO: 2491539 - RNA, 11 nt, Chlamydia trachomatis
gagaagaaaaa

SEQ ID NO: 2491540 - RNA, 22 nt, Chlamydia trachomatis
gagaagaacacacuuuccccau

SEQ ID NO: 2491541 - RNA, 12 nt, Chlamydia trachomatis
gagaagaaggcu

SEQ ID NO: 2491542 - RNA, 16 nt, Chlamydia trachomatis
gagaagcaucucaaug

SEQ ID NO: 2491543 - RNA, 14 nt, Chlamydia trachomatis
gagaagcgauuuga

SEQ ID NO: 2491544 - RNA, 19 nt, Chlamydia trachomatis
gagaagcugauauaaguau

SEQ ID NO: 2491545 - RNA, 16 nt, Chlamydia trachomatis
gagaaguaaaacagaa

SEQ ID NO: 2491546 - RNA, 18 nt, Chlamydia trachomatis
gagaauaccaaaauccuu

SEQ ID NO: 2491547 - RNA, 18 nt, Chlamydia trachomatis
gagacagcacuucuucuu

SEQ ID NO: 2491548 - RNA, 15 nt, Chlamydia trachomatis
gagacuccagcuucu

SEQ ID NO: 2491549 - RNA, 15 nt, Chlamydia trachomatis
gagagaaugaagaau

SEQ ID NO: 2491550 - RNA, 12 nt, Chlamydia trachomatis
gagagagcaaua

SEQ ID NO: 2491551 - RNA, 21 nt, Chlamydia trachomatis
gagagagccuugagugaaaaa

SEQ ID NO: 2491552 - RNA, 20 nt, Chlamydia trachomatis
gagagaggagaaaaacuccu

SEQ ID NO: 2491553 - RNA, 16 nt, Chlamydia trachomatis
gagagaucuaugaaaa

SEQ ID NO: 2491554 - RNA, 20 nt, Chlamydia trachomatis
gagagaucuaugaaaaaagc

SEQ ID NO: 2491555 - RNA, 17 nt, Chlamydia trachomatis
gagagcaacgagcaaua

SEQ ID NO: 2491556 - RNA, 21 nt, Chlamydia trachomatis
gagagcaguuguuuucuugcu

SEQ ID NO: 2491557 - RNA, 17 nt, Chlamydia trachomatis
gagagcauucuucugaa

SEQ ID NO: 2491558 - RNA, 14 nt, Chlamydia trachomatis
gagagccagcgagg

SEQ ID NO: 2491559 - RNA, 17 nt, Chlamydia trachomatis
gagagcuuccacagcag

SEQ ID NO: 2491560 - RNA, 14 nt, Chlamydia trachomatis
gagagcuuuacgac

SEQ ID NO: 2491561 - RNA, 20 nt, Chlamydia trachomatis
gagaggccuccauuuccaug

SEQ ID NO: 2491562 - RNA, 17 nt, Chlamydia trachomatis
gagaggcgucugcauaa

SEQ ID NO: 2491563 - RNA, 18 nt, Chlamydia trachomatis
gagaggugugauaggaga

SEQ ID NO: 2491564 - RNA, 19 nt, Chlamydia trachomatis
gagaguucguuaggauucg

SEQ ID NO: 2491565 - RNA, 23 nt, Chlamydia trachomatis
gagauauaaucuaaagacaaaac

SEQ ID NO: 2491566 - RNA, 19 nt, Chlamydia trachomatis
gagauaucacuaccagccc

SEQ ID NO: 2491567 - RNA, 23 nt, Chlamydia trachomatis
gagauaucacuaccagccccaca

SEQ ID NO: 2491568 - RNA, 15 nt, Chlamydia trachomatis
gagauaugaguggca

SEQ ID NO: 2491569 - RNA, 21 nt, Chlamydia trachomatis
gagaucugacugaugucaauu

SEQ ID NO: 2491570 - RNA, 17 nt, Chlamydia trachomatis
gagaugcuccucucuuu

SEQ ID NO: 2491571 - RNA, 18 nt, Chlamydia trachomatis
gagauggaguaggggaau

SEQ ID NO: 2491572 - RNA, 19 nt, Chlamydia trachomatis
gagauguuuacgaggaggu

SEQ ID NO: 2491573 - RNA, 16 nt, Chlamydia trachomatis
gagauugcaacucuug

SEQ ID NO: 2491574 - RNA, 17 nt, Chlamydia trachomatis
gagauugccuuuucuau

SEQ ID NO: 2491575 - RNA, 16 nt, Chlamydia trachomatis
gagauuuccucuucua

SEQ ID NO: 2491576 - RNA, 13 nt, Chlamydia trachomatis
gagcaaagcuauu

SEQ ID NO: 2491577 - RNA, 18 nt, Chlamydia trachomatis
gagcaauauguuauacgc

SEQ ID NO: 2491578 - RNA, 23 nt, Chlamydia trachomatis
gagcagaacuuaucuguucugcu

SEQ ID NO: 2491579 - RNA, 21 nt, Chlamydia trachomatis
gagcagacgauauuuaagaua

SEQ ID NO: 2491580 - RNA, 23 nt, Chlamydia trachomatis
gagcagagguaugcagacucaaa

SEQ ID NO: 2491581 - RNA, 18 nt, Chlamydia trachomatis
gagcagcuaacagcucuu

SEQ ID NO: 2491582 - RNA, 16 nt, Chlamydia trachomatis
gagcauaagaauaaac

SEQ ID NO: 2491583 - RNA, 23 nt, Chlamydia trachomatis
gagcauaagaauaaacaacaugg

SEQ ID NO: 2491584 - RNA, 18 nt, Chlamydia trachomatis
gagcaucaguaaaaauaa

SEQ ID NO: 2491585 - RNA, 16 nt, Chlamydia trachomatis
gagcauccauauauuc

SEQ ID NO: 2491586 - RNA, 16 nt, Chlamydia trachomatis
gagcauguagccaagg

SEQ ID NO: 2491587 - RNA, 17 nt, Chlamydia trachomatis
gagcauguagccaagga

SEQ ID NO: 2491588 - RNA, 21 nt, Chlamydia trachomatis
gagcauguagccaaggaagau

SEQ ID NO: 2491589 - RNA, 19 nt, Chlamydia trachomatis
gagcauguguuucuggaaa

SEQ ID NO: 2491590 - RNA, 20 nt, Chlamydia trachomatis
gagcauguguuucuggaaag

SEQ ID NO: 2491591 - RNA, 18 nt, Chlamydia trachomatis
gagcauuugccaaugaaa

SEQ ID NO: 2491592 - RNA, 16 nt, Chlamydia trachomatis
gagcauuuuccaagaa

SEQ ID NO: 2491593 - RNA, 16 nt, Chlamydia trachomatis
gagccaaaaaguccgc

SEQ ID NO: 2491594 - RNA, 24 nt, Chlamydia trachomatis
gagccaucgccuucuauagcuaaa

SEQ ID NO: 2491595 - RNA, 14 nt, Chlamydia trachomatis
gagccaugaucaaa

SEQ ID NO: 2491596 - RNA, 20 nt, Chlamydia trachomatis
gagccaugaucaaagaaagc

SEQ ID NO: 2491597 - RNA, 19 nt, Chlamydia trachomatis
gagcccuaggcgacacgcu

SEQ ID NO: 2491598 - RNA, 20 nt, Chlamydia trachomatis
gagcccugcuucacagcuaa

SEQ ID NO: 2491599 - RNA, 15 nt, Chlamydia trachomatis
gagccguucucucua

SEQ ID NO: 2491600 - RNA, 17 nt, Chlamydia trachomatis
gagccuguuuagaaaga

SEQ ID NO: 2491601 - RNA, 19 nt, Chlamydia trachomatis
gagccuguuucuuaucagc

SEQ ID NO: 2491602 - RNA, 13 nt, Chlamydia trachomatis
gagccuguuuugc

SEQ ID NO: 2491603 - RNA, 13 nt, Chlamydia trachomatis
gagccuugaguga

SEQ ID NO: 2491604 - RNA, 15 nt, Chlamydia trachomatis
gagcgauagaauuuc

SEQ ID NO: 2491605 - RNA, 14 nt, Chlamydia trachomatis
gagcgaugagcuua

SEQ ID NO: 2491606 - RNA, 15 nt, Chlamydia trachomatis
gagcgccuucaauac

SEQ ID NO: 2491607 - RNA, 20 nt, Chlamydia trachomatis
gagcgguugcacaaauccag

SEQ ID NO: 2491608 - RNA, 13 nt, Chlamydia trachomatis
gagcuaagaaaau

SEQ ID NO: 2491609 - RNA, 21 nt, Chlamydia trachomatis
gagcuaagaaaauaaacacaa

SEQ ID NO: 2491610 - RNA, 12 nt, Chlamydia trachomatis
gagcuacaggaa

SEQ ID NO: 2491611 - RNA, 19 nt, Chlamydia trachomatis
gagcuccaggaaaagcuuu

SEQ ID NO: 2491612 - RNA, 22 nt, Chlamydia trachomatis
gagcuguuuuugcaacaaagcu

SEQ ID NO: 2491613 - RNA, 17 nt, Chlamydia trachomatis
gagcuuaacuuuguuau

SEQ ID NO: 2491614 - RNA, 19 nt, Chlamydia trachomatis
gagcuucccuuaaauauuc

SEQ ID NO: 2491615 - RNA, 19 nt, Chlamydia trachomatis
gagcuucucgcuacaaauc

SEQ ID NO: 2491616 - RNA, 21 nt, Chlamydia trachomatis
gagcuucuuuauccggagcuu

SEQ ID NO: 2491617 - RNA, 23 nt, Chlamydia trachomatis
gagcuuguucuucgaaauauugu

SEQ ID NO: 2491618 - RNA, 20 nt, Chlamydia trachomatis
gagcuuugaggacugacaga

SEQ ID NO: 2491619 - RNA, 17 nt, Chlamydia trachomatis
cauaacgauccucuuga

SEQ ID NO: 2491620 - RNA, 17 nt, Chlamydia trachomatis
cauaacuuuaauagcca

SEQ ID NO: 2491621 - RNA, 14 nt, Chlamydia trachomatis
cauaagaaauuaac

SEQ ID NO: 2491622 - RNA, 17 nt, Chlamydia trachomatis
cauaagaauguuuccua

SEQ ID NO: 2491623 - RNA, 19 nt, Chlamydia trachomatis
cauaagagaggcuugagaa

SEQ ID NO: 2491624 - RNA, 20 nt, Chlamydia trachomatis
cauaagaucuuuacuuucuu

SEQ ID NO: 2491625 - RNA, 18 nt, Chlamydia trachomatis
cauaagcacuauaucucc

SEQ ID NO: 2491626 - RNA, 16 nt, Chlamydia trachomatis
cauaagcucuaacucu

SEQ ID NO: 2491627 - RNA, 23 nt, Chlamydia trachomatis
cauaagcucuaacucuucuuuau

SEQ ID NO: 2491628 - RNA, 11 nt, Chlamydia trachomatis
cauaaggaaga

SEQ ID NO: 2491629 - RNA, 14 nt, Chlamydia trachomatis
cauaaggaagaugg

SEQ ID NO: 2491630 - RNA, 20 nt, Chlamydia trachomatis
cauaauagcuugcacagcaa

SEQ ID NO: 2491631 - RNA, 22 nt, Chlamydia trachomatis
cauaauagcuugcacagcaagc

SEQ ID NO: 2491632 - RNA, 20 nt, Chlamydia trachomatis
cauaauaggaggaacccuuu

SEQ ID NO: 2491633 - RNA, 18 nt, Chlamydia trachomatis
cauaauaguuaaaacaca

SEQ ID NO: 2491634 - RNA, 21 nt, Chlamydia trachomatis
cauaauaguuaaaacacaaaa

SEQ ID NO: 2491635 - RNA, 20 nt, Chlamydia trachomatis
cauaauccuaugcaguaaag

SEQ ID NO: 2491636 - RNA, 15 nt, Chlamydia trachomatis
cauaaucugauucgc

SEQ ID NO: 2491637 - RNA, 22 nt, Chlamydia trachomatis
cauaaucuuccuguaagaggau

SEQ ID NO: 2491638 - RNA, 23 nt, Chlamydia trachomatis
cauaauuuucuucacuuccucuc

SEQ ID NO: 2491639 - RNA, 17 nt, Chlamydia trachomatis
cauacacaucaaaauga

SEQ ID NO: 2491640 - RNA, 14 nt, Chlamydia trachomatis
cauacaccugcaag

SEQ ID NO: 2491641 - RNA, 13 nt, Chlamydia trachomatis
cauacauaagaac

SEQ ID NO: 2491642 - RNA, 12 nt, Chlamydia trachomatis
cauacaucaucu

SEQ ID NO: 2491643 - RNA, 22 nt, Chlamydia trachomatis
cauacaugauagucagaauaau

SEQ ID NO: 2491644 - RNA, 19 nt, Chlamydia trachomatis
cauaccaagauuagauaca

SEQ ID NO: 2491645 - RNA, 17 nt, Chlamydia trachomatis
cauaccaagcuuucugc

SEQ ID NO: 2491646 - RNA, 20 nt, Chlamydia trachomatis
cauaccgaggauccuaacca

SEQ ID NO: 2491647 - RNA, 15 nt, Chlamydia trachomatis
cauacgcugcugaca

SEQ ID NO: 2491648 - RNA, 16 nt, Chlamydia trachomatis
cauacgcugcugacaa

SEQ ID NO: 2491649 - RNA, 15 nt, Chlamydia trachomatis
cauacguuuucucug

SEQ ID NO: 2491650 - RNA, 14 nt, Chlamydia trachomatis
cauacucagcgauu

SEQ ID NO: 2491651 - RNA, 13 nt, Chlamydia trachomatis
cauacuucccaca

SEQ ID NO: 2491652 - RNA, 15 nt, Chlamydia trachomatis
cauacuucccacaua

SEQ ID NO: 2491653 - RNA, 13 nt, Chlamydia trachomatis
cauacuucugaau

SEQ ID NO: 2491654 - RNA, 22 nt, Chlamydia trachomatis
cauagauugugguuagaaauuc

SEQ ID NO: 2491655 - RNA, 23 nt, Chlamydia trachomatis
cauagcaugggcugcaucagcaa

SEQ ID NO: 2491656 - RNA, 20 nt, Chlamydia trachomatis
cauaggaauacgaaaugaca

SEQ ID NO: 2491657 - RNA, 23 nt, Chlamydia trachomatis
cauaggaucuggaaccggaggau

SEQ ID NO: 2491658 - RNA, 23 nt, Chlamydia trachomatis
cauaggcgugaagagagacacua

SEQ ID NO: 2491659 - RNA, 20 nt, Chlamydia trachomatis
cauaggcuccugcaagggaa

SEQ ID NO: 2491660 - RNA, 19 nt, Chlamydia trachomatis
cauagucugauccauuuuc

SEQ ID NO: 2491661 - RNA, 15 nt, Chlamydia trachomatis
cauauaguuuucgac

SEQ ID NO: 2491662 - RNA, 14 nt, Chlamydia trachomatis
cauauauuggagug

SEQ ID NO: 2491663 - RNA, 10 nt, Chlamydia trachomatis
cauaucaaag

SEQ ID NO: 2491664 - RNA, 15 nt, Chlamydia trachomatis
cauaucaagaauuuc

SEQ ID NO: 2491665 - RNA, 16 nt, Chlamydia trachomatis
cauauccuugagcuga

SEQ ID NO: 2491666 - RNA, 17 nt, Chlamydia trachomatis
cauaucgacuagcugua

SEQ ID NO: 2491667 - RNA, 15 nt, Chlamydia trachomatis
cauaucuccuaaaag

SEQ ID NO: 2491668 - RNA, 12 nt, Chlamydia trachomatis
cauauuccaaag

SEQ ID NO: 2491669 - RNA, 15 nt, Chlamydia trachomatis
cauauucuugcuaag

SEQ ID NO: 2491670 - RNA, 20 nt, Chlamydia trachomatis
caucaaaauauagacugucu

SEQ ID NO: 2491671 - RNA, 13 nt, Chlamydia trachomatis
caucaaaauauuu

SEQ ID NO: 2491672 - RNA, 16 nt, Chlamydia trachomatis
caucaaacucuuuuuc

SEQ ID NO: 2491673 - RNA, 23 nt, Chlamydia trachomatis
caucaauaaugggccguuuuucu

SEQ ID NO: 2491674 - RNA, 16 nt, Chlamydia trachomatis
caucaaugauguaguu

SEQ ID NO: 2491675 - RNA, 22 nt, Chlamydia trachomatis
caucacuauaagucaaaagaau

SEQ ID NO: 2491676 - RNA, 14 nt, Chlamydia trachomatis
caucaggaauagcu

SEQ ID NO: 2491677 - RNA, 16 nt, Chlamydia trachomatis
caucaguaaaaauaau

SEQ ID NO: 2491678 - RNA, 18 nt, Chlamydia trachomatis
caucaucucucagcagau

SEQ ID NO: 2491679 - RNA, 19 nt, Chlamydia trachomatis
cauccaaaacaucccagca

SEQ ID NO: 2491680 - RNA, 17 nt, Chlamydia trachomatis
cauccacuugggcgcca

SEQ ID NO: 2491681 - RNA, 14 nt, Chlamydia trachomatis
cauccauaaaaacu

SEQ ID NO: 2491682 - RNA, 23 nt, Chlamydia trachomatis
cauccauaaaaacugcugcuauc

SEQ ID NO: 2491683 - RNA, 15 nt, Chlamydia trachomatis
cauccauaacgaaga

SEQ ID NO: 2491684 - RNA, 21 nt, Chlamydia trachomatis
cauccccagaacgcaauguuu

SEQ ID NO: 2491685 - RNA, 14 nt, Chlamydia trachomatis
caucccuugaacua

SEQ ID NO: 2491686 - RNA, 18 nt, Chlamydia trachomatis
cauccgcuaaaggaucug

SEQ ID NO: 2491687 - RNA, 22 nt, Chlamydia trachomatis
cauccgcuucuucauguucugu

SEQ ID NO: 2491688 - RNA, 19 nt, Chlamydia trachomatis
cauccguuucuagaagaac

SEQ ID NO: 2491689 - RNA, 18 nt, Chlamydia trachomatis
cauccuaggggauuuuau

SEQ ID NO: 2491690 - RNA, 22 nt, Chlamydia trachomatis
cauccuuuuggaagaucucuuu

SEQ ID NO: 2491691 - RNA, 14 nt, Chlamydia trachomatis
caucgaaaaucacu

SEQ ID NO: 2491692 - RNA, 21 nt, Chlamydia trachomatis
caucgaagcguuuacaaauga

SEQ ID NO: 2491693 - RNA, 16 nt, Chlamydia trachomatis
caucgaaugccccaga

SEQ ID NO: 2491694 - RNA, 15 nt, Chlamydia trachomatis
caucgaauuaauaau

SEQ ID NO: 2491695 - RNA, 15 nt, Chlamydia trachomatis
caucgauauuuuugg

SEQ ID NO: 2491696 - RNA, 17 nt, Chlamydia trachomatis
caucgaucgucaucagu

SEQ ID NO: 2491697 - RNA, 18 nt, Chlamydia trachomatis
caucgaugauaucuucug

SEQ ID NO: 2491698 - RNA, 15 nt, Chlamydia trachomatis
caucgauuuuugcua

SEQ ID NO: 2491699 - RNA, 17 nt, Chlamydia trachomatis
caucgcuguauuuccuu

SEQ ID NO: 2491700 - RNA, 20 nt, Chlamydia trachomatis
caucgggaguccuuccaggu

SEQ ID NO: 2491701 - RNA, 12 nt, Chlamydia trachomatis
caucuaaaagag

SEQ ID NO: 2491702 - RNA, 19 nt, Chlamydia trachomatis
caucuaaaagaguuucuuu

SEQ ID NO: 2491703 - RNA, 24 nt, Chlamydia trachomatis
caucuaaaggcaacucucucuccc

SEQ ID NO: 2491704 - RNA, 14 nt, Chlamydia trachomatis
caucuacaaaacca

SEQ ID NO: 2491705 - RNA, 14 nt, Chlamydia trachomatis
caucuacugaugcu

SEQ ID NO: 2491706 - RNA, 17 nt, Chlamydia trachomatis
caucuagagguauuuua

SEQ ID NO: 2491707 - RNA, 22 nt, Chlamydia trachomatis
caucuagagguauuuuauucaa

SEQ ID NO: 2491708 - RNA, 18 nt, Chlamydia trachomatis
caucuagaucgaauagua

SEQ ID NO: 2491709 - RNA, 23 nt, Chlamydia trachomatis
caucucaaugagcgcuuuuucuu

SEQ ID NO: 2491710 - RNA, 13 nt, Chlamydia trachomatis
caucuccucugga

SEQ ID NO: 2491711 - RNA, 18 nt, Chlamydia trachomatis
caucuccucuggagccgu

SEQ ID NO: 2491712 - RNA, 18 nt, Chlamydia trachomatis
caucucgguauucucaau

SEQ ID NO: 2491713 - RNA, 13 nt, Chlamydia trachomatis
caucucuauacgg

SEQ ID NO: 2491714 - RNA, 15 nt, Chlamydia trachomatis
caucugacuuuuuag

SEQ ID NO: 2491715 - RNA, 21 nt, Chlamydia trachomatis
caucugacuuuuuagcaucug

SEQ ID NO: 2491716 - RNA, 14 nt, Chlamydia trachomatis
caucuggaguggca

SEQ ID NO: 2491717 - RNA, 22 nt, Chlamydia trachomatis
caucuguagagccaugaucaaa

SEQ ID NO: 2491718 - RNA, 13 nt, Chlamydia trachomatis
caucuguuuaggu

SEQ ID NO: 2491719 - RNA, 16 nt, Chlamydia trachomatis
caucuucaauggcaaa

SEQ ID NO: 2491720 - RNA, 20 nt, Chlamydia trachomatis
caucuucaauggcaaaacuu

SEQ ID NO: 2491721 - RNA, 16 nt, Chlamydia trachomatis
caucuucaccaacucc

SEQ ID NO: 2491722 - RNA, 16 nt, Chlamydia trachomatis
caucuucccaauauau

SEQ ID NO: 2491723 - RNA, 17 nt, Chlamydia trachomatis
caucuucucgaaagaga

SEQ ID NO: 2491724 - RNA, 19 nt, Chlamydia trachomatis
caucuucucgaaagagaac

SEQ ID NO: 2491725 - RNA, 19 nt, Chlamydia trachomatis
caucuuuaaagaggaucag

SEQ ID NO: 2491726 - RNA, 17 nt, Chlamydia trachomatis
caucuuuuuuaaaaagc

SEQ ID NO: 2491727 - RNA, 19 nt, Chlamydia trachomatis
caucuuuuuuaaaaagcug

SEQ ID NO: 2491728 - RNA, 18 nt, Chlamydia trachomatis
caugaaaguagcuacuuu

SEQ ID NO: 2491729 - RNA, 18 nt, Chlamydia trachomatis
caugaacagcuucgugag

SEQ ID NO: 2491730 - RNA, 21 nt, Chlamydia trachomatis
caugaacagcuucgugagaca

SEQ ID NO: 2491731 - RNA, 22 nt, Chlamydia trachomatis
caugaacauggcugcaggauau

SEQ ID NO: 2491732 - RNA, 13 nt, Chlamydia trachomatis
caugaaugacugc

SEQ ID NO: 2491733 - RNA, 15 nt, Chlamydia trachomatis
caugaauggaaagua

SEQ ID NO: 2491734 - RNA, 21 nt, Chlamydia trachomatis
caugaauuguuucuccauagc

SEQ ID NO: 2491735 - RNA, 19 nt, Chlamydia trachomatis
caugacauacauaagaaca

SEQ ID NO: 2491736 - RNA, 19 nt, Chlamydia trachomatis
caugagaccgucaaaaaga

SEQ ID NO: 2491737 - RNA, 23 nt, Chlamydia trachomatis
caugagaccgucaaaaagaucuu

SEQ ID NO: 2491738 - RNA, 18 nt, Chlamydia trachomatis
caugagcgauaugcuuuu

SEQ ID NO: 2491739 - RNA, 14 nt, Chlamydia trachomatis
caugauauuuugaa

SEQ ID NO: 2491740 - RNA, 18 nt, Chlamydia trachomatis
caugauauuuugaagaua

SEQ ID NO: 2491741 - RNA, 19 nt, Chlamydia trachomatis
caugauauuuugaagauaa

SEQ ID NO: 2491742 - RNA, 18 nt, Chlamydia trachomatis
caugaucaaagaaagcuu

SEQ ID NO: 2491743 - RNA, 23 nt, Chlamydia trachomatis
caugauccccuacgcuacgagca

SEQ ID NO: 2491744 - RNA, 20 nt, Chlamydia trachomatis
caugaucucugcagaagaag

SEQ ID NO: 2491745 - RNA, 21 nt, Chlamydia trachomatis
caugaucucugcagaagaagc

SEQ ID NO: 2491746 - RNA, 16 nt, Chlamydia trachomatis
caugauucaaaauaau

SEQ ID NO: 2491747 - RNA, 19 nt, Chlamydia trachomatis
caugauuuccugauaggca

SEQ ID NO: 2491748 - RNA, 15 nt, Chlamydia trachomatis
caugcaaaacagcuc

SEQ ID NO: 2491749 - RNA, 20 nt, Chlamydia trachomatis
caugcaaaggauaaauauuu

SEQ ID NO: 2491750 - RNA, 16 nt, Chlamydia trachomatis
caugccgcacauccgc

SEQ ID NO: 2491751 - RNA, 21 nt, Chlamydia trachomatis
caugcguuaauuaauaagccu

SEQ ID NO: 2491752 - RNA, 14 nt, Chlamydia trachomatis
caugcuccuuucac

SEQ ID NO: 2491753 - RNA, 19 nt, Chlamydia trachomatis
caugcuccuuucacuucau

SEQ ID NO: 2491754 - RNA, 20 nt, Chlamydia trachomatis
caugcuuuugaucuuuccag

SEQ ID NO: 2491755 - RNA, 17 nt, Chlamydia trachomatis
cauggaacgauuaucuu

SEQ ID NO: 2491756 - RNA, 16 nt, Chlamydia trachomatis
cauggagcuucaucau

SEQ ID NO: 2491757 - RNA, 15 nt, Chlamydia trachomatis
caugggaucuagaag

SEQ ID NO: 2491758 - RNA, 19 nt, Chlamydia trachomatis
caugggcugcaucagcaag

SEQ ID NO: 2491759 - RNA, 20 nt, Chlamydia trachomatis
caugguauagaagaccuuug

SEQ ID NO: 2491760 - RNA, 20 nt, Chlamydia trachomatis
caugguauucuaaagucuua

SEQ ID NO: 2491761 - RNA, 15 nt, Chlamydia trachomatis
cauguauagucaucu

SEQ ID NO: 2491762 - RNA, 22 nt, Chlamydia trachomatis
cauguauagucaucugcagccu

SEQ ID NO: 2491763 - RNA, 16 nt, Chlamydia trachomatis
cauguauucuccuuuu

SEQ ID NO: 2491764 - RNA, 20 nt, Chlamydia trachomatis
caugucgagauaaaaaccuc

SEQ ID NO: 2491765 - RNA, 15 nt, Chlamydia trachomatis
caugucuagcuagaa

SEQ ID NO: 2491766 - RNA, 13 nt, Chlamydia trachomatis
caugucuucuuuc

SEQ ID NO: 2491767 - RNA, 15 nt, Chlamydia trachomatis
caugugaacagagcu

SEQ ID NO: 2491768 - RNA, 20 nt, Chlamydia trachomatis
cauguggguaugucugugau

SEQ ID NO: 2491769 - RNA, 22 nt, Chlamydia trachomatis
cauguugcguuuguaagaucug

SEQ ID NO: 2491770 - RNA, 16 nt, Chlamydia trachomatis
cauguuucgccaauga

SEQ ID NO: 2491771 - RNA, 17 nt, Chlamydia trachomatis
cauuaaacuaugcaaag

SEQ ID NO: 2491772 - RNA, 17 nt, Chlamydia trachomatis
cauuaaaggaauaauuu

SEQ ID NO: 2491773 - RNA, 15 nt, Chlamydia trachomatis
cauuacauauagcau

SEQ ID NO: 2491774 - RNA, 15 nt, Chlamydia trachomatis
cauuacgccccuucu

SEQ ID NO: 2491775 - RNA, 21 nt, Chlamydia trachomatis
cauuacgccccuucuucaaga

SEQ ID NO: 2491776 - RNA, 20 nt, Chlamydia trachomatis
cauuacucguuaucuaggaa

SEQ ID NO: 2491777 - RNA, 15 nt, Chlamydia trachomatis
cauuacuguacuccu

SEQ ID NO: 2491778 - RNA, 19 nt, Chlamydia trachomatis
cauuagaaugauugauaaa

SEQ ID NO: 2491779 - RNA, 14 nt, Chlamydia trachomatis
cauuagcaaucaca

SEQ ID NO: 2491780 - RNA, 19 nt, Chlamydia trachomatis
cauuaggauuaaaauccau

SEQ ID NO: 2491781 - RNA, 17 nt, Chlamydia trachomatis
cauuauccauaaaaaua

SEQ ID NO: 2491782 - RNA, 14 nt, Chlamydia trachomatis
cauuaucuucuucu

SEQ ID NO: 2491783 - RNA, 16 nt, Chlamydia trachomatis
cauuauuaacaggaag

SEQ ID NO: 2491784 - RNA, 15 nt, Chlamydia trachomatis
cauuauuauuuaaaa

SEQ ID NO: 2491785 - RNA, 13 nt, Chlamydia trachomatis
cauucaaccucuc

SEQ ID NO: 2491786 - RNA, 14 nt, Chlamydia trachomatis
cauuccaggacgaa

SEQ ID NO: 2491787 - RNA, 20 nt, Chlamydia trachomatis
cauuccaggacgaacgaaga

SEQ ID NO: 2491788 - RNA, 15 nt, Chlamydia trachomatis
cauucguguguagga

SEQ ID NO: 2491789 - RNA, 19 nt, Chlamydia trachomatis
cauucguuucuucccuuuu

SEQ ID NO: 2491790 - RNA, 22 nt, Chlamydia trachomatis
cauucuaaggagcaugguauuc

SEQ ID NO: 2491791 - RNA, 20 nt, Chlamydia trachomatis
cauucugcguuuaauuccuu

SEQ ID NO: 2491792 - RNA, 20 nt, Chlamydia trachomatis
cauucuuacuaaagccaucu

SEQ ID NO: 2491793 - RNA, 20 nt, Chlamydia trachomatis
cauucuuagauuuucaugca

SEQ ID NO: 2491794 - RNA, 21 nt, Chlamydia trachomatis
cauucuuagauuuucaugcaa

SEQ ID NO: 2491795 - RNA, 18 nt, Chlamydia trachomatis
cauucuuagugaaugcuc

SEQ ID NO: 2491796 - RNA, 14 nt, Chlamydia trachomatis
cauugaaauagcca

SEQ ID NO: 2491797 - RNA, 14 nt, Chlamydia trachomatis
cauugaaaucagaa

SEQ ID NO: 2491798 - RNA, 23 nt, Chlamydia trachomatis
cauugaacaccauauccuugucc

SEQ ID NO: 2491799 - RNA, 19 nt, Chlamydia trachomatis
cauugacaugccagaagcu

SEQ ID NO: 2491800 - RNA, 13 nt, Chlamydia trachomatis
cauugagaagucc

SEQ ID NO: 2491801 - RNA, 15 nt, Chlamydia trachomatis
cauugagcaaaaaaa

SEQ ID NO: 2491802 - RNA, 23 nt, Chlamydia trachomatis
cauugaguucugcuugcgaauaa

SEQ ID NO: 2491803 - RNA, 19 nt, Chlamydia trachomatis
cauugauucuaugagaaga

SEQ ID NO: 2491804 - RNA, 19 nt, Chlamydia trachomatis
cauugcaggagaucuuuug

SEQ ID NO: 2491805 - RNA, 19 nt, Chlamydia trachomatis
cauugcgcagaucuccuuc

SEQ ID NO: 2491806 - RNA, 22 nt, Chlamydia trachomatis
cauuggaauuuucaucaaaaua

SEQ ID NO: 2491807 - RNA, 22 nt, Chlamydia trachomatis
cauuggugguaacaccaaaaaa

SEQ ID NO: 2491808 - RNA, 18 nt, Chlamydia trachomatis
cauuguaaauagacuucu

SEQ ID NO: 2491809 - RNA, 20 nt, Chlamydia trachomatis
cauuguaaauagacuucuuc

SEQ ID NO: 2491810 - RNA, 24 nt, Chlamydia trachomatis
cauuguaaauagacuucuucgucc

SEQ ID NO: 2491811 - RNA, 23 nt, Chlamydia trachomatis
cauugugaacaauaauucaggcu

SEQ ID NO: 2491812 - RNA, 14 nt, Chlamydia trachomatis
cauuuaaaugaaug

SEQ ID NO: 2491813 - RNA, 16 nt, Chlamydia trachomatis
cauuuaauaaguuuuu

SEQ ID NO: 2491814 - RNA, 18 nt, Chlamydia trachomatis
cauuuaauaaguuuuuca

SEQ ID NO: 2491815 - RNA, 22 nt, Chlamydia trachomatis
cauuuaauauggacuucccuaa

SEQ ID NO: 2491816 - RNA, 20 nt, Chlamydia trachomatis
cauuuacuccuaucgauucu

SEQ ID NO: 2491817 - RNA, 23 nt, Chlamydia trachomatis
cauuuauccacaggucauaucca

SEQ ID NO: 2491818 - RNA, 21 nt, Chlamydia trachomatis
cauuucacuauccaaagcugc

SEQ ID NO: 2491819 - RNA, 21 nt, Chlamydia trachomatis
cauuuccagccucuccagaaa

SEQ ID NO: 2491820 - RNA, 22 nt, Chlamydia trachomatis
cauuuccgguauuaauaaugaa

SEQ ID NO: 2491821 - RNA, 23 nt, Chlamydia trachomatis
cauuuccgguauuaauaaugaaa

SEQ ID NO: 2491822 - RNA, 23 nt, Chlamydia trachomatis
cauuuccuaaggcuugggugacu

SEQ ID NO: 2491823 - RNA, 18 nt, Chlamydia trachomatis
cauuucgaguuuuuuugu

SEQ ID NO: 2491824 - RNA, 20 nt, Chlamydia trachomatis
cauuucucuccaaaccaguu

SEQ ID NO: 2491825 - RNA, 19 nt, Chlamydia trachomatis
cauuucugcaacucucuug

SEQ ID NO: 2491826 - RNA, 22 nt, Chlamydia trachomatis
cauuugagacgggaaccccuca

SEQ ID NO: 2491827 - RNA, 20 nt, Chlamydia trachomatis
cauuugauaguuuuguaaac

SEQ ID NO: 2491828 - RNA, 16 nt, Chlamydia trachomatis
cauuugccauauccuu

SEQ ID NO: 2491829 - RNA, 16 nt, Chlamydia trachomatis
cauuugcgugauaaaa

SEQ ID NO: 2491830 - RNA, 15 nt, Chlamydia trachomatis
cauuugggagauaca

SEQ ID NO: 2491831 - RNA, 21 nt, Chlamydia trachomatis
cauuugucuucgcaaacugcu

SEQ ID NO: 2491832 - RNA, 13 nt, Chlamydia trachomatis
cauuugugugcca

SEQ ID NO: 2491833 - RNA, 21 nt, Chlamydia trachomatis
cauuuuaaggacuucaacaaa

SEQ ID NO: 2491834 - RNA, 15 nt, Chlamydia trachomatis
cauuuuccaagaaaa

SEQ ID NO: 2491835 - RNA, 21 nt, Chlamydia trachomatis
cauuuucguaagcauagcuuc

SEQ ID NO: 2491836 - RNA, 14 nt, Chlamydia trachomatis
cauuuucuguaauu

SEQ ID NO: 2491837 - RNA, 15 nt, Chlamydia trachomatis
cauuuucuugaggag

SEQ ID NO: 2491838 - RNA, 21 nt, Chlamydia trachomatis
ccaaaaaagcgucuccaaaag

SEQ ID NO: 2491839 - RNA, 14 nt, Chlamydia trachomatis
ccaaaaacaaucaa

SEQ ID NO: 2491840 - RNA, 20 nt, Chlamydia trachomatis
ccaaaaacagcagaacucaa

SEQ ID NO: 2491841 - RNA, 11 nt, Chlamydia trachomatis
ccaaaaagaaa

SEQ ID NO: 2491842 - RNA, 20 nt, Chlamydia trachomatis
ccaaaaaggaaaucacugaa

SEQ ID NO: 2491843 - RNA, 15 nt, Chlamydia trachomatis
ccaaaaaucauuucc

SEQ ID NO: 2491844 - RNA, 15 nt, Chlamydia trachomatis
ccaaaaaugaacaua

SEQ ID NO: 2491845 - RNA, 13 nt, Chlamydia trachomatis
ccaaaacaaacaa

SEQ ID NO: 2491846 - RNA, 14 nt, Chlamydia trachomatis
ccaaaagaucuuga

SEQ ID NO: 2491847 - RNA, 21 nt, Chlamydia trachomatis
ccaaaaguguuuagaagugcu

SEQ ID NO: 2491848 - RNA, 22 nt, Chlamydia trachomatis
ccaaaauaucuacuucuuguuc

SEQ ID NO: 2491849 - RNA, 12 nt, Chlamydia trachomatis
ccaaaaucuuca

SEQ ID NO: 2491850 - RNA, 22 nt, Chlamydia trachomatis
ccaaacauaagaggcaccucuu

SEQ ID NO: 2491851 - RNA, 18 nt, Chlamydia trachomatis
ccaaacaucaugguugcu

SEQ ID NO: 2491852 - RNA, 13 nt, Chlamydia trachomatis
ccaaacauuuuga

SEQ ID NO: 2491853 - RNA, 15 nt, Chlamydia trachomatis
ccaaagaaauagcua

SEQ ID NO: 2491854 - RNA, 14 nt, Chlamydia trachomatis
ccaaagaauagaau

SEQ ID NO: 2491855 - RNA, 14 nt, Chlamydia trachomatis
ccaaagaauuuuua

SEQ ID NO: 2491856 - RNA, 21 nt, Chlamydia trachomatis
ccaaagaugcuccuacaaaau

SEQ ID NO: 2491857 - RNA, 13 nt, Chlamydia trachomatis
ccaaagcuucuaa

SEQ ID NO: 2491858 - RNA, 15 nt, Chlamydia trachomatis
ccaaagguuguugcu

SEQ ID NO: 2491859 - RNA, 12 nt, Chlamydia trachomatis
ccaaaguaaaau

SEQ ID NO: 2491860 - RNA, 21 nt, Chlamydia trachomatis
ccaaaguaaucucuuaauccu

SEQ ID NO: 2491861 - RNA, 13 nt, Chlamydia trachomatis
ccaaauaaacaca

SEQ ID NO: 2491862 - RNA, 20 nt, Chlamydia trachomatis
ccaaauaauacuccaccuag

SEQ ID NO: 2491863 - RNA, 11 nt, Chlamydia trachomatis
ccaaaucaaac

SEQ ID NO: 2491864 - RNA, 15 nt, Chlamydia trachomatis
ccaaauccuccauaa

SEQ ID NO: 2491865 - RNA, 22 nt, Chlamydia trachomatis
ccaaaucugcaagaacaaagaa

SEQ ID NO: 2491866 - RNA, 11 nt, Chlamydia trachomatis
ccaacaaaaag

SEQ ID NO: 2491867 - RNA, 13 nt, Chlamydia trachomatis
ccaacagaccccu

SEQ ID NO: 2491868 - RNA, 21 nt, Chlamydia trachomatis
ccaacgagugccgaauaauga

SEQ ID NO: 2491869 - RNA, 17 nt, Chlamydia trachomatis
ccaacgcaucuccaaag

SEQ ID NO: 2491870 - RNA, 15 nt, Chlamydia trachomatis
ccaacgucccugugu

SEQ ID NO: 2491871 - RNA, 20 nt, Chlamydia trachomatis
ccaacuauugaaauaccacu

SEQ ID NO: 2491872 - RNA, 15 nt, Chlamydia trachomatis
ccaagaacaaagcau

SEQ ID NO: 2491873 - RNA, 20 nt, Chlamydia trachomatis
ccaagauguuggagaacauc

SEQ ID NO: 2491874 - RNA, 15 nt, Chlamydia trachomatis
ccaagcacuccucag

SEQ ID NO: 2491875 - RNA, 15 nt, Chlamydia trachomatis
ccaagccauuuccag

SEQ ID NO: 2491876 - RNA, 19 nt, Chlamydia trachomatis
ccaaggaaaagaugaagaa

SEQ ID NO: 2491877 - RNA, 13 nt, Chlamydia trachomatis
ccaaggaaaccaa

SEQ ID NO: 2491878 - RNA, 18 nt, Chlamydia trachomatis
ccaaggauuuuuuuccca

SEQ ID NO: 2491879 - RNA, 19 nt, Chlamydia trachomatis
ccaagggaugaagcuaaaa

SEQ ID NO: 2491880 - RNA, 20 nt, Chlamydia trachomatis
ccaagggggguuaagaaaac

SEQ ID NO: 2491881 - RNA, 14 nt, Chlamydia trachomatis
ccaaguaauucaac

SEQ ID NO: 2491882 - RNA, 18 nt, Chlamydia trachomatis
ccaaguuuuuuucauccu

SEQ ID NO: 2491883 - RNA, 23 nt, Chlamydia trachomatis
ccaauaauccauuccggcucucu

SEQ ID NO: 2491884 - RNA, 17 nt, Chlamydia trachomatis
ccaauauauuccugucu

SEQ ID NO: 2491885 - RNA, 14 nt, Chlamydia trachomatis
ccaauauuuuuucu

SEQ ID NO: 2491886 - RNA, 17 nt, Chlamydia trachomatis
ccaaucaguguacccuc

SEQ ID NO: 2491887 - RNA, 18 nt, Chlamydia trachomatis
ccaaucguauaauaaugg

SEQ ID NO: 2491888 - RNA, 19 nt, Chlamydia trachomatis
ccaaugaaauaucauuccc

SEQ ID NO: 2491889 - RNA, 19 nt, Chlamydia trachomatis
ccaauggaccagaucauag

SEQ ID NO: 2491890 - RNA, 15 nt, Chlamydia trachomatis
ccaauuaaguuccuu

SEQ ID NO: 2491891 - RNA, 15 nt, Chlamydia trachomatis
ccacaaaaucagcaa

SEQ ID NO: 2491892 - RNA, 18 nt, Chlamydia trachomatis
ccacaaacaaaaaagaaa

SEQ ID NO: 2491893 - RNA, 16 nt, Chlamydia trachomatis
ccacaaacaauuccac

SEQ ID NO: 2491894 - RNA, 12 nt, Chlamydia trachomatis
ccacaagaagua

SEQ ID NO: 2491895 - RNA, 21 nt, Chlamydia trachomatis
ccacacauguccuaccaauau

SEQ ID NO: 2491896 - RNA, 14 nt, Chlamydia trachomatis
ccacacuaccccgc

SEQ ID NO: 2491897 - RNA, 20 nt, Chlamydia trachomatis
ccacacuuccccauucuucu

SEQ ID NO: 2491898 - RNA, 22 nt, Chlamydia trachomatis
ccacagaacaugggcgucucuu

SEQ ID NO: 2491899 - RNA, 21 nt, Chlamydia trachomatis
ccacagguugcaucaacaaua

SEQ ID NO: 2491900 - RNA, 15 nt, Chlamydia trachomatis
ccacaguucccaucc

SEQ ID NO: 2491901 - RNA, 16 nt, Chlamydia trachomatis
ccacaugguucaaaca

SEQ ID NO: 2491902 - RNA, 15 nt, Chlamydia trachomatis
ccacauucacuucaa

SEQ ID NO: 2491903 - RNA, 16 nt, Chlamydia trachomatis
ccaccagacuauuucu

SEQ ID NO: 2491904 - RNA, 16 nt, Chlamydia trachomatis
ccaccauagguagaaa

SEQ ID NO: 2491905 - RNA, 14 nt, Chlamydia trachomatis
ccacccuucccaac

SEQ ID NO: 2491906 - RNA, 13 nt, Chlamydia trachomatis
ccaccgcaugaaa

SEQ ID NO: 2491907 - RNA, 16 nt, Chlamydia trachomatis
ccacgaagagcaaaau

SEQ ID NO: 2491908 - RNA, 15 nt, Chlamydia trachomatis
ccacgaugagauaca

SEQ ID NO: 2491909 - RNA, 21 nt, Chlamydia trachomatis
ccacgguaaucuucacggaga

SEQ ID NO: 2491910 - RNA, 14 nt, Chlamydia trachomatis
ccacuaaucccacc

SEQ ID NO: 2491911 - RNA, 19 nt, Chlamydia trachomatis
ccacuccugcagcuaaaga

SEQ ID NO: 2491912 - RNA, 22 nt, Chlamydia trachomatis
ccacucuucagguugcuugaau

SEQ ID NO: 2491913 - RNA, 18 nt, Chlamydia trachomatis
ccacugguucucuuuauc

SEQ ID NO: 2491914 - RNA, 17 nt, Chlamydia trachomatis
ccacuugcuccacacaa

SEQ ID NO: 2491915 - RNA, 23 nt, Chlamydia trachomatis
ccacuuuccgaaauaauugcgaa

SEQ ID NO: 2491916 - RNA, 22 nt, Chlamydia trachomatis
ccagaaacaggagaaagaaccu

SEQ ID NO: 2491917 - RNA, 22 nt, Chlamydia trachomatis
ccagaacaacuucucuuguucu

SEQ ID NO: 2491918 - RNA, 15 nt, Chlamydia trachomatis
ccagaauauaagcac

SEQ ID NO: 2491919 - RNA, 16 nt, Chlamydia trachomatis
ccagaauauaagcacc

SEQ ID NO: 2491920 - RNA, 23 nt, Chlamydia trachomatis
ccagacaaaaagaaagccuucuc

SEQ ID NO: 2491921 - RNA, 22 nt, Chlamydia trachomatis
ccagagcucauagucugaucca

SEQ ID NO: 2491922 - RNA, 19 nt, Chlamydia trachomatis
ccagagucuccgcuuaaaa

SEQ ID NO: 2491923 - RNA, 16 nt, Chlamydia trachomatis
ccagauacugcuccac

SEQ ID NO: 2491924 - RNA, 21 nt, Chlamydia trachomatis
ccagaucuguuaccugggaaa

SEQ ID NO: 2491925 - RNA, 22 nt, Chlamydia trachomatis
ccagauuuuucaaaaauagcaa

SEQ ID NO: 2491926 - RNA, 20 nt, Chlamydia trachomatis
ccagcagacccaaaugcggc

SEQ ID NO: 2491927 - RNA, 13 nt, Chlamydia trachomatis
ccagcauucauaa

SEQ ID NO: 2491928 - RNA, 16 nt, Chlamydia trachomatis
ccagccucuccagaaa

SEQ ID NO: 2491929 - RNA, 14 nt, Chlamydia trachomatis
ccagccugugcauu

SEQ ID NO: 2491930 - RNA, 15 nt, Chlamydia trachomatis
ccagccugugcauuu

SEQ ID NO: 2491931 - RNA, 20 nt, Chlamydia trachomatis
ccagcgacauucaauaagcc

SEQ ID NO: 2491932 - RNA, 14 nt, Chlamydia trachomatis
ccagcgcuuucuaa

SEQ ID NO: 2491933 - RNA, 20 nt, Chlamydia trachomatis
ccagcgcuuucuaaagcagc

SEQ ID NO: 2491934 - RNA, 16 nt, Chlamydia trachomatis
ccagcuaauaaguuca

SEQ ID NO: 2491935 - RNA, 17 nt, Chlamydia trachomatis
ccagcuaauaaguucac

SEQ ID NO: 2491936 - RNA, 22 nt, Chlamydia trachomatis
ccagcucuaauuaauaacgccc

SEQ ID NO: 2491937 - RNA, 15 nt, Chlamydia trachomatis
ccagcugcugcccaa

SEQ ID NO: 2491938 - RNA, 13 nt, Chlamydia trachomatis
ccagcuucuccau

SEQ ID NO: 2491939 - RNA, 23 nt, Chlamydia trachomatis
ccaggagagucugcuacaaacug

SEQ ID NO: 2491940 - RNA, 18 nt, Chlamydia trachomatis
ccaggagauguaggauuc

SEQ ID NO: 2491941 - RNA, 20 nt, Chlamydia trachomatis
ccaggauaacaaacaacacu

SEQ ID NO: 2491942 - RNA, 16 nt, Chlamydia trachomatis
ccagggagagcuuagg

SEQ ID NO: 2491943 - RNA, 16 nt, Chlamydia trachomatis
ccagggauaaaugaua

SEQ ID NO: 2491944 - RNA, 17 nt, Chlamydia trachomatis
ccagguucguuauucuc

SEQ ID NO: 2491945 - RNA, 23 nt, Chlamydia trachomatis
ccagguuuacggucacuccucca

SEQ ID NO: 2491946 - RNA, 18 nt, Chlamydia trachomatis
ccaguaaucaaauuucuu

SEQ ID NO: 2491947 - RNA, 21 nt, Chlamydia trachomatis
ccaguccucccaaaauaccuu

SEQ ID NO: 2491948 - RNA, 23 nt, Chlamydia trachomatis
ccagugaugaaauugagaacaua

SEQ ID NO: 2491949 - RNA, 18 nt, Chlamydia trachomatis
ccaguuaggcauuccuuu

SEQ ID NO: 2491950 - RNA, 21 nt, Chlamydia trachomatis
ccaguuucuucuacaaguucu

SEQ ID NO: 2491951 - RNA, 22 nt, Chlamydia trachomatis
ccauaacgguagcgucuggaua

SEQ ID NO: 2491952 - RNA, 17 nt, Chlamydia trachomatis
ccauaacguccgcuccu

SEQ ID NO: 2491953 - RNA, 23 nt, Chlamydia trachomatis
ccauaacguccgcuccuucuuuc

SEQ ID NO: 2491954 - RNA, 23 nt, Chlamydia trachomatis
ccauaagacuuugugcaaccucu

SEQ ID NO: 2491955 - RNA, 14 nt, Chlamydia trachomatis
ccauaauaguuaaa

SEQ ID NO: 2491956 - RNA, 13 nt, Chlamydia trachomatis
ccauacaucaucu

SEQ ID NO: 2491957 - RNA, 15 nt, Chlamydia trachomatis
ccauagaaagauaga

SEQ ID NO: 2491958 - RNA, 19 nt, Chlamydia trachomatis
ccauagguagaaaaggaua

SEQ ID NO: 2491959 - RNA, 17 nt, Chlamydia trachomatis
ccauaguaccucgagca

SEQ ID NO: 2491960 - RNA, 22 nt, Chlamydia trachomatis
ccauaucaaagcuaacucaccu

SEQ ID NO: 2491961 - RNA, 17 nt, Chlamydia trachomatis
ccauauccauaacuuua

SEQ ID NO: 2491962 - RNA, 21 nt, Chlamydia trachomatis
ccaucaucgaugauaucuucu

SEQ ID NO: 2491963 - RNA, 21 nt, Chlamydia trachomatis
ccauccaaaacaucccagcaa

SEQ ID NO: 2491964 - RNA, 16 nt, Chlamydia trachomatis
ccauccaguugguaca

SEQ ID NO: 2491965 - RNA, 16 nt, Chlamydia trachomatis
ccauccugaacaauau

SEQ ID NO: 2491966 - RNA, 18 nt, Chlamydia trachomatis
ccaucgccuucuauagcu

SEQ ID NO: 2491967 - RNA, 17 nt, Chlamydia trachomatis
ccaucguugauauugac

SEQ ID NO: 2491968 - RNA, 22 nt, Chlamydia trachomatis
ccaucucggaucgagaagagcc

SEQ ID NO: 2491969 - RNA, 15 nt, Chlamydia trachomatis
ccaucugacuuuuua

SEQ ID NO: 2491970 - RNA, 15 nt, Chlamydia trachomatis
ccaucuguaaagcuu

SEQ ID NO: 2491971 - RNA, 21 nt, Chlamydia trachomatis
ccaucuucaauggcaaaacuu

SEQ ID NO: 2491972 - RNA, 18 nt, Chlamydia trachomatis
ccaucuucaccaacucca

SEQ ID NO: 2491973 - RNA, 20 nt, Chlamydia trachomatis
ccaucuugcacauuuucuug

SEQ ID NO: 2491974 - RNA, 17 nt, Chlamydia trachomatis
ccaucuuuaaagaggau

SEQ ID NO: 2491975 - RNA, 18 nt, Chlamydia trachomatis
ccaucuuuaaagaggauc

SEQ ID NO: 2491976 - RNA, 21 nt, Chlamydia trachomatis
ccaugaacagcauuuacuccu

SEQ ID NO: 2491977 - RNA, 14 nt, Chlamydia trachomatis
ccaugaaugacugc

SEQ ID NO: 2491978 - RNA, 21 nt, Chlamydia trachomatis
ccaugaaugacugcgcuauga

SEQ ID NO: 2491979 - RNA, 22 nt, Chlamydia trachomatis
ccaugacauaagcaaauccugc

SEQ ID NO: 2491980 - RNA, 13 nt, Chlamydia trachomatis
ccaugaucucugc

SEQ ID NO: 2491981 - RNA, 19 nt, Chlamydia trachomatis
ccaugaucucugcagaaga

SEQ ID NO: 2491982 - RNA, 22 nt, Chlamydia trachomatis
ccaugaucucugcagaagaagc

SEQ ID NO: 2491983 - RNA, 12 nt, Chlamydia trachomatis
ccaugaugcugc

SEQ ID NO: 2491984 - RNA, 20 nt, Chlamydia trachomatis
ccaugauuucuuuaacaucu

SEQ ID NO: 2491985 - RNA, 19 nt, Chlamydia trachomatis
ccaugcaucuccucuggag

SEQ ID NO: 2491986 - RNA, 21 nt, Chlamydia trachomatis
ccaugcaucuccucuggagcc

SEQ ID NO: 2491987 - RNA, 14 nt, Chlamydia trachomatis
ccauggaauagcuu

SEQ ID NO: 2491988 - RNA, 14 nt, Chlamydia trachomatis
ccauggcaguuaag

SEQ ID NO: 2491989 - RNA, 23 nt, Chlamydia trachomatis
ccaugggaucuagaaguuuuccc

SEQ ID NO: 2491990 - RNA, 13 nt, Chlamydia trachomatis
ccauguuuuuagu

SEQ ID NO: 2491991 - RNA, 21 nt, Chlamydia trachomatis
ccauucagcccaaucacccca

SEQ ID NO: 2491992 - RNA, 12 nt, Chlamydia trachomatis
ccauuccuccua

SEQ ID NO: 2491993 - RNA, 16 nt, Chlamydia trachomatis
ccauucuucucgaacu

SEQ ID NO: 2491994 - RNA, 21 nt, Chlamydia trachomatis
ccauuggaauuuucaucaaaa

SEQ ID NO: 2491995 - RNA, 17 nt, Chlamydia trachomatis
ccauuucaugacagcuu

SEQ ID NO: 2491996 - RNA, 22 nt, Chlamydia trachomatis
ccauuucaugacagcuucuuga

SEQ ID NO: 2491997 - RNA, 12 nt, Chlamydia trachomatis
ccauuuccacag

SEQ ID NO: 2491998 - RNA, 20 nt, Chlamydia trachomatis
ccauuuccagccucuccaga

SEQ ID NO: 2491999 - RNA, 22 nt, Chlamydia trachomatis
ccauuuucauggcugcaauucu

SEQ ID NO: 2492000 - RNA, 16 nt, Chlamydia trachomatis
cccaaaaacaaucaaa

SEQ ID NO: 2492001 - RNA, 20 nt, Chlamydia trachomatis
cccaaaaacaaucaaagcac

SEQ ID NO: 2492002 - RNA, 13 nt, Chlamydia trachomatis
cccaaaagaauga

SEQ ID NO: 2492003 - RNA, 16 nt, Chlamydia trachomatis
cccaaaauagcaggaa

SEQ ID NO: 2492004 - RNA, 19 nt, Chlamydia trachomatis
cccaaaauuuuucugcucc

SEQ ID NO: 2492005 - RNA, 22 nt, Chlamydia trachomatis
cccaaaauuuuucugcuccaaa

SEQ ID NO: 2492006 - RNA, 21 nt, Chlamydia trachomatis
cccaaagucaucgcuaaucuc

SEQ ID NO: 2492007 - RNA, 14 nt, Chlamydia trachomatis
cccaacgcaucucc

SEQ ID NO: 2492008 - RNA, 20 nt, Chlamydia trachomatis
cccaagaaacuuuucugcag

SEQ ID NO: 2492009 - RNA, 17 nt, Chlamydia trachomatis
cccaagaagcgaagcau

SEQ ID NO: 2492010 - RNA, 18 nt, Chlamydia trachomatis
cccaaggaaaagaugaag

SEQ ID NO: 2492011 - RNA, 12 nt, Chlamydia trachomatis
cccaaucacccc

SEQ ID NO: 2492012 - RNA, 20 nt, Chlamydia trachomatis
cccaaucgaguagcaauaac

SEQ ID NO: 2492013 - RNA, 16 nt, Chlamydia trachomatis
cccaauuaaaacaaua

SEQ ID NO: 2492014 - RNA, 17 nt, Chlamydia trachomatis
cccagaacaacuucucu

SEQ ID NO: 2492015 - RNA, 16 nt, Chlamydia trachomatis
cccagauuacauugag

SEQ ID NO: 2492016 - RNA, 19 nt, Chlamydia trachomatis
cccagauuuuucaaaaaua

SEQ ID NO: 2492017 - RNA, 19 nt, Chlamydia trachomatis
cccagcaauaccgaaucua

SEQ ID NO: 2492018 - RNA, 21 nt, Chlamydia trachomatis
cccagcuuauuaauuucuaga

SEQ ID NO: 2492019 - RNA, 14 nt, Chlamydia trachomatis
cccagugacuauuu

SEQ ID NO: 2492020 - RNA, 18 nt, Chlamydia trachomatis
cccauaaaagccauagcc

SEQ ID NO: 2492021 - RNA, 14 nt, Chlamydia trachomatis
cccaucccuugcaa

SEQ ID NO: 2492022 - RNA, 21 nt, Chlamydia trachomatis
cccaucgauuuuugcuaagca

SEQ ID NO: 2492023 - RNA, 17 nt, Chlamydia trachomatis
cccaucuugcacauuuu

SEQ ID NO: 2492024 - RNA, 21 nt, Chlamydia trachomatis
cccaugaacagcauuuacucc

SEQ ID NO: 2492025 - RNA, 20 nt, Chlamydia trachomatis
cccaugacauacauaagaac

SEQ ID NO: 2492026 - RNA, 20 nt, Chlamydia trachomatis
cccaugguauagaagaccuu

SEQ ID NO: 2492027 - RNA, 15 nt, Chlamydia trachomatis
ccccagaaacacuau

SEQ ID NO: 2492028 - RNA, 15 nt, Chlamydia trachomatis
ccccagaagccauaa

SEQ ID NO: 2492029 - RNA, 19 nt, Chlamydia trachomatis
ccccaucccuugcaaaaau

SEQ ID NO: 2492030 - RNA, 13 nt, Chlamydia trachomatis
ccccuacaaacau

SEQ ID NO: 2492031 - RNA, 19 nt, Chlamydia trachomatis
ccccuauguaaacaagaau

SEQ ID NO: 2492032 - RNA, 23 nt, Chlamydia trachomatis
ccccuggaauuucuccagcaucu

SEQ ID NO: 2492033 - RNA, 23 nt, Chlamydia trachomatis
ccccuuagggaaaccccaauguu

SEQ ID NO: 2492034 - RNA, 16 nt, Chlamydia trachomatis
ccccuuuuuuuauucu

SEQ ID NO: 2492035 - RNA, 16 nt, Chlamydia trachomatis
cccgauuacuugagaa

SEQ ID NO: 2492036 - RNA, 13 nt, Chlamydia trachomatis
cccgauucaaaaa

SEQ ID NO: 2492037 - RNA, 20 nt, Chlamydia trachomatis
cccgauucaaaaaucgcuga

SEQ ID NO: 2492038 - RNA, 21 nt, Chlamydia trachomatis
cccguguugaauuacuugggg

SEQ ID NO: 2492039 - RNA, 19 nt, Chlamydia trachomatis
cccguuaaugggucaagaa

SEQ ID NO: 2492040 - RNA, 22 nt, Chlamydia trachomatis
cccuaaaagagcuucuucuaaa

SEQ ID NO: 2492041 - RNA, 23 nt, Chlamydia trachomatis
cccuaaauauagguagguuucug

SEQ ID NO: 2492042 - RNA, 19 nt, Chlamydia trachomatis
cccuaacgaggcacaaaau

SEQ ID NO: 2492043 - RNA, 17 nt, Chlamydia trachomatis
cccuaauaugaagaacu

SEQ ID NO: 2492044 - RNA, 17 nt, Chlamydia trachomatis
cccuaaucgaauuacuc

SEQ ID NO: 2492045 - RNA, 20 nt, Chlamydia trachomatis
cccuaaucgaauuacucugc

SEQ ID NO: 2492046 - RNA, 21 nt, Chlamydia trachomatis
cccuaaucgaauuacucugcc

SEQ ID NO: 2492047 - RNA, 13 nt, Chlamydia trachomatis
cccuaccuucagc

SEQ ID NO: 2492048 - RNA, 22 nt, Chlamydia trachomatis
cccuacgcuacgagcaacacga

SEQ ID NO: 2492049 - RNA, 19 nt, Chlamydia trachomatis
cccuacggaauagccucca

SEQ ID NO: 2492050 - RNA, 15 nt, Chlamydia trachomatis
cccuaguacaaaaau

SEQ ID NO: 2492051 - RNA, 19 nt, Chlamydia trachomatis
cccuagucgagaagaaggu

SEQ ID NO: 2492052 - RNA, 18 nt, Chlamydia trachomatis
cccuauccccccuacauu

SEQ ID NO: 2492053 - RNA, 22 nt, Chlamydia trachomatis
cccuauguaaacaagaauaaua

SEQ ID NO: 2492054 - RNA, 16 nt, Chlamydia trachomatis
cccuccgcugauuaga

SEQ ID NO: 2492055 - RNA, 17 nt, Chlamydia trachomatis
cccucgacgcuguccaa

SEQ ID NO: 2492056 - RNA, 13 nt, Chlamydia trachomatis
cccucucucagau

SEQ ID NO: 2492057 - RNA, 13 nt, Chlamydia trachomatis
cccucuucucuca

SEQ ID NO: 2492058 - RNA, 20 nt, Chlamydia trachomatis
cccucuuuagccaauuucca

SEQ ID NO: 2492059 - RNA, 22 nt, Chlamydia trachomatis
cccucuuuuucaccagcaaaag

SEQ ID NO: 2492060 - RNA, 16 nt, Chlamydia trachomatis
cccugaacauccacca

SEQ ID NO: 2492061 - RNA, 16 nt, Chlamydia trachomatis
cccugaacuaacacgu

SEQ ID NO: 2492062 - RNA, 14 nt, Chlamydia trachomatis
cccugcaccucuuu

SEQ ID NO: 2492063 - RNA, 17 nt, Chlamydia trachomatis
cccugcagccucugccg

SEQ ID NO: 2492064 - RNA, 20 nt, Chlamydia trachomatis
cccuuaacacccucuuccuu

SEQ ID NO: 2492065 - RNA, 21 nt, Chlamydia trachomatis
cccuuacaauguaaacaauau

SEQ ID NO: 2492066 - RNA, 22 nt, Chlamydia trachomatis
cccuuacccaaacaucuacacg

SEQ ID NO: 2492067 - RNA, 23 nt, Chlamydia trachomatis
cccuuccaaauuucccucuuccc

SEQ ID NO: 2492068 - RNA, 23 nt, Chlamydia trachomatis
cccuuccaauaauuugcgcgucu

SEQ ID NO: 2492069 - RNA, 23 nt, Chlamydia trachomatis
cccuucuaacuacucccaaauca

SEQ ID NO: 2492070 - RNA, 22 nt, Chlamydia trachomatis
cccuucuuucuucuaagaaguu

SEQ ID NO: 2492071 - RNA, 14 nt, Chlamydia trachomatis
cccuuugguuuuga

SEQ ID NO: 2492072 - RNA, 16 nt, Chlamydia trachomatis
cccuuuuguuccagaa

SEQ ID NO: 2492073 - RNA, 20 nt, Chlamydia trachomatis
cccuuuuguuccagaaaaaa

SEQ ID NO: 2492074 - RNA, 20 nt, Chlamydia trachomatis
cccuuuuuauaaucuccuaa

SEQ ID NO: 2492075 - RNA, 19 nt, Chlamydia trachomatis
ccgaagcaugauauuuuga

SEQ ID NO: 2492076 - RNA, 18 nt, Chlamydia trachomatis
ccgaagcugcaauagaaa

SEQ ID NO: 2492077 - RNA, 16 nt, Chlamydia trachomatis
ccgaagguucuucuuc

SEQ ID NO: 2492078 - RNA, 13 nt, Chlamydia trachomatis
ccgaauaaaauca

SEQ ID NO: 2492079 - RNA, 20 nt, Chlamydia trachomatis
ccgaauuaaaucugcuccua

SEQ ID NO: 2492080 - RNA, 22 nt, Chlamydia trachomatis
ccgacaguuucccguuguuuuc

SEQ ID NO: 2492081 - RNA, 21 nt, Chlamydia trachomatis
ccgagagaagcuccucuucuu

SEQ ID NO: 2492082 - RNA, 13 nt, Chlamydia trachomatis
ccgagccuccgcu

SEQ ID NO: 2492083 - RNA, 16 nt, Chlamydia trachomatis
ccgauagcaugcaaaa

SEQ ID NO: 2492084 - RNA, 17 nt, Chlamydia trachomatis
ccgauguauuuguacca

SEQ ID NO: 2492085 - RNA, 20 nt, Chlamydia trachomatis
ccgauuacuugagaacaaac

SEQ ID NO: 2492086 - RNA, 13 nt, Chlamydia trachomatis
ccgauucaaaaau

SEQ ID NO: 2492087 - RNA, 13 nt, Chlamydia trachomatis
ccgcaaacaaaau

SEQ ID NO: 2492088 - RNA, 18 nt, Chlamydia trachomatis
ccgcagaaaaaaccacag

SEQ ID NO: 2492089 - RNA, 18 nt, Chlamydia trachomatis
ccgcaguaaaaucuaaaa

SEQ ID NO: 2492090 - RNA, 22 nt, Chlamydia trachomatis
ccgcaguaaaaucuaaaauauc

SEQ ID NO: 2492091 - RNA, 23 nt, Chlamydia trachomatis
ccgccaauuuuuuuauccaaaaa

SEQ ID NO: 2492092 - RNA, 20 nt, Chlamydia trachomatis
ccgccguuuguucucugguc

SEQ ID NO: 2492093 - RNA, 16 nt, Chlamydia trachomatis
ccgccuucugcaauga

SEQ ID NO: 2492094 - RNA, 17 nt, Chlamydia trachomatis
ccgccuuugcuaggguu

SEQ ID NO: 2492095 - RNA, 14 nt, Chlamydia trachomatis
ccgcgacagccaca

SEQ ID NO: 2492096 - RNA, 14 nt, Chlamydia trachomatis
ccgcuaauuuuuga

SEQ ID NO: 2492097 - RNA, 13 nt, Chlamydia trachomatis
ccgcuauuuuccu

SEQ ID NO: 2492098 - RNA, 11 nt, Chlamydia trachomatis
ccgcucuucca

SEQ ID NO: 2492099 - RNA, 14 nt, Chlamydia trachomatis
ccgcugauuagaaa

SEQ ID NO: 2492100 - RNA, 15 nt, Chlamydia trachomatis
ccgcugcucuaacca

SEQ ID NO: 2492101 - RNA, 16 nt, Chlamydia trachomatis
ccgcuuaagcuguucu

SEQ ID NO: 2492102 - RNA, 20 nt, Chlamydia trachomatis
ccgcuuaagcuguucuucca

SEQ ID NO: 2492103 - RNA, 23 nt, Chlamydia trachomatis
ccgcuucuucauguucugugaaa

SEQ ID NO: 2492104 - RNA, 16 nt, Chlamydia trachomatis
ccggaaaccuguuucu

SEQ ID NO: 2492105 - RNA, 15 nt, Chlamydia trachomatis
ccggaguaccaaaaa

SEQ ID NO: 2492106 - RNA, 18 nt, Chlamydia trachomatis
ccggaguaccaaaaaauc

SEQ ID NO: 2492107 - RNA, 19 nt, Chlamydia trachomatis
ccggcaaagaacaguucau

SEQ ID NO: 2492108 - RNA, 14 nt, Chlamydia trachomatis
ccguaaggaagcca

SEQ ID NO: 2492109 - RNA, 15 nt, Chlamydia trachomatis
ccguaaggaagccag

SEQ ID NO: 2492110 - RNA, 22 nt, Chlamydia trachomatis
ccguaaggaagccagccccucc

SEQ ID NO: 2492111 - RNA, 13 nt, Chlamydia trachomatis
ccguauccuuucg

SEQ ID NO: 2492112 - RNA, 23 nt, Chlamydia trachomatis
ccguauuuuuuacgcucuuucuu

SEQ ID NO: 2492113 - RNA, 23 nt, Chlamydia trachomatis
ccgucuguauaacaauuuuaaaa

SEQ ID NO: 2492114 - RNA, 16 nt, Chlamydia trachomatis
ccgugcuugcuuucuu

SEQ ID NO: 2492115 - RNA, 22 nt, Chlamydia trachomatis
ccguucaaagcaaacuucauau

SEQ ID NO: 2492116 - RNA, 18 nt, Chlamydia trachomatis
ccguuccaucuuccaaag

SEQ ID NO: 2492117 - RNA, 21 nt, Chlamydia trachomatis
ccguucgggucauaaacauau

SEQ ID NO: 2492118 - RNA, 11 nt, Chlamydia trachomatis
ccguugauagu

SEQ ID NO: 2492119 - RNA, 15 nt, Chlamydia trachomatis
ccguuuguucucugg

SEQ ID NO: 2492120 - RNA, 19 nt, Chlamydia trachomatis
ccuaaaaaaaaccauucca

SEQ ID NO: 2492121 - RNA, 20 nt, Chlamydia trachomatis
ccuaaaaaaaaccauuccac

SEQ ID NO: 2492122 - RNA, 13 nt, Chlamydia trachomatis
ccuaaacaaaugu

SEQ ID NO: 2492123 - RNA, 18 nt, Chlamydia trachomatis
ccuaaagagacgcaugcu

SEQ ID NO: 2492124 - RNA, 17 nt, Chlamydia trachomatis
ccuaaauaccucuuuuu

SEQ ID NO: 2492125 - RNA, 17 nt, Chlamydia trachomatis
ccuaaauucauaacacc

SEQ ID NO: 2492126 - RNA, 17 nt, Chlamydia trachomatis
ccuaacgaggcacaaaa

SEQ ID NO: 2492127 - RNA, 18 nt, Chlamydia trachomatis
ccuaacgaggcacaaaau

SEQ ID NO: 2492128 - RNA, 19 nt, Chlamydia trachomatis
ccuaagaucucuuccuugu

SEQ ID NO: 2492129 - RNA, 21 nt, Chlamydia trachomatis
ccuaagccgaguagacucuaa

SEQ ID NO: 2492130 - RNA, 22 nt, Chlamydia trachomatis
ccuaauacuaaacuaucuaaaa

SEQ ID NO: 2492131 - RNA, 11 nt, Chlamydia trachomatis
ccuaauagaaa

SEQ ID NO: 2492132 - RNA, 16 nt, Chlamydia trachomatis
ccuaauagaaauagcu

SEQ ID NO: 2492133 - RNA, 20 nt, Chlamydia trachomatis
ccuaauagaucuacagcaaa

SEQ ID NO: 2492134 - RNA, 16 nt, Chlamydia trachomatis
ccuaauaucugcucua

SEQ ID NO: 2492135 - RNA, 22 nt, Chlamydia trachomatis
ccuaaucuuucuaauuucccuc

SEQ ID NO: 2492136 - RNA, 12 nt, Chlamydia trachomatis
ccuaauucaaca

SEQ ID NO: 2492137 - RNA, 15 nt, Chlamydia trachomatis
ccuaauuuaaaaucu

SEQ ID NO: 2492138 - RNA, 19 nt, Chlamydia trachomatis
ccuaauuuucuaggagaag

SEQ ID NO: 2492139 - RNA, 16 nt, Chlamydia trachomatis
ccuacaaacauccuua

SEQ ID NO: 2492140 - RNA, 16 nt, Chlamydia trachomatis
ccuacaaauaaagucu

SEQ ID NO: 2492141 - RNA, 13 nt, Chlamydia trachomatis
ccuacagaaucag

SEQ ID NO: 2492142 - RNA, 17 nt, Chlamydia trachomatis
ccuacauacaugcuuuu

SEQ ID NO: 2492143 - RNA, 19 nt, Chlamydia trachomatis
ccuacauacaugcuuuuga

SEQ ID NO: 2492144 - RNA, 19 nt, Chlamydia trachomatis
ccuaccaucaauccuggaa

SEQ ID NO: 2492145 - RNA, 16 nt, Chlamydia trachomatis
ccuacuccaauggaaa

SEQ ID NO: 2492146 - RNA, 15 nt, Chlamydia trachomatis
ccuagagccaaucca

SEQ ID NO: 2492147 - RNA, 16 nt, Chlamydia trachomatis
ccuagcagcucuuacu

SEQ ID NO: 2492148 - RNA, 22 nt, Chlamydia trachomatis
ccuaggcgacacgcuucuucaa

SEQ ID NO: 2492149 - RNA, 14 nt, Chlamydia trachomatis
ccuaguacaaaaau

SEQ ID NO: 2492150 - RNA, 15 nt, Chlamydia trachomatis
ccuauaauugcuaag

SEQ ID NO: 2492151 - RNA, 18 nt, Chlamydia trachomatis
ccuauacgaaauaacaaa

SEQ ID NO: 2492152 - RNA, 21 nt, Chlamydia trachomatis
ccuauagaagacuaaucuucc

SEQ ID NO: 2492153 - RNA, 14 nt, Chlamydia trachomatis
ccuauagagcaauc

SEQ ID NO: 2492154 - RNA, 16 nt, Chlamydia trachomatis
ccuauagagcaaucuc

SEQ ID NO: 2492155 - RNA, 14 nt, Chlamydia trachomatis
ccuauccaaggaaa

SEQ ID NO: 2492156 - RNA, 17 nt, Chlamydia trachomatis
ccuauguaaacaagaau

SEQ ID NO: 2492157 - RNA, 18 nt, Chlamydia trachomatis
ccuauuucaccacuuuuc

SEQ ID NO: 2492158 - RNA, 12 nt, Chlamydia trachomatis
ccuauuuuuucc

SEQ ID NO: 2492159 - RNA, 18 nt, Chlamydia trachomatis
ccucaaacaaucuaaaaa

SEQ ID NO: 2492160 - RNA, 21 nt, Chlamydia trachomatis
ccucaaacaaucuaaaaaauu

SEQ ID NO: 2492161 - RNA, 22 nt, Chlamydia trachomatis
ccucaauuuguagcaaaagauu

SEQ ID NO: 2492162 - RNA, 15 nt, Chlamydia trachomatis
ccucaccucuugccu

SEQ ID NO: 2492163 - RNA, 20 nt, Chlamydia trachomatis
ccucagcauagcgcuucccg

SEQ ID NO: 2492164 - RNA, 15 nt, Chlamydia trachomatis
ccucauuuaaaaguc

SEQ ID NO: 2492165 - RNA, 21 nt, Chlamydia trachomatis
ccuccaaagaugcuccuacaa

SEQ ID NO: 2492166 - RNA, 18 nt, Chlamydia trachomatis
ccuccagauacugcucca

SEQ ID NO: 2492167 - RNA, 21 nt, Chlamydia trachomatis
ccuccagcgcacacuuuucag

SEQ ID NO: 2492168 - RNA, 14 nt, Chlamydia trachomatis
ccuccuaaacaaau

SEQ ID NO: 2492169 - RNA, 13 nt, Chlamydia trachomatis
ccuccuaaauacc

SEQ ID NO: 2492170 - RNA, 16 nt, Chlamydia trachomatis
ccuccuagaaagaacc

SEQ ID NO: 2492171 - RNA, 19 nt, Chlamydia trachomatis
ccuccuagaaagaaccaca

SEQ ID NO: 2492172 - RNA, 12 nt, Chlamydia trachomatis
ccuccuccucgc

SEQ ID NO: 2492173 - RNA, 15 nt, Chlamydia trachomatis
ccucgauaaugcuua

SEQ ID NO: 2492174 - RNA, 22 nt, Chlamydia trachomatis
ccucgauccgguucuuuuguaa

SEQ ID NO: 2492175 - RNA, 18 nt, Chlamydia trachomatis
ccucgcagagaaagagcc

SEQ ID NO: 2492176 - RNA, 19 nt, Chlamydia trachomatis
ccucgcagagaaagagcca

SEQ ID NO: 2492177 - RNA, 17 nt, Chlamydia trachomatis
ccucgguaaccccaugu

SEQ ID NO: 2492178 - RNA, 13 nt, Chlamydia trachomatis
ccucgucuacacc

SEQ ID NO: 2492179 - RNA, 22 nt, Chlamydia trachomatis
ccucuaaacaagguucuucaac

SEQ ID NO: 2492180 - RNA, 17 nt, Chlamydia trachomatis
ccucuaaagauccucuu

SEQ ID NO: 2492181 - RNA, 19 nt, Chlamydia trachomatis
ccucuaagcaccuuuacaa

SEQ ID NO: 2492182 - RNA, 14 nt, Chlamydia trachomatis
ccucuagcagagau

SEQ ID NO: 2492183 - RNA, 20 nt, Chlamydia trachomatis
ccucuauagccaaaugcacc

SEQ ID NO: 2492184 - RNA, 18 nt, Chlamydia trachomatis
ccucucaucaguaaacac

SEQ ID NO: 2492185 - RNA, 19 nt, Chlamydia trachomatis
ccucucuaaaaacucuuuu

SEQ ID NO: 2492186 - RNA, 22 nt, Chlamydia trachomatis
ccucugcguagaucccagaaua

SEQ ID NO: 2492187 - RNA, 12 nt, Chlamydia trachomatis
ccucugcuucuu

SEQ ID NO: 2492188 - RNA, 17 nt, Chlamydia trachomatis
ccucuggggggaaguau

SEQ ID NO: 2492189 - RNA, 14 nt, Chlamydia trachomatis
ccucugucaauaaa

SEQ ID NO: 2492190 - RNA, 17 nt, Chlamydia trachomatis
ccucuguuuugaaauuc

SEQ ID NO: 2492191 - RNA, 19 nt, Chlamydia trachomatis
ccucuucacagagcuucuc

SEQ ID NO: 2492192 - RNA, 11 nt, Chlamydia trachomatis
ccucuucuucg

SEQ ID NO: 2492193 - RNA, 20 nt, Chlamydia trachomatis
ccucuuuacgcacaaagauu

SEQ ID NO: 2492194 - RNA, 12 nt, Chlamydia trachomatis
ccucuuucucuc

SEQ ID NO: 2492195 - RNA, 18 nt, Chlamydia trachomatis
ccugaaacgaucagcucc

SEQ ID NO: 2492196 - RNA, 19 nt, Chlamydia trachomatis
ccugaaacgaucagcuccu

SEQ ID NO: 2492197 - RNA, 20 nt, Chlamydia trachomatis
ccugaaacgaucagcuccug

SEQ ID NO: 2492198 - RNA, 21 nt, Chlamydia trachomatis
ccugaaaguuuuuuccccuga

SEQ ID NO: 2492199 - RNA, 18 nt, Chlamydia trachomatis
ccugaacauccaccagca

SEQ ID NO: 2492200 - RNA, 15 nt, Chlamydia trachomatis
ccugaaggagcgacu

SEQ ID NO: 2492201 - RNA, 15 nt, Chlamydia trachomatis
ccugaccaauaccua

SEQ ID NO: 2492202 - RNA, 23 nt, Chlamydia trachomatis
ccugaccaauaccuacacgauau

SEQ ID NO: 2492203 - RNA, 16 nt, Chlamydia trachomatis
ccugagaaauugcuca

SEQ ID NO: 2492204 - RNA, 16 nt, Chlamydia trachomatis
ccugagcccaaggaga

SEQ ID NO: 2492205 - RNA, 21 nt, Chlamydia trachomatis
ccugagggccuucuuuuuccu

SEQ ID NO: 2492206 - RNA, 21 nt, Chlamydia trachomatis
ccugauagaguccugagccaa

SEQ ID NO: 2492207 - RNA, 16 nt, Chlamydia trachomatis
ccugaucaaaucgggc

SEQ ID NO: 2492208 - RNA, 18 nt, Chlamydia trachomatis
ccugcaagcacacuugau

SEQ ID NO: 2492209 - RNA, 12 nt, Chlamydia trachomatis
ccugcagacaua

SEQ ID NO: 2492210 - RNA, 17 nt, Chlamydia trachomatis
ccugcagcaaauaaggu

SEQ ID NO: 2492211 - RNA, 19 nt, Chlamydia trachomatis
ccugcauuuauccacaggu

SEQ ID NO: 2492212 - RNA, 19 nt, Chlamydia trachomatis
ccugcuucagcagcauaaa

SEQ ID NO: 2492213 - RNA, 15 nt, Chlamydia trachomatis
ccuggagaaaauccc

SEQ ID NO: 2492214 - RNA, 18 nt, Chlamydia trachomatis
ccuggagggaaaacacca

SEQ ID NO: 2492215 - RNA, 20 nt, Chlamydia trachomatis
ccuggauccaaaaaagaauc

SEQ ID NO: 2492216 - RNA, 13 nt, Chlamydia trachomatis
ccuggcugcagaa

SEQ ID NO: 2492217 - RNA, 20 nt, Chlamydia trachomatis
ccugguccaaggaauaaaca

SEQ ID NO: 2492218 - RNA, 18 nt, Chlamydia trachomatis
ccuguagugaaauaagaa

SEQ ID NO: 2492219 - RNA, 23 nt, Chlamydia trachomatis
ccuguaguuagguaaucuucuau

SEQ ID NO: 2492220 - RNA, 19 nt, Chlamydia trachomatis
ccuguaugugaaaauaucu

SEQ ID NO: 2492221 - RNA, 15 nt, Chlamydia trachomatis
ccugucccugcuccg

SEQ ID NO: 2492222 - RNA, 20 nt, Chlamydia trachomatis
ccugugaagaaacuucugga

SEQ ID NO: 2492223 - RNA, 22 nt, Chlamydia trachomatis
ccugugccuuucguuagaaagg

SEQ ID NO: 2492224 - RNA, 21 nt, Chlamydia trachomatis
ccuuaauagugcguccuucuu

SEQ ID NO: 2492225 - RNA, 12 nt, Chlamydia trachomatis
ccuuacccaaac

SEQ ID NO: 2492226 - RNA, 19 nt, Chlamydia trachomatis
ccuuaguuaaaacuccaga

SEQ ID NO: 2492227 - RNA, 18 nt, Chlamydia trachomatis
ccuuauaguuguuuuuga

SEQ ID NO: 2492228 - RNA, 13 nt, Chlamydia trachomatis
ccuuaucuucuug

SEQ ID NO: 2492229 - RNA, 22 nt, Chlamydia trachomatis
ccuuaucuucuugagaaaacuu

SEQ ID NO: 2492230 - RNA, 21 nt, Chlamydia trachomatis
ccuuauggcucagcuucaacu

SEQ ID NO: 2492231 - RNA, 18 nt, Chlamydia trachomatis
ccuucagagguagccaaa

SEQ ID NO: 2492232 - RNA, 16 nt, Chlamydia trachomatis
ccuucaggauuccgga

SEQ ID NO: 2492233 - RNA, 23 nt, Chlamydia trachomatis
ccuucaugucggccgacuaccug

SEQ ID NO: 2492234 - RNA, 11 nt, Chlamydia trachomatis
ccuucauuuca

SEQ ID NO: 2492235 - RNA, 19 nt, Chlamydia trachomatis
ccuuccaaauuucccucuu

SEQ ID NO: 2492236 - RNA, 15 nt, Chlamydia trachomatis
ccuuccccaaaccau

SEQ ID NO: 2492237 - RNA, 17 nt, Chlamydia trachomatis
ccuucccgacagaggau

SEQ ID NO: 2492238 - RNA, 16 nt, Chlamydia trachomatis
ccuuccgcagcuucuu

SEQ ID NO: 2492239 - RNA, 18 nt, Chlamydia trachomatis
ccuucgccgggggagcca

SEQ ID NO: 2492240 - RNA, 20 nt, Chlamydia trachomatis
ccuucucccgcuaauuuuuu

SEQ ID NO: 2492241 - RNA, 11 nt, Chlamydia trachomatis
ccuucugcuau

SEQ ID NO: 2492242 - RNA, 12 nt, Chlamydia trachomatis
ccuucuuccuuc

SEQ ID NO: 2492243 - RNA, 16 nt, Chlamydia trachomatis
ccuucuugaaagcuua

SEQ ID NO: 2492244 - RNA, 17 nt, Chlamydia trachomatis
ccuucuuucuucuaaga

SEQ ID NO: 2492245 - RNA, 14 nt, Chlamydia trachomatis
ccuucuuuuuccuc

SEQ ID NO: 2492246 - RNA, 21 nt, Chlamydia trachomatis
ccuugaaccccuccuccacuu

SEQ ID NO: 2492247 - RNA, 19 nt, Chlamydia trachomatis
ccuugaacguaggccacaa

SEQ ID NO: 2492248 - RNA, 18 nt, Chlamydia trachomatis
ccuugagauccuuaaacu

SEQ ID NO: 2492249 - RNA, 16 nt, Chlamydia trachomatis
ccuugagccuucaauu

SEQ ID NO: 2492250 - RNA, 20 nt, Chlamydia trachomatis
ccuugaggauaguauucuuu

SEQ ID NO: 2492251 - RNA, 21 nt, Chlamydia trachomatis
ccuugaguccgcaaacaaaau

SEQ ID NO: 2492252 - RNA, 21 nt, Chlamydia trachomatis
ccuugaugaauuuuaucuaaa

SEQ ID NO: 2492253 - RNA, 18 nt, Chlamydia trachomatis
ccuugggaaucuucuucg

SEQ ID NO: 2492254 - RNA, 14 nt, Chlamydia trachomatis
ccuugguaauagcc

SEQ ID NO: 2492255 - RNA, 22 nt, Chlamydia trachomatis
ccuuguucccacaccaucuuac

SEQ ID NO: 2492256 - RNA, 22 nt, Chlamydia trachomatis
ccuuuaaagaaagcccuauuuc

SEQ ID NO: 2492257 - RNA, 19 nt, Chlamydia trachomatis
ccuuuaaccucugcaagaa

SEQ ID NO: 2492258 - RNA, 19 nt, Chlamydia trachomatis
ccuuuaucuugagagaccu

SEQ ID NO: 2492259 - RNA, 23 nt, Chlamydia trachomatis
ccuuucacuagacguuuagccuc

SEQ ID NO: 2492260 - RNA, 22 nt, Chlamydia trachomatis
ccuuucccucguaauaacugag

SEQ ID NO: 2492261 - RNA, 16 nt, Chlamydia trachomatis
ccuuucgucacagauu

SEQ ID NO: 2492262 - RNA, 15 nt, Chlamydia trachomatis
ccuuucguuucucca

SEQ ID NO: 2492263 - RNA, 14 nt, Chlamydia trachomatis
ccuuucuuacuccu

SEQ ID NO: 2492264 - RNA, 22 nt, Chlamydia trachomatis
ccuuuuacaguuccgcagagau

SEQ ID NO: 2492265 - RNA, 15 nt, Chlamydia trachomatis
ccuuuuagcccuccu

SEQ ID NO: 2492266 - RNA, 19 nt, Chlamydia trachomatis
ccuuuucagaauuacccug

SEQ ID NO: 2492267 - RNA, 22 nt, Chlamydia trachomatis
ccuuuucuagagaagagagcau

SEQ ID NO: 2492268 - RNA, 23 nt, Chlamydia trachomatis
ccuuuucuagagaagagagcauc

SEQ ID NO: 2492269 - RNA, 15 nt, Chlamydia trachomatis
ccuuuucuauuuaga

SEQ ID NO: 2492270 - RNA, 22 nt, Chlamydia trachomatis
ccuuuugaaacaucuuuuaaag

SEQ ID NO: 2492271 - RNA, 18 nt, Chlamydia trachomatis
ccuuuugauucugcuuug

SEQ ID NO: 2492272 - RNA, 11 nt, Chlamydia trachomatis
ccuuuuuaaaa

SEQ ID NO: 2492273 - RNA, 15 nt, Chlamydia trachomatis
ccuuuuuaaaauaau

SEQ ID NO: 2492274 - RNA, 11 nt, Chlamydia trachomatis
ccuuuuuucug

SEQ ID NO: 2492275 - RNA, 12 nt, Chlamydia trachomatis
cgaaaaaaagau

SEQ ID NO: 2492276 - RNA, 23 nt, Chlamydia trachomatis
cgaaaaaucacaauuuuucuuug

SEQ ID NO: 2492277 - RNA, 13 nt, Chlamydia trachomatis
cgaaaagacucuc

SEQ ID NO: 2492278 - RNA, 11 nt, Chlamydia trachomatis
cgaaaagagcu

SEQ ID NO: 2492279 - RNA, 20 nt, Chlamydia trachomatis
cgaaacauuugcgugauaaa

SEQ ID NO: 2492280 - RNA, 14 nt, Chlamydia trachomatis
cgaaaccaaaauau

SEQ ID NO: 2492281 - RNA, 14 nt, Chlamydia trachomatis
cgaaaccaacaaga

SEQ ID NO: 2492282 - RNA, 18 nt, Chlamydia trachomatis
cgaaacccaacgcaucuc

SEQ ID NO: 2492283 - RNA, 20 nt, Chlamydia trachomatis
cgaaacuacccgauucaaaa

SEQ ID NO: 2492284 - RNA, 14 nt, Chlamydia trachomatis
cgaaacucaucuuc

SEQ ID NO: 2492285 - RNA, 16 nt, Chlamydia trachomatis
cgaaagcuaagauucc

SEQ ID NO: 2492286 - RNA, 12 nt, Chlamydia trachomatis
cgaacaaaacuu

SEQ ID NO: 2492287 - RNA, 17 nt, Chlamydia trachomatis
cgaacaaucggaaaugu

SEQ ID NO: 2492288 - RNA, 20 nt, Chlamydia trachomatis
cgaacagugacagcauagau

SEQ ID NO: 2492289 - RNA, 15 nt, Chlamydia trachomatis
cgaacgcuuccugaa

SEQ ID NO: 2492290 - RNA, 18 nt, Chlamydia trachomatis
cgaacgcuucuucccaac

SEQ ID NO: 2492291 - RNA, 15 nt, Chlamydia trachomatis
cgaacgggaaaugcu

SEQ ID NO: 2492292 - RNA, 22 nt, Chlamydia trachomatis
cgaagacagaaucguuuaagug

SEQ ID NO: 2492293 - RNA, 22 nt, Chlamydia trachomatis
cgaagacgaacgcuagaaacag

SEQ ID NO: 2492294 - RNA, 20 nt, Chlamydia trachomatis
cgaagcaaaacgcccuccaa

SEQ ID NO: 2492295 - RNA, 17 nt, Chlamydia trachomatis
cgaagcugcaauagaaa

SEQ ID NO: 2492296 - RNA, 16 nt, Chlamydia trachomatis
cgaagguucuucuucg

SEQ ID NO: 2492297 - RNA, 14 nt, Chlamydia trachomatis
cgaagguugaacua

SEQ ID NO: 2492298 - RNA, 15 nt, Chlamydia trachomatis
cgaauaaucagucgc

SEQ ID NO: 2492299 - RNA, 19 nt, Chlamydia trachomatis
cgaaucacaugucauccuu

SEQ ID NO: 2492300 - RNA, 20 nt, Chlamydia trachomatis
cgaauccuggaguauuuuca

SEQ ID NO: 2492301 - RNA, 20 nt, Chlamydia trachomatis
cgaaucgcccuuauugguau

SEQ ID NO: 2492302 - RNA, 22 nt, Chlamydia trachomatis
cgaaucgcugacggauccugcu

SEQ ID NO: 2492303 - RNA, 15 nt, Chlamydia trachomatis
cgaaucgucucucug

SEQ ID NO: 2492304 - RNA, 14 nt, Chlamydia trachomatis
cgaaugccuguggc

SEQ ID NO: 2492305 - RNA, 23 nt, Chlamydia trachomatis
cgaaugcguugcucuaccaacug

SEQ ID NO: 2492306 - RNA, 16 nt, Chlamydia trachomatis
cgaauuaauaauucca

SEQ ID NO: 2492307 - RNA, 20 nt, Chlamydia trachomatis
cgaauuaauaauuccaccua

SEQ ID NO: 2492308 - RNA, 17 nt, Chlamydia trachomatis
cgaauuggaucucccuc

SEQ ID NO: 2492309 - RNA, 16 nt, Chlamydia trachomatis
cgaauuuuucugcuag

SEQ ID NO: 2492310 - RNA, 16 nt, Chlamydia trachomatis
cgacaaacgggagccc

SEQ ID NO: 2492311 - RNA, 23 nt, Chlamydia trachomatis
cgacaacaugaaccgcagcaaca

SEQ ID NO: 2492312 - RNA, 19 nt, Chlamydia trachomatis
cgacaacgauauaaagaag

SEQ ID NO: 2492313 - RNA, 18 nt, Chlamydia trachomatis
cgacaguauauccucucu

SEQ ID NO: 2492314 - RNA, 20 nt, Chlamydia trachomatis
cgacaguuucccguuguuuu

SEQ ID NO: 2492315 - RNA, 11 nt, Chlamydia trachomatis
cgacaguuuga

SEQ ID NO: 2492316 - RNA, 21 nt, Chlamydia trachomatis
cgacgagguuuuuucuucuuu

SEQ ID NO: 2492317 - RNA, 14 nt, Chlamydia trachomatis
cgacugcugcagaa

SEQ ID NO: 2492318 - RNA, 19 nt, Chlamydia trachomatis
cgagaaaugaauuccaagu

SEQ ID NO: 2492319 - RNA, 16 nt, Chlamydia trachomatis
cgagaacggcaauaaa

SEQ ID NO: 2492320 - RNA, 23 nt, Chlamydia trachomatis
cgagaauuucucggccuuuucua

SEQ ID NO: 2492321 - RNA, 16 nt, Chlamydia trachomatis
cgagagaagcuccucu

SEQ ID NO: 2492322 - RNA, 20 nt, Chlamydia trachomatis
cgagagaagcuccucuucuu

SEQ ID NO: 2492323 - RNA, 12 nt, Chlamydia trachomatis
cgagagaggggg

SEQ ID NO: 2492324 - RNA, 19 nt, Chlamydia trachomatis
cgagauguauuauuuugau

SEQ ID NO: 2492325 - RNA, 14 nt, Chlamydia trachomatis
cgagcaagcuuuuu

SEQ ID NO: 2492326 - RNA, 15 nt, Chlamydia trachomatis
cgagcauaagaauaa

SEQ ID NO: 2492327 - RNA, 18 nt, Chlamydia trachomatis
cgagccaagcugaggcuc

SEQ ID NO: 2492328 - RNA, 12 nt, Chlamydia trachomatis
cgagccuccgcu

SEQ ID NO: 2492329 - RNA, 21 nt, Chlamydia trachomatis
cgagcucauuuucuauuucag

SEQ ID NO: 2492330 - RNA, 16 nt, Chlamydia trachomatis
cgagcucccauuucug

SEQ ID NO: 2492331 - RNA, 18 nt, Chlamydia trachomatis
cgaggagcuugagagcau

SEQ ID NO: 2492332 - RNA, 17 nt, Chlamydia trachomatis
cgaggcacaaaaucccu

SEQ ID NO: 2492333 - RNA, 15 nt, Chlamydia trachomatis
cgaggcuucaauaau

SEQ ID NO: 2492334 - RNA, 21 nt, Chlamydia trachomatis
cgaguaaucaaaaaaggaauc

SEQ ID NO: 2492335 - RNA, 20 nt, Chlamydia trachomatis
cgagucaugacaaagccccu

SEQ ID NO: 2492336 - RNA, 19 nt, Chlamydia trachomatis
cgagucggacaguucuuua

SEQ ID NO: 2492337 - RNA, 14 nt, Chlamydia trachomatis
cgagucucuugugg

SEQ ID NO: 2492338 - RNA, 20 nt, Chlamydia trachomatis
cgaguucgccccucuuuuuc

SEQ ID NO: 2492339 - RNA, 22 nt, Chlamydia trachomatis
cgaguucuguuauuuguucucu

SEQ ID NO: 2492340 - RNA, 18 nt, Chlamydia trachomatis
cgaguuuuuuuguuucca

SEQ ID NO: 2492341 - RNA, 12 nt, Chlamydia trachomatis
cgauaaaaagcu

SEQ ID NO: 2492342 - RNA, 16 nt, Chlamydia trachomatis
cgauaaaguaaaggau

SEQ ID NO: 2492343 - RNA, 21 nt, Chlamydia trachomatis
cgauaacaggggcauguaaac

SEQ ID NO: 2492344 - RNA, 19 nt, Chlamydia trachomatis
cgauaacuccaucaggaau

SEQ ID NO: 2492345 - RNA, 15 nt, Chlamydia trachomatis
cgauaccugucccug

SEQ ID NO: 2492346 - RNA, 17 nt, Chlamydia trachomatis
cgauaguaccauaaucc

SEQ ID NO: 2492347 - RNA, 17 nt, Chlamydia trachomatis
cgauauacgcucuuuca

SEQ ID NO: 2492348 - RNA, 19 nt, Chlamydia trachomatis
cgauauauccauucaggau

SEQ ID NO: 2492349 - RNA, 14 nt, Chlamydia trachomatis
cgauaucagcaaaa

SEQ ID NO: 2492350 - RNA, 15 nt, Chlamydia trachomatis
cgauauccuuuuuac

SEQ ID NO: 2492351 - RNA, 22 nt, Chlamydia trachomatis
cgauaugcuuuuuaauauccuc

SEQ ID NO: 2492352 - RNA, 18 nt, Chlamydia trachomatis
cgaucagcccaaaucuca

SEQ ID NO: 2492353 - RNA, 12 nt, Chlamydia trachomatis
cgaucuccuucc

SEQ ID NO: 2492354 - RNA, 19 nt, Chlamydia trachomatis
cgaucuccuuccucuuuaa

SEQ ID NO: 2492355 - RNA, 15 nt, Chlamydia trachomatis
cgaucuuucgaauug

SEQ ID NO: 2492356 - RNA, 16 nt, Chlamydia trachomatis
cgaugagcaccucuuc

SEQ ID NO: 2492357 - RNA, 22 nt, Chlamydia trachomatis
cgaugagcgaguuuguggaauu

SEQ ID NO: 2492358 - RNA, 19 nt, Chlamydia trachomatis
cgaugaucccuaagauuuc

SEQ ID NO: 2492359 - RNA, 20 nt, Chlamydia trachomatis
cgaugcuauuuucagcaaaa

SEQ ID NO: 2492360 - RNA, 16 nt, Chlamydia trachomatis
cgauguuccccauuca

SEQ ID NO: 2492361 - RNA, 14 nt, Chlamydia trachomatis
cgauucaaaagcua

SEQ ID NO: 2492362 - RNA, 16 nt, Chlamydia trachomatis
cgauucaauccagacu

SEQ ID NO: 2492363 - RNA, 16 nt, Chlamydia trachomatis
cgauucuugauaaaua

SEQ ID NO: 2492364 - RNA, 17 nt, Chlamydia trachomatis
cgauucuugauaaauaa

SEQ ID NO: 2492365 - RNA, 20 nt, Chlamydia trachomatis
cgauuugauaucccccuucu

SEQ ID NO: 2492366 - RNA, 16 nt, Chlamydia trachomatis
cgauuuucugaaguuc

SEQ ID NO: 2492367 - RNA, 16 nt, Chlamydia trachomatis
cgcaaacugcucuucu

SEQ ID NO: 2492368 - RNA, 15 nt, Chlamydia trachomatis
cgcaaagcggauuca

SEQ ID NO: 2492369 - RNA, 22 nt, Chlamydia trachomatis
cgcaaaugcguuaaacuuucuu

SEQ ID NO: 2492370 - RNA, 21 nt, Chlamydia trachomatis
cgcaaguauuggagacaacaa

SEQ ID NO: 2492371 - RNA, 17 nt, Chlamydia trachomatis
cgcaaguucuccuucuu

SEQ ID NO: 2492372 - RNA, 18 nt, Chlamydia trachomatis
cgcaauagauagucugca

SEQ ID NO: 2492373 - RNA, 22 nt, Chlamydia trachomatis
cgcaauccuuuuaagauaucca

SEQ ID NO: 2492374 - RNA, 20 nt, Chlamydia trachomatis
cgcacaaagauuucuucuuu

SEQ ID NO: 2492375 - RNA, 15 nt, Chlamydia trachomatis
cgcacccaaucuucu

SEQ ID NO: 2492376 - RNA, 22 nt, Chlamydia trachomatis
cgcagauauucacgcaucccaa

SEQ ID NO: 2492377 - RNA, 23 nt, Chlamydia trachomatis
cgcagcuucugguguaggaaaau

SEQ ID NO: 2492378 - RNA, 17 nt, Chlamydia trachomatis
cgcagcuucuuuaggau

SEQ ID NO: 2492379 - RNA, 14 nt, Chlamydia trachomatis
cgcaggggaauaca

SEQ ID NO: 2492380 - RNA, 14 nt, Chlamydia trachomatis
cgcauaguguugau

SEQ ID NO: 2492381 - RNA, 13 nt, Chlamydia trachomatis
cgcauaugcagaa

SEQ ID NO: 2492382 - RNA, 23 nt, Chlamydia trachomatis
cgcauaugcagaagaccagucaa

SEQ ID NO: 2492383 - RNA, 17 nt, Chlamydia trachomatis
cgcauuaaauaauacaa

SEQ ID NO: 2492384 - RNA, 23 nt, Chlamydia trachomatis
cgcauucccgccaauuuuuuuau

SEQ ID NO: 2492385 - RNA, 22 nt, Chlamydia trachomatis
cgccaaugaucuuuaagcucuu

SEQ ID NO: 2492386 - RNA, 18 nt, Chlamydia trachomatis
cgccauaccuaaauucau

SEQ ID NO: 2492387 - RNA, 14 nt, Chlamydia trachomatis
cgccauuuaugaag

SEQ ID NO: 2492388 - RNA, 15 nt, Chlamydia trachomatis
cgccuccggcuccca

SEQ ID NO: 2492389 - RNA, 24 nt, Chlamydia trachomatis
cgccucgucgaugaucauaaauac

SEQ ID NO: 2492390 - RNA, 14 nt, Chlamydia trachomatis
cgccucuaucucuu

SEQ ID NO: 2492391 - RNA, 19 nt, Chlamydia trachomatis
cgccuugcgcaucaaagga

SEQ ID NO: 2492392 - RNA, 17 nt, Chlamydia trachomatis
cgcgaauaaauccucuu

SEQ ID NO: 2492393 - RNA, 12 nt, Chlamydia trachomatis
cgcgcagcuucu

SEQ ID NO: 2492394 - RNA, 16 nt, Chlamydia trachomatis
cgcgcuccagcucuuc

SEQ ID NO: 2492395 - RNA, 16 nt, Chlamydia trachomatis
cgcguaauuuucuagc

SEQ ID NO: 2492396 - RNA, 17 nt, Chlamydia trachomatis
cgcuaaaaacucuuuca

SEQ ID NO: 2492397 - RNA, 23 nt, Chlamydia trachomatis
cgcuaaaggaucugagcagugac

SEQ ID NO: 2492398 - RNA, 17 nt, Chlamydia trachomatis
cgcuaagacuuucucua

SEQ ID NO: 2492399 - RNA, 17 nt, Chlamydia trachomatis
cgcuaauuuuugagaga

SEQ ID NO: 2492400 - RNA, 19 nt, Chlamydia trachomatis
cgcuaccaaaaauuuuuug

SEQ ID NO: 2492401 - RNA, 22 nt, Chlamydia trachomatis
cgcuagaaacagccugcuuucu

SEQ ID NO: 2492402 - RNA, 12 nt, Chlamydia trachomatis
cgcuagcuuucc

SEQ ID NO: 2492403 - RNA, 15 nt, Chlamydia trachomatis
cgcuaucaauaaaaa

SEQ ID NO: 2492404 - RNA, 13 nt, Chlamydia trachomatis
cgcuaucgguaau

SEQ ID NO: 2492405 - RNA, 17 nt, Chlamydia trachomatis
cgcuaucguaaccaagc

SEQ ID NO: 2492406 - RNA, 12 nt, Chlamydia trachomatis
cgcuccagaacg

SEQ ID NO: 2492407 - RNA, 17 nt, Chlamydia trachomatis
cgcuccccuuccuguuc

SEQ ID NO: 2492408 - RNA, 18 nt, Chlamydia trachomatis
cgcugaguuuccuuuaaa

SEQ ID NO: 2492409 - RNA, 14 nt, Chlamydia trachomatis
cgcugcgagagagc

SEQ ID NO: 2492410 - RNA, 15 nt, Chlamydia trachomatis
cgcuggcuuuguccu

SEQ ID NO: 2492411 - RNA, 21 nt, Chlamydia trachomatis
cgcuguccaaucguauaauaa

SEQ ID NO: 2492412 - RNA, 14 nt, Chlamydia trachomatis
cgcuuaauuuuuua

SEQ ID NO: 2492413 - RNA, 20 nt, Chlamydia trachomatis
cgcuuccuacagcuagaaua

SEQ ID NO: 2492414 - RNA, 16 nt, Chlamydia trachomatis
cgcuuccucuccuucu

SEQ ID NO: 2492415 - RNA, 12 nt, Chlamydia trachomatis
cgcuucuucaug

SEQ ID NO: 2492416 - RNA, 22 nt, Chlamydia trachomatis
cgcuucuucauguucugugaaa

SEQ ID NO: 2492417 - RNA, 20 nt, Chlamydia trachomatis
cgcuuuuuuuuuagaacaga

SEQ ID NO: 2492418 - RNA, 20 nt, Chlamydia trachomatis
cggaaagauagccuccgcua

SEQ ID NO: 2492419 - RNA, 13 nt, Chlamydia trachomatis
cggaaagcacuuc

SEQ ID NO: 2492420 - RNA, 23 nt, Chlamydia trachomatis
cggaaagguuuguuuccucucuc

SEQ ID NO: 2492421 - RNA, 20 nt, Chlamydia trachomatis
cggaaaguuccaucuccuga

SEQ ID NO: 2492422 - RNA, 18 nt, Chlamydia trachomatis
cggaaauaggauuuaaac

SEQ ID NO: 2492423 - RNA, 19 nt, Chlamydia trachomatis
cggaacaggggaccaaaaa

SEQ ID NO: 2492424 - RNA, 20 nt, Chlamydia trachomatis
cggaacaggggaccaaaaaa

SEQ ID NO: 2492425 - RNA, 14 nt, Chlamydia trachomatis
cggaaccagcgaca

SEQ ID NO: 2492426 - RNA, 19 nt, Chlamydia trachomatis
cggaacucuacaaaauaaa

SEQ ID NO: 2492427 - RNA, 17 nt, Chlamydia trachomatis
cggaagauacagccugc

SEQ ID NO: 2492428 - RNA, 15 nt, Chlamydia trachomatis
cggaaggaaaaagaa

SEQ ID NO: 2492429 - RNA, 16 nt, Chlamydia trachomatis
cggaaggcgaauucuu

SEQ ID NO: 2492430 - RNA, 20 nt, Chlamydia trachomatis
cggaagugguuaaugucucu

SEQ ID NO: 2492431 - RNA, 15 nt, Chlamydia trachomatis
cggaauagccuccaa

SEQ ID NO: 2492432 - RNA, 20 nt, Chlamydia trachomatis
cggaaucucgguaauaucca

SEQ ID NO: 2492433 - RNA, 15 nt, Chlamydia trachomatis
cggaauucauagaag

SEQ ID NO: 2492434 - RNA, 18 nt, Chlamydia trachomatis
cggacaaacguccuccug

SEQ ID NO: 2492435 - RNA, 23 nt, Chlamydia trachomatis
cggacaauaggagcgauaacucc

SEQ ID NO: 2492436 - RNA, 13 nt, Chlamydia trachomatis
cggacuugaacca

SEQ ID NO: 2492437 - RNA, 15 nt, Chlamydia trachomatis
cggagaagaagaggg

SEQ ID NO: 2492438 - RNA, 17 nt, Chlamydia trachomatis
cggagaagaagaggguu

SEQ ID NO: 2492439 - RNA, 17 nt, Chlamydia trachomatis
cggagagaaagaggggu

SEQ ID NO: 2492440 - RNA, 14 nt, Chlamydia trachomatis
cggagagaauacca

SEQ ID NO: 2492441 - RNA, 19 nt, Chlamydia trachomatis
cggagauacggcuaacucc

SEQ ID NO: 2492442 - RNA, 20 nt, Chlamydia trachomatis
cggagauacggcuaacucca

SEQ ID NO: 2492443 - RNA, 12 nt, Chlamydia trachomatis
cggagcaucuuc

SEQ ID NO: 2492444 - RNA, 20 nt, Chlamydia trachomatis
cggagccgauucaaaagcua

SEQ ID NO: 2492445 - RNA, 19 nt, Chlamydia trachomatis
cggauaaucaaaucgaaac

SEQ ID NO: 2492446 - RNA, 12 nt, Chlamydia trachomatis
cggauacaauac

SEQ ID NO: 2492447 - RNA, 16 nt, Chlamydia trachomatis
cggauuaugauuccgc

SEQ ID NO: 2492448 - RNA, 15 nt, Chlamydia trachomatis
cggauucaagaccaa

SEQ ID NO: 2492449 - RNA, 14 nt, Chlamydia trachomatis
cggcaaauccugca

SEQ ID NO: 2492450 - RNA, 22 nt, Chlamydia trachomatis
cggcaagccuuuuguuuucuug

SEQ ID NO: 2492451 - RNA, 13 nt, Chlamydia trachomatis
cggcaggaaagug

SEQ ID NO: 2492452 - RNA, 14 nt, Chlamydia trachomatis
cggcaguuucuagg

SEQ ID NO: 2492453 - RNA, 22 nt, Chlamydia trachomatis
cggccccuggaauuucuccagc

SEQ ID NO: 2492454 - RNA, 22 nt, Chlamydia trachomatis
cggccuguaugugaaaauaucu

SEQ ID NO: 2492455 - RNA, 11 nt, Chlamydia trachomatis
cggcucuucuu

SEQ ID NO: 2492456 - RNA, 14 nt, Chlamydia trachomatis
cggcuucauggaau

SEQ ID NO: 2492457 - RNA, 21 nt, Chlamydia trachomatis
cggcuugcccaaacuccaugu

SEQ ID NO: 2492458 - RNA, 14 nt, Chlamydia trachomatis
cgggaaaaaguuug

SEQ ID NO: 2492459 - RNA, 17 nt, Chlamydia trachomatis
cgggaaacauuccaaau

SEQ ID NO: 2492460 - RNA, 15 nt, Chlamydia trachomatis
cgggggagcugaugu

SEQ ID NO: 2492461 - RNA, 22 nt, Chlamydia trachomatis
cggguagucaugaauggaaagu

SEQ ID NO: 2492462 - RNA, 19 nt, Chlamydia trachomatis
cgguaagggcuuuguaaag

SEQ ID NO: 2492463 - RNA, 18 nt, Chlamydia trachomatis
cgguaaucacgccuccga

SEQ ID NO: 2492464 - RNA, 18 nt, Chlamydia trachomatis
cgguacaucgguguugaa

SEQ ID NO: 2492465 - RNA, 13 nt, Chlamydia trachomatis
cgguagaaagucc

SEQ ID NO: 2492466 - RNA, 19 nt, Chlamydia trachomatis
cgguauauucuucaccuuu

SEQ ID NO: 2492467 - RNA, 12 nt, Chlamydia trachomatis
cgguauccauac

SEQ ID NO: 2492468 - RNA, 14 nt, Chlamydia trachomatis
cgguauuaauaaug

SEQ ID NO: 2492469 - RNA, 17 nt, Chlamydia trachomatis
cggucagcuguacgaug

SEQ ID NO: 2492470 - RNA, 13 nt, Chlamydia trachomatis
cggugaggaaggc

SEQ ID NO: 2492471 - RNA, 23 nt, Chlamydia trachomatis
cgguuaacacaauuuuuguuccu

SEQ ID NO: 2492472 - RNA, 13 nt, Chlamydia trachomatis
cgguugcacaaau

SEQ ID NO: 2492473 - RNA, 17 nt, Chlamydia trachomatis
cgguuugauuuccucuu

SEQ ID NO: 2492474 - RNA, 12 nt, Chlamydia trachomatis
cguaaaagagau

SEQ ID NO: 2492475 - RNA, 14 nt, Chlamydia trachomatis
cguaaaagaguaag

SEQ ID NO: 2492476 - RNA, 12 nt, Chlamydia trachomatis
cguaaacaacca

SEQ ID NO: 2492477 - RNA, 13 nt, Chlamydia trachomatis
cguaaacaaccaa

SEQ ID NO: 2492478 - RNA, 20 nt, Chlamydia trachomatis
cguaaacgauuaacucugca

SEQ ID NO: 2492479 - RNA, 18 nt, Chlamydia trachomatis
cguaauaauuaaggacuu

SEQ ID NO: 2492480 - RNA, 19 nt, Chlamydia trachomatis
cguaccaaggauuuuuuuc

SEQ ID NO: 2492481 - RNA, 16 nt, Chlamydia trachomatis
cguagagaucuucuga

SEQ ID NO: 2492482 - RNA, 21 nt, Chlamydia trachomatis
cguagauaucuuuacucuuuu

SEQ ID NO: 2492483 - RNA, 22 nt, Chlamydia trachomatis
cguauauaucuuaauugaaaua

SEQ ID NO: 2492484 - RNA, 20 nt, Chlamydia trachomatis
cguauauuucacaacuaguu

SEQ ID NO: 2492485 - RNA, 14 nt, Chlamydia trachomatis
cguaugcaacaaca

SEQ ID NO: 2492486 - RNA, 20 nt, Chlamydia trachomatis
cguauuuuuguuucuacuuu

SEQ ID NO: 2492487 - RNA, 17 nt, Chlamydia trachomatis
cgucacagauuugaguu

SEQ ID NO: 2492488 - RNA, 17 nt, Chlamydia trachomatis
cgucaguugcuccuccg

SEQ ID NO: 2492489 - RNA, 18 nt, Chlamydia trachomatis
cgucaucuuugagaagca

SEQ ID NO: 2492490 - RNA, 16 nt, Chlamydia trachomatis
cguccacucuucaggu

SEQ ID NO: 2492491 - RNA, 13 nt, Chlamydia trachomatis
cguccgcuccuuc

SEQ ID NO: 2492492 - RNA, 19 nt, Chlamydia trachomatis
cgucggcuccauaaaagag

SEQ ID NO: 2492493 - RNA, 18 nt, Chlamydia trachomatis
cgucgguucgaucccggc

SEQ ID NO: 2492494 - RNA, 14 nt, Chlamydia trachomatis
cgucuaaaacaauu

SEQ ID NO: 2492495 - RNA, 13 nt, Chlamydia trachomatis
cgucuagcuuuuu

SEQ ID NO: 2492496 - RNA, 16 nt, Chlamydia trachomatis
cgucuagcuuuuuuca

SEQ ID NO: 2492497 - RNA, 21 nt, Chlamydia trachomatis
cgucugaaacuagucucuucu

SEQ ID NO: 2492498 - RNA, 18 nt, Chlamydia trachomatis
cgucuugcuaauguagac

SEQ ID NO: 2492499 - RNA, 13 nt, Chlamydia trachomatis
cgucuugucucuc

SEQ ID NO: 2492500 - RNA, 19 nt, Chlamydia trachomatis
cgucuuuaacccuucagga

SEQ ID NO: 2492501 - RNA, 23 nt, Chlamydia trachomatis
cgucuuuaacccuucaggaaagc

SEQ ID NO: 2492502 - RNA, 14 nt, Chlamydia trachomatis
cgugaaauaaauca

SEQ ID NO: 2492503 - RNA, 19 nt, Chlamydia trachomatis
cgugaauguuaacaucuuc

SEQ ID NO: 2492504 - RNA, 19 nt, Chlamydia trachomatis
cgugagcgucuuuucacaa

SEQ ID NO: 2492505 - RNA, 13 nt, Chlamydia trachomatis
cgugauaaaaacu

SEQ ID NO: 2492506 - RNA, 19 nt, Chlamydia trachomatis
cgugaucacugugagagca

SEQ ID NO: 2492507 - RNA, 14 nt, Chlamydia trachomatis
cgugcccaugagaa

SEQ ID NO: 2492508 - RNA, 22 nt, Chlamydia trachomatis
cguggaaucccguaauagagcc

SEQ ID NO: 2492509 - RNA, 19 nt, Chlamydia trachomatis
cguguaauuuccuauuucu

SEQ ID NO: 2492510 - RNA, 21 nt, Chlamydia trachomatis
cguguaguuuagggugaucuu

SEQ ID NO: 2492511 - RNA, 17 nt, Chlamydia trachomatis
cguguccucuauuuccu

SEQ ID NO: 2492512 - RNA, 16 nt, Chlamydia trachomatis
cgugucgauggcugcg

SEQ ID NO: 2492513 - RNA, 22 nt, Chlamydia trachomatis
cguguguguguguaaccuuccc

SEQ ID NO: 2492514 - RNA, 22 nt, Chlamydia trachomatis
cguuaaagaauuauuugccucu

SEQ ID NO: 2492515 - RNA, 14 nt, Chlamydia trachomatis
cguuacuaccgaua

SEQ ID NO: 2492516 - RNA, 18 nt, Chlamydia trachomatis
cguuagcaaagacauaaa

SEQ ID NO: 2492517 - RNA, 22 nt, Chlamydia trachomatis
cguuauauuggaagauaacaau

SEQ ID NO: 2492518 - RNA, 20 nt, Chlamydia trachomatis
cguuccauuaauuuggcuuc

SEQ ID NO: 2492519 - RNA, 12 nt, Chlamydia trachomatis
cguucucuaaag

SEQ ID NO: 2492520 - RNA, 12 nt, Chlamydia trachomatis
cguucucucuaa

SEQ ID NO: 2492521 - RNA, 15 nt, Chlamydia trachomatis
cguucucucuaaaau

SEQ ID NO: 2492522 - RNA, 14 nt, Chlamydia trachomatis
cguucugagaugaa

SEQ ID NO: 2492523 - RNA, 17 nt, Chlamydia trachomatis
cguucugcaaucucuuc

SEQ ID NO: 2492524 - RNA, 22 nt, Chlamydia trachomatis
cguucuugaguagaagaaugaa

SEQ ID NO: 2492525 - RNA, 16 nt, Chlamydia trachomatis
cguucuugcugagaau

SEQ ID NO: 2492526 - RNA, 15 nt, Chlamydia trachomatis
cguugcuuccaaacg

SEQ ID NO: 2492527 - RNA, 19 nt, Chlamydia trachomatis
cguuguguagguuuuaaag

SEQ ID NO: 2492528 - RNA, 17 nt, Chlamydia trachomatis
cguuuaccgcucuucca

SEQ ID NO: 2492529 - RNA, 19 nt, Chlamydia trachomatis
cguuuagcuaacucuugaa

SEQ ID NO: 2492530 - RNA, 20 nt, Chlamydia trachomatis
cguuucagaaaagccuucuu

SEQ ID NO: 2492531 - RNA, 14 nt, Chlamydia trachomatis
cguuuguaagaucu

SEQ ID NO: 2492532 - RNA, 20 nt, Chlamydia trachomatis
cguuuuccgcacccaaucuu

SEQ ID NO: 2492533 - RNA, 23 nt, Chlamydia trachomatis
cguuuuccgcacccaaucuucua

SEQ ID NO: 2492534 - RNA, 13 nt, Chlamydia trachomatis
cguuuugaagaag

SEQ ID NO: 2492535 - RNA, 15 nt, Chlamydia trachomatis
cguuuuucuacaacu

SEQ ID NO: 2492536 - RNA, 17 nt, Chlamydia trachomatis
cguuuuuuuagauaaga

SEQ ID NO: 2492537 - RNA, 16 nt, Chlamydia trachomatis
cuaaaaacucuuucau

SEQ ID NO: 2492538 - RNA, 16 nt, Chlamydia trachomatis
cuaaaaacucuuuuuc

SEQ ID NO: 2492539 - RNA, 11 nt, Chlamydia trachomatis
cuaaaaagcca

SEQ ID NO: 2492540 - RNA, 15 nt, Chlamydia trachomatis
cuaaaaccuuagcuc

SEQ ID NO: 2492541 - RNA, 14 nt, Chlamydia trachomatis
cuaaaagaagagcg

SEQ ID NO: 2492542 - RNA, 12 nt, Chlamydia trachomatis
cuaaaagcccau

SEQ ID NO: 2492543 - RNA, 14 nt, Chlamydia trachomatis
cuaaaaucaccaua

SEQ ID NO: 2492544 - RNA, 18 nt, Chlamydia trachomatis
cuaaaaucccuaacucuu

SEQ ID NO: 2492545 - RNA, 20 nt, Chlamydia trachomatis
cuaaaaucgugcuaugcauu

SEQ ID NO: 2492546 - RNA, 20 nt, Chlamydia trachomatis
cuaaaaugacuaguuuuuuc

SEQ ID NO: 2492547 - RNA, 17 nt, Chlamydia trachomatis
cuaaaaugcaaagcuuu

SEQ ID NO: 2492548 - RNA, 23 nt, Chlamydia trachomatis
cuaaaaugcaaagcuuuucuccu

SEQ ID NO: 2492549 - RNA, 14 nt, Chlamydia trachomatis
cuaaacaaaaacuc

SEQ ID NO: 2492550 - RNA, 13 nt, Chlamydia trachomatis
cuaaacaaauguc

SEQ ID NO: 2492551 - RNA, 14 nt, Chlamydia trachomatis
cuaaacaaggauuu

SEQ ID NO: 2492552 - RNA, 19 nt, Chlamydia trachomatis
cuaaacaagguucuucaac

SEQ ID NO: 2492553 - RNA, 20 nt, Chlamydia trachomatis
cuaaacaagguucuucaaca

SEQ ID NO: 2492554 - RNA, 17 nt, Chlamydia trachomatis
cuaaacccucugcauag

SEQ ID NO: 2492555 - RNA, 21 nt, Chlamydia trachomatis
cuaaacccucugcauagcuau

SEQ ID NO: 2492556 - RNA, 19 nt, Chlamydia trachomatis
cuaaacgaugauagaguag

SEQ ID NO: 2492557 - RNA, 18 nt, Chlamydia trachomatis
cuaaacuaucuaaaaucc

SEQ ID NO: 2492558 - RNA, 19 nt, Chlamydia trachomatis
cuaaacuaucuaaaauccc

SEQ ID NO: 2492559 - RNA, 22 nt, Chlamydia trachomatis
cuaaagaagccauaguagaaau

SEQ ID NO: 2492560 - RNA, 15 nt, Chlamydia trachomatis
cuaaagacaaaacuu

SEQ ID NO: 2492561 - RNA, 16 nt, Chlamydia trachomatis
cuaaagacacuaucac

SEQ ID NO: 2492562 - RNA, 16 nt, Chlamydia trachomatis
cuaaagacagcauaau

SEQ ID NO: 2492563 - RNA, 18 nt, Chlamydia trachomatis
cuaaagacagcauaauug

SEQ ID NO: 2492564 - RNA, 23 nt, Chlamydia trachomatis
cuaaagagacgcaugcuucuuua

SEQ ID NO: 2492565 - RNA, 17 nt, Chlamydia trachomatis
cuaaagagaucucucca

SEQ ID NO: 2492566 - RNA, 20 nt, Chlamydia trachomatis
cuaaagagccaaaauauacu

SEQ ID NO: 2492567 - RNA, 20 nt, Chlamydia trachomatis
cuaaagcagcuaauuccaua

SEQ ID NO: 2492568 - RNA, 15 nt, Chlamydia trachomatis
cuaaagccauaagac

SEQ ID NO: 2492569 - RNA, 16 nt, Chlamydia trachomatis
cuaaagccauaagacu

SEQ ID NO: 2492570 - RNA, 22 nt, Chlamydia trachomatis
cuaaagccaucucggaucgaga

SEQ ID NO: 2492571 - RNA, 20 nt, Chlamydia trachomatis
cuaaaguauucuguaaaagg

SEQ ID NO: 2492572 - RNA, 13 nt, Chlamydia trachomatis
cuaaagucuuaaa

SEQ ID NO: 2492573 - RNA, 13 nt, Chlamydia trachomatis
cuaaagucuuucc

SEQ ID NO: 2492574 - RNA, 16 nt, Chlamydia trachomatis
cuaaauaccacaauuu

SEQ ID NO: 2492575 - RNA, 23 nt, Chlamydia trachomatis
cuaaauaccucuuuuuuaugggu

SEQ ID NO: 2492576 - RNA, 17 nt, Chlamydia trachomatis
cuaaaucgcaaacaggu

SEQ ID NO: 2492577 - RNA, 20 nt, Chlamydia trachomatis
cuaaaucuaaaauuuccuua

SEQ ID NO: 2492578 - RNA, 20 nt, Chlamydia trachomatis
cuaaaucucuuggagagaau

SEQ ID NO: 2492579 - RNA, 17 nt, Chlamydia trachomatis
cuaaaugcuguaaaaca

SEQ ID NO: 2492580 - RNA, 21 nt, Chlamydia trachomatis
cuaaauucaacuggucuucca

SEQ ID NO: 2492581 - RNA, 16 nt, Chlamydia trachomatis
cuaaauucagauccca

SEQ ID NO: 2492582 - RNA, 18 nt, Chlamydia trachomatis
cuaacaaagaauuuuccg

SEQ ID NO: 2492583 - RNA, 18 nt, Chlamydia trachomatis
cuaacaaugacucaaaaa

SEQ ID NO: 2492584 - RNA, 23 nt, Chlamydia trachomatis
cuaacaaugacucaaaaagcugu

SEQ ID NO: 2492585 - RNA, 13 nt, Chlamydia trachomatis
cuaacacaagcag

SEQ ID NO: 2492586 - RNA, 16 nt, Chlamydia trachomatis
cuaacacuuuuuuuuc

SEQ ID NO: 2492587 - RNA, 20 nt, Chlamydia trachomatis
cuaacacuuuuuuuucuuuc

SEQ ID NO: 2492588 - RNA, 21 nt, Chlamydia trachomatis
cuaacagcucuucuucugaag

SEQ ID NO: 2492589 - RNA, 12 nt, Chlamydia trachomatis
cuaaccaaaaaa

SEQ ID NO: 2492590 - RNA, 15 nt, Chlamydia trachomatis
cuaaccaugcuccuu

SEQ ID NO: 2492591 - RNA, 20 nt, Chlamydia trachomatis
cuaacgcuuccucuccuucu

SEQ ID NO: 2492592 - RNA, 14 nt, Chlamydia trachomatis
cuaacgguuccauu

SEQ ID NO: 2492593 - RNA, 17 nt, Chlamydia trachomatis
cuaacuaaagucuuuuc

SEQ ID NO: 2492594 - RNA, 22 nt, Chlamydia trachomatis
cuaacuaaaugucucuaaguaa

SEQ ID NO: 2492595 - RNA, 19 nt, Chlamydia trachomatis
cuaacuacucccaaaucaa

SEQ ID NO: 2492596 - RNA, 12 nt, Chlamydia trachomatis
cuaacucuucug

SEQ ID NO: 2492597 - RNA, 14 nt, Chlamydia trachomatis
cuaacucuucugga

SEQ ID NO: 2492598 - RNA, 14 nt, Chlamydia trachomatis
cuaacucuucuuua

SEQ ID NO: 2492599 - RNA, 19 nt, Chlamydia trachomatis
cuaacuguacacagggugc

SEQ ID NO: 2492600 - RNA, 14 nt, Chlamydia trachomatis
cuaacuuaauaagg

SEQ ID NO: 2492601 - RNA, 17 nt, Chlamydia trachomatis
cuaacuuuucaaguucu

SEQ ID NO: 2492602 - RNA, 21 nt, Chlamydia trachomatis
cuaacuuuucaaguucuaacu

SEQ ID NO: 2492603 - RNA, 14 nt, Chlamydia trachomatis
cuaagaaaaaccuu

SEQ ID NO: 2492604 - RNA, 13 nt, Chlamydia trachomatis
cuaagaaaauaaa

SEQ ID NO: 2492605 - RNA, 14 nt, Chlamydia trachomatis
cuaagaaaauaaac

SEQ ID NO: 2492606 - RNA, 19 nt, Chlamydia trachomatis
cuaagaagcguucgcgucu

SEQ ID NO: 2492607 - RNA, 20 nt, Chlamydia trachomatis
cuaagacuuucucuaacaau

SEQ ID NO: 2492608 - RNA, 22 nt, Chlamydia trachomatis
cuaagaucuccaugauccccua

SEQ ID NO: 2492609 - RNA, 19 nt, Chlamydia trachomatis
cuaagaucucuuccuugua

SEQ ID NO: 2492610 - RNA, 19 nt, Chlamydia trachomatis
cuaagauuuucaucuucca

SEQ ID NO: 2492611 - RNA, 20 nt, Chlamydia trachomatis
cuaagauuuucaucuuccaa

SEQ ID NO: 2492612 - RNA, 21 nt, Chlamydia trachomatis
cuaagauuuucaucuuccaac

SEQ ID NO: 2492613 - RNA, 15 nt, Chlamydia trachomatis
cuaagcaccuuuaca

SEQ ID NO: 2492614 - RNA, 22 nt, Chlamydia trachomatis
cuaagcaccuuuacaaucaucu

SEQ ID NO: 2492615 - RNA, 14 nt, Chlamydia trachomatis
cuaagcuucucaac

SEQ ID NO: 2492616 - RNA, 22 nt, Chlamydia trachomatis
cuaagcuucucaacacugaaaa

SEQ ID NO: 2492617 - RNA, 12 nt, Chlamydia trachomatis
cuaaggagaauu

SEQ ID NO: 2492618 - RNA, 13 nt, Chlamydia trachomatis
cuaaggaguuuaa

SEQ ID NO: 2492619 - RNA, 16 nt, Chlamydia trachomatis
cuaaggccuuauccaa

SEQ ID NO: 2492620 - RNA, 22 nt, Chlamydia trachomatis
cuaagguaacaaucacaggcug

SEQ ID NO: 2492621 - RNA, 15 nt, Chlamydia trachomatis
cuaaguagcaaauua

SEQ ID NO: 2492622 - RNA, 15 nt, Chlamydia trachomatis
cuaaguauagaagcc

SEQ ID NO: 2492623 - RNA, 13 nt, Chlamydia trachomatis
cuaaguuggcauu

SEQ ID NO: 2492624 - RNA, 17 nt, Chlamydia trachomatis
cuaaguuggcauuuugg

SEQ ID NO: 2492625 - RNA, 13 nt, Chlamydia trachomatis
cuaaguuguaaaa

SEQ ID NO: 2492626 - RNA, 16 nt, Chlamydia trachomatis
cuaaguuguaaaacaa

SEQ ID NO: 2492627 - RNA, 23 nt, Chlamydia trachomatis
cuaauaaauuagggaagagcaau

SEQ ID NO: 2492628 - RNA, 16 nt, Chlamydia trachomatis
cuaauacaaucaguaa

SEQ ID NO: 2492629 - RNA, 13 nt, Chlamydia trachomatis
cuaauagaucuac

SEQ ID NO: 2492630 - RNA, 22 nt, Chlamydia trachomatis
cuaauaggguuaggaaagcacu

SEQ ID NO: 2492631 - RNA, 23 nt, Chlamydia trachomatis
cuaauaggguuaggaaagcacuu

SEQ ID NO: 2492632 - RNA, 18 nt, Chlamydia trachomatis
cuaauaguucucugcaua

SEQ ID NO: 2492633 - RNA, 15 nt, Chlamydia trachomatis
cuaauaguugcaaaa

SEQ ID NO: 2492634 - RNA, 22 nt, Chlamydia trachomatis
cuaauauagaauugacgaaucg

SEQ ID NO: 2492635 - RNA, 14 nt, Chlamydia trachomatis
cuaauaucugcucu

SEQ ID NO: 2492636 - RNA, 21 nt, Chlamydia trachomatis
cuaauaugcagggcuugggau

SEQ ID NO: 2492637 - RNA, 15 nt, Chlamydia trachomatis
cuaauccaugcaucu

SEQ ID NO: 2492638 - RNA, 23 nt, Chlamydia trachomatis
cuaaucccauucugcguuuaauu

SEQ ID NO: 2492639 - RNA, 16 nt, Chlamydia trachomatis
cuaaucgaauuacucu

SEQ ID NO: 2492640 - RNA, 22 nt, Chlamydia trachomatis
cuaaucuuccagcguugccuua

SEQ ID NO: 2492641 - RNA, 22 nt, Chlamydia trachomatis
cuaaucuugauuaggaagaagu

SEQ ID NO: 2492642 - RNA, 12 nt, Chlamydia trachomatis
cuaaucuuuuug

SEQ ID NO: 2492643 - RNA, 21 nt, Chlamydia trachomatis
cuaaucuuuuugauuuuucuu

SEQ ID NO: 2492644 - RNA, 21 nt, Chlamydia trachomatis
cuaaugaaacucuuuuuaaau

SEQ ID NO: 2492645 - RNA, 12 nt, Chlamydia trachomatis
cuaaugagcaga

SEQ ID NO: 2492646 - RNA, 15 nt, Chlamydia trachomatis
cuaaugagcagaaua

SEQ ID NO: 2492647 - RNA, 18 nt, Chlamydia trachomatis
cuaauguagaaauuuuaa

SEQ ID NO: 2492648 - RNA, 20 nt, Chlamydia trachomatis
cuaauguagaaauuuuaaau

SEQ ID NO: 2492649 - RNA, 20 nt, Chlamydia trachomatis
cuaauguagacccugcauua

SEQ ID NO: 2492650 - RNA, 17 nt, Chlamydia trachomatis
cuaauuaauaacgcccu

SEQ ID NO: 2492651 - RNA, 17 nt, Chlamydia trachomatis
cuaauucaacauaauaa

SEQ ID NO: 2492652 - RNA, 18 nt, Chlamydia trachomatis
cuaauucaacauaauaaa

SEQ ID NO: 2492653 - RNA, 12 nt, Chlamydia trachomatis
cuaauuccccaa

SEQ ID NO: 2492654 - RNA, 13 nt, Chlamydia trachomatis
cuaauuccuucaa

SEQ ID NO: 2492655 - RNA, 15 nt, Chlamydia trachomatis
cuaauuucuuucuca

SEQ ID NO: 2492656 - RNA, 20 nt, Chlamydia trachomatis
cuacaaauaguguaaggaga

SEQ ID NO: 2492657 - RNA, 22 nt, Chlamydia trachomatis
cuacaagaccucuccauccugc

SEQ ID NO: 2492658 - RNA, 23 nt, Chlamydia trachomatis
cuacacaucuguauccuaacuaa

SEQ ID NO: 2492659 - RNA, 19 nt, Chlamydia trachomatis
cuacacgauauauccauuc

SEQ ID NO: 2492660 - RNA, 23 nt, Chlamydia trachomatis
cuacacgcugaaauucuugguau

SEQ ID NO: 2492661 - RNA, 13 nt, Chlamydia trachomatis
cuacagagcccuu

SEQ ID NO: 2492662 - RNA, 14 nt, Chlamydia trachomatis
cuacagagcccuuu

SEQ ID NO: 2492663 - RNA, 19 nt, Chlamydia trachomatis
cuacagaguuaccaaucac

SEQ ID NO: 2492664 - RNA, 22 nt, Chlamydia trachomatis
cuacagaucauaggcuccugca

SEQ ID NO: 2492665 - RNA, 15 nt, Chlamydia trachomatis
cuacagcaaaaccuu

SEQ ID NO: 2492666 - RNA, 13 nt, Chlamydia trachomatis
cuacagcagacuu

SEQ ID NO: 2492667 - RNA, 19 nt, Chlamydia trachomatis
cuacaggaguaaauccugc

SEQ ID NO: 2492668 - RNA, 20 nt, Chlamydia trachomatis
cuacaggaguaaauccugcu

SEQ ID NO: 2492669 - RNA, 14 nt, Chlamydia trachomatis
cuacagucugucca

SEQ ID NO: 2492670 - RNA, 15 nt, Chlamydia trachomatis
cuacagucuguccag

SEQ ID NO: 2492671 - RNA, 22 nt, Chlamydia trachomatis
cuacagucuucucgagaagaaa

SEQ ID NO: 2492672 - RNA, 13 nt, Chlamydia trachomatis
cuacauaagucuc

SEQ ID NO: 2492673 - RNA, 15 nt, Chlamydia trachomatis
cuacaucuaaaagag

SEQ ID NO: 2492674 - RNA, 13 nt, Chlamydia trachomatis
cuacauggccaaa

SEQ ID NO: 2492675 - RNA, 18 nt, Chlamydia trachomatis
cuacauguaguaaucugc

SEQ ID NO: 2492676 - RNA, 19 nt, Chlamydia trachomatis
cuacauguaguaaucugcu

SEQ ID NO: 2492677 - RNA, 20 nt, Chlamydia trachomatis
cuacauucagaauauagcug

SEQ ID NO: 2492678 - RNA, 17 nt, Chlamydia trachomatis
cuacauucgccucuucu

SEQ ID NO: 2492679 - RNA, 20 nt, Chlamydia trachomatis
cuacauuguaaauagacuuc

SEQ ID NO: 2492680 - RNA, 15 nt, Chlamydia trachomatis
cuaccaaaaauuuuu

SEQ ID NO: 2492681 - RNA, 21 nt, Chlamydia trachomatis
cuaccaaaccuuaaaagcaag

SEQ ID NO: 2492682 - RNA, 21 nt, Chlamydia trachomatis
cuaccacggauaaagaaagcc

SEQ ID NO: 2492683 - RNA, 12 nt, Chlamydia trachomatis
cuaccagcccca

SEQ ID NO: 2492684 - RNA, 22 nt, Chlamydia trachomatis
cuaccauugugaacaauaauuc

SEQ ID NO: 2492685 - RNA, 16 nt, Chlamydia trachomatis
cuacccccuucuccuu

SEQ ID NO: 2492686 - RNA, 21 nt, Chlamydia trachomatis
cuacccccuucuccuuuuuag

SEQ ID NO: 2492687 - RNA, 18 nt, Chlamydia trachomatis
cuaccccuaaagucucca

SEQ ID NO: 2492688 - RNA, 16 nt, Chlamydia trachomatis
cuacccgauucaaaaa

SEQ ID NO: 2492689 - RNA, 23 nt, Chlamydia trachomatis
cuaccgacaaugucaacauacag

SEQ ID NO: 2492690 - RNA, 14 nt, Chlamydia trachomatis
cuaccgcgagcucg

SEQ ID NO: 2492691 - RNA, 15 nt, Chlamydia trachomatis
cuacgcuacagaguu

SEQ ID NO: 2492692 - RNA, 15 nt, Chlamydia trachomatis
cuacgcuuccuacag

SEQ ID NO: 2492693 - RNA, 19 nt, Chlamydia trachomatis
cuacggaaaaagaagaucc

SEQ ID NO: 2492694 - RNA, 20 nt, Chlamydia trachomatis
cuacuaaagacacuaucacu

SEQ ID NO: 2492695 - RNA, 20 nt, Chlamydia trachomatis
cuacuagauagauggcauuu

SEQ ID NO: 2492696 - RNA, 18 nt, Chlamydia trachomatis
cuacucauccuaacugua

SEQ ID NO: 2492697 - RNA, 20 nt, Chlamydia trachomatis
cuacuccaauggaaauaaga

SEQ ID NO: 2492698 - RNA, 15 nt, Chlamydia trachomatis
cuacucccaaaucaa

SEQ ID NO: 2492699 - RNA, 18 nt, Chlamydia trachomatis
cuacuccugcaacaagaa

SEQ ID NO: 2492700 - RNA, 14 nt, Chlamydia trachomatis
cuacucuuccuuga

SEQ ID NO: 2492701 - RNA, 16 nt, Chlamydia trachomatis
cuacugaugacuuucg

SEQ ID NO: 2492702 - RNA, 16 nt, Chlamydia trachomatis
cuacugggucuuuuuu

SEQ ID NO: 2492703 - RNA, 18 nt, Chlamydia trachomatis
cuacuguagcaccaaguu

SEQ ID NO: 2492704 - RNA, 23 nt, Chlamydia trachomatis
cuacugucgaacgcuucuuccca

SEQ ID NO: 2492705 - RNA, 14 nt, Chlamydia trachomatis
cuacuuucgcuuuu

SEQ ID NO: 2492706 - RNA, 21 nt, Chlamydia trachomatis
cuacuuuuugacauucugccg

SEQ ID NO: 2492707 - RNA, 16 nt, Chlamydia trachomatis
cuagaaaauagcaucu

SEQ ID NO: 2492708 - RNA, 15 nt, Chlamydia trachomatis
cuagaaagaaccaca

SEQ ID NO: 2492709 - RNA, 22 nt, Chlamydia trachomatis
cuagaaagaaccacaaaaucag

SEQ ID NO: 2492710 - RNA, 15 nt, Chlamydia trachomatis
cuagaaauaaaaugg

SEQ ID NO: 2492711 - RNA, 17 nt, Chlamydia trachomatis
cuagaagaaucauagaa

SEQ ID NO: 2492712 - RNA, 21 nt, Chlamydia trachomatis
cuagaagggaacagucucuua

SEQ ID NO: 2492713 - RNA, 22 nt, Chlamydia trachomatis
cuagaaguagucuacuccauuu

SEQ ID NO: 2492714 - RNA, 13 nt, Chlamydia trachomatis
cuagacauagcuu

SEQ ID NO: 2492715 - RNA, 18 nt, Chlamydia trachomatis
cuagagacggucuacaaa

SEQ ID NO: 2492716 - RNA, 17 nt, Chlamydia trachomatis
cuagagauaucacuacc

SEQ ID NO: 2492717 - RNA, 15 nt, Chlamydia trachomatis
cuagaggaaugugaa

SEQ ID NO: 2492718 - RNA, 16 nt, Chlamydia trachomatis
cuagagguauuuuauu

SEQ ID NO: 2492719 - RNA, 14 nt, Chlamydia trachomatis
cuagagguuuaagu

SEQ ID NO: 2492720 - RNA, 21 nt, Chlamydia trachomatis
cuagagucagaagcuauucca

SEQ ID NO: 2492721 - RNA, 16 nt, Chlamydia trachomatis
cuagauccguuuuucu

SEQ ID NO: 2492722 - RNA, 16 nt, Chlamydia trachomatis
cuagaucuaaggaaug

SEQ ID NO: 2492723 - RNA, 14 nt, Chlamydia trachomatis
cuagaugcaauaaa

SEQ ID NO: 2492724 - RNA, 17 nt, Chlamydia trachomatis
cuagaugcaauaaacgc

SEQ ID NO: 2492725 - RNA, 17 nt, Chlamydia trachomatis
cuagcaaccaauucucu

SEQ ID NO: 2492726 - RNA, 17 nt, Chlamydia trachomatis
cuagcaaccgauucuuc

SEQ ID NO: 2492727 - RNA, 13 nt, Chlamydia trachomatis
cuagcagccucuc

SEQ ID NO: 2492728 - RNA, 16 nt, Chlamydia trachomatis
cuagcagcucuuacuc

SEQ ID NO: 2492729 - RNA, 14 nt, Chlamydia trachomatis
cuagcuucuugucg

SEQ ID NO: 2492730 - RNA, 17 nt, Chlamydia trachomatis
cuagcuuuccucacaca

SEQ ID NO: 2492731 - RNA, 22 nt, Chlamydia trachomatis
cuaggacagacaggaaagcacu

SEQ ID NO: 2492732 - RNA, 18 nt, Chlamydia trachomatis
cuaggauuacuuuuucua

SEQ ID NO: 2492733 - RNA, 22 nt, Chlamydia trachomatis
cuaggcgacacgcuucuucaaa

SEQ ID NO: 2492734 - RNA, 18 nt, Chlamydia trachomatis
cuaggcucaugagccucu

SEQ ID NO: 2492735 - RNA, 13 nt, Chlamydia trachomatis
cuagggaaaaaaa

SEQ ID NO: 2492736 - RNA, 22 nt, Chlamydia trachomatis
cuagguaaagguuucuggaaaa

SEQ ID NO: 2492737 - RNA, 22 nt, Chlamydia trachomatis
cuagguacgccguaagcauucc

SEQ ID NO: 2492738 - RNA, 16 nt, Chlamydia trachomatis
cuagguagucucuagu

SEQ ID NO: 2492739 - RNA, 14 nt, Chlamydia trachomatis
cuaggucucccagg

SEQ ID NO: 2492740 - RNA, 18 nt, Chlamydia trachomatis
cuaguaaugugucuaaag

SEQ ID NO: 2492741 - RNA, 15 nt, Chlamydia trachomatis
cuaguacaaaaauac

SEQ ID NO: 2492742 - RNA, 14 nt, Chlamydia trachomatis
cuagucgauucugg

SEQ ID NO: 2492743 - RNA, 17 nt, Chlamydia trachomatis
cuagucuacucauccua

SEQ ID NO: 2492744 - RNA, 18 nt, Chlamydia trachomatis
cuaguuauauugcuucau

SEQ ID NO: 2492745 - RNA, 23 nt, Chlamydia trachomatis
cuauaaaugaaaccccucuuucu

SEQ ID NO: 2492746 - RNA, 16 nt, Chlamydia trachomatis
cuauaagguucaagga

SEQ ID NO: 2492747 - RNA, 17 nt, Chlamydia trachomatis
cuauaagucaaaagaau

SEQ ID NO: 2492748 - RNA, 14 nt, Chlamydia trachomatis
cuauaaucccaaaa

SEQ ID NO: 2492749 - RNA, 19 nt, Chlamydia trachomatis
cuauaaucuauuuuauacu

SEQ ID NO: 2492750 - RNA, 17 nt, Chlamydia trachomatis
cuauaauugcuaaggaa

SEQ ID NO: 2492751 - RNA, 19 nt, Chlamydia trachomatis
cuauacccgacuaaaaaau

SEQ ID NO: 2492752 - RNA, 16 nt, Chlamydia trachomatis
cuauacgaaauaacaa

SEQ ID NO: 2492753 - RNA, 16 nt, Chlamydia trachomatis
cuauagaagaauucgc

SEQ ID NO: 2492754 - RNA, 20 nt, Chlamydia trachomatis
cuauagccaaaugcaccucg

SEQ ID NO: 2492755 - RNA, 19 nt, Chlamydia trachomatis
cuauaggaugguauucgcu

SEQ ID NO: 2492756 - RNA, 19 nt, Chlamydia trachomatis
cuauauagucguaaaaacu

SEQ ID NO: 2492757 - RNA, 18 nt, Chlamydia trachomatis
cuauaugagccuugccua

SEQ ID NO: 2492758 - RNA, 23 nt, Chlamydia trachomatis
cuauaugagccuugccuacagaa

SEQ ID NO: 2492759 - RNA, 18 nt, Chlamydia trachomatis
cuauaugcacuaacgaac

SEQ ID NO: 2492760 - RNA, 18 nt, Chlamydia trachomatis
cuaucaacaucuguguca

SEQ ID NO: 2492761 - RNA, 18 nt, Chlamydia trachomatis
cuaucaacuuuacauaag

SEQ ID NO: 2492762 - RNA, 15 nt, Chlamydia trachomatis
cuaucaauuguucug

SEQ ID NO: 2492763 - RNA, 23 nt, Chlamydia trachomatis
cuaucacuguugagaaaaacucu

SEQ ID NO: 2492764 - RNA, 13 nt, Chlamydia trachomatis
cuaucagcacagc

SEQ ID NO: 2492765 - RNA, 20 nt, Chlamydia trachomatis
cuaucagcgcucauaggaca

SEQ ID NO: 2492766 - RNA, 23 nt, Chlamydia trachomatis
cuaucaggaauaaugauuuuuuu

SEQ ID NO: 2492767 - RNA, 22 nt, Chlamydia trachomatis
cuaucaguggcuauauucguga

SEQ ID NO: 2492768 - RNA, 13 nt, Chlamydia trachomatis
cuaucaucuuuug

SEQ ID NO: 2492769 - RNA, 19 nt, Chlamydia trachomatis
cuaucauugagcaaaaaaa

SEQ ID NO: 2492770 - RNA, 22 nt, Chlamydia trachomatis
cuaucccggaggcaacaaauaa

SEQ ID NO: 2492771 - RNA, 15 nt, Chlamydia trachomatis
cuaucgcuugaaaag

SEQ ID NO: 2492772 - RNA, 15 nt, Chlamydia trachomatis
cuaucuaccuuuuuc

SEQ ID NO: 2492773 - RNA, 12 nt, Chlamydia trachomatis
cuaucucuucug

SEQ ID NO: 2492774 - RNA, 11 nt, Chlamydia trachomatis
cuaucuucagg

SEQ ID NO: 2492775 - RNA, 15 nt, Chlamydia trachomatis
cuaucuuugcgugcu

SEQ ID NO: 2492776 - RNA, 10 nt, Chlamydia trachomatis
cuaugagaau

SEQ ID NO: 2492777 - RNA, 20 nt, Chlamydia trachomatis
cuaugcaaaguuucugaaaa

SEQ ID NO: 2492778 - RNA, 22 nt, Chlamydia trachomatis
cuaugcaaaguuucugaaaagu

SEQ ID NO: 2492779 - RNA, 12 nt, Chlamydia trachomatis
cuaugcaguaaa

SEQ ID NO: 2492780 - RNA, 16 nt, Chlamydia trachomatis
cuaugcaguaaagaaa

SEQ ID NO: 2492781 - RNA, 17 nt, Chlamydia trachomatis
cuaugcaguaaagaaaa

SEQ ID NO: 2492782 - RNA, 17 nt, Chlamydia trachomatis
cuaugcccaggauagga

SEQ ID NO: 2492783 - RNA, 23 nt, Chlamydia trachomatis
cuaugcgcggaaggaaaaagaaa

SEQ ID NO: 2492784 - RNA, 12 nt, Chlamydia trachomatis
cuauggcaaaag

SEQ ID NO: 2492785 - RNA, 13 nt, Chlamydia trachomatis
cuaugguuuuuuc

SEQ ID NO: 2492786 - RNA, 21 nt, Chlamydia trachomatis
cuauguaaaaauucuaaagua

SEQ ID NO: 2492787 - RNA, 19 nt, Chlamydia trachomatis
cuauguaaacaagaauaau

SEQ ID NO: 2492788 - RNA, 20 nt, Chlamydia trachomatis
cuauuaagaauuguacacga

SEQ ID NO: 2492789 - RNA, 14 nt, Chlamydia trachomatis
cuauuacauauagg

SEQ ID NO: 2492790 - RNA, 15 nt, Chlamydia trachomatis
cuauucacuaccaga

SEQ ID NO: 2492791 - RNA, 17 nt, Chlamydia trachomatis
cuauuguauagcuuuua

SEQ ID NO: 2492792 - RNA, 14 nt, Chlamydia trachomatis
cuauuuacagaaua

SEQ ID NO: 2492793 - RNA, 17 nt, Chlamydia trachomatis
cuauuuaggcuaacucc

SEQ ID NO: 2492794 - RNA, 12 nt, Chlamydia trachomatis
cuauuucauuua

SEQ ID NO: 2492795 - RNA, 16 nt, Chlamydia trachomatis
cuauuuccccuacaaa

SEQ ID NO: 2492796 - RNA, 16 nt, Chlamydia trachomatis
cuauuuccuaccauca

SEQ ID NO: 2492797 - RNA, 15 nt, Chlamydia trachomatis
cuauuucgaucuuac

SEQ ID NO: 2492798 - RNA, 22 nt, Chlamydia trachomatis
cuauuucucuuccugaauacuc

SEQ ID NO: 2492799 - RNA, 13 nt, Chlamydia trachomatis
cuauuucugucuu

SEQ ID NO: 2492800 - RNA, 19 nt, Chlamydia trachomatis
cuauuucuucgcauagugu

SEQ ID NO: 2492801 - RNA, 16 nt, Chlamydia trachomatis
cuauuugcaagaacug

SEQ ID NO: 2492802 - RNA, 20 nt, Chlamydia trachomatis
cuauuuguuuuccgauccaa

SEQ ID NO: 2492803 - RNA, 17 nt, Chlamydia trachomatis
cuauuuuauacuucuua

SEQ ID NO: 2492804 - RNA, 13 nt, Chlamydia trachomatis
cuauuuuccucuu

SEQ ID NO: 2492805 - RNA, 11 nt, Chlamydia trachomatis
cuauuuucuuc

SEQ ID NO: 2492806 - RNA, 16 nt, Chlamydia trachomatis
cucaaaauaaagaaau

SEQ ID NO: 2492807 - RNA, 13 nt, Chlamydia trachomatis
cucaaacaaucua

SEQ ID NO: 2492808 - RNA, 16 nt, Chlamydia trachomatis
cucaaacaaucuaaaa

SEQ ID NO: 2492809 - RNA, 20 nt, Chlamydia trachomatis
cucaaacaaucuaaaaaauu

SEQ ID NO: 2492810 - RNA, 16 nt, Chlamydia trachomatis
cucaaacacucgugaa

SEQ ID NO: 2492811 - RNA, 13 nt, Chlamydia trachomatis
cucaacaaggauu

SEQ ID NO: 2492812 - RNA, 16 nt, Chlamydia trachomatis
cucaacacugaaaauc

SEQ ID NO: 2492813 - RNA, 22 nt, Chlamydia trachomatis
cucaacgaaagcauccccaaaa

SEQ ID NO: 2492814 - RNA, 17 nt, Chlamydia trachomatis
cucaacucgcuccagaa

SEQ ID NO: 2492815 - RNA, 17 nt, Chlamydia trachomatis
cucaagcgauuaugaaa

SEQ ID NO: 2492816 - RNA, 18 nt, Chlamydia trachomatis
cucaagcgauuaugaaaa

SEQ ID NO: 2492817 - RNA, 22 nt, Chlamydia trachomatis
cucaagcgauuaugaaaaagcc

SEQ ID NO: 2492818 - RNA, 19 nt, Chlamydia trachomatis
cucaaguucauugguaaga

SEQ ID NO: 2492819 - RNA, 23 nt, Chlamydia trachomatis
cucaauaaucgcucguuccucag

SEQ ID NO: 2492820 - RNA, 18 nt, Chlamydia trachomatis
cucaaugagcgcuuuuuc

SEQ ID NO: 2492821 - RNA, 20 nt, Chlamydia trachomatis
cucaaugagcgcuuuuucuu

SEQ ID NO: 2492822 - RNA, 22 nt, Chlamydia trachomatis
cucaauuguuguacaaucauua

SEQ ID NO: 2492823 - RNA, 21 nt, Chlamydia trachomatis
cucacagcaaauaaagagguu

SEQ ID NO: 2492824 - RNA, 14 nt, Chlamydia trachomatis
cucaccgaaaaauu

SEQ ID NO: 2492825 - RNA, 12 nt, Chlamydia trachomatis
cucacuuccuug

SEQ ID NO: 2492826 - RNA, 14 nt, Chlamydia trachomatis
cucagaaaacuuag

SEQ ID NO: 2492827 - RNA, 21 nt, Chlamydia trachomatis
cucagcauagcgcuucccgcu

SEQ ID NO: 2492828 - RNA, 15 nt, Chlamydia trachomatis
cucagcuaauaaccc

SEQ ID NO: 2492829 - RNA, 18 nt, Chlamydia trachomatis
cucauaagcagggcugua

SEQ ID NO: 2492830 - RNA, 23 nt, Chlamydia trachomatis
cucauaagcguuccuauacaaga

SEQ ID NO: 2492831 - RNA, 19 nt, Chlamydia trachomatis
cucauagauuucagcauca

SEQ ID NO: 2492832 - RNA, 22 nt, Chlamydia trachomatis
cucaucaaauagcaaagcgauc

SEQ ID NO: 2492833 - RNA, 21 nt, Chlamydia trachomatis
cucauccuagcagcuaauacu

SEQ ID NO: 2492834 - RNA, 18 nt, Chlamydia trachomatis
cucaucugacggaauuuu

SEQ ID NO: 2492835 - RNA, 15 nt, Chlamydia trachomatis
cucaucuuuuuuaaa

SEQ ID NO: 2492836 - RNA, 18 nt, Chlamydia trachomatis
cucaucuuuuuuaaaaag

SEQ ID NO: 2492837 - RNA, 20 nt, Chlamydia trachomatis
cucaucuuuuuuaaaaagcu

SEQ ID NO: 2492838 - RNA, 13 nt, Chlamydia trachomatis
cucaugacgagaa

SEQ ID NO: 2492839 - RNA, 19 nt, Chlamydia trachomatis
cucaugagccucuaacucu

SEQ ID NO: 2492840 - RNA, 12 nt, Chlamydia trachomatis
cucauuaagaau

SEQ ID NO: 2492841 - RNA, 17 nt, Chlamydia trachomatis
cucauuaaugacuccca

SEQ ID NO: 2492842 - RNA, 18 nt, Chlamydia trachomatis
cucauuaaugacucccau

SEQ ID NO: 2492843 - RNA, 14 nt, Chlamydia trachomatis
cucauuagaaugau

SEQ ID NO: 2492844 - RNA, 17 nt, Chlamydia trachomatis
cucauuagaaugauuga

SEQ ID NO: 2492845 - RNA, 18 nt, Chlamydia trachomatis
cucauuauauaaagcccc

SEQ ID NO: 2492846 - RNA, 15 nt, Chlamydia trachomatis
cucauugggagcucc

SEQ ID NO: 2492847 - RNA, 15 nt, Chlamydia trachomatis
cuccaaaaaagaggg

SEQ ID NO: 2492848 - RNA, 21 nt, Chlamydia trachomatis
cuccaaaaaagagggaguucu

SEQ ID NO: 2492849 - RNA, 17 nt, Chlamydia trachomatis
cuccaaagaauagaaua

SEQ ID NO: 2492850 - RNA, 23 nt, Chlamydia trachomatis
cuccaaagauauagguuccaucu

SEQ ID NO: 2492851 - RNA, 13 nt, Chlamydia trachomatis
cuccaaaguaauc

SEQ ID NO: 2492852 - RNA, 21 nt, Chlamydia trachomatis
cuccaagauguuggagaacau

SEQ ID NO: 2492853 - RNA, 14 nt, Chlamydia trachomatis
cuccaaucacagca

SEQ ID NO: 2492854 - RNA, 21 nt, Chlamydia trachomatis
cuccacacaacauaacucugc

SEQ ID NO: 2492855 - RNA, 23 nt, Chlamydia trachomatis
cuccaccauagcacuuagcaguu

SEQ ID NO: 2492856 - RNA, 16 nt, Chlamydia trachomatis
cuccaccuaauucccc

SEQ ID NO: 2492857 - RNA, 13 nt, Chlamydia trachomatis
cuccacuucuuuu

SEQ ID NO: 2492858 - RNA, 16 nt, Chlamydia trachomatis
cuccagaaacaggaga

SEQ ID NO: 2492859 - RNA, 23 nt, Chlamydia trachomatis
cuccagauacugcuccacaacac

SEQ ID NO: 2492860 - RNA, 17 nt, Chlamydia trachomatis
cuccagcaucuuuucuu

SEQ ID NO: 2492861 - RNA, 19 nt, Chlamydia trachomatis
cuccagcaucuuuucuuau

SEQ ID NO: 2492862 - RNA, 23 nt, Chlamydia trachomatis
cuccagcaucuuuucuuauaaag

SEQ ID NO: 2492863 - RNA, 14 nt, Chlamydia trachomatis
cuccagcuaaaaau

SEQ ID NO: 2492864 - RNA, 13 nt, Chlamydia trachomatis
cuccagcucuucc

SEQ ID NO: 2492865 - RNA, 14 nt, Chlamydia trachomatis
cuccagcuucucca

SEQ ID NO: 2492866 - RNA, 13 nt, Chlamydia trachomatis
cuccaggaaaagc

SEQ ID NO: 2492867 - RNA, 14 nt, Chlamydia trachomatis
cuccaggaaaagcu

SEQ ID NO: 2492868 - RNA, 19 nt, Chlamydia trachomatis
cuccaggaauucguccucc

SEQ ID NO: 2492869 - RNA, 22 nt, Chlamydia trachomatis
cuccauaaaagagucccuuaac

SEQ ID NO: 2492870 - RNA, 18 nt, Chlamydia trachomatis
cuccauaacgauccucuu

SEQ ID NO: 2492871 - RNA, 21 nt, Chlamydia trachomatis
cuccauaagaaauuaacacca

SEQ ID NO: 2492872 - RNA, 22 nt, Chlamydia trachomatis
cuccauaagaaauuaacaccaa

SEQ ID NO: 2492873 - RNA, 14 nt, Chlamydia trachomatis
cuccaucucugcuu

SEQ ID NO: 2492874 - RNA, 15 nt, Chlamydia trachomatis
cuccaucugacuuuu

SEQ ID NO: 2492875 - RNA, 18 nt, Chlamydia trachomatis
cuccaugugcggcaagcc

SEQ ID NO: 2492876 - RNA, 14 nt, Chlamydia trachomatis
cuccauuuuaagga

SEQ ID NO: 2492877 - RNA, 19 nt, Chlamydia trachomatis
cucccaaaucaaaccaaaa

SEQ ID NO: 2492878 - RNA, 20 nt, Chlamydia trachomatis
cucccaauauacaaguauuu

SEQ ID NO: 2492879 - RNA, 15 nt, Chlamydia trachomatis
cucccauacaaaagc

SEQ ID NO: 2492880 - RNA, 16 nt, Chlamydia trachomatis
cuccccagaaaaacca

SEQ ID NO: 2492881 - RNA, 18 nt, Chlamydia trachomatis
cuccccuuccuguucuuc

SEQ ID NO: 2492882 - RNA, 14 nt, Chlamydia trachomatis
cucccuagugcugu

SEQ ID NO: 2492883 - RNA, 18 nt, Chlamydia trachomatis
cucccugcucuugaagau

SEQ ID NO: 2492884 - RNA, 22 nt, Chlamydia trachomatis
cucccuuagcaacagucaauuc

SEQ ID NO: 2492885 - RNA, 21 nt, Chlamydia trachomatis
cucccuuuccauacaucaucu

SEQ ID NO: 2492886 - RNA, 17 nt, Chlamydia trachomatis
cuccgacccaagacacg

SEQ ID NO: 2492887 - RNA, 16 nt, Chlamydia trachomatis
cuccgauaauuuuccu

SEQ ID NO: 2492888 - RNA, 22 nt, Chlamydia trachomatis
cuccgaugccgcagaaaaaacc

SEQ ID NO: 2492889 - RNA, 16 nt, Chlamydia trachomatis
cuccgcugauuagaaa

SEQ ID NO: 2492890 - RNA, 20 nt, Chlamydia trachomatis
cuccgguucucuuggcuuuu

SEQ ID NO: 2492891 - RNA, 15 nt, Chlamydia trachomatis
cuccuaaauccuaua

SEQ ID NO: 2492892 - RNA, 14 nt, Chlamydia trachomatis
cuccuaacccuaaa

SEQ ID NO: 2492893 - RNA, 23 nt, Chlamydia trachomatis
cuccuaacccuuguacagcgaca

SEQ ID NO: 2492894 - RNA, 19 nt, Chlamydia trachomatis
cuccuaaccgguaaucaaa

SEQ ID NO: 2492895 - RNA, 12 nt, Chlamydia trachomatis
cuccuaagcagu

SEQ ID NO: 2492896 - RNA, 16 nt, Chlamydia trachomatis
cuccuaaucuuucuaa

SEQ ID NO: 2492897 - RNA, 15 nt, Chlamydia trachomatis
cuccuaauucaacau

SEQ ID NO: 2492898 - RNA, 12 nt, Chlamydia trachomatis
cuccuacaaaau

SEQ ID NO: 2492899 - RNA, 13 nt, Chlamydia trachomatis
cuccuacaaaaua

SEQ ID NO: 2492900 - RNA, 23 nt, Chlamydia trachomatis
cuccuacaaaauaguucacucca

SEQ ID NO: 2492901 - RNA, 21 nt, Chlamydia trachomatis
cuccuagugauaaacaggagc

SEQ ID NO: 2492902 - RNA, 21 nt, Chlamydia trachomatis
cuccuauaauugcuaaggaaa

SEQ ID NO: 2492903 - RNA, 19 nt, Chlamydia trachomatis
cuccuaucacucccugcaa

SEQ ID NO: 2492904 - RNA, 14 nt, Chlamydia trachomatis
cuccucaagcgauu

SEQ ID NO: 2492905 - RNA, 18 nt, Chlamydia trachomatis
cuccucaagcgauuauga

SEQ ID NO: 2492906 - RNA, 21 nt, Chlamydia trachomatis
cuccucaagcgauuaugaaaa

SEQ ID NO: 2492907 - RNA, 23 nt, Chlamydia trachomatis
cuccucaagcgauuaugaaaaag

SEQ ID NO: 2492908 - RNA, 15 nt, Chlamydia trachomatis
cuccucccuuuccau

SEQ ID NO: 2492909 - RNA, 15 nt, Chlamydia trachomatis
cuccuccuaaacaaa

SEQ ID NO: 2492910 - RNA, 23 nt, Chlamydia trachomatis
cuccucggacaaacguccuccug

SEQ ID NO: 2492911 - RNA, 16 nt, Chlamydia trachomatis
cuccucuccuaacccu

SEQ ID NO: 2492912 - RNA, 12 nt, Chlamydia trachomatis
cuccucucuuug

SEQ ID NO: 2492913 - RNA, 17 nt, Chlamydia trachomatis
cuccucuucuaucgcuu

SEQ ID NO: 2492914 - RNA, 17 nt, Chlamydia trachomatis
cuccugcagacaagccu

SEQ ID NO: 2492915 - RNA, 16 nt, Chlamydia trachomatis
cuccugcagcuaaaga

SEQ ID NO: 2492916 - RNA, 23 nt, Chlamydia trachomatis
cuccuuaguuaaaacuccagaaa

SEQ ID NO: 2492917 - RNA, 12 nt, Chlamydia trachomatis
cuccuuccucuu

SEQ ID NO: 2492918 - RNA, 16 nt, Chlamydia trachomatis
cuccuucuacaaaaaa

SEQ ID NO: 2492919 - RNA, 20 nt, Chlamydia trachomatis
cuccuucucagagcuuugca

SEQ ID NO: 2492920 - RNA, 19 nt, Chlamydia trachomatis
cuccuucuugugagagaaa

SEQ ID NO: 2492921 - RNA, 20 nt, Chlamydia trachomatis
cuccuucuugugagagaaau

SEQ ID NO: 2492922 - RNA, 16 nt, Chlamydia trachomatis
cuccuuugcuaacaaa

SEQ ID NO: 2492923 - RNA, 19 nt, Chlamydia trachomatis
cuccuuugcuaacaaagaa

SEQ ID NO: 2492924 - RNA, 16 nt, Chlamydia trachomatis
cucgaacucagcuucc

SEQ ID NO: 2492925 - RNA, 16 nt, Chlamydia trachomatis
cucgaagcuacugaug

SEQ ID NO: 2492926 - RNA, 18 nt, Chlamydia trachomatis
cucgaaggagcuaagaac

SEQ ID NO: 2492927 - RNA, 14 nt, Chlamydia trachomatis
cucgacgcugucca

SEQ ID NO: 2492928 - RNA, 15 nt, Chlamydia trachomatis
cucgagaagaaaaac

SEQ ID NO: 2492929 - RNA, 17 nt, Chlamydia trachomatis
cucgagccuguuuagaa

SEQ ID NO: 2492930 - RNA, 20 nt, Chlamydia trachomatis
cucgagccuguuuagaaaga

SEQ ID NO: 2492931 - RNA, 15 nt, Chlamydia trachomatis
cucgaggacagucuc

SEQ ID NO: 2492932 - RNA, 19 nt, Chlamydia trachomatis
cucgaguucuguuauuugu

SEQ ID NO: 2492933 - RNA, 14 nt, Chlamydia trachomatis
cucgauauccugaa

SEQ ID NO: 2492934 - RNA, 20 nt, Chlamydia trachomatis
cucgauccgguucuuuugua

SEQ ID NO: 2492935 - RNA, 13 nt, Chlamydia trachomatis
cucgauggcaggg

SEQ ID NO: 2492936 - RNA, 15 nt, Chlamydia trachomatis
cucgauggcagggaa

SEQ ID NO: 2492937 - RNA, 17 nt, Chlamydia trachomatis
cucgauggcagggaauc

SEQ ID NO: 2492938 - RNA, 13 nt, Chlamydia trachomatis
cucgcaaagaauc

SEQ ID NO: 2492939 - RNA, 18 nt, Chlamydia trachomatis
cucgcacacgauuaucua

SEQ ID NO: 2492940 - RNA, 14 nt, Chlamydia trachomatis
cucgcagagaaaga

SEQ ID NO: 2492941 - RNA, 19 nt, Chlamydia trachomatis
cucgcagagaaagagccaa

SEQ ID NO: 2492942 - RNA, 22 nt, Chlamydia trachomatis
cucgcagaugcuucugccuuuu

SEQ ID NO: 2492943 - RNA, 17 nt, Chlamydia trachomatis
cucgccucuaucucuuc

SEQ ID NO: 2492944 - RNA, 15 nt, Chlamydia trachomatis
cucgcgcuaaaaccu

SEQ ID NO: 2492945 - RNA, 22 nt, Chlamydia trachomatis
cucgcuacauguaguaaucugc

SEQ ID NO: 2492946 - RNA, 22 nt, Chlamydia trachomatis
cucggacaaacguccuccugau

SEQ ID NO: 2492947 - RNA, 21 nt, Chlamydia trachomatis
cucggccagagcucauagucu

SEQ ID NO: 2492948 - RNA, 22 nt, Chlamydia trachomatis
cucggccagagcucauagucug

SEQ ID NO: 2492949 - RNA, 16 nt, Chlamydia trachomatis
cucguaaaaaagauaa

SEQ ID NO: 2492950 - RNA, 22 nt, Chlamydia trachomatis
cucguuagcagaagcaagaauc

SEQ ID NO: 2492951 - RNA, 22 nt, Chlamydia trachomatis
cucguugauuaaaguuucuaau

SEQ ID NO: 2492952 - RNA, 20 nt, Chlamydia trachomatis
cucguuuagcagccugagga

SEQ ID NO: 2492953 - RNA, 19 nt, Chlamydia trachomatis
cucuaaaaacucuuuuucu

SEQ ID NO: 2492954 - RNA, 15 nt, Chlamydia trachomatis
cucuaaaaguuuucu

SEQ ID NO: 2492955 - RNA, 20 nt, Chlamydia trachomatis
cucuaaaaucacacaagcug

SEQ ID NO: 2492956 - RNA, 20 nt, Chlamydia trachomatis
cucuaaacaagguucuucaa

SEQ ID NO: 2492957 - RNA, 23 nt, Chlamydia trachomatis
cucuaaaggauaaggaagaagau

SEQ ID NO: 2492958 - RNA, 20 nt, Chlamydia trachomatis
cucuaaagucuuuccauuua

SEQ ID NO: 2492959 - RNA, 17 nt, Chlamydia trachomatis
cucuaacucuucuggag

SEQ ID NO: 2492960 - RNA, 21 nt, Chlamydia trachomatis
cucuaagcaccuuuacaauca

SEQ ID NO: 2492961 - RNA, 21 nt, Chlamydia trachomatis
cucuaauaaacagaucuuuuu

SEQ ID NO: 2492962 - RNA, 18 nt, Chlamydia trachomatis
cucuaauaaaucugcuaa

SEQ ID NO: 2492963 - RNA, 23 nt, Chlamydia trachomatis
cucuaauaggguuaggaaagcac

SEQ ID NO: 2492964 - RNA, 22 nt, Chlamydia trachomatis
cucuacgaaaaagucaagacag

SEQ ID NO: 2492965 - RNA, 20 nt, Chlamydia trachomatis
cucuacgcuuccuacagcua

SEQ ID NO: 2492966 - RNA, 15 nt, Chlamydia trachomatis
cucuagguagucucu

SEQ ID NO: 2492967 - RNA, 23 nt, Chlamydia trachomatis
cucuaucccgcgguagaaagucc

SEQ ID NO: 2492968 - RNA, 22 nt, Chlamydia trachomatis
cucuauguucuuaauaaucugu

SEQ ID NO: 2492969 - RNA, 15 nt, Chlamydia trachomatis
cucucauaagaucuu

SEQ ID NO: 2492970 - RNA, 19 nt, Chlamydia trachomatis
cucucaucaguaaacacuu

SEQ ID NO: 2492971 - RNA, 11 nt, Chlamydia trachomatis
cucucaucuaa

SEQ ID NO: 2492972 - RNA, 20 nt, Chlamydia trachomatis
cucuccagaguucauuuuuu

SEQ ID NO: 2492973 - RNA, 22 nt, Chlamydia trachomatis
cucuccauccugcguguacauu

SEQ ID NO: 2492974 - RNA, 15 nt, Chlamydia trachomatis
cucuccauuuuccug

SEQ ID NO: 2492975 - RNA, 12 nt, Chlamydia trachomatis
cucucccuuccu

SEQ ID NO: 2492976 - RNA, 20 nt, Chlamydia trachomatis
cucuccgguguauccucguc

SEQ ID NO: 2492977 - RNA, 17 nt, Chlamydia trachomatis
cucuccuucuacaaaaa

SEQ ID NO: 2492978 - RNA, 15 nt, Chlamydia trachomatis
cucuccuugaacaau

SEQ ID NO: 2492979 - RNA, 18 nt, Chlamydia trachomatis
cucucgaucucaucaaaa

SEQ ID NO: 2492980 - RNA, 20 nt, Chlamydia trachomatis
cucucuaaaaacucuuuuuc

SEQ ID NO: 2492981 - RNA, 22 nt, Chlamydia trachomatis
cucucuaaaaacucuuuuucua

SEQ ID NO: 2492982 - RNA, 12 nt, Chlamydia trachomatis
cucucuuuauga

SEQ ID NO: 2492983 - RNA, 19 nt, Chlamydia trachomatis
cucugaaagagcuucuuuu

SEQ ID NO: 2492984 - RNA, 18 nt, Chlamydia trachomatis
cucugaguuaaaggaagg

SEQ ID NO: 2492985 - RNA, 13 nt, Chlamydia trachomatis
cucugauuagaag

SEQ ID NO: 2492986 - RNA, 22 nt, Chlamydia trachomatis
cucugcaacaaagaguuuaggc

SEQ ID NO: 2492987 - RNA, 17 nt, Chlamydia trachomatis
cucugcagaagaagccc

SEQ ID NO: 2492988 - RNA, 17 nt, Chlamydia trachomatis
cucugcagauuuuguag

SEQ ID NO: 2492989 - RNA, 14 nt, Chlamydia trachomatis
cucugccaccucau

SEQ ID NO: 2492990 - RNA, 20 nt, Chlamydia trachomatis
cucuggaacagguuucuuac

SEQ ID NO: 2492991 - RNA, 15 nt, Chlamydia trachomatis
cucugguaaaaauag

SEQ ID NO: 2492992 - RNA, 21 nt, Chlamydia trachomatis
cucuggucgugaucacuguga

SEQ ID NO: 2492993 - RNA, 24 nt, Chlamydia trachomatis
cucuuaaaaggccguuuaccaaug

SEQ ID NO: 2492994 - RNA, 17 nt, Chlamydia trachomatis
cucuuacgagcuuucuu

SEQ ID NO: 2492995 - RNA, 22 nt, Chlamydia trachomatis
cucuucacaaauauacucuuug

SEQ ID NO: 2492996 - RNA, 22 nt, Chlamydia trachomatis
cucuucacagagcuucucuaaa

SEQ ID NO: 2492997 - RNA, 14 nt, Chlamydia trachomatis
cucuuccaacaauu

SEQ ID NO: 2492998 - RNA, 21 nt, Chlamydia trachomatis
cucuuccgaagauucgcugcu

SEQ ID NO: 2492999 - RNA, 13 nt, Chlamydia trachomatis
cucuuccuucccu

SEQ ID NO: 2493000 - RNA, 15 nt, Chlamydia trachomatis
cucuucuaacuuuuc

SEQ ID NO: 2493001 - RNA, 21 nt, Chlamydia trachomatis
cucuugaaccaguuucuuggc

SEQ ID NO: 2493002 - RNA, 23 nt, Chlamydia trachomatis
cucuugauugaaccguuuuucua

SEQ ID NO: 2493003 - RNA, 20 nt, Chlamydia trachomatis
cucuugccugcaaauaauaa

SEQ ID NO: 2493004 - RNA, 18 nt, Chlamydia trachomatis
cucuuggagagaaugaag

SEQ ID NO: 2493005 - RNA, 15 nt, Chlamydia trachomatis
cucuuggcuuuuuau

SEQ ID NO: 2493006 - RNA, 22 nt, Chlamydia trachomatis
cucuuguaaguccuuacauaaa

SEQ ID NO: 2493007 - RNA, 21 nt, Chlamydia trachomatis
cucuuguaucauauucuuugu

SEQ ID NO: 2493008 - RNA, 17 nt, Chlamydia trachomatis
cucuugucgauaaagua

SEQ ID NO: 2493009 - RNA, 20 nt, Chlamydia trachomatis
cucuuguugaauaucguaaa

SEQ ID NO: 2493010 - RNA, 15 nt, Chlamydia trachomatis
cucuuuagcaugcac

SEQ ID NO: 2493011 - RNA, 19 nt, Chlamydia trachomatis
cucuuuagccaauuuccau

SEQ ID NO: 2493012 - RNA, 22 nt, Chlamydia trachomatis
cucuuuccuccucccuuuccau

SEQ ID NO: 2493013 - RNA, 12 nt, Chlamydia trachomatis
cucuuuccucua

SEQ ID NO: 2493014 - RNA, 11 nt, Chlamydia trachomatis
cucuuucucuc

SEQ ID NO: 2493015 - RNA, 17 nt, Chlamydia trachomatis
cucuuugaacuucaaga

SEQ ID NO: 2493016 - RNA, 23 nt, Chlamydia trachomatis
cucuuuguugggcaaucaagcua

SEQ ID NO: 2493017 - RNA, 20 nt, Chlamydia trachomatis
cucuuuuaccgagagaugaa

SEQ ID NO: 2493018 - RNA, 21 nt, Chlamydia trachomatis
cucuuuuuaaaucaauuucuc

SEQ ID NO: 2493019 - RNA, 23 nt, Chlamydia trachomatis
cucuuuuucaccagcaaaagaaa

SEQ ID NO: 2493020 - RNA, 18 nt, Chlamydia trachomatis
cucuuuuucagacaaaaa

SEQ ID NO: 2493021 - RNA, 19 nt, Chlamydia trachomatis
cucuuuuucagacaaaaag

SEQ ID NO: 2493022 - RNA, 13 nt, Chlamydia trachomatis
cugaaaagagaag

SEQ ID NO: 2493023 - RNA, 20 nt, Chlamydia trachomatis
cugaaaagagaagaaggcuu

SEQ ID NO: 2493024 - RNA, 17 nt, Chlamydia trachomatis
cugaaaaugcucuaaag

SEQ ID NO: 2493025 - RNA, 14 nt, Chlamydia trachomatis
cugaacauacaauu

SEQ ID NO: 2493026 - RNA, 20 nt, Chlamydia trachomatis
cugaacauacaauuuagacu

SEQ ID NO: 2493027 - RNA, 16 nt, Chlamydia trachomatis
cugaacccuucaauaa

SEQ ID NO: 2493028 - RNA, 18 nt, Chlamydia trachomatis
cugaagauuuuuuaauaa

SEQ ID NO: 2493029 - RNA, 22 nt, Chlamydia trachomatis
cugaagcaaugcuaucagcgaa

SEQ ID NO: 2493030 - RNA, 20 nt, Chlamydia trachomatis
cugaaggugugaaagaaaaa

SEQ ID NO: 2493031 - RNA, 21 nt, Chlamydia trachomatis
cugaaggugugaaagaaaaau

SEQ ID NO: 2493032 - RNA, 23 nt, Chlamydia trachomatis
cugaaggugugaaagaaaaauaa

SEQ ID NO: 2493033 - RNA, 18 nt, Chlamydia trachomatis
cugaauaguuguagaagg

SEQ ID NO: 2493034 - RNA, 14 nt, Chlamydia trachomatis
cugaaucuguguug

SEQ ID NO: 2493035 - RNA, 21 nt, Chlamydia trachomatis
cugaaucuguguugcaaagag

SEQ ID NO: 2493036 - RNA, 23 nt, Chlamydia trachomatis
cugaaucuguguugcaaagagag

SEQ ID NO: 2493037 - RNA, 17 nt, Chlamydia trachomatis
cugaauggucaauaauu

SEQ ID NO: 2493038 - RNA, 17 nt, Chlamydia trachomatis
cugacaaagcuuccuua

SEQ ID NO: 2493039 - RNA, 20 nt, Chlamydia trachomatis
cugacggauccugcuggugg

SEQ ID NO: 2493040 - RNA, 14 nt, Chlamydia trachomatis
cugacuacagucuu

SEQ ID NO: 2493041 - RNA, 13 nt, Chlamydia trachomatis
cugacucaaugug

SEQ ID NO: 2493042 - RNA, 13 nt, Chlamydia trachomatis
cugacuuucacau

SEQ ID NO: 2493043 - RNA, 23 nt, Chlamydia trachomatis
cugagaaucggauccuucgauau

SEQ ID NO: 2493044 - RNA, 15 nt, Chlamydia trachomatis
cugagacaucuccug

SEQ ID NO: 2493045 - RNA, 19 nt, Chlamydia trachomatis
cugagacuccagcuucucc

SEQ ID NO: 2493046 - RNA, 16 nt, Chlamydia trachomatis
cugagagaaaaucaua

SEQ ID NO: 2493047 - RNA, 21 nt, Chlamydia trachomatis
cugagagagcaauacggcaaa

SEQ ID NO: 2493048 - RNA, 20 nt, Chlamydia trachomatis
cugagaggaguuuuuuucac

SEQ ID NO: 2493049 - RNA, 22 nt, Chlamydia trachomatis
cugagaucgagcuucugcauug

SEQ ID NO: 2493050 - RNA, 18 nt, Chlamydia trachomatis
cugagauguuuacgagga

SEQ ID NO: 2493051 - RNA, 19 nt, Chlamydia trachomatis
cugagauguuuacgaggag

SEQ ID NO: 2493052 - RNA, 15 nt, Chlamydia trachomatis
cugagcauuucucuc

SEQ ID NO: 2493053 - RNA, 20 nt, Chlamydia trachomatis
cugagccaucgccuucuaua

SEQ ID NO: 2493054 - RNA, 17 nt, Chlamydia trachomatis
cugagcccaaggagaau

SEQ ID NO: 2493055 - RNA, 14 nt, Chlamydia trachomatis
cugagcuauuuagg

SEQ ID NO: 2493056 - RNA, 15 nt, Chlamydia trachomatis
cugagcucuuuccuc

SEQ ID NO: 2493057 - RNA, 22 nt, Chlamydia trachomatis
cugagcuuugaggacugacaga

SEQ ID NO: 2493058 - RNA, 17 nt, Chlamydia trachomatis
cugagcuuuuuuucacu

SEQ ID NO: 2493059 - RNA, 16 nt, Chlamydia trachomatis
cugagggccuucuuuu

SEQ ID NO: 2493060 - RNA, 14 nt, Chlamydia trachomatis
cugagggugagguc

SEQ ID NO: 2493061 - RNA, 20 nt, Chlamydia trachomatis
cugaguauuaaggaaaugaa

SEQ ID NO: 2493062 - RNA, 23 nt, Chlamydia trachomatis
cugagucucgcgcuaaaaccuua

SEQ ID NO: 2493063 - RNA, 16 nt, Chlamydia trachomatis
cugagucuugugcucu

SEQ ID NO: 2493064 - RNA, 14 nt, Chlamydia trachomatis
cugaguuuccuuua

SEQ ID NO: 2493065 - RNA, 14 nt, Chlamydia trachomatis
cugauaaaaauaau

SEQ ID NO: 2493066 - RNA, 21 nt, Chlamydia trachomatis
cugauaaaugucccugaacau

SEQ ID NO: 2493067 - RNA, 19 nt, Chlamydia trachomatis
cugauaaggaggcuucaca

SEQ ID NO: 2493068 - RNA, 23 nt, Chlamydia trachomatis
cugaucaacaagagcuuguucuu

SEQ ID NO: 2493069 - RNA, 15 nt, Chlamydia trachomatis
cugaucggaacaggg

SEQ ID NO: 2493070 - RNA, 12 nt, Chlamydia trachomatis
cugaugcaccau

SEQ ID NO: 2493071 - RNA, 15 nt, Chlamydia trachomatis
cugaugcaccauaau

SEQ ID NO: 2493072 - RNA, 22 nt, Chlamydia trachomatis
cugaugcuuggaaauaagcuug

SEQ ID NO: 2493073 - RNA, 15 nt, Chlamydia trachomatis
cugauguaauuugga

SEQ ID NO: 2493074 - RNA, 14 nt, Chlamydia trachomatis
cugauguuccaucu

SEQ ID NO: 2493075 - RNA, 20 nt, Chlamydia trachomatis
cugauuccgagggaaucauu

SEQ ID NO: 2493076 - RNA, 15 nt, Chlamydia trachomatis
cugauuccugcugau

SEQ ID NO: 2493077 - RNA, 22 nt, Chlamydia trachomatis
cugcaacaaauaccaaaauauc

SEQ ID NO: 2493078 - RNA, 13 nt, Chlamydia trachomatis
cugcaacaguaaa

SEQ ID NO: 2493079 - RNA, 21 nt, Chlamydia trachomatis
cugcaacauuuccuaaggcuu

SEQ ID NO: 2493080 - RNA, 13 nt, Chlamydia trachomatis
cugcaacccaagc

SEQ ID NO: 2493081 - RNA, 11 nt, Chlamydia trachomatis
cugcaagaaaa

SEQ ID NO: 2493082 - RNA, 15 nt, Chlamydia trachomatis
cugcaagagaucgua

SEQ ID NO: 2493083 - RNA, 22 nt, Chlamydia trachomatis
cugcaagcacacuugauaaaua

SEQ ID NO: 2493084 - RNA, 23 nt, Chlamydia trachomatis
cugcaagcacacuugauaaauag

SEQ ID NO: 2493085 - RNA, 19 nt, Chlamydia trachomatis
cugcaauaaggggaagaaa

SEQ ID NO: 2493086 - RNA, 21 nt, Chlamydia trachomatis
cugcaauagaaaccuuauaua

SEQ ID NO: 2493087 - RNA, 17 nt, Chlamydia trachomatis
cugcaaucucuuguuuc

SEQ ID NO: 2493088 - RNA, 17 nt, Chlamydia trachomatis
cugcacaauauuaucua

SEQ ID NO: 2493089 - RNA, 20 nt, Chlamydia trachomatis
cugcacaauauuaucuacag

SEQ ID NO: 2493090 - RNA, 21 nt, Chlamydia trachomatis
cugcaccggcaaagaacaguu

SEQ ID NO: 2493091 - RNA, 17 nt, Chlamydia trachomatis
cugcaccucuuucagau

SEQ ID NO: 2493092 - RNA, 12 nt, Chlamydia trachomatis
cugcagagaaag

SEQ ID NO: 2493093 - RNA, 19 nt, Chlamydia trachomatis
cugcagagagccagcgagg

SEQ ID NO: 2493094 - RNA, 19 nt, Chlamydia trachomatis
cugcagccuacauacaugc

SEQ ID NO: 2493095 - RNA, 21 nt, Chlamydia trachomatis
cugcagugacauuauuuuuuc

SEQ ID NO: 2493096 - RNA, 15 nt, Chlamydia trachomatis
cugcauaacagcaag

SEQ ID NO: 2493097 - RNA, 14 nt, Chlamydia trachomatis
cugcauacuuuuca

SEQ ID NO: 2493098 - RNA, 14 nt, Chlamydia trachomatis
cugcauuaaacacu

SEQ ID NO: 2493099 - RNA, 16 nt, Chlamydia trachomatis
cugcauuuauccacag

SEQ ID NO: 2493100 - RNA, 21 nt, Chlamydia trachomatis
cugcauuuauccacaggucau

SEQ ID NO: 2493101 - RNA, 17 nt, Chlamydia trachomatis
cugccaguuaaucaauu

SEQ ID NO: 2493102 - RNA, 13 nt, Chlamydia trachomatis
cugcccaucaucg

SEQ ID NO: 2493103 - RNA, 13 nt, Chlamydia trachomatis
cugccgacuccug

SEQ ID NO: 2493104 - RNA, 16 nt, Chlamydia trachomatis
cugcgaaaaagaaaua

SEQ ID NO: 2493105 - RNA, 23 nt, Chlamydia trachomatis
cugcgacguaacaccaaauccuc

SEQ ID NO: 2493106 - RNA, 20 nt, Chlamydia trachomatis
cugcggaaggguauucguag

SEQ ID NO: 2493107 - RNA, 15 nt, Chlamydia trachomatis
cugcggacugcauca

SEQ ID NO: 2493108 - RNA, 18 nt, Chlamydia trachomatis
cugcggcagcugcuugga

SEQ ID NO: 2493109 - RNA, 15 nt, Chlamydia trachomatis
cugcggcuccuucuu

SEQ ID NO: 2493110 - RNA, 17 nt, Chlamydia trachomatis
cugcggcuccuucuuga

SEQ ID NO: 2493111 - RNA, 23 nt, Chlamydia trachomatis
cugcgggauauguuaaagcccag

SEQ ID NO: 2493112 - RNA, 21 nt, Chlamydia trachomatis
cugcuaaauccauucgcauua

SEQ ID NO: 2493113 - RNA, 20 nt, Chlamydia trachomatis
cugcuaauaguucucugcau

SEQ ID NO: 2493114 - RNA, 21 nt, Chlamydia trachomatis
cugcuacaaacugcucaagga

SEQ ID NO: 2493115 - RNA, 15 nt, Chlamydia trachomatis
cugcuagauacaaua

SEQ ID NO: 2493116 - RNA, 15 nt, Chlamydia trachomatis
cugcuauagaaagca

SEQ ID NO: 2493117 - RNA, 13 nt, Chlamydia trachomatis
cugcuaucaucuu

SEQ ID NO: 2493118 - RNA, 22 nt, Chlamydia trachomatis
cugcuauuacauauaggcugaa

SEQ ID NO: 2493119 - RNA, 16 nt, Chlamydia trachomatis
cugcucagagauccca

SEQ ID NO: 2493120 - RNA, 15 nt, Chlamydia trachomatis
cugcuccaaagauau

SEQ ID NO: 2493121 - RNA, 18 nt, Chlamydia trachomatis
cugcuccggcaaauccug

SEQ ID NO: 2493122 - RNA, 23 nt, Chlamydia trachomatis
cugcucgaguucuguuauuuguu

SEQ ID NO: 2493123 - RNA, 16 nt, Chlamydia trachomatis
cugcucuugaagauau

SEQ ID NO: 2493124 - RNA, 17 nt, Chlamydia trachomatis
cugcugcccaagagauu

SEQ ID NO: 2493125 - RNA, 14 nt, Chlamydia trachomatis
cugcugucagaaga

SEQ ID NO: 2493126 - RNA, 15 nt, Chlamydia trachomatis
cugcuuaucuccgcu

SEQ ID NO: 2493127 - RNA, 22 nt, Chlamydia trachomatis
cugcuucaaaaaagauuucccc

SEQ ID NO: 2493128 - RNA, 13 nt, Chlamydia trachomatis
cugcuucacagcu

SEQ ID NO: 2493129 - RNA, 21 nt, Chlamydia trachomatis
cugcuuccuaucgcgagaaga

SEQ ID NO: 2493130 - RNA, 13 nt, Chlamydia trachomatis
cugcuucuuuuuc

SEQ ID NO: 2493131 - RNA, 22 nt, Chlamydia trachomatis
cugcuugcgaauaacuaauaua

SEQ ID NO: 2493132 - RNA, 12 nt, Chlamydia trachomatis
cugcuuggaaua

SEQ ID NO: 2493133 - RNA, 13 nt, Chlamydia trachomatis
cugcuuggaauaa

SEQ ID NO: 2493134 - RNA, 22 nt, Chlamydia trachomatis
cugcuuuauccaaagauagaua

SEQ ID NO: 2493135 - RNA, 23 nt, Chlamydia trachomatis
cugcuuucuuuguuccuacuaaa

SEQ ID NO: 2493136 - RNA, 20 nt, Chlamydia trachomatis
cuggaaaaggcugugaauaa

SEQ ID NO: 2493137 - RNA, 15 nt, Chlamydia trachomatis
cuggaacauacuucu

SEQ ID NO: 2493138 - RNA, 22 nt, Chlamydia trachomatis
cuggaaccggaggauaaaucag

SEQ ID NO: 2493139 - RNA, 16 nt, Chlamydia trachomatis
cuggaagguggcugcg

SEQ ID NO: 2493140 - RNA, 17 nt, Chlamydia trachomatis
cuggaauagcuagagca

SEQ ID NO: 2493141 - RNA, 21 nt, Chlamydia trachomatis
cuggaauaucugguugugaaa

SEQ ID NO: 2493142 - RNA, 11 nt, Chlamydia trachomatis
cuggaaucauu

SEQ ID NO: 2493143 - RNA, 20 nt, Chlamydia trachomatis
cuggaaugcgcaauccuuuu

SEQ ID NO: 2493144 - RNA, 20 nt, Chlamydia trachomatis
cuggacuauuuucaaaaccu

SEQ ID NO: 2493145 - RNA, 20 nt, Chlamydia trachomatis
cuggagcaacaaccaacucu

SEQ ID NO: 2493146 - RNA, 22 nt, Chlamydia trachomatis
cuggagguuuaggagagagccc

SEQ ID NO: 2493147 - RNA, 15 nt, Chlamydia trachomatis
cuggaguggcaucug

SEQ ID NO: 2493148 - RNA, 23 nt, Chlamydia trachomatis
cuggaguuagccguaucuccggu

SEQ ID NO: 2493149 - RNA, 12 nt, Chlamydia trachomatis
cuggaguuuaug

SEQ ID NO: 2493150 - RNA, 19 nt, Chlamydia trachomatis
cuggauccaaaaaagaauc

SEQ ID NO: 2493151 - RNA, 22 nt, Chlamydia trachomatis
cuggcaauaaucuuuuuauuga

SEQ ID NO: 2493152 - RNA, 11 nt, Chlamydia trachomatis
cuggcaccuuu

SEQ ID NO: 2493153 - RNA, 15 nt, Chlamydia trachomatis
cuggccaccuugcca

SEQ ID NO: 2493154 - RNA, 15 nt, Chlamydia trachomatis
cuggcgauaguucua

SEQ ID NO: 2493155 - RNA, 16 nt, Chlamydia trachomatis
cuggcgauaguucuaa

SEQ ID NO: 2493156 - RNA, 13 nt, Chlamydia trachomatis
cugggaaaacuuu

SEQ ID NO: 2493157 - RNA, 17 nt, Chlamydia trachomatis
cugggaggagaacucuu

SEQ ID NO: 2493158 - RNA, 19 nt, Chlamydia trachomatis
cugggauuucgauuaauga

SEQ ID NO: 2493159 - RNA, 22 nt, Chlamydia trachomatis
cugggcauacaccugcaagaga

SEQ ID NO: 2493160 - RNA, 23 nt, Chlamydia trachomatis
cugggguagcugaugaagcgaca

SEQ ID NO: 2493161 - RNA, 16 nt, Chlamydia trachomatis
cugggucuuuuuuaug

SEQ ID NO: 2493162 - RNA, 19 nt, Chlamydia trachomatis
cuggguuuuaucaagagaa

SEQ ID NO: 2493163 - RNA, 22 nt, Chlamydia trachomatis
cugguaaaaauagaaaacgucg

SEQ ID NO: 2493164 - RNA, 22 nt, Chlamydia trachomatis
cugguaaaggaaguugagaagc

SEQ ID NO: 2493165 - RNA, 21 nt, Chlamydia trachomatis
cugguagaaagcuacagucug

SEQ ID NO: 2493166 - RNA, 15 nt, Chlamydia trachomatis
cugguauucuaaaua

SEQ ID NO: 2493167 - RNA, 15 nt, Chlamydia trachomatis
cugguccaaggaaua

SEQ ID NO: 2493168 - RNA, 19 nt, Chlamydia trachomatis
cugguccaaggaauaaaca

SEQ ID NO: 2493169 - RNA, 16 nt, Chlamydia trachomatis
cugguccauggaacga

SEQ ID NO: 2493170 - RNA, 21 nt, Chlamydia trachomatis
cugguugguuuucuuguucuu

SEQ ID NO: 2493171 - RNA, 21 nt, Chlamydia trachomatis
cugguuguucccgauuacuug

SEQ ID NO: 2493172 - RNA, 17 nt, Chlamydia trachomatis
cugguuucuuaaacaaa

SEQ ID NO: 2493173 - RNA, 15 nt, Chlamydia trachomatis
cuguaaaacauuucu

SEQ ID NO: 2493174 - RNA, 16 nt, Chlamydia trachomatis
cuguaaaaggcgcaga

SEQ ID NO: 2493175 - RNA, 23 nt, Chlamydia trachomatis
cuguaacgaaguuagcauguuca

SEQ ID NO: 2493176 - RNA, 16 nt, Chlamydia trachomatis
cuguaacgaggccucc

SEQ ID NO: 2493177 - RNA, 17 nt, Chlamydia trachomatis
cuguaacgaggccucca

SEQ ID NO: 2493178 - RNA, 19 nt, Chlamydia trachomatis
cuguaacgaggccuccagc

SEQ ID NO: 2493179 - RNA, 18 nt, Chlamydia trachomatis
cuguaacuacaucuaaaa

SEQ ID NO: 2493180 - RNA, 18 nt, Chlamydia trachomatis
cuguaauguccucuuuau

SEQ ID NO: 2493181 - RNA, 19 nt, Chlamydia trachomatis
cuguaauguccucuuuauc

SEQ ID NO: 2493182 - RNA, 14 nt, Chlamydia trachomatis
cuguaauuuuaaau

SEQ ID NO: 2493183 - RNA, 15 nt, Chlamydia trachomatis
cuguacagacugccu

SEQ ID NO: 2493184 - RNA, 19 nt, Chlamydia trachomatis
cuguacgucugcaagaaaa

SEQ ID NO: 2493185 - RNA, 15 nt, Chlamydia trachomatis
cuguagagagcccca

SEQ ID NO: 2493186 - RNA, 19 nt, Chlamydia trachomatis
cuguagaugcuuuguaaaa

SEQ ID NO: 2493187 - RNA, 15 nt, Chlamydia trachomatis
cuguagauucagcaa

SEQ ID NO: 2493188 - RNA, 21 nt, Chlamydia trachomatis
cuguagauucagcaagauucu

SEQ ID NO: 2493189 - RNA, 16 nt, Chlamydia trachomatis
cuguagauucuggagg

SEQ ID NO: 2493190 - RNA, 23 nt, Chlamydia trachomatis
cuguagcaccaaguucuucuuua

SEQ ID NO: 2493191 - RNA, 18 nt, Chlamydia trachomatis
cuguaggagagaaucuuu

SEQ ID NO: 2493192 - RNA, 20 nt, Chlamydia trachomatis
cuguaggagagaaucuuuua

SEQ ID NO: 2493193 - RNA, 22 nt, Chlamydia trachomatis
cuguaguugccccuuauuuacc

SEQ ID NO: 2493194 - RNA, 23 nt, Chlamydia trachomatis
cuguaguugccccuuauuuaccu

SEQ ID NO: 2493195 - RNA, 18 nt, Chlamydia trachomatis
cuguauaacaauuuuaaa

SEQ ID NO: 2493196 - RNA, 14 nt, Chlamydia trachomatis
cuguauaagaaaaa

SEQ ID NO: 2493197 - RNA, 22 nt, Chlamydia trachomatis
uccuauaauugcuaaggaaaga

SEQ ID NO: 2493198 - RNA, 21 nt, Chlamydia trachomatis
uccuauagguagagacgagaa

SEQ ID NO: 2493199 - RNA, 18 nt, Chlamydia trachomatis
uccuaucaccacuaaucc

SEQ ID NO: 2493200 - RNA, 13 nt, Chlamydia trachomatis
uccuaugacaggc

SEQ ID NO: 2493201 - RNA, 17 nt, Chlamydia trachomatis
uccucaaaagaacuucc

SEQ ID NO: 2493202 - RNA, 19 nt, Chlamydia trachomatis
uccucaagcgauuaugaaa

SEQ ID NO: 2493203 - RNA, 20 nt, Chlamydia trachomatis
uccucagcauagcgcuuccc

SEQ ID NO: 2493204 - RNA, 16 nt, Chlamydia trachomatis
uccucaguauaaaaaa

SEQ ID NO: 2493205 - RNA, 21 nt, Chlamydia trachomatis
uccucaguauaaaaaaagucu

SEQ ID NO: 2493206 - RNA, 16 nt, Chlamydia trachomatis
uccucauaaaggaaag

SEQ ID NO: 2493207 - RNA, 15 nt, Chlamydia trachomatis
uccucccaaaauacc

SEQ ID NO: 2493208 - RNA, 16 nt, Chlamydia trachomatis
uccucccaaaauaccu

SEQ ID NO: 2493209 - RNA, 16 nt, Chlamydia trachomatis
uccuccucccuuucca

SEQ ID NO: 2493210 - RNA, 20 nt, Chlamydia trachomatis
uccucguuuuuuuagauaag

SEQ ID NO: 2493211 - RNA, 21 nt, Chlamydia trachomatis
uccucguuuuuuuagauaaga

SEQ ID NO: 2493212 - RNA, 23 nt, Chlamydia trachomatis
uccucuacgcuuccuacagcuag

SEQ ID NO: 2493213 - RNA, 15 nt, Chlamydia trachomatis
uccucuccuucuaca

SEQ ID NO: 2493214 - RNA, 12 nt, Chlamydia trachomatis
uccucucuucuu

SEQ ID NO: 2493215 - RNA, 18 nt, Chlamydia trachomatis
uccucuggcuuaucaaca

SEQ ID NO: 2493216 - RNA, 22 nt, Chlamydia trachomatis
uccucuggcuuaucaacaagau

SEQ ID NO: 2493217 - RNA, 17 nt, Chlamydia trachomatis
uccucuucacagagcuu

SEQ ID NO: 2493218 - RNA, 13 nt, Chlamydia trachomatis
uccucuuccgaag

SEQ ID NO: 2493219 - RNA, 12 nt, Chlamydia trachomatis
uccucuucuucu

SEQ ID NO: 2493220 - RNA, 14 nt, Chlamydia trachomatis
uccucuucuucugu

SEQ ID NO: 2493221 - RNA, 19 nt, Chlamydia trachomatis
uccucuugaaccaguuucu

SEQ ID NO: 2493222 - RNA, 14 nt, Chlamydia trachomatis
uccucuugagcauu

SEQ ID NO: 2493223 - RNA, 17 nt, Chlamydia trachomatis
uccugaaacgaucagcu

SEQ ID NO: 2493224 - RNA, 12 nt, Chlamydia trachomatis
uccugaagcaau

SEQ ID NO: 2493225 - RNA, 15 nt, Chlamydia trachomatis
uccugaagcaaugcu

SEQ ID NO: 2493226 - RNA, 16 nt, Chlamydia trachomatis
uccugaagcaaugcua

SEQ ID NO: 2493227 - RNA, 17 nt, Chlamydia trachomatis
uccugcagacaagccuu

SEQ ID NO: 2493228 - RNA, 15 nt, Chlamydia trachomatis
uccugcagcaaauaa

SEQ ID NO: 2493229 - RNA, 19 nt, Chlamydia trachomatis
uccugcagcuaaagaaucu

SEQ ID NO: 2493230 - RNA, 19 nt, Chlamydia trachomatis
uccugcauacuuuucaauu

SEQ ID NO: 2493231 - RNA, 13 nt, Chlamydia trachomatis
uccugccaaaaac

SEQ ID NO: 2493232 - RNA, 14 nt, Chlamydia trachomatis
uccugcugaucaga

SEQ ID NO: 2493233 - RNA, 18 nt, Chlamydia trachomatis
uccugcugaucagaggga

SEQ ID NO: 2493234 - RNA, 13 nt, Chlamydia trachomatis
uccugcugguggc

SEQ ID NO: 2493235 - RNA, 17 nt, Chlamydia trachomatis
uccugcuucuuuuuccc

SEQ ID NO: 2493236 - RNA, 23 nt, Chlamydia trachomatis
uccuguaagaggaucuccagaaa

SEQ ID NO: 2493237 - RNA, 19 nt, Chlamydia trachomatis
uccuguagggaagauagga

SEQ ID NO: 2493238 - RNA, 16 nt, Chlamydia trachomatis
uccuguauaagaaaaa

SEQ ID NO: 2493239 - RNA, 18 nt, Chlamydia trachomatis
uccuguauaagaaaaagg

SEQ ID NO: 2493240 - RNA, 23 nt, Chlamydia trachomatis
uccuguuuguuuguuuuuuucaa

SEQ ID NO: 2493241 - RNA, 23 nt, Chlamydia trachomatis
uccuuaaacucucgggccaaaaa

SEQ ID NO: 2493242 - RNA, 13 nt, Chlamydia trachomatis
uccuuaaaguuug

SEQ ID NO: 2493243 - RNA, 13 nt, Chlamydia trachomatis
uccuuacauaaaa

SEQ ID NO: 2493244 - RNA, 16 nt, Chlamydia trachomatis
uccuuacauaaaaaag

SEQ ID NO: 2493245 - RNA, 14 nt, Chlamydia trachomatis
uccuuagcuaaaag

SEQ ID NO: 2493246 - RNA, 18 nt, Chlamydia trachomatis
uccuuaucuucuugagaa

SEQ ID NO: 2493247 - RNA, 13 nt, Chlamydia trachomatis
uccuuccucuuua

SEQ ID NO: 2493248 - RNA, 23 nt, Chlamydia trachomatis
uccuucgccgggggagccaaaaa

SEQ ID NO: 2493249 - RNA, 14 nt, Chlamydia trachomatis
uccuucuacaaaaa

SEQ ID NO: 2493250 - RNA, 18 nt, Chlamydia trachomatis
uccuucuacaaaaaauga

SEQ ID NO: 2493251 - RNA, 17 nt, Chlamydia trachomatis
uccuucuugugagagaa

SEQ ID NO: 2493252 - RNA, 22 nt, Chlamydia trachomatis
uccuucuuucuggaaucauuca

SEQ ID NO: 2493253 - RNA, 23 nt, Chlamydia trachomatis
uccuuggcuuuuacaauagcauu

SEQ ID NO: 2493254 - RNA, 21 nt, Chlamydia trachomatis
uccuuuaaaagcugcuuuauc

SEQ ID NO: 2493255 - RNA, 20 nt, Chlamydia trachomatis
uccuuugcuuuuuauccuac

SEQ ID NO: 2493256 - RNA, 15 nt, Chlamydia trachomatis
uccuuuugauucugc

SEQ ID NO: 2493257 - RNA, 21 nt, Chlamydia trachomatis
uccuuuugauucugcuccaaa

SEQ ID NO: 2493258 - RNA, 20 nt, Chlamydia trachomatis
uccuuuuggaagaucucuuu

SEQ ID NO: 2493259 - RNA, 12 nt, Chlamydia trachomatis
uccuuuuuccuu

SEQ ID NO: 2493260 - RNA, 13 nt, Chlamydia trachomatis
uccuuuuugccuc

SEQ ID NO: 2493261 - RNA, 20 nt, Chlamydia trachomatis
ucgaaagacuaucuguuuug

SEQ ID NO: 2493262 - RNA, 17 nt, Chlamydia trachomatis
ucgaaccuuuaccaaag

SEQ ID NO: 2493263 - RNA, 21 nt, Chlamydia trachomatis
ucgaacucagcuuccuuggcu

SEQ ID NO: 2493264 - RNA, 17 nt, Chlamydia trachomatis
ucgaagaaauccccagu

SEQ ID NO: 2493265 - RNA, 12 nt, Chlamydia trachomatis
ucgaagcauagg

SEQ ID NO: 2493266 - RNA, 19 nt, Chlamydia trachomatis
ucgaaggagcuaagaacca

SEQ ID NO: 2493267 - RNA, 21 nt, Chlamydia trachomatis
ucgaaguucccuuuuguucca

SEQ ID NO: 2493268 - RNA, 13 nt, Chlamydia trachomatis
ucgaauaaaaauu

SEQ ID NO: 2493269 - RNA, 22 nt, Chlamydia trachomatis
ucgaauuaauaauuccaccuaa

SEQ ID NO: 2493270 - RNA, 17 nt, Chlamydia trachomatis
ucgaauuacucugccua

SEQ ID NO: 2493271 - RNA, 20 nt, Chlamydia trachomatis
ucgaauuuuuuucuuugcuu

SEQ ID NO: 2493272 - RNA, 21 nt, Chlamydia trachomatis
ucgacagaaaaagaaaaggcu

SEQ ID NO: 2493273 - RNA, 22 nt, Chlamydia trachomatis
ucgagaaaaugaugaaaaagaa

SEQ ID NO: 2493274 - RNA, 12 nt, Chlamydia trachomatis
ucgagaaaugaa

SEQ ID NO: 2493275 - RNA, 14 nt, Chlamydia trachomatis
ucgagaagaaaaac

SEQ ID NO: 2493276 - RNA, 17 nt, Chlamydia trachomatis
ucgagaagaucuuuccu

SEQ ID NO: 2493277 - RNA, 18 nt, Chlamydia trachomatis
ucgagaagaucuuuccuu

SEQ ID NO: 2493278 - RNA, 15 nt, Chlamydia trachomatis
ucgagcuaagaaaau

SEQ ID NO: 2493279 - RNA, 17 nt, Chlamydia trachomatis
ucgagcuaagaaaauaa

SEQ ID NO: 2493280 - RNA, 11 nt, Chlamydia trachomatis
ucgaggcuucu

SEQ ID NO: 2493281 - RNA, 16 nt, Chlamydia trachomatis
ucgaggcuucuucuuc

SEQ ID NO: 2493282 - RNA, 17 nt, Chlamydia trachomatis
ucgaggugauuuucuuu

SEQ ID NO: 2493283 - RNA, 17 nt, Chlamydia trachomatis
ucgagucaagaagccuu

SEQ ID NO: 2493284 - RNA, 19 nt, Chlamydia trachomatis
ucgagugaucuacagcugu

SEQ ID NO: 2493285 - RNA, 15 nt, Chlamydia trachomatis
ucgaguuuugaggaa

SEQ ID NO: 2493286 - RNA, 15 nt, Chlamydia trachomatis
ucgauaguaccauaa

SEQ ID NO: 2493287 - RNA, 18 nt, Chlamydia trachomatis
ucgauaucguuagcauca

SEQ ID NO: 2493288 - RNA, 16 nt, Chlamydia trachomatis
ucgauccaaagccucu

SEQ ID NO: 2493289 - RNA, 17 nt, Chlamydia trachomatis
ucgauccgguucuuuug

SEQ ID NO: 2493290 - RNA, 15 nt, Chlamydia trachomatis
ucgaucuuaccaaaa

SEQ ID NO: 2493291 - RNA, 14 nt, Chlamydia trachomatis
ucgauuugaugaga

SEQ ID NO: 2493292 - RNA, 15 nt, Chlamydia trachomatis
ucgauuuuuaaaaga

SEQ ID NO: 2493293 - RNA, 21 nt, Chlamydia trachomatis
ucgcaaaagauuuccccaaga

SEQ ID NO: 2493294 - RNA, 18 nt, Chlamydia trachomatis
ucgcaaacugcucuucua

SEQ ID NO: 2493295 - RNA, 21 nt, Chlamydia trachomatis
ucgcaaacugcucuucuaacu

SEQ ID NO: 2493296 - RNA, 12 nt, Chlamydia trachomatis
ucgcaagccacc

SEQ ID NO: 2493297 - RNA, 15 nt, Chlamydia trachomatis
ucgcaagccaccagc

SEQ ID NO: 2493298 - RNA, 23 nt, Chlamydia trachomatis
ucgcaagguugacuuucccugca

SEQ ID NO: 2493299 - RNA, 22 nt, Chlamydia trachomatis
ucgcaaguucuccuucuuguga

SEQ ID NO: 2493300 - RNA, 13 nt, Chlamydia trachomatis
ucgcagagaaaga

SEQ ID NO: 2493301 - RNA, 21 nt, Chlamydia trachomatis
ucgcagcaccuguuuaucuuc

SEQ ID NO: 2493302 - RNA, 19 nt, Chlamydia trachomatis
ucgcagcuuucuuuuccau

SEQ ID NO: 2493303 - RNA, 16 nt, Chlamydia trachomatis
ucgcaucauccuugcc

SEQ ID NO: 2493304 - RNA, 16 nt, Chlamydia trachomatis
ucgcauuaaauaauac

SEQ ID NO: 2493305 - RNA, 15 nt, Chlamydia trachomatis
ucgcauuccaagaag

SEQ ID NO: 2493306 - RNA, 17 nt, Chlamydia trachomatis
ucgcauuccaagaagaa

SEQ ID NO: 2493307 - RNA, 15 nt, Chlamydia trachomatis
ucgcauuugagauga

SEQ ID NO: 2493308 - RNA, 15 nt, Chlamydia trachomatis
ucgccaaaaaucauu

SEQ ID NO: 2493309 - RNA, 16 nt, Chlamydia trachomatis
ucgcccuuauugguau

SEQ ID NO: 2493310 - RNA, 14 nt, Chlamydia trachomatis
ucgcgcagcuucug

SEQ ID NO: 2493311 - RNA, 19 nt, Chlamydia trachomatis
ucgcgcuccagcucuucca

SEQ ID NO: 2493312 - RNA, 15 nt, Chlamydia trachomatis
ucgcggaagaaagca

SEQ ID NO: 2493313 - RNA, 14 nt, Chlamydia trachomatis
ucgcuaaauugaaa

SEQ ID NO: 2493314 - RNA, 20 nt, Chlamydia trachomatis
ucgcuacauguaguaaucug

SEQ ID NO: 2493315 - RNA, 15 nt, Chlamydia trachomatis
ucgcuaucaauaaaa

SEQ ID NO: 2493316 - RNA, 13 nt, Chlamydia trachomatis
ucgcuaucuucaa

SEQ ID NO: 2493317 - RNA, 14 nt, Chlamydia trachomatis
ucgcuaucuucaau

SEQ ID NO: 2493318 - RNA, 18 nt, Chlamydia trachomatis
ucgcugacggauccugcu

SEQ ID NO: 2493319 - RNA, 17 nt, Chlamydia trachomatis
ucgcuucaaaacuaaaa

SEQ ID NO: 2493320 - RNA, 20 nt, Chlamydia trachomatis
ucgcuucaaaacuaaaaguu

SEQ ID NO: 2493321 - RNA, 13 nt, Chlamydia trachomatis
ucgcuucugcuga

SEQ ID NO: 2493322 - RNA, 13 nt, Chlamydia trachomatis
ucggaaaagauau

SEQ ID NO: 2493323 - RNA, 23 nt, Chlamydia trachomatis
ucggaaggagacaaguucaucaa

SEQ ID NO: 2493324 - RNA, 14 nt, Chlamydia trachomatis
ucggaauaagagga

SEQ ID NO: 2493325 - RNA, 16 nt, Chlamydia trachomatis
ucggaauagcaacucu

SEQ ID NO: 2493326 - RNA, 17 nt, Chlamydia trachomatis
ucggacaguucuuuauc

SEQ ID NO: 2493327 - RNA, 14 nt, Chlamydia trachomatis
ucggagaagaagag

SEQ ID NO: 2493328 - RNA, 23 nt, Chlamydia trachomatis
ucggauaaucaaaucgaaacugu

SEQ ID NO: 2493329 - RNA, 19 nt, Chlamydia trachomatis
ucggauaggcugaggauuc

SEQ ID NO: 2493330 - RNA, 17 nt, Chlamydia trachomatis
ucggauccagaagcaca

SEQ ID NO: 2493331 - RNA, 14 nt, Chlamydia trachomatis
ucggaucgagaaga

SEQ ID NO: 2493332 - RNA, 19 nt, Chlamydia trachomatis
ucggaugaccgaaucucaa

SEQ ID NO: 2493333 - RNA, 14 nt, Chlamydia trachomatis
ucggcaaaagaucu

SEQ ID NO: 2493334 - RNA, 17 nt, Chlamydia trachomatis
ucggcaagacucuuuca

SEQ ID NO: 2493335 - RNA, 18 nt, Chlamydia trachomatis
ucggcccuugagauccuu

SEQ ID NO: 2493336 - RNA, 23 nt, Chlamydia trachomatis
ucggcuuuaggagauuguuguau

SEQ ID NO: 2493337 - RNA, 19 nt, Chlamydia trachomatis
ucgguaaguccgcagagau

SEQ ID NO: 2493338 - RNA, 12 nt, Chlamydia trachomatis
ucggucuuagaa

SEQ ID NO: 2493339 - RNA, 20 nt, Chlamydia trachomatis
ucggugaaagcuagaagaau

SEQ ID NO: 2493340 - RNA, 18 nt, Chlamydia trachomatis
ucgguuguauaaacccac

SEQ ID NO: 2493341 - RNA, 13 nt, Chlamydia trachomatis
ucguaaaaaagau

SEQ ID NO: 2493342 - RNA, 18 nt, Chlamydia trachomatis
ucguaaaaacugucgaag

SEQ ID NO: 2493343 - RNA, 21 nt, Chlamydia trachomatis
ucguaaacaaccaaaugaccu

SEQ ID NO: 2493344 - RNA, 20 nt, Chlamydia trachomatis
ucguaaacgauuaacucugc

SEQ ID NO: 2493345 - RNA, 20 nt, Chlamydia trachomatis
ucguaaccagcggcaaaaau

SEQ ID NO: 2493346 - RNA, 15 nt, Chlamydia trachomatis
ucguaaugaaggaaa

SEQ ID NO: 2493347 - RNA, 14 nt, Chlamydia trachomatis
ucguaaugauguau

SEQ ID NO: 2493348 - RNA, 14 nt, Chlamydia trachomatis
ucguacagaucuug

SEQ ID NO: 2493349 - RNA, 17 nt, Chlamydia trachomatis
ucguagacagagaauag

SEQ ID NO: 2493350 - RNA, 14 nt, Chlamydia trachomatis
ucguagacuucuug

SEQ ID NO: 2493351 - RNA, 14 nt, Chlamydia trachomatis
ucguagagaucuuc

SEQ ID NO: 2493352 - RNA, 14 nt, Chlamydia trachomatis
ucguauaaguuuua

SEQ ID NO: 2493353 - RNA, 20 nt, Chlamydia trachomatis
ucguauaaguuuuaagaaga

SEQ ID NO: 2493354 - RNA, 13 nt, Chlamydia trachomatis
ucguaucccugca

SEQ ID NO: 2493355 - RNA, 14 nt, Chlamydia trachomatis
ucgucaaagaagua

SEQ ID NO: 2493356 - RNA, 15 nt, Chlamydia trachomatis
ucgucaaagaaguaa

SEQ ID NO: 2493357 - RNA, 13 nt, Chlamydia trachomatis
ucguccuccgcca

SEQ ID NO: 2493358 - RNA, 17 nt, Chlamydia trachomatis
ucgucguacuccucguc

SEQ ID NO: 2493359 - RNA, 18 nt, Chlamydia trachomatis
ucgucugcgaaaaagaaa

SEQ ID NO: 2493360 - RNA, 15 nt, Chlamydia trachomatis
ucgucuguucuccuu

SEQ ID NO: 2493361 - RNA, 18 nt, Chlamydia trachomatis
ucgucuuuagaagaaaag

SEQ ID NO: 2493362 - RNA, 15 nt, Chlamydia trachomatis
ucgugaauguuaaca

SEQ ID NO: 2493363 - RNA, 17 nt, Chlamydia trachomatis
ucgugaauguuaacauc

SEQ ID NO: 2493364 - RNA, 18 nt, Chlamydia trachomatis
ucgugagcgucuuuucac

SEQ ID NO: 2493365 - RNA, 16 nt, Chlamydia trachomatis
ucgugaggcaugaaca

SEQ ID NO: 2493366 - RNA, 21 nt, Chlamydia trachomatis
ucgugcagggagaaggggaag

SEQ ID NO: 2493367 - RNA, 14 nt, Chlamydia trachomatis
ucguggaggggaau

SEQ ID NO: 2493368 - RNA, 14 nt, Chlamydia trachomatis
ucgugucuuuaugc

SEQ ID NO: 2493369 - RNA, 23 nt, Chlamydia trachomatis
ucguguguguguguaaccuuccc

SEQ ID NO: 2493370 - RNA, 13 nt, Chlamydia trachomatis
ucguuaggauucg

SEQ ID NO: 2493371 - RNA, 12 nt, Chlamydia trachomatis
ucguucaauuaa

SEQ ID NO: 2493372 - RNA, 22 nt, Chlamydia trachomatis
ucguucuacaggaguaaauccu

SEQ ID NO: 2493373 - RNA, 21 nt, Chlamydia trachomatis
ucguucuuuaagaaaaaugcc

SEQ ID NO: 2493374 - RNA, 24 nt, Chlamydia trachomatis
ucguugauuaaaguuucuaauaau

SEQ ID NO: 2493375 - RNA, 18 nt, Chlamydia trachomatis
ucguuuaugaagccacaa

SEQ ID NO: 2493376 - RNA, 14 nt, Chlamydia trachomatis
ucguuuuuuuagau

SEQ ID NO: 2493377 - RNA, 12 nt, Chlamydia trachomatis
ucuaaaaaacuu

SEQ ID NO: 2493378 - RNA, 22 nt, Chlamydia trachomatis
ucuaaaaguuuucuugguuucu

SEQ ID NO: 2493379 - RNA, 16 nt, Chlamydia trachomatis
ucuaaacccucugcau

SEQ ID NO: 2493380 - RNA, 20 nt, Chlamydia trachomatis
ucuaaacccucugcauagcu

SEQ ID NO: 2493381 - RNA, 12 nt, Chlamydia trachomatis
ucuaaagaaaag

SEQ ID NO: 2493382 - RNA, 12 nt, Chlamydia trachomatis
ucuaaagaaaug

SEQ ID NO: 2493383 - RNA, 12 nt, Chlamydia trachomatis
ucuaaagaauag

SEQ ID NO: 2493384 - RNA, 18 nt, Chlamydia trachomatis
ucuaaagagccaaaauau

SEQ ID NO: 2493385 - RNA, 14 nt, Chlamydia trachomatis
ucuaaagauccucu

SEQ ID NO: 2493386 - RNA, 15 nt, Chlamydia trachomatis
ucuaaagauccucuu

SEQ ID NO: 2493387 - RNA, 17 nt, Chlamydia trachomatis
ucuaaagauccucuuuc

SEQ ID NO: 2493388 - RNA, 16 nt, Chlamydia trachomatis
ucuaaagaucggcuua

SEQ ID NO: 2493389 - RNA, 18 nt, Chlamydia trachomatis
ucuaaagcagcuaaccau

SEQ ID NO: 2493390 - RNA, 21 nt, Chlamydia trachomatis
ucuaaagccauaagacuuugu

SEQ ID NO: 2493391 - RNA, 22 nt, Chlamydia trachomatis
ucuaaagcuuuuguuaaccaag

SEQ ID NO: 2493392 - RNA, 24 nt, Chlamydia trachomatis
ucuaaaggauaaggaagaagauag

SEQ ID NO: 2493393 - RNA, 12 nt, Chlamydia trachomatis
ucuaaagucuga

SEQ ID NO: 2493394 - RNA, 19 nt, Chlamydia trachomatis
ucuaaagucuuaaaagggu

SEQ ID NO: 2493395 - RNA, 18 nt, Chlamydia trachomatis
ucuaaaugcuguaaaaca

SEQ ID NO: 2493396 - RNA, 21 nt, Chlamydia trachomatis
ucuaacgcuuccucuccuucu

SEQ ID NO: 2493397 - RNA, 15 nt, Chlamydia trachomatis
ucuaagaacaacgcu

SEQ ID NO: 2493398 - RNA, 21 nt, Chlamydia trachomatis
ucuaagauuuucaucuuccaa

SEQ ID NO: 2493399 - RNA, 19 nt, Chlamydia trachomatis
ucuaaggaauguggagcua

SEQ ID NO: 2493400 - RNA, 20 nt, Chlamydia trachomatis
ucuaagugcaucauuuugua

SEQ ID NO: 2493401 - RNA, 23 nt, Chlamydia trachomatis
ucuaauaaacagaucuuuuucau

SEQ ID NO: 2493402 - RNA, 20 nt, Chlamydia trachomatis
ucuaauaggguuaggaaagc

SEQ ID NO: 2493403 - RNA, 19 nt, Chlamydia trachomatis
ucuaauaguugcaaaaaga

SEQ ID NO: 2493404 - RNA, 20 nt, Chlamydia trachomatis
ucuaauauuaguugcaguga

SEQ ID NO: 2493405 - RNA, 13 nt, Chlamydia trachomatis
ucuaauuaauaac

SEQ ID NO: 2493406 - RNA, 14 nt, Chlamydia trachomatis
ucuaauuccuucaa

SEQ ID NO: 2493407 - RNA, 19 nt, Chlamydia trachomatis
ucuaauugaaacaguagaa

SEQ ID NO: 2493408 - RNA, 13 nt, Chlamydia trachomatis
ucuaauuguuccc

SEQ ID NO: 2493409 - RNA, 19 nt, Chlamydia trachomatis
ucuaauuucuuucucaugc

SEQ ID NO: 2493410 - RNA, 17 nt, Chlamydia trachomatis
ucuacaaaaccaaaauc

SEQ ID NO: 2493411 - RNA, 21 nt, Chlamydia trachomatis
ucuacaaauaguguaaggaga

SEQ ID NO: 2493412 - RNA, 19 nt, Chlamydia trachomatis
ucuacagcuguauuuacag

SEQ ID NO: 2493413 - RNA, 19 nt, Chlamydia trachomatis
ucuacagugaaaccgcaag

SEQ ID NO: 2493414 - RNA, 13 nt, Chlamydia trachomatis
ucuacauaaugau

SEQ ID NO: 2493415 - RNA, 13 nt, Chlamydia trachomatis
ucuacauccaaaa

SEQ ID NO: 2493416 - RNA, 21 nt, Chlamydia trachomatis
ucuacaugguaccuucucaaa

SEQ ID NO: 2493417 - RNA, 19 nt, Chlamydia trachomatis
ucuaccguauuaucugcaa

SEQ ID NO: 2493418 - RNA, 21 nt, Chlamydia trachomatis
ucuacgaaaaagucaagacag

SEQ ID NO: 2493419 - RNA, 13 nt, Chlamydia trachomatis
ucuacgaucugcc

SEQ ID NO: 2493420 - RNA, 20 nt, Chlamydia trachomatis
ucuagaagaccaaaaaugaa

SEQ ID NO: 2493421 - RNA, 23 nt, Chlamydia trachomatis
ucuagacaaacaccuauggguau

SEQ ID NO: 2493422 - RNA, 13 nt, Chlamydia trachomatis
ucuagagguuuaa

SEQ ID NO: 2493423 - RNA, 14 nt, Chlamydia trachomatis
ucuagauagaagag

SEQ ID NO: 2493424 - RNA, 21 nt, Chlamydia trachomatis
ucuagauggauaaucucugaa

SEQ ID NO: 2493425 - RNA, 22 nt, Chlamydia trachomatis
ucuagccaauccguaugauaaa

SEQ ID NO: 2493426 - RNA, 15 nt, Chlamydia trachomatis
ucuagcgcacuauua

SEQ ID NO: 2493427 - RNA, 14 nt, Chlamydia trachomatis
ucuagcuagaagcc

SEQ ID NO: 2493428 - RNA, 15 nt, Chlamydia trachomatis
ucuagcugauaagga

SEQ ID NO: 2493429 - RNA, 19 nt, Chlamydia trachomatis
ucuagcugauaaggaggcu

SEQ ID NO: 2493430 - RNA, 22 nt, Chlamydia trachomatis
ucuaggaagaagaagaacugca

SEQ ID NO: 2493431 - RNA, 17 nt, Chlamydia trachomatis
ucuaggcugacuuucac

SEQ ID NO: 2493432 - RNA, 18 nt, Chlamydia trachomatis
ucuaggcugacuuucaca

SEQ ID NO: 2493433 - RNA, 21 nt, Chlamydia trachomatis
ucuagggaaaaaaagagguau

SEQ ID NO: 2493434 - RNA, 19 nt, Chlamydia trachomatis
ucuagguauuuagguagca

SEQ ID NO: 2493435 - RNA, 13 nt, Chlamydia trachomatis
ucuauaauaugaa

SEQ ID NO: 2493436 - RNA, 21 nt, Chlamydia trachomatis
ucuauagaaacacgcaacccu

SEQ ID NO: 2493437 - RNA, 19 nt, Chlamydia trachomatis
ucuauaguaauagcuagau

SEQ ID NO: 2493438 - RNA, 14 nt, Chlamydia trachomatis
ucuaucaacaucug

SEQ ID NO: 2493439 - RNA, 18 nt, Chlamydia trachomatis
ucuaucaacuuuacauaa

SEQ ID NO: 2493440 - RNA, 12 nt, Chlamydia trachomatis
ucuauccauaca

SEQ ID NO: 2493441 - RNA, 15 nt, Chlamydia trachomatis
ucuaucgcuugaaaa

SEQ ID NO: 2493442 - RNA, 12 nt, Chlamydia trachomatis
ucuaugaaaaaa

SEQ ID NO: 2493443 - RNA, 14 nt, Chlamydia trachomatis
ucuauggcaaaagg

SEQ ID NO: 2493444 - RNA, 15 nt, Chlamydia trachomatis
ucuauggcaaaaggu

SEQ ID NO: 2493445 - RNA, 19 nt, Chlamydia trachomatis
ucuauguaaaaauucuaaa

SEQ ID NO: 2493446 - RNA, 23 nt, Chlamydia trachomatis
ucuauguaaaaauucuaaaguaa

SEQ ID NO: 2493447 - RNA, 19 nt, Chlamydia trachomatis
ucuauguucuuaauaaucu

SEQ ID NO: 2493448 - RNA, 20 nt, Chlamydia trachomatis
ucuauguucuuaauaaucug

SEQ ID NO: 2493449 - RNA, 14 nt, Chlamydia trachomatis
ucuauuaaagcuuu

SEQ ID NO: 2493450 - RNA, 14 nt, Chlamydia trachomatis
ucuauuaagaaucu

SEQ ID NO: 2493451 - RNA, 18 nt, Chlamydia trachomatis
ucuauucguguccucuau

SEQ ID NO: 2493452 - RNA, 14 nt, Chlamydia trachomatis
ucuauugagaagac

SEQ ID NO: 2493453 - RNA, 21 nt, Chlamydia trachomatis
ucucaaaacgcucuccaaaga

SEQ ID NO: 2493454 - RNA, 14 nt, Chlamydia trachomatis
ucucaccgaaaaau

SEQ ID NO: 2493455 - RNA, 15 nt, Chlamydia trachomatis
ucucagagcuuugca

SEQ ID NO: 2493456 - RNA, 18 nt, Chlamydia trachomatis
ucucagcagcuuccugag

SEQ ID NO: 2493457 - RNA, 15 nt, Chlamydia trachomatis
ucucaggauaaaacc

SEQ ID NO: 2493458 - RNA, 21 nt, Chlamydia trachomatis
ucucauaagaucuuuacuuuc

SEQ ID NO: 2493459 - RNA, 15 nt, Chlamydia trachomatis
ucuccaaaauucugu

SEQ ID NO: 2493460 - RNA, 17 nt, Chlamydia trachomatis
ucuccaaagaauagaau

SEQ ID NO: 2493461 - RNA, 15 nt, Chlamydia trachomatis
ucuccaaucacagca

SEQ ID NO: 2493462 - RNA, 20 nt, Chlamydia trachomatis
ucuccaaucacagcaauagc

SEQ ID NO: 2493463 - RNA, 22 nt, Chlamydia trachomatis
ucuccagaguucauuuuuucuu

SEQ ID NO: 2493464 - RNA, 18 nt, Chlamydia trachomatis
ucuccagcaucuuuucuu

SEQ ID NO: 2493465 - RNA, 21 nt, Chlamydia trachomatis
ucuccaggagagucugcuaca

SEQ ID NO: 2493466 - RNA, 23 nt, Chlamydia trachomatis
ucucccaagaaacuuuucugcag

SEQ ID NO: 2493467 - RNA, 17 nt, Chlamydia trachomatis
ucucccuaagaucucuu

SEQ ID NO: 2493468 - RNA, 17 nt, Chlamydia trachomatis
ucuccgaugccgcagaa

SEQ ID NO: 2493469 - RNA, 13 nt, Chlamydia trachomatis
ucuccgcuuaaaa

SEQ ID NO: 2493470 - RNA, 14 nt, Chlamydia trachomatis
ucuccgguucucuu

SEQ ID NO: 2493471 - RNA, 15 nt, Chlamydia trachomatis
ucuccgugaagauua

SEQ ID NO: 2493472 - RNA, 23 nt, Chlamydia trachomatis
ucuccuaauucaacauaauaaau

SEQ ID NO: 2493473 - RNA, 21 nt, Chlamydia trachomatis
ucuccucgugaggcaugaaca

SEQ ID NO: 2493474 - RNA, 16 nt, Chlamydia trachomatis
ucuccuuccucuuuaa

SEQ ID NO: 2493475 - RNA, 19 nt, Chlamydia trachomatis
ucuccuugaacaauuugug

SEQ ID NO: 2493476 - RNA, 15 nt, Chlamydia trachomatis
ucucgaaagagaaca

SEQ ID NO: 2493477 - RNA, 17 nt, Chlamydia trachomatis
ucucgaacucagcuucc

SEQ ID NO: 2493478 - RNA, 14 nt, Chlamydia trachomatis
ucucgaaugcugua

SEQ ID NO: 2493479 - RNA, 18 nt, Chlamydia trachomatis
ucucgaauucuaucaaca

SEQ ID NO: 2493480 - RNA, 22 nt, Chlamydia trachomatis
ucucgaauucuaucaacaucug

SEQ ID NO: 2493481 - RNA, 16 nt, Chlamydia trachomatis
ucucgagaagaaaaac

SEQ ID NO: 2493482 - RNA, 21 nt, Chlamydia trachomatis
ucucgcagaugcuucugccuu

SEQ ID NO: 2493483 - RNA, 15 nt, Chlamydia trachomatis
ucucgccaaccauag

SEQ ID NO: 2493484 - RNA, 16 nt, Chlamydia trachomatis
ucucgcgcuaaaaccu

SEQ ID NO: 2493485 - RNA, 12 nt, Chlamydia trachomatis
ucucgcuacaaa

SEQ ID NO: 2493486 - RNA, 15 nt, Chlamydia trachomatis
ucucgcugcgagaga

SEQ ID NO: 2493487 - RNA, 15 nt, Chlamydia trachomatis
ucucgguaauaucca

SEQ ID NO: 2493488 - RNA, 19 nt, Chlamydia trachomatis
ucucguugauuaaaguuuc

SEQ ID NO: 2493489 - RNA, 15 nt, Chlamydia trachomatis
ucucuaaaaacucuu

SEQ ID NO: 2493490 - RNA, 21 nt, Chlamydia trachomatis
ucucuaaaaacucuuuuucua

SEQ ID NO: 2493491 - RNA, 14 nt, Chlamydia trachomatis
ucucuaaaaucaca

SEQ ID NO: 2493492 - RNA, 16 nt, Chlamydia trachomatis
ucucuaacaacaguuc

SEQ ID NO: 2493493 - RNA, 12 nt, Chlamydia trachomatis
ucucuaaguaag

SEQ ID NO: 2493494 - RNA, 18 nt, Chlamydia trachomatis
ucucuaccagggauaaau

SEQ ID NO: 2493495 - RNA, 15 nt, Chlamydia trachomatis
ucucuagaauuuccc

SEQ ID NO: 2493496 - RNA, 17 nt, Chlamydia trachomatis
ucucucagcagcuuccu

SEQ ID NO: 2493497 - RNA, 22 nt, Chlamydia trachomatis
ucucucauaccuaaacaaggau

SEQ ID NO: 2493498 - RNA, 20 nt, Chlamydia trachomatis
ucucucaugucuagcuagaa

SEQ ID NO: 2493499 - RNA, 12 nt, Chlamydia trachomatis
ucucuccccaua

SEQ ID NO: 2493500 - RNA, 20 nt, Chlamydia trachomatis
ucucuccccauaauaggagg

SEQ ID NO: 2493501 - RNA, 17 nt, Chlamydia trachomatis
ucucucgaauagcuccc

SEQ ID NO: 2493502 - RNA, 13 nt, Chlamydia trachomatis
ucucucuaaaauc

SEQ ID NO: 2493503 - RNA, 14 nt, Chlamydia trachomatis
ucucucucagcagc

SEQ ID NO: 2493504 - RNA, 19 nt, Chlamydia trachomatis
ucucugaaagagcuucuuu

SEQ ID NO: 2493505 - RNA, 13 nt, Chlamydia trachomatis
ucucugcagagaa

SEQ ID NO: 2493506 - RNA, 14 nt, Chlamydia trachomatis
ucucuggaaaaggc

SEQ ID NO: 2493507 - RNA, 18 nt, Chlamydia trachomatis
ucucuggaagagauguuu

SEQ ID NO: 2493508 - RNA, 20 nt, Chlamydia trachomatis
ucucuggcaauaaucuuuuu

SEQ ID NO: 2493509 - RNA, 18 nt, Chlamydia trachomatis
ucucuggucgugaucacu

SEQ ID NO: 2493510 - RNA, 18 nt, Chlamydia trachomatis
ucucuuagaagcucucaa

SEQ ID NO: 2493511 - RNA, 17 nt, Chlamydia trachomatis
ucucuuagacccucuaa

SEQ ID NO: 2493512 - RNA, 22 nt, Chlamydia trachomatis
ucucuucaagaucaaagucagg

SEQ ID NO: 2493513 - RNA, 12 nt, Chlamydia trachomatis
ucucuucacaaa

SEQ ID NO: 2493514 - RNA, 22 nt, Chlamydia trachomatis
ucucuuccgaguaaucaaaaaa

SEQ ID NO: 2493515 - RNA, 23 nt, Chlamydia trachomatis
ucucuucugugcaaucagcucuc

SEQ ID NO: 2493516 - RNA, 19 nt, Chlamydia trachomatis
ucucuugcagaacagcucu

SEQ ID NO: 2493517 - RNA, 22 nt, Chlamydia trachomatis
ucucuugcauguauagucaucu

SEQ ID NO: 2493518 - RNA, 19 nt, Chlamydia trachomatis
ucucuuguagagaggcaaa

SEQ ID NO: 2493519 - RNA, 16 nt, Chlamydia trachomatis
ucucuugucagaagag

SEQ ID NO: 2493520 - RNA, 13 nt, Chlamydia trachomatis
ucucuuguuucaa

SEQ ID NO: 2493521 - RNA, 17 nt, Chlamydia trachomatis
ucucuuuauccuguucu

SEQ ID NO: 2493522 - RNA, 15 nt, Chlamydia trachomatis
ucucuuuaugaaaaa

SEQ ID NO: 2493523 - RNA, 22 nt, Chlamydia trachomatis
ucucuuucucuagaauuucccu

SEQ ID NO: 2493524 - RNA, 19 nt, Chlamydia trachomatis
ucucuuuucgaacaaaacu

SEQ ID NO: 2493525 - RNA, 20 nt, Chlamydia trachomatis
ucucuuuucgaacaaaacuu

SEQ ID NO: 2493526 - RNA, 23 nt, Chlamydia trachomatis
ucucuuuucgaacaaaacuuguc

SEQ ID NO: 2493527 - RNA, 13 nt, Chlamydia trachomatis
ucucuuuucugca

SEQ ID NO: 2493528 - RNA, 13 nt, Chlamydia trachomatis
ucucuuuuguuug

SEQ ID NO: 2493529 - RNA, 22 nt, Chlamydia trachomatis
ucucuuuuuacaacucugaaca

SEQ ID NO: 2493530 - RNA, 21 nt, Chlamydia trachomatis
ucugaaacgcacuccaauaua

SEQ ID NO: 2493531 - RNA, 21 nt, Chlamydia trachomatis
ucugaaagagcuucuuuuuca

SEQ ID NO: 2493532 - RNA, 13 nt, Chlamydia trachomatis
ucugaacaagaag

SEQ ID NO: 2493533 - RNA, 13 nt, Chlamydia trachomatis
ucugaacauacaa

SEQ ID NO: 2493534 - RNA, 23 nt, Chlamydia trachomatis
ucugaagagaaaaauugcaaaga

SEQ ID NO: 2493535 - RNA, 14 nt, Chlamydia trachomatis
ucugaagucuuuaa

SEQ ID NO: 2493536 - RNA, 16 nt, Chlamydia trachomatis
ucugaauauacccauu

SEQ ID NO: 2493537 - RNA, 21 nt, Chlamydia trachomatis
ucugaaucuguguugcaaaga

SEQ ID NO: 2493538 - RNA, 18 nt, Chlamydia trachomatis
ucugacuuuuuagcaucu

SEQ ID NO: 2493539 - RNA, 12 nt, Chlamydia trachomatis
ucugagaaagcu

SEQ ID NO: 2493540 - RNA, 19 nt, Chlamydia trachomatis
ucugagaaagcuucuaaga

SEQ ID NO: 2493541 - RNA, 17 nt, Chlamydia trachomatis
ucugagcagugacuaag

SEQ ID NO: 2493542 - RNA, 17 nt, Chlamydia trachomatis
ucugaguauuaaggaaa

SEQ ID NO: 2493543 - RNA, 19 nt, Chlamydia trachomatis
ucugaguccucuaaaguau

SEQ ID NO: 2493544 - RNA, 15 nt, Chlamydia trachomatis
ucugaugcaccauaa

SEQ ID NO: 2493545 - RNA, 13 nt, Chlamydia trachomatis
ucugcaaaaucuu

SEQ ID NO: 2493546 - RNA, 17 nt, Chlamydia trachomatis
ucugcaaaaucuuccau

SEQ ID NO: 2493547 - RNA, 18 nt, Chlamydia trachomatis
ucugcaacucucuuggua

SEQ ID NO: 2493548 - RNA, 18 nt, Chlamydia trachomatis
ucugcaagaaaauaaguu

SEQ ID NO: 2493549 - RNA, 15 nt, Chlamydia trachomatis
ucugcaagaaaauag

SEQ ID NO: 2493550 - RNA, 21 nt, Chlamydia trachomatis
ucugcagagaucauaccaaua

SEQ ID NO: 2493551 - RNA, 20 nt, Chlamydia trachomatis
ucugcauaacagcaagacaa

SEQ ID NO: 2493552 - RNA, 19 nt, Chlamydia trachomatis
ucugcaucuuuauagaauu

SEQ ID NO: 2493553 - RNA, 19 nt, Chlamydia trachomatis
ucugcauuaaacacuagcc

SEQ ID NO: 2493554 - RNA, 13 nt, Chlamydia trachomatis
ucugcauugguau

SEQ ID NO: 2493555 - RNA, 23 nt, Chlamydia trachomatis
ucugcauugguauugccaugggc

SEQ ID NO: 2493556 - RNA, 14 nt, Chlamydia trachomatis
ucugccgcuguagc

SEQ ID NO: 2493557 - RNA, 18 nt, Chlamydia trachomatis
ucugcgaugccaaagaaa

SEQ ID NO: 2493558 - RNA, 15 nt, Chlamydia trachomatis
ucugcuaaaaaugcu

SEQ ID NO: 2493559 - RNA, 16 nt, Chlamydia trachomatis
ucugcuaaaaaugcuu

SEQ ID NO: 2493560 - RNA, 17 nt, Chlamydia trachomatis
ucugcuaaaaaugcuug

SEQ ID NO: 2493561 - RNA, 14 nt, Chlamydia trachomatis
ucugcuacaaacug

SEQ ID NO: 2493562 - RNA, 22 nt, Chlamydia trachomatis
ucugcuacaaacugcucaagga

SEQ ID NO: 2493563 - RNA, 13 nt, Chlamydia trachomatis
ucugcuauagaaa

SEQ ID NO: 2493564 - RNA, 22 nt, Chlamydia trachomatis
ucugcuucgccaaacacugcaa

SEQ ID NO: 2493565 - RNA, 23 nt, Chlamydia trachomatis
ucugcuugcgaauaacuaauaua

SEQ ID NO: 2493566 - RNA, 17 nt, Chlamydia trachomatis
ucugcuuugucucugug

SEQ ID NO: 2493567 - RNA, 21 nt, Chlamydia trachomatis
ucuggacuauuuucaaaaccu

SEQ ID NO: 2493568 - RNA, 22 nt, Chlamydia trachomatis
ucuggacuauuuucaaaaccuu

SEQ ID NO: 2493569 - RNA, 18 nt, Chlamydia trachomatis
ucuggagauacagaaucu

SEQ ID NO: 2493570 - RNA, 20 nt, Chlamydia trachomatis
ucuggaggaguauccagaag

SEQ ID NO: 2493571 - RNA, 21 nt, Chlamydia trachomatis
ucuggagguuuaggagagagc

SEQ ID NO: 2493572 - RNA, 22 nt, Chlamydia trachomatis
ucuggaguggcaucugguuggu

SEQ ID NO: 2493573 - RNA, 17 nt, Chlamydia trachomatis
ucuggauauaccacgga

SEQ ID NO: 2493574 - RNA, 21 nt, Chlamydia trachomatis
ucugggacuuggguaagagca

SEQ ID NO: 2493575 - RNA, 14 nt, Chlamydia trachomatis
ucugggucauagaa

SEQ ID NO: 2493576 - RNA, 15 nt, Chlamydia trachomatis
ucugguauucuaaau

SEQ ID NO: 2493577 - RNA, 13 nt, Chlamydia trachomatis
ucugguguaggaa

SEQ ID NO: 2493578 - RNA, 13 nt, Chlamydia trachomatis
ucuguaaaaggaa

SEQ ID NO: 2493579 - RNA, 20 nt, Chlamydia trachomatis
ucuguaaaaggaauucuucg

SEQ ID NO: 2493580 - RNA, 19 nt, Chlamydia trachomatis
ucuguaacuacaucuaaaa

SEQ ID NO: 2493581 - RNA, 16 nt, Chlamydia trachomatis
ucuguagagagcccca

SEQ ID NO: 2493582 - RNA, 22 nt, Chlamydia trachomatis
ucuguagagccaugaucaaaga

SEQ ID NO: 2493583 - RNA, 20 nt, Chlamydia trachomatis
ucuguaggagagaaucuuuu

SEQ ID NO: 2493584 - RNA, 16 nt, Chlamydia trachomatis
ucuguauaacaauuuu

SEQ ID NO: 2493585 - RNA, 15 nt, Chlamydia trachomatis
ucuguaucaaauuuu

SEQ ID NO: 2493586 - RNA, 22 nt, Chlamydia trachomatis
ucuguaucaaauuuuucagaaa

SEQ ID NO: 2493587 - RNA, 16 nt, Chlamydia trachomatis
ucugucguuaaagaau

SEQ ID NO: 2493588 - RNA, 21 nt, Chlamydia trachomatis
ucugucuaagauuuucaucuu

SEQ ID NO: 2493589 - RNA, 15 nt, Chlamydia trachomatis
ucugugcaaucagcu

SEQ ID NO: 2493590 - RNA, 21 nt, Chlamydia trachomatis
ucuguuaacugacaauccagu

SEQ ID NO: 2493591 - RNA, 24 nt, Chlamydia trachomatis
ucuguuaagcguaguaagacccag

SEQ ID NO: 2493592 - RNA, 16 nt, Chlamydia trachomatis
ucuguuaguagcuucu

SEQ ID NO: 2493593 - RNA, 14 nt, Chlamydia trachomatis
ucuguuagugaaga

SEQ ID NO: 2493594 - RNA, 18 nt, Chlamydia trachomatis
ucuguuagugaagagcag

SEQ ID NO: 2493595 - RNA, 20 nt, Chlamydia trachomatis
ucuguuauuuguucucuuag

SEQ ID NO: 2493596 - RNA, 19 nt, Chlamydia trachomatis
ucuguucagaacucaaaau

SEQ ID NO: 2493597 - RNA, 20 nt, Chlamydia trachomatis
ucuguugaaagcuauuuucu

SEQ ID NO: 2493598 - RNA, 22 nt, Chlamydia trachomatis
ucuguuuuuucagggauagaaa

SEQ ID NO: 2493599 - RNA, 14 nt, Chlamydia trachomatis
ucuuaaacaaaaau

SEQ ID NO: 2493600 - RNA, 22 nt, Chlamydia trachomatis
ucuuaaacaaaaauaacgauuc

SEQ ID NO: 2493601 - RNA, 21 nt, Chlamydia trachomatis
ucuuaaaggucgagcucccau

SEQ ID NO: 2493602 - RNA, 23 nt, Chlamydia trachomatis
ucuuaauccuugcacuaagaaua

SEQ ID NO: 2493603 - RNA, 15 nt, Chlamydia trachomatis
ucuuaccaaaaucua

SEQ ID NO: 2493604 - RNA, 16 nt, Chlamydia trachomatis
ucuuacgagcuuucuu

SEQ ID NO: 2493605 - RNA, 17 nt, Chlamydia trachomatis
ucuuacuccuaaaguaa

SEQ ID NO: 2493606 - RNA, 13 nt, Chlamydia trachomatis
ucuuacuccuucu

SEQ ID NO: 2493607 - RNA, 16 nt, Chlamydia trachomatis
ucuuacuuaaaaaaca

SEQ ID NO: 2493608 - RNA, 14 nt, Chlamydia trachomatis
ucuuagaagcucuc

SEQ ID NO: 2493609 - RNA, 17 nt, Chlamydia trachomatis
ucuuaguaaggcgagaa

SEQ ID NO: 2493610 - RNA, 15 nt, Chlamydia trachomatis
ucuuauuaaccaacu

SEQ ID NO: 2493611 - RNA, 16 nt, Chlamydia trachomatis
ucuucaaauucuacuc

SEQ ID NO: 2493612 - RNA, 13 nt, Chlamydia trachomatis
ucuucaagagcug

SEQ ID NO: 2493613 - RNA, 22 nt, Chlamydia trachomatis
ucuucaagaucaaagucaggau

SEQ ID NO: 2493614 - RNA, 16 nt, Chlamydia trachomatis
ucuucacaaauauacu

SEQ ID NO: 2493615 - RNA, 13 nt, Chlamydia trachomatis
ucuucacaccacg

SEQ ID NO: 2493616 - RNA, 21 nt, Chlamydia trachomatis
ucuucacagagcuucucuaaa

SEQ ID NO: 2493617 - RNA, 22 nt, Chlamydia trachomatis
ucuucacagcacgacacuccuc

SEQ ID NO: 2493618 - RNA, 15 nt, Chlamydia trachomatis
ucuucacggagagaa

SEQ ID NO: 2493619 - RNA, 13 nt, Chlamydia trachomatis
ucuucacuuugau

SEQ ID NO: 2493620 - RNA, 13 nt, Chlamydia trachomatis
ucuucagaaaucu

SEQ ID NO: 2493621 - RNA, 14 nt, Chlamydia trachomatis
ucuucagaaaucuu

SEQ ID NO: 2493622 - RNA, 18 nt, Chlamydia trachomatis
ucuucagaaaucuucuua

SEQ ID NO: 2493623 - RNA, 13 nt, Chlamydia trachomatis
ucuucaggagcau

SEQ ID NO: 2493624 - RNA, 22 nt, Chlamydia trachomatis
ucuucaggaucuagacaaucug

SEQ ID NO: 2493625 - RNA, 18 nt, Chlamydia trachomatis
ucuucaggugaucucuuu

SEQ ID NO: 2493626 - RNA, 12 nt, Chlamydia trachomatis
ucuucauaaaac

SEQ ID NO: 2493627 - RNA, 13 nt, Chlamydia trachomatis
ucuucauaagaaa

SEQ ID NO: 2493628 - RNA, 17 nt, Chlamydia trachomatis
ucuucauguucugugaa

SEQ ID NO: 2493629 - RNA, 15 nt, Chlamydia trachomatis
ucuuccaaaggauau

SEQ ID NO: 2493630 - RNA, 19 nt, Chlamydia trachomatis
ucuuccaacaauuuucguu

SEQ ID NO: 2493631 - RNA, 22 nt, Chlamydia trachomatis
ucuuccacgaugagauacagua

SEQ ID NO: 2493632 - RNA, 22 nt, Chlamydia trachomatis
ucuuccagacgcccuccuccuc

SEQ ID NO: 2493633 - RNA, 18 nt, Chlamydia trachomatis
ucuuccagccuacaaaua

SEQ ID NO: 2493634 - RNA, 21 nt, Chlamydia trachomatis
ucuuccagccuacaaauaaag

SEQ ID NO: 2493635 - RNA, 22 nt, Chlamydia trachomatis
ucuuccagccuacaaauaaagu

SEQ ID NO: 2493636 - RNA, 15 nt, Chlamydia trachomatis
ucuuccaucguaagc

SEQ ID NO: 2493637 - RNA, 15 nt, Chlamydia trachomatis
ucuucccaacuuuuu

SEQ ID NO: 2493638 - RNA, 22 nt, Chlamydia trachomatis
ucuucccaacuuuuuuagcaac

SEQ ID NO: 2493639 - RNA, 23 nt, Chlamydia trachomatis
ucuucccugagaaauugcucagg

SEQ ID NO: 2493640 - RNA, 20 nt, Chlamydia trachomatis
ucuucccugaggcuuuaccg

SEQ ID NO: 2493641 - RNA, 21 nt, Chlamydia trachomatis
ucuuccgaagauucgcugcug

SEQ ID NO: 2493642 - RNA, 15 nt, Chlamydia trachomatis
ucuucgaaauauugu

SEQ ID NO: 2493643 - RNA, 13 nt, Chlamydia trachomatis
ucuucgaaaucuu

SEQ ID NO: 2493644 - RNA, 20 nt, Chlamydia trachomatis
ucuucgaugcuauuuucagc

SEQ ID NO: 2493645 - RNA, 21 nt, Chlamydia trachomatis
ucuucgcaaacugcucuucua

SEQ ID NO: 2493646 - RNA, 22 nt, Chlamydia trachomatis
ucuucgcaaacugcucuucuaa

SEQ ID NO: 2493647 - RNA, 17 nt, Chlamydia trachomatis
ucuucggacauugaaca

SEQ ID NO: 2493648 - RNA, 13 nt, Chlamydia trachomatis
ucuucuaaaggau

SEQ ID NO: 2493649 - RNA, 22 nt, Chlamydia trachomatis
ucuucuaaaugcuguaaaacau

SEQ ID NO: 2493650 - RNA, 16 nt, Chlamydia trachomatis
ucuucuaacuuuucaa

SEQ ID NO: 2493651 - RNA, 18 nt, Chlamydia trachomatis
ucuucuaaguauucuucu

SEQ ID NO: 2493652 - RNA, 19 nt, Chlamydia trachomatis
ucuucuagagauaucccua

SEQ ID NO: 2493653 - RNA, 22 nt, Chlamydia trachomatis
ucuucuagaggaguucccguua

SEQ ID NO: 2493654 - RNA, 23 nt, Chlamydia trachomatis
ucuucuagauagagauuccacua

SEQ ID NO: 2493655 - RNA, 22 nt, Chlamydia trachomatis
ucuucuauccauuguagaugcu

SEQ ID NO: 2493656 - RNA, 16 nt, Chlamydia trachomatis
ucuucucgaaagagaa

SEQ ID NO: 2493657 - RNA, 22 nt, Chlamydia trachomatis
ucuucucgagaagaaaaacggu

SEQ ID NO: 2493658 - RNA, 14 nt, Chlamydia trachomatis
ucuucucucauguc

SEQ ID NO: 2493659 - RNA, 14 nt, Chlamydia trachomatis
ucuucugaaaaauc

SEQ ID NO: 2493660 - RNA, 19 nt, Chlamydia trachomatis
ucuucugaaaaaucaagga

SEQ ID NO: 2493661 - RNA, 13 nt, Chlamydia trachomatis
ucuucugaacaac

SEQ ID NO: 2493662 - RNA, 22 nt, Chlamydia trachomatis
ucuucugaacaacauccuuuau

SEQ ID NO: 2493663 - RNA, 19 nt, Chlamydia trachomatis
ucuucugcugaucggaaca

SEQ ID NO: 2493664 - RNA, 23 nt, Chlamydia trachomatis
ucuucuggcgaaucaauuucuag

SEQ ID NO: 2493665 - RNA, 21 nt, Chlamydia trachomatis
ucuucugugcaaucagcucuc

SEQ ID NO: 2493666 - RNA, 16 nt, Chlamydia trachomatis
ucuucuguuuuuucag

SEQ ID NO: 2493667 - RNA, 9 nt, Chlamydia trachomatis
ucuucuucg

SEQ ID NO: 2493668 - RNA, 15 nt, Chlamydia trachomatis
ucuucuucggaaagc

SEQ ID NO: 2493669 - RNA, 15 nt, Chlamydia trachomatis
ucuucuucucuuucg

SEQ ID NO: 2493670 - RNA, 14 nt, Chlamydia trachomatis
ucuucuucuuuagc

SEQ ID NO: 2493671 - RNA, 14 nt, Chlamydia trachomatis
ucuucuugagaaaa

SEQ ID NO: 2493672 - RNA, 21 nt, Chlamydia trachomatis
ucuucuuuagcucgcuucaaa

SEQ ID NO: 2493673 - RNA, 14 nt, Chlamydia trachomatis
ucuucuuuggaaaa

SEQ ID NO: 2493674 - RNA, 17 nt, Chlamydia trachomatis
ucuucuuuggaaaaaaa

SEQ ID NO: 2493675 - RNA, 15 nt, Chlamydia trachomatis
ucuucuuuugagaug

SEQ ID NO: 2493676 - RNA, 16 nt, Chlamydia trachomatis
ucuucuuuugagauga

SEQ ID NO: 2493677 - RNA, 13 nt, Chlamydia trachomatis
ucuucuuuuucuc

SEQ ID NO: 2493678 - RNA, 15 nt, Chlamydia trachomatis
ucuugaagauauuca

SEQ ID NO: 2493679 - RNA, 18 nt, Chlamydia trachomatis
ucuugaagauauucaugu

SEQ ID NO: 2493680 - RNA, 13 nt, Chlamydia trachomatis
ucuugaauggcaa

SEQ ID NO: 2493681 - RNA, 19 nt, Chlamydia trachomatis
ucuugagcauugacaugcc

SEQ ID NO: 2493682 - RNA, 16 nt, Chlamydia trachomatis
ucuugaguagaagaau

SEQ ID NO: 2493683 - RNA, 20 nt, Chlamydia trachomatis
ucuugaguagaagaaugaaa

SEQ ID NO: 2493684 - RNA, 17 nt, Chlamydia trachomatis
ucuugauagucuugcau

SEQ ID NO: 2493685 - RNA, 17 nt, Chlamydia trachomatis
ucuugaucggagucugc

SEQ ID NO: 2493686 - RNA, 13 nt, Chlamydia trachomatis
ucuugaucugaaa

SEQ ID NO: 2493687 - RNA, 21 nt, Chlamydia trachomatis
ucuugaucugaaaagagaaga

SEQ ID NO: 2493688 - RNA, 23 nt, Chlamydia trachomatis
ucuugaucugaaaagagaagaag

SEQ ID NO: 2493689 - RNA, 13 nt, Chlamydia trachomatis
ucuugauuccugg

SEQ ID NO: 2493690 - RNA, 16 nt, Chlamydia trachomatis
ucuugcacauuuucuu

SEQ ID NO: 2493691 - RNA, 17 nt, Chlamydia trachomatis
ucuugcauaaggaagca

SEQ ID NO: 2493692 - RNA, 22 nt, Chlamydia trachomatis
ucuugcauaaggaagcaaaaac

SEQ ID NO: 2493693 - RNA, 14 nt, Chlamydia trachomatis
ucuugcuaagaaca

SEQ ID NO: 2493694 - RNA, 14 nt, Chlamydia trachomatis
ucuugcuaauguag

SEQ ID NO: 2493695 - RNA, 18 nt, Chlamydia trachomatis
ucuugcugggagauagcu

SEQ ID NO: 2493696 - RNA, 22 nt, Chlamydia trachomatis
ucuugggauaugccucuaagca

SEQ ID NO: 2493697 - RNA, 19 nt, Chlamydia trachomatis
ucuuggggaucgaucccuu

SEQ ID NO: 2493698 - RNA, 15 nt, Chlamydia trachomatis
ucuuguaauugcagu

SEQ ID NO: 2493699 - RNA, 15 nt, Chlamydia trachomatis
ucuuguagauagacu

SEQ ID NO: 2493700 - RNA, 23 nt, Chlamydia trachomatis
ucuugucagaagaggcaaaaauc

SEQ ID NO: 2493701 - RNA, 17 nt, Chlamydia trachomatis
ucuugucccauuaccua

SEQ ID NO: 2493702 - RNA, 14 nt, Chlamydia trachomatis
ucuugugcucuguc

SEQ ID NO: 2493703 - RNA, 16 nt, Chlamydia trachomatis
ucuuguguagaagaag

SEQ ID NO: 2493704 - RNA, 20 nt, Chlamydia trachomatis
ucuuguuuagaggagaaggu

SEQ ID NO: 2493705 - RNA, 14 nt, Chlamydia trachomatis
ucuuguuuauucuc

SEQ ID NO: 2493706 - RNA, 21 nt, Chlamydia trachomatis
ucuuguuuuauacucuaaaag

SEQ ID NO: 2493707 - RNA, 15 nt, Chlamydia trachomatis
ucuuuaacaucuuua

SEQ ID NO: 2493708 - RNA, 19 nt, Chlamydia trachomatis
ucuuuaacaucuuuagaau

SEQ ID NO: 2493709 - RNA, 21 nt, Chlamydia trachomatis
ucuuuaacaucuuuagaaucc

SEQ ID NO: 2493710 - RNA, 21 nt, Chlamydia trachomatis
ucuuuaacccuucaggaaagc

SEQ ID NO: 2493711 - RNA, 22 nt, Chlamydia trachomatis
ucuuuaagcugggaaagcugca

SEQ ID NO: 2493712 - RNA, 16 nt, Chlamydia trachomatis
ucuuuacuaggagcaa

SEQ ID NO: 2493713 - RNA, 16 nt, Chlamydia trachomatis
ucuuuagaauccaaag

SEQ ID NO: 2493714 - RNA, 20 nt, Chlamydia trachomatis
ucuuuagaauccaaagucuc

SEQ ID NO: 2493715 - RNA, 19 nt, Chlamydia trachomatis
ucuuuagcgcacuuaauaa

SEQ ID NO: 2493716 - RNA, 22 nt, Chlamydia trachomatis
ucuuuauaaucgaucacagaaa

SEQ ID NO: 2493717 - RNA, 23 nt, Chlamydia trachomatis
ucuuuauagaaggucugaacaac

SEQ ID NO: 2493718 - RNA, 16 nt, Chlamydia trachomatis
ucuuuauagaauuuuu

SEQ ID NO: 2493719 - RNA, 22 nt, Chlamydia trachomatis
ucuuuauagaauuuuucuaaaa

SEQ ID NO: 2493720 - RNA, 23 nt, Chlamydia trachomatis
ucuuuauagaauuuuucuaaaau

SEQ ID NO: 2493721 - RNA, 21 nt, Chlamydia trachomatis
ucuuuauuaaacucccaaaac

SEQ ID NO: 2493722 - RNA, 18 nt, Chlamydia trachomatis
ucuuuauuacgaugaugc

SEQ ID NO: 2493723 - RNA, 15 nt, Chlamydia trachomatis
ucuuuauuuaaguag

SEQ ID NO: 2493724 - RNA, 22 nt, Chlamydia trachomatis
ucuuucaaaagaaggcuuuucu

SEQ ID NO: 2493725 - RNA, 23 nt, Chlamydia trachomatis
ucuuucaaagaagcuccuuuacc

SEQ ID NO: 2493726 - RNA, 14 nt, Chlamydia trachomatis
ucuuucaauagcau

SEQ ID NO: 2493727 - RNA, 22 nt, Chlamydia trachomatis
ucuuucaugcgaagcaaauccu

SEQ ID NO: 2493728 - RNA, 15 nt, Chlamydia trachomatis
ucuuuccuccucccu

SEQ ID NO: 2493729 - RNA, 22 nt, Chlamydia trachomatis
ucuuucgauaucgcguccaaaa

SEQ ID NO: 2493730 - RNA, 16 nt, Chlamydia trachomatis
ucuuucuaauuucccu

SEQ ID NO: 2493731 - RNA, 20 nt, Chlamydia trachomatis
ucuuucuggagcaucaguaa

SEQ ID NO: 2493732 - RNA, 18 nt, Chlamydia trachomatis
ucuuucuucuaagaaguu

SEQ ID NO: 2493733 - RNA, 17 nt, Chlamydia trachomatis
ucuuugaagguaagaaa

SEQ ID NO: 2493734 - RNA, 17 nt, Chlamydia trachomatis
ucuuugagaagcaucuc

SEQ ID NO: 2493735 - RNA, 18 nt, Chlamydia trachomatis
ucuuugaguccaacgcug

SEQ ID NO: 2493736 - RNA, 17 nt, Chlamydia trachomatis
ucuuugauaugcagcau

SEQ ID NO: 2493737 - RNA, 16 nt, Chlamydia trachomatis
ucuuugaucaaauccu

SEQ ID NO: 2493738 - RNA, 16 nt, Chlamydia trachomatis
ucuuugaucuguaaaa

SEQ ID NO: 2493739 - RNA, 21 nt, Chlamydia trachomatis
ucuuugggauagauagcucca

SEQ ID NO: 2493740 - RNA, 18 nt, Chlamydia trachomatis
ucuuuguucacagaaagu

SEQ ID NO: 2493741 - RNA, 20 nt, Chlamydia trachomatis
ucuuuguuccuacuaaaaug

SEQ ID NO: 2493742 - RNA, 14 nt, Chlamydia trachomatis
ucuuuguucucuaa

SEQ ID NO: 2493743 - RNA, 23 nt, Chlamydia trachomatis
ucuuuuccauauucuugcuaaga

SEQ ID NO: 2493744 - RNA, 15 nt, Chlamydia trachomatis
ucuuuucgaacaaaa

SEQ ID NO: 2493745 - RNA, 15 nt, Chlamydia trachomatis
ucuuuugaagaugga

SEQ ID NO: 2493746 - RNA, 22 nt, Chlamydia trachomatis
ucuuuuuaggaggaauauuaaa

SEQ ID NO: 2493747 - RNA, 13 nt, Chlamydia trachomatis
ucuuuuucaagag

SEQ ID NO: 2493748 - RNA, 16 nt, Chlamydia trachomatis
ucuuuuuccucagcau

SEQ ID NO: 2493749 - RNA, 18 nt, Chlamydia trachomatis
ucuuuuuccucagcaugc

SEQ ID NO: 2493750 - RNA, 19 nt, Chlamydia trachomatis
ucuuuuuguugcucuauaa

SEQ ID NO: 2493751 - RNA, 17 nt, Chlamydia trachomatis
ugaaaaagaagcuaaua

SEQ ID NO: 2493752 - RNA, 19 nt, Chlamydia trachomatis
ugaaaaagaagcuaauagc

SEQ ID NO: 2493753 - RNA, 19 nt, Chlamydia trachomatis
ugaaaaagcuuucuucccc

SEQ ID NO: 2493754 - RNA, 17 nt, Chlamydia trachomatis
ugaaaagcuuucaaagc

SEQ ID NO: 2493755 - RNA, 21 nt, Chlamydia trachomatis
ugaaaaggagccuuguaucuu

SEQ ID NO: 2493756 - RNA, 18 nt, Chlamydia trachomatis
ugaaaagggcaaaacucc

SEQ ID NO: 2493757 - RNA, 15 nt, Chlamydia trachomatis
ugaaaauaucuaagc

SEQ ID NO: 2493758 - RNA, 22 nt, Chlamydia trachomatis
ugaaaauaugauuacuggauag

SEQ ID NO: 2493759 - RNA, 23 nt, Chlamydia trachomatis
ugaaaauaugauuacuggauagu

SEQ ID NO: 2493760 - RNA, 16 nt, Chlamydia trachomatis
ugaaaaugcucuaaag

SEQ ID NO: 2493761 - RNA, 17 nt, Chlamydia trachomatis
ugaaacccaucucuaua

SEQ ID NO: 2493762 - RNA, 15 nt, Chlamydia trachomatis
ugaaaccccucuuuc

SEQ ID NO: 2493763 - RNA, 14 nt, Chlamydia trachomatis
ugaaacucuuuuua

SEQ ID NO: 2493764 - RNA, 23 nt, Chlamydia trachomatis
ugaaagagugauucgguaaucac

SEQ ID NO: 2493765 - RNA, 23 nt, Chlamydia trachomatis
ugaaagcuagaagaaucauagaa

SEQ ID NO: 2493766 - RNA, 16 nt, Chlamydia trachomatis
ugaaagcuauuuucuu

SEQ ID NO: 2493767 - RNA, 22 nt, Chlamydia trachomatis
ugaaagcuauuuucuuccugcu

SEQ ID NO: 2493768 - RNA, 13 nt, Chlamydia trachomatis
ugaaaguagacca

SEQ ID NO: 2493769 - RNA, 17 nt, Chlamydia trachomatis
ugaaagucuuuauaucu

SEQ ID NO: 2493770 - RNA, 18 nt, Chlamydia trachomatis
ugaaagucuuuauaucuu

SEQ ID NO: 2493771 - RNA, 21 nt, Chlamydia trachomatis
ugaaaguuccgguauauucuu

SEQ ID NO: 2493772 - RNA, 22 nt, Chlamydia trachomatis
ugaaaguuccgguauauucuuc

SEQ ID NO: 2493773 - RNA, 16 nt, Chlamydia trachomatis
ugaaaguuuuuucccc

SEQ ID NO: 2493774 - RNA, 16 nt, Chlamydia trachomatis
ugaaauaccacucauu

SEQ ID NO: 2493775 - RNA, 19 nt, Chlamydia trachomatis
ugaaauaugcauagucuuc

SEQ ID NO: 2493776 - RNA, 23 nt, Chlamydia trachomatis
ugaacaacugcugauaaauuucu

SEQ ID NO: 2493777 - RNA, 22 nt, Chlamydia trachomatis
ugaacaacuugaucuacagcaa

SEQ ID NO: 2493778 - RNA, 20 nt, Chlamydia trachomatis
ugaacacccgguauauguau

SEQ ID NO: 2493779 - RNA, 20 nt, Chlamydia trachomatis
ugaaccagggagagcuuagg

SEQ ID NO: 2493780 - RNA, 14 nt, Chlamydia trachomatis
ugaacgagaaaaag

SEQ ID NO: 2493781 - RNA, 21 nt, Chlamydia trachomatis
ugaacuagagaucccgaauac

SEQ ID NO: 2493782 - RNA, 20 nt, Chlamydia trachomatis
ugaagaacugucuucuuuca

SEQ ID NO: 2493783 - RNA, 10 nt, Chlamydia trachomatis
ugaagaagau

SEQ ID NO: 2493784 - RNA, 20 nt, Chlamydia trachomatis
ugaagaaugaucacuugaau

SEQ ID NO: 2493785 - RNA, 18 nt, Chlamydia trachomatis
ugaagacccguuuucucu

SEQ ID NO: 2493786 - RNA, 19 nt, Chlamydia trachomatis
ugaagacccguuuucucuu

SEQ ID NO: 2493787 - RNA, 15 nt, Chlamydia trachomatis
ugaagagaaaaauug

SEQ ID NO: 2493788 - RNA, 18 nt, Chlamydia trachomatis
ugaagauucuaaaaugca

SEQ ID NO: 2493789 - RNA, 14 nt, Chlamydia trachomatis
ugaagcaaauagau

SEQ ID NO: 2493790 - RNA, 15 nt, Chlamydia trachomatis
ugaagcaaaucccug

SEQ ID NO: 2493791 - RNA, 21 nt, Chlamydia trachomatis
ugaagccauaggcauugugau

SEQ ID NO: 2493792 - RNA, 19 nt, Chlamydia trachomatis
ugaaggugugaaagaaaaa

SEQ ID NO: 2493793 - RNA, 20 nt, Chlamydia trachomatis
ugaaggugugaaagaaaaau

SEQ ID NO: 2493794 - RNA, 16 nt, Chlamydia trachomatis
ugaaguaacuuugaua

SEQ ID NO: 2493795 - RNA, 14 nt, Chlamydia trachomatis
ugaaguucuuuuuc

SEQ ID NO: 2493796 - RNA, 15 nt, Chlamydia trachomatis
ugaauaagcuugcaa

SEQ ID NO: 2493797 - RNA, 21 nt, Chlamydia trachomatis
ugaauacaaaccgaagaggga

SEQ ID NO: 2493798 - RNA, 22 nt, Chlamydia trachomatis
ugaauacagucaugcaucccuu

SEQ ID NO: 2493799 - RNA, 17 nt, Chlamydia trachomatis
ugaauauacccauuugc

SEQ ID NO: 2493800 - RNA, 21 nt, Chlamydia trachomatis
ugaauauaccccgaacaaucu

SEQ ID NO: 2493801 - RNA, 18 nt, Chlamydia trachomatis
ugaauaucguaaacaacc

SEQ ID NO: 2493802 - RNA, 19 nt, Chlamydia trachomatis
ugaauaucguaaacaacca

SEQ ID NO: 2493803 - RNA, 13 nt, Chlamydia trachomatis
ugaaucaaacaga

SEQ ID NO: 2493804 - RNA, 19 nt, Chlamydia trachomatis
ugaaucacagaaacuucuu

SEQ ID NO: 2493805 - RNA, 22 nt, Chlamydia trachomatis
ugaaucacagaaacuucuucua

SEQ ID NO: 2493806 - RNA, 17 nt, Chlamydia trachomatis
ugaaucagaaguugagc

SEQ ID NO: 2493807 - RNA, 22 nt, Chlamydia trachomatis
ugaaucagaaguugagcaacua

SEQ ID NO: 2493808 - RNA, 15 nt, Chlamydia trachomatis
ugaaucagcuuuucc

SEQ ID NO: 2493809 - RNA, 22 nt, Chlamydia trachomatis
ugaauccuugaaccaaacgauu

SEQ ID NO: 2493810 - RNA, 13 nt, Chlamydia trachomatis
ugaaucuguguug

SEQ ID NO: 2493811 - RNA, 19 nt, Chlamydia trachomatis
ugaauuccaaguugcuugg

SEQ ID NO: 2493812 - RNA, 13 nt, Chlamydia trachomatis
ugaauugaauaca

SEQ ID NO: 2493813 - RNA, 15 nt, Chlamydia trachomatis
ugaauuucaggagua

SEQ ID NO: 2493814 - RNA, 13 nt, Chlamydia trachomatis
ugaauuuccccug

SEQ ID NO: 2493815 - RNA, 14 nt, Chlamydia trachomatis
ugaauuucuguaag

SEQ ID NO: 2493816 - RNA, 14 nt, Chlamydia trachomatis
ugacaaucacacga

SEQ ID NO: 2493817 - RNA, 17 nt, Chlamydia trachomatis
ugacacacguuccaguc

SEQ ID NO: 2493818 - RNA, 19 nt, Chlamydia trachomatis
ugacagcaccaagcuccac

SEQ ID NO: 2493819 - RNA, 17 nt, Chlamydia trachomatis
ugacagguuucaugaca

SEQ ID NO: 2493820 - RNA, 21 nt, Chlamydia trachomatis
ugacagguuucaugacauuca

SEQ ID NO: 2493821 - RNA, 13 nt, Chlamydia trachomatis
ugacauaagcaaa

SEQ ID NO: 2493822 - RNA, 23 nt, Chlamydia trachomatis
ugacauucaguucgaaguucccu

SEQ ID NO: 2493823 - RNA, 13 nt, Chlamydia trachomatis
ugacauuccucga

SEQ ID NO: 2493824 - RNA, 18 nt, Chlamydia trachomatis
ugacccauccaaaacauc

SEQ ID NO: 2493825 - RNA, 22 nt, Chlamydia trachomatis
ugaccucagauuuaucugcuau

SEQ ID NO: 2493826 - RNA, 15 nt, Chlamydia trachomatis
ugacgaaucgcacca

SEQ ID NO: 2493827 - RNA, 18 nt, Chlamydia trachomatis
ugacgaaucgcaccauuu

SEQ ID NO: 2493828 - RNA, 23 nt, Chlamydia trachomatis
ugacgaggggcuaccucuaaaga

SEQ ID NO: 2493829 - RNA, 14 nt, Chlamydia trachomatis
ugacgauagagaac

SEQ ID NO: 2493830 - RNA, 14 nt, Chlamydia trachomatis
ugacggauccugcu

SEQ ID NO: 2493831 - RNA, 21 nt, Chlamydia trachomatis
ugacuacagucuuccucugcu

SEQ ID NO: 2493832 - RNA, 14 nt, Chlamydia trachomatis
ugacuaguuuuuuc

SEQ ID NO: 2493833 - RNA, 18 nt, Chlamydia trachomatis
ugacuauuccugaaggag

SEQ ID NO: 2493834 - RNA, 15 nt, Chlamydia trachomatis
ugacucccauaauca

SEQ ID NO: 2493835 - RNA, 16 nt, Chlamydia trachomatis
ugacucccauaaucac

SEQ ID NO: 2493836 - RNA, 18 nt, Chlamydia trachomatis
ugacuccuucucgcaaaa

SEQ ID NO: 2493837 - RNA, 14 nt, Chlamydia trachomatis
ugacugcgcuauga

SEQ ID NO: 2493838 - RNA, 14 nt, Chlamydia trachomatis
ugacuguagcaacg

SEQ ID NO: 2493839 - RNA, 20 nt, Chlamydia trachomatis
ugacuuuuagcaaauaauag

SEQ ID NO: 2493840 - RNA, 21 nt, Chlamydia trachomatis
ugacuuuuauucacccaaaua

SEQ ID NO: 2493841 - RNA, 22 nt, Chlamydia trachomatis
ugacuuuuauucacccaaauau

SEQ ID NO: 2493842 - RNA, 19 nt, Chlamydia trachomatis
ugagaaagcuucuaagaac

SEQ ID NO: 2493843 - RNA, 20 nt, Chlamydia trachomatis
ugagaaagcuucuaagaaca

SEQ ID NO: 2493844 - RNA, 18 nt, Chlamydia trachomatis
ugagaaaguuaaagaaua

SEQ ID NO: 2493845 - RNA, 13 nt, Chlamydia trachomatis
ugagaaaucuaaa

SEQ ID NO: 2493846 - RNA, 19 nt, Chlamydia trachomatis
ugagaagaaaggucugcau

SEQ ID NO: 2493847 - RNA, 16 nt, Chlamydia trachomatis
ugagaauccaaauuuu

SEQ ID NO: 2493848 - RNA, 19 nt, Chlamydia trachomatis
ugagaaucggauccuucga

SEQ ID NO: 2493849 - RNA, 15 nt, Chlamydia trachomatis
ugagaccgucaaaaa

SEQ ID NO: 2493850 - RNA, 14 nt, Chlamydia trachomatis
ugagagaccugcuu

SEQ ID NO: 2493851 - RNA, 20 nt, Chlamydia trachomatis
ugagagcuuccacagcagug

SEQ ID NO: 2493852 - RNA, 17 nt, Chlamydia trachomatis
ugagauccuuaaacucu

SEQ ID NO: 2493853 - RNA, 22 nt, Chlamydia trachomatis
ugagaugcuccucucuuuggua

SEQ ID NO: 2493854 - RNA, 16 nt, Chlamydia trachomatis
ugagcaaccuuuccug

SEQ ID NO: 2493855 - RNA, 22 nt, Chlamydia trachomatis
ugagcaagccccgaaacccaac

SEQ ID NO: 2493856 - RNA, 14 nt, Chlamydia trachomatis
ugagcaagcucaac

SEQ ID NO: 2493857 - RNA, 16 nt, Chlamydia trachomatis
ugagcagcaaagaucg

SEQ ID NO: 2493858 - RNA, 15 nt, Chlamydia trachomatis
ugagcaucuggagug

SEQ ID NO: 2493859 - RNA, 14 nt, Chlamydia trachomatis
ugagcauuucucuc

SEQ ID NO: 2493860 - RNA, 23 nt, Chlamydia trachomatis
ugagcauuucucucgcugcgaga

SEQ ID NO: 2493861 - RNA, 15 nt, Chlamydia trachomatis
ugagcccaaggagaa

SEQ ID NO: 2493862 - RNA, 14 nt, Chlamydia trachomatis
ugagccucuaacuc

SEQ ID NO: 2493863 - RNA, 19 nt, Chlamydia trachomatis
ugagccucuaacucuucug

SEQ ID NO: 2493864 - RNA, 17 nt, Chlamydia trachomatis
ugagccuugccuacaga

SEQ ID NO: 2493865 - RNA, 14 nt, Chlamydia trachomatis
ugagcuagaaugug

SEQ ID NO: 2493866 - RNA, 22 nt, Chlamydia trachomatis
ugagcuauaccgccucaaacaa

SEQ ID NO: 2493867 - RNA, 16 nt, Chlamydia trachomatis
ugagcuccuaagcagu

SEQ ID NO: 2493868 - RNA, 17 nt, Chlamydia trachomatis
ugagcuuaucacaaacc

SEQ ID NO: 2493869 - RNA, 14 nt, Chlamydia trachomatis
ugagcuuuauugaa

SEQ ID NO: 2493870 - RNA, 16 nt, Chlamydia trachomatis
ugagcuuuauuuucau

SEQ ID NO: 2493871 - RNA, 16 nt, Chlamydia trachomatis
ugagcuuuuuuucacu

SEQ ID NO: 2493872 - RNA, 22 nt, Chlamydia trachomatis
ugaggaagcauuucucuccaaa

SEQ ID NO: 2493873 - RNA, 15 nt, Chlamydia trachomatis
ugaguauuaaggaaa

SEQ ID NO: 2493874 - RNA, 22 nt, Chlamydia trachomatis
ugagucucgcgcuaaaaccuua

SEQ ID NO: 2493875 - RNA, 20 nt, Chlamydia trachomatis
ugagugcagaggauuuauaa

SEQ ID NO: 2493876 - RNA, 20 nt, Chlamydia trachomatis
ugaguggcaagggggagcau

SEQ ID NO: 2493877 - RNA, 15 nt, Chlamydia trachomatis
ugaguggggcucgau

SEQ ID NO: 2493878 - RNA, 14 nt, Chlamydia trachomatis
ugagugugagucua

SEQ ID NO: 2493879 - RNA, 20 nt, Chlamydia trachomatis
ugaguguuuguauagaaccu

SEQ ID NO: 2493880 - RNA, 22 nt, Chlamydia trachomatis
ugaguucugcuugcgaauaacu

SEQ ID NO: 2493881 - RNA, 21 nt, Chlamydia trachomatis
ugaguuguuugggcugcugcu

SEQ ID NO: 2493882 - RNA, 13 nt, Chlamydia trachomatis
ugauaaaaacucu

SEQ ID NO: 2493883 - RNA, 16 nt, Chlamydia trachomatis
ugauacaauuccugcu

SEQ ID NO: 2493884 - RNA, 22 nt, Chlamydia trachomatis
ugauacgcauaugcgucuuccc

SEQ ID NO: 2493885 - RNA, 17 nt, Chlamydia trachomatis
ugauacggacuucuuua

SEQ ID NO: 2493886 - RNA, 17 nt, Chlamydia trachomatis
ugauagcacccuuuuua

SEQ ID NO: 2493887 - RNA, 15 nt, Chlamydia trachomatis
ugauaguuacagacu

SEQ ID NO: 2493888 - RNA, 17 nt, Chlamydia trachomatis
ugauaguuuuuggccuu

SEQ ID NO: 2493889 - RNA, 19 nt, Chlamydia trachomatis
ugauaucuucugaagucuu

SEQ ID NO: 2493890 - RNA, 15 nt, Chlamydia trachomatis
ugauaugcagcaucc

SEQ ID NO: 2493891 - RNA, 22 nt, Chlamydia trachomatis
ugauauucccuucuauuucucu

SEQ ID NO: 2493892 - RNA, 12 nt, Chlamydia trachomatis
ugauauuuugaa

SEQ ID NO: 2493893 - RNA, 18 nt, Chlamydia trachomatis
ugauauuuugaagauaaa

SEQ ID NO: 2493894 - RNA, 12 nt, Chlamydia trachomatis
ugaucaaagaau

SEQ ID NO: 2493895 - RNA, 17 nt, Chlamydia trachomatis
ugaucacuaauauagaa

SEQ ID NO: 2493896 - RNA, 15 nt, Chlamydia trachomatis
ugaucauaaauacuu

SEQ ID NO: 2493897 - RNA, 13 nt, Chlamydia trachomatis
ugaucaugcagau

SEQ ID NO: 2493898 - RNA, 15 nt, Chlamydia trachomatis
ugauccccuacgcua

SEQ ID NO: 2493899 - RNA, 22 nt, Chlamydia trachomatis
ugaucucaacgcucaacucgcu

SEQ ID NO: 2493900 - RNA, 15 nt, Chlamydia trachomatis
ugaucuuuccagcag

SEQ ID NO: 2493901 - RNA, 23 nt, Chlamydia trachomatis
ugaucuuuguucucuaaagauuc

SEQ ID NO: 2493902 - RNA, 22 nt, Chlamydia trachomatis
ugaucuuuugcuguggaaaaau

SEQ ID NO: 2493903 - RNA, 13 nt, Chlamydia trachomatis
ugaucuuuuuagg

SEQ ID NO: 2493904 - RNA, 19 nt, Chlamydia trachomatis
ugaugaaaccuaauagaaa

SEQ ID NO: 2493905 - RNA, 18 nt, Chlamydia trachomatis
ugaugauagacaagacuu

SEQ ID NO: 2493906 - RNA, 19 nt, Chlamydia trachomatis
ugaugauagucugcaaucc

SEQ ID NO: 2493907 - RNA, 21 nt, Chlamydia trachomatis
ugaugcccaggauaacaaaca

SEQ ID NO: 2493908 - RNA, 22 nt, Chlamydia trachomatis
ugaugcccaggauaacaaacaa

SEQ ID NO: 2493909 - RNA, 18 nt, Chlamydia trachomatis
ugauggagauugcaacuc

SEQ ID NO: 2493910 - RNA, 20 nt, Chlamydia trachomatis
ugauuacuggagucucuuga

SEQ ID NO: 2493911 - RNA, 21 nt, Chlamydia trachomatis
ugauuauaaauggauacuaac

SEQ ID NO: 2493912 - RNA, 16 nt, Chlamydia trachomatis
ugauucccuguagaau

SEQ ID NO: 2493913 - RNA, 18 nt, Chlamydia trachomatis
ugauuccgagggaaucau

SEQ ID NO: 2493914 - RNA, 15 nt, Chlamydia trachomatis
ugauuccgcugcucu

SEQ ID NO: 2493915 - RNA, 18 nt, Chlamydia trachomatis
ugauugacaacuuucuuu

SEQ ID NO: 2493916 - RNA, 21 nt, Chlamydia trachomatis
ugauuguugguugcuccaaca

SEQ ID NO: 2493917 - RNA, 15 nt, Chlamydia trachomatis
ugauuucauaaauuu

SEQ ID NO: 2493918 - RNA, 12 nt, Chlamydia trachomatis
ugauuuuaaacc

SEQ ID NO: 2493919 - RNA, 14 nt, Chlamydia trachomatis
ugauuuuaaaccaa

SEQ ID NO: 2493920 - RNA, 12 nt, Chlamydia trachomatis
ugauuuuucuuu

SEQ ID NO: 2493921 - RNA, 13 nt, Chlamydia trachomatis
ugauuuuucuuuc

SEQ ID NO: 2493922 - RNA, 15 nt, Chlamydia trachomatis
ugauuuuucuuucaa

SEQ ID NO: 2493923 - RNA, 19 nt, Chlamydia trachomatis
ugauuuuucuuucaaagag

SEQ ID NO: 2493924 - RNA, 15 nt, Chlamydia trachomatis
ugauuuuuucgcuuu

SEQ ID NO: 2493925 - RNA, 20 nt, Chlamydia trachomatis
ugcaaaaucuuccauaaaau

SEQ ID NO: 2493926 - RNA, 20 nt, Chlamydia trachomatis
ugcaaacgguagcgauuuuc

SEQ ID NO: 2493927 - RNA, 17 nt, Chlamydia trachomatis
ugcaaauaauaaaccaa

SEQ ID NO: 2493928 - RNA, 18 nt, Chlamydia trachomatis
ugcaaauaauaaaccaaa

SEQ ID NO: 2493929 - RNA, 15 nt, Chlamydia trachomatis
ugcaacaaagaguuu

SEQ ID NO: 2493930 - RNA, 14 nt, Chlamydia trachomatis
ugcaacaaauacca

SEQ ID NO: 2493931 - RNA, 19 nt, Chlamydia trachomatis
ugcaacaagaacgcuuucc

SEQ ID NO: 2493932 - RNA, 23 nt, Chlamydia trachomatis
ugcaagaaaauagguaaagaagu

SEQ ID NO: 2493933 - RNA, 16 nt, Chlamydia trachomatis
ugcaagaacaaagaau

SEQ ID NO: 2493934 - RNA, 21 nt, Chlamydia trachomatis
ugcaagcacacuugauaaaua

SEQ ID NO: 2493935 - RNA, 23 nt, Chlamydia trachomatis
ugcaagcacacuugauaaauagc

SEQ ID NO: 2493936 - RNA, 16 nt, Chlamydia trachomatis
ugcaaguaaugacacu

SEQ ID NO: 2493937 - RNA, 23 nt, Chlamydia trachomatis
ugcaaguccuuugauuucugcag

SEQ ID NO: 2493938 - RNA, 22 nt, Chlamydia trachomatis
ugcaauaaggggaagaaauauu

SEQ ID NO: 2493939 - RNA, 20 nt, Chlamydia trachomatis
ugcaauagaaaccuuauaua

SEQ ID NO: 2493940 - RNA, 21 nt, Chlamydia trachomatis
ugcaaucauuugugugccaau

SEQ ID NO: 2493941 - RNA, 18 nt, Chlamydia trachomatis
ugcaauuuacuaucagga

SEQ ID NO: 2493942 - RNA, 14 nt, Chlamydia trachomatis
ugcacaccugcuuu

SEQ ID NO: 2493943 - RNA, 17 nt, Chlamydia trachomatis
ugcacaucacagaucuc

SEQ ID NO: 2493944 - RNA, 23 nt, Chlamydia trachomatis
ugcacaucacagaucucaucagg

SEQ ID NO: 2493945 - RNA, 15 nt, Chlamydia trachomatis
ugcacauuuucuuga

SEQ ID NO: 2493946 - RNA, 18 nt, Chlamydia trachomatis
ugcacccgcggaucccaa

SEQ ID NO: 2493947 - RNA, 15 nt, Chlamydia trachomatis
ugcacuaaagagcuu

SEQ ID NO: 2493948 - RNA, 20 nt, Chlamydia trachomatis
ugcacuaagaauaaagauga

SEQ ID NO: 2493949 - RNA, 17 nt, Chlamydia trachomatis
ugcacugguauucugca

SEQ ID NO: 2493950 - RNA, 21 nt, Chlamydia trachomatis
ugcacugguauucugcagaaa

SEQ ID NO: 2493951 - RNA, 16 nt, Chlamydia trachomatis
ugcacugucucaugga

SEQ ID NO: 2493952 - RNA, 22 nt, Chlamydia trachomatis
ugcagaaaucccaucaaaagcu

SEQ ID NO: 2493953 - RNA, 23 nt, Chlamydia trachomatis
ugcagaagaagccccaauagcua

SEQ ID NO: 2493954 - RNA, 16 nt, Chlamydia trachomatis
ugcagaagaccaguca

SEQ ID NO: 2493955 - RNA, 18 nt, Chlamydia trachomatis
ugcagacaagccuucagg

SEQ ID NO: 2493956 - RNA, 22 nt, Chlamydia trachomatis
ugcagacaagccuucaggauuc

SEQ ID NO: 2493957 - RNA, 16 nt, Chlamydia trachomatis
ugcagagaucauacca

SEQ ID NO: 2493958 - RNA, 20 nt, Chlamydia trachomatis
ugcagaggggggcuugcaca

SEQ ID NO: 2493959 - RNA, 20 nt, Chlamydia trachomatis
ugcagaucccagccugugca

SEQ ID NO: 2493960 - RNA, 14 nt, Chlamydia trachomatis
ugcagcuaaagaau

SEQ ID NO: 2493961 - RNA, 17 nt, Chlamydia trachomatis
ugcaggauauccaucaa

SEQ ID NO: 2493962 - RNA, 20 nt, Chlamydia trachomatis
ugcaggauauccaucaauca

SEQ ID NO: 2493963 - RNA, 18 nt, Chlamydia trachomatis
ugcaggcgagucuuucua

SEQ ID NO: 2493964 - RNA, 19 nt, Chlamydia trachomatis
ugcagggcuugggaucuuc

SEQ ID NO: 2493965 - RNA, 18 nt, Chlamydia trachomatis
ugcaguaccauuacuaca

SEQ ID NO: 2493966 - RNA, 19 nt, Chlamydia trachomatis
ugcaguaccauuacuacaa

SEQ ID NO: 2493967 - RNA, 11 nt, Chlamydia trachomatis
ugcagugacau

SEQ ID NO: 2493968 - RNA, 14 nt, Chlamydia trachomatis
ugcauaaaagccug

SEQ ID NO: 2493969 - RNA, 19 nt, Chlamydia trachomatis
ugcauaaggaagcaaaaac

SEQ ID NO: 2493970 - RNA, 22 nt, Chlamydia trachomatis
ugcauaccaagcuuucugccaa

SEQ ID NO: 2493971 - RNA, 20 nt, Chlamydia trachomatis
ugcauacuucccacauacuu

SEQ ID NO: 2493972 - RNA, 11 nt, Chlamydia trachomatis
ugcauagcuug

SEQ ID NO: 2493973 - RNA, 14 nt, Chlamydia trachomatis
ugcauagucuucag

SEQ ID NO: 2493974 - RNA, 17 nt, Chlamydia trachomatis
ugcauauuuaauugcau

SEQ ID NO: 2493975 - RNA, 20 nt, Chlamydia trachomatis
ugcauauuuaauugcauuaa

SEQ ID NO: 2493976 - RNA, 12 nt, Chlamydia trachomatis
ugcaucauguug

SEQ ID NO: 2493977 - RNA, 21 nt, Chlamydia trachomatis
ugcaucauguugcguuuguaa

SEQ ID NO: 2493978 - RNA, 18 nt, Chlamydia trachomatis
ugcaucugauguuccauc

SEQ ID NO: 2493979 - RNA, 19 nt, Chlamydia trachomatis
ugcauguaaucccuuuuuc

SEQ ID NO: 2493980 - RNA, 15 nt, Chlamydia trachomatis
ugcauucuuuuaaga

SEQ ID NO: 2493981 - RNA, 21 nt, Chlamydia trachomatis
ugcauuuaaaugaauguggug

SEQ ID NO: 2493982 - RNA, 17 nt, Chlamydia trachomatis
ugccaaaaagaaaauca

SEQ ID NO: 2493983 - RNA, 21 nt, Chlamydia trachomatis
ugccaaaaagaaaaucagaaa

SEQ ID NO: 2493984 - RNA, 22 nt, Chlamydia trachomatis
ugccaaagacaaauugcacuaa

SEQ ID NO: 2493985 - RNA, 20 nt, Chlamydia trachomatis
ugccaauugucaaggcuccg

SEQ ID NO: 2493986 - RNA, 12 nt, Chlamydia trachomatis
ugccacacuucc

SEQ ID NO: 2493987 - RNA, 14 nt, Chlamydia trachomatis
ugccacuacuucag

SEQ ID NO: 2493988 - RNA, 17 nt, Chlamydia trachomatis
ugccacuacuucaggau

SEQ ID NO: 2493989 - RNA, 15 nt, Chlamydia trachomatis
ugccagcugcugcuu

SEQ ID NO: 2493990 - RNA, 14 nt, Chlamydia trachomatis
ugccauccauaacg

SEQ ID NO: 2493991 - RNA, 15 nt, Chlamydia trachomatis
ugccauuucuaaagg

SEQ ID NO: 2493992 - RNA, 14 nt, Chlamydia trachomatis
ugcccaaacuccau

SEQ ID NO: 2493993 - RNA, 13 nt, Chlamydia trachomatis
ugcccagucaaga

SEQ ID NO: 2493994 - RNA, 13 nt, Chlamydia trachomatis
ugcccaucaucga

SEQ ID NO: 2493995 - RNA, 17 nt, Chlamydia trachomatis
ugcccuuugugcauaaa

SEQ ID NO: 2493996 - RNA, 14 nt, Chlamydia trachomatis
ugccgaaacuucuc

SEQ ID NO: 2493997 - RNA, 16 nt, Chlamydia trachomatis
ugccgaacucuccucu

SEQ ID NO: 2493998 - RNA, 12 nt, Chlamydia trachomatis
ugccgaauaaug

SEQ ID NO: 2493999 - RNA, 16 nt, Chlamydia trachomatis
ugccuaacgauucccc

SEQ ID NO: 2494000 - RNA, 20 nt, Chlamydia trachomatis
ugccuauagcaggauuuucu

SEQ ID NO: 2494001 - RNA, 12 nt, Chlamydia trachomatis
ugccucuaacac

SEQ ID NO: 2494002 - RNA, 15 nt, Chlamydia trachomatis
ugccucuaagcaccu

SEQ ID NO: 2494003 - RNA, 16 nt, Chlamydia trachomatis
ugccuguggcaacuaa

SEQ ID NO: 2494004 - RNA, 21 nt, Chlamydia trachomatis
ugccuugaggauaguauucuu

SEQ ID NO: 2494005 - RNA, 22 nt, Chlamydia trachomatis
ugccuugaggauaguauucuuu

SEQ ID NO: 2494006 - RNA, 21 nt, Chlamydia trachomatis
ugccuuuaggaagaaugacaa

SEQ ID NO: 2494007 - RNA, 22 nt, Chlamydia trachomatis
ugccuuuaucucccccuguacc

SEQ ID NO: 2494008 - RNA, 21 nt, Chlamydia trachomatis
ugccuuucguuagaaagguug

SEQ ID NO: 2494009 - RNA, 19 nt, Chlamydia trachomatis
ugccuuuugauucugcuuu

SEQ ID NO: 2494010 - RNA, 16 nt, Chlamydia trachomatis
ugcgaagguucaagau

SEQ ID NO: 2494011 - RNA, 21 nt, Chlamydia trachomatis
ugcgacaguaccgucacucuu

SEQ ID NO: 2494012 - RNA, 18 nt, Chlamydia trachomatis
ugcgauaacaacaauaaa

SEQ ID NO: 2494013 - RNA, 13 nt, Chlamydia trachomatis
ugcgauagaugua

SEQ ID NO: 2494014 - RNA, 18 nt, Chlamydia trachomatis
ugcgaugccucuaacacu

SEQ ID NO: 2494015 - RNA, 14 nt, Chlamydia trachomatis
ugcgauuacuucag

SEQ ID NO: 2494016 - RNA, 17 nt, Chlamydia trachomatis
ugcgauuuuuuuuauua

SEQ ID NO: 2494017 - RNA, 13 nt, Chlamydia trachomatis
ugcgcaacguuuc

SEQ ID NO: 2494018 - RNA, 16 nt, Chlamydia trachomatis
ugcgcauacacaucaa

SEQ ID NO: 2494019 - RNA, 23 nt, Chlamydia trachomatis
ugcgcauacacaucaaaaugaua

SEQ ID NO: 2494020 - RNA, 14 nt, Chlamydia trachomatis
ugcgcaucaaagga

SEQ ID NO: 2494021 - RNA, 14 nt, Chlamydia trachomatis
ugcgcaucacgaag

SEQ ID NO: 2494022 - RNA, 19 nt, Chlamydia trachomatis
ugcgcggaaggaaaaagaa

SEQ ID NO: 2494023 - RNA, 14 nt, Chlamydia trachomatis
ugcguauuugaaau

SEQ ID NO: 2494024 - RNA, 16 nt, Chlamydia trachomatis
ugcguauuugaaauca

SEQ ID NO: 2494025 - RNA, 18 nt, Chlamydia trachomatis
ugcguauuugaaaucaaa

SEQ ID NO: 2494026 - RNA, 23 nt, Chlamydia trachomatis
ugcguauuugaaaucaaaaggcc

SEQ ID NO: 2494027 - RNA, 13 nt, Chlamydia trachomatis
ugcguuucuucug

SEQ ID NO: 2494028 - RNA, 14 nt, Chlamydia trachomatis
ugcuaaaaaugcuu

SEQ ID NO: 2494029 - RNA, 13 nt, Chlamydia trachomatis
ugcuaacaaagaa

SEQ ID NO: 2494030 - RNA, 14 nt, Chlamydia trachomatis
ugcuaacaaagaau

SEQ ID NO: 2494031 - RNA, 19 nt, Chlamydia trachomatis
ugcuaacaaagaauuuucc

SEQ ID NO: 2494032 - RNA, 12 nt, Chlamydia trachomatis
ugcuaacuuucu

SEQ ID NO: 2494033 - RNA, 13 nt, Chlamydia trachomatis
ugcuaaggaaaga

SEQ ID NO: 2494034 - RNA, 22 nt, Chlamydia trachomatis
ugcuaauguagacccugcauua

SEQ ID NO: 2494035 - RNA, 15 nt, Chlamydia trachomatis
ugcuacaaaagaagc

SEQ ID NO: 2494036 - RNA, 22 nt, Chlamydia trachomatis
ugcuacaguaucugcuaguccu

SEQ ID NO: 2494037 - RNA, 16 nt, Chlamydia trachomatis
ugcuacggaaaccaau

SEQ ID NO: 2494038 - RNA, 19 nt, Chlamydia trachomatis
ugcuacggaaaccaauaaa

SEQ ID NO: 2494039 - RNA, 17 nt, Chlamydia trachomatis
ugcuaugaaaaauccuu

SEQ ID NO: 2494040 - RNA, 20 nt, Chlamydia trachomatis
ugcuaugaaaaauccuucca

SEQ ID NO: 2494041 - RNA, 19 nt, Chlamydia trachomatis
ugcuaugguccccauaaga

SEQ ID NO: 2494042 - RNA, 19 nt, Chlamydia trachomatis
ugcuauuacauauaggcug

SEQ ID NO: 2494043 - RNA, 23 nt, Chlamydia trachomatis
ugcucaaagauuuuaugacccag

SEQ ID NO: 2494044 - RNA, 22 nt, Chlamydia trachomatis
ugcucaacauagaucccuuuca

SEQ ID NO: 2494045 - RNA, 17 nt, Chlamydia trachomatis
ugcucagagaucccagg

SEQ ID NO: 2494046 - RNA, 14 nt, Chlamydia trachomatis
ugcucagggcuaua

SEQ ID NO: 2494047 - RNA, 14 nt, Chlamydia trachomatis
ugcucauuuccuau

SEQ ID NO: 2494048 - RNA, 22 nt, Chlamydia trachomatis
ugcuccacaacacgucuuaaag

SEQ ID NO: 2494049 - RNA, 16 nt, Chlamydia trachomatis
ugcuccggcaaauccu

SEQ ID NO: 2494050 - RNA, 14 nt, Chlamydia trachomatis
ugcuccuacaaaau

SEQ ID NO: 2494051 - RNA, 23 nt, Chlamydia trachomatis
ugcucggauaggcugaggauucc

SEQ ID NO: 2494052 - RNA, 20 nt, Chlamydia trachomatis
ugcucuaaagucuuuccauu

SEQ ID NO: 2494053 - RNA, 20 nt, Chlamydia trachomatis
ugcucuaaccaccugagcua

SEQ ID NO: 2494054 - RNA, 14 nt, Chlamydia trachomatis
ugcucuaccaacug

SEQ ID NO: 2494055 - RNA, 22 nt, Chlamydia trachomatis
ugcucuauaggcaaaagaugau

SEQ ID NO: 2494056 - RNA, 13 nt, Chlamydia trachomatis
ugcucuugaagau

SEQ ID NO: 2494057 - RNA, 22 nt, Chlamydia trachomatis
ugcucuuucccgauauguucag

SEQ ID NO: 2494058 - RNA, 14 nt, Chlamydia trachomatis
ugcugaagcuacua

SEQ ID NO: 2494059 - RNA, 18 nt, Chlamydia trachomatis
ugcugaauauucccgaac

SEQ ID NO: 2494060 - RNA, 14 nt, Chlamydia trachomatis
ugcugaaugguggc

SEQ ID NO: 2494061 - RNA, 21 nt, Chlamydia trachomatis
ugcugagcauuucucucgcug

SEQ ID NO: 2494062 - RNA, 14 nt, Chlamydia trachomatis
ugcugcagaaaucc

SEQ ID NO: 2494063 - RNA, 11 nt, Chlamydia trachomatis
ugcugcagauu

SEQ ID NO: 2494064 - RNA, 21 nt, Chlamydia trachomatis
ugcugcuaucaucuuuugccu

SEQ ID NO: 2494065 - RNA, 14 nt, Chlamydia trachomatis
ugcugcuuggaaua

SEQ ID NO: 2494066 - RNA, 13 nt, Chlamydia trachomatis
ugcuguaaaacau

SEQ ID NO: 2494067 - RNA, 12 nt, Chlamydia trachomatis
ugcuguacgaac

SEQ ID NO: 2494068 - RNA, 14 nt, Chlamydia trachomatis
ugcugucagaagaa

SEQ ID NO: 2494069 - RNA, 15 nt, Chlamydia trachomatis
ugcugucagaagaau

SEQ ID NO: 2494070 - RNA, 15 nt, Chlamydia trachomatis
ugcugucuugucuuu

SEQ ID NO: 2494071 - RNA, 18 nt, Chlamydia trachomatis
ugcuuaacacuucuuuag

SEQ ID NO: 2494072 - RNA, 20 nt, Chlamydia trachomatis
ugcuucaaaaaagauuuccc

SEQ ID NO: 2494073 - RNA, 12 nt, Chlamydia trachomatis
ugcuucacagcu

SEQ ID NO: 2494074 - RNA, 15 nt, Chlamydia trachomatis
ugcuuccgaaagcau

SEQ ID NO: 2494075 - RNA, 24 nt, Chlamydia trachomatis
ugcuucgccaaacacugcaacagu

SEQ ID NO: 2494076 - RNA, 23 nt, Chlamydia trachomatis
ugcuucuggacuauuuucaaaac

SEQ ID NO: 2494077 - RNA, 14 nt, Chlamydia trachomatis
ugcuuuaaaugcug

SEQ ID NO: 2494078 - RNA, 17 nt, Chlamydia trachomatis
ugcuuuacgaaauagga

SEQ ID NO: 2494079 - RNA, 19 nt, Chlamydia trachomatis
ugcuuuccuuaguuuuaau

SEQ ID NO: 2494080 - RNA, 17 nt, Chlamydia trachomatis
ugcuuucuugaggaaga

SEQ ID NO: 2494081 - RNA, 17 nt, Chlamydia trachomatis
ugcuuuguagauacugg

SEQ ID NO: 2494082 - RNA, 17 nt, Chlamydia trachomatis
ugcuuuuuaauauccuc

SEQ ID NO: 2494083 - RNA, 20 nt, Chlamydia trachomatis
ugcuuuuuaauauccuccaa

SEQ ID NO: 2494084 - RNA, 21 nt, Chlamydia trachomatis
uggaaauguuugaucugagaa

SEQ ID NO: 2494085 - RNA, 22 nt, Chlamydia trachomatis
uggaaauguuugaucugagaaa

SEQ ID NO: 2494086 - RNA, 13 nt, Chlamydia trachomatis
uggaacagcucua

SEQ ID NO: 2494087 - RNA, 18 nt, Chlamydia trachomatis
uggaacauacuucugaau

SEQ ID NO: 2494088 - RNA, 16 nt, Chlamydia trachomatis
uggaagaacagcagca

SEQ ID NO: 2494089 - RNA, 18 nt, Chlamydia trachomatis
uggaagauagaagauucg

SEQ ID NO: 2494090 - RNA, 24 nt, Chlamydia trachomatis
uggaagaucucuuucucuagaauu

SEQ ID NO: 2494091 - RNA, 21 nt, Chlamydia trachomatis
uggaagcagaaagaaugcuug

SEQ ID NO: 2494092 - RNA, 13 nt, Chlamydia trachomatis
uggaauagcuucu

SEQ ID NO: 2494093 - RNA, 15 nt, Chlamydia trachomatis
uggaaucauauccuu

SEQ ID NO: 2494094 - RNA, 14 nt, Chlamydia trachomatis
uggaauuguaucca

SEQ ID NO: 2494095 - RNA, 17 nt, Chlamydia trachomatis
uggaauuuucaucaaaa

SEQ ID NO: 2494096 - RNA, 18 nt, Chlamydia trachomatis
uggacaaaaaucucaaag

SEQ ID NO: 2494097 - RNA, 19 nt, Chlamydia trachomatis
uggacaaagguguuuucua

SEQ ID NO: 2494098 - RNA, 15 nt, Chlamydia trachomatis
uggacaagcaauagc

SEQ ID NO: 2494099 - RNA, 17 nt, Chlamydia trachomatis
uggacacuuucaucaag

SEQ ID NO: 2494100 - RNA, 18 nt, Chlamydia trachomatis
uggaccagaucauagaaa

SEQ ID NO: 2494101 - RNA, 11 nt, Chlamydia trachomatis
uggacucagaa

SEQ ID NO: 2494102 - RNA, 17 nt, Chlamydia trachomatis
uggacuucccuaauaca

SEQ ID NO: 2494103 - RNA, 15 nt, Chlamydia trachomatis
uggacuuuagauagu

SEQ ID NO: 2494104 - RNA, 17 nt, Chlamydia trachomatis
uggacuuucuaccgcgg

SEQ ID NO: 2494105 - RNA, 16 nt, Chlamydia trachomatis
uggagaauuggaaacu

SEQ ID NO: 2494106 - RNA, 17 nt, Chlamydia trachomatis
uggagaauuggaaacuc

SEQ ID NO: 2494107 - RNA, 17 nt, Chlamydia trachomatis
uggagaggcuauauagu

SEQ ID NO: 2494108 - RNA, 19 nt, Chlamydia trachomatis
uggagagucuggacgaugc

SEQ ID NO: 2494109 - RNA, 20 nt, Chlamydia trachomatis
uggagauugaauaaaucuau

SEQ ID NO: 2494110 - RNA, 14 nt, Chlamydia trachomatis
uggagcauaaagaa

SEQ ID NO: 2494111 - RNA, 18 nt, Chlamydia trachomatis
uggagcuaucauuuccaa

SEQ ID NO: 2494112 - RNA, 21 nt, Chlamydia trachomatis
uggaggaggaccucugucaau

SEQ ID NO: 2494113 - RNA, 15 nt, Chlamydia trachomatis
uggaguauuuucaaa

SEQ ID NO: 2494114 - RNA, 16 nt, Chlamydia trachomatis
uggaguguagagaaac

SEQ ID NO: 2494115 - RNA, 23 nt, Chlamydia trachomatis
uggaguguggaagcuagaagaag

SEQ ID NO: 2494116 - RNA, 13 nt, Chlamydia trachomatis
uggauaaaauucc

SEQ ID NO: 2494117 - RNA, 16 nt, Chlamydia trachomatis
uggauaagaacuucuc

SEQ ID NO: 2494118 - RNA, 14 nt, Chlamydia trachomatis
uggauaaucucuga

SEQ ID NO: 2494119 - RNA, 23 nt, Chlamydia trachomatis
uggauaguccuucggagagcagu

SEQ ID NO: 2494120 - RNA, 14 nt, Chlamydia trachomatis
uggauaguuucuuu

SEQ ID NO: 2494121 - RNA, 23 nt, Chlamydia trachomatis
uggauaugccugcaaaaaggcuu

SEQ ID NO: 2494122 - RNA, 12 nt, Chlamydia trachomatis
uggaucagcucc

SEQ ID NO: 2494123 - RNA, 22 nt, Chlamydia trachomatis
uggauccaaaaaagaaucuaaa

SEQ ID NO: 2494124 - RNA, 13 nt, Chlamydia trachomatis
uggaucucuuaga

SEQ ID NO: 2494125 - RNA, 13 nt, Chlamydia trachomatis
uggaugcacaucc

SEQ ID NO: 2494126 - RNA, 18 nt, Chlamydia trachomatis
uggaugcguuaauccuuu

SEQ ID NO: 2494127 - RNA, 20 nt, Chlamydia trachomatis
uggaugcguuaauccuuuga

SEQ ID NO: 2494128 - RNA, 15 nt, Chlamydia trachomatis
uggauguacugcgca

SEQ ID NO: 2494129 - RNA, 13 nt, Chlamydia trachomatis
uggauuucuucug

SEQ ID NO: 2494130 - RNA, 21 nt, Chlamydia trachomatis
uggauuucuucuguuuuuuca

SEQ ID NO: 2494131 - RNA, 20 nt, Chlamydia trachomatis
uggauuugcguuacagaugc

SEQ ID NO: 2494132 - RNA, 18 nt, Chlamydia trachomatis
uggcaaaaucuucauaag

SEQ ID NO: 2494133 - RNA, 20 nt, Chlamydia trachomatis
uggcaaagagcuucuagaaa

SEQ ID NO: 2494134 - RNA, 21 nt, Chlamydia trachomatis
uggcaaggcuuucaaaaagag

SEQ ID NO: 2494135 - RNA, 15 nt, Chlamydia trachomatis
uggcacacuccaucu

SEQ ID NO: 2494136 - RNA, 23 nt, Chlamydia trachomatis
uggcaccuuuuuugcuaaaagaa

SEQ ID NO: 2494137 - RNA, 22 nt, Chlamydia trachomatis
uggcacggagaucauagacugu

SEQ ID NO: 2494138 - RNA, 12 nt, Chlamydia trachomatis
uggcagaacucg

SEQ ID NO: 2494139 - RNA, 21 nt, Chlamydia trachomatis
uggcauucaaccucucaucag

SEQ ID NO: 2494140 - RNA, 14 nt, Chlamydia trachomatis
uggccaaaaaauca

SEQ ID NO: 2494141 - RNA, 17 nt, Chlamydia trachomatis
uggccauucuuacuaaa

SEQ ID NO: 2494142 - RNA, 19 nt, Chlamydia trachomatis
uggcgguguuucuguuuuc

SEQ ID NO: 2494143 - RNA, 21 nt, Chlamydia trachomatis
uggcuaagccauugcuaccga

SEQ ID NO: 2494144 - RNA, 19 nt, Chlamydia trachomatis
uggcucuuuaauauuuccc

SEQ ID NO: 2494145 - RNA, 14 nt, Chlamydia trachomatis
uggcugcagaagac

SEQ ID NO: 2494146 - RNA, 21 nt, Chlamydia trachomatis
uggcugcaggauauccaucaa

SEQ ID NO: 2494147 - RNA, 18 nt, Chlamydia trachomatis
uggcugcggauucagaag

SEQ ID NO: 2494148 - RNA, 11 nt, Chlamydia trachomatis
uggcuucuuuu

SEQ ID NO: 2494149 - RNA, 19 nt, Chlamydia trachomatis
uggcuugcgcaaucauauc

SEQ ID NO: 2494150 - RNA, 13 nt, Chlamydia trachomatis
ugggaaaauuaaa

SEQ ID NO: 2494151 - RNA, 18 nt, Chlamydia trachomatis
ugggaaaauuaaaaggcg

SEQ ID NO: 2494152 - RNA, 15 nt, Chlamydia trachomatis
ugggagauuccacaa

SEQ ID NO: 2494153 - RNA, 16 nt, Chlamydia trachomatis
ugggagauuccacaac

SEQ ID NO: 2494154 - RNA, 14 nt, Chlamydia trachomatis
ugggauaagaaauc

SEQ ID NO: 2494155 - RNA, 15 nt, Chlamydia trachomatis
ugggauaagaaaucu

SEQ ID NO: 2494156 - RNA, 19 nt, Chlamydia trachomatis
ugggauaugccucuaagca

SEQ ID NO: 2494157 - RNA, 15 nt, Chlamydia trachomatis
ugggaucuucgucag

SEQ ID NO: 2494158 - RNA, 21 nt, Chlamydia trachomatis
ugggaucuucgucagggagaa

SEQ ID NO: 2494159 - RNA, 22 nt, Chlamydia trachomatis
ugggauuucgauuaaugagguu

SEQ ID NO: 2494160 - RNA, 15 nt, Chlamydia trachomatis
ugggcagcaagagag

SEQ ID NO: 2494161 - RNA, 20 nt, Chlamydia trachomatis
uggggggauugggggcggca

SEQ ID NO: 2494162 - RNA, 19 nt, Chlamydia trachomatis
ugguaagggguuuucuugg

SEQ ID NO: 2494163 - RNA, 15 nt, Chlamydia trachomatis
ugguaccuucucaaa

SEQ ID NO: 2494164 - RNA, 14 nt, Chlamydia trachomatis
ugguacuucauuuu

SEQ ID NO: 2494165 - RNA, 20 nt, Chlamydia trachomatis
ugguacuucauuuuugcuaa

SEQ ID NO: 2494166 - RNA, 18 nt, Chlamydia trachomatis
ugguagagcaacgcauuc

SEQ ID NO: 2494167 - RNA, 14 nt, Chlamydia trachomatis
ugguagagcauacu

SEQ ID NO: 2494168 - RNA, 17 nt, Chlamydia trachomatis
ugguagcagcuagaaca

SEQ ID NO: 2494169 - RNA, 19 nt, Chlamydia trachomatis
ugguagcagcuagaacaua

SEQ ID NO: 2494170 - RNA, 13 nt, Chlamydia trachomatis
ugguaguuucuuc

SEQ ID NO: 2494171 - RNA, 14 nt, Chlamydia trachomatis
ugguauucuaaagu

SEQ ID NO: 2494172 - RNA, 21 nt, Chlamydia trachomatis
ugguauucuaaauaggaugga

SEQ ID NO: 2494173 - RNA, 18 nt, Chlamydia trachomatis
ugguauucugcagaaaaa

SEQ ID NO: 2494174 - RNA, 17 nt, Chlamydia trachomatis
ugguccaugauuucuuu

SEQ ID NO: 2494175 - RNA, 21 nt, Chlamydia trachomatis
uggucgggaaacauuccaaau

SEQ ID NO: 2494176 - RNA, 22 nt, Chlamydia trachomatis
uggucuacuccgaucaauucau

SEQ ID NO: 2494177 - RNA, 11 nt, Chlamydia trachomatis
uggucuuuauu

SEQ ID NO: 2494178 - RNA, 15 nt, Chlamydia trachomatis
uggugagugcauaga

SEQ ID NO: 2494179 - RNA, 13 nt, Chlamydia trachomatis
ugguguaggaaaa

SEQ ID NO: 2494180 - RNA, 17 nt, Chlamydia trachomatis
ugguguggaguaucuaa

SEQ ID NO: 2494181 - RNA, 23 nt, Chlamydia trachomatis
ugguuaccugugaagaaacuucu

SEQ ID NO: 2494182 - RNA, 18 nt, Chlamydia trachomatis
ugguucccugcaccucuu

SEQ ID NO: 2494183 - RNA, 20 nt, Chlamydia trachomatis
ugguucccugcaccucuuuc

SEQ ID NO: 2494184 - RNA, 17 nt, Chlamydia trachomatis
ugguuguagaggagaag

SEQ ID NO: 2494185 - RNA, 21 nt, Chlamydia trachomatis
ugguugugaaaagggcaaaac

SEQ ID NO: 2494186 - RNA, 13 nt, Chlamydia trachomatis
ugguugugcucga

SEQ ID NO: 2494187 - RNA, 18 nt, Chlamydia trachomatis
ugguuucuagcugauaag

SEQ ID NO: 2494188 - RNA, 14 nt, Chlamydia trachomatis
ugguuucuuaaaca

SEQ ID NO: 2494189 - RNA, 12 nt, Chlamydia trachomatis
ugguuuucuugu

SEQ ID NO: 2494190 - RNA, 19 nt, Chlamydia trachomatis
ugguuuucuuguucuuuua

SEQ ID NO: 2494191 - RNA, 22 nt, Chlamydia trachomatis
ugguuuuuuuuguuauccaaaa

SEQ ID NO: 2494192 - RNA, 17 nt, Chlamydia trachomatis
uguaaaaauucuaaagu

SEQ ID NO: 2494193 - RNA, 20 nt, Chlamydia trachomatis
uguaaaaugagaaauaaaaa

SEQ ID NO: 2494194 - RNA, 13 nt, Chlamydia trachomatis
uguaaagcugcuu

SEQ ID NO: 2494195 - RNA, 23 nt, Chlamydia trachomatis
uguaaauuuucaauagcaaugaa

SEQ ID NO: 2494196 - RNA, 13 nt, Chlamydia trachomatis
uguaaccuucccg

SEQ ID NO: 2494197 - RNA, 16 nt, Chlamydia trachomatis
uguaacgaaguuagca

SEQ ID NO: 2494198 - RNA, 17 nt, Chlamydia trachomatis
uguaacgaaguuagcau

SEQ ID NO: 2494199 - RNA, 15 nt, Chlamydia trachomatis
uguaacuaagcuucu

SEQ ID NO: 2494200 - RNA, 20 nt, Chlamydia trachomatis
uguaaggagagaaaagagga

SEQ ID NO: 2494201 - RNA, 23 nt, Chlamydia trachomatis
uguaaguccuuacauaaaaaagc

SEQ ID NO: 2494202 - RNA, 16 nt, Chlamydia trachomatis
uguaauguccucuuua

SEQ ID NO: 2494203 - RNA, 21 nt, Chlamydia trachomatis
uguaauugggggacuucauua

SEQ ID NO: 2494204 - RNA, 23 nt, Chlamydia trachomatis
uguacaccaccgcaugaaaguag

SEQ ID NO: 2494205 - RNA, 18 nt, Chlamydia trachomatis
uguacacgcugaguuucc

SEQ ID NO: 2494206 - RNA, 14 nt, Chlamydia trachomatis
uguacagagaaaaa

SEQ ID NO: 2494207 - RNA, 18 nt, Chlamydia trachomatis
uguacagagaaaaagauu

SEQ ID NO: 2494208 - RNA, 20 nt, Chlamydia trachomatis
uguacagcgacacguuuucc

SEQ ID NO: 2494209 - RNA, 22 nt, Chlamydia trachomatis
uguacccguuaagaccugugca

SEQ ID NO: 2494210 - RNA, 19 nt, Chlamydia trachomatis
uguacgauggaaauaggac

SEQ ID NO: 2494211 - RNA, 14 nt, Chlamydia trachomatis
uguacgcucuuucc

SEQ ID NO: 2494212 - RNA, 18 nt, Chlamydia trachomatis
uguagaaagcugggaaau

SEQ ID NO: 2494213 - RNA, 21 nt, Chlamydia trachomatis
uguagaaagcugggaaaucuu

SEQ ID NO: 2494214 - RNA, 16 nt, Chlamydia trachomatis
uguagaaauuuuaaau

SEQ ID NO: 2494215 - RNA, 21 nt, Chlamydia trachomatis
uguagagaggcaaacaccuca

SEQ ID NO: 2494216 - RNA, 15 nt, Chlamydia trachomatis
uguagagccaugauc

SEQ ID NO: 2494217 - RNA, 19 nt, Chlamydia trachomatis
uguagauacugguaacugu

SEQ ID NO: 2494218 - RNA, 17 nt, Chlamydia trachomatis
uguagaugcuguacgaa

SEQ ID NO: 2494219 - RNA, 18 nt, Chlamydia trachomatis
uguagaugcuguacgaac

SEQ ID NO: 2494220 - RNA, 14 nt, Chlamydia trachomatis
uguagauguagcag

SEQ ID NO: 2494221 - RNA, 22 nt, Chlamydia trachomatis
uguagcugucccccagauaacu

SEQ ID NO: 2494222 - RNA, 19 nt, Chlamydia trachomatis
uguaggagagaaucuuuua

SEQ ID NO: 2494223 - RNA, 19 nt, Chlamydia trachomatis
uguaggauucagagaggug

SEQ ID NO: 2494224 - RNA, 19 nt, Chlamydia trachomatis
uguaggggaaauagcgauu

SEQ ID NO: 2494225 - RNA, 14 nt, Chlamydia trachomatis
uguaggguagaaca

SEQ ID NO: 2494226 - RNA, 23 nt, Chlamydia trachomatis
uguaguucuaacaucaacugauu

SEQ ID NO: 2494227 - RNA, 21 nt, Chlamydia trachomatis
uguauaacaauuuuaaaaucu

SEQ ID NO: 2494228 - RNA, 20 nt, Chlamydia trachomatis
uguauaagaaaaaggucucc

SEQ ID NO: 2494229 - RNA, 13 nt, Chlamydia trachomatis
uguauuuccuucg

SEQ ID NO: 2494230 - RNA, 21 nt, Chlamydia trachomatis
ugucacagacuccuuacccug

SEQ ID NO: 2494231 - RNA, 17 nt, Chlamydia trachomatis
ugucacugcuuccgaaa

SEQ ID NO: 2494232 - RNA, 14 nt, Chlamydia trachomatis
ugucagaccuacaa

SEQ ID NO: 2494233 - RNA, 20 nt, Chlamydia trachomatis
ugucagaccuacaaagauaa

SEQ ID NO: 2494234 - RNA, 19 nt, Chlamydia trachomatis
ugucaggauuuaaagccuu

SEQ ID NO: 2494235 - RNA, 22 nt, Chlamydia trachomatis
ugucaggcgauaugcuacuccu

SEQ ID NO: 2494236 - RNA, 14 nt, Chlamydia trachomatis
uguccaaagcucuu

SEQ ID NO: 2494237 - RNA, 19 nt, Chlamydia trachomatis
ugucccccagauaacuggu

SEQ ID NO: 2494238 - RNA, 23 nt, Chlamydia trachomatis
ugucccccugguagaaagcuaca

SEQ ID NO: 2494239 - RNA, 13 nt, Chlamydia trachomatis
ugucccugcuccg

SEQ ID NO: 2494240 - RNA, 14 nt, Chlamydia trachomatis
uguccuggccaaaa

SEQ ID NO: 2494241 - RNA, 14 nt, Chlamydia trachomatis
uguccuuuauucaa

SEQ ID NO: 2494242 - RNA, 13 nt, Chlamydia trachomatis
ugucgaacgcuuc

SEQ ID NO: 2494243 - RNA, 17 nt, Chlamydia trachomatis
ugucgaacgcuucuucc

SEQ ID NO: 2494244 - RNA, 18 nt, Chlamydia trachomatis
ugucgaacgcuucuuccc

SEQ ID NO: 2494245 - RNA, 16 nt, Chlamydia trachomatis
ugucgagauaaaaacc

SEQ ID NO: 2494246 - RNA, 22 nt, Chlamydia trachomatis
ugucgauaaaguaaaggaugau

SEQ ID NO: 2494247 - RNA, 15 nt, Chlamydia trachomatis
ugucguuaaagaauu

SEQ ID NO: 2494248 - RNA, 22 nt, Chlamydia trachomatis
ugucguuaaagaauuauuugcc

SEQ ID NO: 2494249 - RNA, 16 nt, Chlamydia trachomatis
ugucguugguucaagu

SEQ ID NO: 2494250 - RNA, 15 nt, Chlamydia trachomatis
ugucuauaaauuaua

SEQ ID NO: 2494251 - RNA, 21 nt, Chlamydia trachomatis
ugucuccaggagagucugcua

SEQ ID NO: 2494252 - RNA, 14 nt, Chlamydia trachomatis
ugucuccuucuuug

SEQ ID NO: 2494253 - RNA, 18 nt, Chlamydia trachomatis
ugucuccuucuuugacaa

SEQ ID NO: 2494254 - RNA, 20 nt, Chlamydia trachomatis
ugucucucgaauagcuccca

SEQ ID NO: 2494255 - RNA, 15 nt, Chlamydia trachomatis
ugucuguugaaagcu

SEQ ID NO: 2494256 - RNA, 16 nt, Chlamydia trachomatis
ugucuguugaaagcua

SEQ ID NO: 2494257 - RNA, 16 nt, Chlamydia trachomatis
ugucuucgcaaacugc

SEQ ID NO: 2494258 - RNA, 17 nt, Chlamydia trachomatis
ugucuucgcaaacugcu

SEQ ID NO: 2494259 - RNA, 22 nt, Chlamydia trachomatis
ugucuucgcaaacugcucuucu

SEQ ID NO: 2494260 - RNA, 19 nt, Chlamydia trachomatis
ugucuucuuucaaagaagc

SEQ ID NO: 2494261 - RNA, 18 nt, Chlamydia trachomatis
ugucuuguaacuaagcuu

SEQ ID NO: 2494262 - RNA, 17 nt, Chlamydia trachomatis
ugucuugucuuugcucu

SEQ ID NO: 2494263 - RNA, 12 nt, Chlamydia trachomatis
ugugaaaauaag

SEQ ID NO: 2494264 - RNA, 20 nt, Chlamydia trachomatis
ugugaauaggaagaauaaua

SEQ ID NO: 2494265 - RNA, 12 nt, Chlamydia trachomatis
ugugaggaaagc

SEQ ID NO: 2494266 - RNA, 14 nt, Chlamydia trachomatis
ugugaguccacaug

SEQ ID NO: 2494267 - RNA, 17 nt, Chlamydia trachomatis
ugugaguuauauuuagg

SEQ ID NO: 2494268 - RNA, 18 nt, Chlamydia trachomatis
ugugaguuauauuuagga

SEQ ID NO: 2494269 - RNA, 16 nt, Chlamydia trachomatis
ugugauaggagaggau

SEQ ID NO: 2494270 - RNA, 23 nt, Chlamydia trachomatis
ugugaugaaaccuaauagaaaua

SEQ ID NO: 2494271 - RNA, 23 nt, Chlamydia trachomatis
ugugauucgcaucaaugauguag

SEQ ID NO: 2494272 - RNA, 21 nt, Chlamydia trachomatis
ugugauuuuucgcuaucccca

SEQ ID NO: 2494273 - RNA, 22 nt, Chlamydia trachomatis
ugugcaccgugcucgaaacuca

SEQ ID NO: 2494274 - RNA, 22 nt, Chlamydia trachomatis
ugugcauuuguggacacuuuca

SEQ ID NO: 2494275 - RNA, 20 nt, Chlamydia trachomatis
ugugccucuaggcauaguug

SEQ ID NO: 2494276 - RNA, 21 nt, Chlamydia trachomatis
ugugcuaaaucuccaaaauuc

SEQ ID NO: 2494277 - RNA, 24 nt, Chlamydia trachomatis
uguggacgaacaaaaaguuugcca

SEQ ID NO: 2494278 - RNA, 19 nt, Chlamydia trachomatis
uguggagcuaucauuucca

SEQ ID NO: 2494279 - RNA, 17 nt, Chlamydia trachomatis
ugugggauagaaacuca

SEQ ID NO: 2494280 - RNA, 14 nt, Chlamydia trachomatis
ugugggcuuuaauc

SEQ ID NO: 2494281 - RNA, 21 nt, Chlamydia trachomatis
ugugggugaugccuauauggu

SEQ ID NO: 2494282 - RNA, 17 nt, Chlamydia trachomatis
uguggguuuuuuuauug

SEQ ID NO: 2494283 - RNA, 16 nt, Chlamydia trachomatis
uguguaaccuucccga

SEQ ID NO: 2494284 - RNA, 21 nt, Chlamydia trachomatis
uguguaguauuuaacuuuuca

SEQ ID NO: 2494285 - RNA, 22 nt, Chlamydia trachomatis
uguguauuuauauaggcuucca

SEQ ID NO: 2494286 - RNA, 20 nt, Chlamydia trachomatis
ugugucucgguuuucuuuag

SEQ ID NO: 2494287 - RNA, 21 nt, Chlamydia trachomatis
uguguguaaccuucccgaagu

SEQ ID NO: 2494288 - RNA, 21 nt, Chlamydia trachomatis
uguguugaauaacguuuuaaa

SEQ ID NO: 2494289 - RNA, 15 nt, Chlamydia trachomatis
uguuaaagcuuuuuc

SEQ ID NO: 2494290 - RNA, 15 nt, Chlamydia trachomatis
uguuaacaucuuccc

SEQ ID NO: 2494291 - RNA, 16 nt, Chlamydia trachomatis
uguuaacucuuucgau

SEQ ID NO: 2494292 - RNA, 17 nt, Chlamydia trachomatis
uguuaaugacaaacuuu

SEQ ID NO: 2494293 - RNA, 22 nt, Chlamydia trachomatis
uguuacagucuguguuugcaca

SEQ ID NO: 2494294 - RNA, 14 nt, Chlamydia trachomatis
uguuagaaaauacg

SEQ ID NO: 2494295 - RNA, 16 nt, Chlamydia trachomatis
uguuagugaagagcag

SEQ ID NO: 2494296 - RNA, 17 nt, Chlamydia trachomatis
uguuagugaagagcaga

SEQ ID NO: 2494297 - RNA, 18 nt, Chlamydia trachomatis
uguuauccacucuaaagu

SEQ ID NO: 2494298 - RNA, 22 nt, Chlamydia trachomatis
uguuauuuguucucuuagaagc

SEQ ID NO: 2494299 - RNA, 19 nt, Chlamydia trachomatis
uguucaagagaggccucca

SEQ ID NO: 2494300 - RNA, 19 nt, Chlamydia trachomatis
uguucagguuugcauguaa

SEQ ID NO: 2494301 - RNA, 14 nt, Chlamydia trachomatis
uguucccagagaaa

SEQ ID NO: 2494302 - RNA, 16 nt, Chlamydia trachomatis
uguucggauucaucaa

SEQ ID NO: 2494303 - RNA, 14 nt, Chlamydia trachomatis
uguucuacacaucu

SEQ ID NO: 2494304 - RNA, 17 nt, Chlamydia trachomatis
uguucuacacaucugua

SEQ ID NO: 2494305 - RNA, 15 nt, Chlamydia trachomatis
uguucucuaaagauu

SEQ ID NO: 2494306 - RNA, 19 nt, Chlamydia trachomatis
uguucucuaaagauucugu

SEQ ID NO: 2494307 - RNA, 12 nt, Chlamydia trachomatis
uguucucuuaga

SEQ ID NO: 2494308 - RNA, 18 nt, Chlamydia trachomatis
uguucuuuuaggcaacag

SEQ ID NO: 2494309 - RNA, 14 nt, Chlamydia trachomatis
uguugaauaacguu

SEQ ID NO: 2494310 - RNA, 16 nt, Chlamydia trachomatis
uguugagaaaaacucu

SEQ ID NO: 2494311 - RNA, 15 nt, Chlamydia trachomatis
uguugaggagacuuu

SEQ ID NO: 2494312 - RNA, 22 nt, Chlamydia trachomatis
uguugauaucuaggucucccag

SEQ ID NO: 2494313 - RNA, 20 nt, Chlamydia trachomatis
uguuggaguuaauucuuuua

SEQ ID NO: 2494314 - RNA, 21 nt, Chlamydia trachomatis
uguuguuaaagcuuuuuccaa

SEQ ID NO: 2494315 - RNA, 19 nt, Chlamydia trachomatis
uguuuacugagaauaugug

SEQ ID NO: 2494316 - RNA, 15 nt, Chlamydia trachomatis
uguuuagaaaauacg

SEQ ID NO: 2494317 - RNA, 14 nt, Chlamydia trachomatis
uguuuagacaauuc

SEQ ID NO: 2494318 - RNA, 14 nt, Chlamydia trachomatis
uguuuaugaaugca

SEQ ID NO: 2494319 - RNA, 19 nt, Chlamydia trachomatis
uguuuccaaagcuuuaaua

SEQ ID NO: 2494320 - RNA, 20 nt, Chlamydia trachomatis
uguuucccuucuuucuucua

SEQ ID NO: 2494321 - RNA, 18 nt, Chlamydia trachomatis
uguuucggaauucauaga

SEQ ID NO: 2494322 - RNA, 19 nt, Chlamydia trachomatis
uguuucggaauucauagaa

SEQ ID NO: 2494323 - RNA, 17 nt, Chlamydia trachomatis
uguuucuaauggaugau

SEQ ID NO: 2494324 - RNA, 18 nt, Chlamydia trachomatis
uguuucuacuuuuugaca

SEQ ID NO: 2494325 - RNA, 22 nt, Chlamydia trachomatis
uguuucuacuuuuugacauucu

SEQ ID NO: 2494326 - RNA, 23 nt, Chlamydia trachomatis
uguuucugaaucaaacagaaccu

SEQ ID NO: 2494327 - RNA, 22 nt, Chlamydia trachomatis
uguuucuggaaagagagaaagc

SEQ ID NO: 2494328 - RNA, 17 nt, Chlamydia trachomatis
uguuucuuaucagcauc

SEQ ID NO: 2494329 - RNA, 13 nt, Chlamydia trachomatis
uguuucuugcugg

SEQ ID NO: 2494330 - RNA, 15 nt, Chlamydia trachomatis
uguuuggauaagaac

SEQ ID NO: 2494331 - RNA, 20 nt, Chlamydia trachomatis
uguuugggcugcugcuugga

SEQ ID NO: 2494332 - RNA, 13 nt, Chlamydia trachomatis
uguuuguauagaa

SEQ ID NO: 2494333 - RNA, 16 nt, Chlamydia trachomatis
uguuuguguuucuaaa

SEQ ID NO: 2494334 - RNA, 18 nt, Chlamydia trachomatis
uguuuuauacucuaaaag

SEQ ID NO: 2494335 - RNA, 19 nt, Chlamydia trachomatis
uguuuugcuaugaaaaauc

SEQ ID NO: 2494336 - RNA, 17 nt, Chlamydia trachomatis
uuaaaaaacaaaacuac

SEQ ID NO: 2494337 - RNA, 14 nt, Chlamydia trachomatis
uuaaaacuccagaa

SEQ ID NO: 2494338 - RNA, 21 nt, Chlamydia trachomatis
uuaaaagcacaauaacagcac

SEQ ID NO: 2494339 - RNA, 17 nt, Chlamydia trachomatis
uuaaaaggguagaaaaa

SEQ ID NO: 2494340 - RNA, 22 nt, Chlamydia trachomatis
uuaaaaggguagaaaaagagaa

SEQ ID NO: 2494341 - RNA, 14 nt, Chlamydia trachomatis
uuaaacaaaaauaa

SEQ ID NO: 2494342 - RNA, 13 nt, Chlamydia trachomatis
uuaaacuuucuug

SEQ ID NO: 2494343 - RNA, 21 nt, Chlamydia trachomatis
uuaaagccacugugaaaugcg

SEQ ID NO: 2494344 - RNA, 23 nt, Chlamydia trachomatis
uuaaaggaauaauuuuccacaaa

SEQ ID NO: 2494345 - RNA, 18 nt, Chlamydia trachomatis
uuaaagggaaaaaacuag

SEQ ID NO: 2494346 - RNA, 22 nt, Chlamydia trachomatis
uuaaagggggacaaaaauacuu

SEQ ID NO: 2494347 - RNA, 18 nt, Chlamydia trachomatis
uuaaaguaaguaaaagca

SEQ ID NO: 2494348 - RNA, 23 nt, Chlamydia trachomatis
uuaaauaaguccuuaucuucuug

SEQ ID NO: 2494349 - RNA, 21 nt, Chlamydia trachomatis
uuaaauauauaccgaggggau

SEQ ID NO: 2494350 - RNA, 17 nt, Chlamydia trachomatis
uuaaauauucauauguu

SEQ ID NO: 2494351 - RNA, 21 nt, Chlamydia trachomatis
uuaaaucccaguacaucaaau

SEQ ID NO: 2494352 - RNA, 21 nt, Chlamydia trachomatis
uuaaauguugaugguuucuag

SEQ ID NO: 2494353 - RNA, 16 nt, Chlamydia trachomatis
uuaacaucuucccaau

SEQ ID NO: 2494354 - RNA, 18 nt, Chlamydia trachomatis
uuaacaugauucaaaaua

SEQ ID NO: 2494355 - RNA, 21 nt, Chlamydia trachomatis
uuaacccucgacgcuguccaa

SEQ ID NO: 2494356 - RNA, 23 nt, Chlamydia trachomatis
uuaaccgccauuuaugaagccuu

SEQ ID NO: 2494357 - RNA, 18 nt, Chlamydia trachomatis
uuaaccucugcaagaaaa

SEQ ID NO: 2494358 - RNA, 20 nt, Chlamydia trachomatis
uuaacgauguacucugcaaa

SEQ ID NO: 2494359 - RNA, 21 nt, Chlamydia trachomatis
uuaacgauuguuucuguagga

SEQ ID NO: 2494360 - RNA, 17 nt, Chlamydia trachomatis
uuaacuacucaacaaau

SEQ ID NO: 2494361 - RNA, 21 nt, Chlamydia trachomatis
uuaacuaggguugugaaaaaa

SEQ ID NO: 2494362 - RNA, 19 nt, Chlamydia trachomatis
uuaacugcagcaucuauuu

SEQ ID NO: 2494363 - RNA, 23 nt, Chlamydia trachomatis
uuaacuuuguuauuuuuuaagaa

SEQ ID NO: 2494364 - RNA, 12 nt, Chlamydia trachomatis
uuaagaaucuuu

SEQ ID NO: 2494365 - RNA, 20 nt, Chlamydia trachomatis
uuaagaauuaacccaaaaga

SEQ ID NO: 2494366 - RNA, 18 nt, Chlamydia trachomatis
uuaagaccgaaauuagua

SEQ ID NO: 2494367 - RNA, 20 nt, Chlamydia trachomatis
uuaagaccuaguaagugcau

SEQ ID NO: 2494368 - RNA, 14 nt, Chlamydia trachomatis
uuaagauccauuug

SEQ ID NO: 2494369 - RNA, 17 nt, Chlamydia trachomatis
uuaaggacuucaacaaa

SEQ ID NO: 2494370 - RNA, 16 nt, Chlamydia trachomatis
uuaaggccgagaauuu

SEQ ID NO: 2494371 - RNA, 16 nt, Chlamydia trachomatis
uuaaguccagggaaaa

SEQ ID NO: 2494372 - RNA, 18 nt, Chlamydia trachomatis
uuaagugacuggcgagaa

SEQ ID NO: 2494373 - RNA, 17 nt, Chlamydia trachomatis
uuaauaagaccucuuuu

SEQ ID NO: 2494374 - RNA, 16 nt, Chlamydia trachomatis
uuaauaaguuuuucaa

SEQ ID NO: 2494375 - RNA, 17 nt, Chlamydia trachomatis
uuaauaaguuuuucaaa

SEQ ID NO: 2494376 - RNA, 22 nt, Chlamydia trachomatis
uuaauaauaaagauagcaucuu

SEQ ID NO: 2494377 - RNA, 20 nt, Chlamydia trachomatis
uuaauaaugaaauugccaug

SEQ ID NO: 2494378 - RNA, 20 nt, Chlamydia trachomatis
uuaauaccaaggauagggcc

SEQ ID NO: 2494379 - RNA, 15 nt, Chlamydia trachomatis
uuaaucauagaacau

SEQ ID NO: 2494380 - RNA, 14 nt, Chlamydia trachomatis
uuaaugacucccau

SEQ ID NO: 2494381 - RNA, 13 nt, Chlamydia trachomatis
uuaauuccaucuu

SEQ ID NO: 2494382 - RNA, 17 nt, Chlamydia trachomatis
uuaauuccaucuuuucg

SEQ ID NO: 2494383 - RNA, 22 nt, Chlamydia trachomatis
uuaauugcagguacuuacccuu

SEQ ID NO: 2494384 - RNA, 13 nt, Chlamydia trachomatis
uuaauuuuuuaga

SEQ ID NO: 2494385 - RNA, 15 nt, Chlamydia trachomatis
uuaauuuuuuagaua

SEQ ID NO: 2494386 - RNA, 17 nt, Chlamydia trachomatis
uuacaacuaaaggaaac

SEQ ID NO: 2494387 - RNA, 18 nt, Chlamydia trachomatis
uuacaauagguuuaaaua

SEQ ID NO: 2494388 - RNA, 17 nt, Chlamydia trachomatis
uuacaauguaaacaaua

SEQ ID NO: 2494389 - RNA, 20 nt, Chlamydia trachomatis
uuacaauguacgcuaaaaac

SEQ ID NO: 2494390 - RNA, 19 nt, Chlamydia trachomatis
uuacacaacucuuuuccua

SEQ ID NO: 2494391 - RNA, 15 nt, Chlamydia trachomatis
uuacagcaagaagaa

SEQ ID NO: 2494392 - RNA, 22 nt, Chlamydia trachomatis
uuacagcaagaagaagagagaa

SEQ ID NO: 2494393 - RNA, 22 nt, Chlamydia trachomatis
uuacaggauagccaaagguugu

SEQ ID NO: 2494394 - RNA, 13 nt, Chlamydia trachomatis
uuacauaagaucc

SEQ ID NO: 2494395 - RNA, 19 nt, Chlamydia trachomatis
uuacauaagauccaucucu

SEQ ID NO: 2494396 - RNA, 13 nt, Chlamydia trachomatis
uuacauacuuuuc

SEQ ID NO: 2494397 - RNA, 14 nt, Chlamydia trachomatis
uuacaucccuugaa

SEQ ID NO: 2494398 - RNA, 23 nt, Chlamydia trachomatis
uuacaucccuugaacuagaaaua

SEQ ID NO: 2494399 - RNA, 13 nt, Chlamydia trachomatis
uuaccaaaccuuu

SEQ ID NO: 2494400 - RNA, 15 nt, Chlamydia trachomatis
uuaccauaucaaaaa

SEQ ID NO: 2494401 - RNA, 18 nt, Chlamydia trachomatis
uuacccuuauaagccgcu

SEQ ID NO: 2494402 - RNA, 20 nt, Chlamydia trachomatis
uuaccggguagauacaauug

SEQ ID NO: 2494403 - RNA, 15 nt, Chlamydia trachomatis
uuaccucuaacagua

SEQ ID NO: 2494404 - RNA, 19 nt, Chlamydia trachomatis
uuaccuguaggaggacaag

SEQ ID NO: 2494405 - RNA, 14 nt, Chlamydia trachomatis
uuacgaaauaggau

SEQ ID NO: 2494406 - RNA, 15 nt, Chlamydia trachomatis
uuacgagaucgccuu

SEQ ID NO: 2494407 - RNA, 15 nt, Chlamydia trachomatis
uuacgagcuuucuua

SEQ ID NO: 2494408 - RNA, 23 nt, Chlamydia trachomatis
uuacgaugaucccuaagauuucc

SEQ ID NO: 2494409 - RNA, 18 nt, Chlamydia trachomatis
uuacgcaaacuguauugu

SEQ ID NO: 2494410 - RNA, 16 nt, Chlamydia trachomatis
uuacgcacuucugcuc

SEQ ID NO: 2494411 - RNA, 20 nt, Chlamydia trachomatis
uuacgcauuugcucuuccaa

SEQ ID NO: 2494412 - RNA, 16 nt, Chlamydia trachomatis
uuacgccccuucuuca

SEQ ID NO: 2494413 - RNA, 16 nt, Chlamydia trachomatis
uuacgcgucuaaaaca

SEQ ID NO: 2494414 - RNA, 19 nt, Chlamydia trachomatis
uuacgcgucuaaaacaauu

SEQ ID NO: 2494415 - RNA, 14 nt, Chlamydia trachomatis
uuacgcucuuucuu

SEQ ID NO: 2494416 - RNA, 17 nt, Chlamydia trachomatis
uuacggaaaagcuuuuu

SEQ ID NO: 2494417 - RNA, 18 nt, Chlamydia trachomatis
uuacuaacaucaaagauc

SEQ ID NO: 2494418 - RNA, 14 nt, Chlamydia trachomatis
uuacugcaauaagg

SEQ ID NO: 2494419 - RNA, 20 nt, Chlamydia trachomatis
uuacuuaaaaaacaaaacua

SEQ ID NO: 2494420 - RNA, 23 nt, Chlamydia trachomatis
uuacuuggggcgggcgacaugcu

SEQ ID NO: 2494421 - RNA, 17 nt, Chlamydia trachomatis
uuacuuucuuugcuauu

SEQ ID NO: 2494422 - RNA, 19 nt, Chlamydia trachomatis
uuacuuuucucaaaacgcu

SEQ ID NO: 2494423 - RNA, 17 nt, Chlamydia trachomatis
uuagaacagauuuagag

SEQ ID NO: 2494424 - RNA, 20 nt, Chlamydia trachomatis
uuagaagaaaagagcuuuuc

SEQ ID NO: 2494425 - RNA, 23 nt, Chlamydia trachomatis
uuagaagaaaagagcuuuucuuc

SEQ ID NO: 2494426 - RNA, 24 nt, Chlamydia trachomatis
uuagaagauaacaacucuccuaau

SEQ ID NO: 2494427 - RNA, 15 nt, Chlamydia trachomatis
uuagaaucugcucac

SEQ ID NO: 2494428 - RNA, 13 nt, Chlamydia trachomatis
uuagacaaaaaau

SEQ ID NO: 2494429 - RNA, 19 nt, Chlamydia trachomatis
uuagaccaggauuccccgu

SEQ ID NO: 2494430 - RNA, 13 nt, Chlamydia trachomatis
uuagagaauaauc

SEQ ID NO: 2494431 - RNA, 15 nt, Chlamydia trachomatis
uuagaggaguuccua

SEQ ID NO: 2494432 - RNA, 13 nt, Chlamydia trachomatis
uuagauaaaagaa

SEQ ID NO: 2494433 - RNA, 17 nt, Chlamydia trachomatis
uuagauacacagaaaga

SEQ ID NO: 2494434 - RNA, 17 nt, Chlamydia trachomatis
uuagauagcuucuuaaa

SEQ ID NO: 2494435 - RNA, 21 nt, Chlamydia trachomatis
uuagauagcuucuuaaauaua

SEQ ID NO: 2494436 - RNA, 23 nt, Chlamydia trachomatis
uuagcaaagacauaaaagcugua

SEQ ID NO: 2494437 - RNA, 13 nt, Chlamydia trachomatis
uuagcaacaguca

SEQ ID NO: 2494438 - RNA, 14 nt, Chlamydia trachomatis
uuagcacuacagau

SEQ ID NO: 2494439 - RNA, 14 nt, Chlamydia trachomatis
uuagcacucaaaca

SEQ ID NO: 2494440 - RNA, 18 nt, Chlamydia trachomatis
uuagcacuugaguuguuu

SEQ ID NO: 2494441 - RNA, 18 nt, Chlamydia trachomatis
uuagcauguucagaaucu

SEQ ID NO: 2494442 - RNA, 17 nt, Chlamydia trachomatis
uuagccaauuuccaugg

SEQ ID NO: 2494443 - RNA, 16 nt, Chlamydia trachomatis
uuagccuaaauagcuc

SEQ ID NO: 2494444 - RNA, 16 nt, Chlamydia trachomatis
uuagcuaaauucaacu

SEQ ID NO: 2494445 - RNA, 13 nt, Chlamydia trachomatis
uuaggaacucuaa

SEQ ID NO: 2494446 - RNA, 19 nt, Chlamydia trachomatis
uuaggaacucuaaauaccu

SEQ ID NO: 2494447 - RNA, 15 nt, Chlamydia trachomatis
uuaggaauauguugg

SEQ ID NO: 2494448 - RNA, 21 nt, Chlamydia trachomatis
uuaggacugccgaacugcuuu

SEQ ID NO: 2494449 - RNA, 22 nt, Chlamydia trachomatis
uuaggacugccgaacugcuuuc

SEQ ID NO: 2494450 - RNA, 15 nt, Chlamydia trachomatis
uuaggagagagcccu

SEQ ID NO: 2494451 - RNA, 16 nt, Chlamydia trachomatis
uuaggauuaaaaucca

SEQ ID NO: 2494452 - RNA, 21 nt, Chlamydia trachomatis
uuaggccauuucaugacagcu

SEQ ID NO: 2494453 - RNA, 17 nt, Chlamydia trachomatis
uuaggcggcauuuuauu

SEQ ID NO: 2494454 - RNA, 19 nt, Chlamydia trachomatis
uuaguaccauaacaucuaa

SEQ ID NO: 2494455 - RNA, 23 nt, Chlamydia trachomatis
uuaguauagucuuuauuuaagua

SEQ ID NO: 2494456 - RNA, 14 nt, Chlamydia trachomatis
uuagugaagagcag

SEQ ID NO: 2494457 - RNA, 21 nt, Chlamydia trachomatis
uuaguuaaaacuccagaaaau

SEQ ID NO: 2494458 - RNA, 19 nt, Chlamydia trachomatis
uuauaagagaacccuaaua

SEQ ID NO: 2494459 - RNA, 12 nt, Chlamydia trachomatis
uuauaauuccaa

SEQ ID NO: 2494460 - RNA, 13 nt, Chlamydia trachomatis
uuauacucuaaaa

SEQ ID NO: 2494461 - RNA, 18 nt, Chlamydia trachomatis
uuauagaaggucugaaca

SEQ ID NO: 2494462 - RNA, 19 nt, Chlamydia trachomatis
uuauagcaagcccuugaga

SEQ ID NO: 2494463 - RNA, 17 nt, Chlamydia trachomatis
uuauaggggugauaaca

SEQ ID NO: 2494464 - RNA, 12 nt, Chlamydia trachomatis
uuauauaccgga

SEQ ID NO: 2494465 - RNA, 17 nt, Chlamydia trachomatis
uuauauaggcuuccaaa

SEQ ID NO: 2494466 - RNA, 15 nt, Chlamydia trachomatis
uuauauugcuucaua

SEQ ID NO: 2494467 - RNA, 21 nt, Chlamydia trachomatis
uuaucacaaaccagcucauca

SEQ ID NO: 2494468 - RNA, 14 nt, Chlamydia trachomatis
uuaucacauucuua

SEQ ID NO: 2494469 - RNA, 17 nt, Chlamydia trachomatis
uuaucaccuauuaagaa

SEQ ID NO: 2494470 - RNA, 22 nt, Chlamydia trachomatis
uuaucauguagcccuaccucau

SEQ ID NO: 2494471 - RNA, 13 nt, Chlamydia trachomatis
uuaucauucaaaa

SEQ ID NO: 2494472 - RNA, 13 nt, Chlamydia trachomatis
uuauccaaaaaag

SEQ ID NO: 2494473 - RNA, 18 nt, Chlamydia trachomatis
uuauccaaauaaacacac

SEQ ID NO: 2494474 - RNA, 13 nt, Chlamydia trachomatis
uuauccuguucuc

SEQ ID NO: 2494475 - RNA, 20 nt, Chlamydia trachomatis
uuaucggcuaacgaguuuaa

SEQ ID NO: 2494476 - RNA, 15 nt, Chlamydia trachomatis
uuaucguaccccaaa

SEQ ID NO: 2494477 - RNA, 13 nt, Chlamydia trachomatis
uuaucuaaaaaaa

SEQ ID NO: 2494478 - RNA, 17 nt, Chlamydia trachomatis
uuaucuaaaucuaaaau

SEQ ID NO: 2494479 - RNA, 19 nt, Chlamydia trachomatis
uuaucuccuaagacaagca

SEQ ID NO: 2494480 - RNA, 15 nt, Chlamydia trachomatis
uuaucugcccaucau

SEQ ID NO: 2494481 - RNA, 15 nt, Chlamydia trachomatis
uuaucugcuauagaa

SEQ ID NO: 2494482 - RNA, 22 nt, Chlamydia trachomatis
uuaucuuguguagaagaaggaa

SEQ ID NO: 2494483 - RNA, 14 nt, Chlamydia trachomatis
uuaugaaaacuuug

SEQ ID NO: 2494484 - RNA, 18 nt, Chlamydia trachomatis
uuaugauauagauuuuag

SEQ ID NO: 2494485 - RNA, 23 nt, Chlamydia trachomatis
uuaugcuagccuggcugcagaag

SEQ ID NO: 2494486 - RNA, 19 nt, Chlamydia trachomatis
uuaugcugcccuugagcaa

SEQ ID NO: 2494487 - RNA, 21 nt, Chlamydia trachomatis
uuauggguagcgauacaagac

SEQ ID NO: 2494488 - RNA, 16 nt, Chlamydia trachomatis
uuauuaaccaacucuc

SEQ ID NO: 2494489 - RNA, 18 nt, Chlamydia trachomatis
uuauucaaaucuucuucu

SEQ ID NO: 2494490 - RNA, 17 nt, Chlamydia trachomatis
uuauucucuuuauagaa

SEQ ID NO: 2494491 - RNA, 20 nt, Chlamydia trachomatis
uuauucuguuucagaaacuu

SEQ ID NO: 2494492 - RNA, 22 nt, Chlamydia trachomatis
uuauucuucaguuugaaucaca

SEQ ID NO: 2494493 - RNA, 14 nt, Chlamydia trachomatis
uuauuguuuauaaa

SEQ ID NO: 2494494 - RNA, 15 nt, Chlamydia trachomatis
uuauuuaaguagaac

SEQ ID NO: 2494495 - RNA, 23 nt, Chlamydia trachomatis
uuauuuacgagaggguuucuucu

SEQ ID NO: 2494496 - RNA, 11 nt, Chlamydia trachomatis
uuauuuacgau

SEQ ID NO: 2494497 - RNA, 12 nt, Chlamydia trachomatis
uuauuuugaggg

SEQ ID NO: 2494498 - RNA, 14 nt, Chlamydia trachomatis
uuauuuuuuaagaa

SEQ ID NO: 2494499 - RNA, 16 nt, Chlamydia trachomatis
uuauuuuuuaagaagu

SEQ ID NO: 2494500 - RNA, 16 nt, Chlamydia trachomatis
uucaaaaauaaugcca

SEQ ID NO: 2494501 - RNA, 24 nt, Chlamydia trachomatis
uucaaaaauaaugccaccuaauau

SEQ ID NO: 2494502 - RNA, 16 nt, Chlamydia trachomatis
uucaaaagcucgucag

SEQ ID NO: 2494503 - RNA, 21 nt, Chlamydia trachomatis
uucaaaauaauguuuuguagu

SEQ ID NO: 2494504 - RNA, 17 nt, Chlamydia trachomatis
uucaaaauccauuccca

SEQ ID NO: 2494505 - RNA, 13 nt, Chlamydia trachomatis
uucaaagaacaag

SEQ ID NO: 2494506 - RNA, 14 nt, Chlamydia trachomatis
uucaaagaacaaga

SEQ ID NO: 2494507 - RNA, 15 nt, Chlamydia trachomatis
uucaaagagaucugc

SEQ ID NO: 2494508 - RNA, 22 nt, Chlamydia trachomatis
uucaaagaucgguucauaaaau

SEQ ID NO: 2494509 - RNA, 15 nt, Chlamydia trachomatis
uucaaagcaaacuuc

SEQ ID NO: 2494510 - RNA, 15 nt, Chlamydia trachomatis
uucaacaacuucaau

SEQ ID NO: 2494511 - RNA, 15 nt, Chlamydia trachomatis
uucaaccucucauca

SEQ ID NO: 2494512 - RNA, 20 nt, Chlamydia trachomatis
uucaagaugcgcuugaggcu

SEQ ID NO: 2494513 - RNA, 15 nt, Chlamydia trachomatis
uucaaggauucauau

SEQ ID NO: 2494514 - RNA, 15 nt, Chlamydia trachomatis
uucaaguucuaacuu

SEQ ID NO: 2494515 - RNA, 20 nt, Chlamydia trachomatis
uucaauaauguugaagucuc

SEQ ID NO: 2494516 - RNA, 20 nt, Chlamydia trachomatis
uucaauagcaggaacuucuu

SEQ ID NO: 2494517 - RNA, 17 nt, Chlamydia trachomatis
uucaaucacuccuccuc

SEQ ID NO: 2494518 - RNA, 21 nt, Chlamydia trachomatis
uucaaucacuccuccuccuaa

SEQ ID NO: 2494519 - RNA, 21 nt, Chlamydia trachomatis
uucaauguggcugauuaauaa

SEQ ID NO: 2494520 - RNA, 20 nt, Chlamydia trachomatis
uucacagagcuucucuaaau

SEQ ID NO: 2494521 - RNA, 22 nt, Chlamydia trachomatis
uucacagcuaaucauagccauc

SEQ ID NO: 2494522 - RNA, 15 nt, Chlamydia trachomatis
uucaccagcaaaaga

SEQ ID NO: 2494523 - RNA, 20 nt, Chlamydia trachomatis
uucaccagcaaaagaaaaau

SEQ ID NO: 2494524 - RNA, 17 nt, Chlamydia trachomatis
uucacugacuguagaaa

SEQ ID NO: 2494525 - RNA, 20 nt, Chlamydia trachomatis
uucacugccuuuaggaagaa

SEQ ID NO: 2494526 - RNA, 19 nt, Chlamydia trachomatis
uucacuuugauaauacucu

SEQ ID NO: 2494527 - RNA, 18 nt, Chlamydia trachomatis
uucacuuuuaggaagaac

SEQ ID NO: 2494528 - RNA, 16 nt, Chlamydia trachomatis
uucagaaagagaauca

SEQ ID NO: 2494529 - RNA, 17 nt, Chlamydia trachomatis
uucagaacucaaaauaa

SEQ ID NO: 2494530 - RNA, 21 nt, Chlamydia trachomatis
uucagaagaagagcugcuguc

SEQ ID NO: 2494531 - RNA, 15 nt, Chlamydia trachomatis
uucagaauuacccug

SEQ ID NO: 2494532 - RNA, 16 nt, Chlamydia trachomatis
uucagacaaaaagccu

SEQ ID NO: 2494533 - RNA, 18 nt, Chlamydia trachomatis
uucagagaaaauuucucu

SEQ ID NO: 2494534 - RNA, 20 nt, Chlamydia trachomatis
uucagagaggcuguaacuaa

SEQ ID NO: 2494535 - RNA, 15 nt, Chlamydia trachomatis
uucagcaaaaaaauc

SEQ ID NO: 2494536 - RNA, 12 nt, Chlamydia trachomatis
uucagcaauaau

SEQ ID NO: 2494537 - RNA, 19 nt, Chlamydia trachomatis
uucagcaggcgaacaguga

SEQ ID NO: 2494538 - RNA, 17 nt, Chlamydia trachomatis
uucaggggagaaaacau

SEQ ID NO: 2494539 - RNA, 17 nt, Chlamydia trachomatis
uucaguuuguucagaaa

SEQ ID NO: 2494540 - RNA, 15 nt, Chlamydia trachomatis
uucauaaacacagcu

SEQ ID NO: 2494541 - RNA, 21 nt, Chlamydia trachomatis
uucauacgagccuguuucuua

SEQ ID NO: 2494542 - RNA, 13 nt, Chlamydia trachomatis
uucauagaaguca

SEQ ID NO: 2494543 - RNA, 19 nt, Chlamydia trachomatis
uucauagcuucuaauuucu

SEQ ID NO: 2494544 - RNA, 17 nt, Chlamydia trachomatis
uucauauguucuuugaa

SEQ ID NO: 2494545 - RNA, 17 nt, Chlamydia trachomatis
uucauauuccaaagaaa

SEQ ID NO: 2494546 - RNA, 13 nt, Chlamydia trachomatis
uucaucaaaauau

SEQ ID NO: 2494547 - RNA, 19 nt, Chlamydia trachomatis
uucaucaaaauauagacug

SEQ ID NO: 2494548 - RNA, 21 nt, Chlamydia trachomatis
uucaucaagguggccauucuu

SEQ ID NO: 2494549 - RNA, 20 nt, Chlamydia trachomatis
uucaucaucauggaaaauau

SEQ ID NO: 2494550 - RNA, 22 nt, Chlamydia trachomatis
uucauccacuugggcgccauau

SEQ ID NO: 2494551 - RNA, 14 nt, Chlamydia trachomatis
uucauccuuggcuu

SEQ ID NO: 2494552 - RNA, 16 nt, Chlamydia trachomatis
uucaucucaauaaucg

SEQ ID NO: 2494553 - RNA, 18 nt, Chlamydia trachomatis
uucaucucaauaaucgcu

SEQ ID NO: 2494554 - RNA, 14 nt, Chlamydia trachomatis
uucaucuuccaacg

SEQ ID NO: 2494555 - RNA, 20 nt, Chlamydia trachomatis
uucaucuuuacuaggagcaa

SEQ ID NO: 2494556 - RNA, 22 nt, Chlamydia trachomatis
uucaugaaaagcuuucaaagcg

SEQ ID NO: 2494557 - RNA, 15 nt, Chlamydia trachomatis
uucaugaaacccauc

SEQ ID NO: 2494558 - RNA, 16 nt, Chlamydia trachomatis
uucaugaaacccaucu

SEQ ID NO: 2494559 - RNA, 21 nt, Chlamydia trachomatis
uucaugagaccgucaaaaaga

SEQ ID NO: 2494560 - RNA, 22 nt, Chlamydia trachomatis
uucauguaaauuuucaauagca

SEQ ID NO: 2494561 - RNA, 13 nt, Chlamydia trachomatis
uucauucucagga

SEQ ID NO: 2494562 - RNA, 20 nt, Chlamydia trachomatis
uucauugacuguagcaacga

SEQ ID NO: 2494563 - RNA, 14 nt, Chlamydia trachomatis
uucauuuaauaagu

SEQ ID NO: 2494564 - RNA, 21 nt, Chlamydia trachomatis
uuccaaagcuucuaacgcuuc

SEQ ID NO: 2494565 - RNA, 20 nt, Chlamydia trachomatis
uuccaaaggauauacagaac

SEQ ID NO: 2494566 - RNA, 12 nt, Chlamydia trachomatis
uuccaacaaaaa

SEQ ID NO: 2494567 - RNA, 16 nt, Chlamydia trachomatis
uuccaacagaccccuu

SEQ ID NO: 2494568 - RNA, 22 nt, Chlamydia trachomatis
uuccaaccuaagcgcaagaaac

SEQ ID NO: 2494569 - RNA, 19 nt, Chlamydia trachomatis
uuccacgaagagcaaaauc

SEQ ID NO: 2494570 - RNA, 15 nt, Chlamydia trachomatis
uuccacgaugagaua

SEQ ID NO: 2494571 - RNA, 16 nt, Chlamydia trachomatis
uuccacuuuugugaaa

SEQ ID NO: 2494572 - RNA, 20 nt, Chlamydia trachomatis
uuccagacaaaaagaaagcc

SEQ ID NO: 2494573 - RNA, 19 nt, Chlamydia trachomatis
uuccagacgcccuccuccu

SEQ ID NO: 2494574 - RNA, 19 nt, Chlamydia trachomatis
uuccagccuacaaauaaag

SEQ ID NO: 2494575 - RNA, 15 nt, Chlamydia trachomatis
uuccauaaaauccaa

SEQ ID NO: 2494576 - RNA, 19 nt, Chlamydia trachomatis
uuccauaauuaaaggcucu

SEQ ID NO: 2494577 - RNA, 20 nt, Chlamydia trachomatis
uuccaucacuccaagaagag

SEQ ID NO: 2494578 - RNA, 15 nt, Chlamydia trachomatis
uuccaucuaaaggca

SEQ ID NO: 2494579 - RNA, 13 nt, Chlamydia trachomatis
uuccaucuccuga

SEQ ID NO: 2494580 - RNA, 20 nt, Chlamydia trachomatis
uuccaucuccugauuccgag

SEQ ID NO: 2494581 - RNA, 12 nt, Chlamydia trachomatis
uuccaucuucca

SEQ ID NO: 2494582 - RNA, 14 nt, Chlamydia trachomatis
uuccaucuuccaaa

SEQ ID NO: 2494583 - RNA, 22 nt, Chlamydia trachomatis
uuccauggauaaaauuccuacg

SEQ ID NO: 2494584 - RNA, 18 nt, Chlamydia trachomatis
uuccauuaauuuggcuuc

SEQ ID NO: 2494585 - RNA, 14 nt, Chlamydia trachomatis
uuccauuccuccua

SEQ ID NO: 2494586 - RNA, 12 nt, Chlamydia trachomatis
uucccaaaauuu

SEQ ID NO: 2494587 - RNA, 16 nt, Chlamydia trachomatis
uucccaaaauuuuucu

SEQ ID NO: 2494588 - RNA, 20 nt, Chlamydia trachomatis
uucccaaagcuagguaaagg

SEQ ID NO: 2494589 - RNA, 22 nt, Chlamydia trachomatis
uucccaaauacugggaaaucau

SEQ ID NO: 2494590 - RNA, 18 nt, Chlamydia trachomatis
uucccaguuaggcauucc

SEQ ID NO: 2494591 - RNA, 17 nt, Chlamydia trachomatis
uucccauccaaagguaa

SEQ ID NO: 2494592 - RNA, 20 nt, Chlamydia trachomatis
uucccaucuacaaaaccaaa

SEQ ID NO: 2494593 - RNA, 21 nt, Chlamydia trachomatis
uucccaucuacaaaaccaaaa

SEQ ID NO: 2494594 - RNA, 21 nt, Chlamydia trachomatis
uucccaugucuguugaaagcu

SEQ ID NO: 2494595 - RNA, 12 nt, Chlamydia trachomatis
uucccauuuuua

SEQ ID NO: 2494596 - RNA, 19 nt, Chlamydia trachomatis
uuccccaaaccaugaugcu

SEQ ID NO: 2494597 - RNA, 15 nt, Chlamydia trachomatis
uucccgacagaggau

SEQ ID NO: 2494598 - RNA, 15 nt, Chlamydia trachomatis
uucccgauauguuca

SEQ ID NO: 2494599 - RNA, 17 nt, Chlamydia trachomatis
uucccgcuauuuuccuc

SEQ ID NO: 2494600 - RNA, 22 nt, Chlamydia trachomatis
uucccguagcagguaccuauaa

SEQ ID NO: 2494601 - RNA, 18 nt, Chlamydia trachomatis
uucccuccuagaaagaac

SEQ ID NO: 2494602 - RNA, 15 nt, Chlamydia trachomatis
uucccucuucccgcc

SEQ ID NO: 2494603 - RNA, 18 nt, Chlamydia trachomatis
uucccugcaacauuuccu

SEQ ID NO: 2494604 - RNA, 17 nt, Chlamydia trachomatis
uucccugcaccucuuuc

SEQ ID NO: 2494605 - RNA, 19 nt, Chlamydia trachomatis
uucccugcaccucuuucag

SEQ ID NO: 2494606 - RNA, 16 nt, Chlamydia trachomatis
uucccuguauucugag

SEQ ID NO: 2494607 - RNA, 20 nt, Chlamydia trachomatis
uucccuguauucugagggau

SEQ ID NO: 2494608 - RNA, 18 nt, Chlamydia trachomatis
uucccuuaaacauacaca

SEQ ID NO: 2494609 - RNA, 16 nt, Chlamydia trachomatis
uucccuucuuucuucu

SEQ ID NO: 2494610 - RNA, 15 nt, Chlamydia trachomatis
uucccuugaaagaca

SEQ ID NO: 2494611 - RNA, 13 nt, Chlamydia trachomatis
uuccgaaaagauu

SEQ ID NO: 2494612 - RNA, 15 nt, Chlamydia trachomatis
uuccgaacaaaauga

SEQ ID NO: 2494613 - RNA, 17 nt, Chlamydia trachomatis
uuccgaauaagcauuac

SEQ ID NO: 2494614 - RNA, 14 nt, Chlamydia trachomatis
uuccgacugcaguu

SEQ ID NO: 2494615 - RNA, 19 nt, Chlamydia trachomatis
uuccgaguaaucaaaaaag

SEQ ID NO: 2494616 - RNA, 20 nt, Chlamydia trachomatis
uuccgcacccaaucuucuaa

SEQ ID NO: 2494617 - RNA, 16 nt, Chlamydia trachomatis
uuccgcagagaucuaa

SEQ ID NO: 2494618 - RNA, 22 nt, Chlamydia trachomatis
uuccggaaggauguuucccuuu

SEQ ID NO: 2494619 - RNA, 15 nt, Chlamydia trachomatis
uuccguaacaauauu

SEQ ID NO: 2494620 - RNA, 13 nt, Chlamydia trachomatis
uuccguugauagu

SEQ ID NO: 2494621 - RNA, 13 nt, Chlamydia trachomatis
uuccuaaauaccu

SEQ ID NO: 2494622 - RNA, 19 nt, Chlamydia trachomatis
uuccuacucggccagagcu

SEQ ID NO: 2494623 - RNA, 22 nt, Chlamydia trachomatis
uuccuagcgaagucuucuauca

SEQ ID NO: 2494624 - RNA, 14 nt, Chlamydia trachomatis
uuccucaaaagaac

SEQ ID NO: 2494625 - RNA, 21 nt, Chlamydia trachomatis
uuccuccuauguuuaacccuc

SEQ ID NO: 2494626 - RNA, 15 nt, Chlamydia trachomatis
uuccuccucccuuuc

SEQ ID NO: 2494627 - RNA, 23 nt, Chlamydia trachomatis
uuccuccucccuuuccauacauc

SEQ ID NO: 2494628 - RNA, 13 nt, Chlamydia trachomatis
uuccucgaagcua

SEQ ID NO: 2494629 - RNA, 22 nt, Chlamydia trachomatis
uuccucguuuuuuuagauaaga

SEQ ID NO: 2494630 - RNA, 19 nt, Chlamydia trachomatis
uuccucuaaacaagguucu

SEQ ID NO: 2494631 - RNA, 13 nt, Chlamydia trachomatis
uuccucuccuucu

SEQ ID NO: 2494632 - RNA, 19 nt, Chlamydia trachomatis
uuccucuccuucuacaaaa

SEQ ID NO: 2494633 - RNA, 23 nt, Chlamydia trachomatis
uuccucucucucaccgaaaaauu

SEQ ID NO: 2494634 - RNA, 18 nt, Chlamydia trachomatis
uuccucucucugcagaga

SEQ ID NO: 2494635 - RNA, 19 nt, Chlamydia trachomatis
uuccucugguacucaucuu

SEQ ID NO: 2494636 - RNA, 22 nt, Chlamydia trachomatis
uuccucuucacagagcuucucu

SEQ ID NO: 2494637 - RNA, 16 nt, Chlamydia trachomatis
uuccucuucuagaaga

SEQ ID NO: 2494638 - RNA, 21 nt, Chlamydia trachomatis
uuccugaaacgaucagcuccu

SEQ ID NO: 2494639 - RNA, 22 nt, Chlamydia trachomatis
uuccugaaacgaucagcuccug

SEQ ID NO: 2494640 - RNA, 21 nt, Chlamydia trachomatis
uuccugcuucaaaaaagauuu

SEQ ID NO: 2494641 - RNA, 23 nt, Chlamydia trachomatis
uuccuggauccaaaaaagaaucu

SEQ ID NO: 2494642 - RNA, 16 nt, Chlamydia trachomatis
uuccuuauaguuguuu

SEQ ID NO: 2494643 - RNA, 19 nt, Chlamydia trachomatis
uuccuucagagguagccaa

SEQ ID NO: 2494644 - RNA, 17 nt, Chlamydia trachomatis
uuccuugacucuaaaga

SEQ ID NO: 2494645 - RNA, 22 nt, Chlamydia trachomatis
uuccuuggcuuuuacaauagca

SEQ ID NO: 2494646 - RNA, 23 nt, Chlamydia trachomatis
uucgaaaacaacgcguucuucug

SEQ ID NO: 2494647 - RNA, 21 nt, Chlamydia trachomatis
uucgaauaguauacuuuagau

SEQ ID NO: 2494648 - RNA, 16 nt, Chlamydia trachomatis
uucgacggaacucuuu

SEQ ID NO: 2494649 - RNA, 20 nt, Chlamydia trachomatis
uucgagcuguuuuugcaaca

SEQ ID NO: 2494650 - RNA, 21 nt, Chlamydia trachomatis
uucgaguaauuccaaauaaua

SEQ ID NO: 2494651 - RNA, 20 nt, Chlamydia trachomatis
uucgagucuucccuuaaaca

SEQ ID NO: 2494652 - RNA, 22 nt, Chlamydia trachomatis
uucgaugcauacucagcgauug

SEQ ID NO: 2494653 - RNA, 23 nt, Chlamydia trachomatis
uucgcaaacugcucuucuaacuu

SEQ ID NO: 2494654 - RNA, 18 nt, Chlamydia trachomatis
uucgcaggggaauacagu

SEQ ID NO: 2494655 - RNA, 14 nt, Chlamydia trachomatis
uucgcauuaaauaa

SEQ ID NO: 2494656 - RNA, 15 nt, Chlamydia trachomatis
uucgccacgaggaug

SEQ ID NO: 2494657 - RNA, 23 nt, Chlamydia trachomatis
uucgccgggggagccaaaaaguc

SEQ ID NO: 2494658 - RNA, 15 nt, Chlamydia trachomatis
uucggagaagaagag

SEQ ID NO: 2494659 - RNA, 13 nt, Chlamydia trachomatis
uucggagagcagu

SEQ ID NO: 2494660 - RNA, 15 nt, Chlamydia trachomatis
uucggauucaucaaa

SEQ ID NO: 2494661 - RNA, 16 nt, Chlamydia trachomatis
uucgggauaagaucuc

SEQ ID NO: 2494662 - RNA, 17 nt, Chlamydia trachomatis
uucguagacagagaaua

SEQ ID NO: 2494663 - RNA, 12 nt, Chlamydia trachomatis
uucguagacuuc

SEQ ID NO: 2494664 - RNA, 21 nt, Chlamydia trachomatis
uucguaggguuguuuuagaau

SEQ ID NO: 2494665 - RNA, 16 nt, Chlamydia trachomatis
uucguaugcaacuugu

SEQ ID NO: 2494666 - RNA, 14 nt, Chlamydia trachomatis
uucgucaaagaagu

SEQ ID NO: 2494667 - RNA, 12 nt, Chlamydia trachomatis
uucgugacaaau

SEQ ID NO: 2494668 - RNA, 14 nt, Chlamydia trachomatis
uucgugagacagca

SEQ ID NO: 2494669 - RNA, 17 nt, Chlamydia trachomatis
uucgugugacuguaagu

SEQ ID NO: 2494670 - RNA, 14 nt, Chlamydia trachomatis
uucguuucuucccu

SEQ ID NO: 2494671 - RNA, 18 nt, Chlamydia trachomatis
uucguuuugaagaagauc

SEQ ID NO: 2494672 - RNA, 14 nt, Chlamydia trachomatis
uucuaaaaaacuuu

SEQ ID NO: 2494673 - RNA, 15 nt, Chlamydia trachomatis
uucuaaaaucugccg

SEQ ID NO: 2494674 - RNA, 16 nt, Chlamydia trachomatis
uucuaaacccucugca

SEQ ID NO: 2494675 - RNA, 17 nt, Chlamydia trachomatis
uucuaaacccucugcau

SEQ ID NO: 2494676 - RNA, 18 nt, Chlamydia trachomatis
uucuaaagucuuaaaagg

SEQ ID NO: 2494677 - RNA, 22 nt, Chlamydia trachomatis
uucuaaaugcuguaaaacauuu

SEQ ID NO: 2494678 - RNA, 14 nt, Chlamydia trachomatis
uucuaacuuuucaa

SEQ ID NO: 2494679 - RNA, 15 nt, Chlamydia trachomatis
uucuaagaaauuguc

SEQ ID NO: 2494680 - RNA, 10 nt, Chlamydia trachomatis
uucuaagaag

SEQ ID NO: 2494681 - RNA, 23 nt, Chlamydia trachomatis
uucuaauaauacagauuuuucga

SEQ ID NO: 2494682 - RNA, 19 nt, Chlamydia trachomatis
uucuaaucccauucugcgu

SEQ ID NO: 2494683 - RNA, 14 nt, Chlamydia trachomatis
uucuaauuucuuuc

SEQ ID NO: 2494684 - RNA, 21 nt, Chlamydia trachomatis
uucuacaaguucucucucagc

SEQ ID NO: 2494685 - RNA, 21 nt, Chlamydia trachomatis
uucuacgaauaccccaaaugu

SEQ ID NO: 2494686 - RNA, 15 nt, Chlamydia trachomatis
uucuagcagccucuc

SEQ ID NO: 2494687 - RNA, 21 nt, Chlamydia trachomatis
uucuagcagccucucuuugcu

SEQ ID NO: 2494688 - RNA, 14 nt, Chlamydia trachomatis
uucuaggagaagag

SEQ ID NO: 2494689 - RNA, 15 nt, Chlamydia trachomatis
uucuauacgcacaua

SEQ ID NO: 2494690 - RNA, 16 nt, Chlamydia trachomatis
uucuauagcuaaagca

SEQ ID NO: 2494691 - RNA, 14 nt, Chlamydia trachomatis
uucuaucacagcua

SEQ ID NO: 2494692 - RNA, 19 nt, Chlamydia trachomatis
uucuauccauuguagaugc

SEQ ID NO: 2494693 - RNA, 21 nt, Chlamydia trachomatis
uucuauccggaguaccaaaaa

SEQ ID NO: 2494694 - RNA, 19 nt, Chlamydia trachomatis
uucuauguaaaaauucuaa

SEQ ID NO: 2494695 - RNA, 12 nt, Chlamydia trachomatis
uucucaaaucac

SEQ ID NO: 2494696 - RNA, 17 nt, Chlamydia trachomatis
uucucaaguugagugca

SEQ ID NO: 2494697 - RNA, 23 nt, Chlamydia trachomatis
uucucaaguugagugcagaggau

SEQ ID NO: 2494698 - RNA, 17 nt, Chlamydia trachomatis
uucuccagcaucuuuuc

SEQ ID NO: 2494699 - RNA, 21 nt, Chlamydia trachomatis
uucuccgaugccgcagaaaaa

SEQ ID NO: 2494700 - RNA, 11 nt, Chlamydia trachomatis
uucuccuaaag

SEQ ID NO: 2494701 - RNA, 19 nt, Chlamydia trachomatis
uucuccucccagauuuuau

SEQ ID NO: 2494702 - RNA, 16 nt, Chlamydia trachomatis
uucucgagaagaaaaa

SEQ ID NO: 2494703 - RNA, 13 nt, Chlamydia trachomatis
uucucgcaaaaga

SEQ ID NO: 2494704 - RNA, 21 nt, Chlamydia trachomatis
uucucgcagaugcuucugccu

SEQ ID NO: 2494705 - RNA, 13 nt, Chlamydia trachomatis
uucucgcuacaaa

SEQ ID NO: 2494706 - RNA, 18 nt, Chlamydia trachomatis
uucucggaaaagauaucc

SEQ ID NO: 2494707 - RNA, 15 nt, Chlamydia trachomatis
uucucggccuuuucu

SEQ ID NO: 2494708 - RNA, 14 nt, Chlamydia trachomatis
uucucuaacaauga

SEQ ID NO: 2494709 - RNA, 19 nt, Chlamydia trachomatis
uucucuaauaguugcaaaa

SEQ ID NO: 2494710 - RNA, 20 nt, Chlamydia trachomatis
uucucuaauaguugcaaaaa

SEQ ID NO: 2494711 - RNA, 17 nt, Chlamydia trachomatis
uucucuagaauuucccu

SEQ ID NO: 2494712 - RNA, 10 nt, Chlamydia trachomatis
uucucucaua

SEQ ID NO: 2494713 - RNA, 16 nt, Chlamydia trachomatis
uucucucccuuccuga

SEQ ID NO: 2494714 - RNA, 17 nt, Chlamydia trachomatis
uucucucccuuccugag

SEQ ID NO: 2494715 - RNA, 21 nt, Chlamydia trachomatis
uucucucgcugcgagagagcu

SEQ ID NO: 2494716 - RNA, 13 nt, Chlamydia trachomatis
uucucucuaaaau

SEQ ID NO: 2494717 - RNA, 15 nt, Chlamydia trachomatis
uucucuugaaaaaac

SEQ ID NO: 2494718 - RNA, 16 nt, Chlamydia trachomatis
uucucuugaaaacucu

SEQ ID NO: 2494719 - RNA, 16 nt, Chlamydia trachomatis
uucucuugaaucaaaa

SEQ ID NO: 2494720 - RNA, 13 nt, Chlamydia trachomatis
uucucuugcagaa

SEQ ID NO: 2494721 - RNA, 17 nt, Chlamydia trachomatis
uucucuuggcuuuuuau

SEQ ID NO: 2494722 - RNA, 22 nt, Chlamydia trachomatis
uucucuuguagagaggcaaaca

SEQ ID NO: 2494723 - RNA, 17 nt, Chlamydia trachomatis
uucugaacgagaaaaag

SEQ ID NO: 2494724 - RNA, 20 nt, Chlamydia trachomatis
uucugaaggugugaaagaaa

SEQ ID NO: 2494725 - RNA, 22 nt, Chlamydia trachomatis
uucugaaggugugaaagaaaaa

SEQ ID NO: 2494726 - RNA, 13 nt, Chlamydia trachomatis
uucugaaucaaac

SEQ ID NO: 2494727 - RNA, 14 nt, Chlamydia trachomatis
uucugaaucaaaca

SEQ ID NO: 2494728 - RNA, 16 nt, Chlamydia trachomatis
uucugagaaaucuaaa

SEQ ID NO: 2494729 - RNA, 12 nt, Chlamydia trachomatis
uucugagacucc

SEQ ID NO: 2494730 - RNA, 17 nt, Chlamydia trachomatis
uucugagaugaaaauau

SEQ ID NO: 2494731 - RNA, 16 nt, Chlamydia trachomatis
uucugcaaugagugcg

SEQ ID NO: 2494732 - RNA, 14 nt, Chlamydia trachomatis
uucugcagaaaaau

SEQ ID NO: 2494733 - RNA, 15 nt, Chlamydia trachomatis
uucugcagaaaaauu

SEQ ID NO: 2494734 - RNA, 19 nt, Chlamydia trachomatis
uucugcauaacagcaagac

SEQ ID NO: 2494735 - RNA, 12 nt, Chlamydia trachomatis
uucugcauaacg

SEQ ID NO: 2494736 - RNA, 13 nt, Chlamydia trachomatis
uucugccaaagac

SEQ ID NO: 2494737 - RNA, 14 nt, Chlamydia trachomatis
uucugccauuucua

SEQ ID NO: 2494738 - RNA, 13 nt, Chlamydia trachomatis
uucugcgaaagaa

SEQ ID NO: 2494739 - RNA, 22 nt, Chlamydia trachomatis
uucugcuaaaggugcgauuacu

SEQ ID NO: 2494740 - RNA, 13 nt, Chlamydia trachomatis
uucugcuccaaag

SEQ ID NO: 2494741 - RNA, 16 nt, Chlamydia trachomatis
uucugcuccaaagaua

SEQ ID NO: 2494742 - RNA, 23 nt, Chlamydia trachomatis
uucugcuugcgaauaacuaauau

SEQ ID NO: 2494743 - RNA, 12 nt, Chlamydia trachomatis
uucugcuuuguc

SEQ ID NO: 2494744 - RNA, 14 nt, Chlamydia trachomatis
uucugcuuugucuc

SEQ ID NO: 2494745 - RNA, 23 nt, Chlamydia trachomatis
uucuggaaugcgcaauccuuuua

SEQ ID NO: 2494746 - RNA, 13 nt, Chlamydia trachomatis
uucuggagcaaca

SEQ ID NO: 2494747 - RNA, 13 nt, Chlamydia trachomatis
uucuggaggagga

SEQ ID NO: 2494748 - RNA, 21 nt, Chlamydia trachomatis
uucuggcgaaucaauuucuag

SEQ ID NO: 2494749 - RNA, 16 nt, Chlamydia trachomatis
uucuggcgauaguucu

SEQ ID NO: 2494750 - RNA, 23 nt, Chlamydia trachomatis
uucugguuucuuaaacaaaaaua

SEQ ID NO: 2494751 - RNA, 15 nt, Chlamydia trachomatis
uucuguaaggcagga

SEQ ID NO: 2494752 - RNA, 20 nt, Chlamydia trachomatis
uucuguaggagagaaucuuu

SEQ ID NO: 2494753 - RNA, 19 nt, Chlamydia trachomatis
uucugugcaaucagcucuc

SEQ ID NO: 2494754 - RNA, 15 nt, Chlamydia trachomatis
uucuguuacacagac

SEQ ID NO: 2494755 - RNA, 20 nt, Chlamydia trachomatis
uucuuaaaagcacaauaaca

SEQ ID NO: 2494756 - RNA, 16 nt, Chlamydia trachomatis
uucuuaaacaaaaaua

SEQ ID NO: 2494757 - RNA, 20 nt, Chlamydia trachomatis
uucuuacauaagauccaucu

SEQ ID NO: 2494758 - RNA, 15 nt, Chlamydia trachomatis
uucuuacuccuucuc

SEQ ID NO: 2494759 - RNA, 14 nt, Chlamydia trachomatis
uucuuagccuuguu

SEQ ID NO: 2494760 - RNA, 21 nt, Chlamydia trachomatis
uucuucaacaacuucaauagc

SEQ ID NO: 2494761 - RNA, 19 nt, Chlamydia trachomatis
uucuucacagcacgacacu

SEQ ID NO: 2494762 - RNA, 20 nt, Chlamydia trachomatis
uucuucauagcuucuaauuu

SEQ ID NO: 2494763 - RNA, 15 nt, Chlamydia trachomatis
uucuucccuuuuuuc

SEQ ID NO: 2494764 - RNA, 19 nt, Chlamydia trachomatis
uucuucccuuuuuucuguu

SEQ ID NO: 2494765 - RNA, 14 nt, Chlamydia trachomatis
uucuuccucuaauu

SEQ ID NO: 2494766 - RNA, 20 nt, Chlamydia trachomatis
uucuuccugcuucaaaaaag

SEQ ID NO: 2494767 - RNA, 14 nt, Chlamydia trachomatis
uucuucgaaauauu

SEQ ID NO: 2494768 - RNA, 12 nt, Chlamydia trachomatis
uucuucuauaag

SEQ ID NO: 2494769 - RNA, 15 nt, Chlamydia trachomatis
uucuucugaacaaca

SEQ ID NO: 2494770 - RNA, 16 nt, Chlamydia trachomatis
uucuucugcaggcuca

SEQ ID NO: 2494771 - RNA, 12 nt, Chlamydia trachomatis
uucuucuucugu

SEQ ID NO: 2494772 - RNA, 18 nt, Chlamydia trachomatis
uucuucuuuggaaaaaaa

SEQ ID NO: 2494773 - RNA, 12 nt, Chlamydia trachomatis
uucuugaaagcu

SEQ ID NO: 2494774 - RNA, 13 nt, Chlamydia trachomatis
uucuugaaagcuu

SEQ ID NO: 2494775 - RNA, 13 nt, Chlamydia trachomatis
uucuugaacaacg

SEQ ID NO: 2494776 - RNA, 18 nt, Chlamydia trachomatis
uucuugaaucagaaguug

SEQ ID NO: 2494777 - RNA, 18 nt, Chlamydia trachomatis
uucuugaaugccuaacga

SEQ ID NO: 2494778 - RNA, 21 nt, Chlamydia trachomatis
uucuugaauggcaaggacaag

SEQ ID NO: 2494779 - RNA, 14 nt, Chlamydia trachomatis
uucuugaggaagau

SEQ ID NO: 2494780 - RNA, 16 nt, Chlamydia trachomatis
uucuugauaaauaauc

SEQ ID NO: 2494781 - RNA, 18 nt, Chlamydia trachomatis
uucuugcgaugccucuaa

SEQ ID NO: 2494782 - RNA, 19 nt, Chlamydia trachomatis
uucuugcgaugccucuaac

SEQ ID NO: 2494783 - RNA, 23 nt, Chlamydia trachomatis
uucuuguagaaaaagauggagag

SEQ ID NO: 2494784 - RNA, 15 nt, Chlamydia trachomatis
uucuugugauaucuc

SEQ ID NO: 2494785 - RNA, 12 nt, Chlamydia trachomatis
uucuuguuuuau

SEQ ID NO: 2494786 - RNA, 23 nt, Chlamydia trachomatis
uucuuguuuuauacucuaaaagu

SEQ ID NO: 2494787 - RNA, 15 nt, Chlamydia trachomatis
uucuuuaagaaaaau

SEQ ID NO: 2494788 - RNA, 23 nt, Chlamydia trachomatis
uucuuugacgauagagaacaucu

SEQ ID NO: 2494789 - RNA, 20 nt, Chlamydia trachomatis
uucuuugagaaaguuaaaga

SEQ ID NO: 2494790 - RNA, 17 nt, Chlamydia trachomatis
uucuuugcguagcucag

SEQ ID NO: 2494791 - RNA, 23 nt, Chlamydia trachomatis
uucuuugcguagcucagagauuu

SEQ ID NO: 2494792 - RNA, 11 nt, Chlamydia trachomatis
uucuuugcuuu

SEQ ID NO: 2494793 - RNA, 19 nt, Chlamydia trachomatis
uucuuuugcaaaaauuuuc

SEQ ID NO: 2494794 - RNA, 12 nt, Chlamydia trachomatis
uucuuuuuccuc

SEQ ID NO: 2494795 - RNA, 14 nt, Chlamydia trachomatis
uucuuuuuccucag

SEQ ID NO: 2494796 - RNA, 19 nt, Chlamydia trachomatis
uucuuuuuuguguuucuug

SEQ ID NO: 2494797 - RNA, 13 nt, Chlamydia trachomatis
uugaacaacuccu

SEQ ID NO: 2494798 - RNA, 16 nt, Chlamydia trachomatis
uugaaccaguuucuug

SEQ ID NO: 2494799 - RNA, 15 nt, Chlamydia trachomatis
uugaacuagaaauaa

SEQ ID NO: 2494800 - RNA, 23 nt, Chlamydia trachomatis
uugaacuuauuggugagugcaua

SEQ ID NO: 2494801 - RNA, 18 nt, Chlamydia trachomatis
uugaagaagaucuguaac

SEQ ID NO: 2494802 - RNA, 15 nt, Chlamydia trachomatis
uugaagauucuaaaa

SEQ ID NO: 2494803 - RNA, 14 nt, Chlamydia trachomatis
uugaaguagcauug

SEQ ID NO: 2494804 - RNA, 21 nt, Chlamydia trachomatis
uugaauaaaucuauccauaau

SEQ ID NO: 2494805 - RNA, 14 nt, Chlamydia trachomatis
uugaauaacguuuu

SEQ ID NO: 2494806 - RNA, 21 nt, Chlamydia trachomatis
uugaauacgauccucuggaua

SEQ ID NO: 2494807 - RNA, 16 nt, Chlamydia trachomatis
uugaaucaaaaaguuc

SEQ ID NO: 2494808 - RNA, 22 nt, Chlamydia trachomatis
uugaaucaaaaaguucauagau

SEQ ID NO: 2494809 - RNA, 14 nt, Chlamydia trachomatis
uugaauggcaagga

SEQ ID NO: 2494810 - RNA, 16 nt, Chlamydia trachomatis
uugaauuucaggagua

SEQ ID NO: 2494811 - RNA, 14 nt, Chlamydia trachomatis
uugacucaucaaaa

SEQ ID NO: 2494812 - RNA, 15 nt, Chlamydia trachomatis
uugacucuaaagaau

SEQ ID NO: 2494813 - RNA, 17 nt, Chlamydia trachomatis
uugacucuaaagaauag

SEQ ID NO: 2494814 - RNA, 22 nt, Chlamydia trachomatis
uugacucucauaagaauacaaa

SEQ ID NO: 2494815 - RNA, 23 nt, Chlamydia trachomatis
uugacucucauaagaauacaaag

SEQ ID NO: 2494816 - RNA, 13 nt, Chlamydia trachomatis
uugacuuucccug

SEQ ID NO: 2494817 - RNA, 11 nt, Chlamydia trachomatis
uugagaaaaac

SEQ ID NO: 2494818 - RNA, 13 nt, Chlamydia trachomatis
uugagaaaacuug

SEQ ID NO: 2494819 - RNA, 21 nt, Chlamydia trachomatis
uugagaaguaaaacagaagga

SEQ ID NO: 2494820 - RNA, 16 nt, Chlamydia trachomatis
uugagaauccaaauuu

SEQ ID NO: 2494821 - RNA, 22 nt, Chlamydia trachomatis
uugagagcauucuucugaacaa

SEQ ID NO: 2494822 - RNA, 16 nt, Chlamydia trachomatis
uugagaugaucccauc

SEQ ID NO: 2494823 - RNA, 16 nt, Chlamydia trachomatis
uugagcagcaaagauc

SEQ ID NO: 2494824 - RNA, 22 nt, Chlamydia trachomatis
uugagcuuuauuuucauauagu

SEQ ID NO: 2494825 - RNA, 20 nt, Chlamydia trachomatis
uugaguuguuugggcugcug

SEQ ID NO: 2494826 - RNA, 23 nt, Chlamydia trachomatis
uugauaaacucggguuuuaaaug

SEQ ID NO: 2494827 - RNA, 16 nt, Chlamydia trachomatis
uugauaauacucuucu

SEQ ID NO: 2494828 - RNA, 18 nt, Chlamydia trachomatis
uugauacaauuccugcuc

SEQ ID NO: 2494829 - RNA, 17 nt, Chlamydia trachomatis
uugauagcaacaguuuu

SEQ ID NO: 2494830 - RNA, 18 nt, Chlamydia trachomatis
uugauaucuaggucuccc

SEQ ID NO: 2494831 - RNA, 21 nt, Chlamydia trachomatis
uugauaucuaggucucccagg

SEQ ID NO: 2494832 - RNA, 23 nt, Chlamydia trachomatis
uugauauucccuucuauuucucu

SEQ ID NO: 2494833 - RNA, 15 nt, Chlamydia trachomatis
uugaucaaagaaucu

SEQ ID NO: 2494834 - RNA, 13 nt, Chlamydia trachomatis
uugaucaaauccu

SEQ ID NO: 2494835 - RNA, 15 nt, Chlamydia trachomatis
uugaucuucuggaau

SEQ ID NO: 2494836 - RNA, 22 nt, Chlamydia trachomatis
uugaucuuuccagcaggccucu

SEQ ID NO: 2494837 - RNA, 22 nt, Chlamydia trachomatis
uugaugcccaggauaacaaaca

SEQ ID NO: 2494838 - RNA, 13 nt, Chlamydia trachomatis
uugauuaaaguuu

SEQ ID NO: 2494839 - RNA, 19 nt, Chlamydia trachomatis
uugauuaggaagaaguuuu

SEQ ID NO: 2494840 - RNA, 12 nt, Chlamydia trachomatis
uugauucugcuc

SEQ ID NO: 2494841 - RNA, 13 nt, Chlamydia trachomatis
uugauucugcucc

SEQ ID NO: 2494842 - RNA, 15 nt, Chlamydia trachomatis
uugauuuuuucgcuu

SEQ ID NO: 2494843 - RNA, 17 nt, Chlamydia trachomatis
uugauuuuuucgcuuuu

SEQ ID NO: 2494844 - RNA, 23 nt, Chlamydia trachomatis
uugauuuuuuucgauagaaaaaa

SEQ ID NO: 2494845 - RNA, 21 nt, Chlamydia trachomatis
uugcaaacgguagcgauuuuc

SEQ ID NO: 2494846 - RNA, 22 nt, Chlamydia trachomatis
uugcaaagagagcaacgagcaa

SEQ ID NO: 2494847 - RNA, 23 nt, Chlamydia trachomatis
uugcaaagcgucgacuguagaug

SEQ ID NO: 2494848 - RNA, 19 nt, Chlamydia trachomatis
uugcaauccuuuuuccuua

SEQ ID NO: 2494849 - RNA, 14 nt, Chlamydia trachomatis
uugcacaagauaca

SEQ ID NO: 2494850 - RNA, 15 nt, Chlamydia trachomatis
uugcacaagauacaa

SEQ ID NO: 2494851 - RNA, 21 nt, Chlamydia trachomatis
uugcagaucguugcuuccaaa

SEQ ID NO: 2494852 - RNA, 17 nt, Chlamydia trachomatis
uugcagccuuucccuug

SEQ ID NO: 2494853 - RNA, 20 nt, Chlamydia trachomatis
uugcaguaccauuacuacaa

SEQ ID NO: 2494854 - RNA, 21 nt, Chlamydia trachomatis
uugcagugauguauuccaagc

SEQ ID NO: 2494855 - RNA, 17 nt, Chlamydia trachomatis
uugcauaguuccuguau

SEQ ID NO: 2494856 - RNA, 17 nt, Chlamydia trachomatis
uugccaaucuguaauaa

SEQ ID NO: 2494857 - RNA, 15 nt, Chlamydia trachomatis
uugccaaugaaauau

SEQ ID NO: 2494858 - RNA, 20 nt, Chlamydia trachomatis
uugccaucuucaauggcaaa

SEQ ID NO: 2494859 - RNA, 19 nt, Chlamydia trachomatis
uugcccuuccgaaaagauu

SEQ ID NO: 2494860 - RNA, 21 nt, Chlamydia trachomatis
uugccugcuccggcaaauccu

SEQ ID NO: 2494861 - RNA, 17 nt, Chlamydia trachomatis
uugcgagggauauuucu

SEQ ID NO: 2494862 - RNA, 19 nt, Chlamydia trachomatis
uugcgauuuuuuuuauuag

SEQ ID NO: 2494863 - RNA, 16 nt, Chlamydia trachomatis
uugcgcaaucauauca

SEQ ID NO: 2494864 - RNA, 14 nt, Chlamydia trachomatis
uugcgcaucaaagg

SEQ ID NO: 2494865 - RNA, 23 nt, Chlamydia trachomatis
uugcgcaucacgaagaguuugua

SEQ ID NO: 2494866 - RNA, 14 nt, Chlamydia trachomatis
uugcgugcucuagc

SEQ ID NO: 2494867 - RNA, 19 nt, Chlamydia trachomatis
uugcuaaggagaauucucc

SEQ ID NO: 2494868 - RNA, 17 nt, Chlamydia trachomatis
uugcuacggaaaccaau

SEQ ID NO: 2494869 - RNA, 18 nt, Chlamydia trachomatis
uugcuaugaaaaauccuu

SEQ ID NO: 2494870 - RNA, 15 nt, Chlamydia trachomatis
uugcuauuuggaucu

SEQ ID NO: 2494871 - RNA, 13 nt, Chlamydia trachomatis
uugcuccacacaa

SEQ ID NO: 2494872 - RNA, 17 nt, Chlamydia trachomatis
uugcucgagaaaugaau

SEQ ID NO: 2494873 - RNA, 14 nt, Chlamydia trachomatis
uugcucgauccaaa

SEQ ID NO: 2494874 - RNA, 12 nt, Chlamydia trachomatis
uugcucuuugaa

SEQ ID NO: 2494875 - RNA, 19 nt, Chlamydia trachomatis
uugcugagcuuuuuuucac

SEQ ID NO: 2494876 - RNA, 21 nt, Chlamydia trachomatis
uugcugcguuacccuuccaau

SEQ ID NO: 2494877 - RNA, 19 nt, Chlamydia trachomatis
uugcuuaacacuucuuuag

SEQ ID NO: 2494878 - RNA, 23 nt, Chlamydia trachomatis
uugcuuaucauguagcccuaccu

SEQ ID NO: 2494879 - RNA, 14 nt, Chlamydia trachomatis
uugcuucauaaaaa

SEQ ID NO: 2494880 - RNA, 17 nt, Chlamydia trachomatis
uuggaaaaaaaaccaaa

SEQ ID NO: 2494881 - RNA, 21 nt, Chlamydia trachomatis
uuggaaaaaaaaccaaaccag

SEQ ID NO: 2494882 - RNA, 12 nt, Chlamydia trachomatis
uuggaaauccuc

SEQ ID NO: 2494883 - RNA, 17 nt, Chlamydia trachomatis
uuggaccauaaaacuug

SEQ ID NO: 2494884 - RNA, 22 nt, Chlamydia trachomatis
uuggacgagaggcgaaaguuuc

SEQ ID NO: 2494885 - RNA, 22 nt, Chlamydia trachomatis
uuggagaacaucggaccacauu

SEQ ID NO: 2494886 - RNA, 17 nt, Chlamydia trachomatis
uuggagagaaugaagaa

SEQ ID NO: 2494887 - RNA, 18 nt, Chlamydia trachomatis
uuggagagaaugaagaau

SEQ ID NO: 2494888 - RNA, 17 nt, Chlamydia trachomatis
uuggagugacuagccaa

SEQ ID NO: 2494889 - RNA, 19 nt, Chlamydia trachomatis
uuggaucagcuccuaucac

SEQ ID NO: 2494890 - RNA, 21 nt, Chlamydia trachomatis
uuggaucccaaaccuccuaaa

SEQ ID NO: 2494891 - RNA, 21 nt, Chlamydia trachomatis
uuggcaaagagcuucuagaaa

SEQ ID NO: 2494892 - RNA, 13 nt, Chlamydia trachomatis
uuggcaagaagcu

SEQ ID NO: 2494893 - RNA, 22 nt, Chlamydia trachomatis
uuggcaagaagcugcaguuucu

SEQ ID NO: 2494894 - RNA, 24 nt, Chlamydia trachomatis
uuggcaagaagcugcaguuucuga

SEQ ID NO: 2494895 - RNA, 18 nt, Chlamydia trachomatis
uuggcacggagaucauag

SEQ ID NO: 2494896 - RNA, 19 nt, Chlamydia trachomatis
uuggcaugcccuaaagaga

SEQ ID NO: 2494897 - RNA, 15 nt, Chlamydia trachomatis
uuggcggauaucuuc

SEQ ID NO: 2494898 - RNA, 15 nt, Chlamydia trachomatis
uuggcggcaguuucu

SEQ ID NO: 2494899 - RNA, 14 nt, Chlamydia trachomatis
uuggcguauuucuu

SEQ ID NO: 2494900 - RNA, 20 nt, Chlamydia trachomatis
uuggcguauuucuuguggga

SEQ ID NO: 2494901 - RNA, 17 nt, Chlamydia trachomatis
uuggcuucuuuuuucuu

SEQ ID NO: 2494902 - RNA, 23 nt, Chlamydia trachomatis
uugggaaaacgauaaaaagcugg

SEQ ID NO: 2494903 - RNA, 20 nt, Chlamydia trachomatis
uugggauagaggaaacacug

SEQ ID NO: 2494904 - RNA, 16 nt, Chlamydia trachomatis
uugggaucuucgucag

SEQ ID NO: 2494905 - RNA, 14 nt, Chlamydia trachomatis
uuggguuaugagcc

SEQ ID NO: 2494906 - RNA, 12 nt, Chlamydia trachomatis
uugguaagauuc

SEQ ID NO: 2494907 - RNA, 20 nt, Chlamydia trachomatis
uugguagcagcuagaacaua

SEQ ID NO: 2494908 - RNA, 12 nt, Chlamydia trachomatis
uugguauagaaa

SEQ ID NO: 2494909 - RNA, 17 nt, Chlamydia trachomatis
uuggucgggaaacauuc

SEQ ID NO: 2494910 - RNA, 21 nt, Chlamydia trachomatis
uuggugagugcauagagauag

SEQ ID NO: 2494911 - RNA, 18 nt, Chlamydia trachomatis
uuguaaagcauucguuau

SEQ ID NO: 2494912 - RNA, 21 nt, Chlamydia trachomatis
uuguaaagcauucguuaucaa

SEQ ID NO: 2494913 - RNA, 14 nt, Chlamydia trachomatis
uuguaaagcuuuuc

SEQ ID NO: 2494914 - RNA, 21 nt, Chlamydia trachomatis
uuguaaguccuuacauaaaaa

SEQ ID NO: 2494915 - RNA, 18 nt, Chlamydia trachomatis
uuguagaccuaagcuaug

SEQ ID NO: 2494916 - RNA, 18 nt, Chlamydia trachomatis
uuguagagaggcaaacac

SEQ ID NO: 2494917 - RNA, 23 nt, Chlamydia trachomatis
uuguagugaaguucccuuuacaa

SEQ ID NO: 2494918 - RNA, 19 nt, Chlamydia trachomatis
uuguauaaguucuuuuugu

SEQ ID NO: 2494919 - RNA, 16 nt, Chlamydia trachomatis
uuguaugcucgccucu

SEQ ID NO: 2494920 - RNA, 23 nt, Chlamydia trachomatis
uugucacaaauuaccccaaauua

SEQ ID NO: 2494921 - RNA, 15 nt, Chlamydia trachomatis
uugucagaagaggca

SEQ ID NO: 2494922 - RNA, 19 nt, Chlamydia trachomatis
uugucgaauuuuucugcua

SEQ ID NO: 2494923 - RNA, 21 nt, Chlamydia trachomatis
uugucgaauuuuucugcuaga

SEQ ID NO: 2494924 - RNA, 19 nt, Chlamydia trachomatis
uugucgauaaaguaaagga

SEQ ID NO: 2494925 - RNA, 21 nt, Chlamydia trachomatis
uugucuaaaagaauaugcgac

SEQ ID NO: 2494926 - RNA, 15 nt, Chlamydia trachomatis
uugucuacuuuuugu

SEQ ID NO: 2494927 - RNA, 12 nt, Chlamydia trachomatis
uugucuuagaag

SEQ ID NO: 2494928 - RNA, 20 nt, Chlamydia trachomatis
uugugaaaagggcaaaacuc

SEQ ID NO: 2494929 - RNA, 13 nt, Chlamydia trachomatis
uugugaugaagac

SEQ ID NO: 2494930 - RNA, 15 nt, Chlamydia trachomatis
uugugcaaccucuau

SEQ ID NO: 2494931 - RNA, 16 nt, Chlamydia trachomatis
uugugcuaaaucucca

SEQ ID NO: 2494932 - RNA, 13 nt, Chlamydia trachomatis
uuguggaauugua

SEQ ID NO: 2494933 - RNA, 22 nt, Chlamydia trachomatis
uuguguagcuuuucggugagga

SEQ ID NO: 2494934 - RNA, 21 nt, Chlamydia trachomatis
uugugugaacgugagguacag

SEQ ID NO: 2494935 - RNA, 15 nt, Chlamydia trachomatis
uugugugaugaaccc

SEQ ID NO: 2494936 - RNA, 12 nt, Chlamydia trachomatis
uuguuaagaagg

SEQ ID NO: 2494937 - RNA, 14 nt, Chlamydia trachomatis
uuguuagaaaugca

SEQ ID NO: 2494938 - RNA, 13 nt, Chlamydia trachomatis
uuguuaucuaaau

SEQ ID NO: 2494939 - RNA, 23 nt, Chlamydia trachomatis
uuguuaucuaaaucuaaaauuuc

SEQ ID NO: 2494940 - RNA, 18 nt, Chlamydia trachomatis
uuguucggauucaucaaa

SEQ ID NO: 2494941 - RNA, 11 nt, Chlamydia trachomatis
uuguucugggc

SEQ ID NO: 2494942 - RNA, 23 nt, Chlamydia trachomatis
uuguugccaaccaccuguugcuu

SEQ ID NO: 2494943 - RNA, 15 nt, Chlamydia trachomatis
uuguugccuuggccc

SEQ ID NO: 2494944 - RNA, 18 nt, Chlamydia trachomatis
uuguugcuaaccguucuu

SEQ ID NO: 2494945 - RNA, 22 nt, Chlamydia trachomatis
uuguuggacaaagguguuuucu

SEQ ID NO: 2494946 - RNA, 19 nt, Chlamydia trachomatis
uuguuguccacaugccauc

SEQ ID NO: 2494947 - RNA, 15 nt, Chlamydia trachomatis
uuguuuagaaaauac

SEQ ID NO: 2494948 - RNA, 17 nt, Chlamydia trachomatis
uuguuuagcauuucuuu

SEQ ID NO: 2494949 - RNA, 18 nt, Chlamydia trachomatis
uuguuuauuaucuagaaa

SEQ ID NO: 2494950 - RNA, 21 nt, Chlamydia trachomatis
uuguuuauuaucuagaaaaga

SEQ ID NO: 2494951 - RNA, 17 nt, Chlamydia trachomatis
uuguuuguuuuuuucaa

SEQ ID NO: 2494952 - RNA, 18 nt, Chlamydia trachomatis
uuguuuuuuaagaguuuu

SEQ ID NO: 2494953 - RNA, 13 nt, Chlamydia trachomatis
uuuaaaagaagcu

SEQ ID NO: 2494954 - RNA, 15 nt, Chlamydia trachomatis
uuuaaagaggaucag

SEQ ID NO: 2494955 - RNA, 20 nt, Chlamydia trachomatis
uuuaaagggggacaaaaaua

SEQ ID NO: 2494956 - RNA, 20 nt, Chlamydia trachomatis
uuuaaccagaauauaagcac

SEQ ID NO: 2494957 - RNA, 14 nt, Chlamydia trachomatis
uuuaaccucugcaa

SEQ ID NO: 2494958 - RNA, 18 nt, Chlamydia trachomatis
uuuaaccucugcaagaaa

SEQ ID NO: 2494959 - RNA, 22 nt, Chlamydia trachomatis
uuuaaccucugcaagaaaauaa

SEQ ID NO: 2494960 - RNA, 20 nt, Chlamydia trachomatis
uuuaacuucccacucauccu

SEQ ID NO: 2494961 - RNA, 19 nt, Chlamydia trachomatis
uuuaagggaauagccuaug

SEQ ID NO: 2494962 - RNA, 21 nt, Chlamydia trachomatis
uuuaagucguacauuaauagc

SEQ ID NO: 2494963 - RNA, 23 nt, Chlamydia trachomatis
uuuaauaaaagcuccuaaagaag

SEQ ID NO: 2494964 - RNA, 18 nt, Chlamydia trachomatis
uuuaauaaguuuuucaaa

SEQ ID NO: 2494965 - RNA, 18 nt, Chlamydia trachomatis
uuuaauuaugcaaaaaga

SEQ ID NO: 2494966 - RNA, 16 nt, Chlamydia trachomatis
uuuaauuccaucuuuu

SEQ ID NO: 2494967 - RNA, 20 nt, Chlamydia trachomatis
uuuacaauagguuuaaauaa

SEQ ID NO: 2494968 - RNA, 21 nt, Chlamydia trachomatis
uuuacaauagguuuaaauaag

SEQ ID NO: 2494969 - RNA, 14 nt, Chlamydia trachomatis
uuuacaaucaucuu

SEQ ID NO: 2494970 - RNA, 20 nt, Chlamydia trachomatis
uuuacaauguacgcuaaaaa

SEQ ID NO: 2494971 - RNA, 18 nt, Chlamydia trachomatis
uuuaccaaaccuuucaaa

SEQ ID NO: 2494972 - RNA, 21 nt, Chlamydia trachomatis
uuuaccucuccauuuuccugu

SEQ ID NO: 2494973 - RNA, 15 nt, Chlamydia trachomatis
uuuacgcacaaagau

SEQ ID NO: 2494974 - RNA, 16 nt, Chlamydia trachomatis
uuuacgcacuucugcu

SEQ ID NO: 2494975 - RNA, 20 nt, Chlamydia trachomatis
uuuacgucaauuuuuccauu

SEQ ID NO: 2494976 - RNA, 12 nt, Chlamydia trachomatis
uuuacugucgau

SEQ ID NO: 2494977 - RNA, 16 nt, Chlamydia trachomatis
uuuacuugagagccua

SEQ ID NO: 2494978 - RNA, 15 nt, Chlamydia trachomatis
uuuacuuucuuugcu

SEQ ID NO: 2494979 - RNA, 15 nt, Chlamydia trachomatis
uuuagaagacaaaga

SEQ ID NO: 2494980 - RNA, 17 nt, Chlamydia trachomatis
uuuagaaggaaagcuau

SEQ ID NO: 2494981 - RNA, 13 nt, Chlamydia trachomatis
uuuagagaaaaga

SEQ ID NO: 2494982 - RNA, 18 nt, Chlamydia trachomatis
uuuagauaaaagaagcag

SEQ ID NO: 2494983 - RNA, 16 nt, Chlamydia trachomatis
uuuagccaauuuccau

SEQ ID NO: 2494984 - RNA, 21 nt, Chlamydia trachomatis
uuuagcucgcuucaaaacuaa

SEQ ID NO: 2494985 - RNA, 23 nt, Chlamydia trachomatis
uuuaggagauuguuguaugcucg

SEQ ID NO: 2494986 - RNA, 12 nt, Chlamydia trachomatis
uuuagucuguga

SEQ ID NO: 2494987 - RNA, 11 nt, Chlamydia trachomatis
uuuauaaaaag

SEQ ID NO: 2494988 - RNA, 13 nt, Chlamydia trachomatis
uuuauaauccagg

SEQ ID NO: 2494989 - RNA, 22 nt, Chlamydia trachomatis
uuuauacuagggaauaaaagua

SEQ ID NO: 2494990 - RNA, 17 nt, Chlamydia trachomatis
uuuauacucuaaaaguu

SEQ ID NO: 2494991 - RNA, 21 nt, Chlamydia trachomatis
uuuauacuucuuacuuaaaaa

SEQ ID NO: 2494992 - RNA, 23 nt, Chlamydia trachomatis
uuuauacuucuuacuuaaaaaac

SEQ ID NO: 2494993 - RNA, 14 nt, Chlamydia trachomatis
uuuauagaaccccu

SEQ ID NO: 2494994 - RNA, 13 nt, Chlamydia trachomatis
uuuauagaauuuu

SEQ ID NO: 2494995 - RNA, 22 nt, Chlamydia trachomatis
uuuaucauugaaaucagaaaca

SEQ ID NO: 2494996 - RNA, 24 nt, Chlamydia trachomatis
uuuaucgcuuuuccaauauuauuu

SEQ ID NO: 2494997 - RNA, 17 nt, Chlamydia trachomatis
uuuaucugcuaaagaaa

SEQ ID NO: 2494998 - RNA, 14 nt, Chlamydia trachomatis
uuuaucuucaaaga

SEQ ID NO: 2494999 - RNA, 15 nt, Chlamydia trachomatis
uuuaugaagcaaaua

SEQ ID NO: 2495000 - RNA, 22 nt, Chlamydia trachomatis
uuuaugaagcaaauagauaacu

SEQ ID NO: 2495001 - RNA, 22 nt, Chlamydia trachomatis
uuuauuaaaucgugagcgucuu

SEQ ID NO: 2495002 - RNA, 19 nt, Chlamydia trachomatis
uuuauucaaaucuucuucu

SEQ ID NO: 2495003 - RNA, 13 nt, Chlamydia trachomatis
uuuauucucaccu

SEQ ID NO: 2495004 - RNA, 19 nt, Chlamydia trachomatis
uuuauucucaccuugaacg

SEQ ID NO: 2495005 - RNA, 12 nt, Chlamydia trachomatis
uuucaaaaagag

SEQ ID NO: 2495006 - RNA, 22 nt, Chlamydia trachomatis
uuucaaaaagagcuaaacuucu

SEQ ID NO: 2495007 - RNA, 22 nt, Chlamydia trachomatis
uuucaaagaagcuccuuuaccu

SEQ ID NO: 2495008 - RNA, 22 nt, Chlamydia trachomatis
uuucaaagaugcgaucuccuca

SEQ ID NO: 2495009 - RNA, 18 nt, Chlamydia trachomatis
uuucaauagcaaugaagg

SEQ ID NO: 2495010 - RNA, 17 nt, Chlamydia trachomatis
uuucacaagguguccug

SEQ ID NO: 2495011 - RNA, 21 nt, Chlamydia trachomatis
uuucacacauccuucugcuau

SEQ ID NO: 2495012 - RNA, 15 nt, Chlamydia trachomatis
uuucagaauuacccu

SEQ ID NO: 2495013 - RNA, 17 nt, Chlamydia trachomatis
uuucagagaaaauuucu

SEQ ID NO: 2495014 - RNA, 19 nt, Chlamydia trachomatis
uuucagagaaaauuucucu

SEQ ID NO: 2495015 - RNA, 20 nt, Chlamydia trachomatis
uuucagagaaaauuucucuu

SEQ ID NO: 2495016 - RNA, 18 nt, Chlamydia trachomatis
uuucagcaagaacagauu

SEQ ID NO: 2495017 - RNA, 14 nt, Chlamydia trachomatis
uuucagcaauaaua

SEQ ID NO: 2495018 - RNA, 14 nt, Chlamydia trachomatis
uuucaucaaaauau

SEQ ID NO: 2495019 - RNA, 15 nt, Chlamydia trachomatis
uuucaucaaaauaua

SEQ ID NO: 2495020 - RNA, 22 nt, Chlamydia trachomatis
uuucaucaucauggaaaauaug

SEQ ID NO: 2495021 - RNA, 16 nt, Chlamydia trachomatis
uuucaucuccuuugcu

SEQ ID NO: 2495022 - RNA, 14 nt, Chlamydia trachomatis
uuucauucguuucu

SEQ ID NO: 2495023 - RNA, 20 nt, Chlamydia trachomatis
uuucauuuuauguaaauauu

SEQ ID NO: 2495024 - RNA, 18 nt, Chlamydia trachomatis
uuuccaaagcuucuaacg

SEQ ID NO: 2495025 - RNA, 23 nt, Chlamydia trachomatis
uuuccaagaaaaauacagcggau

SEQ ID NO: 2495026 - RNA, 19 nt, Chlamydia trachomatis
uuuccacaaauauuuuugg

SEQ ID NO: 2495027 - RNA, 18 nt, Chlamydia trachomatis
uuuccacaagauuuugaa

SEQ ID NO: 2495028 - RNA, 17 nt, Chlamydia trachomatis
uuuccacagguugcauc

SEQ ID NO: 2495029 - RNA, 19 nt, Chlamydia trachomatis
uuuccagccucuccagaaa

SEQ ID NO: 2495030 - RNA, 17 nt, Chlamydia trachomatis
uuuccauacaucaucuc

SEQ ID NO: 2495031 - RNA, 18 nt, Chlamydia trachomatis
uuuccauacaucaucucu

SEQ ID NO: 2495032 - RNA, 21 nt, Chlamydia trachomatis
uuuccauacaucaucucucag

SEQ ID NO: 2495033 - RNA, 17 nt, Chlamydia trachomatis
uuuccauagaaagauag

SEQ ID NO: 2495034 - RNA, 21 nt, Chlamydia trachomatis
uuuccauggagcuucaucauu

SEQ ID NO: 2495035 - RNA, 17 nt, Chlamydia trachomatis
uuuccauuuccagaacg

SEQ ID NO: 2495036 - RNA, 13 nt, Chlamydia trachomatis
uuucccaaaauuu

SEQ ID NO: 2495037 - RNA, 19 nt, Chlamydia trachomatis
uuucccaucuacaaaacca

SEQ ID NO: 2495038 - RNA, 21 nt, Chlamydia trachomatis
uuucccaucuacaaaaccaaa

SEQ ID NO: 2495039 - RNA, 19 nt, Chlamydia trachomatis
uuucccccaccuuuucucc

SEQ ID NO: 2495040 - RNA, 20 nt, Chlamydia trachomatis
uuuccccuacaaacauccuu

SEQ ID NO: 2495041 - RNA, 22 nt, Chlamydia trachomatis
uuuccccuauaugagccuugcc

SEQ ID NO: 2495042 - RNA, 14 nt, Chlamydia trachomatis
uuuccccugaacua

SEQ ID NO: 2495043 - RNA, 15 nt, Chlamydia trachomatis
uuuccgaauuaaauc

SEQ ID NO: 2495044 - RNA, 21 nt, Chlamydia trachomatis
uuuccgagagcgaagacagaa

SEQ ID NO: 2495045 - RNA, 21 nt, Chlamydia trachomatis
uuuccgcacccaaucuucuaa

SEQ ID NO: 2495046 - RNA, 22 nt, Chlamydia trachomatis
uuuccgcacccaaucuucuaaa

SEQ ID NO: 2495047 - RNA, 18 nt, Chlamydia trachomatis
uuuccgcugcaaucucuu

SEQ ID NO: 2495048 - RNA, 18 nt, Chlamydia trachomatis
uuuccuacgcgaaucaca

SEQ ID NO: 2495049 - RNA, 12 nt, Chlamydia trachomatis
uuuccucacaca

SEQ ID NO: 2495050 - RNA, 19 nt, Chlamydia trachomatis
uuuccucacacacaaaaaa

SEQ ID NO: 2495051 - RNA, 14 nt, Chlamydia trachomatis
uuuccucuagcaga

SEQ ID NO: 2495052 - RNA, 20 nt, Chlamydia trachomatis
uuuccucugguacucaucuu

SEQ ID NO: 2495053 - RNA, 22 nt, Chlamydia trachomatis
uuuccucugguacucaucuuuu

SEQ ID NO: 2495054 - RNA, 13 nt, Chlamydia trachomatis
uuuccucuucaga

SEQ ID NO: 2495055 - RNA, 21 nt, Chlamydia trachomatis
uuuccucuucagacacaauga

SEQ ID NO: 2495056 - RNA, 14 nt, Chlamydia trachomatis
uuuccucuucuucg

SEQ ID NO: 2495057 - RNA, 14 nt, Chlamydia trachomatis
uuuccugaaacgau

SEQ ID NO: 2495058 - RNA, 21 nt, Chlamydia trachomatis
uuuccugaaacgaucagcucc

SEQ ID NO: 2495059 - RNA, 12 nt, Chlamydia trachomatis
uuuccuuaguuu

SEQ ID NO: 2495060 - RNA, 23 nt, Chlamydia trachomatis
uuuccuuaguuuuaauuccaucu

SEQ ID NO: 2495061 - RNA, 17 nt, Chlamydia trachomatis
uuucgauuaaugagguu

SEQ ID NO: 2495062 - RNA, 16 nt, Chlamydia trachomatis
uuucuaaaaaacuuug

SEQ ID NO: 2495063 - RNA, 22 nt, Chlamydia trachomatis
uuucuaauggaugaucuguaau

SEQ ID NO: 2495064 - RNA, 21 nt, Chlamydia trachomatis
uuucuacaacuaucagaagau

SEQ ID NO: 2495065 - RNA, 16 nt, Chlamydia trachomatis
uuucuacggaaagguu

SEQ ID NO: 2495066 - RNA, 20 nt, Chlamydia trachomatis
uuucuacggaaagguuuguu

SEQ ID NO: 2495067 - RNA, 14 nt, Chlamydia trachomatis
uuucuagaagaacu

SEQ ID NO: 2495068 - RNA, 17 nt, Chlamydia trachomatis
uuucuagaagaacuccc

SEQ ID NO: 2495069 - RNA, 20 nt, Chlamydia trachomatis
uuucuagaagaacucccccu

SEQ ID NO: 2495070 - RNA, 14 nt, Chlamydia trachomatis
uuucuagaauuuug

SEQ ID NO: 2495071 - RNA, 14 nt, Chlamydia trachomatis
uuucuagauggaua

SEQ ID NO: 2495072 - RNA, 15 nt, Chlamydia trachomatis
uuucuagcuucuugu

SEQ ID NO: 2495073 - RNA, 21 nt, Chlamydia trachomatis
uuucuauagccauuucaucau

SEQ ID NO: 2495074 - RNA, 12 nt, Chlamydia trachomatis
uuucuauuuuua

SEQ ID NO: 2495075 - RNA, 14 nt, Chlamydia trachomatis
uuucuccagaggaa

SEQ ID NO: 2495076 - RNA, 17 nt, Chlamydia trachomatis
uuucuccagcaucuuuu

SEQ ID NO: 2495077 - RNA, 22 nt, Chlamydia trachomatis
uuucuccucucucuuuaugaaa

SEQ ID NO: 2495078 - RNA, 15 nt, Chlamydia trachomatis
uuucucgauucucuu

SEQ ID NO: 2495079 - RNA, 13 nt, Chlamydia trachomatis
uuucugaaucaaa

SEQ ID NO: 2495080 - RNA, 14 nt, Chlamydia trachomatis
uuucugacucagaa

SEQ ID NO: 2495081 - RNA, 17 nt, Chlamydia trachomatis
uuucugacucagaaucu

SEQ ID NO: 2495082 - RNA, 14 nt, Chlamydia trachomatis
uuucugagaaaucu

SEQ ID NO: 2495083 - RNA, 13 nt, Chlamydia trachomatis
uuucugagacucc

SEQ ID NO: 2495084 - RNA, 13 nt, Chlamydia trachomatis
uuucugcaacucu

SEQ ID NO: 2495085 - RNA, 10 nt, Chlamydia trachomatis
uuucugcuaa

SEQ ID NO: 2495086 - RNA, 16 nt, Chlamydia trachomatis
uuucugcuccaaagua

SEQ ID NO: 2495087 - RNA, 22 nt, Chlamydia trachomatis
uuucuggaaaaucuuucgagga

SEQ ID NO: 2495088 - RNA, 14 nt, Chlamydia trachomatis
uuucugucuuagca

SEQ ID NO: 2495089 - RNA, 16 nt, Chlamydia trachomatis
uuucuguugcacuuuc

SEQ ID NO: 2495090 - RNA, 18 nt, Chlamydia trachomatis
uuucuuaaacaaaaauaa

SEQ ID NO: 2495091 - RNA, 22 nt, Chlamydia trachomatis
uuucuuacgaccguauuuuuua

SEQ ID NO: 2495092 - RNA, 15 nt, Chlamydia trachomatis
uuucuuacuccuucu

SEQ ID NO: 2495093 - RNA, 14 nt, Chlamydia trachomatis
uuucuuagaauuuu

SEQ ID NO: 2495094 - RNA, 21 nt, Chlamydia trachomatis
uuucuuagccuuguuucucaa

SEQ ID NO: 2495095 - RNA, 14 nt, Chlamydia trachomatis
uuucuuaucagcau

SEQ ID NO: 2495096 - RNA, 19 nt, Chlamydia trachomatis
uuucuucaggugaucucuu

SEQ ID NO: 2495097 - RNA, 22 nt, Chlamydia trachomatis
uuucuucccuuuuuucuguuug

SEQ ID NO: 2495098 - RNA, 21 nt, Chlamydia trachomatis
uuucuuccucaguauaaaaaa

SEQ ID NO: 2495099 - RNA, 12 nt, Chlamydia trachomatis
uuucuuccugcu

SEQ ID NO: 2495100 - RNA, 14 nt, Chlamydia trachomatis
uuucuucgguuuga

SEQ ID NO: 2495101 - RNA, 14 nt, Chlamydia trachomatis
uuucuucuagauag

SEQ ID NO: 2495102 - RNA, 12 nt, Chlamydia trachomatis
uuucuucuguuu

SEQ ID NO: 2495103 - RNA, 11 nt, Chlamydia trachomatis
uuucuucuuug

SEQ ID NO: 2495104 - RNA, 16 nt, Chlamydia trachomatis
uuucuuuaacaucuuu

SEQ ID NO: 2495105 - RNA, 19 nt, Chlamydia trachomatis
uuucuuuaagcaacaacug

SEQ ID NO: 2495106 - RNA, 16 nt, Chlamydia trachomatis
uuucuuucaaagagau

SEQ ID NO: 2495107 - RNA, 15 nt, Chlamydia trachomatis
uuucuuuuccaucgu

SEQ ID NO: 2495108 - RNA, 21 nt, Chlamydia trachomatis
uuugaauaauagaaaaacuau

SEQ ID NO: 2495109 - RNA, 21 nt, Chlamydia trachomatis
uuugaauagggggaguucuau

SEQ ID NO: 2495110 - RNA, 21 nt, Chlamydia trachomatis
uuugaaucacagaaacuucuu

SEQ ID NO: 2495111 - RNA, 23 nt, Chlamydia trachomatis
uuugaaucacagaaacuucuucu

SEQ ID NO: 2495112 - RNA, 20 nt, Chlamydia trachomatis
uuugaauuuaugucgcagcu

SEQ ID NO: 2495113 - RNA, 15 nt, Chlamydia trachomatis
uuugacaagcaguag

SEQ ID NO: 2495114 - RNA, 16 nt, Chlamydia trachomatis
uuugacgacaacauga

SEQ ID NO: 2495115 - RNA, 18 nt, Chlamydia trachomatis
uuugacucucauaagaau

SEQ ID NO: 2495116 - RNA, 17 nt, Chlamydia trachomatis
uuugaggaagaaauguu

SEQ ID NO: 2495117 - RNA, 22 nt, Chlamydia trachomatis
uuugaggacugacagaaguuag

SEQ ID NO: 2495118 - RNA, 15 nt, Chlamydia trachomatis
uuugaggcucucuag

SEQ ID NO: 2495119 - RNA, 22 nt, Chlamydia trachomatis
uuugaguaggacucuaagagaa

SEQ ID NO: 2495120 - RNA, 18 nt, Chlamydia trachomatis
uuugauaacgcuguuccu

SEQ ID NO: 2495121 - RNA, 15 nt, Chlamydia trachomatis
uuugaucuucuggaa

SEQ ID NO: 2495122 - RNA, 17 nt, Chlamydia trachomatis
uuugaucuuuccagcag

SEQ ID NO: 2495123 - RNA, 14 nt, Chlamydia trachomatis
uuugaugaggcuug

SEQ ID NO: 2495124 - RNA, 16 nt, Chlamydia trachomatis
uuugaugccacugacu

SEQ ID NO: 2495125 - RNA, 17 nt, Chlamydia trachomatis
uuugauucauuguaucu

SEQ ID NO: 2495126 - RNA, 18 nt, Chlamydia trachomatis
uuugauuuuucuuucaaa

SEQ ID NO: 2495127 - RNA, 16 nt, Chlamydia trachomatis
uuugcaacaaagcuuu

SEQ ID NO: 2495128 - RNA, 13 nt, Chlamydia trachomatis
uuugcaaucauuu

SEQ ID NO: 2495129 - RNA, 15 nt, Chlamydia trachomatis
uuugcaaugcaaaac

SEQ ID NO: 2495130 - RNA, 17 nt, Chlamydia trachomatis
uuugcaaugcaaaacau

SEQ ID NO: 2495131 - RNA, 14 nt, Chlamydia trachomatis
uuugcacaaaaaaa

SEQ ID NO: 2495132 - RNA, 21 nt, Chlamydia trachomatis
uuugcagcauccucaaaaaag

SEQ ID NO: 2495133 - RNA, 19 nt, Chlamydia trachomatis
uuugcauucuuuuaagaau

SEQ ID NO: 2495134 - RNA, 21 nt, Chlamydia trachomatis
uuugccuauagagcaaucucu

SEQ ID NO: 2495135 - RNA, 18 nt, Chlamydia trachomatis
uuugcguagcucagagau

SEQ ID NO: 2495136 - RNA, 17 nt, Chlamydia trachomatis
uuugcuaacaaagaauu

SEQ ID NO: 2495137 - RNA, 21 nt, Chlamydia trachomatis
uuugcuaggguucuaaagaaa

SEQ ID NO: 2495138 - RNA, 21 nt, Chlamydia trachomatis
uuugcuggguuuuaucaagag

SEQ ID NO: 2495139 - RNA, 19 nt, Chlamydia trachomatis
uuuggagcagcuaacagcu

SEQ ID NO: 2495140 - RNA, 23 nt, Chlamydia trachomatis
uuuggcaugcccuaaagagaucu

SEQ ID NO: 2495141 - RNA, 15 nt, Chlamydia trachomatis
uuuggcguauuucuu

SEQ ID NO: 2495142 - RNA, 17 nt, Chlamydia trachomatis
uuuggcguauuucuugu

SEQ ID NO: 2495143 - RNA, 14 nt, Chlamydia trachomatis
uuugggcauuccua

SEQ ID NO: 2495144 - RNA, 13 nt, Chlamydia trachomatis
uuuggguuuuaau

SEQ ID NO: 2495145 - RNA, 15 nt, Chlamydia trachomatis
uuugguguggaguau

SEQ ID NO: 2495146 - RNA, 16 nt, Chlamydia trachomatis
uuugguucuuguaauu

SEQ ID NO: 2495147 - RNA, 12 nt, Chlamydia trachomatis
uuugguuucuuc

SEQ ID NO: 2495148 - RNA, 16 nt, Chlamydia trachomatis
uuugguuuuuuuuguu

SEQ ID NO: 2495149 - RNA, 20 nt, Chlamydia trachomatis
uuuguacaugauaaugaguu

SEQ ID NO: 2495150 - RNA, 19 nt, Chlamydia trachomatis
uuuguagauguagcagaau

SEQ ID NO: 2495151 - RNA, 15 nt, Chlamydia trachomatis
uuuguagcaaaagau

SEQ ID NO: 2495152 - RNA, 19 nt, Chlamydia trachomatis
uuuguaguuagacaaaaaa

SEQ ID NO: 2495153 - RNA, 15 nt, Chlamydia trachomatis
uuuguauaaugcaac

SEQ ID NO: 2495154 - RNA, 18 nt, Chlamydia trachomatis
uuuguccuggccaaaaaa

SEQ ID NO: 2495155 - RNA, 19 nt, Chlamydia trachomatis
uuugucuuuagcauaguau

SEQ ID NO: 2495156 - RNA, 17 nt, Chlamydia trachomatis
uuugugauuucugaauc

SEQ ID NO: 2495157 - RNA, 16 nt, Chlamydia trachomatis
uuuguguauggaagua

SEQ ID NO: 2495158 - RNA, 19 nt, Chlamydia trachomatis
uuuguuagcggaacaagca

SEQ ID NO: 2495159 - RNA, 15 nt, Chlamydia trachomatis
uuuguuaucuaaauc

SEQ ID NO: 2495160 - RNA, 22 nt, Chlamydia trachomatis
uuuguuccuacuaaaaugacua

SEQ ID NO: 2495161 - RNA, 19 nt, Chlamydia trachomatis
uuuguucucuaaagauucu

SEQ ID NO: 2495162 - RNA, 23 nt, Chlamydia trachomatis
uuuguucucuaaagauucuguaa

SEQ ID NO: 2495163 - RNA, 21 nt, Chlamydia trachomatis
uuuguuguccacaugccaucg

SEQ ID NO: 2495164 - RNA, 14 nt, Chlamydia trachomatis
uuuguuuccucucu

SEQ ID NO: 2495165 - RNA, 13 nt, Chlamydia trachomatis
uuuguuucuacuu

SEQ ID NO: 2495166 - RNA, 11 nt, Chlamydia trachomatis
uuuguuuuuuu

SEQ ID NO: 2495167 - RNA, 15 nt, Chlamydia trachomatis
uuuuaaaaucuccuc

SEQ ID NO: 2495168 - RNA, 12 nt, Chlamydia trachomatis
uuuuaagauauc

SEQ ID NO: 2495169 - RNA, 13 nt, Chlamydia trachomatis
uuuuaauccagcu

SEQ ID NO: 2495170 - RNA, 15 nt, Chlamydia trachomatis
uuuuaauuccaucuu

SEQ ID NO: 2495171 - RNA, 20 nt, Chlamydia trachomatis
uuuuacguaauucaugaucu

SEQ ID NO: 2495172 - RNA, 19 nt, Chlamydia trachomatis
uuuuagcguaauagcucug

SEQ ID NO: 2495173 - RNA, 14 nt, Chlamydia trachomatis
uuuuaggcaacagc

SEQ ID NO: 2495174 - RNA, 15 nt, Chlamydia trachomatis
uuuuaggcguuccug

SEQ ID NO: 2495175 - RNA, 13 nt, Chlamydia trachomatis
uuuuaucuaaaaa

SEQ ID NO: 2495176 - RNA, 15 nt, Chlamydia trachomatis
uuuuaucuaaaaagg

SEQ ID NO: 2495177 - RNA, 15 nt, Chlamydia trachomatis
uuuuauucacccaaa

SEQ ID NO: 2495178 - RNA, 13 nt, Chlamydia trachomatis
uuuucaaaaauaa

SEQ ID NO: 2495179 - RNA, 13 nt, Chlamydia trachomatis
uuuucaaaaauag

SEQ ID NO: 2495180 - RNA, 17 nt, Chlamydia trachomatis
uuuucaaaaccuugaug

SEQ ID NO: 2495181 - RNA, 18 nt, Chlamydia trachomatis
uuuucaauagcaaugaag

SEQ ID NO: 2495182 - RNA, 16 nt, Chlamydia trachomatis
uuuucacaaagagaag

SEQ ID NO: 2495183 - RNA, 14 nt, Chlamydia trachomatis
uuuucacaagaccu

SEQ ID NO: 2495184 - RNA, 16 nt, Chlamydia trachomatis
uuuucagcaagaacag

SEQ ID NO: 2495185 - RNA, 18 nt, Chlamydia trachomatis
uuuucaggagaaaggcuu

SEQ ID NO: 2495186 - RNA, 16 nt, Chlamydia trachomatis
uuuucagggauagaaa

SEQ ID NO: 2495187 - RNA, 13 nt, Chlamydia trachomatis
uuuucaguuucaa

SEQ ID NO: 2495188 - RNA, 17 nt, Chlamydia trachomatis
uuuucaguuucaaacau

SEQ ID NO: 2495189 - RNA, 23 nt, Chlamydia trachomatis
uuuucauccuaggggauuuuaug

SEQ ID NO: 2495190 - RNA, 14 nt, Chlamydia trachomatis
uuuucaugcaagua

SEQ ID NO: 2495191 - RNA, 18 nt, Chlamydia trachomatis
uuuuccaagaaaaauaca

SEQ ID NO: 2495192 - RNA, 14 nt, Chlamydia trachomatis
uuuuccacaaauau

SEQ ID NO: 2495193 - RNA, 19 nt, Chlamydia trachomatis
uuuuccacaaauauuuuug

SEQ ID NO: 2495194 - RNA, 19 nt, Chlamydia trachomatis
uuuucccaucuacaaaacc

SEQ ID NO: 2495195 - RNA, 24 nt, Chlamydia trachomatis
uuuucccgcaacuuuucagcaaga

SEQ ID NO: 2495196 - RNA, 14 nt, Chlamydia trachomatis
uuuucccuagaaaa

SEQ ID NO: 2495197 - RNA, 17 nt, Chlamydia trachomatis
uuuuccgaauaaaauca

SEQ ID NO: 2495198 - RNA, 23 nt, Chlamydia trachomatis
uuuuccgaauuaaaucugcuccu

SEQ ID NO: 2495199 - RNA, 15 nt, Chlamydia trachomatis
uuuuccgaauucuuu

SEQ ID NO: 2495200 - RNA, 18 nt, Chlamydia trachomatis
uuuuccuaaacaaaaacu

SEQ ID NO: 2495201 - RNA, 13 nt, Chlamydia trachomatis
uuuuccucuucac

SEQ ID NO: 2495202 - RNA, 21 nt, Chlamydia trachomatis
uuuucgaauuuuuuucuuugc

SEQ ID NO: 2495203 - RNA, 19 nt, Chlamydia trachomatis
uuuucgauagaaaaaaaca

SEQ ID NO: 2495204 - RNA, 12 nt, Chlamydia trachomatis
uuuucgcuuuug

SEQ ID NO: 2495205 - RNA, 15 nt, Chlamydia trachomatis
uuuucggagaagaag

SEQ ID NO: 2495206 - RNA, 17 nt, Chlamydia trachomatis
uuuucggagaagaagag

SEQ ID NO: 2495207 - RNA, 20 nt, Chlamydia trachomatis
uuuucguaagcauagcuucu

SEQ ID NO: 2495208 - RNA, 22 nt, Chlamydia trachomatis
uuuucguaagcauagcuucuug

SEQ ID NO: 2495209 - RNA, 16 nt, Chlamydia trachomatis
uuuucuagugcaugga

SEQ ID NO: 2495210 - RNA, 14 nt, Chlamydia trachomatis
uuuucuauuucaga

SEQ ID NO: 2495211 - RNA, 15 nt, Chlamydia trachomatis
uuuucucccuaagau

SEQ ID NO: 2495212 - RNA, 12 nt, Chlamydia trachomatis
uuuucucucuag

SEQ ID NO: 2495213 - RNA, 13 nt, Chlamydia trachomatis
uuuucucucuagc

SEQ ID NO: 2495214 - RNA, 13 nt, Chlamydia trachomatis
uuuucuuccagag

SEQ ID NO: 2495215 - RNA, 22 nt, Chlamydia trachomatis
uuuucuuccagagcauguguuu

SEQ ID NO: 2495216 - RNA, 14 nt, Chlamydia trachomatis
uuuucuucucuagc

SEQ ID NO: 2495217 - RNA, 11 nt, Chlamydia trachomatis
uuuucuucuuu

SEQ ID NO: 2495218 - RNA, 23 nt, Chlamydia trachomatis
uuuucuugugauaucuccaccau

SEQ ID NO: 2495219 - RNA, 15 nt, Chlamydia trachomatis
uuuucuuucaaagag

SEQ ID NO: 2495220 - RNA, 22 nt, Chlamydia trachomatis
uuuucuuuccuagcgaagucuu

SEQ ID NO: 2495221 - RNA, 16 nt, Chlamydia trachomatis
uuuugaagauaaaacu

SEQ ID NO: 2495222 - RNA, 12 nt, Chlamydia trachomatis
uuuugaauacga

SEQ ID NO: 2495223 - RNA, 15 nt, Chlamydia trachomatis
uuuugaucccuaaua

SEQ ID NO: 2495224 - RNA, 24 nt, Chlamydia trachomatis
uuuugaucccuaauaugaagaacu

SEQ ID NO: 2495225 - RNA, 18 nt, Chlamydia trachomatis
uuuugaucuuuccagcag

SEQ ID NO: 2495226 - RNA, 23 nt, Chlamydia trachomatis
uuuugaugaggcuuguugccaac

SEQ ID NO: 2495227 - RNA, 14 nt, Chlamydia trachomatis
uuuugauuuuucuu

SEQ ID NO: 2495228 - RNA, 14 nt, Chlamydia trachomatis
uuuugcaaaaauuu

SEQ ID NO: 2495229 - RNA, 16 nt, Chlamydia trachomatis
uuuugcaacaaagcuu

SEQ ID NO: 2495230 - RNA, 18 nt, Chlamydia trachomatis
uuuugcagccuuucccuu

SEQ ID NO: 2495231 - RNA, 19 nt, Chlamydia trachomatis
uuuugcuaugaaaaauccu

SEQ ID NO: 2495232 - RNA, 16 nt, Chlamydia trachomatis
uuuuggaagaucucuu

SEQ ID NO: 2495233 - RNA, 22 nt, Chlamydia trachomatis
uuuuggaagaucucuuucucua

SEQ ID NO: 2495234 - RNA, 14 nt, Chlamydia trachomatis
uuuuguacgacaaa

SEQ ID NO: 2495235 - RNA, 13 nt, Chlamydia trachomatis
uuuuguaggagaa

SEQ ID NO: 2495236 - RNA, 18 nt, Chlamydia trachomatis
uuuuguaguugcgccuuc

SEQ ID NO: 2495237 - RNA, 15 nt, Chlamydia trachomatis
uuuuguguaauagcu

SEQ ID NO: 2495238 - RNA, 16 nt, Chlamydia trachomatis
uuuuguguuuccaaag

SEQ ID NO: 2495239 - RNA, 22 nt, Chlamydia trachomatis
uuuuguguuuccaaagcuuuaa

SEQ ID NO: 2495240 - RNA, 22 nt, Chlamydia trachomatis
uuuuguuuaaucagugugugua

SEQ ID NO: 2495241 - RNA, 16 nt, Chlamydia trachomatis
uuuuguuuucaaaagc

SEQ ID NO: 2495242 - RNA, 16 nt, Chlamydia trachomatis
uuuuuaaaagaccaua

SEQ ID NO: 2495243 - RNA, 22 nt, Chlamydia trachomatis
uuuuuaaaagagucgcuucugg

SEQ ID NO: 2495244 - RNA, 12 nt, Chlamydia trachomatis
uuuuuaaaauaa

SEQ ID NO: 2495245 - RNA, 19 nt, Chlamydia trachomatis
uuuuuaauaauaaagauag

SEQ ID NO: 2495246 - RNA, 15 nt, Chlamydia trachomatis
uuuuuaauauccucc

SEQ ID NO: 2495247 - RNA, 13 nt, Chlamydia trachomatis
uuuuuacaaugua

SEQ ID NO: 2495248 - RNA, 16 nt, Chlamydia trachomatis
uuuuuacgcucuuucu

SEQ ID NO: 2495249 - RNA, 13 nt, Chlamydia trachomatis
uuuuuaggaggaa

SEQ ID NO: 2495250 - RNA, 22 nt, Chlamydia trachomatis
uuuuucaagaggcuuaaagaua

SEQ ID NO: 2495251 - RNA, 13 nt, Chlamydia trachomatis
uuuuucagaaaaa

SEQ ID NO: 2495252 - RNA, 15 nt, Chlamydia trachomatis
uuuuucagacaaaaa

SEQ ID NO: 2495253 - RNA, 14 nt, Chlamydia trachomatis
uuuuucagcaauaa

SEQ ID NO: 2495254 - RNA, 18 nt, Chlamydia trachomatis
uuuuucagcaauaauacc

SEQ ID NO: 2495255 - RNA, 21 nt, Chlamydia trachomatis
uuuuucagggauagaaacucc

SEQ ID NO: 2495256 - RNA, 20 nt, Chlamydia trachomatis
uuuuucccacaaacaaaaaa

SEQ ID NO: 2495257 - RNA, 17 nt, Chlamydia trachomatis
uuuuucgauagaaaaaa

SEQ ID NO: 2495258 - RNA, 22 nt, Chlamydia trachomatis
uuuuucgauagaaaaaaacagc

SEQ ID NO: 2495259 - RNA, 16 nt, Chlamydia trachomatis
uuuuucguuaaugcua

SEQ ID NO: 2495260 - RNA, 10 nt, Chlamydia trachomatis
uuuuucucuu

SEQ ID NO: 2495261 - RNA, 15 nt, Chlamydia trachomatis
uuuuucuguaauaag

SEQ ID NO: 2495262 - RNA, 12 nt, Chlamydia trachomatis
uuuuucuucucu

SEQ ID NO: 2495263 - RNA, 12 nt, Chlamydia trachomatis
uuuuugaaugau

SEQ ID NO: 2495264 - RNA, 19 nt, Chlamydia trachomatis
uuuuuggacgaggguuuaa

SEQ ID NO: 2495265 - RNA, 14 nt, Chlamydia trachomatis
uuuuuggauguacu

SEQ ID NO: 2495266 - RNA, 15 nt, Chlamydia trachomatis
uuuuuguuauccaaa

SEQ ID NO: 2495267 - RNA, 11 nt, Chlamydia trachomatis
uuuuuucagga

SEQ ID NO: 2495268 - RNA, 13 nt, Chlamydia trachomatis
uuuuuucuuugcu

SEQ ID NO: 2495269 - RNA, 19 nt, Chlamydia trachomatis
uuuuuugagcaaaauaguc

SEQ ID NO: 2495270 - RNA, 10 nt, Chlamydia trachomatis
uuuuuuucag

SEQ ID NO: 2495271 - RNA, 12 nt, Chlamydia trachomatis
uuuuuuucccac

SEQ ID NO: 2495272 - RNA, 14 nt, Chlamydia trachomatis
aauacaaaucuuuu

SEQ ID NO: 2495273 - RNA, 15 nt, Chlamydia trachomatis
aauacaaucaguaag

SEQ ID NO: 2495274 - RNA, 22 nt, Chlamydia trachomatis
aauacaccgcaucagccccaaa

SEQ ID NO: 2495275 - RNA, 22 nt, Chlamydia trachomatis
aauacagucaugcaucccuuaa

SEQ ID NO: 2495276 - RNA, 14 nt, Chlamydia trachomatis
aauaccaaaauccu

SEQ ID NO: 2495277 - RNA, 15 nt, Chlamydia trachomatis
aauaccaaaauccuu

SEQ ID NO: 2495278 - RNA, 17 nt, Chlamydia trachomatis
aauaccacaauuuuucu

SEQ ID NO: 2495279 - RNA, 20 nt, Chlamydia trachomatis
aauaccaccauagguagaaa

SEQ ID NO: 2495280 - RNA, 14 nt, Chlamydia trachomatis
aauaccuagcaauu

SEQ ID NO: 2495281 - RNA, 22 nt, Chlamydia trachomatis
aauaccugagggcgagucucgu

SEQ ID NO: 2495282 - RNA, 18 nt, Chlamydia trachomatis
aauaccuucuuacauaag

SEQ ID NO: 2495283 - RNA, 23 nt, Chlamydia trachomatis
aauacgauccucuggauauacca

SEQ ID NO: 2495284 - RNA, 20 nt, Chlamydia trachomatis
aauacgugcccaugagaaac

SEQ ID NO: 2495285 - RNA, 19 nt, Chlamydia trachomatis
aauacuaaacuaucuaaaa

SEQ ID NO: 2495286 - RNA, 22 nt, Chlamydia trachomatis
aauacugacccauccaaaacau

SEQ ID NO: 2495287 - RNA, 13 nt, Chlamydia trachomatis
aauacuucuuuuu

SEQ ID NO: 2495288 - RNA, 20 nt, Chlamydia trachomatis
aauagaaaccuuauauaccg

SEQ ID NO: 2495289 - RNA, 14 nt, Chlamydia trachomatis
aauagaaauuuuca

SEQ ID NO: 2495290 - RNA, 20 nt, Chlamydia trachomatis
aauagagaccgcucucuuuu

SEQ ID NO: 2495291 - RNA, 20 nt, Chlamydia trachomatis
aauagauagucugcauuaaa

SEQ ID NO: 2495292 - RNA, 22 nt, Chlamydia trachomatis
aauagauucccuuuaaagaaag

SEQ ID NO: 2495293 - RNA, 12 nt, Chlamydia trachomatis
aauagcaaagaa

SEQ ID NO: 2495294 - RNA, 14 nt, Chlamydia trachomatis
aauagcaaagaaga

SEQ ID NO: 2495295 - RNA, 16 nt, Chlamydia trachomatis
aauagcaacucuuuca

SEQ ID NO: 2495296 - RNA, 20 nt, Chlamydia trachomatis
aauagcacgcaaaacaucua

SEQ ID NO: 2495297 - RNA, 20 nt, Chlamydia trachomatis
aauagcagcauucucuagac

SEQ ID NO: 2495298 - RNA, 15 nt, Chlamydia trachomatis
aauagcaucucugua

SEQ ID NO: 2495299 - RNA, 16 nt, Chlamydia trachomatis
aauagcauuaauauac

SEQ ID NO: 2495300 - RNA, 19 nt, Chlamydia trachomatis
aauagcauuaauauacuca

SEQ ID NO: 2495301 - RNA, 15 nt, Chlamydia trachomatis
aauagccacagcaua

SEQ ID NO: 2495302 - RNA, 18 nt, Chlamydia trachomatis
aauagccauuaacaacaa

SEQ ID NO: 2495303 - RNA, 22 nt, Chlamydia trachomatis
aauagccgcgaguauaggcaua

SEQ ID NO: 2495304 - RNA, 19 nt, Chlamydia trachomatis
aauagccuccaaacauuuu

SEQ ID NO: 2495305 - RNA, 18 nt, Chlamydia trachomatis
aauagcuacuagauagau

SEQ ID NO: 2495306 - RNA, 18 nt, Chlamydia trachomatis
aauagcugacuuugaaga

SEQ ID NO: 2495307 - RNA, 20 nt, Chlamydia trachomatis
aauagcuuaccucaauagca

SEQ ID NO: 2495308 - RNA, 16 nt, Chlamydia trachomatis
aauagcuugaagaaua

SEQ ID NO: 2495309 - RNA, 18 nt, Chlamydia trachomatis
aauagcuugcacagcaag

SEQ ID NO: 2495310 - RNA, 21 nt, Chlamydia trachomatis
aauagcuuuuaacuucccacu

SEQ ID NO: 2495311 - RNA, 13 nt, Chlamydia trachomatis
aauaggaggaacc

SEQ ID NO: 2495312 - RNA, 15 nt, Chlamydia trachomatis
aauagggauuuuaaa

SEQ ID NO: 2495313 - RNA, 21 nt, Chlamydia trachomatis
aauaggguuaggaaagcacuu

SEQ ID NO: 2495314 - RNA, 14 nt, Chlamydia trachomatis
aauaguucucugca

SEQ ID NO: 2495315 - RNA, 14 nt, Chlamydia trachomatis
aauaguugcaaaaa

SEQ ID NO: 2495316 - RNA, 13 nt, Chlamydia trachomatis
aauauaacuagaa

SEQ ID NO: 2495317 - RNA, 18 nt, Chlamydia trachomatis
aauauacucaacuccaga

SEQ ID NO: 2495318 - RNA, 14 nt, Chlamydia trachomatis
aauauacucagaga

SEQ ID NO: 2495319 - RNA, 15 nt, Chlamydia trachomatis
aauauacucagagau

SEQ ID NO: 2495320 - RNA, 13 nt, Chlamydia trachomatis
aauauacucccau

SEQ ID NO: 2495321 - RNA, 12 nt, Chlamydia trachomatis
aauauagaauug

SEQ ID NO: 2495322 - RNA, 21 nt, Chlamydia trachomatis
aauauagcuguaauaaacacu

SEQ ID NO: 2495323 - RNA, 21 nt, Chlamydia trachomatis
aauauagguagguuucugcua

SEQ ID NO: 2495324 - RNA, 13 nt, Chlamydia trachomatis
aauauagucccua

SEQ ID NO: 2495325 - RNA, 16 nt, Chlamydia trachomatis
aauauauccaucuaca

SEQ ID NO: 2495326 - RNA, 19 nt, Chlamydia trachomatis
aauauauggacaagcaaua

SEQ ID NO: 2495327 - RNA, 20 nt, Chlamydia trachomatis
aauaucaaaguagcaaucac

SEQ ID NO: 2495328 - RNA, 18 nt, Chlamydia trachomatis
aauaucaacguuuucacu

SEQ ID NO: 2495329 - RNA, 17 nt, Chlamydia trachomatis
aauaucauccgcuaaag

SEQ ID NO: 2495330 - RNA, 18 nt, Chlamydia trachomatis
aauaucccacucuucccc

SEQ ID NO: 2495331 - RNA, 23 nt, Chlamydia trachomatis
aauauccccauccugaacaauau

SEQ ID NO: 2495332 - RNA, 18 nt, Chlamydia trachomatis
aauauccgcuagauccgu

SEQ ID NO: 2495333 - RNA, 24 nt, Chlamydia trachomatis
aauaucgagcucauuuucuauuuc

SEQ ID NO: 2495334 - RNA, 16 nt, Chlamydia trachomatis
aauaucguaaacaacc

SEQ ID NO: 2495335 - RNA, 12 nt, Chlamydia trachomatis
aauaucugguug

SEQ ID NO: 2495336 - RNA, 16 nt, Chlamydia trachomatis
aauaucuucacgauau

SEQ ID NO: 2495337 - RNA, 23 nt, Chlamydia trachomatis
aauaugacagagcccuucuuuuc

SEQ ID NO: 2495338 - RNA, 16 nt, Chlamydia trachomatis
aauauggacuucccua

SEQ ID NO: 2495339 - RNA, 17 nt, Chlamydia trachomatis
aauaugguaauggcugu

SEQ ID NO: 2495340 - RNA, 17 nt, Chlamydia trachomatis
aauauugaucuccccau

SEQ ID NO: 2495341 - RNA, 18 nt, Chlamydia trachomatis
aauauugcucuaaagucu

SEQ ID NO: 2495342 - RNA, 19 nt, Chlamydia trachomatis
aauauuggugaucauuuuu

SEQ ID NO: 2495343 - RNA, 19 nt, Chlamydia trachomatis
aaucaaaacgcucagaaaa

SEQ ID NO: 2495344 - RNA, 16 nt, Chlamydia trachomatis
aaucaaagacuucacu

SEQ ID NO: 2495345 - RNA, 17 nt, Chlamydia trachomatis
aaucaaaggaugucuau

SEQ ID NO: 2495346 - RNA, 19 nt, Chlamydia trachomatis
aaucaauuucuagaauuuu

SEQ ID NO: 2495347 - RNA, 21 nt, Chlamydia trachomatis
aaucacacaagcugacaaagc

SEQ ID NO: 2495348 - RNA, 16 nt, Chlamydia trachomatis
aaucacacgggucucu

SEQ ID NO: 2495349 - RNA, 19 nt, Chlamydia trachomatis
aaucacaguaauacucuua

SEQ ID NO: 2495350 - RNA, 18 nt, Chlamydia trachomatis
aaucacaugcucaucaaa

SEQ ID NO: 2495351 - RNA, 20 nt, Chlamydia trachomatis
aaucacaugguuuucugggu

SEQ ID NO: 2495352 - RNA, 21 nt, Chlamydia trachomatis
aaucaccacgagaucugcauc

SEQ ID NO: 2495353 - RNA, 22 nt, Chlamydia trachomatis
aaucaccccaucccuugcaaaa

SEQ ID NO: 2495354 - RNA, 14 nt, Chlamydia trachomatis
aaucacuaaaagua

SEQ ID NO: 2495355 - RNA, 13 nt, Chlamydia trachomatis
aaucacucuacca

SEQ ID NO: 2495356 - RNA, 14 nt, Chlamydia trachomatis
aaucacugaaucag

SEQ ID NO: 2495357 - RNA, 21 nt, Chlamydia trachomatis
aaucacugagaggaguuuuuu

SEQ ID NO: 2495358 - RNA, 15 nt, Chlamydia trachomatis
aaucacuuucugcuu

SEQ ID NO: 2495359 - RNA, 13 nt, Chlamydia trachomatis
aaucaggaaucac

SEQ ID NO: 2495360 - RNA, 17 nt, Chlamydia trachomatis
aaucaguggaacugcuu

SEQ ID NO: 2495361 - RNA, 17 nt, Chlamydia trachomatis
aaucaguguacccucga

SEQ ID NO: 2495362 - RNA, 17 nt, Chlamydia trachomatis
aaucaguugaaagacuu

SEQ ID NO: 2495363 - RNA, 15 nt, Chlamydia trachomatis
aaucauacauccuac

SEQ ID NO: 2495364 - RNA, 17 nt, Chlamydia trachomatis
aaucauagauaaugaca

SEQ ID NO: 2495365 - RNA, 18 nt, Chlamydia trachomatis
aaucauauccuuugauga

SEQ ID NO: 2495366 - RNA, 13 nt, Chlamydia trachomatis
aaucaucugguau

SEQ ID NO: 2495367 - RNA, 22 nt, Chlamydia trachomatis
aaucaugaugaugagagcagcu

SEQ ID NO: 2495368 - RNA, 19 nt, Chlamydia trachomatis
aaucauuauccauaaaaau

SEQ ID NO: 2495369 - RNA, 12 nt, Chlamydia trachomatis
aaucauuuccac

SEQ ID NO: 2495370 - RNA, 23 nt, Chlamydia trachomatis
aaucauuuccacaagauuuugaa

SEQ ID NO: 2495371 - RNA, 14 nt, Chlamydia trachomatis
aaucauuuucugua

SEQ ID NO: 2495372 - RNA, 20 nt, Chlamydia trachomatis
aaucauuuucuguaauuuua

SEQ ID NO: 2495373 - RNA, 15 nt, Chlamydia trachomatis
aauccaaaguacuca

SEQ ID NO: 2495374 - RNA, 22 nt, Chlamydia trachomatis
aauccaaagucucgaauucuau

SEQ ID NO: 2495375 - RNA, 21 nt, Chlamydia trachomatis
aauccaccguacgauauccau

SEQ ID NO: 2495376 - RNA, 15 nt, Chlamydia trachomatis
aauccagaauuaauu

SEQ ID NO: 2495377 - RNA, 20 nt, Chlamydia trachomatis
aauccagcgugucuaccaau

SEQ ID NO: 2495378 - RNA, 12 nt, Chlamydia trachomatis
aauccagcugcu

SEQ ID NO: 2495379 - RNA, 12 nt, Chlamydia trachomatis
aauccaggagac

SEQ ID NO: 2495380 - RNA, 20 nt, Chlamydia trachomatis
aauccauucaagacaacuug

SEQ ID NO: 2495381 - RNA, 18 nt, Chlamydia trachomatis
aauccauucgcauuaaau

SEQ ID NO: 2495382 - RNA, 21 nt, Chlamydia trachomatis
aauccauucgcauuaaauaau

SEQ ID NO: 2495383 - RNA, 22 nt, Chlamydia trachomatis
aauccauucgcauuaaauaaua

SEQ ID NO: 2495384 - RNA, 14 nt, Chlamydia trachomatis
aauccauugauucc

SEQ ID NO: 2495385 - RNA, 22 nt, Chlamydia trachomatis
aauccauuuacgagguagccag

SEQ ID NO: 2495386 - RNA, 13 nt, Chlamydia trachomatis
aaucccaaaaaca

SEQ ID NO: 2495387 - RNA, 17 nt, Chlamydia trachomatis
aaucccucuagcaacca

SEQ ID NO: 2495388 - RNA, 14 nt, Chlamydia trachomatis
aauccgaagauuau

SEQ ID NO: 2495389 - RNA, 13 nt, Chlamydia trachomatis
aauccuaauguag

SEQ ID NO: 2495390 - RNA, 23 nt, Chlamydia trachomatis
aauccuauacccgacuaaaaaau

SEQ ID NO: 2495391 - RNA, 17 nt, Chlamydia trachomatis
aauccucuuugaauauc

SEQ ID NO: 2495392 - RNA, 14 nt, Chlamydia trachomatis
aauccugcauuuau

SEQ ID NO: 2495393 - RNA, 21 nt, Chlamydia trachomatis
aauccugcauuuauccacagg

SEQ ID NO: 2495394 - RNA, 21 nt, Chlamydia trachomatis
aauccuggaaucacaugcuca

SEQ ID NO: 2495395 - RNA, 18 nt, Chlamydia trachomatis
aauccuggaguauuuuca

SEQ ID NO: 2495396 - RNA, 21 nt, Chlamydia trachomatis
aauccuguagggaagauagga

SEQ ID NO: 2495397 - RNA, 18 nt, Chlamydia trachomatis
aauccuguggucacaaga

SEQ ID NO: 2495398 - RNA, 19 nt, Chlamydia trachomatis
aauccuguggucacaagaa

SEQ ID NO: 2495399 - RNA, 22 nt, Chlamydia trachomatis
aauccuguggucacaagaacau

SEQ ID NO: 2495400 - RNA, 21 nt, Chlamydia trachomatis
aauccuuaaccgugaacugcu

SEQ ID NO: 2495401 - RNA, 20 nt, Chlamydia trachomatis
aauccuuggcaagaagcugc

SEQ ID NO: 2495402 - RNA, 22 nt, Chlamydia trachomatis
aauccuuuucagaauuacccug

SEQ ID NO: 2495403 - RNA, 20 nt, Chlamydia trachomatis
aaucgaagggaaaucuguuu

SEQ ID NO: 2495404 - RNA, 16 nt, Chlamydia trachomatis
aaucgaggugauuuuc

SEQ ID NO: 2495405 - RNA, 16 nt, Chlamydia trachomatis
aaucgaucacagaaac

SEQ ID NO: 2495406 - RNA, 19 nt, Chlamydia trachomatis
aaucgcugagcucuuuccu

SEQ ID NO: 2495407 - RNA, 14 nt, Chlamydia trachomatis
aaucgcuucugcug

SEQ ID NO: 2495408 - RNA, 16 nt, Chlamydia trachomatis
aaucggauagagaaga

SEQ ID NO: 2495409 - RNA, 19 nt, Chlamydia trachomatis
aaucggauagagaagaauu

SEQ ID NO: 2495410 - RNA, 18 nt, Chlamydia trachomatis
aaucggcaaaagaucuca

SEQ ID NO: 2495411 - RNA, 21 nt, Chlamydia trachomatis
aaucguauaaguuuuaagaag

SEQ ID NO: 2495412 - RNA, 16 nt, Chlamydia trachomatis
aaucguauaauaaugg

SEQ ID NO: 2495413 - RNA, 21 nt, Chlamydia trachomatis
aaucgugcuaugcauuugcuc

SEQ ID NO: 2495414 - RNA, 18 nt, Chlamydia trachomatis
aaucuaaaauuuccuuau

SEQ ID NO: 2495415 - RNA, 20 nt, Chlamydia trachomatis
aaucuagacaagcacguaca

SEQ ID NO: 2495416 - RNA, 13 nt, Chlamydia trachomatis
aaucuaucuggau

SEQ ID NO: 2495417 - RNA, 12 nt, Chlamydia trachomatis
aaucucaaaaac

SEQ ID NO: 2495418 - RNA, 13 nt, Chlamydia trachomatis
aaucucaaaaaca

SEQ ID NO: 2495419 - RNA, 17 nt, Chlamydia trachomatis
aaucucaaaaacacuac

SEQ ID NO: 2495420 - RNA, 16 nt, Chlamydia trachomatis
aaucucaaaguuuuug

SEQ ID NO: 2495421 - RNA, 16 nt, Chlamydia trachomatis
aaucuccuguacacca

SEQ ID NO: 2495422 - RNA, 18 nt, Chlamydia trachomatis
aaucucgagcuaagaaaa

SEQ ID NO: 2495423 - RNA, 19 nt, Chlamydia trachomatis
aaucucgagcuaagaaaau

SEQ ID NO: 2495424 - RNA, 17 nt, Chlamydia trachomatis
aaucucugaaagagcuu

SEQ ID NO: 2495425 - RNA, 20 nt, Chlamydia trachomatis
aaucucugcaacaaagaguu

SEQ ID NO: 2495426 - RNA, 22 nt, Chlamydia trachomatis
aaucucuuaauccuugcacuaa

SEQ ID NO: 2495427 - RNA, 23 nt, Chlamydia trachomatis
aaucucuuuagcaugcacaucua

SEQ ID NO: 2495428 - RNA, 16 nt, Chlamydia trachomatis
aaucugcaacaaauac

SEQ ID NO: 2495429 - RNA, 18 nt, Chlamydia trachomatis
aaucugcaacaaauacca

SEQ ID NO: 2495430 - RNA, 21 nt, Chlamydia trachomatis
aaucugcaacaaauaccaaaa

SEQ ID NO: 2495431 - RNA, 15 nt, Chlamydia trachomatis
aaucugcaagaacaa

SEQ ID NO: 2495432 - RNA, 22 nt, Chlamydia trachomatis
aaucugcaugguaaauguguag

SEQ ID NO: 2495433 - RNA, 12 nt, Chlamydia trachomatis
aaucugcuccua

SEQ ID NO: 2495434 - RNA, 15 nt, Chlamydia trachomatis
aaucugcuuaucucc

SEQ ID NO: 2495435 - RNA, 18 nt, Chlamydia trachomatis
aaucuggauagacagcca

SEQ ID NO: 2495436 - RNA, 13 nt, Chlamydia trachomatis
aaucugguuuaau

SEQ ID NO: 2495437 - RNA, 20 nt, Chlamydia trachomatis
aaucuguaauaaacccugga

SEQ ID NO: 2495438 - RNA, 13 nt, Chlamydia trachomatis
aaucuguagggga

SEQ ID NO: 2495439 - RNA, 14 nt, Chlamydia trachomatis
aaucugucuaagau

SEQ ID NO: 2495440 - RNA, 23 nt, Chlamydia trachomatis
aaucugugccagcugcugcuugg

SEQ ID NO: 2495441 - RNA, 23 nt, Chlamydia trachomatis
aaucugugcuugcauagauagau

SEQ ID NO: 2495442 - RNA, 19 nt, Chlamydia trachomatis
aaucuguguugcaaagaga

SEQ ID NO: 2495443 - RNA, 15 nt, Chlamydia trachomatis
aaucuuaaacaagau

SEQ ID NO: 2495444 - RNA, 21 nt, Chlamydia trachomatis
aaucuucacggagagaaagag

SEQ ID NO: 2495445 - RNA, 18 nt, Chlamydia trachomatis
aaucuucauaagaaaauu

SEQ ID NO: 2495446 - RNA, 20 nt, Chlamydia trachomatis
aaucuucggcagaagcugca

SEQ ID NO: 2495447 - RNA, 16 nt, Chlamydia trachomatis
aaucuucgugcaggga

SEQ ID NO: 2495448 - RNA, 12 nt, Chlamydia trachomatis
aaucuucuuaua

SEQ ID NO: 2495449 - RNA, 15 nt, Chlamydia trachomatis
aaucuucuuauacag

SEQ ID NO: 2495450 - RNA, 17 nt, Chlamydia trachomatis
aaucuucuuauacagca

SEQ ID NO: 2495451 - RNA, 19 nt, Chlamydia trachomatis
aaucuucuucgaaaucuuc

SEQ ID NO: 2495452 - RNA, 20 nt, Chlamydia trachomatis
aaucuucuucggaaagcacu

SEQ ID NO: 2495453 - RNA, 18 nt, Chlamydia trachomatis
aaucuuucuaauuucccu

SEQ ID NO: 2495454 - RNA, 20 nt, Chlamydia trachomatis
aaucuuucuuucuaagaaau

SEQ ID NO: 2495455 - RNA, 22 nt, Chlamydia trachomatis
aaucuuucuuucuaagaaauug

SEQ ID NO: 2495456 - RNA, 21 nt, Chlamydia trachomatis
aaucuuuggaagcagaaagaa

SEQ ID NO: 2495457 - RNA, 21 nt, Chlamydia trachomatis
aaucuuuuacuggagaacagu

SEQ ID NO: 2495458 - RNA, 21 nt, Chlamydia trachomatis
aaugaaaucacucgcacacga

SEQ ID NO: 2495459 - RNA, 21 nt, Chlamydia trachomatis
aaugaacauaugcucuuuccc

SEQ ID NO: 2495460 - RNA, 23 nt, Chlamydia trachomatis
aaugaagcaaaucccugugcuau

SEQ ID NO: 2495461 - RNA, 13 nt, Chlamydia trachomatis
aaugaauuucccc

SEQ ID NO: 2495462 - RNA, 13 nt, Chlamydia trachomatis
aaugacaaacuuu

SEQ ID NO: 2495463 - RNA, 17 nt, Chlamydia trachomatis
aaugacacacaucuaga

SEQ ID NO: 2495464 - RNA, 18 nt, Chlamydia trachomatis
aaugacacacguuccagu

SEQ ID NO: 2495465 - RNA, 13 nt, Chlamydia trachomatis
aaugacacuggca

SEQ ID NO: 2495466 - RNA, 17 nt, Chlamydia trachomatis
aaugacagguuucauga

SEQ ID NO: 2495467 - RNA, 15 nt, Chlamydia trachomatis
aaugaccgaagguuc

SEQ ID NO: 2495468 - RNA, 16 nt, Chlamydia trachomatis
aaugaccuuucccucg

SEQ ID NO: 2495469 - RNA, 21 nt, Chlamydia trachomatis
aaugaccuuucccucguaaua

SEQ ID NO: 2495470 - RNA, 14 nt, Chlamydia trachomatis
aaugacucaaaaag

SEQ ID NO: 2495471 - RNA, 16 nt, Chlamydia trachomatis
aaugacucaaaaagcu

SEQ ID NO: 2495472 - RNA, 22 nt, Chlamydia trachomatis
aaugagcgcuuuuucuucucua

SEQ ID NO: 2495473 - RNA, 19 nt, Chlamydia trachomatis
aaugagcguguaagcguuu

SEQ ID NO: 2495474 - RNA, 18 nt, Chlamydia trachomatis
aaugaguuccgaacaaaa

SEQ ID NO: 2495475 - RNA, 18 nt, Chlamydia trachomatis
aaugauaagggaaucaua

SEQ ID NO: 2495476 - RNA, 21 nt, Chlamydia trachomatis
aaugauagugaucucaacgcu

SEQ ID NO: 2495477 - RNA, 18 nt, Chlamydia trachomatis
aaugaucagcaaaaagag

SEQ ID NO: 2495478 - RNA, 22 nt, Chlamydia trachomatis
aaugaucagcaaaaagaggaga

SEQ ID NO: 2495479 - RNA, 12 nt, Chlamydia trachomatis
aaugaugagaau

SEQ ID NO: 2495480 - RNA, 21 nt, Chlamydia trachomatis
aaugauuugccccuuuuguac

SEQ ID NO: 2495481 - RNA, 13 nt, Chlamydia trachomatis
aaugcaaaacaua

SEQ ID NO: 2495482 - RNA, 14 nt, Chlamydia trachomatis
aaugcaaauuugca

SEQ ID NO: 2495483 - RNA, 22 nt, Chlamydia trachomatis
aaugcaccucggauccagaagc

SEQ ID NO: 2495484 - RNA, 21 nt, Chlamydia trachomatis
aaugcaguggaagauagaaga

SEQ ID NO: 2495485 - RNA, 23 nt, Chlamydia trachomatis
aaugccuuuugcacaaaggaaca

SEQ ID NO: 2495486 - RNA, 21 nt, Chlamydia trachomatis
aaugccuuuuguuuucaaaag

SEQ ID NO: 2495487 - RNA, 22 nt, Chlamydia trachomatis
aaugccuuuuguuuucaaaagc

SEQ ID NO: 2495488 - RNA, 15 nt, Chlamydia trachomatis
aaugcgaucagaaac

SEQ ID NO: 2495489 - RNA, 14 nt, Chlamydia trachomatis
aaugcgcucccauu

SEQ ID NO: 2495490 - RNA, 18 nt, Chlamydia trachomatis
aaugcggcccacacuacc

SEQ ID NO: 2495491 - RNA, 21 nt, Chlamydia trachomatis
aaugcgugaacuguucauucu

SEQ ID NO: 2495492 - RNA, 18 nt, Chlamydia trachomatis
aaugcguuaaacuuucuu

SEQ ID NO: 2495493 - RNA, 15 nt, Chlamydia trachomatis
aaugcguucuucuau

SEQ ID NO: 2495494 - RNA, 13 nt, Chlamydia trachomatis
aaugcguugcucu

SEQ ID NO: 2495495 - RNA, 20 nt, Chlamydia trachomatis
aaugcguugcucuaccaacu

SEQ ID NO: 2495496 - RNA, 18 nt, Chlamydia trachomatis
aaugcuaaggaguuuaac

SEQ ID NO: 2495497 - RNA, 23 nt, Chlamydia trachomatis
aaugcucuaaaggauaaggaaga

SEQ ID NO: 2495498 - RNA, 18 nt, Chlamydia trachomatis
aaugcugauaaaaauaau

SEQ ID NO: 2495499 - RNA, 17 nt, Chlamydia trachomatis
aaugcugcgauaacaac

SEQ ID NO: 2495500 - RNA, 23 nt, Chlamydia trachomatis
aaugcugcuguugcgauuugaua

SEQ ID NO: 2495501 - RNA, 15 nt, Chlamydia trachomatis
aaugcugcuguuuau

SEQ ID NO: 2495502 - RNA, 15 nt, Chlamydia trachomatis
aaugcuguuucaggc

SEQ ID NO: 2495503 - RNA, 18 nt, Chlamydia trachomatis
aaugcuucuuaacugcag

SEQ ID NO: 2495504 - RNA, 11 nt, Chlamydia trachomatis
aaugcuugaac

SEQ ID NO: 2495505 - RNA, 14 nt, Chlamydia trachomatis
aaugcuugaacaac

SEQ ID NO: 2495506 - RNA, 18 nt, Chlamydia trachomatis
aauggaaauaaaaagccc

SEQ ID NO: 2495507 - RNA, 20 nt, Chlamydia trachomatis
aauggaaauaaaaagcccag

SEQ ID NO: 2495508 - RNA, 22 nt, Chlamydia trachomatis
aauggauacuaacgguuccauu

SEQ ID NO: 2495509 - RNA, 15 nt, Chlamydia trachomatis
aauggcaaaacuucg

SEQ ID NO: 2495510 - RNA, 17 nt, Chlamydia trachomatis
aaugguuacuugccucu

SEQ ID NO: 2495511 - RNA, 14 nt, Chlamydia trachomatis
aauguaaacaauau

SEQ ID NO: 2495512 - RNA, 19 nt, Chlamydia trachomatis
aauguccucuuuaucuaaa

SEQ ID NO: 2495513 - RNA, 21 nt, Chlamydia trachomatis
aaugucgcugaggcaauaaaa

SEQ ID NO: 2495514 - RNA, 16 nt, Chlamydia trachomatis
aaugucuccaggagag

SEQ ID NO: 2495515 - RNA, 21 nt, Chlamydia trachomatis
aaugucuuuuucagcaggcga

SEQ ID NO: 2495516 - RNA, 21 nt, Chlamydia trachomatis
aaugugugguuguagaggaga

SEQ ID NO: 2495517 - RNA, 12 nt, Chlamydia trachomatis
aauguugaaguc

SEQ ID NO: 2495518 - RNA, 17 nt, Chlamydia trachomatis
aauguugaagucuccga

SEQ ID NO: 2495519 - RNA, 20 nt, Chlamydia trachomatis
aauguugaugguuucuagcu

SEQ ID NO: 2495520 - RNA, 22 nt, Chlamydia trachomatis
aauguuugaucugagaaagcuu

SEQ ID NO: 2495521 - RNA, 19 nt, Chlamydia trachomatis
aauguuuggauaagaacuu

SEQ ID NO: 2495522 - RNA, 22 nt, Chlamydia trachomatis
aauguuuggauaagaacuucuc

SEQ ID NO: 2495523 - RNA, 17 nt, Chlamydia trachomatis
aauguuugggaagauau

SEQ ID NO: 2495524 - RNA, 14 nt, Chlamydia trachomatis
aauuaaaacaauag

SEQ ID NO: 2495525 - RNA, 11 nt, Chlamydia trachomatis
aauuaaagaga

SEQ ID NO: 2495526 - RNA, 13 nt, Chlamydia trachomatis
aauuaaaggcucu

SEQ ID NO: 2495527 - RNA, 16 nt, Chlamydia trachomatis
aauuaaagguuuccca

SEQ ID NO: 2495528 - RNA, 17 nt, Chlamydia trachomatis
aauuaacaauccccaaa

SEQ ID NO: 2495529 - RNA, 13 nt, Chlamydia trachomatis
aauuaacccaaaa

SEQ ID NO: 2495530 - RNA, 16 nt, Chlamydia trachomatis
aauuaauaauuccacc

SEQ ID NO: 2495531 - RNA, 19 nt, Chlamydia trachomatis
aauuacgcgucuaaaacaa

SEQ ID NO: 2495532 - RNA, 21 nt, Chlamydia trachomatis
aauuagaacggcauucccauu

SEQ ID NO: 2495533 - RNA, 23 nt, Chlamydia trachomatis
aauuagcuacugucgaacgcuuc

SEQ ID NO: 2495534 - RNA, 17 nt, Chlamydia trachomatis
aauuauacaauuuauag

SEQ ID NO: 2495535 - RNA, 16 nt, Chlamydia trachomatis
aauuaucgccaaaaau

SEQ ID NO: 2495536 - RNA, 19 nt, Chlamydia trachomatis
aauuaugcaaaaagagcau

SEQ ID NO: 2495537 - RNA, 23 nt, Chlamydia trachomatis
aauuauuugccucuauguucuua

SEQ ID NO: 2495538 - RNA, 15 nt, Chlamydia trachomatis
aauucaacauaauaa

SEQ ID NO: 2495539 - RNA, 16 nt, Chlamydia trachomatis
aauucaggcucuuuca

SEQ ID NO: 2495540 - RNA, 20 nt, Chlamydia trachomatis
aauucaggcucuuucagaga

SEQ ID NO: 2495541 - RNA, 14 nt, Chlamydia trachomatis
aauuccaaugagga

SEQ ID NO: 2495542 - RNA, 22 nt, Chlamydia trachomatis
aauuccacgaagagcaaaauca

SEQ ID NO: 2495543 - RNA, 15 nt, Chlamydia trachomatis
aauuccaucuuuucg

SEQ ID NO: 2495544 - RNA, 21 nt, Chlamydia trachomatis
aauuccucuaaacaagguucu

SEQ ID NO: 2495545 - RNA, 22 nt, Chlamydia trachomatis
aauuccuucagagguagccaaa

SEQ ID NO: 2495546 - RNA, 17 nt, Chlamydia trachomatis
aauuccuuggauacgua

SEQ ID NO: 2495547 - RNA, 13 nt, Chlamydia trachomatis
aauucgagccugu

SEQ ID NO: 2495548 - RNA, 21 nt, Chlamydia trachomatis
aauucgagucggacaguucuu

SEQ ID NO: 2495549 - RNA, 15 nt, Chlamydia trachomatis
aauucgcuaccaaaa

SEQ ID NO: 2495550 - RNA, 13 nt, Chlamydia trachomatis
aauucguaugcaa

SEQ ID NO: 2495551 - RNA, 23 nt, Chlamydia trachomatis
aauucguccuccgccaccaguug

SEQ ID NO: 2495552 - RNA, 18 nt, Chlamydia trachomatis
aauucuagcaaccgauuc

SEQ ID NO: 2495553 - RNA, 22 nt, Chlamydia trachomatis
aauucuagcaaccgauucuuca

SEQ ID NO: 2495554 - RNA, 23 nt, Chlamydia trachomatis
aauucuagcaaccgauucuucac

SEQ ID NO: 2495555 - RNA, 23 nt, Chlamydia trachomatis
aauucuaucaacaucugugucau

SEQ ID NO: 2495556 - RNA, 23 nt, Chlamydia trachomatis
aauucuuggaucgcaugaaugag

SEQ ID NO: 2495557 - RNA, 13 nt, Chlamydia trachomatis
aauucuuugaucu

SEQ ID NO: 2495558 - RNA, 17 nt, Chlamydia trachomatis
aauucuuugaucuguaa

SEQ ID NO: 2495559 - RNA, 11 nt, Chlamydia trachomatis
aauugaaguau

SEQ ID NO: 2495560 - RNA, 19 nt, Chlamydia trachomatis
aauugagaacauaacacau

SEQ ID NO: 2495561 - RNA, 21 nt, Chlamydia trachomatis
aauugagcugucucugaugua

SEQ ID NO: 2495562 - RNA, 19 nt, Chlamydia trachomatis
aauugcgacaccuaauccu

SEQ ID NO: 2495563 - RNA, 18 nt, Chlamydia trachomatis
aauugcgguaaacaaugc

SEQ ID NO: 2495564 - RNA, 18 nt, Chlamydia trachomatis
aauugcuaaggaaagaga

SEQ ID NO: 2495565 - RNA, 20 nt, Chlamydia trachomatis
aauugcuguuaagauaagca

SEQ ID NO: 2495566 - RNA, 22 nt, Chlamydia trachomatis
aauuguacacgauguuccccau

SEQ ID NO: 2495567 - RNA, 23 nt, Chlamydia trachomatis
aauuguacacgauguuccccauu

SEQ ID NO: 2495568 - RNA, 23 nt, Chlamydia trachomatis
aauuguccaagcucgagucucuu

SEQ ID NO: 2495569 - RNA, 20 nt, Chlamydia trachomatis
aauugucgaauuuuucugcu

SEQ ID NO: 2495570 - RNA, 19 nt, Chlamydia trachomatis
aauugugaauggagcagca

SEQ ID NO: 2495571 - RNA, 22 nt, Chlamydia trachomatis
aauugugaauggagcagcauuc

SEQ ID NO: 2495572 - RNA, 14 nt, Chlamydia trachomatis
aauuguugagcagc

SEQ ID NO: 2495573 - RNA, 21 nt, Chlamydia trachomatis
aauuuaucggcuaacgaguuu

SEQ ID NO: 2495574 - RNA, 23 nt, Chlamydia trachomatis
aauuuaucugcuuccguaacaau

SEQ ID NO: 2495575 - RNA, 21 nt, Chlamydia trachomatis
aauuuaugucgcagcuuucuu

SEQ ID NO: 2495576 - RNA, 17 nt, Chlamydia trachomatis
aauuucagggaaacgua

SEQ ID NO: 2495577 - RNA, 18 nt, Chlamydia trachomatis
aauuucaucacagauaau

SEQ ID NO: 2495578 - RNA, 23 nt, Chlamydia trachomatis
aauuucaucccacaugcuaguua

SEQ ID NO: 2495579 - RNA, 20 nt, Chlamydia trachomatis
aauuuccccugcagccucug

SEQ ID NO: 2495580 - RNA, 19 nt, Chlamydia trachomatis
aauuuccuuagaaagaauu

SEQ ID NO: 2495581 - RNA, 18 nt, Chlamydia trachomatis
aauuucuauagaagaauu

SEQ ID NO: 2495582 - RNA, 19 nt, Chlamydia trachomatis
aauuucuccagcaucuuuu

SEQ ID NO: 2495583 - RNA, 20 nt, Chlamydia trachomatis
aauuucuuaaaagcacaaua

SEQ ID NO: 2495584 - RNA, 14 nt, Chlamydia trachomatis
aauuucuuccucua

SEQ ID NO: 2495585 - RNA, 12 nt, Chlamydia trachomatis
aauuucuugaac

SEQ ID NO: 2495586 - RNA, 14 nt, Chlamydia trachomatis
aauuucuugaacaa

SEQ ID NO: 2495587 - RNA, 16 nt, Chlamydia trachomatis
aauuugauucauugua

SEQ ID NO: 2495588 - RNA, 15 nt, Chlamydia trachomatis
aauuuggauaugccu

SEQ ID NO: 2495589 - RNA, 22 nt, Chlamydia trachomatis
aauuuggcaauggcaaaaucuu

SEQ ID NO: 2495590 - RNA, 17 nt, Chlamydia trachomatis
aauuuggcucuuuaaua

SEQ ID NO: 2495591 - RNA, 16 nt, Chlamydia trachomatis
aauuuuaaaucccagu

SEQ ID NO: 2495592 - RNA, 23 nt, Chlamydia trachomatis
aauuuuaagaccgaaauuaguaa

SEQ ID NO: 2495593 - RNA, 16 nt, Chlamydia trachomatis
aauuuuacguaauuca

SEQ ID NO: 2495594 - RNA, 17 nt, Chlamydia trachomatis
aauuuuaucuaaaaagg

SEQ ID NO: 2495595 - RNA, 16 nt, Chlamydia trachomatis
aauuuucaauagcaau

SEQ ID NO: 2495596 - RNA, 22 nt, Chlamydia trachomatis
aauuuuccacaaauauuuuugg

SEQ ID NO: 2495597 - RNA, 21 nt, Chlamydia trachomatis
aauuuucuaggagaagaggua

SEQ ID NO: 2495598 - RNA, 20 nt, Chlamydia trachomatis
aauuuucuucacuuccucuc

SEQ ID NO: 2495599 - RNA, 17 nt, Chlamydia trachomatis
aauuuuguuaagaauua

SEQ ID NO: 2495600 - RNA, 18 nt, Chlamydia trachomatis
aauuuuguuuaaucagug

SEQ ID NO: 2495601 - RNA, 14 nt, Chlamydia trachomatis
aauuuuucagaaaa

SEQ ID NO: 2495602 - RNA, 19 nt, Chlamydia trachomatis
aauuuuucuuugagaaagu

SEQ ID NO: 2495603 - RNA, 23 nt, Chlamydia trachomatis
aauuuuugauacaauuccugcuc

SEQ ID NO: 2495604 - RNA, 22 nt, Chlamydia trachomatis
aauuuuuugucgaauaggcaag

SEQ ID NO: 2495605 - RNA, 18 nt, Chlamydia trachomatis
aauuuuuuucuuugcuuu

SEQ ID NO: 2495606 - RNA, 10 nt, Chlamydia trachomatis
acaaaaaaga

SEQ ID NO: 2495607 - RNA, 15 nt, Chlamydia trachomatis
acaaaaaagaaagcu

SEQ ID NO: 2495608 - RNA, 14 nt, Chlamydia trachomatis
acaaaaacucucaa

SEQ ID NO: 2495609 - RNA, 21 nt, Chlamydia trachomatis
acaaaaagaaagccuucucuu

SEQ ID NO: 2495610 - RNA, 20 nt, Chlamydia trachomatis
acaaaaauacuugauuuuuu

SEQ ID NO: 2495611 - RNA, 12 nt, Chlamydia trachomatis
acaaaaccaaaa

SEQ ID NO: 2495612 - RNA, 13 nt, Chlamydia trachomatis
acaaaaccaaaau

SEQ ID NO: 2495613 - RNA, 14 nt, Chlamydia trachomatis
acaaaaccaaaauc

SEQ ID NO: 2495614 - RNA, 23 nt, Chlamydia trachomatis
acaaaacuugucuaaaagaauau

SEQ ID NO: 2495615 - RNA, 17 nt, Chlamydia trachomatis
acaaaagauuucuucug

SEQ ID NO: 2495616 - RNA, 23 nt, Chlamydia trachomatis
acaaaauaaucggcaaaagaucu

SEQ ID NO: 2495617 - RNA, 17 nt, Chlamydia trachomatis
acaaaaucagcaaaugu

SEQ ID NO: 2495618 - RNA, 15 nt, Chlamydia trachomatis
acaaacaaaaaagaa

SEQ ID NO: 2495619 - RNA, 13 nt, Chlamydia trachomatis
acaaacaaauccu

SEQ ID NO: 2495620 - RNA, 13 nt, Chlamydia trachomatis
acaaaccaauuaa

SEQ ID NO: 2495621 - RNA, 18 nt, Chlamydia trachomatis
acaaaccagcucaucaaa

SEQ ID NO: 2495622 - RNA, 19 nt, Chlamydia trachomatis
acaaaccaucuguaaagcu

SEQ ID NO: 2495623 - RNA, 16 nt, Chlamydia trachomatis
acaaaccgaagaggga

SEQ ID NO: 2495624 - RNA, 18 nt, Chlamydia trachomatis
acaaacgaagcugccgaa

SEQ ID NO: 2495625 - RNA, 21 nt, Chlamydia trachomatis
acaaacgggagcccaauuaaa

SEQ ID NO: 2495626 - RNA, 20 nt, Chlamydia trachomatis
acaaacuuucucgauucucu

SEQ ID NO: 2495627 - RNA, 12 nt, Chlamydia trachomatis
acaaagaaagcc

SEQ ID NO: 2495628 - RNA, 16 nt, Chlamydia trachomatis
acaaagagaaggccuu

SEQ ID NO: 2495629 - RNA, 20 nt, Chlamydia trachomatis
acaaagagaaggccuuuuuu

SEQ ID NO: 2495630 - RNA, 17 nt, Chlamydia trachomatis
acaaagaguuuaccucu

SEQ ID NO: 2495631 - RNA, 19 nt, Chlamydia trachomatis
acaaagaguuuaccucucc

SEQ ID NO: 2495632 - RNA, 17 nt, Chlamydia trachomatis
acaaagauaaucaaacc

SEQ ID NO: 2495633 - RNA, 17 nt, Chlamydia trachomatis
acaaagaucguaaaaua

SEQ ID NO: 2495634 - RNA, 22 nt, Chlamydia trachomatis
acaaagcacgauaaaagacaga

SEQ ID NO: 2495635 - RNA, 21 nt, Chlamydia trachomatis
acaaaggaacaucgagaaaau

SEQ ID NO: 2495636 - RNA, 23 nt, Chlamydia trachomatis
acaaaggaacaucgagaaaauga

SEQ ID NO: 2495637 - RNA, 15 nt, Chlamydia trachomatis
acaaaggagcccaag

SEQ ID NO: 2495638 - RNA, 16 nt, Chlamydia trachomatis
acaaaggagcccaagc

SEQ ID NO: 2495639 - RNA, 16 nt, Chlamydia trachomatis
acaaagguguuuucua

SEQ ID NO: 2495640 - RNA, 22 nt, Chlamydia trachomatis
acaaagucagagauauugucua

SEQ ID NO: 2495641 - RNA, 17 nt, Chlamydia trachomatis
acaaauaacagaaacgu

SEQ ID NO: 2495642 - RNA, 15 nt, Chlamydia trachomatis
acaaauaccaaaaua

SEQ ID NO: 2495643 - RNA, 21 nt, Chlamydia trachomatis
acaaauaguguaaggagagaa

SEQ ID NO: 2495644 - RNA, 22 nt, Chlamydia trachomatis
acaaauauuuuugggaaaaaau

SEQ ID NO: 2495645 - RNA, 20 nt, Chlamydia trachomatis
acaaauccagcugcugccca

SEQ ID NO: 2495646 - RNA, 18 nt, Chlamydia trachomatis
acaaaucuuucuuucuaa

SEQ ID NO: 2495647 - RNA, 14 nt, Chlamydia trachomatis
acaaauuccucugu

SEQ ID NO: 2495648 - RNA, 19 nt, Chlamydia trachomatis
acaaauugcacuaaagagc

SEQ ID NO: 2495649 - RNA, 23 nt, Chlamydia trachomatis
acaaauuuaucugcuaaagaaaa

SEQ ID NO: 2495650 - RNA, 22 nt, Chlamydia trachomatis
acaaauuucuauagaagaauuc

SEQ ID NO: 2495651 - RNA, 17 nt, Chlamydia trachomatis
acaacacgucuuaaagg

SEQ ID NO: 2495652 - RNA, 17 nt, Chlamydia trachomatis
acaacacugacuauucc

SEQ ID NO: 2495653 - RNA, 13 nt, Chlamydia trachomatis
acaacaugaaccg

SEQ ID NO: 2495654 - RNA, 22 nt, Chlamydia trachomatis
acaacaugaaccgcagcaacau

SEQ ID NO: 2495655 - RNA, 20 nt, Chlamydia trachomatis
acaaccaaaugaccuuuccc

SEQ ID NO: 2495656 - RNA, 19 nt, Chlamydia trachomatis
acaaccaacucuccuuuaa

SEQ ID NO: 2495657 - RNA, 16 nt, Chlamydia trachomatis
acaaccaucaaagcag

SEQ ID NO: 2495658 - RNA, 23 nt, Chlamydia trachomatis
acaacggcccuuccuaaccaagu

SEQ ID NO: 2495659 - RNA, 14 nt, Chlamydia trachomatis
acaacguuacuacc

SEQ ID NO: 2495660 - RNA, 16 nt, Chlamydia trachomatis
acaacguuacuaccga

SEQ ID NO: 2495661 - RNA, 18 nt, Chlamydia trachomatis
acaacguuuaaugaauac

SEQ ID NO: 2495662 - RNA, 20 nt, Chlamydia trachomatis
acaacuaaaggaaacaagca

SEQ ID NO: 2495663 - RNA, 14 nt, Chlamydia trachomatis
acaacuacaacaag

SEQ ID NO: 2495664 - RNA, 18 nt, Chlamydia trachomatis
acaacuaguuuacgcacu

SEQ ID NO: 2495665 - RNA, 16 nt, Chlamydia trachomatis
acaacugcucugccau

SEQ ID NO: 2495666 - RNA, 21 nt, Chlamydia trachomatis
acaacuucaauagcaggaacu

SEQ ID NO: 2495667 - RNA, 20 nt, Chlamydia trachomatis
acaacuuggugcagaagaau

SEQ ID NO: 2495668 - RNA, 19 nt, Chlamydia trachomatis
acaagaaguaacaccucuu

SEQ ID NO: 2495669 - RNA, 16 nt, Chlamydia trachomatis
acaagaauaauagaga

SEQ ID NO: 2495670 - RNA, 18 nt, Chlamydia trachomatis
acaagaauaauagagaca

SEQ ID NO: 2495671 - RNA, 19 nt, Chlamydia trachomatis
acaagaauaauagagacaa

SEQ ID NO: 2495672 - RNA, 15 nt, Chlamydia trachomatis
acaagagagaacaaa

SEQ ID NO: 2495673 - RNA, 19 nt, Chlamydia trachomatis
acaagaucuaucuauguuu

SEQ ID NO: 2495674 - RNA, 21 nt, Chlamydia trachomatis
acaagauuuugaauacgaucc

SEQ ID NO: 2495675 - RNA, 14 nt, Chlamydia trachomatis
acaagcaauagcgc

SEQ ID NO: 2495676 - RNA, 22 nt, Chlamydia trachomatis
acaagcacguacaauauguugc

SEQ ID NO: 2495677 - RNA, 17 nt, Chlamydia trachomatis
acaagcucgucuuuaga

SEQ ID NO: 2495678 - RNA, 19 nt, Chlamydia trachomatis
acaagcugacaaagcuucc

SEQ ID NO: 2495679 - RNA, 18 nt, Chlamydia trachomatis
acaaggauuuucuucuuu

SEQ ID NO: 2495680 - RNA, 13 nt, Chlamydia trachomatis
acaaggcuaagaa

SEQ ID NO: 2495681 - RNA, 20 nt, Chlamydia trachomatis
acaagguucuucaacaacuu

SEQ ID NO: 2495682 - RNA, 19 nt, Chlamydia trachomatis
acaaguaugagaggaagau

SEQ ID NO: 2495683 - RNA, 13 nt, Chlamydia trachomatis
acaagugcagcgu

SEQ ID NO: 2495684 - RNA, 19 nt, Chlamydia trachomatis
acaagugccaacaucaaaa

SEQ ID NO: 2495685 - RNA, 20 nt, Chlamydia trachomatis
acaagugccaacaucaaaau

SEQ ID NO: 2495686 - RNA, 19 nt, Chlamydia trachomatis
acaaguugauacaagagag

SEQ ID NO: 2495687 - RNA, 20 nt, Chlamydia trachomatis
acaaguugauacaagagaga

SEQ ID NO: 2495688 - RNA, 16 nt, Chlamydia trachomatis
acaaguuuauggaaaa

SEQ ID NO: 2495689 - RNA, 18 nt, Chlamydia trachomatis
acaaguuuauggaaaaga

SEQ ID NO: 2495690 - RNA, 21 nt, Chlamydia trachomatis
acaaguuuauggaaaagaucu

SEQ ID NO: 2495691 - RNA, 20 nt, Chlamydia trachomatis
acaaguuucuuccagacaaa

SEQ ID NO: 2495692 - RNA, 21 nt, Chlamydia trachomatis
acaauaacagcacaaacaaau

SEQ ID NO: 2495693 - RNA, 19 nt, Chlamydia trachomatis
acaauaauacaaagcacga

SEQ ID NO: 2495694 - RNA, 21 nt, Chlamydia trachomatis
acaauaauucaggcucuuuca

SEQ ID NO: 2495695 - RNA, 19 nt, Chlamydia trachomatis
acaauacagccuuggauuu

SEQ ID NO: 2495696 - RNA, 17 nt, Chlamydia trachomatis
acaauagcauuugucuu

SEQ ID NO: 2495697 - RNA, 22 nt, Chlamydia trachomatis
acaauagcauuugucuucgcaa

SEQ ID NO: 2495698 - RNA, 14 nt, Chlamydia trachomatis
acaauaguaucucc

SEQ ID NO: 2495699 - RNA, 15 nt, Chlamydia trachomatis
acaauaguaucuccu

SEQ ID NO: 2495700 - RNA, 16 nt, Chlamydia trachomatis
acaauauguugccacu

SEQ ID NO: 2495701 - RNA, 22 nt, Chlamydia trachomatis
acaauauuaucuacagugaaac

SEQ ID NO: 2495702 - RNA, 17 nt, Chlamydia trachomatis
acaauauucuuuuccau

SEQ ID NO: 2495703 - RNA, 15 nt, Chlamydia trachomatis
acaaucaaagcacca

SEQ ID NO: 2495704 - RNA, 20 nt, Chlamydia trachomatis
acaauccaguacugcuacaa

SEQ ID NO: 2495705 - RNA, 20 nt, Chlamydia trachomatis
acaauccgaagauuauacca

SEQ ID NO: 2495706 - RNA, 19 nt, Chlamydia trachomatis
acaauccuagacgauuaau

SEQ ID NO: 2495707 - RNA, 16 nt, Chlamydia trachomatis
acaaucgagccaagcu

SEQ ID NO: 2495708 - RNA, 20 nt, Chlamydia trachomatis
acaaucggccggaauauccg

SEQ ID NO: 2495709 - RNA, 16 nt, Chlamydia trachomatis
acaaucucaaaaacac

SEQ ID NO: 2495710 - RNA, 15 nt, Chlamydia trachomatis
acaaucucuuuaagc

SEQ ID NO: 2495711 - RNA, 23 nt, Chlamydia trachomatis
acaaugaccgaagguucuucuuc

SEQ ID NO: 2495712 - RNA, 21 nt, Chlamydia trachomatis
acaaugauauucuaauccuaa

SEQ ID NO: 2495713 - RNA, 19 nt, Chlamydia trachomatis
acaaugccgcccaaggaaa

SEQ ID NO: 2495714 - RNA, 14 nt, Chlamydia trachomatis
acaauguacgcuaa

SEQ ID NO: 2495715 - RNA, 18 nt, Chlamydia trachomatis
acaauguacgcuaaaaac

SEQ ID NO: 2495716 - RNA, 19 nt, Chlamydia trachomatis
acaauguacgcuaaaaacu

SEQ ID NO: 2495717 - RNA, 13 nt, Chlamydia trachomatis
acaauuccugcuc

SEQ ID NO: 2495718 - RNA, 24 nt, Chlamydia trachomatis
acaauugagugugagucuaucuuc

SEQ ID NO: 2495719 - RNA, 22 nt, Chlamydia trachomatis
acaauugguuugauagcuucau

SEQ ID NO: 2495720 - RNA, 18 nt, Chlamydia trachomatis
acaauuuccuuagaaaga

SEQ ID NO: 2495721 - RNA, 15 nt, Chlamydia trachomatis
acaauuuuaaaaucu

SEQ ID NO: 2495722 - RNA, 17 nt, Chlamydia trachomatis
acaauuuuuguuccuuu

SEQ ID NO: 2495723 - RNA, 13 nt, Chlamydia trachomatis
acacaacauaacu

SEQ ID NO: 2495724 - RNA, 21 nt, Chlamydia trachomatis
acacaacuucugcuaaaaaug

SEQ ID NO: 2495725 - RNA, 20 nt, Chlamydia trachomatis
acacaagcagacaagcaaua

SEQ ID NO: 2495726 - RNA, 15 nt, Chlamydia trachomatis
acacaagcugacaaa

SEQ ID NO: 2495727 - RNA, 14 nt, Chlamydia trachomatis
acacaaguaugaga

SEQ ID NO: 2495728 - RNA, 18 nt, Chlamydia trachomatis
acacaaguaugagaggaa

SEQ ID NO: 2495729 - RNA, 20 nt, Chlamydia trachomatis
acacaaguaugagaggaaga

SEQ ID NO: 2495730 - RNA, 21 nt, Chlamydia trachomatis
acacaauucggaauacuguuu

SEQ ID NO: 2495731 - RNA, 13 nt, Chlamydia trachomatis
acacacucucccu

SEQ ID NO: 2495732 - RNA, 21 nt, Chlamydia trachomatis
acacacucucccuguagagac

SEQ ID NO: 2495733 - RNA, 23 nt, Chlamydia trachomatis
acacauaucuccaaaaauauggg

SEQ ID NO: 2495734 - RNA, 16 nt, Chlamydia trachomatis
acacauccuucugcua

SEQ ID NO: 2495735 - RNA, 17 nt, Chlamydia trachomatis
acacauccuucugcuau

SEQ ID NO: 2495736 - RNA, 13 nt, Chlamydia trachomatis
acacaucgaugcu

SEQ ID NO: 2495737 - RNA, 13 nt, Chlamydia trachomatis
acacaucuguauc

SEQ ID NO: 2495738 - RNA, 19 nt, Chlamydia trachomatis
acacaucuguauccuaacu

SEQ ID NO: 2495739 - RNA, 16 nt, Chlamydia trachomatis
acacauucccuaaaua

SEQ ID NO: 2495740 - RNA, 18 nt, Chlamydia trachomatis
acacauucccuaaauaua

SEQ ID NO: 2495741 - RNA, 15 nt, Chlamydia trachomatis
acaccaaaaaaucca

SEQ ID NO: 2495742 - RNA, 12 nt, Chlamydia trachomatis
acaccaaauccu

SEQ ID NO: 2495743 - RNA, 17 nt, Chlamydia trachomatis
acaccagcggacaaguc

SEQ ID NO: 2495744 - RNA, 14 nt, Chlamydia trachomatis
acaccaggcaaugc

SEQ ID NO: 2495745 - RNA, 17 nt, Chlamydia trachomatis
acaccgcaucagcccca

SEQ ID NO: 2495746 - RNA, 15 nt, Chlamydia trachomatis
acacgauauauccau

SEQ ID NO: 2495747 - RNA, 15 nt, Chlamydia trachomatis
acacgauguucccca

SEQ ID NO: 2495748 - RNA, 17 nt, Chlamydia trachomatis
acacgauguuccccauu

SEQ ID NO: 2495749 - RNA, 18 nt, Chlamydia trachomatis
acacgcucaggcuaucac

SEQ ID NO: 2495750 - RNA, 21 nt, Chlamydia trachomatis
acacgucguuaggccauuuca

SEQ ID NO: 2495751 - RNA, 14 nt, Chlamydia trachomatis
acacguuuuagaau

SEQ ID NO: 2495752 - RNA, 15 nt, Chlamydia trachomatis
acacuacgcuacaga

SEQ ID NO: 2495753 - RNA, 17 nt, Chlamydia trachomatis
acacuacgcuacagagu

SEQ ID NO: 2495754 - RNA, 20 nt, Chlamydia trachomatis
acacuagagucagaagcuau

SEQ ID NO: 2495755 - RNA, 19 nt, Chlamydia trachomatis
acacuaucacuguugagaa

SEQ ID NO: 2495756 - RNA, 22 nt, Chlamydia trachomatis
acacugacuauuccugaaggag

SEQ ID NO: 2495757 - RNA, 21 nt, Chlamydia trachomatis
acacugcgugaccguuaauau

SEQ ID NO: 2495758 - RNA, 17 nt, Chlamydia trachomatis
acacuguauugcucugc

SEQ ID NO: 2495759 - RNA, 18 nt, Chlamydia trachomatis
acacuuccccauucuucu

SEQ ID NO: 2495760 - RNA, 21 nt, Chlamydia trachomatis
acacuucucgaaaaaaugccu

SEQ ID NO: 2495761 - RNA, 22 nt, Chlamydia trachomatis
acacuucucgaaaaaaugccuc

SEQ ID NO: 2495762 - RNA, 18 nt, Chlamydia trachomatis
acacuugauaaauagcaa

SEQ ID NO: 2495763 - RNA, 13 nt, Chlamydia trachomatis
acacuuuccccau

SEQ ID NO: 2495764 - RNA, 16 nt, Chlamydia trachomatis
acacuuuucagcuuuu

SEQ ID NO: 2495765 - RNA, 14 nt, Chlamydia trachomatis
acagaagcugucag

SEQ ID NO: 2495766 - RNA, 20 nt, Chlamydia trachomatis
acagaaggaguuuuucuccu

SEQ ID NO: 2495767 - RNA, 16 nt, Chlamydia trachomatis
acagagcuucucuaaa

SEQ ID NO: 2495768 - RNA, 22 nt, Chlamydia trachomatis
acagagguaaucguauaaguuu

SEQ ID NO: 2495769 - RNA, 20 nt, Chlamydia trachomatis
acagaguuaccaaucacgcu

SEQ ID NO: 2495770 - RNA, 21 nt, Chlamydia trachomatis
acagauauaacaacggcauag

SEQ ID NO: 2495771 - RNA, 20 nt, Chlamydia trachomatis
acagaucauaggcuccugca

SEQ ID NO: 2495772 - RNA, 21 nt, Chlamydia trachomatis
acagaucuugaucugaaaaga

SEQ ID NO: 2495773 - RNA, 23 nt, Chlamydia trachomatis
acagaucuugaucugaaaagaga

SEQ ID NO: 2495774 - RNA, 21 nt, Chlamydia trachomatis
acagaugacucaaacugugaa

SEQ ID NO: 2495775 - RNA, 20 nt, Chlamydia trachomatis
acagauugagaauaaauaua

SEQ ID NO: 2495776 - RNA, 18 nt, Chlamydia trachomatis
acagauuuagagaauaau

SEQ ID NO: 2495777 - RNA, 19 nt, Chlamydia trachomatis
acagcaaaaccuuuugaaa

SEQ ID NO: 2495778 - RNA, 23 nt, Chlamydia trachomatis
acagcaaaaccuuuugaaacauc

SEQ ID NO: 2495779 - RNA, 15 nt, Chlamydia trachomatis
acagcaaauaaagag

SEQ ID NO: 2495780 - RNA, 18 nt, Chlamydia trachomatis
acagcaagaagaagagag

SEQ ID NO: 2495781 - RNA, 19 nt, Chlamydia trachomatis
acagcaagaagaagagaga

SEQ ID NO: 2495782 - RNA, 23 nt, Chlamydia trachomatis
acagcaagacaacguuacuaccg

SEQ ID NO: 2495783 - RNA, 23 nt, Chlamydia trachomatis
acagcaauagccauuaacaacaa

SEQ ID NO: 2495784 - RNA, 14 nt, Chlamydia trachomatis
acagcacaaacaaa

SEQ ID NO: 2495785 - RNA, 20 nt, Chlamydia trachomatis
acagcacaaacaaauccuag

SEQ ID NO: 2495786 - RNA, 19 nt, Chlamydia trachomatis
acagcagaacucaacgaaa

SEQ ID NO: 2495787 - RNA, 20 nt, Chlamydia trachomatis
acagcauacguuagcaaaga

SEQ ID NO: 2495788 - RNA, 22 nt, Chlamydia trachomatis
acagcauacguuagcaaagaca

SEQ ID NO: 2495789 - RNA, 18 nt, Chlamydia trachomatis
acagcaugaacagcuucg

SEQ ID NO: 2495790 - RNA, 13 nt, Chlamydia trachomatis
acagccaagcaag

SEQ ID NO: 2495791 - RNA, 14 nt, Chlamydia trachomatis
acagccaagcaaga

SEQ ID NO: 2495792 - RNA, 23 nt, Chlamydia trachomatis
acagccucaucauuaauuagaau

SEQ ID NO: 2495793 - RNA, 19 nt, Chlamydia trachomatis
acagccugcuuucuucugc

SEQ ID NO: 2495794 - RNA, 22 nt, Chlamydia trachomatis
acagcgaagaaccgaauuugua

SEQ ID NO: 2495795 - RNA, 18 nt, Chlamydia trachomatis
acagcuaaucauagccau

SEQ ID NO: 2495796 - RNA, 16 nt, Chlamydia trachomatis
acagcuagaauagcag

SEQ ID NO: 2495797 - RNA, 22 nt, Chlamydia trachomatis
acagcucgccggaaaccuguuu

SEQ ID NO: 2495798 - RNA, 22 nt, Chlamydia trachomatis
acagcucuguucaauuguugga

SEQ ID NO: 2495799 - RNA, 13 nt, Chlamydia trachomatis
acagcucuucuuc

SEQ ID NO: 2495800 - RNA, 14 nt, Chlamydia trachomatis
acagcucuugcauu

SEQ ID NO: 2495801 - RNA, 20 nt, Chlamydia trachomatis
acagcuucuucuucucuuuc

SEQ ID NO: 2495802 - RNA, 21 nt, Chlamydia trachomatis
acagcuucuucuucucuuucg

SEQ ID NO: 2495803 - RNA, 13 nt, Chlamydia trachomatis
acagcuuucacag

SEQ ID NO: 2495804 - RNA, 19 nt, Chlamydia trachomatis
acagcuuucacagggacau

SEQ ID NO: 2495805 - RNA, 17 nt, Chlamydia trachomatis
acaggaccagagaucau

SEQ ID NO: 2495806 - RNA, 15 nt, Chlamydia trachomatis
acaggagaugaauug

SEQ ID NO: 2495807 - RNA, 16 nt, Chlamydia trachomatis
acaggauccgcaccaa

SEQ ID NO: 2495808 - RNA, 23 nt, Chlamydia trachomatis
acaggauccgcaccaaucaccgc

SEQ ID NO: 2495809 - RNA, 14 nt, Chlamydia trachomatis
acaggcagcagagc

SEQ ID NO: 2495810 - RNA, 15 nt, Chlamydia trachomatis
acagggaaaaacagg

SEQ ID NO: 2495811 - RNA, 16 nt, Chlamydia trachomatis
acaggggaccaaaaaa

SEQ ID NO: 2495812 - RNA, 17 nt, Chlamydia trachomatis
acaggugaauucuccag

SEQ ID NO: 2495813 - RNA, 13 nt, Chlamydia trachomatis
acagguuucauga

SEQ ID NO: 2495814 - RNA, 17 nt, Chlamydia trachomatis
acaguaccgucacucuu

SEQ ID NO: 2495815 - RNA, 15 nt, Chlamydia trachomatis
acaguaggucguuga

SEQ ID NO: 2495816 - RNA, 15 nt, Chlamydia trachomatis
acaguaucugcuagu

SEQ ID NO: 2495817 - RNA, 16 nt, Chlamydia trachomatis
acagucuguguuugca

SEQ ID NO: 2495818 - RNA, 22 nt, Chlamydia trachomatis
acagucuucucgagaagaaaaa

SEQ ID NO: 2495819 - RNA, 20 nt, Chlamydia trachomatis
acagugacuugauuggauaa

SEQ ID NO: 2495820 - RNA, 19 nt, Chlamydia trachomatis
acaguucuuuauaacucuc

SEQ ID NO: 2495821 - RNA, 18 nt, Chlamydia trachomatis
acauaaaauccuucugcc

SEQ ID NO: 2495822 - RNA, 21 nt, Chlamydia trachomatis
acauaaacgguggaacagcuc

SEQ ID NO: 2495823 - RNA, 19 nt, Chlamydia trachomatis
acauaacaaggcuuuucca

SEQ ID NO: 2495824 - RNA, 20 nt, Chlamydia trachomatis
acauaagaggcaccucuuuu

SEQ ID NO: 2495825 - RNA, 21 nt, Chlamydia trachomatis
acauaagaggcaccucuuuuu

SEQ ID NO: 2495826 - RNA, 15 nt, Chlamydia trachomatis
acauaagauccaucu

SEQ ID NO: 2495827 - RNA, 15 nt, Chlamydia trachomatis
acauaagcaaauccu

SEQ ID NO: 2495828 - RNA, 14 nt, Chlamydia trachomatis
acauaagucucuug

SEQ ID NO: 2495829 - RNA, 18 nt, Chlamydia trachomatis
acauaauaaauauuauca

SEQ ID NO: 2495830 - RNA, 12 nt, Chlamydia trachomatis
acauaaucuucc

SEQ ID NO: 2495831 - RNA, 15 nt, Chlamydia trachomatis
acauacuuuucuccc

SEQ ID NO: 2495832 - RNA, 20 nt, Chlamydia trachomatis
acauagcgacuaauacugac

SEQ ID NO: 2495833 - RNA, 15 nt, Chlamydia trachomatis
acauauagcauggaa

SEQ ID NO: 2495834 - RNA, 15 nt, Chlamydia trachomatis
acauaugcucuuucc

SEQ ID NO: 2495835 - RNA, 14 nt, Chlamydia trachomatis
acaucaaaaugaua

SEQ ID NO: 2495836 - RNA, 18 nt, Chlamydia trachomatis
acaucaacugauucguuu

SEQ ID NO: 2495837 - RNA, 16 nt, Chlamydia trachomatis
acaucacuauaaguca

SEQ ID NO: 2495838 - RNA, 22 nt, Chlamydia trachomatis
acaucacuauaagucaaaagaa

SEQ ID NO: 2495839 - RNA, 12 nt, Chlamydia trachomatis
acaucagagcaa

SEQ ID NO: 2495840 - RNA, 13 nt, Chlamydia trachomatis
acauccaguaauu

SEQ ID NO: 2495841 - RNA, 18 nt, Chlamydia trachomatis
acauccaugucuaaggau

SEQ ID NO: 2495842 - RNA, 21 nt, Chlamydia trachomatis
acauccaugucuaaggaugca

SEQ ID NO: 2495843 - RNA, 21 nt, Chlamydia trachomatis
acaucccuugaacuagaaaua

SEQ ID NO: 2495844 - RNA, 20 nt, Chlamydia trachomatis
acauccgcuucuucauguuc

SEQ ID NO: 2495845 - RNA, 13 nt, Chlamydia trachomatis
acauccguuucua

SEQ ID NO: 2495846 - RNA, 15 nt, Chlamydia trachomatis
acauccuucugcuau

SEQ ID NO: 2495847 - RNA, 13 nt, Chlamydia trachomatis
acaucuaacagaa

SEQ ID NO: 2495848 - RNA, 15 nt, Chlamydia trachomatis
acaucucguugcuau

SEQ ID NO: 2495849 - RNA, 20 nt, Chlamydia trachomatis
acaucuguagagccaugauc

SEQ ID NO: 2495850 - RNA, 21 nt, Chlamydia trachomatis
acaucuuuuaaaguaaguaaa

SEQ ID NO: 2495851 - RNA, 13 nt, Chlamydia trachomatis
acaugaucauagu

SEQ ID NO: 2495852 - RNA, 13 nt, Chlamydia trachomatis
acauggccaaaca

SEQ ID NO: 2495853 - RNA, 23 nt, Chlamydia trachomatis
acaugggcacgcuacuaacgaag

SEQ ID NO: 2495854 - RNA, 16 nt, Chlamydia trachomatis
acaugggcgucucuuu

SEQ ID NO: 2495855 - RNA, 13 nt, Chlamydia trachomatis
acaugguuuucug

SEQ ID NO: 2495856 - RNA, 18 nt, Chlamydia trachomatis
acauguaguaaucugcuu

SEQ ID NO: 2495857 - RNA, 21 nt, Chlamydia trachomatis
acaugucgauuggaucagcuc

SEQ ID NO: 2495858 - RNA, 13 nt, Chlamydia trachomatis
acauuaccauuca

SEQ ID NO: 2495859 - RNA, 22 nt, Chlamydia trachomatis
acauuaguauagucuuuauuua

SEQ ID NO: 2495860 - RNA, 15 nt, Chlamydia trachomatis
acauuccaaacccau

SEQ ID NO: 2495861 - RNA, 21 nt, Chlamydia trachomatis
acauuccaaacccauccaugg

SEQ ID NO: 2495862 - RNA, 15 nt, Chlamydia trachomatis
acauucccuucuuua

SEQ ID NO: 2495863 - RNA, 18 nt, Chlamydia trachomatis
acauuccucgauaaugcu

SEQ ID NO: 2495864 - RNA, 17 nt, Chlamydia trachomatis
acauuccugccaaaaac

SEQ ID NO: 2495865 - RNA, 18 nt, Chlamydia trachomatis
acauucgccucuucucuu

SEQ ID NO: 2495866 - RNA, 17 nt, Chlamydia trachomatis
acauucucggaaaagau

SEQ ID NO: 2495867 - RNA, 12 nt, Chlamydia trachomatis
acauucucuuuu

SEQ ID NO: 2495868 - RNA, 14 nt, Chlamydia trachomatis
acauucucuuuugc

SEQ ID NO: 2495869 - RNA, 19 nt, Chlamydia trachomatis
acauucugccgacuccugu

SEQ ID NO: 2495870 - RNA, 17 nt, Chlamydia trachomatis
acauugcaguacaucug

SEQ ID NO: 2495871 - RNA, 18 nt, Chlamydia trachomatis
acauugcaguacaucugu

SEQ ID NO: 2495872 - RNA, 16 nt, Chlamydia trachomatis
acauuucacuauccaa

SEQ ID NO: 2495873 - RNA, 19 nt, Chlamydia trachomatis
acauuucucgucaggggau

SEQ ID NO: 2495874 - RNA, 18 nt, Chlamydia trachomatis
acauuugcgcaacguuuc

SEQ ID NO: 2495875 - RNA, 16 nt, Chlamydia trachomatis
acauuugcgugauaaa

SEQ ID NO: 2495876 - RNA, 23 nt, Chlamydia trachomatis
acauuuuccguugauaguuacag

SEQ ID NO: 2495877 - RNA, 16 nt, Chlamydia trachomatis
acauuuugcuguaguu

SEQ ID NO: 2495878 - RNA, 15 nt, Chlamydia trachomatis
accaaaaacaacaau

SEQ ID NO: 2495879 - RNA, 14 nt, Chlamydia trachomatis
accaaaaauuuuuu

SEQ ID NO: 2495880 - RNA, 17 nt, Chlamydia trachomatis
accaaaagagcgcaacc

SEQ ID NO: 2495881 - RNA, 16 nt, Chlamydia trachomatis
accaaagcauuuuuaa

SEQ ID NO: 2495882 - RNA, 19 nt, Chlamydia trachomatis
accaaaugaccuuucccuc

SEQ ID NO: 2495883 - RNA, 14 nt, Chlamydia trachomatis
accaacaagagcca

SEQ ID NO: 2495884 - RNA, 15 nt, Chlamydia trachomatis
accaacugagcuauu

SEQ ID NO: 2495885 - RNA, 19 nt, Chlamydia trachomatis
accaaggacggauguugau

SEQ ID NO: 2495886 - RNA, 19 nt, Chlamydia trachomatis
accaaggauuuuuuuccca

SEQ ID NO: 2495887 - RNA, 20 nt, Chlamydia trachomatis
accaaggauuuuuuucccac

SEQ ID NO: 2495888 - RNA, 17 nt, Chlamydia trachomatis
accaagggaauaaaaac

SEQ ID NO: 2495889 - RNA, 17 nt, Chlamydia trachomatis
accaaguucuucuuuag

SEQ ID NO: 2495890 - RNA, 21 nt, Chlamydia trachomatis
accaauaccuacacgauauau

SEQ ID NO: 2495891 - RNA, 22 nt, Chlamydia trachomatis
accaauagagaccgcucucuuu

SEQ ID NO: 2495892 - RNA, 17 nt, Chlamydia trachomatis
accaauauuuuuucuau

SEQ ID NO: 2495893 - RNA, 15 nt, Chlamydia trachomatis
accaaucaccgcugc

SEQ ID NO: 2495894 - RNA, 12 nt, Chlamydia trachomatis
accaaucacgcu

SEQ ID NO: 2495895 - RNA, 14 nt, Chlamydia trachomatis
accaaucacgcuac

SEQ ID NO: 2495896 - RNA, 20 nt, Chlamydia trachomatis
accaaucgagagguccaguc

SEQ ID NO: 2495897 - RNA, 14 nt, Chlamydia trachomatis
accaaugaaacgga

SEQ ID NO: 2495898 - RNA, 15 nt, Chlamydia trachomatis
accaauuguugagca

SEQ ID NO: 2495899 - RNA, 16 nt, Chlamydia trachomatis
accacaaacaauucca

SEQ ID NO: 2495900 - RNA, 14 nt, Chlamydia trachomatis
accacaaccucucu

SEQ ID NO: 2495901 - RNA, 15 nt, Chlamydia trachomatis
accacaauuuuucuu

SEQ ID NO: 2495902 - RNA, 14 nt, Chlamydia trachomatis
accacagacucagg

SEQ ID NO: 2495903 - RNA, 14 nt, Chlamydia trachomatis
accacauucucuuu

SEQ ID NO: 2495904 - RNA, 21 nt, Chlamydia trachomatis
accaccuucugcaugcaaaua

SEQ ID NO: 2495905 - RNA, 16 nt, Chlamydia trachomatis
accacgagcauaagaa

SEQ ID NO: 2495906 - RNA, 16 nt, Chlamydia trachomatis
accacuaaucccaccu

SEQ ID NO: 2495907 - RNA, 22 nt, Chlamydia trachomatis
accacuaaucccaccuuaaaug

SEQ ID NO: 2495908 - RNA, 14 nt, Chlamydia trachomatis
accacucauuacca

SEQ ID NO: 2495909 - RNA, 14 nt, Chlamydia trachomatis
accacugauggcuu

SEQ ID NO: 2495910 - RNA, 20 nt, Chlamydia trachomatis
accacuguauccaaaacaua

SEQ ID NO: 2495911 - RNA, 14 nt, Chlamydia trachomatis
accacuuuucugua

SEQ ID NO: 2495912 - RNA, 23 nt, Chlamydia trachomatis
accagaauauaagcacccuuucu

SEQ ID NO: 2495913 - RNA, 20 nt, Chlamydia trachomatis
accagacuauuucuucuaga

SEQ ID NO: 2495914 - RNA, 15 nt, Chlamydia trachomatis
accagagauaaagcu

SEQ ID NO: 2495915 - RNA, 13 nt, Chlamydia trachomatis
accagaguuucau

SEQ ID NO: 2495916 - RNA, 12 nt, Chlamydia trachomatis
accagauccgau

SEQ ID NO: 2495917 - RNA, 14 nt, Chlamydia trachomatis
accagcaaaagaaa

SEQ ID NO: 2495918 - RNA, 19 nt, Chlamydia trachomatis
accagcgcuuucuaaagca

SEQ ID NO: 2495919 - RNA, 20 nt, Chlamydia trachomatis
accagcgcuuucuaaagcag

SEQ ID NO: 2495920 - RNA, 12 nt, Chlamydia trachomatis
accaggagcgcc

SEQ ID NO: 2495921 - RNA, 15 nt, Chlamydia trachomatis
accaggauuccccgu

SEQ ID NO: 2495922 - RNA, 17 nt, Chlamydia trachomatis
accaggucacauuuucc

SEQ ID NO: 2495923 - RNA, 17 nt, Chlamydia trachomatis
accagguuuacggucac

SEQ ID NO: 2495924 - RNA, 21 nt, Chlamydia trachomatis
accagguuuacggucacuccu

SEQ ID NO: 2495925 - RNA, 15 nt, Chlamydia trachomatis
accaguuucuucuac

SEQ ID NO: 2495926 - RNA, 22 nt, Chlamydia trachomatis
accaguuucuucuacaaguucu

SEQ ID NO: 2495927 - RNA, 14 nt, Chlamydia trachomatis
accaguuugucuua

SEQ ID NO: 2495928 - RNA, 13 nt, Chlamydia trachomatis
accauaggaucug

SEQ ID NO: 2495929 - RNA, 14 nt, Chlamydia trachomatis
accauaggaucugg

SEQ ID NO: 2495930 - RNA, 21 nt, Chlamydia trachomatis
accaucacaaugcguagucuc

SEQ ID NO: 2495931 - RNA, 16 nt, Chlamydia trachomatis
accaucuguaaagcuu

SEQ ID NO: 2495932 - RNA, 21 nt, Chlamydia trachomatis
accaucuuacuugcugcagau

SEQ ID NO: 2495933 - RNA, 19 nt, Chlamydia trachomatis
accaugagcuccaaaguaa

SEQ ID NO: 2495934 - RNA, 14 nt, Chlamydia trachomatis
accaugcuccuuuc

SEQ ID NO: 2495935 - RNA, 12 nt, Chlamydia trachomatis
acccaagacacg

SEQ ID NO: 2495936 - RNA, 14 nt, Chlamydia trachomatis
acccaaucuucuaa

SEQ ID NO: 2495937 - RNA, 15 nt, Chlamydia trachomatis
acccaaucuucuaaa

SEQ ID NO: 2495938 - RNA, 15 nt, Chlamydia trachomatis
acccauaaaaaagag

SEQ ID NO: 2495939 - RNA, 21 nt, Chlamydia trachomatis
acccauccaaaacaucccagc

SEQ ID NO: 2495940 - RNA, 16 nt, Chlamydia trachomatis
acccaugaacagcauu

SEQ ID NO: 2495941 - RNA, 18 nt, Chlamydia trachomatis
acccauuugccauauccu

SEQ ID NO: 2495942 - RNA, 13 nt, Chlamydia trachomatis
accccccucugca

SEQ ID NO: 2495943 - RNA, 14 nt, Chlamydia trachomatis
accccuaaaggaag

SEQ ID NO: 2495944 - RNA, 11 nt, Chlamydia trachomatis
accccucuuuc

SEQ ID NO: 2495945 - RNA, 15 nt, Chlamydia trachomatis
accccucuuucucuc

SEQ ID NO: 2495946 - RNA, 17 nt, Chlamydia trachomatis
accccuuacaauguaaa

SEQ ID NO: 2495947 - RNA, 16 nt, Chlamydia trachomatis
acccgaggaagcaaua

SEQ ID NO: 2495948 - RNA, 20 nt, Chlamydia trachomatis
acccuaacgaggcacaaaau

SEQ ID NO: 2495949 - RNA, 24 nt, Chlamydia trachomatis
acccuaaucgaauuacucugccua

SEQ ID NO: 2495950 - RNA, 20 nt, Chlamydia trachomatis
acccuccgacccaagacacg

SEQ ID NO: 2495951 - RNA, 19 nt, Chlamydia trachomatis
acccucgauccagcaucuc

SEQ ID NO: 2495952 - RNA, 19 nt, Chlamydia trachomatis
acccuuucuuacuccuucu

SEQ ID NO: 2495953 - RNA, 12 nt, Chlamydia trachomatis
acccuuuguagu

SEQ ID NO: 2495954 - RNA, 22 nt, Chlamydia trachomatis
acccuuuguaguuagacaaaaa

SEQ ID NO: 2495955 - RNA, 17 nt, Chlamydia trachomatis
acccuuuuaauccagcu

SEQ ID NO: 2495956 - RNA, 14 nt, Chlamydia trachomatis
accgaagguucuuc

SEQ ID NO: 2495957 - RNA, 15 nt, Chlamydia trachomatis
accgacuucaacuuc

SEQ ID NO: 2495958 - RNA, 16 nt, Chlamydia trachomatis
accgacuucaacuucu

SEQ ID NO: 2495959 - RNA, 14 nt, Chlamydia trachomatis
accgagccuccgcu

SEQ ID NO: 2495960 - RNA, 20 nt, Chlamydia trachomatis
accgauaccaauaaugacac

SEQ ID NO: 2495961 - RNA, 21 nt, Chlamydia trachomatis
accgauaccaauaaugacaca

SEQ ID NO: 2495962 - RNA, 23 nt, Chlamydia trachomatis
accgauguauuuguaccaaccca

SEQ ID NO: 2495963 - RNA, 22 nt, Chlamydia trachomatis
accgcaucagccccaaaaacag

SEQ ID NO: 2495964 - RNA, 15 nt, Chlamydia trachomatis
accggaacaaucacg

SEQ ID NO: 2495965 - RNA, 14 nt, Chlamydia trachomatis
accguagaauuucu

SEQ ID NO: 2495966 - RNA, 19 nt, Chlamydia trachomatis
accguagaauuucuucuuu

SEQ ID NO: 2495967 - RNA, 16 nt, Chlamydia trachomatis
accguagauccuuucg

SEQ ID NO: 2495968 - RNA, 17 nt, Chlamydia trachomatis
accguauuaucugcaac

SEQ ID NO: 2495969 - RNA, 18 nt, Chlamydia trachomatis
accgucaaaaagaucuuc

SEQ ID NO: 2495970 - RNA, 20 nt, Chlamydia trachomatis
accguuacaggauagccaaa

SEQ ID NO: 2495971 - RNA, 13 nt, Chlamydia trachomatis
accguuccaucuu

SEQ ID NO: 2495972 - RNA, 17 nt, Chlamydia trachomatis
accguucgacaacgaua

SEQ ID NO: 2495973 - RNA, 13 nt, Chlamydia trachomatis
accuaaauucaua

SEQ ID NO: 2495974 - RNA, 13 nt, Chlamydia trachomatis
accuaagcgcaag

SEQ ID NO: 2495975 - RNA, 21 nt, Chlamydia trachomatis
accuaagcgcaagaaacugaa

SEQ ID NO: 2495976 - RNA, 17 nt, Chlamydia trachomatis
accuaauuccccaauga

SEQ ID NO: 2495977 - RNA, 19 nt, Chlamydia trachomatis
accuacaaagauaaucaaa

SEQ ID NO: 2495978 - RNA, 18 nt, Chlamydia trachomatis
accuacacgauauaucca

SEQ ID NO: 2495979 - RNA, 15 nt, Chlamydia trachomatis
accuaggagcauucc

SEQ ID NO: 2495980 - RNA, 18 nt, Chlamydia trachomatis
accuaguaagugcauacc

SEQ ID NO: 2495981 - RNA, 15 nt, Chlamydia trachomatis
accuagugauuuuaa

SEQ ID NO: 2495982 - RNA, 13 nt, Chlamydia trachomatis
accucaauagcug

SEQ ID NO: 2495983 - RNA, 12 nt, Chlamydia trachomatis
accuccuaaaua

SEQ ID NO: 2495984 - RNA, 19 nt, Chlamydia trachomatis
accucuccauccugcgugu

SEQ ID NO: 2495985 - RNA, 15 nt, Chlamydia trachomatis
accucuccuugaaca

SEQ ID NO: 2495986 - RNA, 16 nt, Chlamydia trachomatis
accucugcaagaaaau

SEQ ID NO: 2495987 - RNA, 22 nt, Chlamydia trachomatis
accucuggggggaaguaugcau

SEQ ID NO: 2495988 - RNA, 18 nt, Chlamydia trachomatis
accucuucuggaauaucu

SEQ ID NO: 2495989 - RNA, 19 nt, Chlamydia trachomatis
accucuugccugcaaauaa

SEQ ID NO: 2495990 - RNA, 23 nt, Chlamydia trachomatis
accucuuuuuuaugggugaagaa

SEQ ID NO: 2495991 - RNA, 15 nt, Chlamydia trachomatis
accucuuuuuuuccc

SEQ ID NO: 2495992 - RNA, 21 nt, Chlamydia trachomatis
accucuuuuuuucccuagaaa

SEQ ID NO: 2495993 - RNA, 15 nt, Chlamydia trachomatis
accugaagauuuuuu

SEQ ID NO: 2495994 - RNA, 12 nt, Chlamydia trachomatis
accugcaagaga

SEQ ID NO: 2495995 - RNA, 14 nt, Chlamydia trachomatis
accugcauagcuga

SEQ ID NO: 2495996 - RNA, 11 nt, Chlamydia trachomatis
accugcuucag

SEQ ID NO: 2495997 - RNA, 22 nt, Chlamydia trachomatis
accugggaaaacuuucucgcaa

SEQ ID NO: 2495998 - RNA, 13 nt, Chlamydia trachomatis
accugugaagaaa

SEQ ID NO: 2495999 - RNA, 14 nt, Chlamydia trachomatis
accuguugcuuuuc

SEQ ID NO: 2496000 - RNA, 16 nt, Chlamydia trachomatis
accuguugcuuuucga

SEQ ID NO: 2496001 - RNA, 22 nt, Chlamydia trachomatis
accuguuguguaucaaaaucaa

SEQ ID NO: 2496002 - RNA, 16 nt, Chlamydia trachomatis
accuguuucugaauca

SEQ ID NO: 2496003 - RNA, 18 nt, Chlamydia trachomatis
accuguuucugaaucaaa

SEQ ID NO: 2496004 - RNA, 22 nt, Chlamydia trachomatis
accuguuucugaaucaaacaga

SEQ ID NO: 2496005 - RNA, 12 nt, Chlamydia trachomatis
accuuauuauua

SEQ ID NO: 2496006 - RNA, 13 nt, Chlamydia trachomatis
accuuauuauuac

SEQ ID NO: 2496007 - RNA, 22 nt, Chlamydia trachomatis
accuuauuauuacgaacagcaa

SEQ ID NO: 2496008 - RNA, 13 nt, Chlamydia trachomatis
accuucuuacaua

SEQ ID NO: 2496009 - RNA, 17 nt, Chlamydia trachomatis
accuucuuacauaagau

SEQ ID NO: 2496010 - RNA, 21 nt, Chlamydia trachomatis
accuugaguccgcaaacaaaa

SEQ ID NO: 2496011 - RNA, 17 nt, Chlamydia trachomatis
accuugaugaauuuuau

SEQ ID NO: 2496012 - RNA, 20 nt, Chlamydia trachomatis
accuugcuuaacacuucuuu

SEQ ID NO: 2496013 - RNA, 15 nt, Chlamydia trachomatis
accuuguuuuuuaag

SEQ ID NO: 2496014 - RNA, 20 nt, Chlamydia trachomatis
accuuuaccaaagaauucuu

SEQ ID NO: 2496015 - RNA, 21 nt, Chlamydia trachomatis
accuuucccucguaauaacug

SEQ ID NO: 2496016 - RNA, 18 nt, Chlamydia trachomatis
acgaaaagacucucccuc

SEQ ID NO: 2496017 - RNA, 16 nt, Chlamydia trachomatis
acgaaagcuaagauuc

SEQ ID NO: 2496018 - RNA, 12 nt, Chlamydia trachomatis
acgaacaaaaag

SEQ ID NO: 2496019 - RNA, 13 nt, Chlamydia trachomatis
acgaacuuuccau

SEQ ID NO: 2496020 - RNA, 18 nt, Chlamydia trachomatis
acgaacuuuccauagcau

SEQ ID NO: 2496021 - RNA, 17 nt, Chlamydia trachomatis
acgaagagcaaaaucau

SEQ ID NO: 2496022 - RNA, 22 nt, Chlamydia trachomatis
acgaaggaaugguuacuugccu

SEQ ID NO: 2496023 - RNA, 18 nt, Chlamydia trachomatis
acgaaguaggagaugcuu

SEQ ID NO: 2496024 - RNA, 20 nt, Chlamydia trachomatis
acgaaguuagcauguucaga

SEQ ID NO: 2496025 - RNA, 18 nt, Chlamydia trachomatis
acgaaucgcaccauuuaa

SEQ ID NO: 2496026 - RNA, 18 nt, Chlamydia trachomatis
acgaaugcguugcucuac

SEQ ID NO: 2496027 - RNA, 18 nt, Chlamydia trachomatis
acgaauuucugggaaaau

SEQ ID NO: 2496028 - RNA, 19 nt, Chlamydia trachomatis
acgagaucugcaucuuuau

SEQ ID NO: 2496029 - RNA, 23 nt, Chlamydia trachomatis
acgagcauaagaauaaacaacau

SEQ ID NO: 2496030 - RNA, 13 nt, Chlamydia trachomatis
acgagcuagcucu

SEQ ID NO: 2496031 - RNA, 15 nt, Chlamydia trachomatis
acgaggcacaaaauc

SEQ ID NO: 2496032 - RNA, 23 nt, Chlamydia trachomatis
acgaggcacaaaaucccuuccca

SEQ ID NO: 2496033 - RNA, 18 nt, Chlamydia trachomatis
acgagugccgaaggggau

SEQ ID NO: 2496034 - RNA, 18 nt, Chlamydia trachomatis
acgaguugaucuuccucu

SEQ ID NO: 2496035 - RNA, 22 nt, Chlamydia trachomatis
acgaguugaucuuccucuugaa

SEQ ID NO: 2496036 - RNA, 14 nt, Chlamydia trachomatis
acgauaaacagauc

SEQ ID NO: 2496037 - RNA, 21 nt, Chlamydia trachomatis
acgauauccaucauaaaaaga

SEQ ID NO: 2496038 - RNA, 20 nt, Chlamydia trachomatis
acgauauuuaagauagaugc

SEQ ID NO: 2496039 - RNA, 16 nt, Chlamydia trachomatis
acgauccgcuuccugc

SEQ ID NO: 2496040 - RNA, 18 nt, Chlamydia trachomatis
acgauccgcuuccugcca

SEQ ID NO: 2496041 - RNA, 24 nt, Chlamydia trachomatis
acgaucugcccuuuguacaugaua

SEQ ID NO: 2496042 - RNA, 15 nt, Chlamydia trachomatis
acgaugccauccaua

SEQ ID NO: 2496043 - RNA, 16 nt, Chlamydia trachomatis
acgauuaauaggccag

SEQ ID NO: 2496044 - RNA, 20 nt, Chlamydia trachomatis
acgauucuugauaaauaauc

SEQ ID NO: 2496045 - RNA, 20 nt, Chlamydia trachomatis
acgauuuugucgauaagaag

SEQ ID NO: 2496046 - RNA, 16 nt, Chlamydia trachomatis
acgcaaaacaucuaga

SEQ ID NO: 2496047 - RNA, 18 nt, Chlamydia trachomatis
acgcaacccuaaaucucc

SEQ ID NO: 2496048 - RNA, 18 nt, Chlamydia trachomatis
acgcaaguauuggagaca

SEQ ID NO: 2496049 - RNA, 18 nt, Chlamydia trachomatis
acgcacuuuuuguuuuag

SEQ ID NO: 2496050 - RNA, 19 nt, Chlamydia trachomatis
acgcaucccgaaucccauc

SEQ ID NO: 2496051 - RNA, 22 nt, Chlamydia trachomatis
acgccaagaauugacagcacca

SEQ ID NO: 2496052 - RNA, 16 nt, Chlamydia trachomatis
acgccauaucaaagcu

SEQ ID NO: 2496053 - RNA, 17 nt, Chlamydia trachomatis
acgccauaucaaagcua

SEQ ID NO: 2496054 - RNA, 20 nt, Chlamydia trachomatis
acgccguaagcauucccaga

SEQ ID NO: 2496055 - RNA, 19 nt, Chlamydia trachomatis
acgccuguuaguauaugcu

SEQ ID NO: 2496056 - RNA, 13 nt, Chlamydia trachomatis
acgcguucuucug

SEQ ID NO: 2496057 - RNA, 17 nt, Chlamydia trachomatis
acgcucaggcuaucaca

SEQ ID NO: 2496058 - RNA, 20 nt, Chlamydia trachomatis
acgcuccaaauaaaacgaaa

SEQ ID NO: 2496059 - RNA, 13 nt, Chlamydia trachomatis
acgcucuccaaag

SEQ ID NO: 2496060 - RNA, 13 nt, Chlamydia trachomatis
acgcucuuucuua

SEQ ID NO: 2496061 - RNA, 18 nt, Chlamydia trachomatis
acgcucuuuuucuuccag

SEQ ID NO: 2496062 - RNA, 16 nt, Chlamydia trachomatis
acgcuguuccuuccuc

SEQ ID NO: 2496063 - RNA, 16 nt, Chlamydia trachomatis
acgcuuccuacagcua

SEQ ID NO: 2496064 - RNA, 15 nt, Chlamydia trachomatis
acgcuuccucuccuu

SEQ ID NO: 2496065 - RNA, 18 nt, Chlamydia trachomatis
acgcuuccucuccuucua

SEQ ID NO: 2496066 - RNA, 22 nt, Chlamydia trachomatis
acgcuuccucuccuucuacaaa

SEQ ID NO: 2496067 - RNA, 14 nt, Chlamydia trachomatis
acggaaaaagaaga

SEQ ID NO: 2496068 - RNA, 17 nt, Chlamydia trachomatis
acggaacucuacaaaau

SEQ ID NO: 2496069 - RNA, 17 nt, Chlamydia trachomatis
acggaagugguuaaugu

SEQ ID NO: 2496070 - RNA, 17 nt, Chlamydia trachomatis
acggaaguucuugcuug

SEQ ID NO: 2496071 - RNA, 16 nt, Chlamydia trachomatis
acggaauagccuccaa

SEQ ID NO: 2496072 - RNA, 17 nt, Chlamydia trachomatis
acggaaucucgagcuaa

SEQ ID NO: 2496073 - RNA, 16 nt, Chlamydia trachomatis
acggaauuuuucucac

SEQ ID NO: 2496074 - RNA, 15 nt, Chlamydia trachomatis
acggagagaaagagg

SEQ ID NO: 2496075 - RNA, 17 nt, Chlamydia trachomatis
acggagagaaagagggg

SEQ ID NO: 2496076 - RNA, 15 nt, Chlamydia trachomatis
acggcauaggcguga

SEQ ID NO: 2496077 - RNA, 13 nt, Chlamydia trachomatis
acggcucuucuua

SEQ ID NO: 2496078 - RNA, 22 nt, Chlamydia trachomatis
acggggcuagccguguucugaa

SEQ ID NO: 2496079 - RNA, 17 nt, Chlamydia trachomatis
acgguggaacagcucua

SEQ ID NO: 2496080 - RNA, 15 nt, Chlamydia trachomatis
acgguguuagaaaau

SEQ ID NO: 2496081 - RNA, 18 nt, Chlamydia trachomatis
acgguguuagaaaauacg

SEQ ID NO: 2496082 - RNA, 17 nt, Chlamydia trachomatis
acguagauaucuuuacu

SEQ ID NO: 2496083 - RNA, 16 nt, Chlamydia trachomatis
acguaggccacaagau

SEQ ID NO: 2496084 - RNA, 21 nt, Chlamydia trachomatis
acguaguaauuuugacagaau

SEQ ID NO: 2496085 - RNA, 22 nt, Chlamydia trachomatis
acguagucauugauucuaugag

SEQ ID NO: 2496086 - RNA, 22 nt, Chlamydia trachomatis
acguauacgagggagcagcuuu

SEQ ID NO: 2496087 - RNA, 23 nt, Chlamydia trachomatis
acguccgcuccuucuuucuggaa

SEQ ID NO: 2496088 - RNA, 23 nt, Chlamydia trachomatis
acguccuccugauuccugcugau

SEQ ID NO: 2496089 - RNA, 21 nt, Chlamydia trachomatis
acgucgaaaagcuucugccau

SEQ ID NO: 2496090 - RNA, 20 nt, Chlamydia trachomatis
acgucugaaacuagucucuu

SEQ ID NO: 2496091 - RNA, 17 nt, Chlamydia trachomatis
acgugagguacagcgaa

SEQ ID NO: 2496092 - RNA, 22 nt, Chlamydia trachomatis
acgugcgacugcccuugagaac

SEQ ID NO: 2496093 - RNA, 16 nt, Chlamydia trachomatis
acguuccagucuuaac

SEQ ID NO: 2496094 - RNA, 23 nt, Chlamydia trachomatis
acguuccguucgggucauaaaca

SEQ ID NO: 2496095 - RNA, 18 nt, Chlamydia trachomatis
acguuccuccuccaggaa

SEQ ID NO: 2496096 - RNA, 20 nt, Chlamydia trachomatis
acguugaugagagaaaaggc

SEQ ID NO: 2496097 - RNA, 23 nt, Chlamydia trachomatis
acguuuaccgcucuuccauaauu

SEQ ID NO: 2496098 - RNA, 14 nt, Chlamydia trachomatis
acguuuagccucca

SEQ ID NO: 2496099 - RNA, 21 nt, Chlamydia trachomatis
acguuucuguucaagagaggc

SEQ ID NO: 2496100 - RNA, 15 nt, Chlamydia trachomatis
acguuuggaaauccu

SEQ ID NO: 2496101 - RNA, 20 nt, Chlamydia trachomatis
acguuuuagaaugguucuua

SEQ ID NO: 2496102 - RNA, 21 nt, Chlamydia trachomatis
acguuuuucguagacagagaa

SEQ ID NO: 2496103 - RNA, 23 nt, Chlamydia trachomatis
acuaaaaguaguccuaucaccac

SEQ ID NO: 2496104 - RNA, 18 nt, Chlamydia trachomatis
acuaaaggaaacaagcag

SEQ ID NO: 2496105 - RNA, 13 nt, Chlamydia trachomatis
acuaaaucucuug

SEQ ID NO: 2496106 - RNA, 18 nt, Chlamydia trachomatis
acuaacaucaaagaucuu

SEQ ID NO: 2496107 - RNA, 22 nt, Chlamydia trachomatis
acuaauaaauuagggaagagca

SEQ ID NO: 2496108 - RNA, 22 nt, Chlamydia trachomatis
acuacaaaacgcucuuuuucuu

SEQ ID NO: 2496109 - RNA, 16 nt, Chlamydia trachomatis
acuacaacaaguuccu

SEQ ID NO: 2496110 - RNA, 15 nt, Chlamydia trachomatis
acuacagucuuccuc

SEQ ID NO: 2496111 - RNA, 20 nt, Chlamydia trachomatis
acuacagucuuccucugcuu

SEQ ID NO: 2496112 - RNA, 14 nt, Chlamydia trachomatis
acuacauucuuuuu

SEQ ID NO: 2496113 - RNA, 20 nt, Chlamydia trachomatis
acuaccaaaccuuaaaagca

SEQ ID NO: 2496114 - RNA, 22 nt, Chlamydia trachomatis
acuacccgauucaaaaaucgcu

SEQ ID NO: 2496115 - RNA, 13 nt, Chlamydia trachomatis
acuaccuagugau

SEQ ID NO: 2496116 - RNA, 22 nt, Chlamydia trachomatis
acuacgcuaucgguaaugccuu

SEQ ID NO: 2496117 - RNA, 16 nt, Chlamydia trachomatis
acuacucccaaaucaa

SEQ ID NO: 2496118 - RNA, 15 nt, Chlamydia trachomatis
acuacugggucuuuu

SEQ ID NO: 2496119 - RNA, 17 nt, Chlamydia trachomatis
acuacugggucuuuuuu

SEQ ID NO: 2496120 - RNA, 19 nt, Chlamydia trachomatis
acuacugggucuuuuuuau

SEQ ID NO: 2496121 - RNA, 23 nt, Chlamydia trachomatis
acuacugucagaccuacaaagau

SEQ ID NO: 2496122 - RNA, 16 nt, Chlamydia trachomatis
acuagauagauggcau

SEQ ID NO: 2496123 - RNA, 15 nt, Chlamydia trachomatis
acuagaugcaauaaa

SEQ ID NO: 2496124 - RNA, 21 nt, Chlamydia trachomatis
acuagcuguaaauguucauga

SEQ ID NO: 2496125 - RNA, 14 nt, Chlamydia trachomatis
acuaggcucaugag

SEQ ID NO: 2496126 - RNA, 21 nt, Chlamydia trachomatis
acuaggcucaugagccucuaa

SEQ ID NO: 2496127 - RNA, 20 nt, Chlamydia trachomatis
acuagggaauaaaaguacuu

SEQ ID NO: 2496128 - RNA, 14 nt, Chlamydia trachomatis
acuaguuuuuuccc

SEQ ID NO: 2496129 - RNA, 20 nt, Chlamydia trachomatis
acuaucauugagcaaaaaaa

SEQ ID NO: 2496130 - RNA, 15 nt, Chlamydia trachomatis
acuauccaaagcugc

SEQ ID NO: 2496131 - RNA, 15 nt, Chlamydia trachomatis
acuaucccuacugaa

SEQ ID NO: 2496132 - RNA, 11 nt, Chlamydia trachomatis
acuaucuccua

SEQ ID NO: 2496133 - RNA, 16 nt, Chlamydia trachomatis
acuaucugcaaaagca

SEQ ID NO: 2496134 - RNA, 18 nt, Chlamydia trachomatis
acuaugaacaaacagcug

SEQ ID NO: 2496135 - RNA, 17 nt, Chlamydia trachomatis
acuauugaaauaccacu

SEQ ID NO: 2496136 - RNA, 17 nt, Chlamydia trachomatis
acuauugaauccagaau

SEQ ID NO: 2496137 - RNA, 17 nt, Chlamydia trachomatis
acucaaagcuucccuuc

SEQ ID NO: 2496138 - RNA, 21 nt, Chlamydia trachomatis
acucaaauuucucuaggaaca

SEQ ID NO: 2496139 - RNA, 22 nt, Chlamydia trachomatis
acucaacacgaacacuacuauc

SEQ ID NO: 2496140 - RNA, 20 nt, Chlamydia trachomatis
acucaacgaaagcaucccca

SEQ ID NO: 2496141 - RNA, 22 nt, Chlamydia trachomatis
acucaagggcguuauauuggaa

SEQ ID NO: 2496142 - RNA, 17 nt, Chlamydia trachomatis
acucagguuauccaaau

SEQ ID NO: 2496143 - RNA, 19 nt, Chlamydia trachomatis
acucauccuagcagcuaau

SEQ ID NO: 2496144 - RNA, 20 nt, Chlamydia trachomatis
acucaucuucggacauugaa

SEQ ID NO: 2496145 - RNA, 13 nt, Chlamydia trachomatis
acucaucuuuuuu

SEQ ID NO: 2496146 - RNA, 20 nt, Chlamydia trachomatis
acuccaacacgaaugccugu

SEQ ID NO: 2496147 - RNA, 13 nt, Chlamydia trachomatis
acuccaagaagag

SEQ ID NO: 2496148 - RNA, 15 nt, Chlamydia trachomatis
acuccaagaagaguc

SEQ ID NO: 2496149 - RNA, 21 nt, Chlamydia trachomatis
acuccaauauauggacaagca

SEQ ID NO: 2496150 - RNA, 16 nt, Chlamydia trachomatis
acuccagagcaaauag

SEQ ID NO: 2496151 - RNA, 14 nt, Chlamydia trachomatis
acucccaaaucaaa

SEQ ID NO: 2496152 - RNA, 18 nt, Chlamydia trachomatis
acucccaaaucaaaccaa

SEQ ID NO: 2496153 - RNA, 17 nt, Chlamydia trachomatis
acucccauaaucacaga

SEQ ID NO: 2496154 - RNA, 16 nt, Chlamydia trachomatis
acucccccuuucaaag

SEQ ID NO: 2496155 - RNA, 16 nt, Chlamydia trachomatis
acuccgaucaauucau

SEQ ID NO: 2496156 - RNA, 20 nt, Chlamydia trachomatis
acuccgaucaauucaucuac

SEQ ID NO: 2496157 - RNA, 16 nt, Chlamydia trachomatis
acuccuaaaucgcaaa

SEQ ID NO: 2496158 - RNA, 14 nt, Chlamydia trachomatis
acuccucaagcgau

SEQ ID NO: 2496159 - RNA, 17 nt, Chlamydia trachomatis
acuccucgucgaagaaa

SEQ ID NO: 2496160 - RNA, 22 nt, Chlamydia trachomatis
acuccugaaaguuuuuuccccu

SEQ ID NO: 2496161 - RNA, 21 nt, Chlamydia trachomatis
acucgauccaucauagaagca

SEQ ID NO: 2496162 - RNA, 20 nt, Chlamydia trachomatis
acucgcacacgauuaucuaa

SEQ ID NO: 2496163 - RNA, 19 nt, Chlamydia trachomatis
acucgcaucauccuugccc

SEQ ID NO: 2496164 - RNA, 16 nt, Chlamydia trachomatis
acucgcgcuucucuug

SEQ ID NO: 2496165 - RNA, 21 nt, Chlamydia trachomatis
acucgcuacauguaguaaucu

SEQ ID NO: 2496166 - RNA, 13 nt, Chlamydia trachomatis
acucgcuccagaa

SEQ ID NO: 2496167 - RNA, 15 nt, Chlamydia trachomatis
acucggccagagcuc

SEQ ID NO: 2496168 - RNA, 18 nt, Chlamydia trachomatis
acucuaaaaguuuucuug

SEQ ID NO: 2496169 - RNA, 15 nt, Chlamydia trachomatis
acucuaaagaauagu

SEQ ID NO: 2496170 - RNA, 15 nt, Chlamydia trachomatis
acucuacaaaauaaa

SEQ ID NO: 2496171 - RNA, 19 nt, Chlamydia trachomatis
acucuaccauugugaacaa

SEQ ID NO: 2496172 - RNA, 22 nt, Chlamydia trachomatis
acucuaucccgcgguagaaagu

SEQ ID NO: 2496173 - RNA, 23 nt, Chlamydia trachomatis
acucuaucccgcgguagaaaguc

SEQ ID NO: 2496174 - RNA, 22 nt, Chlamydia trachomatis
acucucaacgaaagcuaagauu

SEQ ID NO: 2496175 - RNA, 19 nt, Chlamydia trachomatis
acucucagcgauuguucgu

SEQ ID NO: 2496176 - RNA, 17 nt, Chlamydia trachomatis
acucucauaagaauaca

SEQ ID NO: 2496177 - RNA, 23 nt, Chlamydia trachomatis
acucucauaagaauacaaagcag

SEQ ID NO: 2496178 - RNA, 19 nt, Chlamydia trachomatis
acucucccuguagagacua

SEQ ID NO: 2496179 - RNA, 15 nt, Chlamydia trachomatis
acucuccuaauucaa

SEQ ID NO: 2496180 - RNA, 15 nt, Chlamydia trachomatis
acucuccucuccuaa

SEQ ID NO: 2496181 - RNA, 20 nt, Chlamydia trachomatis
acucucgggccaaaaagacu

SEQ ID NO: 2496182 - RNA, 22 nt, Chlamydia trachomatis
acucucgggccaaaaagacuac

SEQ ID NO: 2496183 - RNA, 13 nt, Chlamydia trachomatis
acucucucucccc

SEQ ID NO: 2496184 - RNA, 19 nt, Chlamydia trachomatis
acucugaacaacugcugau

SEQ ID NO: 2496185 - RNA, 14 nt, Chlamydia trachomatis
acucugauuagaag

SEQ ID NO: 2496186 - RNA, 18 nt, Chlamydia trachomatis
acucuuacgagcuuucuu

SEQ ID NO: 2496187 - RNA, 16 nt, Chlamydia trachomatis
acucuuaucguagaga

SEQ ID NO: 2496188 - RNA, 20 nt, Chlamydia trachomatis
acucuucagguugcuugaau

SEQ ID NO: 2496189 - RNA, 23 nt, Chlamydia trachomatis
acucuucagguugcuugaauaag

SEQ ID NO: 2496190 - RNA, 15 nt, Chlamydia trachomatis
acucuuccuugauua

SEQ ID NO: 2496191 - RNA, 14 nt, Chlamydia trachomatis
acucuucuauccau

SEQ ID NO: 2496192 - RNA, 20 nt, Chlamydia trachomatis
acucuuguagaccuaagcua

SEQ ID NO: 2496193 - RNA, 19 nt, Chlamydia trachomatis
acucuuguaucauauucuu

SEQ ID NO: 2496194 - RNA, 20 nt, Chlamydia trachomatis
acucuuguaucauauucuuu

SEQ ID NO: 2496195 - RNA, 20 nt, Chlamydia trachomatis
acucuuuauuaaacucccaa

SEQ ID NO: 2496196 - RNA, 18 nt, Chlamydia trachomatis
acucuuucaauagcauuu

SEQ ID NO: 2496197 - RNA, 19 nt, Chlamydia trachomatis
acucuuuguguaaagcgaa

SEQ ID NO: 2496198 - RNA, 11 nt, Chlamydia trachomatis
acucuuuucuu

SEQ ID NO: 2496199 - RNA, 16 nt, Chlamydia trachomatis
acucuuuuuaaaucaa

SEQ ID NO: 2496200 - RNA, 19 nt, Chlamydia trachomatis
acucuuuuucagacaaaaa

SEQ ID NO: 2496201 - RNA, 14 nt, Chlamydia trachomatis
acugaaagauucac

SEQ ID NO: 2496202 - RNA, 18 nt, Chlamydia trachomatis
acugagacgaauaagcau

SEQ ID NO: 2496203 - RNA, 22 nt, Chlamydia trachomatis
acugagauguuuacgaggaggu

SEQ ID NO: 2496204 - RNA, 23 nt, Chlamydia trachomatis
acugagcuauuuaggcuaacucc

SEQ ID NO: 2496205 - RNA, 15 nt, Chlamydia trachomatis
acugcaacaguaaau

SEQ ID NO: 2496206 - RNA, 14 nt, Chlamydia trachomatis
acugcagcaucuau

SEQ ID NO: 2496207 - RNA, 18 nt, Chlamydia trachomatis
acugcaguugaucauuga

SEQ ID NO: 2496208 - RNA, 17 nt, Chlamydia trachomatis
acugcaucauguugcgu

SEQ ID NO: 2496209 - RNA, 14 nt, Chlamydia trachomatis
acugccgaacugcu

SEQ ID NO: 2496210 - RNA, 15 nt, Chlamydia trachomatis
acugcgcuaugagga

SEQ ID NO: 2496211 - RNA, 19 nt, Chlamydia trachomatis
acugcggcagcugcuugga

SEQ ID NO: 2496212 - RNA, 15 nt, Chlamydia trachomatis
acugcguauuugaaa

SEQ ID NO: 2496213 - RNA, 13 nt, Chlamydia trachomatis
acugcucaaggaa

SEQ ID NO: 2496214 - RNA, 20 nt, Chlamydia trachomatis
acugcuccuaacccuuguac

SEQ ID NO: 2496215 - RNA, 13 nt, Chlamydia trachomatis
acugcucugccau

SEQ ID NO: 2496216 - RNA, 12 nt, Chlamydia trachomatis
acugcugauaaa

SEQ ID NO: 2496217 - RNA, 15 nt, Chlamydia trachomatis
acugcugcuaucauc

SEQ ID NO: 2496218 - RNA, 16 nt, Chlamydia trachomatis
acugcugcuaucaucu

SEQ ID NO: 2496219 - RNA, 21 nt, Chlamydia trachomatis
acugcuucccuccuagaaaga

SEQ ID NO: 2496220 - RNA, 22 nt, Chlamydia trachomatis
acugcuucccuccuagaaagaa

SEQ ID NO: 2496221 - RNA, 22 nt, Chlamydia trachomatis
acuggaauagcuagagcaugca

SEQ ID NO: 2496222 - RNA, 17 nt, Chlamydia trachomatis
acuggaguuuuccugaa

SEQ ID NO: 2496223 - RNA, 14 nt, Chlamydia trachomatis
acuggauccuaaau

SEQ ID NO: 2496224 - RNA, 13 nt, Chlamydia trachomatis
acugggauaagaa

SEQ ID NO: 2496225 - RNA, 14 nt, Chlamydia trachomatis
acugggauaagaaa

SEQ ID NO: 2496226 - RNA, 21 nt, Chlamydia trachomatis
acugguauucugcagaaaaau

SEQ ID NO: 2496227 - RNA, 22 nt, Chlamydia trachomatis
acugguuccccaagggggguua

SEQ ID NO: 2496228 - RNA, 21 nt, Chlamydia trachomatis
acugguucucuuuauccuguu

SEQ ID NO: 2496229 - RNA, 18 nt, Chlamydia trachomatis
acuguaauguccucuuua

SEQ ID NO: 2496230 - RNA, 22 nt, Chlamydia trachomatis
acuguagaaaaucauagauaau

SEQ ID NO: 2496231 - RNA, 14 nt, Chlamydia trachomatis
acuguauccaaaac

SEQ ID NO: 2496232 - RNA, 14 nt, Chlamydia trachomatis
acuguauugcucug

SEQ ID NO: 2496233 - RNA, 13 nt, Chlamydia trachomatis
acugucagaccua

SEQ ID NO: 2496234 - RNA, 15 nt, Chlamydia trachomatis
acugucagaccuaca

SEQ ID NO: 2496235 - RNA, 17 nt, Chlamydia trachomatis
acugucagaccuacaaa

SEQ ID NO: 2496236 - RNA, 14 nt, Chlamydia trachomatis
acugucgaacgcuu

SEQ ID NO: 2496237 - RNA, 17 nt, Chlamydia trachomatis
acugucugagccuaugc

SEQ ID NO: 2496238 - RNA, 17 nt, Chlamydia trachomatis
acugugaagaaugaaac

SEQ ID NO: 2496239 - RNA, 14 nt, Chlamydia trachomatis
acuguugagaaaaa

SEQ ID NO: 2496240 - RNA, 21 nt, Chlamydia trachomatis
acuguugaggagacuuuagcu

SEQ ID NO: 2496241 - RNA, 17 nt, Chlamydia trachomatis
acuuaacgugucgaaaa

SEQ ID NO: 2496242 - RNA, 22 nt, Chlamydia trachomatis
acuuaauaagggcuuuugcaaa

SEQ ID NO: 2496243 - RNA, 23 nt, Chlamydia trachomatis
acuuaauaagggcuuuugcaaac

SEQ ID NO: 2496244 - RNA, 19 nt, Chlamydia trachomatis
acuuaccuuguuagaaaug

SEQ ID NO: 2496245 - RNA, 14 nt, Chlamydia trachomatis
acuuacuuuucuua

SEQ ID NO: 2496246 - RNA, 14 nt, Chlamydia trachomatis
acuuagagacauuu

SEQ ID NO: 2496247 - RNA, 23 nt, Chlamydia trachomatis
acuucaaguucuucuuccacaga

SEQ ID NO: 2496248 - RNA, 22 nt, Chlamydia trachomatis
acuucaaucacuccuccuccua

SEQ ID NO: 2496249 - RNA, 23 nt, Chlamydia trachomatis
acuucagcgcgaauaaauccucu

SEQ ID NO: 2496250 - RNA, 20 nt, Chlamydia trachomatis
acuucauacauaacuauccc

SEQ ID NO: 2496251 - RNA, 15 nt, Chlamydia trachomatis
acuucauauucccug

SEQ ID NO: 2496252 - RNA, 16 nt, Chlamydia trachomatis
acuucaucgagaagau

SEQ ID NO: 2496253 - RNA, 17 nt, Chlamydia trachomatis
acuucauuuuugcuaaa

SEQ ID NO: 2496254 - RNA, 22 nt, Chlamydia trachomatis
acuucccacggaagaggagaga

SEQ ID NO: 2496255 - RNA, 17 nt, Chlamydia trachomatis
acuuccccauucuucuc

SEQ ID NO: 2496256 - RNA, 19 nt, Chlamydia trachomatis
acuuccguaccaaggauuu

SEQ ID NO: 2496257 - RNA, 14 nt, Chlamydia trachomatis
acuucuauccggag

SEQ ID NO: 2496258 - RNA, 22 nt, Chlamydia trachomatis
acuucuauccggaguaccaaaa

SEQ ID NO: 2496259 - RNA, 23 nt, Chlamydia trachomatis
acuucucgaaaaaaugccuccau

SEQ ID NO: 2496260 - RNA, 21 nt, Chlamydia trachomatis
acuucugcuaaaaaugcuugc

SEQ ID NO: 2496261 - RNA, 18 nt, Chlamydia trachomatis
acuucuggagauugaaua

SEQ ID NO: 2496262 - RNA, 22 nt, Chlamydia trachomatis
acuucuggcaguaacaagcaca

SEQ ID NO: 2496263 - RNA, 17 nt, Chlamydia trachomatis
acuucuuacuuaaaaaa

SEQ ID NO: 2496264 - RNA, 14 nt, Chlamydia trachomatis
acuucuucauccuu

SEQ ID NO: 2496265 - RNA, 22 nt, Chlamydia trachomatis
acuucuucgucugugagagagc

SEQ ID NO: 2496266 - RNA, 13 nt, Chlamydia trachomatis
acuucuucuagag

SEQ ID NO: 2496267 - RNA, 13 nt, Chlamydia trachomatis
acuucuucuuugg

SEQ ID NO: 2496268 - RNA, 20 nt, Chlamydia trachomatis
acuucuucuuuggaaaaaaa

SEQ ID NO: 2496269 - RNA, 22 nt, Chlamydia trachomatis
acuucuuguauaaguucuuuuu

SEQ ID NO: 2496270 - RNA, 19 nt, Chlamydia trachomatis
acuucuuuaaagccuuucu

SEQ ID NO: 2496271 - RNA, 20 nt, Chlamydia trachomatis
acuucuuuaaagccuuucuc

SEQ ID NO: 2496272 - RNA, 13 nt, Chlamydia trachomatis
acuugagaacaaa

SEQ ID NO: 2496273 - RNA, 22 nt, Chlamydia trachomatis
acuugaguaaucaguugaaaga

SEQ ID NO: 2496274 - RNA, 15 nt, Chlamydia trachomatis
acuugauaaauagca

SEQ ID NO: 2496275 - RNA, 17 nt, Chlamydia trachomatis
acuugauaaauagcaau

SEQ ID NO: 2496276 - RNA, 18 nt, Chlamydia trachomatis
acuugauuggauaacguc

SEQ ID NO: 2496277 - RNA, 14 nt, Chlamydia trachomatis
acuugcuccacaca

SEQ ID NO: 2496278 - RNA, 21 nt, Chlamydia trachomatis
acuugcuccguggcaagcaac

SEQ ID NO: 2496279 - RNA, 15 nt, Chlamydia trachomatis
acuugucuaaaagaa

SEQ ID NO: 2496280 - RNA, 13 nt, Chlamydia trachomatis
acuuguucugcug

SEQ ID NO: 2496281 - RNA, 18 nt, Chlamydia trachomatis
acuuuaccgacuucaacu

SEQ ID NO: 2496282 - RNA, 17 nt, Chlamydia trachomatis
acuuuagauagucuucu

SEQ ID NO: 2496283 - RNA, 23 nt, Chlamydia trachomatis
acuuuagauuuguuuaaaagaag

SEQ ID NO: 2496284 - RNA, 14 nt, Chlamydia trachomatis
acuuuaggagaaag

SEQ ID NO: 2496285 - RNA, 15 nt, Chlamydia trachomatis
acuuuaggagaaaga

SEQ ID NO: 2496286 - RNA, 16 nt, Chlamydia trachomatis
acuuuaggagaaagaa

SEQ ID NO: 2496287 - RNA, 15 nt, Chlamydia trachomatis
acuuuauuauugaaa

SEQ ID NO: 2496288 - RNA, 21 nt, Chlamydia trachomatis
acuuuauuauugaaaaagcuu

SEQ ID NO: 2496289 - RNA, 17 nt, Chlamydia trachomatis
acuuucccugcaacauu

SEQ ID NO: 2496290 - RNA, 20 nt, Chlamydia trachomatis
acuuucccugcaacauuucc

SEQ ID NO: 2496291 - RNA, 14 nt, Chlamydia trachomatis
acuuuccgaaauaa

SEQ ID NO: 2496292 - RNA, 21 nt, Chlamydia trachomatis
acuuuccucugguacucaucu

SEQ ID NO: 2496293 - RNA, 22 nt, Chlamydia trachomatis
acuuucucuucaagaucaaagu

SEQ ID NO: 2496294 - RNA, 12 nt, Chlamydia trachomatis
acuuugaaaugu

SEQ ID NO: 2496295 - RNA, 14 nt, Chlamydia trachomatis
acuuugacaagcag

SEQ ID NO: 2496296 - RNA, 23 nt, Chlamydia trachomatis
acuuuggcaugcccuaaagagau

SEQ ID NO: 2496297 - RNA, 14 nt, Chlamydia trachomatis
acuuuguauuaacg

SEQ ID NO: 2496298 - RNA, 22 nt, Chlamydia trachomatis
acuuugugacguauauuucaca

SEQ ID NO: 2496299 - RNA, 14 nt, Chlamydia trachomatis
acuuuucaauuaca

SEQ ID NO: 2496300 - RNA, 17 nt, Chlamydia trachomatis
acuuuucagcaagaaca

SEQ ID NO: 2496301 - RNA, 13 nt, Chlamydia trachomatis
acuuuucuagcag

SEQ ID NO: 2496302 - RNA, 13 nt, Chlamydia trachomatis
acuuuucuuccuc

SEQ ID NO: 2496303 - RNA, 20 nt, Chlamydia trachomatis
acuuuugaucccuaauauga

SEQ ID NO: 2496304 - RNA, 17 nt, Chlamydia trachomatis
acuuuugguucugccag

SEQ ID NO: 2496305 - RNA, 22 nt, Chlamydia trachomatis
acuuuuuagcaucugauacuga

SEQ ID NO: 2496306 - RNA, 14 nt, Chlamydia trachomatis
acuuuuuuuucuuu

SEQ ID NO: 2496307 - RNA, 19 nt, Chlamydia trachomatis
agaaaaacuccuucuguug

SEQ ID NO: 2496308 - RNA, 15 nt, Chlamydia trachomatis
agaaaaagaaaaggc

SEQ ID NO: 2496309 - RNA, 17 nt, Chlamydia trachomatis
agaaaaagagaaauauu

SEQ ID NO: 2496310 - RNA, 13 nt, Chlamydia trachomatis
agaaaaagaugga

SEQ ID NO: 2496311 - RNA, 13 nt, Chlamydia trachomatis
agaaaaagggaga

SEQ ID NO: 2496312 - RNA, 21 nt, Chlamydia trachomatis
agaaaaaggucucccaagaaa

SEQ ID NO: 2496313 - RNA, 16 nt, Chlamydia trachomatis
agaaaaauugcaaaga

SEQ ID NO: 2496314 - RNA, 23 nt, Chlamydia trachomatis
agaaaacuuagcuaaauucaacu

SEQ ID NO: 2496315 - RNA, 10 nt, Chlamydia trachomatis
agaaaagagc

SEQ ID NO: 2496316 - RNA, 14 nt, Chlamydia trachomatis
agaaaagaggaguu

SEQ ID NO: 2496317 - RNA, 18 nt, Chlamydia trachomatis
agaaaaggauaguuucga

SEQ ID NO: 2496318 - RNA, 13 nt, Chlamydia trachomatis
agaaaauaaacac

SEQ ID NO: 2496319 - RNA, 14 nt, Chlamydia trachomatis
agaaaauaaacaca

SEQ ID NO: 2496320 - RNA, 16 nt, Chlamydia trachomatis
agaaaauaaguuaccu

SEQ ID NO: 2496321 - RNA, 16 nt, Chlamydia trachomatis
agaaaauagguaaaga

SEQ ID NO: 2496322 - RNA, 19 nt, Chlamydia trachomatis
agaaaaucagaaagcucug

SEQ ID NO: 2496323 - RNA, 20 nt, Chlamydia trachomatis
agaaaaugaugaaaaagaag

SEQ ID NO: 2496324 - RNA, 16 nt, Chlamydia trachomatis
agaaaauggcugcuug

SEQ ID NO: 2496325 - RNA, 15 nt, Chlamydia trachomatis
agaaaauuucucuuc

SEQ ID NO: 2496326 - RNA, 12 nt, Chlamydia trachomatis
agaaacaaaacg

SEQ ID NO: 2496327 - RNA, 20 nt, Chlamydia trachomatis
agaaacaaauaacuuuuucu

SEQ ID NO: 2496328 - RNA, 14 nt, Chlamydia trachomatis
agaaacaacaaaga

SEQ ID NO: 2496329 - RNA, 15 nt, Chlamydia trachomatis
agaaacaacaaagaa

SEQ ID NO: 2496330 - RNA, 16 nt, Chlamydia trachomatis
agaaacacgcaacccu

SEQ ID NO: 2496331 - RNA, 19 nt, Chlamydia trachomatis
agaaacagccugcuuucuu

SEQ ID NO: 2496332 - RNA, 14 nt, Chlamydia trachomatis
agaaacaggagaaa

SEQ ID NO: 2496333 - RNA, 14 nt, Chlamydia trachomatis
agaaacgacaggcu

SEQ ID NO: 2496334 - RNA, 11 nt, Chlamydia trachomatis
agaaacguuua

SEQ ID NO: 2496335 - RNA, 21 nt, Chlamydia trachomatis
agaaacuaaacgaugauagag

SEQ ID NO: 2496336 - RNA, 20 nt, Chlamydia trachomatis
agaaacuauugaucaaagua

SEQ ID NO: 2496337 - RNA, 12 nt, Chlamydia trachomatis
agaaacugaaag

SEQ ID NO: 2496338 - RNA, 19 nt, Chlamydia trachomatis
agaaacuguaauguccucu

SEQ ID NO: 2496339 - RNA, 22 nt, Chlamydia trachomatis
agaaacuguaauguccucuuua

SEQ ID NO: 2496340 - RNA, 16 nt, Chlamydia trachomatis
agaaacuucaguuugu

SEQ ID NO: 2496341 - RNA, 15 nt, Chlamydia trachomatis
agaaacuucuggaga

SEQ ID NO: 2496342 - RNA, 12 nt, Chlamydia trachomatis
agaaacuucuuc

SEQ ID NO: 2496343 - RNA, 23 nt, Chlamydia trachomatis
agaaacuucuucuaaguauucuu

SEQ ID NO: 2496344 - RNA, 13 nt, Chlamydia trachomatis
agaaacuuuucug

SEQ ID NO: 2496345 - RNA, 14 nt, Chlamydia trachomatis
agaaacuuuucugc

SEQ ID NO: 2496346 - RNA, 17 nt, Chlamydia trachomatis
agaaacuuuucugcaga

SEQ ID NO: 2496347 - RNA, 23 nt, Chlamydia trachomatis
agaaagagcgaugauuaucaccu

SEQ ID NO: 2496348 - RNA, 12 nt, Chlamydia trachomatis
agaaagaggcuu

SEQ ID NO: 2496349 - RNA, 13 nt, Chlamydia trachomatis
agaaagagggguu

SEQ ID NO: 2496350 - RNA, 19 nt, Chlamydia trachomatis
agaaagccguucccaauaa

SEQ ID NO: 2496351 - RNA, 14 nt, Chlamydia trachomatis
agaaagcuacaguc

SEQ ID NO: 2496352 - RNA, 23 nt, Chlamydia trachomatis
agaaagcuuauaacuaagaucuc

SEQ ID NO: 2496353 - RNA, 21 nt, Chlamydia trachomatis
agaaaggucugcauauuuaau

SEQ ID NO: 2496354 - RNA, 16 nt, Chlamydia trachomatis
agaaagguuuuucuua

SEQ ID NO: 2496355 - RNA, 13 nt, Chlamydia trachomatis
agaaaguccugcu

SEQ ID NO: 2496356 - RNA, 17 nt, Chlamydia trachomatis
agaaaguucguucaauu

SEQ ID NO: 2496357 - RNA, 18 nt, Chlamydia trachomatis
agaaaguuuuuuucagga

SEQ ID NO: 2496358 - RNA, 19 nt, Chlamydia trachomatis
agaaaguuuuuuucaggag

SEQ ID NO: 2496359 - RNA, 23 nt, Chlamydia trachomatis
agaaauaaaauggaaauaaaaag

SEQ ID NO: 2496360 - RNA, 22 nt, Chlamydia trachomatis
agaaauaaccuaggagcauucc

SEQ ID NO: 2496361 - RNA, 23 nt, Chlamydia trachomatis
agaaauagcuaucaauaaagaag

SEQ ID NO: 2496362 - RNA, 19 nt, Chlamydia trachomatis
agaaauauucccaaagcua

SEQ ID NO: 2496363 - RNA, 22 nt, Chlamydia trachomatis
agaaauccuaaaaaaaaccauu

SEQ ID NO: 2496364 - RNA, 20 nt, Chlamydia trachomatis
agaaaucuuuuacuggagaa

SEQ ID NO: 2496365 - RNA, 21 nt, Chlamydia trachomatis
agaaaugcaaauuugcagaag

SEQ ID NO: 2496366 - RNA, 16 nt, Chlamydia trachomatis
agaaauggucucuucu

SEQ ID NO: 2496367 - RNA, 17 nt, Chlamydia trachomatis
agaaauggucucuucuc

SEQ ID NO: 2496368 - RNA, 23 nt, Chlamydia trachomatis
agaaauggucucuucuccuagag

SEQ ID NO: 2496369 - RNA, 18 nt, Chlamydia trachomatis
agaaauguugugugauga

SEQ ID NO: 2496370 - RNA, 22 nt, Chlamydia trachomatis
agaaauguuuggauaagaacuu

SEQ ID NO: 2496371 - RNA, 14 nt, Chlamydia trachomatis
agaaauuacagaag

SEQ ID NO: 2496372 - RNA, 18 nt, Chlamydia trachomatis
agaaauucguaugcaacu

SEQ ID NO: 2496373 - RNA, 20 nt, Chlamydia trachomatis
agaaauugauagugaaauaa

SEQ ID NO: 2496374 - RNA, 23 nt, Chlamydia trachomatis
agaaauugauagugaaauaaguc

SEQ ID NO: 2496375 - RNA, 18 nt, Chlamydia trachomatis
agaacaaacgaaggagcu

SEQ ID NO: 2496376 - RNA, 19 nt, Chlamydia trachomatis
agaacaaacgaaggagcuu

SEQ ID NO: 2496377 - RNA, 14 nt, Chlamydia trachomatis
agaacaagauaaag

SEQ ID NO: 2496378 - RNA, 15 nt, Chlamydia trachomatis
agaacaagauaaaga

SEQ ID NO: 2496379 - RNA, 14 nt, Chlamydia trachomatis
agaacaagugcagc

SEQ ID NO: 2496380 - RNA, 15 nt, Chlamydia trachomatis
agaacaaucuggagc

SEQ ID NO: 2496381 - RNA, 20 nt, Chlamydia trachomatis
agaacagauugagaauaaau

SEQ ID NO: 2496382 - RNA, 23 nt, Chlamydia trachomatis
agaacagauugagaauaaauaua

SEQ ID NO: 2496383 - RNA, 20 nt, Chlamydia trachomatis
agaacagauuuagagaauaa

SEQ ID NO: 2496384 - RNA, 23 nt, Chlamydia trachomatis
agaacagcucuagcuaaacccaa

SEQ ID NO: 2496385 - RNA, 19 nt, Chlamydia trachomatis
agaacaguguccuuccaug

SEQ ID NO: 2496386 - RNA, 15 nt, Chlamydia trachomatis
agaacauaacaaggc

SEQ ID NO: 2496387 - RNA, 16 nt, Chlamydia trachomatis
agaacauaacaaggcu

SEQ ID NO: 2496388 - RNA, 16 nt, Chlamydia trachomatis
agaacauaacacauau

SEQ ID NO: 2496389 - RNA, 18 nt, Chlamydia trachomatis
agaacaucggaccacauu

SEQ ID NO: 2496390 - RNA, 14 nt, Chlamydia trachomatis
agaacauuucucgu

SEQ ID NO: 2496391 - RNA, 21 nt, Chlamydia trachomatis
agaacauuucucgucagggga

SEQ ID NO: 2496392 - RNA, 22 nt, Chlamydia trachomatis
agaacauuucucgucaggggau

SEQ ID NO: 2496393 - RNA, 21 nt, Chlamydia trachomatis
agaaccaaucgagagguccag

SEQ ID NO: 2496394 - RNA, 15 nt, Chlamydia trachomatis
agaaccacuuuucug

SEQ ID NO: 2496395 - RNA, 14 nt, Chlamydia trachomatis
agaacccuaucccc

SEQ ID NO: 2496396 - RNA, 20 nt, Chlamydia trachomatis
agaaccgaauuuguagaucu

SEQ ID NO: 2496397 - RNA, 14 nt, Chlamydia trachomatis
agaaccgcaagcaa

SEQ ID NO: 2496398 - RNA, 16 nt, Chlamydia trachomatis
agaaccucaauagcug

SEQ ID NO: 2496399 - RNA, 21 nt, Chlamydia trachomatis
agaaccuccauaagaaauuaa

SEQ ID NO: 2496400 - RNA, 15 nt, Chlamydia trachomatis
agaacggcaauaaag

SEQ ID NO: 2496401 - RNA, 18 nt, Chlamydia trachomatis
agaacggcaauaaagaaa

SEQ ID NO: 2496402 - RNA, 19 nt, Chlamydia trachomatis
agaacguuucgucucuuua

SEQ ID NO: 2496403 - RNA, 14 nt, Chlamydia trachomatis
agaacucaaaagcu

SEQ ID NO: 2496404 - RNA, 15 nt, Chlamydia trachomatis
agaacucaaaagcuu

SEQ ID NO: 2496405 - RNA, 19 nt, Chlamydia trachomatis
agaacucaaaauaaagaaa

SEQ ID NO: 2496406 - RNA, 17 nt, Chlamydia trachomatis
agaacucccuccaaaaa

SEQ ID NO: 2496407 - RNA, 19 nt, Chlamydia trachomatis
agaacucccuccaaaaaag

SEQ ID NO: 2496408 - RNA, 22 nt, Chlamydia trachomatis
agaacucccuccaaaaaagagg

SEQ ID NO: 2496409 - RNA, 12 nt, Chlamydia trachomatis
agaacucuuucc

SEQ ID NO: 2496410 - RNA, 14 nt, Chlamydia trachomatis
agaacugcagugac

SEQ ID NO: 2496411 - RNA, 16 nt, Chlamydia trachomatis
agaacugcagugacau

SEQ ID NO: 2496412 - RNA, 22 nt, Chlamydia trachomatis
agaagaaccuccauaagaaauu

SEQ ID NO: 2496413 - RNA, 21 nt, Chlamydia trachomatis
agaagaacgccugaucaaauc

SEQ ID NO: 2496414 - RNA, 15 nt, Chlamydia trachomatis
agaagaacugcagug

SEQ ID NO: 2496415 - RNA, 18 nt, Chlamydia trachomatis
agaagaacugcagugaca

SEQ ID NO: 2496416 - RNA, 13 nt, Chlamydia trachomatis
agaagaagaacug

SEQ ID NO: 2496417 - RNA, 10 nt, Chlamydia trachomatis
agaagaagag

SEQ ID NO: 2496418 - RNA, 11 nt, Chlamydia trachomatis
agaagaagagc

SEQ ID NO: 2496419 - RNA, 13 nt, Chlamydia trachomatis
agaagaagaggag

SEQ ID NO: 2496420 - RNA, 14 nt, Chlamydia trachomatis
agaagaagaggagg

SEQ ID NO: 2496421 - RNA, 14 nt, Chlamydia trachomatis
agaagaaucauaga

SEQ ID NO: 2496422 - RNA, 24 nt, Chlamydia trachomatis
agaagacaaagaucguaaaauagc

SEQ ID NO: 2496423 - RNA, 18 nt, Chlamydia trachomatis
agaagacuuacucucuaa

SEQ ID NO: 2496424 - RNA, 13 nt, Chlamydia trachomatis
agaagacuuugga

SEQ ID NO: 2496425 - RNA, 15 nt, Chlamydia trachomatis
agaagagcugcuguc

SEQ ID NO: 2496426 - RNA, 12 nt, Chlamydia trachomatis
agaagaggcaaa

SEQ ID NO: 2496427 - RNA, 18 nt, Chlamydia trachomatis
agaagaggcaaaaaucug

SEQ ID NO: 2496428 - RNA, 16 nt, Chlamydia trachomatis
agaagauaagcaagga

SEQ ID NO: 2496429 - RNA, 18 nt, Chlamydia trachomatis
agaagaucccaacaggag

SEQ ID NO: 2496430 - RNA, 16 nt, Chlamydia trachomatis
agaagauccuucgcag

SEQ ID NO: 2496431 - RNA, 20 nt, Chlamydia trachomatis
agaagauccuucgcagggga

SEQ ID NO: 2496432 - RNA, 18 nt, Chlamydia trachomatis
agaagaucuuuccuugug

SEQ ID NO: 2496433 - RNA, 19 nt, Chlamydia trachomatis
agaagccauaguagaaauu

SEQ ID NO: 2496434 - RNA, 15 nt, Chlamydia trachomatis
agaagccuugagccu

SEQ ID NO: 2496435 - RNA, 18 nt, Chlamydia trachomatis
agaagccuugagccuuca

SEQ ID NO: 2496436 - RNA, 17 nt, Chlamydia trachomatis
agaagcgaagcauucuc

SEQ ID NO: 2496437 - RNA, 18 nt, Chlamydia trachomatis
agaagcgaagcauucucu

SEQ ID NO: 2496438 - RNA, 19 nt, Chlamydia trachomatis
agaagcugagcuucucgcu

SEQ ID NO: 2496439 - RNA, 13 nt, Chlamydia trachomatis
agaagcugcaguu

SEQ ID NO: 2496440 - RNA, 11 nt, Chlamydia trachomatis
agaaggaucua

SEQ ID NO: 2496441 - RNA, 15 nt, Chlamydia trachomatis
agaagguaacaaugc

SEQ ID NO: 2496442 - RNA, 22 nt, Chlamydia trachomatis
agaagguauuuuagagaaaaga

SEQ ID NO: 2496443 - RNA, 17 nt, Chlamydia trachomatis
agaaggucugaacaacu

SEQ ID NO: 2496444 - RNA, 17 nt, Chlamydia trachomatis
agaagguugaauuucag

SEQ ID NO: 2496445 - RNA, 19 nt, Chlamydia trachomatis
agaagguugugaagaacug

SEQ ID NO: 2496446 - RNA, 15 nt, Chlamydia trachomatis
agaaguaaaacagaa

SEQ ID NO: 2496447 - RNA, 17 nt, Chlamydia trachomatis
agaaguaacaccucuuc

SEQ ID NO: 2496448 - RNA, 19 nt, Chlamydia trachomatis
agaaguaacaccucuucug

SEQ ID NO: 2496449 - RNA, 17 nt, Chlamydia trachomatis
agaaguaaugaagguuu

SEQ ID NO: 2496450 - RNA, 15 nt, Chlamydia trachomatis
agaaguagucuacuc

SEQ ID NO: 2496451 - RNA, 19 nt, Chlamydia trachomatis
agaaguaucuaacaauacu

SEQ ID NO: 2496452 - RNA, 16 nt, Chlamydia trachomatis
agaaguccuucuccac

SEQ ID NO: 2496453 - RNA, 15 nt, Chlamydia trachomatis
agaagucgugucuuu

SEQ ID NO: 2496454 - RNA, 16 nt, Chlamydia trachomatis
agaaguuuaaaagccc

SEQ ID NO: 2496455 - RNA, 12 nt, Chlamydia trachomatis
agaaguuuuaac

SEQ ID NO: 2496456 - RNA, 14 nt, Chlamydia trachomatis
agaauaaacaacau

SEQ ID NO: 2496457 - RNA, 15 nt, Chlamydia trachomatis
agaauaaacaacaug

SEQ ID NO: 2496458 - RNA, 14 nt, Chlamydia trachomatis
agaauaaauauagg

SEQ ID NO: 2496459 - RNA, 12 nt, Chlamydia trachomatis
agaauaacuccc

SEQ ID NO: 2496460 - RNA, 20 nt, Chlamydia trachomatis
agaauaagguauccaacaau

SEQ ID NO: 2496461 - RNA, 21 nt, Chlamydia trachomatis
agaauaagguauccaacaaua

SEQ ID NO: 2496462 - RNA, 22 nt, Chlamydia trachomatis
agaauaagguauccaacaauau

SEQ ID NO: 2496463 - RNA, 15 nt, Chlamydia trachomatis
agaauaauagagaca

SEQ ID NO: 2496464 - RNA, 19 nt, Chlamydia trachomatis
agaauaaucgagugaucua

SEQ ID NO: 2496465 - RNA, 16 nt, Chlamydia trachomatis
agaauacaaagcagcc

SEQ ID NO: 2496466 - RNA, 12 nt, Chlamydia trachomatis
agaauacaagaa

SEQ ID NO: 2496467 - RNA, 15 nt, Chlamydia trachomatis
agaauacaagaaagg

SEQ ID NO: 2496468 - RNA, 17 nt, Chlamydia trachomatis
agaauaccaaaauccuu

SEQ ID NO: 2496469 - RNA, 12 nt, Chlamydia trachomatis
agaauaccaacu

SEQ ID NO: 2496470 - RNA, 23 nt, Chlamydia trachomatis
agaauagcgacacgacuuagcac

SEQ ID NO: 2496471 - RNA, 23 nt, Chlamydia trachomatis
agaauagcgcguacccgauucca

SEQ ID NO: 2496472 - RNA, 19 nt, Chlamydia trachomatis
agaauagggagguuuuguu

SEQ ID NO: 2496473 - RNA, 15 nt, Chlamydia trachomatis
agaauauaagcaccc

SEQ ID NO: 2496474 - RNA, 13 nt, Chlamydia trachomatis
agaaucaaaaagu

SEQ ID NO: 2496475 - RNA, 15 nt, Chlamydia trachomatis
agaaucaaaaaguuc

SEQ ID NO: 2496476 - RNA, 14 nt, Chlamydia trachomatis
agaaucuaaaaagc

SEQ ID NO: 2496477 - RNA, 16 nt, Chlamydia trachomatis
agaaucuaaaaagcca

SEQ ID NO: 2496478 - RNA, 22 nt, Chlamydia trachomatis
agaaucuaaaaagccauacaaa

SEQ ID NO: 2496479 - RNA, 23 nt, Chlamydia trachomatis
agaaucuaccacggauaaagaaa

SEQ ID NO: 2496480 - RNA, 19 nt, Chlamydia trachomatis
agaaucuccuguacaccac

SEQ ID NO: 2496481 - RNA, 21 nt, Chlamydia trachomatis
agaaucucugggguagcugau

SEQ ID NO: 2496482 - RNA, 11 nt, Chlamydia trachomatis
agaaucugcuc

SEQ ID NO: 2496483 - RNA, 15 nt, Chlamydia trachomatis
agaaucuguuuugau

SEQ ID NO: 2496484 - RNA, 17 nt, Chlamydia trachomatis
agaaucuguuuugauua

SEQ ID NO: 2496485 - RNA, 18 nt, Chlamydia trachomatis
agaaucuguuuugauuac

SEQ ID NO: 2496486 - RNA, 22 nt, Chlamydia trachomatis
agaaugaucacuugaaucacac

SEQ ID NO: 2496487 - RNA, 14 nt, Chlamydia trachomatis
agaauggaucuccc

SEQ ID NO: 2496488 - RNA, 17 nt, Chlamydia trachomatis
agaauggccuguuucau

SEQ ID NO: 2496489 - RNA, 20 nt, Chlamydia trachomatis
agaaugguccaugauuucuu

SEQ ID NO: 2496490 - RNA, 22 nt, Chlamydia trachomatis
agaaugguccaugauuucuuua

SEQ ID NO: 2496491 - RNA, 22 nt, Chlamydia trachomatis
agaauguggguguagguuuugu

SEQ ID NO: 2496492 - RNA, 23 nt, Chlamydia trachomatis
agaauuauuugccucuauguucu

SEQ ID NO: 2496493 - RNA, 22 nt, Chlamydia trachomatis
agaauugacgaaucgcaccauu

SEQ ID NO: 2496494 - RNA, 17 nt, Chlamydia trachomatis
agaauugccgaaucaaa

SEQ ID NO: 2496495 - RNA, 21 nt, Chlamydia trachomatis
agaauugccgaaucaaagacu

SEQ ID NO: 2496496 - RNA, 12 nt, Chlamydia trachomatis
agaauuucccua

SEQ ID NO: 2496497 - RNA, 16 nt, Chlamydia trachomatis
agaauuuuccguaaaa

SEQ ID NO: 2496498 - RNA, 17 nt, Chlamydia trachomatis
agaauuuuucuaaaauc

SEQ ID NO: 2496499 - RNA, 20 nt, Chlamydia trachomatis
agaauuuuucuaaaaucugc

SEQ ID NO: 2496500 - RNA, 13 nt, Chlamydia trachomatis
agacaaaaaaugc

SEQ ID NO: 2496501 - RNA, 16 nt, Chlamydia trachomatis
agacaaaaagaaagcc

SEQ ID NO: 2496502 - RNA, 13 nt, Chlamydia trachomatis
agacaaaacaagc

SEQ ID NO: 2496503 - RNA, 19 nt, Chlamydia trachomatis
agacaaauugcacuaaaga

SEQ ID NO: 2496504 - RNA, 16 nt, Chlamydia trachomatis
agacaagcacguggcc

SEQ ID NO: 2496505 - RNA, 20 nt, Chlamydia trachomatis
agacaauggucuccuaaauc

SEQ ID NO: 2496506 - RNA, 15 nt, Chlamydia trachomatis
agacaauucagaaau

SEQ ID NO: 2496507 - RNA, 17 nt, Chlamydia trachomatis
agacaauucagaaauau

SEQ ID NO: 2496508 - RNA, 21 nt, Chlamydia trachomatis
agacaauucagaaauaugaca

SEQ ID NO: 2496509 - RNA, 17 nt, Chlamydia trachomatis
agacacuauuaaaaagg

SEQ ID NO: 2496510 - RNA, 22 nt, Chlamydia trachomatis
agacacuauuaaaaaggcuaga

SEQ ID NO: 2496511 - RNA, 13 nt, Chlamydia trachomatis
agacagaacaaac

SEQ ID NO: 2496512 - RNA, 18 nt, Chlamydia trachomatis
agacagagaauagcugcc

SEQ ID NO: 2496513 - RNA, 16 nt, Chlamydia trachomatis
agacauaaaagcugua

SEQ ID NO: 2496514 - RNA, 21 nt, Chlamydia trachomatis
agacauagcuuguuccguugu

SEQ ID NO: 2496515 - RNA, 19 nt, Chlamydia trachomatis
agacaucgcuguauuuccu

SEQ ID NO: 2496516 - RNA, 12 nt, Chlamydia trachomatis
agacaucuauug

SEQ ID NO: 2496517 - RNA, 13 nt, Chlamydia trachomatis
agaccaggauucc

SEQ ID NO: 2496518 - RNA, 17 nt, Chlamydia trachomatis
agaccauaguugcaggc

SEQ ID NO: 2496519 - RNA, 15 nt, Chlamydia trachomatis
agacccagcucauua

SEQ ID NO: 2496520 - RNA, 23 nt, Chlamydia trachomatis
agacccaguaguuuacugggccu

SEQ ID NO: 2496521 - RNA, 23 nt, Chlamydia trachomatis
agacccguuuucucuugaaaaaa

SEQ ID NO: 2496522 - RNA, 13 nt, Chlamydia trachomatis
agacccugcauua

SEQ ID NO: 2496523 - RNA, 19 nt, Chlamydia trachomatis
agaccgaaauuaguaauaa

SEQ ID NO: 2496524 - RNA, 17 nt, Chlamydia trachomatis
agaccgagauuaucauu

SEQ ID NO: 2496525 - RNA, 12 nt, Chlamydia trachomatis
agaccuaaucca

SEQ ID NO: 2496526 - RNA, 14 nt, Chlamydia trachomatis
agaccuacaaagau

SEQ ID NO: 2496527 - RNA, 21 nt, Chlamydia trachomatis
agaccugcuucagcagcauaa

SEQ ID NO: 2496528 - RNA, 24 nt, Chlamydia trachomatis
agacgcaucacggcuucugucccu

SEQ ID NO: 2496529 - RNA, 21 nt, Chlamydia trachomatis
agacgcaugcuucuuuaagac

SEQ ID NO: 2496530 - RNA, 18 nt, Chlamydia trachomatis
agacgcccuccuccucgc

SEQ ID NO: 2496531 - RNA, 16 nt, Chlamydia trachomatis
agacuauuucuucuag

SEQ ID NO: 2496532 - RNA, 17 nt, Chlamydia trachomatis
agacuauuucuucuaga

SEQ ID NO: 2496533 - RNA, 23 nt, Chlamydia trachomatis
agacuauuucuucuagauagaga

SEQ ID NO: 2496534 - RNA, 17 nt, Chlamydia trachomatis
agacucaaagcuucccu

SEQ ID NO: 2496535 - RNA, 21 nt, Chlamydia trachomatis
agacucaaauuuucaugaaaa

SEQ ID NO: 2496536 - RNA, 15 nt, Chlamydia trachomatis
agacucaaucaccac

SEQ ID NO: 2496537 - RNA, 15 nt, Chlamydia trachomatis
agacucacagcaaau

SEQ ID NO: 2496538 - RNA, 23 nt, Chlamydia trachomatis
agacucacagcaaauaaagaggu

SEQ ID NO: 2496539 - RNA, 22 nt, Chlamydia trachomatis
agacucagguuauccaaauaaa

SEQ ID NO: 2496540 - RNA, 13 nt, Chlamydia trachomatis
agacuccagcuuc

SEQ ID NO: 2496541 - RNA, 20 nt, Chlamydia trachomatis
agacuccagcuucuccaucu

SEQ ID NO: 2496542 - RNA, 16 nt, Chlamydia trachomatis
agacucggaaucucug

SEQ ID NO: 2496543 - RNA, 22 nt, Chlamydia trachomatis
agacucuuucaauagcauuucu

SEQ ID NO: 2496544 - RNA, 22 nt, Chlamydia trachomatis
agacucuuuguugggcaaucaa

SEQ ID NO: 2496545 - RNA, 23 nt, Chlamydia trachomatis
agacucuuuguugggcaaucaag

SEQ ID NO: 2496546 - RNA, 17 nt, Chlamydia trachomatis
agacuguggcaaggcuu

SEQ ID NO: 2496547 - RNA, 17 nt, Chlamydia trachomatis
agacuguuugcguagga

SEQ ID NO: 2496548 - RNA, 14 nt, Chlamydia trachomatis
agacuuacucucua

SEQ ID NO: 2496549 - RNA, 15 nt, Chlamydia trachomatis
agacuuguucugcug

SEQ ID NO: 2496550 - RNA, 22 nt, Chlamydia trachomatis
agacuuuguuuauuaucuagaa

SEQ ID NO: 2496551 - RNA, 19 nt, Chlamydia trachomatis
agagaaaaauugcaaagag

SEQ ID NO: 2496552 - RNA, 14 nt, Chlamydia trachomatis
agagaaaagaaaag

SEQ ID NO: 2496553 - RNA, 13 nt, Chlamydia trachomatis
agagaaaagagga

SEQ ID NO: 2496554 - RNA, 11 nt, Chlamydia trachomatis
agagaaaaggc

SEQ ID NO: 2496555 - RNA, 14 nt, Chlamydia trachomatis
agagaaacaaccau

SEQ ID NO: 2496556 - RNA, 17 nt, Chlamydia trachomatis
agagaaaccaacgagug

SEQ ID NO: 2496557 - RNA, 17 nt, Chlamydia trachomatis
agagaaaucagaugcca

SEQ ID NO: 2496558 - RNA, 12 nt, Chlamydia trachomatis
agagaaccaaac

SEQ ID NO: 2496559 - RNA, 14 nt, Chlamydia trachomatis
agagaacccuaaua

SEQ ID NO: 2496560 - RNA, 22 nt, Chlamydia trachomatis
agagaauaaucgagugaucuac

SEQ ID NO: 2496561 - RNA, 15 nt, Chlamydia trachomatis
agagaccugcuucag

SEQ ID NO: 2496562 - RNA, 18 nt, Chlamydia trachomatis
agagacgcaugcuucuuu

SEQ ID NO: 2496563 - RNA, 22 nt, Chlamydia trachomatis
agagacgcaugcuucuuuaaga

SEQ ID NO: 2496564 - RNA, 13 nt, Chlamydia trachomatis
agagagacucuuu

SEQ ID NO: 2496565 - RNA, 19 nt, Chlamydia trachomatis
agagagauugauaggguug

SEQ ID NO: 2496566 - RNA, 12 nt, Chlamydia trachomatis
agagagcccuuu

SEQ ID NO: 2496567 - RNA, 13 nt, Chlamydia trachomatis
agagagccuugag

SEQ ID NO: 2496568 - RNA, 19 nt, Chlamydia trachomatis
agagagccuugagugaaaa

SEQ ID NO: 2496569 - RNA, 21 nt, Chlamydia trachomatis
agagagcgguugcacaaaucc

SEQ ID NO: 2496570 - RNA, 21 nt, Chlamydia trachomatis
agagaggccuccauuuccaug

SEQ ID NO: 2496571 - RNA, 19 nt, Chlamydia trachomatis
agagaggcugcauuacucg

SEQ ID NO: 2496572 - RNA, 16 nt, Chlamydia trachomatis
agagaggcuguaacua

SEQ ID NO: 2496573 - RNA, 14 nt, Chlamydia trachomatis
agagaggcuugaga

SEQ ID NO: 2496574 - RNA, 18 nt, Chlamydia trachomatis
agagauaucccuaaagag

SEQ ID NO: 2496575 - RNA, 13 nt, Chlamydia trachomatis
agagaucauacca

SEQ ID NO: 2496576 - RNA, 13 nt, Chlamydia trachomatis
agagaucccaggg

SEQ ID NO: 2496577 - RNA, 13 nt, Chlamydia trachomatis
agagaucccgaau

SEQ ID NO: 2496578 - RNA, 18 nt, Chlamydia trachomatis
agagaucuaugaaaaaag

SEQ ID NO: 2496579 - RNA, 13 nt, Chlamydia trachomatis
agagaucucucca

SEQ ID NO: 2496580 - RNA, 15 nt, Chlamydia trachomatis
agagaucuucugaaa

SEQ ID NO: 2496581 - RNA, 18 nt, Chlamydia trachomatis
agagaucuucugaaaaau

SEQ ID NO: 2496582 - RNA, 15 nt, Chlamydia trachomatis
agagauucuuugacg

SEQ ID NO: 2496583 - RNA, 18 nt, Chlamydia trachomatis
agagauuuccucuucuag

SEQ ID NO: 2496584 - RNA, 19 nt, Chlamydia trachomatis
agagcacaaaucuuucuuu

SEQ ID NO: 2496585 - RNA, 14 nt, Chlamydia trachomatis
agagcaguuguuuu

SEQ ID NO: 2496586 - RNA, 23 nt, Chlamydia trachomatis
agagcauccauauauucagaaga

SEQ ID NO: 2496587 - RNA, 13 nt, Chlamydia trachomatis
agagccaauccau

SEQ ID NO: 2496588 - RNA, 12 nt, Chlamydia trachomatis
agagccagcgag

SEQ ID NO: 2496589 - RNA, 18 nt, Chlamydia trachomatis
agagccaugaucaaagaa

SEQ ID NO: 2496590 - RNA, 23 nt, Chlamydia trachomatis
agagccccaccagagauaaagcu

SEQ ID NO: 2496591 - RNA, 16 nt, Chlamydia trachomatis
agagcccuaauaaaag

SEQ ID NO: 2496592 - RNA, 21 nt, Chlamydia trachomatis
agagcccuaauaaaagggcuc

SEQ ID NO: 2496593 - RNA, 23 nt, Chlamydia trachomatis
agagccguuuucagguugagcaa

SEQ ID NO: 2496594 - RNA, 21 nt, Chlamydia trachomatis
agagccuaugcgugucacaga

SEQ ID NO: 2496595 - RNA, 12 nt, Chlamydia trachomatis
agagccuugagu

SEQ ID NO: 2496596 - RNA, 18 nt, Chlamydia trachomatis
agagcgguugcacaaauc

SEQ ID NO: 2496597 - RNA, 20 nt, Chlamydia trachomatis
agagcgguugcacaaaucca

SEQ ID NO: 2496598 - RNA, 20 nt, Chlamydia trachomatis
agagcuguuguuaauaucag

SEQ ID NO: 2496599 - RNA, 16 nt, Chlamydia trachomatis
agagcuuccacagcag

SEQ ID NO: 2496600 - RNA, 18 nt, Chlamydia trachomatis
agagcuuccacagcagug

SEQ ID NO: 2496601 - RNA, 19 nt, Chlamydia trachomatis
agagcuuccacagcaguga

SEQ ID NO: 2496602 - RNA, 13 nt, Chlamydia trachomatis
agagcuucucuaa

SEQ ID NO: 2496603 - RNA, 14 nt, Chlamydia trachomatis
agagcuucuucuaa

SEQ ID NO: 2496604 - RNA, 19 nt, Chlamydia trachomatis
agagcuucuuuuucaagag

SEQ ID NO: 2496605 - RNA, 22 nt, Chlamydia trachomatis
agagcuuugaucuuuguucucu

SEQ ID NO: 2496606 - RNA, 21 nt, Chlamydia trachomatis
agagcuuuucuucccugagaa

SEQ ID NO: 2496607 - RNA, 21 nt, Chlamydia trachomatis
agagcuuuuuuuuucagcaau

SEQ ID NO: 2496608 - RNA, 23 nt, Chlamydia trachomatis
agagcuuuuuuuuucagcaauaa

SEQ ID NO: 2496609 - RNA, 17 nt, Chlamydia trachomatis
agaggagaacaagauaa

SEQ ID NO: 2496610 - RNA, 23 nt, Chlamydia trachomatis
agaggagaaggucgucagugcag

SEQ ID NO: 2496611 - RNA, 13 nt, Chlamydia trachomatis
agaggagaggcua

SEQ ID NO: 2496612 - RNA, 18 nt, Chlamydia trachomatis
agaggagauauucagguc

SEQ ID NO: 2496613 - RNA, 10 nt, Chlamydia trachomatis
agaggauaga

SEQ ID NO: 2496614 - RNA, 20 nt, Chlamydia trachomatis
agaggauuauuccgagagaa

SEQ ID NO: 2496615 - RNA, 16 nt, Chlamydia trachomatis
agaggccuccauuucc

SEQ ID NO: 2496616 - RNA, 15 nt, Chlamydia trachomatis
agaggcgaaaguuuc

SEQ ID NO: 2496617 - RNA, 19 nt, Chlamydia trachomatis
agaggcgaaaguuuccuua

SEQ ID NO: 2496618 - RNA, 12 nt, Chlamydia trachomatis
agaggguuucuu

SEQ ID NO: 2496619 - RNA, 21 nt, Chlamydia trachomatis
agaggguuucuucuuuugaga

SEQ ID NO: 2496620 - RNA, 21 nt, Chlamydia trachomatis
agagguaaucguauaaguuuu

SEQ ID NO: 2496621 - RNA, 21 nt, Chlamydia trachomatis
agagguagccaaagaauuuuu

SEQ ID NO: 2496622 - RNA, 18 nt, Chlamydia trachomatis
agagguauguuuggauug

SEQ ID NO: 2496623 - RNA, 13 nt, Chlamydia trachomatis
agaggucuuauua

SEQ ID NO: 2496624 - RNA, 19 nt, Chlamydia trachomatis
agaggucuuauuaaaagac

SEQ ID NO: 2496625 - RNA, 17 nt, Chlamydia trachomatis
agaggugugauaggaga

SEQ ID NO: 2496626 - RNA, 18 nt, Chlamydia trachomatis
agaggugugauaggagag

SEQ ID NO: 2496627 - RNA, 23 nt, Chlamydia trachomatis
agagguucuauaccuaaaaguuu

SEQ ID NO: 2496628 - RNA, 22 nt, Chlamydia trachomatis
agaguaaucggauagagaagaa

SEQ ID NO: 2496629 - RNA, 13 nt, Chlamydia trachomatis
agaguaucuuuga

SEQ ID NO: 2496630 - RNA, 15 nt, Chlamydia trachomatis
agaguaucuuugaua

SEQ ID NO: 2496631 - RNA, 20 nt, Chlamydia trachomatis
agagucuccgcuuaaaacua

SEQ ID NO: 2496632 - RNA, 21 nt, Chlamydia trachomatis
agagucucgaaggaauaccca

SEQ ID NO: 2496633 - RNA, 18 nt, Chlamydia trachomatis
agagucucuaaaaucgug

SEQ ID NO: 2496634 - RNA, 14 nt, Chlamydia trachomatis
agaguuaggcugcu

SEQ ID NO: 2496635 - RNA, 21 nt, Chlamydia trachomatis
agaguuccuaaauaccucuuu

SEQ ID NO: 2496636 - RNA, 18 nt, Chlamydia trachomatis
agaguucguuaggauucg

SEQ ID NO: 2496637 - RNA, 16 nt, Chlamydia trachomatis
agaguugcaaguuggu

SEQ ID NO: 2496638 - RNA, 22 nt, Chlamydia trachomatis
agaguuucuuuguucacagaaa

SEQ ID NO: 2496639 - RNA, 23 nt, Chlamydia trachomatis
agaguuucuuuguucacagaaag

SEQ ID NO: 2496640 - RNA, 20 nt, Chlamydia trachomatis
agauaaaacuaccugauaga

SEQ ID NO: 2496641 - RNA, 13 nt, Chlamydia trachomatis
agauaaaagaagc

SEQ ID NO: 2496642 - RNA, 14 nt, Chlamydia trachomatis
agauaacaauccua

SEQ ID NO: 2496643 - RNA, 19 nt, Chlamydia trachomatis
agauaaucaaaccuaagua

SEQ ID NO: 2496644 - RNA, 19 nt, Chlamydia trachomatis
agauaauucucgcaaagaa

SEQ ID NO: 2496645 - RNA, 22 nt, Chlamydia trachomatis
agauacaacuuggaccauaaaa

SEQ ID NO: 2496646 - RNA, 23 nt, Chlamydia trachomatis
agauacagaaucuguuuugauua

SEQ ID NO: 2496647 - RNA, 14 nt, Chlamydia trachomatis
agauagaucuaaag

SEQ ID NO: 2496648 - RNA, 18 nt, Chlamydia trachomatis
agauagcuucuuaaauau

SEQ ID NO: 2496649 - RNA, 20 nt, Chlamydia trachomatis
agauagcuucuuaaauauau

SEQ ID NO: 2496650 - RNA, 22 nt, Chlamydia trachomatis
agauaggaacuacauucgccuc

SEQ ID NO: 2496651 - RNA, 14 nt, Chlamydia trachomatis
agauagucuucuac

SEQ ID NO: 2496652 - RNA, 12 nt, Chlamydia trachomatis
agauauaaacaa

SEQ ID NO: 2496653 - RNA, 18 nt, Chlamydia trachomatis
agauauaaacaauaagaa

SEQ ID NO: 2496654 - RNA, 23 nt, Chlamydia trachomatis
agauauagccacgauaagaucuu

SEQ ID NO: 2496655 - RNA, 20 nt, Chlamydia trachomatis
agauauagguuccaucuaaa

SEQ ID NO: 2496656 - RNA, 14 nt, Chlamydia trachomatis
agauauccauagcc

SEQ ID NO: 2496657 - RNA, 23 nt, Chlamydia trachomatis
agauaucuuuacucuuuucuuua

SEQ ID NO: 2496658 - RNA, 13 nt, Chlamydia trachomatis
agauauucccuaa

SEQ ID NO: 2496659 - RNA, 14 nt, Chlamydia trachomatis
agaucaagaaaaga

SEQ ID NO: 2496660 - RNA, 18 nt, Chlamydia trachomatis
agaucaagaaaagauagu

SEQ ID NO: 2496661 - RNA, 16 nt, Chlamydia trachomatis
agaucauaaagucuac

SEQ ID NO: 2496662 - RNA, 22 nt, Chlamydia trachomatis
agaucauaaagucuaccaguuc

SEQ ID NO: 2496663 - RNA, 22 nt, Chlamydia trachomatis
agaucaugggaaauaaauaagu

SEQ ID NO: 2496664 - RNA, 23 nt, Chlamydia trachomatis
agauccauuugauaguuuuguaa

SEQ ID NO: 2496665 - RNA, 13 nt, Chlamydia trachomatis
agaucccaaaaga

SEQ ID NO: 2496666 - RNA, 19 nt, Chlamydia trachomatis
agaucccagggagagagag

SEQ ID NO: 2496667 - RNA, 17 nt, Chlamydia trachomatis
agaucccugucauacca

SEQ ID NO: 2496668 - RNA, 19 nt, Chlamydia trachomatis
agauccgauaucagcaaaa

SEQ ID NO: 2496669 - RNA, 15 nt, Chlamydia trachomatis
agauccuuaaacucu

SEQ ID NO: 2496670 - RNA, 23 nt, Chlamydia trachomatis
agauccuucgcaggggaauacag

SEQ ID NO: 2496671 - RNA, 14 nt, Chlamydia trachomatis
agaucgaauaguag

SEQ ID NO: 2496672 - RNA, 18 nt, Chlamydia trachomatis
agaucgguugcauccaau

SEQ ID NO: 2496673 - RNA, 16 nt, Chlamydia trachomatis
agaucuaaagcagaaa

SEQ ID NO: 2496674 - RNA, 20 nt, Chlamydia trachomatis
agaucuaaagcagaaacaau

SEQ ID NO: 2496675 - RNA, 22 nt, Chlamydia trachomatis
agaucuaaggaauguggagcua

SEQ ID NO: 2496676 - RNA, 21 nt, Chlamydia trachomatis
agaucuaggaucccaaggaaa

SEQ ID NO: 2496677 - RNA, 15 nt, Chlamydia trachomatis
agaucuaugaaaaaa

SEQ ID NO: 2496678 - RNA, 16 nt, Chlamydia trachomatis
agaucuaugaaaaaag

SEQ ID NO: 2496679 - RNA, 14 nt, Chlamydia trachomatis
agaucuccuucuca

SEQ ID NO: 2496680 - RNA, 21 nt, Chlamydia trachomatis
agaucucuuucucuagaauuu

SEQ ID NO: 2496681 - RNA, 18 nt, Chlamydia trachomatis
agaucugcauuccaggac

SEQ ID NO: 2496682 - RNA, 20 nt, Chlamydia trachomatis
agaucuguaacuacaucuaa

SEQ ID NO: 2496683 - RNA, 13 nt, Chlamydia trachomatis
agaucuucaacaa

SEQ ID NO: 2496684 - RNA, 17 nt, Chlamydia trachomatis
agaucuucaacaagauu

SEQ ID NO: 2496685 - RNA, 20 nt, Chlamydia trachomatis
agaucuucagaaaucuucuu

SEQ ID NO: 2496686 - RNA, 21 nt, Chlamydia trachomatis
agaucuugaucugaaaagaga

SEQ ID NO: 2496687 - RNA, 16 nt, Chlamydia trachomatis
agaucuuuacuuucuu

SEQ ID NO: 2496688 - RNA, 17 nt, Chlamydia trachomatis
agaucuuuacuuucuuu

SEQ ID NO: 2496689 - RNA, 15 nt, Chlamydia trachomatis
agaucuuucuacauu

SEQ ID NO: 2496690 - RNA, 21 nt, Chlamydia trachomatis
agaucuuucuacauuuugcug

SEQ ID NO: 2496691 - RNA, 14 nt, Chlamydia trachomatis
agaucuuuugaaga

SEQ ID NO: 2496692 - RNA, 16 nt, Chlamydia trachomatis
agaucuuuuucauuuu

SEQ ID NO: 2496693 - RNA, 18 nt, Chlamydia trachomatis
agaucuuuuucauuuuau

SEQ ID NO: 2496694 - RNA, 15 nt, Chlamydia trachomatis
agaugaauugaauac

SEQ ID NO: 2496695 - RNA, 16 nt, Chlamydia trachomatis
agaugaccacuacucu

SEQ ID NO: 2496696 - RNA, 13 nt, Chlamydia trachomatis
agaugaucccauc

SEQ ID NO: 2496697 - RNA, 20 nt, Chlamydia trachomatis
agaugauugaaguucuuuuu

SEQ ID NO: 2496698 - RNA, 19 nt, Chlamydia trachomatis
agaugcuccucucuuuggu

SEQ ID NO: 2496699 - RNA, 13 nt, Chlamydia trachomatis
agauggagaggag

SEQ ID NO: 2496700 - RNA, 15 nt, Chlamydia trachomatis
agauggagaggagua

SEQ ID NO: 2496701 - RNA, 20 nt, Chlamydia trachomatis
agauguaggauucagagagg

SEQ ID NO: 2496702 - RNA, 23 nt, Chlamydia trachomatis
agauguuguuaaagcuuuuucca

SEQ ID NO: 2496703 - RNA, 17 nt, Chlamydia trachomatis
agauguuuguguuucua

SEQ ID NO: 2496704 - RNA, 19 nt, Chlamydia trachomatis
agauguuuguguuucuaaa

SEQ ID NO: 2496705 - RNA, 17 nt, Chlamydia trachomatis
agauuaagauuauaauu

SEQ ID NO: 2496706 - RNA, 20 nt, Chlamydia trachomatis
agauucacgaguuuuaggau

SEQ ID NO: 2496707 - RNA, 19 nt, Chlamydia trachomatis
agauuccacaacggcccuu

SEQ ID NO: 2496708 - RNA, 14 nt, Chlamydia trachomatis
agauucgaauaauc

SEQ ID NO: 2496709 - RNA, 15 nt, Chlamydia trachomatis
agauucgcugcuguc

SEQ ID NO: 2496710 - RNA, 17 nt, Chlamydia trachomatis
agauucgcugcugucuu

SEQ ID NO: 2496711 - RNA, 15 nt, Chlamydia trachomatis
agauugcaacucuug

SEQ ID NO: 2496712 - RNA, 15 nt, Chlamydia trachomatis
agauugccuuuucua

SEQ ID NO: 2496713 - RNA, 22 nt, Chlamydia trachomatis
agauugccuuuucuauuuagag

SEQ ID NO: 2496714 - RNA, 17 nt, Chlamydia trachomatis
agauuuagagaauaauc

SEQ ID NO: 2496715 - RNA, 15 nt, Chlamydia trachomatis
agauuuaucugcuau

SEQ ID NO: 2496716 - RNA, 23 nt, Chlamydia trachomatis
agauuuaucugcuauagaaagca

SEQ ID NO: 2496717 - RNA, 21 nt, Chlamydia trachomatis
agauuucgauuugaugagagc

SEQ ID NO: 2496718 - RNA, 22 nt, Chlamydia trachomatis
agauuucuucuguagccccagu

SEQ ID NO: 2496719 - RNA, 12 nt, Chlamydia trachomatis
agauuucuucuu

SEQ ID NO: 2496720 - RNA, 14 nt, Chlamydia trachomatis
agauuugcaaauuc

SEQ ID NO: 2496721 - RNA, 14 nt, Chlamydia trachomatis
agauuugccuccag

SEQ ID NO: 2496722 - RNA, 19 nt, Chlamydia trachomatis
agauuuguuuaaaagaagc

SEQ ID NO: 2496723 - RNA, 18 nt, Chlamydia trachomatis
agauuuuaugacccagaa

SEQ ID NO: 2496724 - RNA, 20 nt, Chlamydia trachomatis
agauuuuaugacccagaauc

SEQ ID NO: 2496725 - RNA, 18 nt, Chlamydia trachomatis
agauuuucaugcaaguaa

SEQ ID NO: 2496726 - RNA, 15 nt, Chlamydia trachomatis
agauuuuuagaagga

SEQ ID NO: 2496727 - RNA, 17 nt, Chlamydia trachomatis
agauuuuucaaaaauag

SEQ ID NO: 2496728 - RNA, 12 nt, Chlamydia trachomatis
agauuuuucagc

SEQ ID NO: 2496729 - RNA, 17 nt, Chlamydia trachomatis
agauuuuuuaauaauaa

SEQ ID NO: 2496730 - RNA, 18 nt, Chlamydia trachomatis
agauuuuuugagcaaaau

SEQ ID NO: 2496731 - RNA, 15 nt, Chlamydia trachomatis
agcaaaaaaaucgau

SEQ ID NO: 2496732 - RNA, 15 nt, Chlamydia trachomatis
agcaaaaacugucug

SEQ ID NO: 2496733 - RNA, 20 nt, Chlamydia trachomatis
agcaaaacauccaugucuaa

SEQ ID NO: 2496734 - RNA, 23 nt, Chlamydia trachomatis
agcaaaaccuuuuacaguuccgc

SEQ ID NO: 2496735 - RNA, 14 nt, Chlamydia trachomatis
agcaaaagaaaaau

SEQ ID NO: 2496736 - RNA, 19 nt, Chlamydia trachomatis
agcaaaagaaaaaucuccu

SEQ ID NO: 2496737 - RNA, 23 nt, Chlamydia trachomatis
agcaaaagaagaaucuucuucga

SEQ ID NO: 2496738 - RNA, 14 nt, Chlamydia trachomatis
agcaaauaaagagg

SEQ ID NO: 2496739 - RNA, 15 nt, Chlamydia trachomatis
agcaaauaauagcuu

SEQ ID NO: 2496740 - RNA, 17 nt, Chlamydia trachomatis
agcaaauagaauaaaag

SEQ ID NO: 2496741 - RNA, 15 nt, Chlamydia trachomatis
agcaaauagauaacu

SEQ ID NO: 2496742 - RNA, 22 nt, Chlamydia trachomatis
agcaaauagauaacuuugaaca

SEQ ID NO: 2496743 - RNA, 20 nt, Chlamydia trachomatis
agcaaauccuacacaagcuu

SEQ ID NO: 2496744 - RNA, 20 nt, Chlamydia trachomatis
agcaaaucuggcugaagaag

SEQ ID NO: 2496745 - RNA, 17 nt, Chlamydia trachomatis
agcaacaauauccucca

SEQ ID NO: 2496746 - RNA, 13 nt, Chlamydia trachomatis
agcaacauucacg

SEQ ID NO: 2496747 - RNA, 23 nt, Chlamydia trachomatis
agcaacauucacgugcgacugcc

SEQ ID NO: 2496748 - RNA, 22 nt, Chlamydia trachomatis
agcaacgacaaacgggagccca

SEQ ID NO: 2496749 - RNA, 16 nt, Chlamydia trachomatis
agcaacgauaaacaga

SEQ ID NO: 2496750 - RNA, 18 nt, Chlamydia trachomatis
agcaacucuuucauaaaa

SEQ ID NO: 2496751 - RNA, 18 nt, Chlamydia trachomatis
agcaacugcuuucuuugu

SEQ ID NO: 2496752 - RNA, 19 nt, Chlamydia trachomatis
agcaacuucuggcaguaac

SEQ ID NO: 2496753 - RNA, 12 nt, Chlamydia trachomatis
agcaagaacaga

SEQ ID NO: 2496754 - RNA, 14 nt, Chlamydia trachomatis
agcaagaagcuauc

SEQ ID NO: 2496755 - RNA, 14 nt, Chlamydia trachomatis
agcaagagagauug

SEQ ID NO: 2496756 - RNA, 12 nt, Chlamydia trachomatis
agcaagcucaac

SEQ ID NO: 2496757 - RNA, 20 nt, Chlamydia trachomatis
agcaagcugaggaagcauuu

SEQ ID NO: 2496758 - RNA, 18 nt, Chlamydia trachomatis
agcaagcuugucuccuuc

SEQ ID NO: 2496759 - RNA, 17 nt, Chlamydia trachomatis
agcaaguaaaauuacaa

SEQ ID NO: 2496760 - RNA, 17 nt, Chlamydia trachomatis
agcaauaauuuccccua

SEQ ID NO: 2496761 - RNA, 21 nt, Chlamydia trachomatis
agcaauaccgaaucuaauaug

SEQ ID NO: 2496762 - RNA, 23 nt, Chlamydia trachomatis
agcaauagccauuaacaacaaug

SEQ ID NO: 2496763 - RNA, 19 nt, Chlamydia trachomatis
agcaauagcgcaaaaggcu

SEQ ID NO: 2496764 - RNA, 14 nt, Chlamydia trachomatis
agcaaucacuaaaa

SEQ ID NO: 2496765 - RNA, 20 nt, Chlamydia trachomatis
agcaaugcgaucagaaacgu

SEQ ID NO: 2496766 - RNA, 15 nt, Chlamydia trachomatis
agcaauguuccuugu

SEQ ID NO: 2496767 - RNA, 13 nt, Chlamydia trachomatis
agcacacuugaua

SEQ ID NO: 2496768 - RNA, 20 nt, Chlamydia trachomatis
agcacacuugauaaauagca

SEQ ID NO: 2496769 - RNA, 18 nt, Chlamydia trachomatis
agcacagcggacaauagg

SEQ ID NO: 2496770 - RNA, 19 nt, Chlamydia trachomatis
agcacauuacuguacuccu

SEQ ID NO: 2496771 - RNA, 21 nt, Chlamydia trachomatis
agcacccuuuuuauaaucucc

SEQ ID NO: 2496772 - RNA, 12 nt, Chlamydia trachomatis
agcacgauaaaa

SEQ ID NO: 2496773 - RNA, 13 nt, Chlamydia trachomatis
agcacguacaaua

SEQ ID NO: 2496774 - RNA, 15 nt, Chlamydia trachomatis
agcacuacagaucau

SEQ ID NO: 2496775 - RNA, 14 nt, Chlamydia trachomatis
agcacuauaucucc

SEQ ID NO: 2496776 - RNA, 15 nt, Chlamydia trachomatis
agcacuauaucucca

SEQ ID NO: 2496777 - RNA, 16 nt, Chlamydia trachomatis
agcacucucaacgaaa

SEQ ID NO: 2496778 - RNA, 16 nt, Chlamydia trachomatis
agcacuucuucuuugg

SEQ ID NO: 2496779 - RNA, 21 nt, Chlamydia trachomatis
agcacuugaucuaucuuucuu

SEQ ID NO: 2496780 - RNA, 18 nt, Chlamydia trachomatis
agcagaacucaacgaaag

SEQ ID NO: 2496781 - RNA, 14 nt, Chlamydia trachomatis
agcagacuuuguuu

SEQ ID NO: 2496782 - RNA, 21 nt, Chlamydia trachomatis
agcagacuuuguuuauuaucu

SEQ ID NO: 2496783 - RNA, 22 nt, Chlamydia trachomatis
agcagagauaugaguggcaagg

SEQ ID NO: 2496784 - RNA, 16 nt, Chlamydia trachomatis
agcagagcuuuuacuu

SEQ ID NO: 2496785 - RNA, 23 nt, Chlamydia trachomatis
agcagauaauucucgcaaagaau

SEQ ID NO: 2496786 - RNA, 19 nt, Chlamydia trachomatis
agcagauauggaagaacag

SEQ ID NO: 2496787 - RNA, 23 nt, Chlamydia trachomatis
agcagauauggaagaacagcagc

SEQ ID NO: 2496788 - RNA, 15 nt, Chlamydia trachomatis
agcagaucauccaua

SEQ ID NO: 2496789 - RNA, 12 nt, Chlamydia trachomatis
agcagcaaagau

SEQ ID NO: 2496790 - RNA, 14 nt, Chlamydia trachomatis
agcagcaguuuuua

SEQ ID NO: 2496791 - RNA, 21 nt, Chlamydia trachomatis
agcagcauucguguguaggaa

SEQ ID NO: 2496792 - RNA, 23 nt, Chlamydia trachomatis
agcagccccccuuuuuuuauucu

SEQ ID NO: 2496793 - RNA, 19 nt, Chlamydia trachomatis
agcagcuaauuccauaauc

SEQ ID NO: 2496794 - RNA, 16 nt, Chlamydia trachomatis
agcagcucuuacuccu

SEQ ID NO: 2496795 - RNA, 14 nt, Chlamydia trachomatis
agcaggccucuguu

SEQ ID NO: 2496796 - RNA, 15 nt, Chlamydia trachomatis
agcaggccucuguuu

SEQ ID NO: 2496797 - RNA, 13 nt, Chlamydia trachomatis
agcaggcgaacag

SEQ ID NO: 2496798 - RNA, 17 nt, Chlamydia trachomatis
agcaggcgaacagugac

SEQ ID NO: 2496799 - RNA, 18 nt, Chlamydia trachomatis
agcaggcgaacagugaca

SEQ ID NO: 2496800 - RNA, 18 nt, Chlamydia trachomatis
agcaguagcuacuucagg

SEQ ID NO: 2496801 - RNA, 13 nt, Chlamydia trachomatis
agcagucuagagg

SEQ ID NO: 2496802 - RNA, 15 nt, Chlamydia trachomatis
agcagugaagaauga

SEQ ID NO: 2496803 - RNA, 15 nt, Chlamydia trachomatis
agcaguuguuuucuu

SEQ ID NO: 2496804 - RNA, 20 nt, Chlamydia trachomatis
agcauaauauccccauccug

SEQ ID NO: 2496805 - RNA, 19 nt, Chlamydia trachomatis
agcauaauuccuaggaaug

SEQ ID NO: 2496806 - RNA, 18 nt, Chlamydia trachomatis
agcauacguuagcaaaga

SEQ ID NO: 2496807 - RNA, 20 nt, Chlamydia trachomatis
agcauacguuagcaaagaca

SEQ ID NO: 2496808 - RNA, 12 nt, Chlamydia trachomatis
agcauagccuug

SEQ ID NO: 2496809 - RNA, 16 nt, Chlamydia trachomatis
agcauaucuccuaaaa

SEQ ID NO: 2496810 - RNA, 13 nt, Chlamydia trachomatis
agcaucaguaaaa

SEQ ID NO: 2496811 - RNA, 15 nt, Chlamydia trachomatis
agcauccauauauuc

SEQ ID NO: 2496812 - RNA, 23 nt, Chlamydia trachomatis
agcauccauauauucagaagaag

SEQ ID NO: 2496813 - RNA, 13 nt, Chlamydia trachomatis
agcauccugaacc

SEQ ID NO: 2496814 - RNA, 16 nt, Chlamydia trachomatis
agcaucuacugaugcu

SEQ ID NO: 2496815 - RNA, 19 nt, Chlamydia trachomatis
agcaucuauuuucucuuua

SEQ ID NO: 2496816 - RNA, 18 nt, Chlamydia trachomatis
agcaucuggaguggcauc

SEQ ID NO: 2496817 - RNA, 12 nt, Chlamydia trachomatis
agcaucuucaca

SEQ ID NO: 2496818 - RNA, 22 nt, Chlamydia trachomatis
agcaucuucacaguucguugua

SEQ ID NO: 2496819 - RNA, 21 nt, Chlamydia trachomatis
agcaucuucucgaaagagaac

SEQ ID NO: 2496820 - RNA, 17 nt, Chlamydia trachomatis
agcaucuuuaccauuuc

SEQ ID NO: 2496821 - RNA, 12 nt, Chlamydia trachomatis
agcaucuuuucu

SEQ ID NO: 2496822 - RNA, 23 nt, Chlamydia trachomatis
agcaugaucaugcagaugaagaa

SEQ ID NO: 2496823 - RNA, 14 nt, Chlamydia trachomatis
agcaugcaaaacag

SEQ ID NO: 2496824 - RNA, 17 nt, Chlamydia trachomatis
agcaugccgcacauccg

SEQ ID NO: 2496825 - RNA, 14 nt, Chlamydia trachomatis
agcaugccuucuuc

SEQ ID NO: 2496826 - RNA, 18 nt, Chlamydia trachomatis
agcauguagccaaggaag

SEQ ID NO: 2496827 - RNA, 19 nt, Chlamydia trachomatis
agcauguagccaaggaaga

SEQ ID NO: 2496828 - RNA, 16 nt, Chlamydia trachomatis
agcauguguuucugga

SEQ ID NO: 2496829 - RNA, 17 nt, Chlamydia trachomatis
agcauguguuucuggaa

SEQ ID NO: 2496830 - RNA, 18 nt, Chlamydia trachomatis
agcauuacacaacucuuu

SEQ ID NO: 2496831 - RNA, 13 nt, Chlamydia trachomatis
agcauuaccauau

SEQ ID NO: 2496832 - RNA, 22 nt, Chlamydia trachomatis
agcauuaccauaucaaaaauag

SEQ ID NO: 2496833 - RNA, 18 nt, Chlamydia trachomatis
agcauucaucuauuuuua

SEQ ID NO: 2496834 - RNA, 15 nt, Chlamydia trachomatis
agcauucguuaucaa

SEQ ID NO: 2496835 - RNA, 18 nt, Chlamydia trachomatis
agcauucuucugaacaac

SEQ ID NO: 2496836 - RNA, 19 nt, Chlamydia trachomatis
agcauugaacaccauaucc

SEQ ID NO: 2496837 - RNA, 21 nt, Chlamydia trachomatis
agcauugaacaccauauccuu

SEQ ID NO: 2496838 - RNA, 19 nt, Chlamydia trachomatis
agcauuuuccaagaaaaau

SEQ ID NO: 2496839 - RNA, 19 nt, Chlamydia trachomatis
agccaaaauauacucagag

SEQ ID NO: 2496840 - RNA, 15 nt, Chlamydia trachomatis
agccaagaacaaagc

SEQ ID NO: 2496841 - RNA, 19 nt, Chlamydia trachomatis
agccaagaacaaagcaucu

SEQ ID NO: 2496842 - RNA, 20 nt, Chlamydia trachomatis
agccaagcugaggcucuuca

SEQ ID NO: 2496843 - RNA, 13 nt, Chlamydia trachomatis
agccaauguucua

SEQ ID NO: 2496844 - RNA, 15 nt, Chlamydia trachomatis
agccacaaccacugu

SEQ ID NO: 2496845 - RNA, 19 nt, Chlamydia trachomatis
agccagcgaggcuucaaua

SEQ ID NO: 2496846 - RNA, 17 nt, Chlamydia trachomatis
agccauaauaaaaggcu

SEQ ID NO: 2496847 - RNA, 14 nt, Chlamydia trachomatis
agccauacaaagau

SEQ ID NO: 2496848 - RNA, 17 nt, Chlamydia trachomatis
agccauaucaggaccua

SEQ ID NO: 2496849 - RNA, 17 nt, Chlamydia trachomatis
agccaugaucaaagaaa

SEQ ID NO: 2496850 - RNA, 23 nt, Chlamydia trachomatis
agccauuuccagccucuccagaa

SEQ ID NO: 2496851 - RNA, 13 nt, Chlamydia trachomatis
agccauuuuguaa

SEQ ID NO: 2496852 - RNA, 14 nt, Chlamydia trachomatis
agcccaagcuuuca

SEQ ID NO: 2496853 - RNA, 19 nt, Chlamydia trachomatis
agcccagaacaacuucucu

SEQ ID NO: 2496854 - RNA, 20 nt, Chlamydia trachomatis
agcccagaacaacuucucuu

SEQ ID NO: 2496855 - RNA, 22 nt, Chlamydia trachomatis
agcccaugguauagaagaccuu

SEQ ID NO: 2496856 - RNA, 18 nt, Chlamydia trachomatis
agccccaaaaacagcaga

SEQ ID NO: 2496857 - RNA, 15 nt, Chlamydia trachomatis
agccccaccagagau

SEQ ID NO: 2496858 - RNA, 16 nt, Chlamydia trachomatis
agccccgaaacccaac

SEQ ID NO: 2496859 - RNA, 12 nt, Chlamydia trachomatis
agccccuccgcu

SEQ ID NO: 2496860 - RNA, 19 nt, Chlamydia trachomatis
agcccugcuucacagcuaa

SEQ ID NO: 2496861 - RNA, 14 nt, Chlamydia trachomatis
agccguucccaaua

SEQ ID NO: 2496862 - RNA, 18 nt, Chlamydia trachomatis
agccguuuucagguugag

SEQ ID NO: 2496863 - RNA, 21 nt, Chlamydia trachomatis
agccuaaauagcucaguuggu

SEQ ID NO: 2496864 - RNA, 16 nt, Chlamydia trachomatis
agccuaucgcacacaa

SEQ ID NO: 2496865 - RNA, 16 nt, Chlamydia trachomatis
agccuccaaacauuuu

SEQ ID NO: 2496866 - RNA, 17 nt, Chlamydia trachomatis
agccuccgcuaauuuuu

SEQ ID NO: 2496867 - RNA, 19 nt, Chlamydia trachomatis
agccuccgguuuccaaaua

SEQ ID NO: 2496868 - RNA, 13 nt, Chlamydia trachomatis
agccuccucuaca

SEQ ID NO: 2496869 - RNA, 23 nt, Chlamydia trachomatis
agccuccucuacaccauaaaacu

SEQ ID NO: 2496870 - RNA, 16 nt, Chlamydia trachomatis
agccucuaacucuucu

SEQ ID NO: 2496871 - RNA, 16 nt, Chlamydia trachomatis
agccugaauuugcucu

SEQ ID NO: 2496872 - RNA, 14 nt, Chlamydia trachomatis
agccugcuuucuuc

SEQ ID NO: 2496873 - RNA, 17 nt, Chlamydia trachomatis
agccugcuuucuucugc

SEQ ID NO: 2496874 - RNA, 16 nt, Chlamydia trachomatis
agccuggcugcagaag

SEQ ID NO: 2496875 - RNA, 17 nt, Chlamydia trachomatis
agccuggcugcagaaga

SEQ ID NO: 2496876 - RNA, 19 nt, Chlamydia trachomatis
agccuggcugcagaagacu

SEQ ID NO: 2496877 - RNA, 19 nt, Chlamydia trachomatis
agccuucaauucuugcuuc

SEQ ID NO: 2496878 - RNA, 22 nt, Chlamydia trachomatis
agccuucucuuuucacaaagag

SEQ ID NO: 2496879 - RNA, 20 nt, Chlamydia trachomatis
agccuucuuucaaaagaagg

SEQ ID NO: 2496880 - RNA, 17 nt, Chlamydia trachomatis
agccuuggauuucuucu

SEQ ID NO: 2496881 - RNA, 17 nt, Chlamydia trachomatis
agccuuggguucuucug

SEQ ID NO: 2496882 - RNA, 20 nt, Chlamydia trachomatis
agccuuggguucuucugagc

SEQ ID NO: 2496883 - RNA, 22 nt, Chlamydia trachomatis
agccuuuagauaguuacuucca

SEQ ID NO: 2496884 - RNA, 21 nt, Chlamydia trachomatis
agccuuucucuaaaagaagag

SEQ ID NO: 2496885 - RNA, 20 nt, Chlamydia trachomatis
agccuuugcuaucagcauac

SEQ ID NO: 2496886 - RNA, 14 nt, Chlamydia trachomatis
agccuuuuauucuu

SEQ ID NO: 2496887 - RNA, 19 nt, Chlamydia trachomatis
agccuuuuguuuucuugau

SEQ ID NO: 2496888 - RNA, 15 nt, Chlamydia trachomatis
agcgaaaaaaaaaga

SEQ ID NO: 2496889 - RNA, 14 nt, Chlamydia trachomatis
agcgaaaaaucaca

SEQ ID NO: 2496890 - RNA, 19 nt, Chlamydia trachomatis
agcgaacgcuuccugaacg

SEQ ID NO: 2496891 - RNA, 22 nt, Chlamydia trachomatis
agcgaagucuucuaucacagcu

SEQ ID NO: 2496892 - RNA, 19 nt, Chlamydia trachomatis
agcgacugcugcagaaauc

SEQ ID NO: 2496893 - RNA, 15 nt, Chlamydia trachomatis
agcgaguaagccgga

SEQ ID NO: 2496894 - RNA, 14 nt, Chlamydia trachomatis
agcgaguuugugga

SEQ ID NO: 2496895 - RNA, 19 nt, Chlamydia trachomatis
agcgauagaauuucuuccu

SEQ ID NO: 2496896 - RNA, 12 nt, Chlamydia trachomatis
agcgaucucccg

SEQ ID NO: 2496897 - RNA, 15 nt, Chlamydia trachomatis
agcgaucuuugaaca

SEQ ID NO: 2496898 - RNA, 16 nt, Chlamydia trachomatis
agcgauuaugaaaaag

SEQ ID NO: 2496899 - RNA, 23 nt, Chlamydia trachomatis
agcgauucgcgcauaugcagaag

SEQ ID NO: 2496900 - RNA, 13 nt, Chlamydia trachomatis
agcgcaaagcgga

SEQ ID NO: 2496901 - RNA, 14 nt, Chlamydia trachomatis
agcgcaaccccgca

SEQ ID NO: 2496902 - RNA, 13 nt, Chlamydia trachomatis
agcgcauaaguaa

SEQ ID NO: 2496903 - RNA, 16 nt, Chlamydia trachomatis
agcgcuccuagugaua

SEQ ID NO: 2496904 - RNA, 20 nt, Chlamydia trachomatis
agcgcuccuagugauaaaca

SEQ ID NO: 2496905 - RNA, 23 nt, Chlamydia trachomatis
agcgcuuccauuucgaguuuuuu

SEQ ID NO: 2496906 - RNA, 22 nt, Chlamydia trachomatis
agcgcuuguaugguuuguccuu

SEQ ID NO: 2496907 - RNA, 23 nt, Chlamydia trachomatis
agcgcuuuuuuuuuagaacagau

SEQ ID NO: 2496908 - RNA, 14 nt, Chlamydia trachomatis
agcggacauuucac

SEQ ID NO: 2496909 - RNA, 18 nt, Chlamydia trachomatis
agcggaguguuuucuguu

SEQ ID NO: 2496910 - RNA, 14 nt, Chlamydia trachomatis
agcgggagaaggau

SEQ ID NO: 2496911 - RNA, 20 nt, Chlamydia trachomatis
agcgggagagagccuugagu

SEQ ID NO: 2496912 - RNA, 14 nt, Chlamydia trachomatis
agcgggcgguaaaa

SEQ ID NO: 2496913 - RNA, 17 nt, Chlamydia trachomatis
agcgggcgguaaaaggu

SEQ ID NO: 2496914 - RNA, 15 nt, Chlamydia trachomatis
agcguaaaagagauu

SEQ ID NO: 2496915 - RNA, 22 nt, Chlamydia trachomatis
agcguauauaucuuaauugaaa

SEQ ID NO: 2496916 - RNA, 23 nt, Chlamydia trachomatis
agcgucaucuuugagaagcaucu

SEQ ID NO: 2496917 - RNA, 19 nt, Chlamydia trachomatis
agcgucuccaaaaguguuu

SEQ ID NO: 2496918 - RNA, 18 nt, Chlamydia trachomatis
agcgucuuuucacaaggu

SEQ ID NO: 2496919 - RNA, 19 nt, Chlamydia trachomatis
agcgugcauggcagaugca

SEQ ID NO: 2496920 - RNA, 22 nt, Chlamydia trachomatis
agcgugugaccaucuucaccaa

SEQ ID NO: 2496921 - RNA, 18 nt, Chlamydia trachomatis
agcguucgcgucuagcuu

SEQ ID NO: 2496922 - RNA, 19 nt, Chlamydia trachomatis
agcguucgcgucuagcuuu

SEQ ID NO: 2496923 - RNA, 12 nt, Chlamydia trachomatis
agcguucugaga

SEQ ID NO: 2496924 - RNA, 17 nt, Chlamydia trachomatis
agcuaaacuucuuguua

SEQ ID NO: 2496925 - RNA, 18 nt, Chlamydia trachomatis
agcuaaagcagaaacagc

SEQ ID NO: 2496926 - RNA, 21 nt, Chlamydia trachomatis
agcuaacagcucuucuucuga

SEQ ID NO: 2496927 - RNA, 22 nt, Chlamydia trachomatis
agcuaacagcucuucuucugaa

SEQ ID NO: 2496928 - RNA, 22 nt, Chlamydia trachomatis
agcuaagaaaauaaacacaagu

SEQ ID NO: 2496929 - RNA, 14 nt, Chlamydia trachomatis
agcuaauaucucag

SEQ ID NO: 2496930 - RNA, 13 nt, Chlamydia trachomatis
agcuaaucuuuuu

SEQ ID NO: 2496931 - RNA, 21 nt, Chlamydia trachomatis
agcuaauuccauaaucgugga

SEQ ID NO: 2496932 - RNA, 21 nt, Chlamydia trachomatis
agcuacagcaauagagauauc

SEQ ID NO: 2496933 - RNA, 18 nt, Chlamydia trachomatis
agcuagaaaauagcaucu

SEQ ID NO: 2496934 - RNA, 14 nt, Chlamydia trachomatis
agcuagaagaagag

SEQ ID NO: 2496935 - RNA, 12 nt, Chlamydia trachomatis
agcuagaagaau

SEQ ID NO: 2496936 - RNA, 14 nt, Chlamydia trachomatis
agcuagagcaugca

SEQ ID NO: 2496937 - RNA, 21 nt, Chlamydia trachomatis
agcuagguaaagguuucugga

SEQ ID NO: 2496938 - RNA, 19 nt, Chlamydia trachomatis
agcuaguucagacagagaa

SEQ ID NO: 2496939 - RNA, 21 nt, Chlamydia trachomatis
agcuaguucagacagagaaga

SEQ ID NO: 2496940 - RNA, 12 nt, Chlamydia trachomatis
agcuaucauuuc

SEQ ID NO: 2496941 - RNA, 22 nt, Chlamydia trachomatis
agcuaucauuuccaaaaucuuc

SEQ ID NO: 2496942 - RNA, 17 nt, Chlamydia trachomatis
agcuaugagaauuucca

SEQ ID NO: 2496943 - RNA, 21 nt, Chlamydia trachomatis
agcuauguaaaaaaucuuguc

SEQ ID NO: 2496944 - RNA, 21 nt, Chlamydia trachomatis
agcuauucccacuacauucuu

SEQ ID NO: 2496945 - RNA, 19 nt, Chlamydia trachomatis
agcucaacaaggauuuuuu

SEQ ID NO: 2496946 - RNA, 21 nt, Chlamydia trachomatis
agcucauuagaaugauugaua

SEQ ID NO: 2496947 - RNA, 22 nt, Chlamydia trachomatis
agcucauuuucuauuucagaca

SEQ ID NO: 2496948 - RNA, 22 nt, Chlamydia trachomatis
agcuccaaagaacagcgaagaa

SEQ ID NO: 2496949 - RNA, 21 nt, Chlamydia trachomatis
agcuccaggaaaagcuuuguu

SEQ ID NO: 2496950 - RNA, 18 nt, Chlamydia trachomatis
agcucccugcucuugaag

SEQ ID NO: 2496951 - RNA, 13 nt, Chlamydia trachomatis
agcuccucuucuu

SEQ ID NO: 2496952 - RNA, 16 nt, Chlamydia trachomatis
agcuccucuucuucug

SEQ ID NO: 2496953 - RNA, 20 nt, Chlamydia trachomatis
agcuccuuuaccuuucacua

SEQ ID NO: 2496954 - RNA, 19 nt, Chlamydia trachomatis
agcucgaauacgaggagcu

SEQ ID NO: 2496955 - RNA, 18 nt, Chlamydia trachomatis
agcucgagucucuugugg

SEQ ID NO: 2496956 - RNA, 20 nt, Chlamydia trachomatis
agcucggucacgaaguuuuu

SEQ ID NO: 2496957 - RNA, 17 nt, Chlamydia trachomatis
agcucggucucauuaua

SEQ ID NO: 2496958 - RNA, 18 nt, Chlamydia trachomatis
agcucgucuuuagaagaa

SEQ ID NO: 2496959 - RNA, 19 nt, Chlamydia trachomatis
agcucgucuuuagaagaaa

SEQ ID NO: 2496960 - RNA, 21 nt, Chlamydia trachomatis
agcucguuuagcagccugagg

SEQ ID NO: 2496961 - RNA, 16 nt, Chlamydia trachomatis
agcucuaacucuucuu

SEQ ID NO: 2496962 - RNA, 20 nt, Chlamydia trachomatis
agcucuccauuuaagacuac

SEQ ID NO: 2496963 - RNA, 20 nt, Chlamydia trachomatis
agcucugaguuaaaggaagg

SEQ ID NO: 2496964 - RNA, 19 nt, Chlamydia trachomatis
agcucugcccccuacagag

SEQ ID NO: 2496965 - RNA, 23 nt, Chlamydia trachomatis
agcucuguucaauuguuggacaa

SEQ ID NO: 2496966 - RNA, 22 nt, Chlamydia trachomatis
agcucuuacuccuaaaguaaga

SEQ ID NO: 2496967 - RNA, 20 nt, Chlamydia trachomatis
agcucuugucgauaaaguaa

SEQ ID NO: 2496968 - RNA, 20 nt, Chlamydia trachomatis
agcucuuuccucuagcagag

SEQ ID NO: 2496969 - RNA, 23 nt, Chlamydia trachomatis
agcucuuugauaugcagcaucca

SEQ ID NO: 2496970 - RNA, 14 nt, Chlamydia trachomatis
agcugacaaagcuu

SEQ ID NO: 2496971 - RNA, 23 nt, Chlamydia trachomatis
agcugagcuucucgcuacaaauc

SEQ ID NO: 2496972 - RNA, 22 nt, Chlamydia trachomatis
agcugaggcucuucaguacuua

SEQ ID NO: 2496973 - RNA, 18 nt, Chlamydia trachomatis
agcugagucuugugcucu

SEQ ID NO: 2496974 - RNA, 14 nt, Chlamydia trachomatis
agcugauaaggagg

SEQ ID NO: 2496975 - RNA, 15 nt, Chlamydia trachomatis
agcugauauaaguau

SEQ ID NO: 2496976 - RNA, 21 nt, Chlamydia trachomatis
agcugauguaagcgagauaag

SEQ ID NO: 2496977 - RNA, 23 nt, Chlamydia trachomatis
agcugauguaagcgagauaagga

SEQ ID NO: 2496978 - RNA, 20 nt, Chlamydia trachomatis
agcugccagugcucaaagau

SEQ ID NO: 2496979 - RNA, 14 nt, Chlamydia trachomatis
agcugcuuggaaua

SEQ ID NO: 2496980 - RNA, 15 nt, Chlamydia trachomatis
agcugcuuuauccaa

SEQ ID NO: 2496981 - RNA, 23 nt, Chlamydia trachomatis
agcugcuuuauccaaagauagau

SEQ ID NO: 2496982 - RNA, 22 nt, Chlamydia trachomatis
agcugguaauuggcggagaagc

SEQ ID NO: 2496983 - RNA, 20 nt, Chlamydia trachomatis
agcugguuuuuuuugaaaag

SEQ ID NO: 2496984 - RNA, 22 nt, Chlamydia trachomatis
agcugguuuuuuuugaaaaggg

SEQ ID NO: 2496985 - RNA, 13 nt, Chlamydia trachomatis
agcuguaugccaa

SEQ ID NO: 2496986 - RNA, 14 nt, Chlamydia trachomatis
agcugucagaucau

SEQ ID NO: 2496987 - RNA, 20 nt, Chlamydia trachomatis
agcuguuaugaaccagggag

SEQ ID NO: 2496988 - RNA, 21 nt, Chlamydia trachomatis
agcuguuaugaaccagggaga

SEQ ID NO: 2496989 - RNA, 14 nt, Chlamydia trachomatis
agcuguucuuccau

SEQ ID NO: 2496990 - RNA, 22 nt, Chlamydia trachomatis
agcuguuguuaauaucagcaga

SEQ ID NO: 2496991 - RNA, 18 nt, Chlamydia trachomatis
agcuguuucauucacuuu

SEQ ID NO: 2496992 - RNA, 22 nt, Chlamydia trachomatis
agcuguuuuugcaacaaagcuu

SEQ ID NO: 2496993 - RNA, 13 nt, Chlamydia trachomatis
agcuuagauauac

SEQ ID NO: 2496994 - RNA, 15 nt, Chlamydia trachomatis
agcuuagccacugca

SEQ ID NO: 2496995 - RNA, 16 nt, Chlamydia trachomatis
agcuuagcucccugcu

SEQ ID NO: 2496996 - RNA, 15 nt, Chlamydia trachomatis
agcuuauaacuaaga

SEQ ID NO: 2496997 - RNA, 21 nt, Chlamydia trachomatis
agcuuauaacuaagaucucca

SEQ ID NO: 2496998 - RNA, 14 nt, Chlamydia trachomatis
agcuucaucauuga

SEQ ID NO: 2496999 - RNA, 15 nt, Chlamydia trachomatis
agcuuccacagcagu

SEQ ID NO: 2497000 - RNA, 16 nt, Chlamydia trachomatis
agcuuccuguuuauca

SEQ ID NO: 2497001 - RNA, 20 nt, Chlamydia trachomatis
agcuucguagagcaagauac

SEQ ID NO: 2497002 - RNA, 21 nt, Chlamydia trachomatis
agcuucuaacgcuuccucucc

SEQ ID NO: 2497003 - RNA, 21 nt, Chlamydia trachomatis
agcuucuaauuucuuucucau

SEQ ID NO: 2497004 - RNA, 19 nt, Chlamydia trachomatis
agcuucuagaaauucuuca

SEQ ID NO: 2497005 - RNA, 15 nt, Chlamydia trachomatis
agcuucuccaucuga

SEQ ID NO: 2497006 - RNA, 16 nt, Chlamydia trachomatis
agcuucuccaucugac

SEQ ID NO: 2497007 - RNA, 23 nt, Chlamydia trachomatis
agcuucuccaucugacuuuuuag

SEQ ID NO: 2497008 - RNA, 23 nt, Chlamydia trachomatis
agcuucucuucacuuugauaaua

SEQ ID NO: 2497009 - RNA, 17 nt, Chlamydia trachomatis
agcuucugccauuucua

SEQ ID NO: 2497010 - RNA, 18 nt, Chlamydia trachomatis
agcuucugguguaggaaa

SEQ ID NO: 2497011 - RNA, 22 nt, Chlamydia trachomatis
agcuucuuguagauagacuacg

SEQ ID NO: 2497012 - RNA, 14 nt, Chlamydia trachomatis
agcuucuuuaggau

SEQ ID NO: 2497013 - RNA, 17 nt, Chlamydia trachomatis
agcuucuuuuucaagag

SEQ ID NO: 2497014 - RNA, 20 nt, Chlamydia trachomatis
agcuugagagcauucuucug

SEQ ID NO: 2497015 - RNA, 18 nt, Chlamydia trachomatis
agcuugaucaaagaaucu

SEQ ID NO: 2497016 - RNA, 16 nt, Chlamydia trachomatis
agcuugucuccuucuu

SEQ ID NO: 2497017 - RNA, 19 nt, Chlamydia trachomatis
agcuugucuccuucuuuga

SEQ ID NO: 2497018 - RNA, 14 nt, Chlamydia trachomatis
agcuuguucuucga

SEQ ID NO: 2497019 - RNA, 13 nt, Chlamydia trachomatis
agcuuuagaaaua

SEQ ID NO: 2497020 - RNA, 21 nt, Chlamydia trachomatis
agcuuuauugaacccauagau

SEQ ID NO: 2497021 - RNA, 14 nt, Chlamydia trachomatis
agcuuucacaggga

SEQ ID NO: 2497022 - RNA, 16 nt, Chlamydia trachomatis
agcuuucacagggaca

SEQ ID NO: 2497023 - RNA, 16 nt, Chlamydia trachomatis
agcuuugcacaccugc

SEQ ID NO: 2497024 - RNA, 22 nt, Chlamydia trachomatis
agcuuuguuaaucgauucuugg

SEQ ID NO: 2497025 - RNA, 22 nt, Chlamydia trachomatis
agcuuuuacuuccguuucuuag

SEQ ID NO: 2497026 - RNA, 14 nt, Chlamydia trachomatis
agcuuuuccacauu

SEQ ID NO: 2497027 - RNA, 14 nt, Chlamydia trachomatis
agcuuuuccgcugc

SEQ ID NO: 2497028 - RNA, 19 nt, Chlamydia trachomatis
agcuuuucggugaggaagg

SEQ ID NO: 2497029 - RNA, 21 nt, Chlamydia trachomatis
agcuuuucuucccugagaaau

SEQ ID NO: 2497030 - RNA, 14 nt, Chlamydia trachomatis
agcuuuucuuuccu

SEQ ID NO: 2497031 - RNA, 17 nt, Chlamydia trachomatis
agcuuuuuccaaagcuu

SEQ ID NO: 2497032 - RNA, 16 nt, Chlamydia trachomatis
agcuuuuugcaaugca

SEQ ID NO: 2497033 - RNA, 13 nt, Chlamydia trachomatis
aggaaaagaugaa

SEQ ID NO: 2497034 - RNA, 13 nt, Chlamydia trachomatis
aggaaaagcuuug

SEQ ID NO: 2497035 - RNA, 23 nt, Chlamydia trachomatis
aggaaacacuguauugcucugca

SEQ ID NO: 2497036 - RNA, 11 nt, Chlamydia trachomatis
aggaaagccua

SEQ ID NO: 2497037 - RNA, 19 nt, Chlamydia trachomatis
aggaaauaccuuguuuuuu

SEQ ID NO: 2497038 - RNA, 20 nt, Chlamydia trachomatis
aggaaauaccuuguuuuuua

SEQ ID NO: 2497039 - RNA, 16 nt, Chlamydia trachomatis
aggaaaugaggacaga

SEQ ID NO: 2497040 - RNA, 23 nt, Chlamydia trachomatis
aggaacaucgagaaaaugaugaa

SEQ ID NO: 2497041 - RNA, 11 nt, Chlamydia trachomatis
aggaacauuug

SEQ ID NO: 2497042 - RNA, 19 nt, Chlamydia trachomatis
aggaacucccucauuaaga

SEQ ID NO: 2497043 - RNA, 16 nt, Chlamydia trachomatis
aggaacucuaaauacc

SEQ ID NO: 2497044 - RNA, 12 nt, Chlamydia trachomatis
aggaacuucuuc

SEQ ID NO: 2497045 - RNA, 17 nt, Chlamydia trachomatis
aggaacuucuucauccu

SEQ ID NO: 2497046 - RNA, 13 nt, Chlamydia trachomatis
aggaagaagaaga

SEQ ID NO: 2497047 - RNA, 16 nt, Chlamydia trachomatis
aggaagagagaacaaa

SEQ ID NO: 2497048 - RNA, 17 nt, Chlamydia trachomatis
aggaagauucacgggag

SEQ ID NO: 2497049 - RNA, 19 nt, Chlamydia trachomatis
aggaauaaacagguaaaaa

SEQ ID NO: 2497050 - RNA, 20 nt, Chlamydia trachomatis
aggaauaauuuuccacaaau

SEQ ID NO: 2497051 - RNA, 21 nt, Chlamydia trachomatis
aggaauacccagaaguaucua

SEQ ID NO: 2497052 - RNA, 17 nt, Chlamydia trachomatis
aggaauacgaaaugaca

SEQ ID NO: 2497053 - RNA, 19 nt, Chlamydia trachomatis
aggaauagcuacaccagau

SEQ ID NO: 2497054 - RNA, 14 nt, Chlamydia trachomatis
aggaauauuaagau

SEQ ID NO: 2497055 - RNA, 14 nt, Chlamydia trachomatis
aggaaucacaguaa

SEQ ID NO: 2497056 - RNA, 18 nt, Chlamydia trachomatis
aggaaucacaguaauacu

SEQ ID NO: 2497057 - RNA, 13 nt, Chlamydia trachomatis
aggaauccucuuc

SEQ ID NO: 2497058 - RNA, 14 nt, Chlamydia trachomatis
aggaauccucuucc

SEQ ID NO: 2497059 - RNA, 18 nt, Chlamydia trachomatis
aggaauccuuaaccguga

SEQ ID NO: 2497060 - RNA, 20 nt, Chlamydia trachomatis
aggaaucuguccaaagagau

SEQ ID NO: 2497061 - RNA, 23 nt, Chlamydia trachomatis
aggaaucuguccaaagagauugu

SEQ ID NO: 2497062 - RNA, 18 nt, Chlamydia trachomatis
aggaaugguuacuugccu

SEQ ID NO: 2497063 - RNA, 20 nt, Chlamydia trachomatis
aggaauguauaaacacugag

SEQ ID NO: 2497064 - RNA, 13 nt, Chlamydia trachomatis
aggaaugugaaga

SEQ ID NO: 2497065 - RNA, 17 nt, Chlamydia trachomatis
aggacagacaggaaagc

SEQ ID NO: 2497066 - RNA, 18 nt, Chlamydia trachomatis
aggaccuaauaucugcuc

SEQ ID NO: 2497067 - RNA, 13 nt, Chlamydia trachomatis
aggacucuaagag

SEQ ID NO: 2497068 - RNA, 12 nt, Chlamydia trachomatis
aggacugacaga

SEQ ID NO: 2497069 - RNA, 15 nt, Chlamydia trachomatis
aggacugacagaagu

SEQ ID NO: 2497070 - RNA, 20 nt, Chlamydia trachomatis
aggacugacagaaguuagaa

SEQ ID NO: 2497071 - RNA, 12 nt, Chlamydia trachomatis
aggagaaagaau

SEQ ID NO: 2497072 - RNA, 21 nt, Chlamydia trachomatis
aggagaaaggcuuugucuaua

SEQ ID NO: 2497073 - RNA, 20 nt, Chlamydia trachomatis
aggagaaggucgucagugca

SEQ ID NO: 2497074 - RNA, 16 nt, Chlamydia trachomatis
aggagagaaaagagga

SEQ ID NO: 2497075 - RNA, 17 nt, Chlamydia trachomatis
aggagagaaaagaggag

SEQ ID NO: 2497076 - RNA, 24 nt, Chlamydia trachomatis
aggagaugcuuguggugaagcgcu

SEQ ID NO: 2497077 - RNA, 13 nt, Chlamydia trachomatis
aggagcaagaaua

SEQ ID NO: 2497078 - RNA, 17 nt, Chlamydia trachomatis
aggagcauaaauaucuu

SEQ ID NO: 2497079 - RNA, 21 nt, Chlamydia trachomatis
aggagcccaagcuuucaucuc

SEQ ID NO: 2497080 - RNA, 20 nt, Chlamydia trachomatis
aggagcuugagagcauucuu

SEQ ID NO: 2497081 - RNA, 21 nt, Chlamydia trachomatis
aggagcuuugauuaaccaaaa

SEQ ID NO: 2497082 - RNA, 20 nt, Chlamydia trachomatis
aggaggucucacuuccuugg

SEQ ID NO: 2497083 - RNA, 13 nt, Chlamydia trachomatis
aggaguaaauccu

SEQ ID NO: 2497084 - RNA, 14 nt, Chlamydia trachomatis
aggaguaggaaggu

SEQ ID NO: 2497085 - RNA, 15 nt, Chlamydia trachomatis
aggaguaggaaggua

SEQ ID NO: 2497086 - RNA, 20 nt, Chlamydia trachomatis
aggagucggaccaugaauga

SEQ ID NO: 2497087 - RNA, 15 nt, Chlamydia trachomatis
aggagucucuaggua

SEQ ID NO: 2497088 - RNA, 16 nt, Chlamydia trachomatis
aggagucucugcaguc

SEQ ID NO: 2497089 - RNA, 15 nt, Chlamydia trachomatis
aggaguugguuuguu

SEQ ID NO: 2497090 - RNA, 21 nt, Chlamydia trachomatis
aggauaaaucaguggaacugc

SEQ ID NO: 2497091 - RNA, 14 nt, Chlamydia trachomatis
aggauaacaaacaa

SEQ ID NO: 2497092 - RNA, 12 nt, Chlamydia trachomatis
aggauaaggaag

SEQ ID NO: 2497093 - RNA, 17 nt, Chlamydia trachomatis
aggauaaggaagaagau

SEQ ID NO: 2497094 - RNA, 20 nt, Chlamydia trachomatis
aggauacgaaggaucuucca

SEQ ID NO: 2497095 - RNA, 15 nt, Chlamydia trachomatis
aggauagacuggcau

SEQ ID NO: 2497096 - RNA, 22 nt, Chlamydia trachomatis
aggauagagccccuauguaaac

SEQ ID NO: 2497097 - RNA, 18 nt, Chlamydia trachomatis
aggauagccaaagguugu

SEQ ID NO: 2497098 - RNA, 19 nt, Chlamydia trachomatis
aggauaguuacauacuuuu

SEQ ID NO: 2497099 - RNA, 18 nt, Chlamydia trachomatis
aggaucagagacuuguuu

SEQ ID NO: 2497100 - RNA, 15 nt, Chlamydia trachomatis
aggaucccaaggaaa

SEQ ID NO: 2497101 - RNA, 20 nt, Chlamydia trachomatis
aggauccccacgaccacaaa

SEQ ID NO: 2497102 - RNA, 22 nt, Chlamydia trachomatis
aggauccccacgaccacaaaca

SEQ ID NO: 2497103 - RNA, 21 nt, Chlamydia trachomatis
aggaucgcuaucaauaaaaac

SEQ ID NO: 2497104 - RNA, 17 nt, Chlamydia trachomatis
aggaucuaauucuagca

SEQ ID NO: 2497105 - RNA, 13 nt, Chlamydia trachomatis
aggaucuccagaa

SEQ ID NO: 2497106 - RNA, 15 nt, Chlamydia trachomatis
aggaucugagcagug

SEQ ID NO: 2497107 - RNA, 19 nt, Chlamydia trachomatis
aggaucugaugcaccauaa

SEQ ID NO: 2497108 - RNA, 14 nt, Chlamydia trachomatis
aggaucuuccagcc

SEQ ID NO: 2497109 - RNA, 14 nt, Chlamydia trachomatis
aggaugucuaucua

SEQ ID NO: 2497110 - RNA, 22 nt, Chlamydia trachomatis
aggauguggacgaacaaaaagu

SEQ ID NO: 2497111 - RNA, 21 nt, Chlamydia trachomatis
aggauguugcgaguuuugauu

SEQ ID NO: 2497112 - RNA, 14 nt, Chlamydia trachomatis
aggauguuucccuu

SEQ ID NO: 2497113 - RNA, 23 nt, Chlamydia trachomatis
aggauuacaaaucguaaguccuu

SEQ ID NO: 2497114 - RNA, 20 nt, Chlamydia trachomatis
aggauuacagcaagaagaag

SEQ ID NO: 2497115 - RNA, 21 nt, Chlamydia trachomatis
aggauuacagcaagaagaaga

SEQ ID NO: 2497116 - RNA, 17 nt, Chlamydia trachomatis
aggauucaaaauagcag

SEQ ID NO: 2497117 - RNA, 22 nt, Chlamydia trachomatis
aggauucauauuccaaagaaau

SEQ ID NO: 2497118 - RNA, 13 nt, Chlamydia trachomatis
aggauuccaaggg

SEQ ID NO: 2497119 - RNA, 17 nt, Chlamydia trachomatis
aggauuccaagggagau

SEQ ID NO: 2497120 - RNA, 21 nt, Chlamydia trachomatis
aggauuccccgauauaucugu

SEQ ID NO: 2497121 - RNA, 16 nt, Chlamydia trachomatis
aggauucgguaucuga

SEQ ID NO: 2497122 - RNA, 23 nt, Chlamydia trachomatis
aggauucguugcucccaucaacu

SEQ ID NO: 2497123 - RNA, 22 nt, Chlamydia trachomatis
aggauuggaaaauccaaaguac

SEQ ID NO: 2497124 - RNA, 19 nt, Chlamydia trachomatis
aggauugguguucuauaug

SEQ ID NO: 2497125 - RNA, 20 nt, Chlamydia trachomatis
aggauuuuuuucugcaaucu

SEQ ID NO: 2497126 - RNA, 15 nt, Chlamydia trachomatis
aggcaaaaaucugca

SEQ ID NO: 2497127 - RNA, 14 nt, Chlamydia trachomatis
aggcaacaaauaac

SEQ ID NO: 2497128 - RNA, 15 nt, Chlamydia trachomatis
aggcaacagcucugu

SEQ ID NO: 2497129 - RNA, 18 nt, Chlamydia trachomatis
aggcacaugggcauagaa

SEQ ID NO: 2497130 - RNA, 23 nt, Chlamydia trachomatis
aggcacucgagucaugcaaagga

SEQ ID NO: 2497131 - RNA, 21 nt, Chlamydia trachomatis
aggcagucucugaggcaaagc

SEQ ID NO: 2497132 - RNA, 15 nt, Chlamydia trachomatis
aggcauaaaagagaa

SEQ ID NO: 2497133 - RNA, 17 nt, Chlamydia trachomatis
aggcauaaaagagaaga

SEQ ID NO: 2497134 - RNA, 15 nt, Chlamydia trachomatis
aggcauaauuaugau

SEQ ID NO: 2497135 - RNA, 14 nt, Chlamydia trachomatis
aggcauacaggaga

SEQ ID NO: 2497136 - RNA, 14 nt, Chlamydia trachomatis
aggcauagccaucc

SEQ ID NO: 2497137 - RNA, 19 nt, Chlamydia trachomatis
aggcauuaaagggaaaaaa

SEQ ID NO: 2497138 - RNA, 21 nt, Chlamydia trachomatis
aggcauuccuuggcaaagagc

SEQ ID NO: 2497139 - RNA, 18 nt, Chlamydia trachomatis
aggcauuccuuucuucca

SEQ ID NO: 2497140 - RNA, 18 nt, Chlamydia trachomatis
aggccauuucaugacagc

SEQ ID NO: 2497141 - RNA, 15 nt, Chlamydia trachomatis
aggccuccauuucca

SEQ ID NO: 2497142 - RNA, 13 nt, Chlamydia trachomatis
aggccucccuauc

SEQ ID NO: 2497143 - RNA, 20 nt, Chlamydia trachomatis
aggcgacacgcuucuucaaa

SEQ ID NO: 2497144 - RNA, 16 nt, Chlamydia trachomatis
aggcgcccacagaaca

SEQ ID NO: 2497145 - RNA, 22 nt, Chlamydia trachomatis
aggcgcgcgcguaauuuucuag

SEQ ID NO: 2497146 - RNA, 17 nt, Chlamydia trachomatis
aggcguaaaccuucuug

SEQ ID NO: 2497147 - RNA, 20 nt, Chlamydia trachomatis
aggcguuccugcauacuuuu

SEQ ID NO: 2497148 - RNA, 13 nt, Chlamydia trachomatis
aggcuaacuccau

SEQ ID NO: 2497149 - RNA, 18 nt, Chlamydia trachomatis
aggcuaagaaagguuuuu

SEQ ID NO: 2497150 - RNA, 15 nt, Chlamydia trachomatis
aggcuacuaaagaca

SEQ ID NO: 2497151 - RNA, 21 nt, Chlamydia trachomatis
aggcuagagauaucacuacca

SEQ ID NO: 2497152 - RNA, 20 nt, Chlamydia trachomatis
aggcuauugauacugggagg

SEQ ID NO: 2497153 - RNA, 15 nt, Chlamydia trachomatis
aggcuccccagaaaa

SEQ ID NO: 2497154 - RNA, 16 nt, Chlamydia trachomatis
aggcuccgccuucugc

SEQ ID NO: 2497155 - RNA, 17 nt, Chlamydia trachomatis
aggcuccgccuucugca

SEQ ID NO: 2497156 - RNA, 22 nt, Chlamydia trachomatis
aggcuccguucaaagcaaacuu

SEQ ID NO: 2497157 - RNA, 19 nt, Chlamydia trachomatis
aggcuccugcaagggaaca

SEQ ID NO: 2497158 - RNA, 22 nt, Chlamydia trachomatis
aggcuccugcaagggaacaaac

SEQ ID NO: 2497159 - RNA, 22 nt, Chlamydia trachomatis
aggcucuuucagagaaaauuuc

SEQ ID NO: 2497160 - RNA, 21 nt, Chlamydia trachomatis
aggcugaggauuccaagggag

SEQ ID NO: 2497161 - RNA, 12 nt, Chlamydia trachomatis
aggcugcucccu

SEQ ID NO: 2497162 - RNA, 14 nt, Chlamydia trachomatis
aggcuguaacuaaa

SEQ ID NO: 2497163 - RNA, 14 nt, Chlamydia trachomatis
aggcuuacagagag

SEQ ID NO: 2497164 - RNA, 22 nt, Chlamydia trachomatis
aggcuuaugaacggcucuucuu

SEQ ID NO: 2497165 - RNA, 15 nt, Chlamydia trachomatis
aggcuucaaagaaca

SEQ ID NO: 2497166 - RNA, 22 nt, Chlamydia trachomatis
aggcuucaauaauguugaaguc

SEQ ID NO: 2497167 - RNA, 12 nt, Chlamydia trachomatis
aggcuuccaaau

SEQ ID NO: 2497168 - RNA, 15 nt, Chlamydia trachomatis
aggcuuccaaaucug

SEQ ID NO: 2497169 - RNA, 24 nt, Chlamydia trachomatis
aggcuucucuuuucgaacaaaacu

SEQ ID NO: 2497170 - RNA, 16 nt, Chlamydia trachomatis
aggcuucuucuucuuu

SEQ ID NO: 2497171 - RNA, 16 nt, Chlamydia trachomatis
aggcuugggugacugc

SEQ ID NO: 2497172 - RNA, 19 nt, Chlamydia trachomatis
aggcuuucaaaaagagcua

SEQ ID NO: 2497173 - RNA, 12 nt, Chlamydia trachomatis
aggcuuuuccau

SEQ ID NO: 2497174 - RNA, 14 nt, Chlamydia trachomatis
aggcuuuucuauuu

SEQ ID NO: 2497175 - RNA, 17 nt, Chlamydia trachomatis
aggcuuuucuauuuuua

SEQ ID NO: 2497176 - RNA, 14 nt, Chlamydia trachomatis
agggaaaacaccau

SEQ ID NO: 2497177 - RNA, 16 nt, Chlamydia trachomatis
agggaaacguaaaaga

SEQ ID NO: 2497178 - RNA, 15 nt, Chlamydia trachomatis
agggaacaaaccaau

SEQ ID NO: 2497179 - RNA, 22 nt, Chlamydia trachomatis
agggaacaaaccaauuaaguuc

SEQ ID NO: 2497180 - RNA, 13 nt, Chlamydia trachomatis
agggaauaaaaac

SEQ ID NO: 2497181 - RNA, 16 nt, Chlamydia trachomatis
agggaauaaaaguacu

SEQ ID NO: 2497182 - RNA, 17 nt, Chlamydia trachomatis
agggaaucauaaggaag

SEQ ID NO: 2497183 - RNA, 18 nt, Chlamydia trachomatis
agggaaucauaaggaaga

SEQ ID NO: 2497184 - RNA, 20 nt, Chlamydia trachomatis
agggaauguuucccuucuuu

SEQ ID NO: 2497185 - RNA, 19 nt, Chlamydia trachomatis
agggacaucgaaaaucacu

SEQ ID NO: 2497186 - RNA, 19 nt, Chlamydia trachomatis
agggacuucuucuagagau

SEQ ID NO: 2497187 - RNA, 16 nt, Chlamydia trachomatis
agggagaaggggaagg

SEQ ID NO: 2497188 - RNA, 17 nt, Chlamydia trachomatis
agggagaaggggaagga

SEQ ID NO: 2497189 - RNA, 21 nt, Chlamydia trachomatis
agggagaugaucgaguucuac

SEQ ID NO: 2497190 - RNA, 13 nt, Chlamydia trachomatis
agggagcaaagcu

SEQ ID NO: 2497191 - RNA, 19 nt, Chlamydia trachomatis
agggagguauuccuguaga

SEQ ID NO: 2497192 - RNA, 14 nt, Chlamydia trachomatis
agggauagaaacuc

SEQ ID NO: 2497193 - RNA, 20 nt, Chlamydia trachomatis
agggauagaaacuccguagu

SEQ ID NO: 2497194 - RNA, 16 nt, Chlamydia trachomatis
agggauauuucuuccu

SEQ ID NO: 2497195 - RNA, 17 nt, Chlamydia trachomatis
agggaugaagcuaaaaa

SEQ ID NO: 2497196 - RNA, 17 nt, Chlamydia trachomatis
agggauuuuaaagagcu

SEQ ID NO: 2497197 - RNA, 15 nt, Chlamydia trachomatis
agggauuuugaguuc

SEQ ID NO: 2497198 - RNA, 22 nt, Chlamydia trachomatis
agggcguuauauuggaagauaa

SEQ ID NO: 2497199 - RNA, 20 nt, Chlamydia trachomatis
agggcuguauucaucucuac

SEQ ID NO: 2497200 - RNA, 15 nt, Chlamydia trachomatis
aggggaagaaauauu

SEQ ID NO: 2497201 - RNA, 14 nt, Chlamydia trachomatis
aggggaagaaucaa

SEQ ID NO: 2497202 - RNA, 15 nt, Chlamydia trachomatis
aggggaagaaucaau

SEQ ID NO: 2497203 - RNA, 16 nt, Chlamydia trachomatis
aggggaccaaaaaagc

SEQ ID NO: 2497204 - RNA, 17 nt, Chlamydia trachomatis
aggguagaaaaagagaa

SEQ ID NO: 2497205 - RNA, 18 nt, Chlamydia trachomatis
aggguagaaaaagagaaa

SEQ ID NO: 2497206 - RNA, 19 nt, Chlamydia trachomatis
aggguagaaaaagagaaau

SEQ ID NO: 2497207 - RNA, 18 nt, Chlamydia trachomatis
aggguagucgcuuagaua

SEQ ID NO: 2497208 - RNA, 14 nt, Chlamydia trachomatis
agggucacugggau

SEQ ID NO: 2497209 - RNA, 21 nt, Chlamydia trachomatis
aggguguuuuucgcuaucuuc

SEQ ID NO: 2497210 - RNA, 17 nt, Chlamydia trachomatis
aggguuaggaaagcacu

SEQ ID NO: 2497211 - RNA, 23 nt, Chlamydia trachomatis
aggguugugaauacaaaccgaag

SEQ ID NO: 2497212 - RNA, 14 nt, Chlamydia trachomatis
aggguuucuucuuu

SEQ ID NO: 2497213 - RNA, 22 nt, Chlamydia trachomatis
agguaaauggugaaacuuuccu

SEQ ID NO: 2497214 - RNA, 23 nt, Chlamydia trachomatis
agguaaucuguagagagccccac

SEQ ID NO: 2497215 - RNA, 14 nt, Chlamydia trachomatis
agguacuuacccuu

SEQ ID NO: 2497216 - RNA, 21 nt, Chlamydia trachomatis
agguagccagguaaacucaag

SEQ ID NO: 2497217 - RNA, 22 nt, Chlamydia trachomatis
agguaucgaaaguaaaauuccu

SEQ ID NO: 2497218 - RNA, 19 nt, Chlamydia trachomatis
agguaugugcucauuuccu

SEQ ID NO: 2497219 - RNA, 20 nt, Chlamydia trachomatis
agguauuuuagagaaaagaa

SEQ ID NO: 2497220 - RNA, 18 nt, Chlamydia trachomatis
aggucaagccuacagcua

SEQ ID NO: 2497221 - RNA, 13 nt, Chlamydia trachomatis
aggucauauccac

SEQ ID NO: 2497222 - RNA, 19 nt, Chlamydia trachomatis
aggucauucgucaaagaag

SEQ ID NO: 2497223 - RNA, 20 nt, Chlamydia trachomatis
aggucauucgucaaagaagu

SEQ ID NO: 2497224 - RNA, 19 nt, Chlamydia trachomatis
aggucauugaguucugcuu

SEQ ID NO: 2497225 - RNA, 19 nt, Chlamydia trachomatis
aggucgcuugauucuugaa

SEQ ID NO: 2497226 - RNA, 20 nt, Chlamydia trachomatis
aggucgcuugauucuugaau

SEQ ID NO: 2497227 - RNA, 19 nt, Chlamydia trachomatis
aggucuaggggaagaauca

SEQ ID NO: 2497228 - RNA, 14 nt, Chlamydia trachomatis
aggucucccuccuc

SEQ ID NO: 2497229 - RNA, 14 nt, Chlamydia trachomatis
aggucuuaauaaua

SEQ ID NO: 2497230 - RNA, 16 nt, Chlamydia trachomatis
aggucuuauuaaaaga

SEQ ID NO: 2497231 - RNA, 23 nt, Chlamydia trachomatis
aggucuuauuaaaagaccucuuu

SEQ ID NO: 2497232 - RNA, 14 nt, Chlamydia trachomatis
aggucuuuaccguc

SEQ ID NO: 2497233 - RNA, 22 nt, Chlamydia trachomatis
aggucuuuuaauaagaccucuu

SEQ ID NO: 2497234 - RNA, 14 nt, Chlamydia trachomatis
aggugaccucugcg

SEQ ID NO: 2497235 - RNA, 16 nt, Chlamydia trachomatis
aggugaguuucccuuc

SEQ ID NO: 2497236 - RNA, 13 nt, Chlamydia trachomatis
aggugauuuucuu

SEQ ID NO: 2497237 - RNA, 15 nt, Chlamydia trachomatis
aggugguacuucauu

SEQ ID NO: 2497238 - RNA, 22 nt, Chlamydia trachomatis
aggugguacuucauuuuugcua

SEQ ID NO: 2497239 - RNA, 15 nt, Chlamydia trachomatis
aggugugaaagaaaa

SEQ ID NO: 2497240 - RNA, 20 nt, Chlamydia trachomatis
aggugugaauaggaagaaua

SEQ ID NO: 2497241 - RNA, 18 nt, Chlamydia trachomatis
agguuaccacauucucuu

SEQ ID NO: 2497242 - RNA, 19 nt, Chlamydia trachomatis
agguuaccacauucucuuu

SEQ ID NO: 2497243 - RNA, 18 nt, Chlamydia trachomatis
agguuauccaaauaaaca

SEQ ID NO: 2497244 - RNA, 19 nt, Chlamydia trachomatis
agguucccuugaaagacac

SEQ ID NO: 2497245 - RNA, 19 nt, Chlamydia trachomatis
agguucuauaccuaaaagu

SEQ ID NO: 2497246 - RNA, 14 nt, Chlamydia trachomatis
agguucuuugauca

SEQ ID NO: 2497247 - RNA, 22 nt, Chlamydia trachomatis
agguucuuugaucaaauccugc

SEQ ID NO: 2497248 - RNA, 18 nt, Chlamydia trachomatis
agguugaauuucaggagu

SEQ ID NO: 2497249 - RNA, 23 nt, Chlamydia trachomatis
agguugacuuucccugcaacauu

SEQ ID NO: 2497250 - RNA, 16 nt, Chlamydia trachomatis
agguugccuuuaucuc

SEQ ID NO: 2497251 - RNA, 13 nt, Chlamydia trachomatis
agguugcuugaau

SEQ ID NO: 2497252 - RNA, 15 nt, Chlamydia trachomatis
agguuuauaacucca

SEQ ID NO: 2497253 - RNA, 15 nt, Chlamydia trachomatis
agguuugucuucaga

SEQ ID NO: 2497254 - RNA, 18 nt, Chlamydia trachomatis
agguuuguuuccucucuc

SEQ ID NO: 2497255 - RNA, 20 nt, Chlamydia trachomatis
agguuuguuuccucucucug

SEQ ID NO: 2497256 - RNA, 17 nt, Chlamydia trachomatis
aguaaagaaaagcuccu

SEQ ID NO: 2497257 - RNA, 20 nt, Chlamydia trachomatis
aguaacaagcacagaauaga

SEQ ID NO: 2497258 - RNA, 14 nt, Chlamydia trachomatis
aguaaccauuccuu

SEQ ID NO: 2497259 - RNA, 22 nt, Chlamydia trachomatis
aguaacggaacucuacaaaaua

SEQ ID NO: 2497260 - RNA, 16 nt, Chlamydia trachomatis
aguaagcgaagaagga

SEQ ID NO: 2497261 - RNA, 20 nt, Chlamydia trachomatis
aguaagcgcuuccauuucga

SEQ ID NO: 2497262 - RNA, 22 nt, Chlamydia trachomatis
aguaagcuaauuuuucucuaau

SEQ ID NO: 2497263 - RNA, 13 nt, Chlamydia trachomatis
aguaaguaaaagc

SEQ ID NO: 2497264 - RNA, 21 nt, Chlamydia trachomatis
aguaagucaccauuuucucga

SEQ ID NO: 2497265 - RNA, 17 nt, Chlamydia trachomatis
aguaauacucuuaucgu

SEQ ID NO: 2497266 - RNA, 17 nt, Chlamydia trachomatis
aguaaugacacuggcac

SEQ ID NO: 2497267 - RNA, 22 nt, Chlamydia trachomatis
aguaaugacacuggcaccuuuu

SEQ ID NO: 2497268 - RNA, 15 nt, Chlamydia trachomatis
aguaauuccaaauaa

SEQ ID NO: 2497269 - RNA, 16 nt, Chlamydia trachomatis
aguaauuccaaauaau

SEQ ID NO: 2497270 - RNA, 13 nt, Chlamydia trachomatis
aguaauucuucuu

SEQ ID NO: 2497271 - RNA, 13 nt, Chlamydia trachomatis
aguacaaaaauac

SEQ ID NO: 2497272 - RNA, 16 nt, Chlamydia trachomatis
aguacaaguauauacc

SEQ ID NO: 2497273 - RNA, 21 nt, Chlamydia trachomatis
aguacaucuguagagccauga

SEQ ID NO: 2497274 - RNA, 15 nt, Chlamydia trachomatis
aguacugcuacaaaa

SEQ ID NO: 2497275 - RNA, 15 nt, Chlamydia trachomatis
aguacuucuaaaauu

SEQ ID NO: 2497276 - RNA, 17 nt, Chlamydia trachomatis
aguacuuuaccuguagg

SEQ ID NO: 2497277 - RNA, 20 nt, Chlamydia trachomatis
aguagaaacuuacuuuucuu

SEQ ID NO: 2497278 - RNA, 15 nt, Chlamydia trachomatis
aguagaccauuuaga

SEQ ID NO: 2497279 - RNA, 16 nt, Chlamydia trachomatis
aguagaccauuuagac

SEQ ID NO: 2497280 - RNA, 13 nt, Chlamydia trachomatis
aguagcaaauuaa

SEQ ID NO: 2497281 - RNA, 16 nt, Chlamydia trachomatis
aguagcaaauuaacag

SEQ ID NO: 2497282 - RNA, 21 nt, Chlamydia trachomatis
aguagcaaauuaacagauaua

SEQ ID NO: 2497283 - RNA, 18 nt, Chlamydia trachomatis
aguaggacucuaagagaa

SEQ ID NO: 2497284 - RNA, 19 nt, Chlamydia trachomatis
aguaggacucuaagagaac

SEQ ID NO: 2497285 - RNA, 17 nt, Chlamydia trachomatis
aguagggauuuccuuau

SEQ ID NO: 2497286 - RNA, 19 nt, Chlamydia trachomatis
aguagguaucugaaucugu

SEQ ID NO: 2497287 - RNA, 23 nt, Chlamydia trachomatis
aguaggucguugauaaugauaga

SEQ ID NO: 2497288 - RNA, 21 nt, Chlamydia trachomatis
aguagucuacuccauuuuaag

SEQ ID NO: 2497289 - RNA, 12 nt, Chlamydia trachomatis
aguaguugaaua

SEQ ID NO: 2497290 - RNA, 14 nt, Chlamydia trachomatis
aguaucuaacaaua

SEQ ID NO: 2497291 - RNA, 17 nt, Chlamydia trachomatis
aguauuaaacuucaaac

SEQ ID NO: 2497292 - RNA, 12 nt, Chlamydia trachomatis
aguauucuucug

SEQ ID NO: 2497293 - RNA, 16 nt, Chlamydia trachomatis
aguauuuaacuuuuca

SEQ ID NO: 2497294 - RNA, 15 nt, Chlamydia trachomatis
aguauuuucaaaaau

SEQ ID NO: 2497295 - RNA, 21 nt, Chlamydia trachomatis
aguauuuucaaaaauaaugcc

SEQ ID NO: 2497296 - RNA, 23 nt, Chlamydia trachomatis
agucaacagaaggaguuuuucuc

SEQ ID NO: 2497297 - RNA, 18 nt, Chlamydia trachomatis
agucaagaagccuugagc

SEQ ID NO: 2497298 - RNA, 17 nt, Chlamydia trachomatis
agucaagagcuucuugu

SEQ ID NO: 2497299 - RNA, 14 nt, Chlamydia trachomatis
agucaccauuuucu

SEQ ID NO: 2497300 - RNA, 18 nt, Chlamydia trachomatis
agucagaagcuauuccau

SEQ ID NO: 2497301 - RNA, 19 nt, Chlamydia trachomatis
agucaguuaggaaaugagg

SEQ ID NO: 2497302 - RNA, 23 nt, Chlamydia trachomatis
agucaguuaggaaaugaggacag

SEQ ID NO: 2497303 - RNA, 13 nt, Chlamydia trachomatis
aguccaacgcugc

SEQ ID NO: 2497304 - RNA, 16 nt, Chlamydia trachomatis
agucccuucaaucaua

SEQ ID NO: 2497305 - RNA, 14 nt, Chlamydia trachomatis
aguccgcaaacaaa

SEQ ID NO: 2497306 - RNA, 15 nt, Chlamydia trachomatis
aguccgcgauuuucu

SEQ ID NO: 2497307 - RNA, 16 nt, Chlamydia trachomatis
aguccggacuuuccuc

SEQ ID NO: 2497308 - RNA, 20 nt, Chlamydia trachomatis
aguccggacuuuccucuggu

SEQ ID NO: 2497309 - RNA, 15 nt, Chlamydia trachomatis
aguccuuaucuucuu

SEQ ID NO: 2497310 - RNA, 16 nt, Chlamydia trachomatis
aguccuucuccaccua

SEQ ID NO: 2497311 - RNA, 19 nt, Chlamydia trachomatis
agucgaguuuugaggaaga

SEQ ID NO: 2497312 - RNA, 14 nt, Chlamydia trachomatis
agucgauucuggca

SEQ ID NO: 2497313 - RNA, 13 nt, Chlamydia trachomatis
agucucccaaauu

SEQ ID NO: 2497314 - RNA, 15 nt, Chlamydia trachomatis
agucucgaaggaaua

SEQ ID NO: 2497315 - RNA, 17 nt, Chlamydia trachomatis
agucucgacgcucauaa

SEQ ID NO: 2497316 - RNA, 20 nt, Chlamydia trachomatis
agucucuaacaacaguucuu

SEQ ID NO: 2497317 - RNA, 20 nt, Chlamydia trachomatis
agucucuguauugaucucua

SEQ ID NO: 2497318 - RNA, 18 nt, Chlamydia trachomatis
agucugaauauacccauu

SEQ ID NO: 2497319 - RNA, 17 nt, Chlamydia trachomatis
agucugcauuaaacacu

SEQ ID NO: 2497320 - RNA, 16 nt, Chlamydia trachomatis
agucuguugccugcaa

SEQ ID NO: 2497321 - RNA, 18 nt, Chlamydia trachomatis
agucuucaggauuggaaa

SEQ ID NO: 2497322 - RNA, 16 nt, Chlamydia trachomatis
agucuucaucaauauu

SEQ ID NO: 2497323 - RNA, 18 nt, Chlamydia trachomatis
agucuucccuuaaacaua

SEQ ID NO: 2497324 - RNA, 14 nt, Chlamydia trachomatis
agucuuccucugcu

SEQ ID NO: 2497325 - RNA, 19 nt, Chlamydia trachomatis
agucuucucgagaagaaaa

SEQ ID NO: 2497326 - RNA, 22 nt, Chlamydia trachomatis
agucuucucgagaagaaaaacg

SEQ ID NO: 2497327 - RNA, 15 nt, Chlamydia trachomatis
agucuuguccuuccc

SEQ ID NO: 2497328 - RNA, 18 nt, Chlamydia trachomatis
agucuuuauaucuugucc

SEQ ID NO: 2497329 - RNA, 21 nt, Chlamydia trachomatis
agugacauuauuuuuucgaga

SEQ ID NO: 2497330 - RNA, 15 nt, Chlamydia trachomatis
agugauaaacaggag

SEQ ID NO: 2497331 - RNA, 17 nt, Chlamydia trachomatis
agugauuuuaaaccaau

SEQ ID NO: 2497332 - RNA, 21 nt, Chlamydia trachomatis
agugcagaagauaagcaagga

SEQ ID NO: 2497333 - RNA, 17 nt, Chlamydia trachomatis
agugcauggagaauggc

SEQ ID NO: 2497334 - RNA, 14 nt, Chlamydia trachomatis
agugccaacaucaa

SEQ ID NO: 2497335 - RNA, 15 nt, Chlamydia trachomatis
agugccagcauucau

SEQ ID NO: 2497336 - RNA, 23 nt, Chlamydia trachomatis
agugccucaauuuguagcaaaag

SEQ ID NO: 2497337 - RNA, 16 nt, Chlamydia trachomatis
agugcgcuuagcacuu

SEQ ID NO: 2497338 - RNA, 17 nt, Chlamydia trachomatis
agugcgcuuagcacuug

SEQ ID NO: 2497339 - RNA, 14 nt, Chlamydia trachomatis
agugcguccuucuu

SEQ ID NO: 2497340 - RNA, 18 nt, Chlamydia trachomatis
agugcguccuucuuuacc

SEQ ID NO: 2497341 - RNA, 22 nt, Chlamydia trachomatis
agugcuaacgcuucuucugcag

SEQ ID NO: 2497342 - RNA, 16 nt, Chlamydia trachomatis
agugcuccuaaaggaa

SEQ ID NO: 2497343 - RNA, 13 nt, Chlamydia trachomatis
aguggaacugcuu

SEQ ID NO: 2497344 - RNA, 13 nt, Chlamydia trachomatis
agugguaaggggu

SEQ ID NO: 2497345 - RNA, 20 nt, Chlamydia trachomatis
aguguagucuuuguugcuau

SEQ ID NO: 2497346 - RNA, 22 nt, Chlamydia trachomatis
aguguccuuccauggauaaaau

SEQ ID NO: 2497347 - RNA, 18 nt, Chlamydia trachomatis
aguguugagaagcuuagu

SEQ ID NO: 2497348 - RNA, 15 nt, Chlamydia trachomatis
aguguuugcauucuu

SEQ ID NO: 2497349 - RNA, 18 nt, Chlamydia trachomatis
aguuaaaacacaaaagca

SEQ ID NO: 2497350 - RNA, 20 nt, Chlamydia trachomatis
aguuaacggaaauaggauuu

SEQ ID NO: 2497351 - RNA, 14 nt, Chlamydia trachomatis
aguuaccaaucacg

SEQ ID NO: 2497352 - RNA, 20 nt, Chlamydia trachomatis
aguuaccaaucacgcuacau

SEQ ID NO: 2497353 - RNA, 13 nt, Chlamydia trachomatis
aguuacuuuucuc

SEQ ID NO: 2497354 - RNA, 14 nt, Chlamydia trachomatis
aguuagacaaaaaa

SEQ ID NO: 2497355 - RNA, 14 nt, Chlamydia trachomatis
aguuagcugaaaug

SEQ ID NO: 2497356 - RNA, 14 nt, Chlamydia trachomatis
aguuagugaagucu

SEQ ID NO: 2497357 - RNA, 15 nt, Chlamydia trachomatis
aguuauauugcuuca

SEQ ID NO: 2497358 - RNA, 22 nt, Chlamydia trachomatis
aguuauauugcuucauaaaaaa

SEQ ID NO: 2497359 - RNA, 24 nt, Chlamydia trachomatis
aguucacugacuguagaaaaucau

SEQ ID NO: 2497360 - RNA, 20 nt, Chlamydia trachomatis
aguucauugguaagauucga

SEQ ID NO: 2497361 - RNA, 23 nt, Chlamydia trachomatis
aguucccuuuuguuccagaaaaa

SEQ ID NO: 2497362 - RNA, 14 nt, Chlamydia trachomatis
aguuccgaacaaaa

SEQ ID NO: 2497363 - RNA, 17 nt, Chlamydia trachomatis
aguuccgaauaagcauu

SEQ ID NO: 2497364 - RNA, 15 nt, Chlamydia trachomatis
aguuccucaaaagaa

SEQ ID NO: 2497365 - RNA, 22 nt, Chlamydia trachomatis
aguucguuacgcguaaagauuu

SEQ ID NO: 2497366 - RNA, 11 nt, Chlamydia trachomatis
aguucuaacuu

SEQ ID NO: 2497367 - RNA, 13 nt, Chlamydia trachomatis
aguucuccuucuu

SEQ ID NO: 2497368 - RNA, 16 nt, Chlamydia trachomatis
aguucucucccuuccu

SEQ ID NO: 2497369 - RNA, 17 nt, Chlamydia trachomatis
aguucuucuuccacaga

SEQ ID NO: 2497370 - RNA, 20 nt, Chlamydia trachomatis
aguucuucuuccacagaagu

SEQ ID NO: 2497371 - RNA, 17 nt, Chlamydia trachomatis
aguucuuuuuccucuuc

SEQ ID NO: 2497372 - RNA, 20 nt, Chlamydia trachomatis
aguucuuuuuccucuucaga

SEQ ID NO: 2497373 - RNA, 18 nt, Chlamydia trachomatis
aguugaucauugauaaau

SEQ ID NO: 2497374 - RNA, 19 nt, Chlamydia trachomatis
aguugaucuuccucuugaa

SEQ ID NO: 2497375 - RNA, 11 nt, Chlamydia trachomatis
aguugcaaaaa

SEQ ID NO: 2497376 - RNA, 17 nt, Chlamydia trachomatis
aguugccccuuauuuac

SEQ ID NO: 2497377 - RNA, 13 nt, Chlamydia trachomatis
aguugcgccuucu

SEQ ID NO: 2497378 - RNA, 22 nt, Chlamydia trachomatis
aguugcuuguauagcuucauac

SEQ ID NO: 2497379 - RNA, 13 nt, Chlamydia trachomatis
aguuguaaagcau

SEQ ID NO: 2497380 - RNA, 14 nt, Chlamydia trachomatis
aguuguaaagcauu

SEQ ID NO: 2497381 - RNA, 21 nt, Chlamydia trachomatis
aguuguuggaguuaauucuuu

SEQ ID NO: 2497382 - RNA, 15 nt, Chlamydia trachomatis
aguuguuugggcugc

SEQ ID NO: 2497383 - RNA, 13 nt, Chlamydia trachomatis
aguuguuuucuug

SEQ ID NO: 2497384 - RNA, 20 nt, Chlamydia trachomatis
aguuuaaaggacccgcuauu

SEQ ID NO: 2497385 - RNA, 13 nt, Chlamydia trachomatis
aguuuaccucucc

SEQ ID NO: 2497386 - RNA, 12 nt, Chlamydia trachomatis
aguuuacugcaa

SEQ ID NO: 2497387 - RNA, 19 nt, Chlamydia trachomatis
aguuuauggaaaagaucuu

SEQ ID NO: 2497388 - RNA, 19 nt, Chlamydia trachomatis
aguuucaaacauccaguaa

SEQ ID NO: 2497389 - RNA, 13 nt, Chlamydia trachomatis
aguuucaucccca

SEQ ID NO: 2497390 - RNA, 20 nt, Chlamydia trachomatis
aguuucccuucgucccuugc

SEQ ID NO: 2497391 - RNA, 20 nt, Chlamydia trachomatis
aguuucucgcagaugcuucu

SEQ ID NO: 2497392 - RNA, 15 nt, Chlamydia trachomatis
aguuucugaaaaguc

SEQ ID NO: 2497393 - RNA, 17 nt, Chlamydia trachomatis
aguuucugagaaaucua

SEQ ID NO: 2497394 - RNA, 20 nt, Chlamydia trachomatis
aguuucuuccagacaaaaag

SEQ ID NO: 2497395 - RNA, 23 nt, Chlamydia trachomatis
aguuucuuccagacaaaaagaaa

SEQ ID NO: 2497396 - RNA, 12 nt, Chlamydia trachomatis
aguuucuuucuu

SEQ ID NO: 2497397 - RNA, 17 nt, Chlamydia trachomatis
aguuucuuucuuaguuu

SEQ ID NO: 2497398 - RNA, 19 nt, Chlamydia trachomatis
aguuucuuuguucacagaa

SEQ ID NO: 2497399 - RNA, 22 nt, Chlamydia trachomatis
aguuugaaucacagaaacuucu

SEQ ID NO: 2497400 - RNA, 16 nt, Chlamydia trachomatis
aguuuguggaauugua

SEQ ID NO: 2497401 - RNA, 17 nt, Chlamydia trachomatis
aguuuuaagaagaggua

SEQ ID NO: 2497402 - RNA, 19 nt, Chlamydia trachomatis
aguuuucccaucuacaaaa

SEQ ID NO: 2497403 - RNA, 19 nt, Chlamydia trachomatis
aguuuucgaauuuuuuucu

SEQ ID NO: 2497404 - RNA, 16 nt, Chlamydia trachomatis
aguuuugaggaagaaa

SEQ ID NO: 2497405 - RNA, 20 nt, Chlamydia trachomatis
aguuuuuauggaugaucugc

SEQ ID NO: 2497406 - RNA, 22 nt, Chlamydia trachomatis
aguuuuucuccucucucuuuau

SEQ ID NO: 2497407 - RNA, 16 nt, Chlamydia trachomatis
aguuuuuuuaaaagag

SEQ ID NO: 2497408 - RNA, 23 nt, Chlamydia trachomatis
aguuuuuuucaggagaaaggcuu

SEQ ID NO: 2497409 - RNA, 19 nt, Chlamydia trachomatis
auaaaaaaagucuguuccu

SEQ ID NO: 2497410 - RNA, 19 nt, Chlamydia trachomatis
auaaaaacugcugcuauca

SEQ ID NO: 2497411 - RNA, 11 nt, Chlamydia trachomatis
auaaaaagccc

SEQ ID NO: 2497412 - RNA, 22 nt, Chlamydia trachomatis
auaaaaagcccuuuccucauaa

SEQ ID NO: 2497413 - RNA, 12 nt, Chlamydia trachomatis
auaaaaagcugg

SEQ ID NO: 2497414 - RNA, 17 nt, Chlamydia trachomatis
auaaaaagcugggcagc

SEQ ID NO: 2497415 - RNA, 13 nt, Chlamydia trachomatis
auaaaaauuccau

SEQ ID NO: 2497416 - RNA, 16 nt, Chlamydia trachomatis
auaaaacgaaaaacag

SEQ ID NO: 2497417 - RNA, 15 nt, Chlamydia trachomatis
auaaaacuuguuccu

SEQ ID NO: 2497418 - RNA, 22 nt, Chlamydia trachomatis
auaaaagcuccuaaagaaggca

SEQ ID NO: 2497419 - RNA, 17 nt, Chlamydia trachomatis
auaaaagcugguuuuuu

SEQ ID NO: 2497420 - RNA, 16 nt, Chlamydia trachomatis
auaaaaguacuucuag

SEQ ID NO: 2497421 - RNA, 16 nt, Chlamydia trachomatis
auaaaaucaaauaaag

SEQ ID NO: 2497422 - RNA, 21 nt, Chlamydia trachomatis
auaaaauccaauguaaaauga

SEQ ID NO: 2497423 - RNA, 14 nt, Chlamydia trachomatis
auaaaauuccuacg

SEQ ID NO: 2497424 - RNA, 18 nt, Chlamydia trachomatis
auaaacaaggcuaagaaa

SEQ ID NO: 2497425 - RNA, 17 nt, Chlamydia trachomatis
auaaacccacgaaaaga

SEQ ID NO: 2497426 - RNA, 19 nt, Chlamydia trachomatis
auaaacgguggaacagcuc

SEQ ID NO: 2497427 - RNA, 19 nt, Chlamydia trachomatis
auaaacucggguuuuaaau

SEQ ID NO: 2497428 - RNA, 22 nt, Chlamydia trachomatis
auaaagagccguucucucuaaa

SEQ ID NO: 2497429 - RNA, 21 nt, Chlamydia trachomatis
auaaagagguuguuacagucu

SEQ ID NO: 2497430 - RNA, 22 nt, Chlamydia trachomatis
auaaagccccuccgcugauuag

SEQ ID NO: 2497431 - RNA, 23 nt, Chlamydia trachomatis
auaaagcuaucccaaaagaauga

SEQ ID NO: 2497432 - RNA, 17 nt, Chlamydia trachomatis
auaaagcuuuuucuacu

SEQ ID NO: 2497433 - RNA, 18 nt, Chlamydia trachomatis
auaaagcuuuuucuacug

SEQ ID NO: 2497434 - RNA, 19 nt, Chlamydia trachomatis
auaaaggaaacaaauuccu

SEQ ID NO: 2497435 - RNA, 21 nt, Chlamydia trachomatis
auaaaguccggacuuuccucu

SEQ ID NO: 2497436 - RNA, 14 nt, Chlamydia trachomatis
auaaauagcaaugc

SEQ ID NO: 2497437 - RNA, 14 nt, Chlamydia trachomatis
auaaaucaguggaa

SEQ ID NO: 2497438 - RNA, 22 nt, Chlamydia trachomatis
auaaauccucuuugaauauccg

SEQ ID NO: 2497439 - RNA, 15 nt, Chlamydia trachomatis
auaaaucucuuccaa

SEQ ID NO: 2497440 - RNA, 24 nt, Chlamydia trachomatis
auaaaucugcuaaggccuuaucca

SEQ ID NO: 2497441 - RNA, 14 nt, Chlamydia trachomatis
auaaaugauaaucc

SEQ ID NO: 2497442 - RNA, 19 nt, Chlamydia trachomatis
auaaauuagggaagagcaa

SEQ ID NO: 2497443 - RNA, 20 nt, Chlamydia trachomatis
auaaauuucuaaauauuuau

SEQ ID NO: 2497444 - RNA, 19 nt, Chlamydia trachomatis
auaaauuucuuaaaagcac

SEQ ID NO: 2497445 - RNA, 13 nt, Chlamydia trachomatis
auaacaaacaaca

SEQ ID NO: 2497446 - RNA, 21 nt, Chlamydia trachomatis
auaacaaguuucuuccagaca

SEQ ID NO: 2497447 - RNA, 15 nt, Chlamydia trachomatis
auaacaauccuagac

SEQ ID NO: 2497448 - RNA, 15 nt, Chlamydia trachomatis
auaacaauuuuaaaa

SEQ ID NO: 2497449 - RNA, 21 nt, Chlamydia trachomatis
auaacaauuuuaaaaucuccu

SEQ ID NO: 2497450 - RNA, 23 nt, Chlamydia trachomatis
auaacacauaucuccaaaaauau

SEQ ID NO: 2497451 - RNA, 21 nt, Chlamydia trachomatis
auaacacccuguaaaaggcgc

SEQ ID NO: 2497452 - RNA, 22 nt, Chlamydia trachomatis
auaacacccuguaaaaggcgca

SEQ ID NO: 2497453 - RNA, 18 nt, Chlamydia trachomatis
auaacacucucaucuaaa

SEQ ID NO: 2497454 - RNA, 10 nt, Chlamydia trachomatis
auaacagcac

SEQ ID NO: 2497455 - RNA, 18 nt, Chlamydia trachomatis
auaacagcacaaacaaau

SEQ ID NO: 2497456 - RNA, 15 nt, Chlamydia trachomatis
auaacaugguugauu

SEQ ID NO: 2497457 - RNA, 18 nt, Chlamydia trachomatis
auaaccagaauccuuuuc

SEQ ID NO: 2497458 - RNA, 15 nt, Chlamydia trachomatis
auaaccaugagcucc

SEQ ID NO: 2497459 - RNA, 19 nt, Chlamydia trachomatis
auaacccuccgacccaaga

SEQ ID NO: 2497460 - RNA, 12 nt, Chlamydia trachomatis
auaaccugaccu

SEQ ID NO: 2497461 - RNA, 13 nt, Chlamydia trachomatis
auaacgauaguac

SEQ ID NO: 2497462 - RNA, 22 nt, Chlamydia trachomatis
auaacgauccucuugagcauug

SEQ ID NO: 2497463 - RNA, 21 nt, Chlamydia trachomatis
auaacgauuccgaagcaugau

SEQ ID NO: 2497464 - RNA, 22 nt, Chlamydia trachomatis
auaacgauucuugauaaauaau

SEQ ID NO: 2497465 - RNA, 13 nt, Chlamydia trachomatis
auaacgcauuucu

SEQ ID NO: 2497466 - RNA, 17 nt, Chlamydia trachomatis
auaacgucauugcuugc

SEQ ID NO: 2497467 - RNA, 13 nt, Chlamydia trachomatis
auaacguuuuaaa

SEQ ID NO: 2497468 - RNA, 16 nt, Chlamydia trachomatis
auaacuaagaucucca

SEQ ID NO: 2497469 - RNA, 16 nt, Chlamydia trachomatis
auaacuccaagggaug

SEQ ID NO: 2497470 - RNA, 16 nt, Chlamydia trachomatis
auaacuccaucaggaa

SEQ ID NO: 2497471 - RNA, 16 nt, Chlamydia trachomatis
auaacuggaguuuucc

SEQ ID NO: 2497472 - RNA, 20 nt, Chlamydia trachomatis
auaacuggaguuuuccugaa

SEQ ID NO: 2497473 - RNA, 18 nt, Chlamydia trachomatis
auaacuuuuucucuugcu

SEQ ID NO: 2497474 - RNA, 20 nt, Chlamydia trachomatis
auaagaaaaaaaaccaaacu

SEQ ID NO: 2497475 - RNA, 20 nt, Chlamydia trachomatis
auaagaauguuuccuaauuu

SEQ ID NO: 2497476 - RNA, 16 nt, Chlamydia trachomatis
auaagaccucuuuuuu

SEQ ID NO: 2497477 - RNA, 18 nt, Chlamydia trachomatis
auaagagaagguaacaau

SEQ ID NO: 2497478 - RNA, 15 nt, Chlamydia trachomatis
auaagaggcaccucu

SEQ ID NO: 2497479 - RNA, 17 nt, Chlamydia trachomatis
auaagaggcaccucuuu

SEQ ID NO: 2497480 - RNA, 15 nt, Chlamydia trachomatis
auaagaucuuuacuu

SEQ ID NO: 2497481 - RNA, 22 nt, Chlamydia trachomatis
auaagaucuuuacuuucuuugc

SEQ ID NO: 2497482 - RNA, 20 nt, Chlamydia trachomatis
auaagcacuauaucuccaac

SEQ ID NO: 2497483 - RNA, 15 nt, Chlamydia trachomatis
auaagcauuacacaa

SEQ ID NO: 2497484 - RNA, 13 nt, Chlamydia trachomatis
auaagcgaaaaaa

SEQ ID NO: 2497485 - RNA, 22 nt, Chlamydia trachomatis
auaagcguuccuauacaagaaa

SEQ ID NO: 2497486 - RNA, 19 nt, Chlamydia trachomatis
auaagcucuaacucuucuu

SEQ ID NO: 2497487 - RNA, 22 nt, Chlamydia trachomatis
auaagcuguaggucgcuugauu

SEQ ID NO: 2497488 - RNA, 22 nt, Chlamydia trachomatis
auaaggaagaagauaguagaga

SEQ ID NO: 2497489 - RNA, 17 nt, Chlamydia trachomatis
auaaggaagaugggcau

SEQ ID NO: 2497490 - RNA, 17 nt, Chlamydia trachomatis
auaaggaagcaaaaacu

SEQ ID NO: 2497491 - RNA, 14 nt, Chlamydia trachomatis
auaagggaaucaua

SEQ ID NO: 2497492 - RNA, 19 nt, Chlamydia trachomatis
auaagggaaucauaaggaa

SEQ ID NO: 2497493 - RNA, 17 nt, Chlamydia trachomatis
auaagguggcacacucc

SEQ ID NO: 2497494 - RNA, 22 nt, Chlamydia trachomatis
auaaguccaucuaaagggagaa

SEQ ID NO: 2497495 - RNA, 22 nt, Chlamydia trachomatis
auaaguccuuaucuucuugaga

SEQ ID NO: 2497496 - RNA, 15 nt, Chlamydia trachomatis
auaagucuuuuacuu

SEQ ID NO: 2497497 - RNA, 14 nt, Chlamydia trachomatis
auaaguuaccucuu

SEQ ID NO: 2497498 - RNA, 16 nt, Chlamydia trachomatis
auaaguuaccucuuua

SEQ ID NO: 2497499 - RNA, 22 nt, Chlamydia trachomatis
auaaguuaccucuuuacgcaca

SEQ ID NO: 2497500 - RNA, 23 nt, Chlamydia trachomatis
auaaguucagccccuaaagccac

SEQ ID NO: 2497501 - RNA, 16 nt, Chlamydia trachomatis
auaaguucuuuagcuu

SEQ ID NO: 2497502 - RNA, 14 nt, Chlamydia trachomatis
auaaguuuuaagaa

SEQ ID NO: 2497503 - RNA, 16 nt, Chlamydia trachomatis
auaaguuuuaagaaga

SEQ ID NO: 2497504 - RNA, 11 nt, Chlamydia trachomatis
auaaguuuuuc

SEQ ID NO: 2497505 - RNA, 12 nt, Chlamydia trachomatis
auaauaaauauu

SEQ ID NO: 2497506 - RNA, 13 nt, Chlamydia trachomatis
auaauaagaugau

SEQ ID NO: 2497507 - RNA, 13 nt, Chlamydia trachomatis
auaauaaugggcu

SEQ ID NO: 2497508 - RNA, 22 nt, Chlamydia trachomatis
auaauacaaagcacgauaaaag

SEQ ID NO: 2497509 - RNA, 15 nt, Chlamydia trachomatis
auaauacagauuuuu

SEQ ID NO: 2497510 - RNA, 14 nt, Chlamydia trachomatis
auaauacucuucua

SEQ ID NO: 2497511 - RNA, 15 nt, Chlamydia trachomatis
auaauacucuucuau

SEQ ID NO: 2497512 - RNA, 15 nt, Chlamydia trachomatis
auaauagagacaagu

SEQ ID NO: 2497513 - RNA, 18 nt, Chlamydia trachomatis
auaauagcuugcacagca

SEQ ID NO: 2497514 - RNA, 20 nt, Chlamydia trachomatis
auaauagcuugcacagcaag

SEQ ID NO: 2497515 - RNA, 13 nt, Chlamydia trachomatis
auaauaggauagg

SEQ ID NO: 2497516 - RNA, 20 nt, Chlamydia trachomatis
auaauaggauaggaaaugag

SEQ ID NO: 2497517 - RNA, 17 nt, Chlamydia trachomatis
auaauaguccuacucaa

SEQ ID NO: 2497518 - RNA, 14 nt, Chlamydia trachomatis
auaaucccaaaaac

SEQ ID NO: 2497519 - RNA, 16 nt, Chlamydia trachomatis
auaaucccaaaaacaa

SEQ ID NO: 2497520 - RNA, 20 nt, Chlamydia trachomatis
auaaucccaaaaacaaucaa

SEQ ID NO: 2497521 - RNA, 19 nt, Chlamydia trachomatis
auaaucgaucacagaaacg

SEQ ID NO: 2497522 - RNA, 21 nt, Chlamydia trachomatis
auaaucgaucacagaaacgga

SEQ ID NO: 2497523 - RNA, 17 nt, Chlamydia trachomatis
auaaucuaaagacaaaa

SEQ ID NO: 2497524 - RNA, 21 nt, Chlamydia trachomatis
auaaucuuccuguaagaggau

SEQ ID NO: 2497525 - RNA, 15 nt, Chlamydia trachomatis
auaaucuuuuuauug

SEQ ID NO: 2497526 - RNA, 23 nt, Chlamydia trachomatis
auaauggcaaaaauaccaaaaaa

SEQ ID NO: 2497527 - RNA, 20 nt, Chlamydia trachomatis
auaaugggccguuuuucucc

SEQ ID NO: 2497528 - RNA, 20 nt, Chlamydia trachomatis
auaauuaaaggcucuguuaa

SEQ ID NO: 2497529 - RNA, 18 nt, Chlamydia trachomatis
auaauuuaauuaaagaga

SEQ ID NO: 2497530 - RNA, 13 nt, Chlamydia trachomatis
auaauuuccccua

SEQ ID NO: 2497531 - RNA, 21 nt, Chlamydia trachomatis
auaauuuccggacacacucuc

SEQ ID NO: 2497532 - RNA, 11 nt, Chlamydia trachomatis
auaauuucuag

SEQ ID NO: 2497533 - RNA, 15 nt, Chlamydia trachomatis
auaauuucugagucc

SEQ ID NO: 2497534 - RNA, 13 nt, Chlamydia trachomatis
auaauuuuccuuu

SEQ ID NO: 2497535 - RNA, 19 nt, Chlamydia trachomatis
auaauuuuccuuuuuccca

SEQ ID NO: 2497536 - RNA, 13 nt, Chlamydia trachomatis
auacaaagauugc

SEQ ID NO: 2497537 - RNA, 23 nt, Chlamydia trachomatis
auacaaagcagccacuccugcag

SEQ ID NO: 2497538 - RNA, 15 nt, Chlamydia trachomatis
auacaaaucuuuuau

SEQ ID NO: 2497539 - RNA, 20 nt, Chlamydia trachomatis
auacaagacucacagcaaau

SEQ ID NO: 2497540 - RNA, 14 nt, Chlamydia trachomatis
auacacaucaaaau

SEQ ID NO: 2497541 - RNA, 23 nt, Chlamydia trachomatis
auacaccgcaucagccccaaaaa

SEQ ID NO: 2497542 - RNA, 16 nt, Chlamydia trachomatis
auacaccugcaagaga

SEQ ID NO: 2497543 - RNA, 19 nt, Chlamydia trachomatis
auacagacaucuaaagucu

SEQ ID NO: 2497544 - RNA, 17 nt, Chlamydia trachomatis
auacaggccgucaauau

SEQ ID NO: 2497545 - RNA, 19 nt, Chlamydia trachomatis
auacaguaaggcucucgca

SEQ ID NO: 2497546 - RNA, 14 nt, Chlamydia trachomatis
auacauauaaugcc

SEQ ID NO: 2497547 - RNA, 11 nt, Chlamydia trachomatis
auacaucaucu

SEQ ID NO: 2497548 - RNA, 17 nt, Chlamydia trachomatis
auacaucaucucucagc

SEQ ID NO: 2497549 - RNA, 22 nt, Chlamydia trachomatis
auacaugcuuuugaucuuucca

SEQ ID NO: 2497550 - RNA, 19 nt, Chlamydia trachomatis
auacauuauguaagaguuu

SEQ ID NO: 2497551 - RNA, 19 nt, Chlamydia trachomatis
auaccaaaaaacauuccug

SEQ ID NO: 2497552 - RNA, 18 nt, Chlamydia trachomatis
auaccaaagcauuuuuaa

SEQ ID NO: 2497553 - RNA, 16 nt, Chlamydia trachomatis
auaccaagccauuucc

SEQ ID NO: 2497554 - RNA, 17 nt, Chlamydia trachomatis
auaccaagccauuucca

SEQ ID NO: 2497555 - RNA, 18 nt, Chlamydia trachomatis
auaccaagccauuuccag

SEQ ID NO: 2497556 - RNA, 16 nt, Chlamydia trachomatis
auaccaagcuuucugc

SEQ ID NO: 2497557 - RNA, 19 nt, Chlamydia trachomatis
auaccacaauuuuucuugu

SEQ ID NO: 2497558 - RNA, 22 nt, Chlamydia trachomatis
auacccaggguagcuguagcaa

SEQ ID NO: 2497559 - RNA, 19 nt, Chlamydia trachomatis
auacccuaacgaggcacaa

SEQ ID NO: 2497560 - RNA, 17 nt, Chlamydia trachomatis
auaccuaaagaagccau

SEQ ID NO: 2497561 - RNA, 13 nt, Chlamydia trachomatis
auacgaaagauuu

SEQ ID NO: 2497562 - RNA, 17 nt, Chlamydia trachomatis
auacgaaauaacaaagc

SEQ ID NO: 2497563 - RNA, 19 nt, Chlamydia trachomatis
auacgacguaaucguguuc

SEQ ID NO: 2497564 - RNA, 17 nt, Chlamydia trachomatis
auacgagccuguuucuu

SEQ ID NO: 2497565 - RNA, 17 nt, Chlamydia trachomatis
auacgaggagcuugaga

SEQ ID NO: 2497566 - RNA, 21 nt, Chlamydia trachomatis
auacgaggagcuugagagcau

SEQ ID NO: 2497567 - RNA, 22 nt, Chlamydia trachomatis
auacgcaaguauuggagacaac

SEQ ID NO: 2497568 - RNA, 21 nt, Chlamydia trachomatis
auacgcauaugcgucuucccu

SEQ ID NO: 2497569 - RNA, 21 nt, Chlamydia trachomatis
auacgcgcgcuaagacuuucu

SEQ ID NO: 2497570 - RNA, 16 nt, Chlamydia trachomatis
auacgcugguauacca

SEQ ID NO: 2497571 - RNA, 20 nt, Chlamydia trachomatis
auacggacggacaaauuucu

SEQ ID NO: 2497572 - RNA, 14 nt, Chlamydia trachomatis
auacuaaacuaucu

SEQ ID NO: 2497573 - RNA, 17 nt, Chlamydia trachomatis
auacuaaacuaucuaaa

SEQ ID NO: 2497574 - RNA, 18 nt, Chlamydia trachomatis
auacuaaacuaucuaaaa

SEQ ID NO: 2497575 - RNA, 14 nt, Chlamydia trachomatis
auacuaacaaauag

SEQ ID NO: 2497576 - RNA, 21 nt, Chlamydia trachomatis
auacuacuaaggugaguuucc

SEQ ID NO: 2497577 - RNA, 17 nt, Chlamydia trachomatis
auacucaacuccagagc

SEQ ID NO: 2497578 - RNA, 13 nt, Chlamydia trachomatis
auacucuaaaagu

SEQ ID NO: 2497579 - RNA, 15 nt, Chlamydia trachomatis
auacucuuaucguag

SEQ ID NO: 2497580 - RNA, 22 nt, Chlamydia trachomatis
auacucuuaucguagagaucuu

SEQ ID NO: 2497581 - RNA, 23 nt, Chlamydia trachomatis
auacugacccauccaaaacaucc

SEQ ID NO: 2497582 - RNA, 17 nt, Chlamydia trachomatis
auacugcuccacaacac

SEQ ID NO: 2497583 - RNA, 20 nt, Chlamydia trachomatis
auacuggcagggauaguaaa

SEQ ID NO: 2497584 - RNA, 19 nt, Chlamydia trachomatis
auacuucuuacuuaaaaaa

SEQ ID NO: 2497585 - RNA, 21 nt, Chlamydia trachomatis
auacuucuuacuuaaaaaaca

SEQ ID NO: 2497586 - RNA, 22 nt, Chlamydia trachomatis
auacuucuuacuuaaaaaacaa

SEQ ID NO: 2497587 - RNA, 20 nt, Chlamydia trachomatis
auacuuuaaucauagaacau

SEQ ID NO: 2497588 - RNA, 20 nt, Chlamydia trachomatis
auacuuuagauuuguuuaaa

SEQ ID NO: 2497589 - RNA, 12 nt, Chlamydia trachomatis
auagaaaaaaac

SEQ ID NO: 2497590 - RNA, 19 nt, Chlamydia trachomatis
auagaaaaaaacagcucug

SEQ ID NO: 2497591 - RNA, 15 nt, Chlamydia trachomatis
auagaaaauggcugc

SEQ ID NO: 2497592 - RNA, 20 nt, Chlamydia trachomatis
auagaaacacgcaacccuaa

SEQ ID NO: 2497593 - RNA, 18 nt, Chlamydia trachomatis
auagaaaccgaaaaaaag

SEQ ID NO: 2497594 - RNA, 19 nt, Chlamydia trachomatis
auagaaaccuuauauaccg

SEQ ID NO: 2497595 - RNA, 12 nt, Chlamydia trachomatis
auagaaacuccg

SEQ ID NO: 2497596 - RNA, 14 nt, Chlamydia trachomatis
auagaaagauagau

SEQ ID NO: 2497597 - RNA, 18 nt, Chlamydia trachomatis
auagaaccccucuuuuuu

SEQ ID NO: 2497598 - RNA, 18 nt, Chlamydia trachomatis
auagaaggaaugcagauc

SEQ ID NO: 2497599 - RNA, 16 nt, Chlamydia trachomatis
auagaaggucugaaca

SEQ ID NO: 2497600 - RNA, 22 nt, Chlamydia trachomatis
auagaauuucuuccucuaauuu

SEQ ID NO: 2497601 - RNA, 15 nt, Chlamydia trachomatis
auagaauuuuucuaa

SEQ ID NO: 2497602 - RNA, 18 nt, Chlamydia trachomatis
auagaauuuuucuaaaau

SEQ ID NO: 2497603 - RNA, 18 nt, Chlamydia trachomatis
auagacaacguuuaauga

SEQ ID NO: 2497604 - RNA, 14 nt, Chlamydia trachomatis
auagaccagagucu

SEQ ID NO: 2497605 - RNA, 13 nt, Chlamydia trachomatis
auagagaagaauu

SEQ ID NO: 2497606 - RNA, 22 nt, Chlamydia trachomatis
auagagauaucaaucguagaaa

SEQ ID NO: 2497607 - RNA, 12 nt, Chlamydia trachomatis
auagagcaaucu

SEQ ID NO: 2497608 - RNA, 20 nt, Chlamydia trachomatis
auagagcauaucaugugggu

SEQ ID NO: 2497609 - RNA, 19 nt, Chlamydia trachomatis
auagagccccuauguaaac

SEQ ID NO: 2497610 - RNA, 21 nt, Chlamydia trachomatis
auagagccccuauguaaacaa

SEQ ID NO: 2497611 - RNA, 20 nt, Chlamydia trachomatis
auagauaaguccaucuaaag

SEQ ID NO: 2497612 - RNA, 17 nt, Chlamydia trachomatis
auagauaggcaggaaga

SEQ ID NO: 2497613 - RNA, 22 nt, Chlamydia trachomatis
auagauauugccuacaagaccu

SEQ ID NO: 2497614 - RNA, 16 nt, Chlamydia trachomatis
auagaucaagaaaaga

SEQ ID NO: 2497615 - RNA, 15 nt, Chlamydia trachomatis
auagaucuaaagcag

SEQ ID NO: 2497616 - RNA, 13 nt, Chlamydia trachomatis
auagaucuacagc

SEQ ID NO: 2497617 - RNA, 13 nt, Chlamydia trachomatis
auagauuagaaga

SEQ ID NO: 2497618 - RNA, 16 nt, Chlamydia trachomatis
auagcaacucuuucau

SEQ ID NO: 2497619 - RNA, 17 nt, Chlamydia trachomatis
auagcaacugcuuucuu

SEQ ID NO: 2497620 - RNA, 13 nt, Chlamydia trachomatis
auagcaagcccuu

SEQ ID NO: 2497621 - RNA, 19 nt, Chlamydia trachomatis
auagcaauaauuuccccua

SEQ ID NO: 2497622 - RNA, 22 nt, Chlamydia trachomatis
auagcaaugcgaucagaaacgu

SEQ ID NO: 2497623 - RNA, 15 nt, Chlamydia trachomatis
auagcagggaacaca

SEQ ID NO: 2497624 - RNA, 16 nt, Chlamydia trachomatis
auagcagggaacacag

SEQ ID NO: 2497625 - RNA, 20 nt, Chlamydia trachomatis
auagcagugaaaucagagau

SEQ ID NO: 2497626 - RNA, 23 nt, Chlamydia trachomatis
auagcaucuucacaguucguugu

SEQ ID NO: 2497627 - RNA, 17 nt, Chlamydia trachomatis
auagcaugcaaaacagc

SEQ ID NO: 2497628 - RNA, 13 nt, Chlamydia trachomatis
auagccaaagguu

SEQ ID NO: 2497629 - RNA, 16 nt, Chlamydia trachomatis
auagccaaaugcaccu

SEQ ID NO: 2497630 - RNA, 19 nt, Chlamydia trachomatis
auagccacagcauacguua

SEQ ID NO: 2497631 - RNA, 17 nt, Chlamydia trachomatis
auagccauuaacaacaa

SEQ ID NO: 2497632 - RNA, 17 nt, Chlamydia trachomatis
auagccuccuuaaucaa

SEQ ID NO: 2497633 - RNA, 18 nt, Chlamydia trachomatis
auagccuuaauagugcgu

SEQ ID NO: 2497634 - RNA, 15 nt, Chlamydia trachomatis
auagcggguucuuuu

SEQ ID NO: 2497635 - RNA, 17 nt, Chlamydia trachomatis
auagcggguucuuuugc

SEQ ID NO: 2497636 - RNA, 13 nt, Chlamydia trachomatis
auagcuaaagcag

SEQ ID NO: 2497637 - RNA, 15 nt, Chlamydia trachomatis
auagcuagagcaugc

SEQ ID NO: 2497638 - RNA, 16 nt, Chlamydia trachomatis
auagcuauaaaauacg

SEQ ID NO: 2497639 - RNA, 21 nt, Chlamydia trachomatis
auagcucaguugguagagcaa

SEQ ID NO: 2497640 - RNA, 19 nt, Chlamydia trachomatis
auagcucugcagauuuugu

SEQ ID NO: 2497641 - RNA, 18 nt, Chlamydia trachomatis
auagcugacuuugaagau

SEQ ID NO: 2497642 - RNA, 17 nt, Chlamydia trachomatis
auagcuuaucuaggcuu

SEQ ID NO: 2497643 - RNA, 16 nt, Chlamydia trachomatis
auagcuucuaauuucu

SEQ ID NO: 2497644 - RNA, 18 nt, Chlamydia trachomatis
auagcuucuaauuucuuu

SEQ ID NO: 2497645 - RNA, 17 nt, Chlamydia trachomatis
auaggaaaaaagaagcu

SEQ ID NO: 2497646 - RNA, 13 nt, Chlamydia trachomatis
auaggaaaugaga

SEQ ID NO: 2497647 - RNA, 19 nt, Chlamydia trachomatis
auaggaauacgaaaugaca

SEQ ID NO: 2497648 - RNA, 12 nt, Chlamydia trachomatis
auaggagaggau

SEQ ID NO: 2497649 - RNA, 22 nt, Chlamydia trachomatis
auaggagaggauuaaggaauga

SEQ ID NO: 2497650 - RNA, 18 nt, Chlamydia trachomatis
auaggauaggaaaugaga

SEQ ID NO: 2497651 - RNA, 14 nt, Chlamydia trachomatis
auaggauuuaaacc

SEQ ID NO: 2497652 - RNA, 24 nt, Chlamydia trachomatis
auaggcaacuugagcaucuggagu

SEQ ID NO: 2497653 - RNA, 21 nt, Chlamydia trachomatis
auaggcauacaggagagacau

SEQ ID NO: 2497654 - RNA, 17 nt, Chlamydia trachomatis
auaggcgaucacgccuc

SEQ ID NO: 2497655 - RNA, 18 nt, Chlamydia trachomatis
auaggcuccugcaaggga

SEQ ID NO: 2497656 - RNA, 16 nt, Chlamydia trachomatis
auaggcuuccaaaucu

SEQ ID NO: 2497657 - RNA, 16 nt, Chlamydia trachomatis
auaggguccaaacaua

SEQ ID NO: 2497658 - RNA, 17 nt, Chlamydia trachomatis
auaggguccaaacauaa

SEQ ID NO: 2497659 - RNA, 15 nt, Chlamydia trachomatis
auagguucuauccau

SEQ ID NO: 2497660 - RNA, 14 nt, Chlamydia trachomatis
auaguaaaaacuau

SEQ ID NO: 2497661 - RNA, 21 nt, Chlamydia trachomatis
auaguaaaaacuauaaggaau

SEQ ID NO: 2497662 - RNA, 16 nt, Chlamydia trachomatis
auaguaccauaauccu

SEQ ID NO: 2497663 - RNA, 21 nt, Chlamydia trachomatis
auaguagagaauuagagauaa

SEQ ID NO: 2497664 - RNA, 19 nt, Chlamydia trachomatis
auaguauaacgauuaucca

SEQ ID NO: 2497665 - RNA, 13 nt, Chlamydia trachomatis
auaguauuuuuga

SEQ ID NO: 2497666 - RNA, 14 nt, Chlamydia trachomatis
auaguccaugugag

SEQ ID NO: 2497667 - RNA, 12 nt, Chlamydia trachomatis
auagucugcauu

SEQ ID NO: 2497668 - RNA, 22 nt, Chlamydia trachomatis
auagucugcauuaaacacuagc

SEQ ID NO: 2497669 - RNA, 21 nt, Chlamydia trachomatis
auagucugggcgaucuccuuc

SEQ ID NO: 2497670 - RNA, 12 nt, Chlamydia trachomatis
auagucuugcau

SEQ ID NO: 2497671 - RNA, 19 nt, Chlamydia trachomatis
auaguuacauacuuuucuc

SEQ ID NO: 2497672 - RNA, 16 nt, Chlamydia trachomatis
auaguuggugucuuug

SEQ ID NO: 2497673 - RNA, 15 nt, Chlamydia trachomatis
auaguuuaggcggca

SEQ ID NO: 2497674 - RNA, 18 nt, Chlamydia trachomatis
auaguuucgaguaauucc

SEQ ID NO: 2497675 - RNA, 23 nt, Chlamydia trachomatis
auauaaauuuggauuagaaaaag

SEQ ID NO: 2497676 - RNA, 13 nt, Chlamydia trachomatis
auauaagagaagg

SEQ ID NO: 2497677 - RNA, 22 nt, Chlamydia trachomatis
auauaagcuuggcgguuuuuuu

SEQ ID NO: 2497678 - RNA, 16 nt, Chlamydia trachomatis
auauacauauaaugcc

SEQ ID NO: 2497679 - RNA, 13 nt, Chlamydia trachomatis
auauacucagaga

SEQ ID NO: 2497680 - RNA, 21 nt, Chlamydia trachomatis
auauagccacgauaagaucuu

SEQ ID NO: 2497681 - RNA, 16 nt, Chlamydia trachomatis
auauaggcuuccaaau

SEQ ID NO: 2497682 - RNA, 18 nt, Chlamydia trachomatis
auauagguuccaucuaaa

SEQ ID NO: 2497683 - RNA, 18 nt, Chlamydia trachomatis
auauauucagaagaagag

SEQ ID NO: 2497684 - RNA, 17 nt, Chlamydia trachomatis
auauauuuaagaagcua

SEQ ID NO: 2497685 - RNA, 13 nt, Chlamydia trachomatis
auaucaagaauuu

SEQ ID NO: 2497686 - RNA, 18 nt, Chlamydia trachomatis
auauccauaacuuuaaua

SEQ ID NO: 2497687 - RNA, 14 nt, Chlamydia trachomatis
auauccaucauaaa

SEQ ID NO: 2497688 - RNA, 17 nt, Chlamydia trachomatis
auauccaucauaaaaag

SEQ ID NO: 2497689 - RNA, 21 nt, Chlamydia trachomatis
auauccaucauaaaaagauag

SEQ ID NO: 2497690 - RNA, 22 nt, Chlamydia trachomatis
auaucccacucuuccccuucuu

SEQ ID NO: 2497691 - RNA, 15 nt, Chlamydia trachomatis
auauccguaaggaag

SEQ ID NO: 2497692 - RNA, 20 nt, Chlamydia trachomatis
auauccguaaggaagccagc

SEQ ID NO: 2497693 - RNA, 23 nt, Chlamydia trachomatis
auauccugaaccgcgcgaaaauu

SEQ ID NO: 2497694 - RNA, 21 nt, Chlamydia trachomatis
auauccuuuuuacuaacuaaa

SEQ ID NO: 2497695 - RNA, 17 nt, Chlamydia trachomatis
auaucgcguccaaaaag

SEQ ID NO: 2497696 - RNA, 18 nt, Chlamydia trachomatis
auaucguaaccagcggca

SEQ ID NO: 2497697 - RNA, 13 nt, Chlamydia trachomatis
auaucuacuucuu

SEQ ID NO: 2497698 - RNA, 15 nt, Chlamydia trachomatis
auaucucaggauaaa

SEQ ID NO: 2497699 - RNA, 16 nt, Chlamydia trachomatis
auaucucaggauaaaa

SEQ ID NO: 2497700 - RNA, 22 nt, Chlamydia trachomatis
auaucugcagcggcgaaaauuu

SEQ ID NO: 2497701 - RNA, 20 nt, Chlamydia trachomatis
auaucuggauugugaagaac

SEQ ID NO: 2497702 - RNA, 19 nt, Chlamydia trachomatis
auaucuuuacucuuuucuu

SEQ ID NO: 2497703 - RNA, 20 nt, Chlamydia trachomatis
auaucuuuacucuuuucuuu

SEQ ID NO: 2497704 - RNA, 23 nt, Chlamydia trachomatis
auaugagccuugccuacagaauc

SEQ ID NO: 2497705 - RNA, 18 nt, Chlamydia trachomatis
auaugaguggcaaggggg

SEQ ID NO: 2497706 - RNA, 23 nt, Chlamydia trachomatis
auaugauuacuggauaguccuuc

SEQ ID NO: 2497707 - RNA, 15 nt, Chlamydia trachomatis
auaugcgucuucccu

SEQ ID NO: 2497708 - RNA, 18 nt, Chlamydia trachomatis
auaugcuuuuuaauaucc

SEQ ID NO: 2497709 - RNA, 19 nt, Chlamydia trachomatis
auauggaagaacagcagca

SEQ ID NO: 2497710 - RNA, 14 nt, Chlamydia trachomatis
auauguaagaagcu

SEQ ID NO: 2497711 - RNA, 13 nt, Chlamydia trachomatis
auauguugccacu

SEQ ID NO: 2497712 - RNA, 17 nt, Chlamydia trachomatis
auauuagauagcuucuu

SEQ ID NO: 2497713 - RNA, 16 nt, Chlamydia trachomatis
auauucagaagaagag

SEQ ID NO: 2497714 - RNA, 16 nt, Chlamydia trachomatis
auauuccaaagaaaug

SEQ ID NO: 2497715 - RNA, 19 nt, Chlamydia trachomatis
auauuccaaagaaauguug

SEQ ID NO: 2497716 - RNA, 20 nt, Chlamydia trachomatis
auauucuucuucugcaagag

SEQ ID NO: 2497717 - RNA, 21 nt, Chlamydia trachomatis
auauugaucuccccaucgaca

SEQ ID NO: 2497718 - RNA, 22 nt, Chlamydia trachomatis
auauugccaaaaagaaaaucag

SEQ ID NO: 2497719 - RNA, 21 nt, Chlamydia trachomatis
auauugcucuaaagucuuucc

SEQ ID NO: 2497720 - RNA, 12 nt, Chlamydia trachomatis
auauugcuucau

SEQ ID NO: 2497721 - RNA, 19 nt, Chlamydia trachomatis
auauugcuucauaaaaaag

SEQ ID NO: 2497722 - RNA, 21 nt, Chlamydia trachomatis
auauuggaagauaacaauccu

SEQ ID NO: 2497723 - RNA, 22 nt, Chlamydia trachomatis
auauuggcaccauccauagugc

SEQ ID NO: 2497724 - RNA, 14 nt, Chlamydia trachomatis
auauuuuuucccuu

SEQ ID NO: 2497725 - RNA, 22 nt, Chlamydia trachomatis
aucaaaaaguucucucccuucc

SEQ ID NO: 2497726 - RNA, 22 nt, Chlamydia trachomatis
aucaaaaucaauaaugucucca

SEQ ID NO: 2497727 - RNA, 15 nt, Chlamydia trachomatis
aucaaacagaaccuu

SEQ ID NO: 2497728 - RNA, 22 nt, Chlamydia trachomatis
aucaaacagaaccuuuuuaaaa

SEQ ID NO: 2497729 - RNA, 13 nt, Chlamydia trachomatis
aucaaaccaaaaa

SEQ ID NO: 2497730 - RNA, 16 nt, Chlamydia trachomatis
aucaaaccaaaaauau

SEQ ID NO: 2497731 - RNA, 19 nt, Chlamydia trachomatis
aucaaacucuuuuucagac

SEQ ID NO: 2497732 - RNA, 20 nt, Chlamydia trachomatis
aucaaacucuuuuucagaca

SEQ ID NO: 2497733 - RNA, 19 nt, Chlamydia trachomatis
aucaaagaaucuuugucuu

SEQ ID NO: 2497734 - RNA, 15 nt, Chlamydia trachomatis
aucaaagacuucacu

SEQ ID NO: 2497735 - RNA, 17 nt, Chlamydia trachomatis
aucaaagagugugcuuc

SEQ ID NO: 2497736 - RNA, 13 nt, Chlamydia trachomatis
aucaaagaucuuu

SEQ ID NO: 2497737 - RNA, 20 nt, Chlamydia trachomatis
aucaaaggaugucuaucuag

SEQ ID NO: 2497738 - RNA, 20 nt, Chlamydia trachomatis
aucaaaguacgccucuuuug

SEQ ID NO: 2497739 - RNA, 16 nt, Chlamydia trachomatis
aucaaauuucuucgau

SEQ ID NO: 2497740 - RNA, 20 nt, Chlamydia trachomatis
aucaaauuuuucagaaaaag

SEQ ID NO: 2497741 - RNA, 20 nt, Chlamydia trachomatis
aucaacaagauuuuuuacaa

SEQ ID NO: 2497742 - RNA, 19 nt, Chlamydia trachomatis
aucaaccaggucacauuuu

SEQ ID NO: 2497743 - RNA, 13 nt, Chlamydia trachomatis
aucaacuguucug

SEQ ID NO: 2497744 - RNA, 14 nt, Chlamydia trachomatis
aucaagaaucgcuu

SEQ ID NO: 2497745 - RNA, 16 nt, Chlamydia trachomatis
aucaagaaucgcuuug

SEQ ID NO: 2497746 - RNA, 22 nt, Chlamydia trachomatis
aucaagagaaaucagaugccau

SEQ ID NO: 2497747 - RNA, 19 nt, Chlamydia trachomatis
aucaaguauugugccaccg

SEQ ID NO: 2497748 - RNA, 23 nt, Chlamydia trachomatis
aucaauaaccugaagauuuuuua

SEQ ID NO: 2497749 - RNA, 19 nt, Chlamydia trachomatis
aucaauaccuagcaauuca

SEQ ID NO: 2497750 - RNA, 20 nt, Chlamydia trachomatis
aucaauauucgcaauauaga

SEQ ID NO: 2497751 - RNA, 20 nt, Chlamydia trachomatis
aucaaucguagaaaaccgaa

SEQ ID NO: 2497752 - RNA, 13 nt, Chlamydia trachomatis
aucaaugauguag

SEQ ID NO: 2497753 - RNA, 17 nt, Chlamydia trachomatis
aucaauuguucugcgaa

SEQ ID NO: 2497754 - RNA, 19 nt, Chlamydia trachomatis
aucacaaugcguagucucu

SEQ ID NO: 2497755 - RNA, 14 nt, Chlamydia trachomatis
aucacaauuuuucu

SEQ ID NO: 2497756 - RNA, 17 nt, Chlamydia trachomatis
aucacacgggucucuau

SEQ ID NO: 2497757 - RNA, 20 nt, Chlamydia trachomatis
aucacacgggucucuauauc

SEQ ID NO: 2497758 - RNA, 14 nt, Chlamydia trachomatis
aucacagaaacuuc

SEQ ID NO: 2497759 - RNA, 20 nt, Chlamydia trachomatis
aucacagaaacuucuucuaa

SEQ ID NO: 2497760 - RNA, 13 nt, Chlamydia trachomatis
aucacagcaauag

SEQ ID NO: 2497761 - RNA, 14 nt, Chlamydia trachomatis
aucacaugguuuuc

SEQ ID NO: 2497762 - RNA, 22 nt, Chlamydia trachomatis
aucacauucuuagauuuucaug

SEQ ID NO: 2497763 - RNA, 15 nt, Chlamydia trachomatis
aucaccacgagaucu

SEQ ID NO: 2497764 - RNA, 15 nt, Chlamydia trachomatis
aucaccacuaauccc

SEQ ID NO: 2497765 - RNA, 15 nt, Chlamydia trachomatis
aucaccgaacaaccu

SEQ ID NO: 2497766 - RNA, 20 nt, Chlamydia trachomatis
aucaccgaacaaccuucuga

SEQ ID NO: 2497767 - RNA, 21 nt, Chlamydia trachomatis
aucacggaaacugcaaggaug

SEQ ID NO: 2497768 - RNA, 16 nt, Chlamydia trachomatis
aucacuccaagaagag

SEQ ID NO: 2497769 - RNA, 13 nt, Chlamydia trachomatis
aucacuccuccuc

SEQ ID NO: 2497770 - RNA, 23 nt, Chlamydia trachomatis
aucacuccuccuccuaaacaaau

SEQ ID NO: 2497771 - RNA, 23 nt, Chlamydia trachomatis
aucacugagaggaguuuuuuuca

SEQ ID NO: 2497772 - RNA, 15 nt, Chlamydia trachomatis
aucacugcaacuaau

SEQ ID NO: 2497773 - RNA, 19 nt, Chlamydia trachomatis
aucacugcaacuaauauua

SEQ ID NO: 2497774 - RNA, 17 nt, Chlamydia trachomatis
aucacuguugagaaaaa

SEQ ID NO: 2497775 - RNA, 12 nt, Chlamydia trachomatis
aucacuuucugc

SEQ ID NO: 2497776 - RNA, 14 nt, Chlamydia trachomatis
aucagaccuuuugu

SEQ ID NO: 2497777 - RNA, 14 nt, Chlamydia trachomatis
aucagagcaauaga

SEQ ID NO: 2497778 - RNA, 18 nt, Chlamydia trachomatis
aucagagggacgagcagc

SEQ ID NO: 2497779 - RNA, 15 nt, Chlamydia trachomatis
aucagcaaaugugga

SEQ ID NO: 2497780 - RNA, 23 nt, Chlamydia trachomatis
aucagcacagcggacaauaggag

SEQ ID NO: 2497781 - RNA, 14 nt, Chlamydia trachomatis
aucagccccaaaaa

SEQ ID NO: 2497782 - RNA, 22 nt, Chlamydia trachomatis
aucagccccaaaaacagcagaa

SEQ ID NO: 2497783 - RNA, 17 nt, Chlamydia trachomatis
aucagcgucaucuuuga

SEQ ID NO: 2497784 - RNA, 16 nt, Chlamydia trachomatis
aucagcuccuaucacu

SEQ ID NO: 2497785 - RNA, 16 nt, Chlamydia trachomatis
aucagcuuuuccacau

SEQ ID NO: 2497786 - RNA, 19 nt, Chlamydia trachomatis
aucaggaauauuaagaucc

SEQ ID NO: 2497787 - RNA, 12 nt, Chlamydia trachomatis
aucaguaaaaau

SEQ ID NO: 2497788 - RNA, 17 nt, Chlamydia trachomatis
aucaguguacccucgau

SEQ ID NO: 2497789 - RNA, 18 nt, Chlamydia trachomatis
aucauaaagucuaccagu

SEQ ID NO: 2497790 - RNA, 20 nt, Chlamydia trachomatis
aucauaacaugguugauuug

SEQ ID NO: 2497791 - RNA, 15 nt, Chlamydia trachomatis
aucauagccaucauc

SEQ ID NO: 2497792 - RNA, 17 nt, Chlamydia trachomatis
aucauaggcuccugcaa

SEQ ID NO: 2497793 - RNA, 22 nt, Chlamydia trachomatis
aucauaucaagaauuucuugaa

SEQ ID NO: 2497794 - RNA, 22 nt, Chlamydia trachomatis
aucaucaaccgcgacagccaca

SEQ ID NO: 2497795 - RNA, 22 nt, Chlamydia trachomatis
aucauccauaaaaacugcugcu

SEQ ID NO: 2497796 - RNA, 24 nt, Chlamydia trachomatis
aucaucucucagcagaucauccau

SEQ ID NO: 2497797 - RNA, 18 nt, Chlamydia trachomatis
aucaucuucaagagcugu

SEQ ID NO: 2497798 - RNA, 17 nt, Chlamydia trachomatis
aucaucuucccaagacu

SEQ ID NO: 2497799 - RNA, 19 nt, Chlamydia trachomatis
aucaucuucccaagacuca

SEQ ID NO: 2497800 - RNA, 15 nt, Chlamydia trachomatis
aucaugaugaugaga

SEQ ID NO: 2497801 - RNA, 19 nt, Chlamydia trachomatis
aucauggaaaauauggcuc

SEQ ID NO: 2497802 - RNA, 16 nt, Chlamydia trachomatis
aucaugggaaauaaau

SEQ ID NO: 2497803 - RNA, 16 nt, Chlamydia trachomatis
aucaugguugcuguug

SEQ ID NO: 2497804 - RNA, 22 nt, Chlamydia trachomatis
aucauguuaaggccgagaauuu

SEQ ID NO: 2497805 - RNA, 14 nt, Chlamydia trachomatis
aucauguugcguuu

SEQ ID NO: 2497806 - RNA, 21 nt, Chlamydia trachomatis
aucauuaauuagaauuuccag

SEQ ID NO: 2497807 - RNA, 19 nt, Chlamydia trachomatis
aucauuauccauaaaaaua

SEQ ID NO: 2497808 - RNA, 16 nt, Chlamydia trachomatis
aucauucaaaauccau

SEQ ID NO: 2497809 - RNA, 22 nt, Chlamydia trachomatis
aucauucuuagugaaugcucca

SEQ ID NO: 2497810 - RNA, 18 nt, Chlamydia trachomatis
aucauugggucugaucca

SEQ ID NO: 2497811 - RNA, 11 nt, Chlamydia trachomatis
aucauuuccaa

SEQ ID NO: 2497812 - RNA, 23 nt, Chlamydia trachomatis
auccaaaaaagaaucuaaaaagc

SEQ ID NO: 2497813 - RNA, 13 nt, Chlamydia trachomatis
auccaaaaaagug

SEQ ID NO: 2497814 - RNA, 19 nt, Chlamydia trachomatis
auccaaaaauugaaagaga

SEQ ID NO: 2497815 - RNA, 14 nt, Chlamydia trachomatis
auccaaaacauaag

SEQ ID NO: 2497816 - RNA, 22 nt, Chlamydia trachomatis
auccaaaacaucccagcaauac

SEQ ID NO: 2497817 - RNA, 23 nt, Chlamydia trachomatis
auccaaaaggauggcgguguuuc

SEQ ID NO: 2497818 - RNA, 15 nt, Chlamydia trachomatis
auccaaaguacucag

SEQ ID NO: 2497819 - RNA, 23 nt, Chlamydia trachomatis
auccaaauaaacacacuggguau

SEQ ID NO: 2497820 - RNA, 15 nt, Chlamydia trachomatis
auccaagcacuccuc

SEQ ID NO: 2497821 - RNA, 15 nt, Chlamydia trachomatis
auccacgaauuuucu

SEQ ID NO: 2497822 - RNA, 19 nt, Chlamydia trachomatis
auccacuggaauagcuaga

SEQ ID NO: 2497823 - RNA, 23 nt, Chlamydia trachomatis
auccagacaauggucuccuaaau

SEQ ID NO: 2497824 - RNA, 14 nt, Chlamydia trachomatis
auccagagcugugu

SEQ ID NO: 2497825 - RNA, 20 nt, Chlamydia trachomatis
auccagauccguuaaagagu

SEQ ID NO: 2497826 - RNA, 18 nt, Chlamydia trachomatis
auccagcucgaucaauaa

SEQ ID NO: 2497827 - RNA, 16 nt, Chlamydia trachomatis
auccagcugcugccca

SEQ ID NO: 2497828 - RNA, 22 nt, Chlamydia trachomatis
auccagcugcugcccaagagau

SEQ ID NO: 2497829 - RNA, 17 nt, Chlamydia trachomatis
auccaggagauguagga

SEQ ID NO: 2497830 - RNA, 14 nt, Chlamydia trachomatis
auccauaaaaacug

SEQ ID NO: 2497831 - RNA, 15 nt, Chlamydia trachomatis
auccauaaaaacugc

SEQ ID NO: 2497832 - RNA, 18 nt, Chlamydia trachomatis
auccauaacgaagauuaa

SEQ ID NO: 2497833 - RNA, 14 nt, Chlamydia trachomatis
auccaucauaaaaa

SEQ ID NO: 2497834 - RNA, 23 nt, Chlamydia trachomatis
auccauguuucgccaaugaucuu

SEQ ID NO: 2497835 - RNA, 19 nt, Chlamydia trachomatis
auccauucgcauuaaauaa

SEQ ID NO: 2497836 - RNA, 19 nt, Chlamydia trachomatis
auccauuuacgagguagcc

SEQ ID NO: 2497837 - RNA, 15 nt, Chlamydia trachomatis
aucccaaaagaauga

SEQ ID NO: 2497838 - RNA, 18 nt, Chlamydia trachomatis
aucccaaaccuccuaaau

SEQ ID NO: 2497839 - RNA, 15 nt, Chlamydia trachomatis
aucccaacaggagau

SEQ ID NO: 2497840 - RNA, 14 nt, Chlamydia trachomatis
aucccacaaagaaa

SEQ ID NO: 2497841 - RNA, 15 nt, Chlamydia trachomatis
aucccacaugcuagu

SEQ ID NO: 2497842 - RNA, 14 nt, Chlamydia trachomatis
aucccagaauaaag

SEQ ID NO: 2497843 - RNA, 12 nt, Chlamydia trachomatis
aucccagcaaua

SEQ ID NO: 2497844 - RNA, 19 nt, Chlamydia trachomatis
aucccagccugugcauuug

SEQ ID NO: 2497845 - RNA, 18 nt, Chlamydia trachomatis
aucccagggagagagagc

SEQ ID NO: 2497846 - RNA, 17 nt, Chlamydia trachomatis
aucccauccuuuaucuu

SEQ ID NO: 2497847 - RNA, 20 nt, Chlamydia trachomatis
auccccaaaccaguuucuuc

SEQ ID NO: 2497848 - RNA, 21 nt, Chlamydia trachomatis
auccccaaaccaguuucuucu

SEQ ID NO: 2497849 - RNA, 16 nt, Chlamydia trachomatis
auccccagaagccaua

SEQ ID NO: 2497850 - RNA, 15 nt, Chlamydia trachomatis
auccccaucucuuuu

SEQ ID NO: 2497851 - RNA, 19 nt, Chlamydia trachomatis
auccccccuacauuguaaa

SEQ ID NO: 2497852 - RNA, 15 nt, Chlamydia trachomatis
aucccccuucuggau

SEQ ID NO: 2497853 - RNA, 18 nt, Chlamydia trachomatis
aucccgcgguagaaaguc

SEQ ID NO: 2497854 - RNA, 12 nt, Chlamydia trachomatis
aucccguucuug

SEQ ID NO: 2497855 - RNA, 22 nt, Chlamydia trachomatis
aucccuaguacaaaaauacuug

SEQ ID NO: 2497856 - RNA, 19 nt, Chlamydia trachomatis
aucccuugcaaaaaucucu

SEQ ID NO: 2497857 - RNA, 14 nt, Chlamydia trachomatis
aucccuuucauucu

SEQ ID NO: 2497858 - RNA, 12 nt, Chlamydia trachomatis
aucccuuuccaa

SEQ ID NO: 2497859 - RNA, 22 nt, Chlamydia trachomatis
aucccuuuccaagaaucaaaaa

SEQ ID NO: 2497860 - RNA, 16 nt, Chlamydia trachomatis
aucccuuuuucaagaa

SEQ ID NO: 2497861 - RNA, 16 nt, Chlamydia trachomatis
auccgagcauuuucca

SEQ ID NO: 2497862 - RNA, 15 nt, Chlamydia trachomatis
auccgcagagaugau

SEQ ID NO: 2497863 - RNA, 16 nt, Chlamydia trachomatis
auccgcagagaugaua

SEQ ID NO: 2497864 - RNA, 18 nt, Chlamydia trachomatis
auccgcaguaaaaucuaa

SEQ ID NO: 2497865 - RNA, 14 nt, Chlamydia trachomatis
auccgcuucuucau

SEQ ID NO: 2497866 - RNA, 14 nt, Chlamydia trachomatis
auccgguucuuuug

SEQ ID NO: 2497867 - RNA, 14 nt, Chlamydia trachomatis
auccguaaggaagc

SEQ ID NO: 2497868 - RNA, 15 nt, Chlamydia trachomatis
auccguaaggaagcc

SEQ ID NO: 2497869 - RNA, 20 nt, Chlamydia trachomatis
auccguaaggaagccagccc

SEQ ID NO: 2497870 - RNA, 22 nt, Chlamydia trachomatis
auccguaaggaagccagccccu

SEQ ID NO: 2497871 - RNA, 17 nt, Chlamydia trachomatis
auccguaugauaaaacu

SEQ ID NO: 2497872 - RNA, 15 nt, Chlamydia trachomatis
auccuaacuaaaaag

SEQ ID NO: 2497873 - RNA, 20 nt, Chlamydia trachomatis
auccuaacuguacacagggu

SEQ ID NO: 2497874 - RNA, 13 nt, Chlamydia trachomatis
auccuacagcaga

SEQ ID NO: 2497875 - RNA, 22 nt, Chlamydia trachomatis
auccuagagacggucuacaaau

SEQ ID NO: 2497876 - RNA, 19 nt, Chlamydia trachomatis
auccuauacccgacuaaaa

SEQ ID NO: 2497877 - RNA, 22 nt, Chlamydia trachomatis
auccucaaaaaaggcauaaaag

SEQ ID NO: 2497878 - RNA, 13 nt, Chlamydia trachomatis
auccucagggcug

SEQ ID NO: 2497879 - RNA, 18 nt, Chlamydia trachomatis
auccucaucuagcuaaag

SEQ ID NO: 2497880 - RNA, 15 nt, Chlamydia trachomatis
auccuccauaguuac

SEQ ID NO: 2497881 - RNA, 15 nt, Chlamydia trachomatis
auccugcuugaagua

SEQ ID NO: 2497882 - RNA, 14 nt, Chlamydia trachomatis
auccuggaaucaca

SEQ ID NO: 2497883 - RNA, 21 nt, Chlamydia trachomatis
auccuggaguauuuucaaaaa

SEQ ID NO: 2497884 - RNA, 18 nt, Chlamydia trachomatis
auccuguggucacaagaa

SEQ ID NO: 2497885 - RNA, 12 nt, Chlamydia trachomatis
auccuuaaacuc

SEQ ID NO: 2497886 - RNA, 22 nt, Chlamydia trachomatis
auccuucgccgggggagccaaa

SEQ ID NO: 2497887 - RNA, 13 nt, Chlamydia trachomatis
auccuucugccuc

SEQ ID NO: 2497888 - RNA, 20 nt, Chlamydia trachomatis
auccuugaaccaaacgauua

SEQ ID NO: 2497889 - RNA, 12 nt, Chlamydia trachomatis
auccuugcccaa

SEQ ID NO: 2497890 - RNA, 23 nt, Chlamydia trachomatis
auccuugcuaggagguuucaggg

SEQ ID NO: 2497891 - RNA, 19 nt, Chlamydia trachomatis
auccuuuauggguagcgau

SEQ ID NO: 2497892 - RNA, 17 nt, Chlamydia trachomatis
auccuuucgucacagau

SEQ ID NO: 2497893 - RNA, 15 nt, Chlamydia trachomatis
auccuuuucagaauu

SEQ ID NO: 2497894 - RNA, 22 nt, Chlamydia trachomatis
auccuuuuggaagaucucuuuc

SEQ ID NO: 2497895 - RNA, 16 nt, Chlamydia trachomatis
aucgaaaacaaagagu

SEQ ID NO: 2497896 - RNA, 17 nt, Chlamydia trachomatis
aucgaaaauagauuuuc

SEQ ID NO: 2497897 - RNA, 15 nt, Chlamydia trachomatis
aucgaaaguaaaauu

SEQ ID NO: 2497898 - RNA, 14 nt, Chlamydia trachomatis
aucgaauuacucug

SEQ ID NO: 2497899 - RNA, 12 nt, Chlamydia trachomatis
aucgagaaaaug

SEQ ID NO: 2497900 - RNA, 18 nt, Chlamydia trachomatis
aucgagcaaccagcgcau

SEQ ID NO: 2497901 - RNA, 16 nt, Chlamydia trachomatis
aucgaggugauuuucu

SEQ ID NO: 2497902 - RNA, 20 nt, Chlamydia trachomatis
aucgaggugguauagaggaa

SEQ ID NO: 2497903 - RNA, 19 nt, Chlamydia trachomatis
aucgauaccuauuccaaau

SEQ ID NO: 2497904 - RNA, 19 nt, Chlamydia trachomatis
aucgaugauaucuucugaa

SEQ ID NO: 2497905 - RNA, 15 nt, Chlamydia trachomatis
aucgcaccauuuaau

SEQ ID NO: 2497906 - RNA, 18 nt, Chlamydia trachomatis
aucgcagcuucggaagga

SEQ ID NO: 2497907 - RNA, 14 nt, Chlamydia trachomatis
aucgccgguuaaca

SEQ ID NO: 2497908 - RNA, 17 nt, Chlamydia trachomatis
aucgccuauagaagacu

SEQ ID NO: 2497909 - RNA, 23 nt, Chlamydia trachomatis
aucgccuucuauagcuaaagcag

SEQ ID NO: 2497910 - RNA, 20 nt, Chlamydia trachomatis
aucgcggcuaucgucuuuaa

SEQ ID NO: 2497911 - RNA, 22 nt, Chlamydia trachomatis
aucgcuauuuccccuacaaaca

SEQ ID NO: 2497912 - RNA, 15 nt, Chlamydia trachomatis
aucgcuugaaaagaa

SEQ ID NO: 2497913 - RNA, 17 nt, Chlamydia trachomatis
aucgcuugaaaagaacc

SEQ ID NO: 2497914 - RNA, 16 nt, Chlamydia trachomatis
aucggacccaugaaca

SEQ ID NO: 2497915 - RNA, 17 nt, Chlamydia trachomatis
aucggauagagaagaau

SEQ ID NO: 2497916 - RNA, 19 nt, Chlamydia trachomatis
aucggauagagaagaauug

SEQ ID NO: 2497917 - RNA, 22 nt, Chlamydia trachomatis
aucggcaaaagaucucauagca

SEQ ID NO: 2497918 - RNA, 15 nt, Chlamydia trachomatis
aucguaaaauagcac

SEQ ID NO: 2497919 - RNA, 15 nt, Chlamydia trachomatis
aucguaaacaaccaa

SEQ ID NO: 2497920 - RNA, 20 nt, Chlamydia trachomatis
aucuaaaaaaauucuugcca

SEQ ID NO: 2497921 - RNA, 16 nt, Chlamydia trachomatis
aucuaaaauuuccuua

SEQ ID NO: 2497922 - RNA, 13 nt, Chlamydia trachomatis
aucuaaagaaaug

SEQ ID NO: 2497923 - RNA, 17 nt, Chlamydia trachomatis
aucuaaggaauguggag

SEQ ID NO: 2497924 - RNA, 19 nt, Chlamydia trachomatis
aucuaauuuuagauaaaag

SEQ ID NO: 2497925 - RNA, 14 nt, Chlamydia trachomatis
aucuacaaaaccaa

SEQ ID NO: 2497926 - RNA, 15 nt, Chlamydia trachomatis
aucuacaaaaccaaa

SEQ ID NO: 2497927 - RNA, 21 nt, Chlamydia trachomatis
aucuacaaaaccaaaaucgua

SEQ ID NO: 2497928 - RNA, 21 nt, Chlamydia trachomatis
aucuacaccauuacgaggaag

SEQ ID NO: 2497929 - RNA, 23 nt, Chlamydia trachomatis
aucuacacgcucaggcuaucaca

SEQ ID NO: 2497930 - RNA, 14 nt, Chlamydia trachomatis
aucuaccuuuuucc

SEQ ID NO: 2497931 - RNA, 15 nt, Chlamydia trachomatis
aucuaccuuuuuccc

SEQ ID NO: 2497932 - RNA, 13 nt, Chlamydia trachomatis
aucuagaaaagag

SEQ ID NO: 2497933 - RNA, 15 nt, Chlamydia trachomatis
aucuagaaaagagca

SEQ ID NO: 2497934 - RNA, 16 nt, Chlamydia trachomatis
aucuagaaaagagcag

SEQ ID NO: 2497935 - RNA, 14 nt, Chlamydia trachomatis
aucuagacaaucug

SEQ ID NO: 2497936 - RNA, 14 nt, Chlamydia trachomatis
aucuagacauagcu

SEQ ID NO: 2497937 - RNA, 21 nt, Chlamydia trachomatis
aucuagagguauuuuauucaa

SEQ ID NO: 2497938 - RNA, 20 nt, Chlamydia trachomatis
aucuagguugaagaggcaag

SEQ ID NO: 2497939 - RNA, 20 nt, Chlamydia trachomatis
aucuauaaucuauuuuauac

SEQ ID NO: 2497940 - RNA, 18 nt, Chlamydia trachomatis
aucuaucaacuuuacaua

SEQ ID NO: 2497941 - RNA, 18 nt, Chlamydia trachomatis
aucuauccauaauuuucu

SEQ ID NO: 2497942 - RNA, 19 nt, Chlamydia trachomatis
aucuaucgcuugaaaagaa

SEQ ID NO: 2497943 - RNA, 13 nt, Chlamydia trachomatis
aucuaucuuucuu

SEQ ID NO: 2497944 - RNA, 14 nt, Chlamydia trachomatis
aucuaugaaaaaag

SEQ ID NO: 2497945 - RNA, 16 nt, Chlamydia trachomatis
aucuaugaaaaaagcu

SEQ ID NO: 2497946 - RNA, 18 nt, Chlamydia trachomatis
aucuauuuuauacuucuu

SEQ ID NO: 2497947 - RNA, 19 nt, Chlamydia trachomatis
aucuauuuuauacuucuua

SEQ ID NO: 2497948 - RNA, 16 nt, Chlamydia trachomatis
aucuauuuucucuuua

SEQ ID NO: 2497949 - RNA, 17 nt, Chlamydia trachomatis
aucuccaaaauucugua

SEQ ID NO: 2497950 - RNA, 16 nt, Chlamydia trachomatis
aucuccaaagacacac

SEQ ID NO: 2497951 - RNA, 16 nt, Chlamydia trachomatis
aucuccaaucacagca

SEQ ID NO: 2497952 - RNA, 18 nt, Chlamydia trachomatis
aucuccaaucacagcaau

SEQ ID NO: 2497953 - RNA, 14 nt, Chlamydia trachomatis
aucuccagaaauaa

SEQ ID NO: 2497954 - RNA, 12 nt, Chlamydia trachomatis
aucucccgaaac

SEQ ID NO: 2497955 - RNA, 15 nt, Chlamydia trachomatis
aucucccgaaacauu

SEQ ID NO: 2497956 - RNA, 16 nt, Chlamydia trachomatis
aucuccgcuaggcaaa

SEQ ID NO: 2497957 - RNA, 13 nt, Chlamydia trachomatis
aucuccuaagaca

SEQ ID NO: 2497958 - RNA, 22 nt, Chlamydia trachomatis
aucuccuauugagcgcaaagcg

SEQ ID NO: 2497959 - RNA, 17 nt, Chlamydia trachomatis
aucuccucauccuuuug

SEQ ID NO: 2497960 - RNA, 13 nt, Chlamydia trachomatis
aucuccugcagcu

SEQ ID NO: 2497961 - RNA, 14 nt, Chlamydia trachomatis
aucuccugcagcua

SEQ ID NO: 2497962 - RNA, 15 nt, Chlamydia trachomatis
aucuccuuaauugga

SEQ ID NO: 2497963 - RNA, 15 nt, Chlamydia trachomatis
aucuccuuccucuuu

SEQ ID NO: 2497964 - RNA, 18 nt, Chlamydia trachomatis
aucuccuucucagagcuu

SEQ ID NO: 2497965 - RNA, 19 nt, Chlamydia trachomatis
aucucgagcuaagaaaaua

SEQ ID NO: 2497966 - RNA, 20 nt, Chlamydia trachomatis
aucucgagcuaagaaaauaa

SEQ ID NO: 2497967 - RNA, 14 nt, Chlamydia trachomatis
aucucgguauucuc

SEQ ID NO: 2497968 - RNA, 17 nt, Chlamydia trachomatis
aucucgguauucucaau

SEQ ID NO: 2497969 - RNA, 19 nt, Chlamydia trachomatis
aucucggucuuagaaggau

SEQ ID NO: 2497970 - RNA, 17 nt, Chlamydia trachomatis
aucucguuucuguuaca

SEQ ID NO: 2497971 - RNA, 15 nt, Chlamydia trachomatis
aucucuaccagggau

SEQ ID NO: 2497972 - RNA, 16 nt, Chlamydia trachomatis
aucucucagcagauca

SEQ ID NO: 2497973 - RNA, 19 nt, Chlamydia trachomatis
aucucucagcagaucaucc

SEQ ID NO: 2497974 - RNA, 13 nt, Chlamydia trachomatis
aucucuggaaaag

SEQ ID NO: 2497975 - RNA, 22 nt, Chlamydia trachomatis
aucucugguaaaaauagaaaac

SEQ ID NO: 2497976 - RNA, 23 nt, Chlamydia trachomatis
aucucugguaaaaauagaaaacg

SEQ ID NO: 2497977 - RNA, 18 nt, Chlamydia trachomatis
aucucuuccuuguagaaa

SEQ ID NO: 2497978 - RNA, 19 nt, Chlamydia trachomatis
aucucuuggagagaaugaa

SEQ ID NO: 2497979 - RNA, 22 nt, Chlamydia trachomatis
aucucuuggagagaaugaagaa

SEQ ID NO: 2497980 - RNA, 14 nt, Chlamydia trachomatis
aucucuuucucuag

SEQ ID NO: 2497981 - RNA, 23 nt, Chlamydia trachomatis
aucucuuucucuagaauuucccu

SEQ ID NO: 2497982 - RNA, 21 nt, Chlamydia trachomatis
aucucuuuuaccucuaacagu

SEQ ID NO: 2497983 - RNA, 18 nt, Chlamydia trachomatis
aucucuuuuuacaacucu

SEQ ID NO: 2497984 - RNA, 16 nt, Chlamydia trachomatis
aucugaaaagagaaga

SEQ ID NO: 2497985 - RNA, 20 nt, Chlamydia trachomatis
aucugaaaagagaagaaggc

SEQ ID NO: 2497986 - RNA, 23 nt, Chlamydia trachomatis
aucugaaucuguguugcaaagag

SEQ ID NO: 2497987 - RNA, 14 nt, Chlamydia trachomatis
aucugauaggaaua

SEQ ID NO: 2497988 - RNA, 22 nt, Chlamydia trachomatis
aucugauguuccaucuuuucgg

SEQ ID NO: 2497989 - RNA, 18 nt, Chlamydia trachomatis
aucugcaucuuuauagaa

SEQ ID NO: 2497990 - RNA, 22 nt, Chlamydia trachomatis
aucugcgacgagguuuuuucuu

SEQ ID NO: 2497991 - RNA, 23 nt, Chlamydia trachomatis
aucugcgacgagguuuuuucuuc

SEQ ID NO: 2497992 - RNA, 23 nt, Chlamydia trachomatis
aucugcgguauccauacgaaaga

SEQ ID NO: 2497993 - RNA, 16 nt, Chlamydia trachomatis
aucugcugagagauga

SEQ ID NO: 2497994 - RNA, 23 nt, Chlamydia trachomatis
aucugcuuccguaacaauauuac

SEQ ID NO: 2497995 - RNA, 19 nt, Chlamydia trachomatis
aucuggcugaagaaguuga

SEQ ID NO: 2497996 - RNA, 16 nt, Chlamydia trachomatis
aucugggauggaaaua

SEQ ID NO: 2497997 - RNA, 14 nt, Chlamydia trachomatis
aucugguauucuaa

SEQ ID NO: 2497998 - RNA, 13 nt, Chlamydia trachomatis
aucuguaaagcuu

SEQ ID NO: 2497999 - RNA, 22 nt, Chlamydia trachomatis
aucuguaacuacaucuaaaaga

SEQ ID NO: 2498000 - RNA, 16 nt, Chlamydia trachomatis
aucuguaauaaacccu

SEQ ID NO: 2498001 - RNA, 20 nt, Chlamydia trachomatis
aucuguaauaaacccuggau

SEQ ID NO: 2498002 - RNA, 10 nt, Chlamydia trachomatis
aucuguagca

SEQ ID NO: 2498003 - RNA, 23 nt, Chlamydia trachomatis
aucuguaggggagggacuucuuc

SEQ ID NO: 2498004 - RNA, 19 nt, Chlamydia trachomatis
aucuguauccuaacuaaaa

SEQ ID NO: 2498005 - RNA, 13 nt, Chlamydia trachomatis
aucuguccaaaga

SEQ ID NO: 2498006 - RNA, 17 nt, Chlamydia trachomatis
aucugucuaagauuuuc

SEQ ID NO: 2498007 - RNA, 22 nt, Chlamydia trachomatis
aucugucuaagauuuucaucuu

SEQ ID NO: 2498008 - RNA, 12 nt, Chlamydia trachomatis
aucugugauaac

SEQ ID NO: 2498009 - RNA, 20 nt, Chlamydia trachomatis
aucugugccagcugcugcuu

SEQ ID NO: 2498010 - RNA, 19 nt, Chlamydia trachomatis
aucuguuagugaagagcag

SEQ ID NO: 2498011 - RNA, 14 nt, Chlamydia trachomatis
aucuguucagaacu

SEQ ID NO: 2498012 - RNA, 21 nt, Chlamydia trachomatis
aucuguucagaacucaaaaua

SEQ ID NO: 2498013 - RNA, 23 nt, Chlamydia trachomatis
aucuguugucgauuuuuaaaaga

SEQ ID NO: 2498014 - RNA, 12 nt, Chlamydia trachomatis
aucuucaaagaa

SEQ ID NO: 2498015 - RNA, 18 nt, Chlamydia trachomatis
aucuucaacccuuuuaau

SEQ ID NO: 2498016 - RNA, 17 nt, Chlamydia trachomatis
aucuucaauccacugca

SEQ ID NO: 2498017 - RNA, 17 nt, Chlamydia trachomatis
aucuucaccccuuacaa

SEQ ID NO: 2498018 - RNA, 19 nt, Chlamydia trachomatis
aucuucaccccuuacaaug

SEQ ID NO: 2498019 - RNA, 16 nt, Chlamydia trachomatis
aucuucacggagagaa

SEQ ID NO: 2498020 - RNA, 18 nt, Chlamydia trachomatis
aucuucacggagagaaag

SEQ ID NO: 2498021 - RNA, 19 nt, Chlamydia trachomatis
aucuucacggagagaaaga

SEQ ID NO: 2498022 - RNA, 17 nt, Chlamydia trachomatis
aucuucagaaaucuucu

SEQ ID NO: 2498023 - RNA, 18 nt, Chlamydia trachomatis
aucuucagaaaucuucuu

SEQ ID NO: 2498024 - RNA, 22 nt, Chlamydia trachomatis
aucuucauaagaaaauucuucu

SEQ ID NO: 2498025 - RNA, 18 nt, Chlamydia trachomatis
aucuuccagccuacaaau

SEQ ID NO: 2498026 - RNA, 19 nt, Chlamydia trachomatis
aucuucccaagacucaauc

SEQ ID NO: 2498027 - RNA, 16 nt, Chlamydia trachomatis
aucuucccaauauauu

SEQ ID NO: 2498028 - RNA, 24 nt, Chlamydia trachomatis
aucuucccaauauauuccugucuu

SEQ ID NO: 2498029 - RNA, 22 nt, Chlamydia trachomatis
aucuuccggaaggauguuuccc

SEQ ID NO: 2498030 - RNA, 15 nt, Chlamydia trachomatis
aucuuccucuugaaa

SEQ ID NO: 2498031 - RNA, 18 nt, Chlamydia trachomatis
aucuuccuguaagaggau

SEQ ID NO: 2498032 - RNA, 20 nt, Chlamydia trachomatis
aucuucggcagaagcugcag

SEQ ID NO: 2498033 - RNA, 21 nt, Chlamydia trachomatis
aucuucggcagaagcugcaga

SEQ ID NO: 2498034 - RNA, 14 nt, Chlamydia trachomatis
aucuucuaaaugcu

SEQ ID NO: 2498035 - RNA, 15 nt, Chlamydia trachomatis
aucuucuagaggagu

SEQ ID NO: 2498036 - RNA, 17 nt, Chlamydia trachomatis
aucuucucuugaaucaa

SEQ ID NO: 2498037 - RNA, 22 nt, Chlamydia trachomatis
aucuucucuugaaucaaaaagu

SEQ ID NO: 2498038 - RNA, 17 nt, Chlamydia trachomatis
aucuucugaaaaaucaa

SEQ ID NO: 2498039 - RNA, 18 nt, Chlamydia trachomatis
aucuucugggcuuucuac

SEQ ID NO: 2498040 - RNA, 23 nt, Chlamydia trachomatis
aucuucugggcuuucuacauggc

SEQ ID NO: 2498041 - RNA, 16 nt, Chlamydia trachomatis
aucuucuuaauugccu

SEQ ID NO: 2498042 - RNA, 13 nt, Chlamydia trachomatis
aucuucuuauaca

SEQ ID NO: 2498043 - RNA, 19 nt, Chlamydia trachomatis
aucuucuuauacagcaugc

SEQ ID NO: 2498044 - RNA, 20 nt, Chlamydia trachomatis
aucuucuucuaagcuagaaa

SEQ ID NO: 2498045 - RNA, 22 nt, Chlamydia trachomatis
aucuucuucuaagcuagaaaau

SEQ ID NO: 2498046 - RNA, 15 nt, Chlamydia trachomatis
aucuugagagaccug

SEQ ID NO: 2498047 - RNA, 17 nt, Chlamydia trachomatis
aucuugaggacgagugu

SEQ ID NO: 2498048 - RNA, 17 nt, Chlamydia trachomatis
aucuugaucugaaaaga

SEQ ID NO: 2498049 - RNA, 18 nt, Chlamydia trachomatis
aucuugaucugaaaagag

SEQ ID NO: 2498050 - RNA, 22 nt, Chlamydia trachomatis
aucuuggguaagaccaaaaaca

SEQ ID NO: 2498051 - RNA, 18 nt, Chlamydia trachomatis
aucuuguaauaucaaaga

SEQ ID NO: 2498052 - RNA, 14 nt, Chlamydia trachomatis
aucuugucguuccu

SEQ ID NO: 2498053 - RNA, 16 nt, Chlamydia trachomatis
aucuugucguuccucu

SEQ ID NO: 2498054 - RNA, 19 nt, Chlamydia trachomatis
aucuugugcaaacaaaaga

SEQ ID NO: 2498055 - RNA, 20 nt, Chlamydia trachomatis
aucuuuacuaggagcaaaaa

SEQ ID NO: 2498056 - RNA, 21 nt, Chlamydia trachomatis
aucuuuacuaggagcaaaaag

SEQ ID NO: 2498057 - RNA, 16 nt, Chlamydia trachomatis
aucuuucacaacccaa

SEQ ID NO: 2498058 - RNA, 15 nt, Chlamydia trachomatis
aucuuuccagcaggc

SEQ ID NO: 2498059 - RNA, 22 nt, Chlamydia trachomatis
aucuuucgaauuggaucucccu

SEQ ID NO: 2498060 - RNA, 21 nt, Chlamydia trachomatis
aucuuugaacauuuaucguac

SEQ ID NO: 2498061 - RNA, 20 nt, Chlamydia trachomatis
aucuuugaagguaagaaagu

SEQ ID NO: 2498062 - RNA, 20 nt, Chlamydia trachomatis
aucuuuuacuggagaacagu

SEQ ID NO: 2498063 - RNA, 13 nt, Chlamydia trachomatis
aucuuuugcugug

SEQ ID NO: 2498064 - RNA, 15 nt, Chlamydia trachomatis
aucuuuuuauugaug

SEQ ID NO: 2498065 - RNA, 13 nt, Chlamydia trachomatis
augaaaaagaagc

SEQ ID NO: 2498066 - RNA, 16 nt, Chlamydia trachomatis
augaaaaagaagcuaa

SEQ ID NO: 2498067 - RNA, 16 nt, Chlamydia trachomatis
augaaaaauccuucca

SEQ ID NO: 2498068 - RNA, 14 nt, Chlamydia trachomatis
augaaacaccucuc

SEQ ID NO: 2498069 - RNA, 17 nt, Chlamydia trachomatis
augaaaccccucuuucu

SEQ ID NO: 2498070 - RNA, 18 nt, Chlamydia trachomatis
augaaaccccucuuucuc

SEQ ID NO: 2498071 - RNA, 21 nt, Chlamydia trachomatis
augaaaccccucuuucucucc

SEQ ID NO: 2498072 - RNA, 21 nt, Chlamydia trachomatis
augaaaccuaauagaaauagc

SEQ ID NO: 2498073 - RNA, 18 nt, Chlamydia trachomatis
augaaacucuuuuuaaau

SEQ ID NO: 2498074 - RNA, 23 nt, Chlamydia trachomatis
augaaacucuuuuuaaaucaauu

SEQ ID NO: 2498075 - RNA, 20 nt, Chlamydia trachomatis
augaaagcgugcauuugagg

SEQ ID NO: 2498076 - RNA, 23 nt, Chlamydia trachomatis
augaaauaucauucccuacggaa

SEQ ID NO: 2498077 - RNA, 11 nt, Chlamydia trachomatis
augaacaacau

SEQ ID NO: 2498078 - RNA, 17 nt, Chlamydia trachomatis
augaacaacauaaaauc

SEQ ID NO: 2498079 - RNA, 14 nt, Chlamydia trachomatis
augaacagcauuua

SEQ ID NO: 2498080 - RNA, 21 nt, Chlamydia trachomatis
augaaccagggagagcuuagg

SEQ ID NO: 2498081 - RNA, 19 nt, Chlamydia trachomatis
augaacccaucgauauuuu

SEQ ID NO: 2498082 - RNA, 23 nt, Chlamydia trachomatis
augaacccaucgauauuuuugga

SEQ ID NO: 2498083 - RNA, 17 nt, Chlamydia trachomatis
augaacggacgacugca

SEQ ID NO: 2498084 - RNA, 18 nt, Chlamydia trachomatis
augaacggacgacugcaa

SEQ ID NO: 2498085 - RNA, 22 nt, Chlamydia trachomatis
augaagaaguuuacgaacaaga

SEQ ID NO: 2498086 - RNA, 17 nt, Chlamydia trachomatis
augaagaaucucugggg

SEQ ID NO: 2498087 - RNA, 17 nt, Chlamydia trachomatis
augaagcaauauaacua

SEQ ID NO: 2498088 - RNA, 14 nt, Chlamydia trachomatis
augaagcuaaaaaa

SEQ ID NO: 2498089 - RNA, 16 nt, Chlamydia trachomatis
augaagcuaaaaaauc

SEQ ID NO: 2498090 - RNA, 16 nt, Chlamydia trachomatis
augaaggccaaagaaa

SEQ ID NO: 2498091 - RNA, 18 nt, Chlamydia trachomatis
augaaggccaaagaaaua

SEQ ID NO: 2498092 - RNA, 22 nt, Chlamydia trachomatis
augaaggccaaagaaauagcua

SEQ ID NO: 2498093 - RNA, 20 nt, Chlamydia trachomatis
augaagguuucuaaaaaacu

SEQ ID NO: 2498094 - RNA, 17 nt, Chlamydia trachomatis
augaaucagcuuuucca

SEQ ID NO: 2498095 - RNA, 16 nt, Chlamydia trachomatis
augaauggaaaguacu

SEQ ID NO: 2498096 - RNA, 20 nt, Chlamydia trachomatis
augaauguggggagagcaaa

SEQ ID NO: 2498097 - RNA, 18 nt, Chlamydia trachomatis
augaauuuuaucuaaaaa

SEQ ID NO: 2498098 - RNA, 20 nt, Chlamydia trachomatis
augaauuuuaucuaaaaagg

SEQ ID NO: 2498099 - RNA, 16 nt, Chlamydia trachomatis
augacaacuacaacaa

SEQ ID NO: 2498100 - RNA, 16 nt, Chlamydia trachomatis
augacaggcagcagag

SEQ ID NO: 2498101 - RNA, 18 nt, Chlamydia trachomatis
augacauaagcaaauccu

SEQ ID NO: 2498102 - RNA, 22 nt, Chlamydia trachomatis
augacauuccucgauaaugcuu

SEQ ID NO: 2498103 - RNA, 13 nt, Chlamydia trachomatis
augaccaguuugu

SEQ ID NO: 2498104 - RNA, 21 nt, Chlamydia trachomatis
augacgagugccgaaggggau

SEQ ID NO: 2498105 - RNA, 16 nt, Chlamydia trachomatis
augacugcgcuaugag

SEQ ID NO: 2498106 - RNA, 15 nt, Chlamydia trachomatis
augagaaauaaaaac

SEQ ID NO: 2498107 - RNA, 12 nt, Chlamydia trachomatis
augagaagaaag

SEQ ID NO: 2498108 - RNA, 13 nt, Chlamydia trachomatis
augagaagaaagg

SEQ ID NO: 2498109 - RNA, 13 nt, Chlamydia trachomatis
augagagaaaagg

SEQ ID NO: 2498110 - RNA, 14 nt, Chlamydia trachomatis
augagagaaaaggc

SEQ ID NO: 2498111 - RNA, 19 nt, Chlamydia trachomatis
augagagcagcuacaaccu

SEQ ID NO: 2498112 - RNA, 17 nt, Chlamydia trachomatis
augagagcuuccacagc

SEQ ID NO: 2498113 - RNA, 11 nt, Chlamydia trachomatis
augagcauuug

SEQ ID NO: 2498114 - RNA, 13 nt, Chlamydia trachomatis
augagccucuaac

SEQ ID NO: 2498115 - RNA, 16 nt, Chlamydia trachomatis
augagcgauaugcuuu

SEQ ID NO: 2498116 - RNA, 21 nt, Chlamydia trachomatis
augagcuuaucacaaaccagc

SEQ ID NO: 2498117 - RNA, 17 nt, Chlamydia trachomatis
augaguggcaaggggga

SEQ ID NO: 2498118 - RNA, 22 nt, Chlamydia trachomatis
augaguuccgaacaaaaugaac

SEQ ID NO: 2498119 - RNA, 15 nt, Chlamydia trachomatis
augauaaaacucccc

SEQ ID NO: 2498120 - RNA, 12 nt, Chlamydia trachomatis
augauaagggaa

SEQ ID NO: 2498121 - RNA, 22 nt, Chlamydia trachomatis
augauacgcauaugcgucuucc

SEQ ID NO: 2498122 - RNA, 15 nt, Chlamydia trachomatis
augauagacaagacu

SEQ ID NO: 2498123 - RNA, 17 nt, Chlamydia trachomatis
augauagaguagggaau

SEQ ID NO: 2498124 - RNA, 15 nt, Chlamydia trachomatis
augauaucuucugaa

SEQ ID NO: 2498125 - RNA, 20 nt, Chlamydia trachomatis
augauauuaguuagugaagu

SEQ ID NO: 2498126 - RNA, 21 nt, Chlamydia trachomatis
augauauuaguuagugaaguc

SEQ ID NO: 2498127 - RNA, 20 nt, Chlamydia trachomatis
augaucacuaauauagaauu

SEQ ID NO: 2498128 - RNA, 14 nt, Chlamydia trachomatis
augaucagcaaaaa

SEQ ID NO: 2498129 - RNA, 17 nt, Chlamydia trachomatis
augaucagcaaaaagag

SEQ ID NO: 2498130 - RNA, 18 nt, Chlamydia trachomatis
augaucagcaaaaagagg

SEQ ID NO: 2498131 - RNA, 20 nt, Chlamydia trachomatis
augaucagcaaaaagaggag

SEQ ID NO: 2498132 - RNA, 15 nt, Chlamydia trachomatis
augaucauaaauacu

SEQ ID NO: 2498133 - RNA, 15 nt, Chlamydia trachomatis
augaucccuaagauu

SEQ ID NO: 2498134 - RNA, 19 nt, Chlamydia trachomatis
augaucgccucuaaagcuu

SEQ ID NO: 2498135 - RNA, 14 nt, Chlamydia trachomatis
augaucuaaaggaa

SEQ ID NO: 2498136 - RNA, 18 nt, Chlamydia trachomatis
augaucucugcagaagaa

SEQ ID NO: 2498137 - RNA, 22 nt, Chlamydia trachomatis
augaucuucaccccuuacaaug

SEQ ID NO: 2498138 - RNA, 19 nt, Chlamydia trachomatis
augaucuuuccaauaucuu

SEQ ID NO: 2498139 - RNA, 20 nt, Chlamydia trachomatis
augaucuuuccaauaucuuc

SEQ ID NO: 2498140 - RNA, 15 nt, Chlamydia trachomatis
augaugaaaaagaag

SEQ ID NO: 2498141 - RNA, 13 nt, Chlamydia trachomatis
augaugagaaugu

SEQ ID NO: 2498142 - RNA, 21 nt, Chlamydia trachomatis
augaugagaaugugacuaaag

SEQ ID NO: 2498143 - RNA, 14 nt, Chlamydia trachomatis
augauguccaaagc

SEQ ID NO: 2498144 - RNA, 17 nt, Chlamydia trachomatis
augauguccaaagcucu

SEQ ID NO: 2498145 - RNA, 13 nt, Chlamydia trachomatis
augauuaauucua

SEQ ID NO: 2498146 - RNA, 16 nt, Chlamydia trachomatis
augauuaauucuagga

SEQ ID NO: 2498147 - RNA, 14 nt, Chlamydia trachomatis
augcaaaaagagca

SEQ ID NO: 2498148 - RNA, 23 nt, Chlamydia trachomatis
augcaaaaagagcauaauauccc

SEQ ID NO: 2498149 - RNA, 15 nt, Chlamydia trachomatis
augcaaaacauaaca

SEQ ID NO: 2498150 - RNA, 14 nt, Chlamydia trachomatis
augcaaauaagaaa

SEQ ID NO: 2498151 - RNA, 16 nt, Chlamydia trachomatis
augcaaguaaugacac

SEQ ID NO: 2498152 - RNA, 17 nt, Chlamydia trachomatis
augcaaguaaugacacu

SEQ ID NO: 2498153 - RNA, 15 nt, Chlamydia trachomatis
augcaauaaacgcuu

SEQ ID NO: 2498154 - RNA, 17 nt, Chlamydia trachomatis
augcagaucauaucugc

SEQ ID NO: 2498155 - RNA, 13 nt, Chlamydia trachomatis
augcagaugaaga

SEQ ID NO: 2498156 - RNA, 14 nt, Chlamydia trachomatis
augcagaugaagaa

SEQ ID NO: 2498157 - RNA, 12 nt, Chlamydia trachomatis
augcagcaucca

SEQ ID NO: 2498158 - RNA, 15 nt, Chlamydia trachomatis
augcaguaaagaaaa

SEQ ID NO: 2498159 - RNA, 16 nt, Chlamydia trachomatis
augcaguggaagauag

SEQ ID NO: 2498160 - RNA, 12 nt, Chlamydia trachomatis
augcauacucag

SEQ ID NO: 2498161 - RNA, 13 nt, Chlamydia trachomatis
augcauacucagc

SEQ ID NO: 2498162 - RNA, 12 nt, Chlamydia trachomatis
augcaucuauug

SEQ ID NO: 2498163 - RNA, 21 nt, Chlamydia trachomatis
augcaucugauguuccaucuu

SEQ ID NO: 2498164 - RNA, 23 nt, Chlamydia trachomatis
augccaauugcgguaaacaaugc

SEQ ID NO: 2498165 - RNA, 18 nt, Chlamydia trachomatis
augccacacuuccccauu

SEQ ID NO: 2498166 - RNA, 21 nt, Chlamydia trachomatis
augccagaagcuaugagaauu

SEQ ID NO: 2498167 - RNA, 14 nt, Chlamydia trachomatis
augccauccagagc

SEQ ID NO: 2498168 - RNA, 17 nt, Chlamydia trachomatis
augccauccauaacgaa

SEQ ID NO: 2498169 - RNA, 19 nt, Chlamydia trachomatis
augccauccauaacgaaga

SEQ ID NO: 2498170 - RNA, 17 nt, Chlamydia trachomatis
augccgcagaaaaaacc

SEQ ID NO: 2498171 - RNA, 11 nt, Chlamydia trachomatis
augccucuaag

SEQ ID NO: 2498172 - RNA, 18 nt, Chlamydia trachomatis
augccugcaaaaaggcuu

SEQ ID NO: 2498173 - RNA, 22 nt, Chlamydia trachomatis
augccuugaggauaguauucuu

SEQ ID NO: 2498174 - RNA, 15 nt, Chlamydia trachomatis
augcgcccaucaaua

SEQ ID NO: 2498175 - RNA, 19 nt, Chlamydia trachomatis
augcggauuaaagaaggaa

SEQ ID NO: 2498176 - RNA, 17 nt, Chlamydia trachomatis
augcggcgucugucaac

SEQ ID NO: 2498177 - RNA, 14 nt, Chlamydia trachomatis
augcguagucucua

SEQ ID NO: 2498178 - RNA, 16 nt, Chlamydia trachomatis
augcgugucacagacu

SEQ ID NO: 2498179 - RNA, 16 nt, Chlamydia trachomatis
augcguuaaacuuucu

SEQ ID NO: 2498180 - RNA, 21 nt, Chlamydia trachomatis
augcguuaauuaauaagccuu

SEQ ID NO: 2498181 - RNA, 14 nt, Chlamydia trachomatis
augcguuucuucug

SEQ ID NO: 2498182 - RNA, 17 nt, Chlamydia trachomatis
augcuccgagauuuuca

SEQ ID NO: 2498183 - RNA, 17 nt, Chlamydia trachomatis
augcugaaugguggcau

SEQ ID NO: 2498184 - RNA, 19 nt, Chlamydia trachomatis
augcugcccuugagcaagu

SEQ ID NO: 2498185 - RNA, 23 nt, Chlamydia trachomatis
augcugcgauaacaacaauaaac

SEQ ID NO: 2498186 - RNA, 23 nt, Chlamydia trachomatis
augcugcgcggaauaagucugcc

SEQ ID NO: 2498187 - RNA, 18 nt, Chlamydia trachomatis
augcuguaaaacauuucu

SEQ ID NO: 2498188 - RNA, 17 nt, Chlamydia trachomatis
augcugugacuccuucu

SEQ ID NO: 2498189 - RNA, 18 nt, Chlamydia trachomatis
augcugugacuccuucuc

SEQ ID NO: 2498190 - RNA, 13 nt, Chlamydia trachomatis
augcuuuguaaaa

SEQ ID NO: 2498191 - RNA, 22 nt, Chlamydia trachomatis
augcuuuuuaauauccuccaaa

SEQ ID NO: 2498192 - RNA, 17 nt, Chlamydia trachomatis
auggaaauaaaaagccc

SEQ ID NO: 2498193 - RNA, 15 nt, Chlamydia trachomatis
auggaaauaagagag

SEQ ID NO: 2498194 - RNA, 13 nt, Chlamydia trachomatis
auggaagaacagc

SEQ ID NO: 2498195 - RNA, 18 nt, Chlamydia trachomatis
auggagauugcaacucuu

SEQ ID NO: 2498196 - RNA, 15 nt, Chlamydia trachomatis
auggaguaggggaau

SEQ ID NO: 2498197 - RNA, 22 nt, Chlamydia trachomatis
auggaucucccucauuuaaaag

SEQ ID NO: 2498198 - RNA, 23 nt, Chlamydia trachomatis
auggcaaucgcggaagaaagcau

SEQ ID NO: 2498199 - RNA, 16 nt, Chlamydia trachomatis
auggcagaugcaucua

SEQ ID NO: 2498200 - RNA, 18 nt, Chlamydia trachomatis
auggcucagcuucaacug

SEQ ID NO: 2498201 - RNA, 16 nt, Chlamydia trachomatis
auggcucccagagaau

SEQ ID NO: 2498202 - RNA, 22 nt, Chlamydia trachomatis
augggauggcugcuaucuucua

SEQ ID NO: 2498203 - RNA, 15 nt, Chlamydia trachomatis
augggcuccuucaug

SEQ ID NO: 2498204 - RNA, 21 nt, Chlamydia trachomatis
augguaauggcuguagcacaa

SEQ ID NO: 2498205 - RNA, 12 nt, Chlamydia trachomatis
augguauucuaa

SEQ ID NO: 2498206 - RNA, 17 nt, Chlamydia trachomatis
auggugacgaauccaga

SEQ ID NO: 2498207 - RNA, 21 nt, Chlamydia trachomatis
augguuauaagaccuaaucca

SEQ ID NO: 2498208 - RNA, 21 nt, Chlamydia trachomatis
augguucaaacauagaaggaa

SEQ ID NO: 2498209 - RNA, 20 nt, Chlamydia trachomatis
augguucuugugaggagcuc

SEQ ID NO: 2498210 - RNA, 19 nt, Chlamydia trachomatis
augguugcucuuugaacuu

SEQ ID NO: 2498211 - RNA, 19 nt, Chlamydia trachomatis
augguuuguccuuuucucc

SEQ ID NO: 2498212 - RNA, 23 nt, Chlamydia trachomatis
auguaaaaaaucuugucguuccu

SEQ ID NO: 2498213 - RNA, 22 nt, Chlamydia trachomatis
auguaaaaauucuaaaguaaga

SEQ ID NO: 2498214 - RNA, 22 nt, Chlamydia trachomatis
auguaaacaauauucuuuucca

SEQ ID NO: 2498215 - RNA, 21 nt, Chlamydia trachomatis
auguaacacggccauuauaaa

SEQ ID NO: 2498216 - RNA, 17 nt, Chlamydia trachomatis
auguaagccuaaaacuc

SEQ ID NO: 2498217 - RNA, 12 nt, Chlamydia trachomatis
auguaaggaaau

SEQ ID NO: 2498218 - RNA, 22 nt, Chlamydia trachomatis
auguaaggaaauaccuuguuuu

SEQ ID NO: 2498219 - RNA, 22 nt, Chlamydia trachomatis
auguacgcuaaaaacucuuuca

SEQ ID NO: 2498220 - RNA, 19 nt, Chlamydia trachomatis
auguacucugcaaaaucuu

SEQ ID NO: 2498221 - RNA, 21 nt, Chlamydia trachomatis
auguagaucuguuagugaaga

SEQ ID NO: 2498222 - RNA, 22 nt, Chlamydia trachomatis
auguauggaaagggaggaggaa

SEQ ID NO: 2498223 - RNA, 13 nt, Chlamydia trachomatis
auguccaaagcuc

SEQ ID NO: 2498224 - RNA, 13 nt, Chlamydia trachomatis
auguccauacaaa

SEQ ID NO: 2498225 - RNA, 22 nt, Chlamydia trachomatis
augucgagauaaaaaccucuuc

SEQ ID NO: 2498226 - RNA, 20 nt, Chlamydia trachomatis
augucuaaggaugcaaauaa

SEQ ID NO: 2498227 - RNA, 21 nt, Chlamydia trachomatis
auguguauuugguugugggcu

SEQ ID NO: 2498228 - RNA, 20 nt, Chlamydia trachomatis
augugugguuguagaggaga

SEQ ID NO: 2498229 - RNA, 15 nt, Chlamydia trachomatis
auguguugcuuccca

SEQ ID NO: 2498230 - RNA, 16 nt, Chlamydia trachomatis
auguguuucuggaaag

SEQ ID NO: 2498231 - RNA, 16 nt, Chlamydia trachomatis
auguuaacaucuuccc

SEQ ID NO: 2498232 - RNA, 12 nt, Chlamydia trachomatis
auguuaucucug

SEQ ID NO: 2498233 - RNA, 19 nt, Chlamydia trachomatis
auguucacacuuucuucca

SEQ ID NO: 2498234 - RNA, 14 nt, Chlamydia trachomatis
auguuccaucuuuu

SEQ ID NO: 2498235 - RNA, 22 nt, Chlamydia trachomatis
auguuccucguuuuuuuagaua

SEQ ID NO: 2498236 - RNA, 16 nt, Chlamydia trachomatis
auguucugugaaauau

SEQ ID NO: 2498237 - RNA, 19 nt, Chlamydia trachomatis
auguucugugggauagaaa

SEQ ID NO: 2498238 - RNA, 16 nt, Chlamydia trachomatis
auguuggagaacaucg

SEQ ID NO: 2498239 - RNA, 15 nt, Chlamydia trachomatis
auguuguuaaagcuu

SEQ ID NO: 2498240 - RNA, 17 nt, Chlamydia trachomatis
auguuguuaaagcuuuu

SEQ ID NO: 2498241 - RNA, 11 nt, Chlamydia trachomatis
auuaaacuccc

SEQ ID NO: 2498242 - RNA, 17 nt, Chlamydia trachomatis
auuaaagacuacaaaac

SEQ ID NO: 2498243 - RNA, 20 nt, Chlamydia trachomatis
auuaaaggaauaauuuucca

SEQ ID NO: 2498244 - RNA, 15 nt, Chlamydia trachomatis
auuaaagguuuccca

SEQ ID NO: 2498245 - RNA, 16 nt, Chlamydia trachomatis
auuaacaggaagaaua

SEQ ID NO: 2498246 - RNA, 13 nt, Chlamydia trachomatis
auuaagaaucuuu

SEQ ID NO: 2498247 - RNA, 16 nt, Chlamydia trachomatis
auuaaggaaugauaag

SEQ ID NO: 2498248 - RNA, 12 nt, Chlamydia trachomatis
auuaauaaugaa

SEQ ID NO: 2498249 - RNA, 14 nt, Chlamydia trachomatis
auuaauaaugaaau

SEQ ID NO: 2498250 - RNA, 17 nt, Chlamydia trachomatis
auuaauaauuccaccua

SEQ ID NO: 2498251 - RNA, 18 nt, Chlamydia trachomatis
auuaauaccaaggauagg

SEQ ID NO: 2498252 - RNA, 20 nt, Chlamydia trachomatis
auuaauagcggguucuuuug

SEQ ID NO: 2498253 - RNA, 13 nt, Chlamydia trachomatis
auuacaaaucgua

SEQ ID NO: 2498254 - RNA, 23 nt, Chlamydia trachomatis
auuacacaacucuuuuccuaaac

SEQ ID NO: 2498255 - RNA, 15 nt, Chlamydia trachomatis
auuacagcaagaaga

SEQ ID NO: 2498256 - RNA, 19 nt, Chlamydia trachomatis
auuacagcaagaagaagag

SEQ ID NO: 2498257 - RNA, 19 nt, Chlamydia trachomatis
auuacauauagcauggaag

SEQ ID NO: 2498258 - RNA, 17 nt, Chlamydia trachomatis
auuacccugaaagacuu

SEQ ID NO: 2498259 - RNA, 18 nt, Chlamydia trachomatis
auuacccugaaagacuuu

SEQ ID NO: 2498260 - RNA, 13 nt, Chlamydia trachomatis
auuacgaauuucu

SEQ ID NO: 2498261 - RNA, 19 nt, Chlamydia trachomatis
auuacgaauuucugggaaa

SEQ ID NO: 2498262 - RNA, 21 nt, Chlamydia trachomatis
auuacgaggaagcuguuuaug

SEQ ID NO: 2498263 - RNA, 21 nt, Chlamydia trachomatis
auuacgccccuucuucaagaa

SEQ ID NO: 2498264 - RNA, 20 nt, Chlamydia trachomatis
auuacuuuuucuacuuuccc

SEQ ID NO: 2498265 - RNA, 15 nt, Chlamydia trachomatis
auuagaaaaagggag

SEQ ID NO: 2498266 - RNA, 21 nt, Chlamydia trachomatis
auuagaacggcauucccauuu

SEQ ID NO: 2498267 - RNA, 12 nt, Chlamydia trachomatis
auuaggaagaag

SEQ ID NO: 2498268 - RNA, 21 nt, Chlamydia trachomatis
auuagggaagagcaauauguu

SEQ ID NO: 2498269 - RNA, 14 nt, Chlamydia trachomatis
auuagucgugugaa

SEQ ID NO: 2498270 - RNA, 22 nt, Chlamydia trachomatis
auuagucgugugaacggaggau

SEQ ID NO: 2498271 - RNA, 16 nt, Chlamydia trachomatis
auuaguuagugaaguc

SEQ ID NO: 2498272 - RNA, 13 nt, Chlamydia trachomatis
auuaguucguuau

SEQ ID NO: 2498273 - RNA, 14 nt, Chlamydia trachomatis
auuauauaaagccc

SEQ ID NO: 2498274 - RNA, 14 nt, Chlamydia trachomatis
auuaucacauucuu

SEQ ID NO: 2498275 - RNA, 22 nt, Chlamydia trachomatis
auuaucacauucuuagauuuuc

SEQ ID NO: 2498276 - RNA, 17 nt, Chlamydia trachomatis
auuaucgagaaccaauc

SEQ ID NO: 2498277 - RNA, 15 nt, Chlamydia trachomatis
auuaucgccaaaaau

SEQ ID NO: 2498278 - RNA, 18 nt, Chlamydia trachomatis
auuaucgccaaaaaucau

SEQ ID NO: 2498279 - RNA, 18 nt, Chlamydia trachomatis
auuaucguucucuaaaga

SEQ ID NO: 2498280 - RNA, 21 nt, Chlamydia trachomatis
auuaucuaaaaaaauucuugc

SEQ ID NO: 2498281 - RNA, 15 nt, Chlamydia trachomatis
auuaucuagaaaaga

SEQ ID NO: 2498282 - RNA, 16 nt, Chlamydia trachomatis
auuaucuagaaaagag

SEQ ID NO: 2498283 - RNA, 17 nt, Chlamydia trachomatis
auuaucuagaaaagagc

SEQ ID NO: 2498284 - RNA, 16 nt, Chlamydia trachomatis
auuaucucgacuugcu

SEQ ID NO: 2498285 - RNA, 19 nt, Chlamydia trachomatis
auuaucuuguguagaagaa

SEQ ID NO: 2498286 - RNA, 20 nt, Chlamydia trachomatis
auuaugaucacuaauauaga

SEQ ID NO: 2498287 - RNA, 22 nt, Chlamydia trachomatis
auuauuaacaggaagaauauca

SEQ ID NO: 2498288 - RNA, 18 nt, Chlamydia trachomatis
auuauuacgaacagcaau

SEQ ID NO: 2498289 - RNA, 14 nt, Chlamydia trachomatis
auuauuauuuaaaa

SEQ ID NO: 2498290 - RNA, 21 nt, Chlamydia trachomatis
auuauucacacuuaaaaagaa

SEQ ID NO: 2498291 - RNA, 17 nt, Chlamydia trachomatis
auuauuccgagagaagc

SEQ ID NO: 2498292 - RNA, 14 nt, Chlamydia trachomatis
auuauuuaaaacaa

SEQ ID NO: 2498293 - RNA, 21 nt, Chlamydia trachomatis
auuauuugccucuauguucuu

SEQ ID NO: 2498294 - RNA, 14 nt, Chlamydia trachomatis
auucaaaagcuauc

SEQ ID NO: 2498295 - RNA, 14 nt, Chlamydia trachomatis
auucaaaauccauu

SEQ ID NO: 2498296 - RNA, 13 nt, Chlamydia trachomatis
auucaaaucuucu

SEQ ID NO: 2498297 - RNA, 19 nt, Chlamydia trachomatis
auucaaaucuucuucuaag

SEQ ID NO: 2498298 - RNA, 20 nt, Chlamydia trachomatis
auucaaccucucaucaguaa

SEQ ID NO: 2498299 - RNA, 17 nt, Chlamydia trachomatis
auucaacuggucuucca

SEQ ID NO: 2498300 - RNA, 18 nt, Chlamydia trachomatis
auucaacuggucuuccag

SEQ ID NO: 2498301 - RNA, 15 nt, Chlamydia trachomatis
auucaagaccaaaag

SEQ ID NO: 2498302 - RNA, 22 nt, Chlamydia trachomatis
auucaagugacuuuuagcaaau

SEQ ID NO: 2498303 - RNA, 20 nt, Chlamydia trachomatis
auucaauccagacucuugua

SEQ ID NO: 2498304 - RNA, 16 nt, Chlamydia trachomatis
auucaauuaaagccac

SEQ ID NO: 2498305 - RNA, 20 nt, Chlamydia trachomatis
auucacacuuaaaaagaaac

SEQ ID NO: 2498306 - RNA, 18 nt, Chlamydia trachomatis
auucacaucgaauaaaaa

SEQ ID NO: 2498307 - RNA, 17 nt, Chlamydia trachomatis
auucacgaguuuuagga

SEQ ID NO: 2498308 - RNA, 22 nt, Chlamydia trachomatis
auucacgcaucccaaaauagca

SEQ ID NO: 2498309 - RNA, 17 nt, Chlamydia trachomatis
auucacuaccagaggag

SEQ ID NO: 2498310 - RNA, 20 nt, Chlamydia trachomatis
auucacuuucccccaccuuu

SEQ ID NO: 2498311 - RNA, 13 nt, Chlamydia trachomatis
auucagaauauag

SEQ ID NO: 2498312 - RNA, 17 nt, Chlamydia trachomatis
auucaggcucuuucaga

SEQ ID NO: 2498313 - RNA, 14 nt, Chlamydia trachomatis
auucauagaaguca

SEQ ID NO: 2498314 - RNA, 10 nt, Chlamydia trachomatis
auucaucaaa

SEQ ID NO: 2498315 - RNA, 20 nt, Chlamydia trachomatis
auucaucuauuuuuauugag

SEQ ID NO: 2498316 - RNA, 13 nt, Chlamydia trachomatis
auucaucuuuacu

SEQ ID NO: 2498317 - RNA, 21 nt, Chlamydia trachomatis
auucaugcuccgagauuuuca

SEQ ID NO: 2498318 - RNA, 24 nt, Chlamydia trachomatis
auucaugcuccgagauuuucauca

SEQ ID NO: 2498319 - RNA, 16 nt, Chlamydia trachomatis
auuccaaacccaucca

SEQ ID NO: 2498320 - RNA, 12 nt, Chlamydia trachomatis
auuccaaauaau

SEQ ID NO: 2498321 - RNA, 23 nt, Chlamydia trachomatis
auuccaagcggauugcuuuuugc

SEQ ID NO: 2498322 - RNA, 16 nt, Chlamydia trachomatis
auuccaaucauuugug

SEQ ID NO: 2498323 - RNA, 17 nt, Chlamydia trachomatis
auuccacgaagagcaaa

SEQ ID NO: 2498324 - RNA, 19 nt, Chlamydia trachomatis
auuccacuaccccaccuau

SEQ ID NO: 2498325 - RNA, 20 nt, Chlamydia trachomatis
auuccauaaucguggaacac

SEQ ID NO: 2498326 - RNA, 23 nt, Chlamydia trachomatis
auuccaucuuuucgcaaagguag

SEQ ID NO: 2498327 - RNA, 18 nt, Chlamydia trachomatis
auuccauggcguuagaau

SEQ ID NO: 2498328 - RNA, 17 nt, Chlamydia trachomatis
auucccgccaauuuuuu

SEQ ID NO: 2498329 - RNA, 19 nt, Chlamydia trachomatis
auucccgccuaauaaugaa

SEQ ID NO: 2498330 - RNA, 22 nt, Chlamydia trachomatis
auucccgccuaauaaugaaacc

SEQ ID NO: 2498331 - RNA, 15 nt, Chlamydia trachomatis
auucccuaaaugcuc

SEQ ID NO: 2498332 - RNA, 23 nt, Chlamydia trachomatis
auuccgagggaaucauuugccaa

SEQ ID NO: 2498333 - RNA, 19 nt, Chlamydia trachomatis
auuccgcuucuauuuccag

SEQ ID NO: 2498334 - RNA, 18 nt, Chlamydia trachomatis
auuccguacucugauuag

SEQ ID NO: 2498335 - RNA, 20 nt, Chlamydia trachomatis
auuccguacucugauuagaa

SEQ ID NO: 2498336 - RNA, 14 nt, Chlamydia trachomatis
auuccuaggaauga

SEQ ID NO: 2498337 - RNA, 16 nt, Chlamydia trachomatis
auuccuaggcagagua

SEQ ID NO: 2498338 - RNA, 19 nt, Chlamydia trachomatis
auuccuaggcagaguaauu

SEQ ID NO: 2498339 - RNA, 14 nt, Chlamydia trachomatis
auuccucuaaacaa

SEQ ID NO: 2498340 - RNA, 22 nt, Chlamydia trachomatis
auuccugaauggucaauaauuu

SEQ ID NO: 2498341 - RNA, 16 nt, Chlamydia trachomatis
auuccugcugaucaga

SEQ ID NO: 2498342 - RNA, 22 nt, Chlamydia trachomatis
auuccugggccugauuucucuu

SEQ ID NO: 2498343 - RNA, 16 nt, Chlamydia trachomatis
auuccuguuaauccca

SEQ ID NO: 2498344 - RNA, 17 nt, Chlamydia trachomatis
auuccuucaaauauuuu

SEQ ID NO: 2498345 - RNA, 20 nt, Chlamydia trachomatis
auuccuucguccccucucuc

SEQ ID NO: 2498346 - RNA, 12 nt, Chlamydia trachomatis
auucgaauaauc

SEQ ID NO: 2498347 - RNA, 18 nt, Chlamydia trachomatis
auucgaaucauugggaaa

SEQ ID NO: 2498348 - RNA, 22 nt, Chlamydia trachomatis
auucgagagacggcacaggugu

SEQ ID NO: 2498349 - RNA, 17 nt, Chlamydia trachomatis
auucgaggcuucuucuu

SEQ ID NO: 2498350 - RNA, 21 nt, Chlamydia trachomatis
auucgcauuaaauaauacaaa

SEQ ID NO: 2498351 - RNA, 21 nt, Chlamydia trachomatis
auucgcuaaugauucuugaag

SEQ ID NO: 2498352 - RNA, 23 nt, Chlamydia trachomatis
auucgcuugcagagggccuccca

SEQ ID NO: 2498353 - RNA, 18 nt, Chlamydia trachomatis
auucggagcaagaauaaa

SEQ ID NO: 2498354 - RNA, 13 nt, Chlamydia trachomatis
auucguagauaau

SEQ ID NO: 2498355 - RNA, 16 nt, Chlamydia trachomatis
auucgucaaagaagua

SEQ ID NO: 2498356 - RNA, 13 nt, Chlamydia trachomatis
auucuaggaagcu

SEQ ID NO: 2498357 - RNA, 19 nt, Chlamydia trachomatis
auucuauaggauaaauuaa

SEQ ID NO: 2498358 - RNA, 15 nt, Chlamydia trachomatis
auucuaucaacaucu

SEQ ID NO: 2498359 - RNA, 17 nt, Chlamydia trachomatis
auucuaucaacaucugu

SEQ ID NO: 2498360 - RNA, 18 nt, Chlamydia trachomatis
auucucaaguugagugca

SEQ ID NO: 2498361 - RNA, 21 nt, Chlamydia trachomatis
auucucaauccaugaggcucc

SEQ ID NO: 2498362 - RNA, 19 nt, Chlamydia trachomatis
auucucaccuugaacguag

SEQ ID NO: 2498363 - RNA, 18 nt, Chlamydia trachomatis
auucucaggaucuaauuc

SEQ ID NO: 2498364 - RNA, 14 nt, Chlamydia trachomatis
auucucgcaaagaa

SEQ ID NO: 2498365 - RNA, 15 nt, Chlamydia trachomatis
auucucucauaagau

SEQ ID NO: 2498366 - RNA, 12 nt, Chlamydia trachomatis
auucugcagaaa

SEQ ID NO: 2498367 - RNA, 13 nt, Chlamydia trachomatis
auucugcagaaaa

SEQ ID NO: 2498368 - RNA, 14 nt, Chlamydia trachomatis
auucugcagaaaaa

SEQ ID NO: 2498369 - RNA, 22 nt, Chlamydia trachomatis
auucuggaggaggaccucuguc

SEQ ID NO: 2498370 - RNA, 17 nt, Chlamydia trachomatis
auucugucgacaagcac

SEQ ID NO: 2498371 - RNA, 16 nt, Chlamydia trachomatis
auucuuagcccagauu

SEQ ID NO: 2498372 - RNA, 17 nt, Chlamydia trachomatis
auucuuagcccagauuu

SEQ ID NO: 2498373 - RNA, 15 nt, Chlamydia trachomatis
auucuucugaacaac

SEQ ID NO: 2498374 - RNA, 15 nt, Chlamydia trachomatis
auucuucuucugcaa

SEQ ID NO: 2498375 - RNA, 14 nt, Chlamydia trachomatis
auucuugaagauuu

SEQ ID NO: 2498376 - RNA, 19 nt, Chlamydia trachomatis
auucuugaagauuugcaaa

SEQ ID NO: 2498377 - RNA, 13 nt, Chlamydia trachomatis
auucuugccaccg

SEQ ID NO: 2498378 - RNA, 22 nt, Chlamydia trachomatis
auucuugcuaagaacauaacaa

SEQ ID NO: 2498379 - RNA, 22 nt, Chlamydia trachomatis
auucuuucauucguuucuuccc

SEQ ID NO: 2498380 - RNA, 23 nt, Chlamydia trachomatis
auucuuucuuaucugucagucuu

SEQ ID NO: 2498381 - RNA, 18 nt, Chlamydia trachomatis
auucuuugcguagcucag

SEQ ID NO: 2498382 - RNA, 18 nt, Chlamydia trachomatis
auucuuugguaauagcaa

SEQ ID NO: 2498383 - RNA, 13 nt, Chlamydia trachomatis
auugaacauuuuc

SEQ ID NO: 2498384 - RNA, 20 nt, Chlamydia trachomatis
auugaacccauagauucaug

SEQ ID NO: 2498385 - RNA, 15 nt, Chlamydia trachomatis
auugaaguucuuuuu

SEQ ID NO: 2498386 - RNA, 18 nt, Chlamydia trachomatis
auugaauaaaucuaucca

SEQ ID NO: 2498387 - RNA, 12 nt, Chlamydia trachomatis
auugaauacagu

SEQ ID NO: 2498388 - RNA, 14 nt, Chlamydia trachomatis
auugacaacuuucu

SEQ ID NO: 2498389 - RNA, 15 nt, Chlamydia trachomatis
auugacaacuuucuu

SEQ ID NO: 2498390 - RNA, 23 nt, Chlamydia trachomatis
auugacggccuguaugugaaaau

SEQ ID NO: 2498391 - RNA, 13 nt, Chlamydia trachomatis
auugagaaauaau

SEQ ID NO: 2498392 - RNA, 23 nt, Chlamydia trachomatis
auugagaaauaaucaucucaagu

SEQ ID NO: 2498393 - RNA, 20 nt, Chlamydia trachomatis
auugagaacauaacacauau

SEQ ID NO: 2498394 - RNA, 23 nt, Chlamydia trachomatis
auugagaugaucccaucggcuuu

SEQ ID NO: 2498395 - RNA, 13 nt, Chlamydia trachomatis
auugagcaaaaaa

SEQ ID NO: 2498396 - RNA, 20 nt, Chlamydia trachomatis
auugauagugaaauaagucu

SEQ ID NO: 2498397 - RNA, 16 nt, Chlamydia trachomatis
auugaugacaacuaca

SEQ ID NO: 2498398 - RNA, 20 nt, Chlamydia trachomatis
auugaugacaacuacaacaa

SEQ ID NO: 2498399 - RNA, 14 nt, Chlamydia trachomatis
auugccauguuuuu

SEQ ID NO: 2498400 - RNA, 12 nt, Chlamydia trachomatis
auugcgaagguu

SEQ ID NO: 2498401 - RNA, 22 nt, Chlamydia trachomatis
auugcuaccgauguauuuguac

SEQ ID NO: 2498402 - RNA, 23 nt, Chlamydia trachomatis
auugcucuauaggcaaaagauga

SEQ ID NO: 2498403 - RNA, 16 nt, Chlamydia trachomatis
auugcuguuaagauaa

SEQ ID NO: 2498404 - RNA, 13 nt, Chlamydia trachomatis
auugcuucauaaa

SEQ ID NO: 2498405 - RNA, 15 nt, Chlamydia trachomatis
auuggaaaauccaaa

SEQ ID NO: 2498406 - RNA, 16 nt, Chlamydia trachomatis
auuggaagauaacaau

SEQ ID NO: 2498407 - RNA, 14 nt, Chlamydia trachomatis
auuggacucagaau

SEQ ID NO: 2498408 - RNA, 14 nt, Chlamydia trachomatis
auuggagacaacaa

SEQ ID NO: 2498409 - RNA, 12 nt, Chlamydia trachomatis
auuggaucuccc

SEQ ID NO: 2498410 - RNA, 18 nt, Chlamydia trachomatis
auuggcacggagaucaua

SEQ ID NO: 2498411 - RNA, 21 nt, Chlamydia trachomatis
auuggcucgcaguacuuuacc

SEQ ID NO: 2498412 - RNA, 15 nt, Chlamydia trachomatis
auugggcauauuaga

SEQ ID NO: 2498413 - RNA, 16 nt, Chlamydia trachomatis
auugguauagaaacua

SEQ ID NO: 2498414 - RNA, 16 nt, Chlamydia trachomatis
auuggugagugcauag

SEQ ID NO: 2498415 - RNA, 17 nt, Chlamydia trachomatis
auuggugguaacaccaa

SEQ ID NO: 2498416 - RNA, 23 nt, Chlamydia trachomatis
auugguucccugcaccucuuuca

SEQ ID NO: 2498417 - RNA, 16 nt, Chlamydia trachomatis
auugguuuaauauuuu

SEQ ID NO: 2498418 - RNA, 15 nt, Chlamydia trachomatis
auuguauagcuuuua

SEQ ID NO: 2498419 - RNA, 17 nt, Chlamydia trachomatis
auuguaucaacagauga

SEQ ID NO: 2498420 - RNA, 23 nt, Chlamydia trachomatis
auuguccaaacggcacucaaauu

SEQ ID NO: 2498421 - RNA, 16 nt, Chlamydia trachomatis
auugucgaauuuuucu

SEQ ID NO: 2498422 - RNA, 19 nt, Chlamydia trachomatis
auugucgaauuuuucugcu

SEQ ID NO: 2498423 - RNA, 15 nt, Chlamydia trachomatis
auugucuaaguuggc

SEQ ID NO: 2498424 - RNA, 23 nt, Chlamydia trachomatis
auugucuacuuuuuguuuagaca

SEQ ID NO: 2498425 - RNA, 19 nt, Chlamydia trachomatis
auugugcaagccccccucu

SEQ ID NO: 2498426 - RNA, 22 nt, Chlamydia trachomatis
auugugcaagccccccucugca

SEQ ID NO: 2498427 - RNA, 23 nt, Chlamydia trachomatis
auugugcuuuuaucuucaaagaa

SEQ ID NO: 2498428 - RNA, 17 nt, Chlamydia trachomatis
auuguuggcgaauuucu

SEQ ID NO: 2498429 - RNA, 19 nt, Chlamydia trachomatis
auuuaauaaguuuuucaaa

SEQ ID NO: 2498430 - RNA, 16 nt, Chlamydia trachomatis
auuuaauuaaagagau

SEQ ID NO: 2498431 - RNA, 18 nt, Chlamydia trachomatis
auuuaccggguagauaca

SEQ ID NO: 2498432 - RNA, 21 nt, Chlamydia trachomatis
auuuacgagaggguuucuucu

SEQ ID NO: 2498433 - RNA, 18 nt, Chlamydia trachomatis
auuuacgucaauuuuucc

SEQ ID NO: 2498434 - RNA, 13 nt, Chlamydia trachomatis
caaaaaucucuuu

SEQ ID NO: 2498435 - RNA, 17 nt, Chlamydia trachomatis
caaaaaucugcaacaaa

SEQ ID NO: 2498436 - RNA, 20 nt, Chlamydia trachomatis
caaaaaucugcaacaaauac

SEQ ID NO: 2498437 - RNA, 14 nt, Chlamydia trachomatis
caaaacaaacaaua

SEQ ID NO: 2498438 - RNA, 13 nt, Chlamydia trachomatis
caaaacauaaacg

SEQ ID NO: 2498439 - RNA, 14 nt, Chlamydia trachomatis
caaaacauaacacc

SEQ ID NO: 2498440 - RNA, 12 nt, Chlamydia trachomatis
caaaacauccca

SEQ ID NO: 2498441 - RNA, 18 nt, Chlamydia trachomatis
caaaacaucccagcaaua

SEQ ID NO: 2498442 - RNA, 17 nt, Chlamydia trachomatis
caaaacgcucagaaaac

SEQ ID NO: 2498443 - RNA, 14 nt, Chlamydia trachomatis
caaaacgcucucca

SEQ ID NO: 2498444 - RNA, 17 nt, Chlamydia trachomatis
caaaacgcucuccaaag

SEQ ID NO: 2498445 - RNA, 12 nt, Chlamydia trachomatis
caaaacuucggg

SEQ ID NO: 2498446 - RNA, 21 nt, Chlamydia trachomatis
caaaacuugucuaaaagaaua

SEQ ID NO: 2498447 - RNA, 18 nt, Chlamydia trachomatis
caaaagaagaaucuucuu

SEQ ID NO: 2498448 - RNA, 20 nt, Chlamydia trachomatis
caaaagaagaaucuucuucg

SEQ ID NO: 2498449 - RNA, 12 nt, Chlamydia trachomatis
caaaagaagcug

SEQ ID NO: 2498450 - RNA, 21 nt, Chlamydia trachomatis
caaaagaaggcuuuucuauuu

SEQ ID NO: 2498451 - RNA, 20 nt, Chlamydia trachomatis
caaaagaaugaccaguuugu

SEQ ID NO: 2498452 - RNA, 15 nt, Chlamydia trachomatis
caaaagagaugggga

SEQ ID NO: 2498453 - RNA, 12 nt, Chlamydia trachomatis
caaaagaugaua

SEQ ID NO: 2498454 - RNA, 21 nt, Chlamydia trachomatis
caaaagauuuucaacgggaac

SEQ ID NO: 2498455 - RNA, 22 nt, Chlamydia trachomatis
caaaagcauugaacaccauauc

SEQ ID NO: 2498456 - RNA, 15 nt, Chlamydia trachomatis
caaaagcgaaccuuu

SEQ ID NO: 2498457 - RNA, 21 nt, Chlamydia trachomatis
caaaagcgaggcuucaaagaa

SEQ ID NO: 2498458 - RNA, 22 nt, Chlamydia trachomatis
caaaagcgaggcuucaaagaac

SEQ ID NO: 2498459 - RNA, 23 nt, Chlamydia trachomatis
caaaaguagacgaaguaggagau

SEQ ID NO: 2498460 - RNA, 22 nt, Chlamydia trachomatis
caaaaguguuuagaagugcugu

SEQ ID NO: 2498461 - RNA, 23 nt, Chlamydia trachomatis
caaaauaaaaaaaaagaggaggu

SEQ ID NO: 2498462 - RNA, 21 nt, Chlamydia trachomatis
caaaauaaucggcaaaagauc

SEQ ID NO: 2498463 - RNA, 17 nt, Chlamydia trachomatis
caaaauagcagugaaau

SEQ ID NO: 2498464 - RNA, 18 nt, Chlamydia trachomatis
caaaauaucauaauuaca

SEQ ID NO: 2498465 - RNA, 15 nt, Chlamydia trachomatis
caaaaucaauaaugu

SEQ ID NO: 2498466 - RNA, 18 nt, Chlamydia trachomatis
caaaaucaauaaugucuc

SEQ ID NO: 2498467 - RNA, 18 nt, Chlamydia trachomatis
caaaaucacggcuaucag

SEQ ID NO: 2498468 - RNA, 15 nt, Chlamydia trachomatis
caaaauccuucgccg

SEQ ID NO: 2498469 - RNA, 13 nt, Chlamydia trachomatis
caaaaucuucaua

SEQ ID NO: 2498470 - RNA, 15 nt, Chlamydia trachomatis
caaaaucuucauaag

SEQ ID NO: 2498471 - RNA, 23 nt, Chlamydia trachomatis
caaaaucuucauaagaaaauucu

SEQ ID NO: 2498472 - RNA, 19 nt, Chlamydia trachomatis
caaaaucuuccauaaaauc

SEQ ID NO: 2498473 - RNA, 20 nt, Chlamydia trachomatis
caaaaucuucuggagcaacu

SEQ ID NO: 2498474 - RNA, 20 nt, Chlamydia trachomatis
caaaauuaucuaaaaaaauu

SEQ ID NO: 2498475 - RNA, 21 nt, Chlamydia trachomatis
caaaauucuguacgucugcaa

SEQ ID NO: 2498476 - RNA, 18 nt, Chlamydia trachomatis
caaaauuucagggaaacg

SEQ ID NO: 2498477 - RNA, 18 nt, Chlamydia trachomatis
caaaauuuuucugcucca

SEQ ID NO: 2498478 - RNA, 21 nt, Chlamydia trachomatis
caaacaaaaaagaaagcuucu

SEQ ID NO: 2498479 - RNA, 11 nt, Chlamydia trachomatis
caaacaaaaga

SEQ ID NO: 2498480 - RNA, 15 nt, Chlamydia trachomatis
caaacaaauccuaga

SEQ ID NO: 2498481 - RNA, 21 nt, Chlamydia trachomatis
caaacaacacugacuauuccu

SEQ ID NO: 2498482 - RNA, 14 nt, Chlamydia trachomatis
caaacaaucuaaaa

SEQ ID NO: 2498483 - RNA, 22 nt, Chlamydia trachomatis
caaacacuagagucagaagcua

SEQ ID NO: 2498484 - RNA, 12 nt, Chlamydia trachomatis
caaacacugcaa

SEQ ID NO: 2498485 - RNA, 12 nt, Chlamydia trachomatis
caaacauagaag

SEQ ID NO: 2498486 - RNA, 14 nt, Chlamydia trachomatis
caaacauagaagga

SEQ ID NO: 2498487 - RNA, 21 nt, Chlamydia trachomatis
caaacaucaugguugcuguug

SEQ ID NO: 2498488 - RNA, 16 nt, Chlamydia trachomatis
caaaccaaaaccacac

SEQ ID NO: 2498489 - RNA, 17 nt, Chlamydia trachomatis
caaacccauccauggca

SEQ ID NO: 2498490 - RNA, 14 nt, Chlamydia trachomatis
caaaccgaagaggg

SEQ ID NO: 2498491 - RNA, 22 nt, Chlamydia trachomatis
caaaccuaaguagcaaauuaac

SEQ ID NO: 2498492 - RNA, 15 nt, Chlamydia trachomatis
caaaccuccuaaaua

SEQ ID NO: 2498493 - RNA, 18 nt, Chlamydia trachomatis
caaaccuuaaaagcaagg

SEQ ID NO: 2498494 - RNA, 22 nt, Chlamydia trachomatis
caaaccuuaaaagcaaggcuua

SEQ ID NO: 2498495 - RNA, 14 nt, Chlamydia trachomatis
caaaccuuucaaau

SEQ ID NO: 2498496 - RNA, 18 nt, Chlamydia trachomatis
caaaccuuucaaauaccc

SEQ ID NO: 2498497 - RNA, 23 nt, Chlamydia trachomatis
caaacggcacucaaauuucucua

SEQ ID NO: 2498498 - RNA, 16 nt, Chlamydia trachomatis
caaacugcucaaggaa

SEQ ID NO: 2498499 - RNA, 19 nt, Chlamydia trachomatis
caaacugcucaaggaaacu

SEQ ID NO: 2498500 - RNA, 15 nt, Chlamydia trachomatis
caaacugcucuucua

SEQ ID NO: 2498501 - RNA, 19 nt, Chlamydia trachomatis
caaacugcucuucuaacuu

SEQ ID NO: 2498502 - RNA, 21 nt, Chlamydia trachomatis
caaacuuaccuuguuagaaau

SEQ ID NO: 2498503 - RNA, 13 nt, Chlamydia trachomatis
caaagaaauagcu

SEQ ID NO: 2498504 - RNA, 22 nt, Chlamydia trachomatis
caaagaacauaugaauccuuga

SEQ ID NO: 2498505 - RNA, 11 nt, Chlamydia trachomatis
caaagaagcuc

SEQ ID NO: 2498506 - RNA, 14 nt, Chlamydia trachomatis
caaagaauggaucu

SEQ ID NO: 2498507 - RNA, 20 nt, Chlamydia trachomatis
caaagaauucuugcuauccu

SEQ ID NO: 2498508 - RNA, 14 nt, Chlamydia trachomatis
caaagaauuuuccg

SEQ ID NO: 2498509 - RNA, 23 nt, Chlamydia trachomatis
caaagaauuuuccguaaaagucu

SEQ ID NO: 2498510 - RNA, 19 nt, Chlamydia trachomatis
caaagacauaaaagcugua

SEQ ID NO: 2498511 - RNA, 12 nt, Chlamydia trachomatis
caaagagagcaa

SEQ ID NO: 2498512 - RNA, 16 nt, Chlamydia trachomatis
caaagagcuucuagaa

SEQ ID NO: 2498513 - RNA, 15 nt, Chlamydia trachomatis
caaagaguagggagc

SEQ ID NO: 2498514 - RNA, 23 nt, Chlamydia trachomatis
caaagauauagguuccaucuaaa

SEQ ID NO: 2498515 - RNA, 22 nt, Chlamydia trachomatis
caaagaucgguucauaaaauuu

SEQ ID NO: 2498516 - RNA, 19 nt, Chlamydia trachomatis
caaagaucguaaaauagca

SEQ ID NO: 2498517 - RNA, 22 nt, Chlamydia trachomatis
caaagaucguaaaauagcacgc

SEQ ID NO: 2498518 - RNA, 19 nt, Chlamydia trachomatis
caaagaucuuucuacauuu

SEQ ID NO: 2498519 - RNA, 13 nt, Chlamydia trachomatis
caaagaugcuccu

SEQ ID NO: 2498520 - RNA, 21 nt, Chlamydia trachomatis
caaagauugcguuacuucuug

SEQ ID NO: 2498521 - RNA, 13 nt, Chlamydia trachomatis
caaagcaaacuuc

SEQ ID NO: 2498522 - RNA, 14 nt, Chlamydia trachomatis
caaagcacgauaaa

SEQ ID NO: 2498523 - RNA, 15 nt, Chlamydia trachomatis
caaagcacgauaaaa

SEQ ID NO: 2498524 - RNA, 17 nt, Chlamydia trachomatis
caaagcacuguccacau

SEQ ID NO: 2498525 - RNA, 18 nt, Chlamydia trachomatis
caaagcacuguccacauu

SEQ ID NO: 2498526 - RNA, 21 nt, Chlamydia trachomatis
caaagcagccacuccugcagc

SEQ ID NO: 2498527 - RNA, 20 nt, Chlamydia trachomatis
caaagccccuacucuuccuu

SEQ ID NO: 2498528 - RNA, 23 nt, Chlamydia trachomatis
caaagcgaucuuugaacauuuau

SEQ ID NO: 2498529 - RNA, 18 nt, Chlamydia trachomatis
caaagcuauuugcaagaa

SEQ ID NO: 2498530 - RNA, 19 nt, Chlamydia trachomatis
caaagcucuagcaauagag

SEQ ID NO: 2498531 - RNA, 15 nt, Chlamydia trachomatis
caaagcuuccuuauc

SEQ ID NO: 2498532 - RNA, 23 nt, Chlamydia trachomatis
caaagcuuuaauaauaagagcua

SEQ ID NO: 2498533 - RNA, 18 nt, Chlamydia trachomatis
caaaggauaaauauuuua

SEQ ID NO: 2498534 - RNA, 20 nt, Chlamydia trachomatis
caaaggauauacagaacauu

SEQ ID NO: 2498535 - RNA, 17 nt, Chlamydia trachomatis
caaaggcaacaaaggcg

SEQ ID NO: 2498536 - RNA, 17 nt, Chlamydia trachomatis
caaagguaaauggugaa

SEQ ID NO: 2498537 - RNA, 15 nt, Chlamydia trachomatis
caaagguguuuucua

SEQ ID NO: 2498538 - RNA, 17 nt, Chlamydia trachomatis
caaaguaaucucuuaau

SEQ ID NO: 2498539 - RNA, 20 nt, Chlamydia trachomatis
caaagucaggauuuucuagg

SEQ ID NO: 2498540 - RNA, 19 nt, Chlamydia trachomatis
caaaguuuuguguuuccaa

SEQ ID NO: 2498541 - RNA, 13 nt, Chlamydia trachomatis
caaauaaaacgaa

SEQ ID NO: 2498542 - RNA, 15 nt, Chlamydia trachomatis
caaauaaaacgaaaa

SEQ ID NO: 2498543 - RNA, 22 nt, Chlamydia trachomatis
caaauaaaacgaaaaacagaaa

SEQ ID NO: 2498544 - RNA, 21 nt, Chlamydia trachomatis
caaauaacuuuuucucuugcu

SEQ ID NO: 2498545 - RNA, 13 nt, Chlamydia trachomatis
caaauaagaaagu

SEQ ID NO: 2498546 - RNA, 19 nt, Chlamydia trachomatis
caaauaagaaaguuuuuuu

SEQ ID NO: 2498547 - RNA, 16 nt, Chlamydia trachomatis
caaauaaguuaacccu

SEQ ID NO: 2498548 - RNA, 17 nt, Chlamydia trachomatis
caaauaauaaaccaaag

SEQ ID NO: 2498549 - RNA, 20 nt, Chlamydia trachomatis
caaauaauaaaccaaaggca

SEQ ID NO: 2498550 - RNA, 22 nt, Chlamydia trachomatis
caaauaauuguuggcgaauuuc

SEQ ID NO: 2498551 - RNA, 14 nt, Chlamydia trachomatis
caaauaccaaaaua

SEQ ID NO: 2498552 - RNA, 17 nt, Chlamydia trachomatis
caaauaccaaaauauca

SEQ ID NO: 2498553 - RNA, 18 nt, Chlamydia trachomatis
caaauacugggaaaucau

SEQ ID NO: 2498554 - RNA, 14 nt, Chlamydia trachomatis
caaauagcaaagcg

SEQ ID NO: 2498555 - RNA, 16 nt, Chlamydia trachomatis
caaauaggcgaauuuc

SEQ ID NO: 2498556 - RNA, 20 nt, Chlamydia trachomatis
caaauaggcgaauuucucua

SEQ ID NO: 2498557 - RNA, 13 nt, Chlamydia trachomatis
caaauagggaggu

SEQ ID NO: 2498558 - RNA, 22 nt, Chlamydia trachomatis
caaauagggagguauuccugua

SEQ ID NO: 2498559 - RNA, 15 nt, Chlamydia trachomatis
caaauaguguaagga

SEQ ID NO: 2498560 - RNA, 14 nt, Chlamydia trachomatis
caaauauacucuuu

SEQ ID NO: 2498561 - RNA, 17 nt, Chlamydia trachomatis
caaauauccuaaauuau

SEQ ID NO: 2498562 - RNA, 21 nt, Chlamydia trachomatis
caaauauuuuugggaaaaaau

SEQ ID NO: 2498563 - RNA, 13 nt, Chlamydia trachomatis
caaaucaaaccaa

SEQ ID NO: 2498564 - RNA, 14 nt, Chlamydia trachomatis
caaaucaaaccaaa

SEQ ID NO: 2498565 - RNA, 19 nt, Chlamydia trachomatis
caaauccagcugcugccca

SEQ ID NO: 2498566 - RNA, 14 nt, Chlamydia trachomatis
caaaucuucuucua

SEQ ID NO: 2498567 - RNA, 18 nt, Chlamydia trachomatis
caaaucuuuuaucuucuu

SEQ ID NO: 2498568 - RNA, 19 nt, Chlamydia trachomatis
caaaugaugauauugucua

SEQ ID NO: 2498569 - RNA, 22 nt, Chlamydia trachomatis
caaauuacgcgucuaaaacaau

SEQ ID NO: 2498570 - RNA, 12 nt, Chlamydia trachomatis
caaauuccucug

SEQ ID NO: 2498571 - RNA, 15 nt, Chlamydia trachomatis
caaauucuucaugca

SEQ ID NO: 2498572 - RNA, 21 nt, Chlamydia trachomatis
caaauuuaucugcuaaagaaa

SEQ ID NO: 2498573 - RNA, 19 nt, Chlamydia trachomatis
caaauuucucuaggaacau

SEQ ID NO: 2498574 - RNA, 19 nt, Chlamydia trachomatis
caaauuucuucgaucggaa

SEQ ID NO: 2498575 - RNA, 16 nt, Chlamydia trachomatis
caaauuuucaugaaaa

SEQ ID NO: 2498576 - RNA, 20 nt, Chlamydia trachomatis
caaauuuucaugaaaagcuu

SEQ ID NO: 2498577 - RNA, 12 nt, Chlamydia trachomatis
caacaaauacca

SEQ ID NO: 2498578 - RNA, 15 nt, Chlamydia trachomatis
caacaaauaccaaaa

SEQ ID NO: 2498579 - RNA, 21 nt, Chlamydia trachomatis
caacaaauaccaaaauaucau

SEQ ID NO: 2498580 - RNA, 15 nt, Chlamydia trachomatis
caacaaggauuuuuu

SEQ ID NO: 2498581 - RNA, 20 nt, Chlamydia trachomatis
caacaagggaaugaaaucac

SEQ ID NO: 2498582 - RNA, 20 nt, Chlamydia trachomatis
caacaauuuucguuguugua

SEQ ID NO: 2498583 - RNA, 22 nt, Chlamydia trachomatis
caacaauuuucguuguuguaaa

SEQ ID NO: 2498584 - RNA, 22 nt, Chlamydia trachomatis
caacacgguucuguguauuuau

SEQ ID NO: 2498585 - RNA, 12 nt, Chlamydia trachomatis
caacacuccuga

SEQ ID NO: 2498586 - RNA, 21 nt, Chlamydia trachomatis
caacacugacuauuccugaag

SEQ ID NO: 2498587 - RNA, 14 nt, Chlamydia trachomatis
caacagaugacuca

SEQ ID NO: 2498588 - RNA, 12 nt, Chlamydia trachomatis
caacauaacucu

SEQ ID NO: 2498589 - RNA, 14 nt, Chlamydia trachomatis
caacauaauaaaua

SEQ ID NO: 2498590 - RNA, 21 nt, Chlamydia trachomatis
caacauagaucccuuucauuc

SEQ ID NO: 2498591 - RNA, 14 nt, Chlamydia trachomatis
caacaucauaacca

SEQ ID NO: 2498592 - RNA, 17 nt, Chlamydia trachomatis
caacaucuccauccgaa

SEQ ID NO: 2498593 - RNA, 17 nt, Chlamydia trachomatis
caacaugggcauagucu

SEQ ID NO: 2498594 - RNA, 15 nt, Chlamydia trachomatis
caaccaccuguugcu

SEQ ID NO: 2498595 - RNA, 20 nt, Chlamydia trachomatis
caaccacuguauccaaaaca

SEQ ID NO: 2498596 - RNA, 13 nt, Chlamydia trachomatis
caaccacuguuca

SEQ ID NO: 2498597 - RNA, 15 nt, Chlamydia trachomatis
caaccagcgcauuaa

SEQ ID NO: 2498598 - RNA, 16 nt, Chlamydia trachomatis
caaccauaauacgaau

SEQ ID NO: 2498599 - RNA, 20 nt, Chlamydia trachomatis
caaccauaauacgaauaaga

SEQ ID NO: 2498600 - RNA, 21 nt, Chlamydia trachomatis
caacccaaggcgguaccugcu

SEQ ID NO: 2498601 - RNA, 17 nt, Chlamydia trachomatis
caacccuaaaucuccuc

SEQ ID NO: 2498602 - RNA, 18 nt, Chlamydia trachomatis
caacccucgcagagaaag

SEQ ID NO: 2498603 - RNA, 15 nt, Chlamydia trachomatis
caaccucucaucagu

SEQ ID NO: 2498604 - RNA, 15 nt, Chlamydia trachomatis
caaccuucugacuga

SEQ ID NO: 2498605 - RNA, 20 nt, Chlamydia trachomatis
caaccuuuccuguauaagaa

SEQ ID NO: 2498606 - RNA, 23 nt, Chlamydia trachomatis
caaccuuuccuguauaagaaaaa

SEQ ID NO: 2498607 - RNA, 13 nt, Chlamydia trachomatis
caacgagaagucc

SEQ ID NO: 2498608 - RNA, 15 nt, Chlamydia trachomatis
caacgagaaguccug

SEQ ID NO: 2498609 - RNA, 22 nt, Chlamydia trachomatis
caacgagcugccgaaacuucuc

SEQ ID NO: 2498610 - RNA, 20 nt, Chlamydia trachomatis
caacgagugccgaauaauga

SEQ ID NO: 2498611 - RNA, 17 nt, Chlamydia trachomatis
caacgauaaacagaucu

SEQ ID NO: 2498612 - RNA, 19 nt, Chlamydia trachomatis
caacgauauaaagaagacu

SEQ ID NO: 2498613 - RNA, 21 nt, Chlamydia trachomatis
caacgauauaaagaagacuuc

SEQ ID NO: 2498614 - RNA, 16 nt, Chlamydia trachomatis
caacguuacuaccgau

SEQ ID NO: 2498615 - RNA, 19 nt, Chlamydia trachomatis
caacguuuucacuagggua

SEQ ID NO: 2498616 - RNA, 18 nt, Chlamydia trachomatis
caacuaucagaagauagu

SEQ ID NO: 2498617 - RNA, 15 nt, Chlamydia trachomatis
caacuauugaaauac

SEQ ID NO: 2498618 - RNA, 20 nt, Chlamydia trachomatis
caacucuccuuuaaaagcug

SEQ ID NO: 2498619 - RNA, 18 nt, Chlamydia trachomatis
caacucuuauaacauuau

SEQ ID NO: 2498620 - RNA, 13 nt, Chlamydia trachomatis
caacucuuuuccu

SEQ ID NO: 2498621 - RNA, 15 nt, Chlamydia trachomatis
caacugauucguuug

SEQ ID NO: 2498622 - RNA, 22 nt, Chlamydia trachomatis
caacuggcaagucuaggagaua

SEQ ID NO: 2498623 - RNA, 15 nt, Chlamydia trachomatis
caacuggccuuuuuc

SEQ ID NO: 2498624 - RNA, 18 nt, Chlamydia trachomatis
caacuucaauagcaggaa

SEQ ID NO: 2498625 - RNA, 16 nt, Chlamydia trachomatis
caacuucuaagagccc

SEQ ID NO: 2498626 - RNA, 15 nt, Chlamydia trachomatis
caacuucucuuguuc

SEQ ID NO: 2498627 - RNA, 22 nt, Chlamydia trachomatis
caacuucucuuguucugggcug

SEQ ID NO: 2498628 - RNA, 23 nt, Chlamydia trachomatis
caacuugaucuacagcaaaaccu

SEQ ID NO: 2498629 - RNA, 13 nt, Chlamydia trachomatis
caacuuuacauaa

SEQ ID NO: 2498630 - RNA, 14 nt, Chlamydia trachomatis
caacuuuucagcaa

SEQ ID NO: 2498631 - RNA, 22 nt, Chlamydia trachomatis
caagaaaauagguaaagaaguu

SEQ ID NO: 2498632 - RNA, 14 nt, Chlamydia trachomatis
caagaaacuuuucu

SEQ ID NO: 2498633 - RNA, 13 nt, Chlamydia trachomatis
caagaacaaagca

SEQ ID NO: 2498634 - RNA, 21 nt, Chlamydia trachomatis
caagaagcgaagcauucucuc

SEQ ID NO: 2498635 - RNA, 18 nt, Chlamydia trachomatis
caagaauacaagaaaggc

SEQ ID NO: 2498636 - RNA, 22 nt, Chlamydia trachomatis
caagaaugcgguaauagaguuc

SEQ ID NO: 2498637 - RNA, 21 nt, Chlamydia trachomatis
caagaauugacagcaccaagc

SEQ ID NO: 2498638 - RNA, 22 nt, Chlamydia trachomatis
caagacaacuuggugcagaaga

SEQ ID NO: 2498639 - RNA, 20 nt, Chlamydia trachomatis
caagacacgcaguucgcuau

SEQ ID NO: 2498640 - RNA, 14 nt, Chlamydia trachomatis
caagacaucuauug

SEQ ID NO: 2498641 - RNA, 20 nt, Chlamydia trachomatis
caagacaucuauugagaaga

SEQ ID NO: 2498642 - RNA, 13 nt, Chlamydia trachomatis
caagacgauucuc

SEQ ID NO: 2498643 - RNA, 22 nt, Chlamydia trachomatis
caagacgauucucaugcacugu

SEQ ID NO: 2498644 - RNA, 19 nt, Chlamydia trachomatis
caagacucacagcaaauaa

SEQ ID NO: 2498645 - RNA, 13 nt, Chlamydia trachomatis
caagacucuuuca

SEQ ID NO: 2498646 - RNA, 14 nt, Chlamydia trachomatis
caagacuucuucua

SEQ ID NO: 2498647 - RNA, 15 nt, Chlamydia trachomatis
caagagaaaucagau

SEQ ID NO: 2498648 - RNA, 15 nt, Chlamydia trachomatis
caagagagaacaaaa

SEQ ID NO: 2498649 - RNA, 21 nt, Chlamydia trachomatis
caagagagaucuaugaaaaaa

SEQ ID NO: 2498650 - RNA, 22 nt, Chlamydia trachomatis
caagagaggccuccauuuccau

SEQ ID NO: 2498651 - RNA, 17 nt, Chlamydia trachomatis
caagagcuucuuguuua

SEQ ID NO: 2498652 - RNA, 18 nt, Chlamydia trachomatis
caagaggcccuucuugag

SEQ ID NO: 2498653 - RNA, 21 nt, Chlamydia trachomatis
caagagugugguaugcugaag

SEQ ID NO: 2498654 - RNA, 18 nt, Chlamydia trachomatis
caagaucaugggaaauaa

SEQ ID NO: 2498655 - RNA, 11 nt, Chlamydia trachomatis
caagaugacuu

SEQ ID NO: 2498656 - RNA, 12 nt, Chlamydia trachomatis
caagauuuugaa

SEQ ID NO: 2498657 - RNA, 16 nt, Chlamydia trachomatis
caagcaacgaaaccaa

SEQ ID NO: 2498658 - RNA, 14 nt, Chlamydia trachomatis
caagcaauagcuua

SEQ ID NO: 2498659 - RNA, 19 nt, Chlamydia trachomatis
caagcaauuucuacgagcu

SEQ ID NO: 2498660 - RNA, 15 nt, Chlamydia trachomatis
caagcagauucuuug

SEQ ID NO: 2498661 - RNA, 21 nt, Chlamydia trachomatis
caagcaguagcuacuucaggg

SEQ ID NO: 2498662 - RNA, 19 nt, Chlamydia trachomatis
caagcaugucgagauaaaa

SEQ ID NO: 2498663 - RNA, 12 nt, Chlamydia trachomatis
caagccauuucc

SEQ ID NO: 2498664 - RNA, 13 nt, Chlamydia trachomatis
caagccauuuugu

SEQ ID NO: 2498665 - RNA, 18 nt, Chlamydia trachomatis
caagccccgaaacccaac

SEQ ID NO: 2498666 - RNA, 19 nt, Chlamydia trachomatis
caagcucgagucucuugug

SEQ ID NO: 2498667 - RNA, 14 nt, Chlamydia trachomatis
caagcucgucuuua

SEQ ID NO: 2498668 - RNA, 20 nt, Chlamydia trachomatis
caagcuugucuccuucuuug

SEQ ID NO: 2498669 - RNA, 17 nt, Chlamydia trachomatis
caagcuuucaucuccuu

SEQ ID NO: 2498670 - RNA, 21 nt, Chlamydia trachomatis
caaggaaaccaagggaauaaa

SEQ ID NO: 2498671 - RNA, 15 nt, Chlamydia trachomatis
caaggaagucccucc

SEQ ID NO: 2498672 - RNA, 20 nt, Chlamydia trachomatis
caaggauuuuuuucccacaa

SEQ ID NO: 2498673 - RNA, 19 nt, Chlamydia trachomatis
caaggcuccguucaaagca

SEQ ID NO: 2498674 - RNA, 20 nt, Chlamydia trachomatis
caaggcuccguucaaagcaa

SEQ ID NO: 2498675 - RNA, 13 nt, Chlamydia trachomatis
caaggcuccuuuu

SEQ ID NO: 2498676 - RNA, 14 nt, Chlamydia trachomatis
caaggcuuucaaaa

SEQ ID NO: 2498677 - RNA, 14 nt, Chlamydia trachomatis
caaggcuuuuccau

SEQ ID NO: 2498678 - RNA, 21 nt, Chlamydia trachomatis
caagggaugaagcuaaaaaau

SEQ ID NO: 2498679 - RNA, 22 nt, Chlamydia trachomatis
caagggugcuaacuuucuucca

SEQ ID NO: 2498680 - RNA, 13 nt, Chlamydia trachomatis
caaguauuggaga

SEQ ID NO: 2498681 - RNA, 18 nt, Chlamydia trachomatis
caaguauuggagacaaca

SEQ ID NO: 2498682 - RNA, 19 nt, Chlamydia trachomatis
caaguccuuccauggccuu

SEQ ID NO: 2498683 - RNA, 15 nt, Chlamydia trachomatis
caaguucuucuucca

SEQ ID NO: 2498684 - RNA, 22 nt, Chlamydia trachomatis
caaguucuucuuuagaaacuaa

SEQ ID NO: 2498685 - RNA, 13 nt, Chlamydia trachomatis
caaguuuuguaaa

SEQ ID NO: 2498686 - RNA, 20 nt, Chlamydia trachomatis
caauaaacaaggcuaagaaa

SEQ ID NO: 2498687 - RNA, 18 nt, Chlamydia trachomatis
caauaaacgcgauguaag

SEQ ID NO: 2498688 - RNA, 12 nt, Chlamydia trachomatis
caauaaagaagc

SEQ ID NO: 2498689 - RNA, 19 nt, Chlamydia trachomatis
caauaacagcacaaacaaa

SEQ ID NO: 2498690 - RNA, 15 nt, Chlamydia trachomatis
caauaaccugaccuu

SEQ ID NO: 2498691 - RNA, 17 nt, Chlamydia trachomatis
caauaagccuccugcgu

SEQ ID NO: 2498692 - RNA, 17 nt, Chlamydia trachomatis
caauaaggggaagaaau

SEQ ID NO: 2498693 - RNA, 17 nt, Chlamydia trachomatis
caauaauacaaagcacg

SEQ ID NO: 2498694 - RNA, 15 nt, Chlamydia trachomatis
caauaaucuuuuuau

SEQ ID NO: 2498695 - RNA, 17 nt, Chlamydia trachomatis
caauaaucuuuuuauug

SEQ ID NO: 2498696 - RNA, 20 nt, Chlamydia trachomatis
caauaaugggccguuuuucu

SEQ ID NO: 2498697 - RNA, 16 nt, Chlamydia trachomatis
caauaauguugaaguc

SEQ ID NO: 2498698 - RNA, 14 nt, Chlamydia trachomatis
caauaauucaggcu

SEQ ID NO: 2498699 - RNA, 23 nt, Chlamydia trachomatis
caauaccuacacgauauauccau

SEQ ID NO: 2498700 - RNA, 18 nt, Chlamydia trachomatis
caauagcaggaacuucuu

SEQ ID NO: 2498701 - RNA, 19 nt, Chlamydia trachomatis
caauagcuaagguaacaau

SEQ ID NO: 2498702 - RNA, 20 nt, Chlamydia trachomatis
caauauacaaguauuucuug

SEQ ID NO: 2498703 - RNA, 13 nt, Chlamydia trachomatis
caauauccuccau

SEQ ID NO: 2498704 - RNA, 16 nt, Chlamydia trachomatis
caauauccuccauagu

SEQ ID NO: 2498705 - RNA, 19 nt, Chlamydia trachomatis
caauaucuguuuuucccca

SEQ ID NO: 2498706 - RNA, 21 nt, Chlamydia trachomatis
caauaucuguuuuuccccaua

SEQ ID NO: 2498707 - RNA, 13 nt, Chlamydia trachomatis
caauaucuucaga

SEQ ID NO: 2498708 - RNA, 20 nt, Chlamydia trachomatis
caauaucuucagaagcggca

SEQ ID NO: 2498709 - RNA, 23 nt, Chlamydia trachomatis
caauauguuauacgcaaguauug

SEQ ID NO: 2498710 - RNA, 13 nt, Chlamydia trachomatis
caauauucuuuuc

SEQ ID NO: 2498711 - RNA, 13 nt, Chlamydia trachomatis
caaucaaagcacc

SEQ ID NO: 2498712 - RNA, 13 nt, Chlamydia trachomatis
caaucacagcaau

SEQ ID NO: 2498713 - RNA, 14 nt, Chlamydia trachomatis
caaucacagcaaua

SEQ ID NO: 2498714 - RNA, 15 nt, Chlamydia trachomatis
caaucacuccuccuc

SEQ ID NO: 2498715 - RNA, 19 nt, Chlamydia trachomatis
caaucauuauccauaaaaa

SEQ ID NO: 2498716 - RNA, 19 nt, Chlamydia trachomatis
caaucauuugugugccaau

SEQ ID NO: 2498717 - RNA, 16 nt, Chlamydia trachomatis
caauccacccacaacg

SEQ ID NO: 2498718 - RNA, 15 nt, Chlamydia trachomatis
caauccacgaauuuu

SEQ ID NO: 2498719 - RNA, 19 nt, Chlamydia trachomatis
caauccuguggucacaaga

SEQ ID NO: 2498720 - RNA, 18 nt, Chlamydia trachomatis
caauccuuggcaagaagc

SEQ ID NO: 2498721 - RNA, 22 nt, Chlamydia trachomatis
caauccuuggcaagaagcugca

SEQ ID NO: 2498722 - RNA, 19 nt, Chlamydia trachomatis
caauccuuuaacuaggguu

SEQ ID NO: 2498723 - RNA, 19 nt, Chlamydia trachomatis
caauccuuuugauucugcu

SEQ ID NO: 2498724 - RNA, 18 nt, Chlamydia trachomatis
caaucgaucgauaccuau

SEQ ID NO: 2498725 - RNA, 16 nt, Chlamydia trachomatis
caaucgcggaagaaag

SEQ ID NO: 2498726 - RNA, 20 nt, Chlamydia trachomatis
caaucguauaauaaugggcu

SEQ ID NO: 2498727 - RNA, 21 nt, Chlamydia trachomatis
caaucguauaauaaugggcuc

SEQ ID NO: 2498728 - RNA, 21 nt, Chlamydia trachomatis
caaucuguaauaaacccugga

SEQ ID NO: 2498729 - RNA, 16 nt, Chlamydia trachomatis
caaugaccgaagguuc

SEQ ID NO: 2498730 - RNA, 20 nt, Chlamydia trachomatis
caaugauauucuaauccuaa

SEQ ID NO: 2498731 - RNA, 15 nt, Chlamydia trachomatis
caaugccaagccauu

SEQ ID NO: 2498732 - RNA, 22 nt, Chlamydia trachomatis
caaugccgcccaaggaaaagau

SEQ ID NO: 2498733 - RNA, 15 nt, Chlamydia trachomatis
caaugcgaucagaaa

SEQ ID NO: 2498734 - RNA, 16 nt, Chlamydia trachomatis
caaugcuaucagcgaa

SEQ ID NO: 2498735 - RNA, 18 nt, Chlamydia trachomatis
caaugcugauaaaaauaa

SEQ ID NO: 2498736 - RNA, 20 nt, Chlamydia trachomatis
caaugcugcuguuuauuuuc

SEQ ID NO: 2498737 - RNA, 17 nt, Chlamydia trachomatis
caaugcuguuucaggca

SEQ ID NO: 2498738 - RNA, 15 nt, Chlamydia trachomatis
caauggcaaaacuuc

SEQ ID NO: 2498739 - RNA, 16 nt, Chlamydia trachomatis
caauguaaacaauauu

SEQ ID NO: 2498740 - RNA, 20 nt, Chlamydia trachomatis
caauguacgcuaaaaacucu

SEQ ID NO: 2498741 - RNA, 16 nt, Chlamydia trachomatis
caaugucaacauaaua

SEQ ID NO: 2498742 - RNA, 15 nt, Chlamydia trachomatis
caaugucaacauaca

SEQ ID NO: 2498743 - RNA, 18 nt, Chlamydia trachomatis
caauguucuauauacauu

SEQ ID NO: 2498744 - RNA, 19 nt, Chlamydia trachomatis
caauuaaagccacugugaa

SEQ ID NO: 2498745 - RNA, 14 nt, Chlamydia trachomatis
caauucaucagcac

SEQ ID NO: 2498746 - RNA, 15 nt, Chlamydia trachomatis
caauuccucuaaaca

SEQ ID NO: 2498747 - RNA, 21 nt, Chlamydia trachomatis
caauuccucuaaacaagguuc

SEQ ID NO: 2498748 - RNA, 13 nt, Chlamydia trachomatis
caauuccugcuca

SEQ ID NO: 2498749 - RNA, 14 nt, Chlamydia trachomatis
caauuccugcucag

SEQ ID NO: 2498750 - RNA, 15 nt, Chlamydia trachomatis
caauucuugcuucau

SEQ ID NO: 2498751 - RNA, 17 nt, Chlamydia trachomatis
caauugcgguaaacaau

SEQ ID NO: 2498752 - RNA, 20 nt, Chlamydia trachomatis
caauugguuugauagcuuca

SEQ ID NO: 2498753 - RNA, 15 nt, Chlamydia trachomatis
caauuguugagcagc

SEQ ID NO: 2498754 - RNA, 22 nt, Chlamydia trachomatis
caauuguugagcagcaaagauc

SEQ ID NO: 2498755 - RNA, 17 nt, Chlamydia trachomatis
caauuuacuaucaggaa

SEQ ID NO: 2498756 - RNA, 19 nt, Chlamydia trachomatis
caauuuccuuagaaagaau

SEQ ID NO: 2498757 - RNA, 16 nt, Chlamydia trachomatis
caauuuuuguuccuuu

SEQ ID NO: 2498758 - RNA, 23 nt, Chlamydia trachomatis
caauuuuuuuauccaaaaaagug

SEQ ID NO: 2498759 - RNA, 12 nt, Chlamydia trachomatis
cacaaagagaag

SEQ ID NO: 2498760 - RNA, 20 nt, Chlamydia trachomatis
cacaaaggaacaucgagaaa

SEQ ID NO: 2498761 - RNA, 19 nt, Chlamydia trachomatis
cacaaauuuaucugcuaaa

SEQ ID NO: 2498762 - RNA, 16 nt, Chlamydia trachomatis
cacaaccucucuaaaa

SEQ ID NO: 2498763 - RNA, 20 nt, Chlamydia trachomatis
cacaacgcguuggguaguac

SEQ ID NO: 2498764 - RNA, 13 nt, Chlamydia trachomatis
cacaacuaguuua

SEQ ID NO: 2498765 - RNA, 17 nt, Chlamydia trachomatis
cacaacuugcguuuucu

SEQ ID NO: 2498766 - RNA, 18 nt, Chlamydia trachomatis
cacaacuugcguuuucuu

SEQ ID NO: 2498767 - RNA, 19 nt, Chlamydia trachomatis
cacaacuugcguuuucuug

SEQ ID NO: 2498768 - RNA, 17 nt, Chlamydia trachomatis
cacaagaacaucuccaa

SEQ ID NO: 2498769 - RNA, 23 nt, Chlamydia trachomatis
cacaagaaguaacaccucuucug

SEQ ID NO: 2498770 - RNA, 16 nt, Chlamydia trachomatis
cacaagcagacaagca

SEQ ID NO: 2498771 - RNA, 17 nt, Chlamydia trachomatis
cacaagcagacaagcaa

SEQ ID NO: 2498772 - RNA, 14 nt, Chlamydia trachomatis
cacaaggagauauu

SEQ ID NO: 2498773 - RNA, 19 nt, Chlamydia trachomatis
cacaaguaugagaggaaga

SEQ ID NO: 2498774 - RNA, 17 nt, Chlamydia trachomatis
cacaagugccaacauca

SEQ ID NO: 2498775 - RNA, 20 nt, Chlamydia trachomatis
cacaagugccaacaucaaaa

SEQ ID NO: 2498776 - RNA, 13 nt, Chlamydia trachomatis
cacaauaacagca

SEQ ID NO: 2498777 - RNA, 14 nt, Chlamydia trachomatis
cacaauauuaucua

SEQ ID NO: 2498778 - RNA, 16 nt, Chlamydia trachomatis
cacaaucucaaaaaca

SEQ ID NO: 2498779 - RNA, 13 nt, Chlamydia trachomatis
cacaauuuuucuu

SEQ ID NO: 2498780 - RNA, 14 nt, Chlamydia trachomatis
cacaauuuuucuug

SEQ ID NO: 2498781 - RNA, 16 nt, Chlamydia trachomatis
cacaauuuuuguuccu

SEQ ID NO: 2498782 - RNA, 17 nt, Chlamydia trachomatis
cacaauuuuuguuccuu

SEQ ID NO: 2498783 - RNA, 20 nt, Chlamydia trachomatis
cacacaagcugacaaagcuu

SEQ ID NO: 2498784 - RNA, 15 nt, Chlamydia trachomatis
cacaccauucagcaa

SEQ ID NO: 2498785 - RNA, 13 nt, Chlamydia trachomatis
cacacgauuaucu

SEQ ID NO: 2498786 - RNA, 14 nt, Chlamydia trachomatis
cacacgauuaucua

SEQ ID NO: 2498787 - RNA, 15 nt, Chlamydia trachomatis
cacacgauuaucuaa

SEQ ID NO: 2498788 - RNA, 14 nt, Chlamydia trachomatis
cacacuugauaaau

SEQ ID NO: 2498789 - RNA, 15 nt, Chlamydia trachomatis
cacagaaacuucuuc

SEQ ID NO: 2498790 - RNA, 18 nt, Chlamydia trachomatis
cacagaaaguccugcuuc

SEQ ID NO: 2498791 - RNA, 19 nt, Chlamydia trachomatis
cacagaaaguccugcuucu

SEQ ID NO: 2498792 - RNA, 19 nt, Chlamydia trachomatis
cacagaaguuguuggaguu

SEQ ID NO: 2498793 - RNA, 13 nt, Chlamydia trachomatis
cacagaauuuaca

SEQ ID NO: 2498794 - RNA, 20 nt, Chlamydia trachomatis
cacagauuugaguuuaucau

SEQ ID NO: 2498795 - RNA, 20 nt, Chlamydia trachomatis
cacagucauaguauaacgau

SEQ ID NO: 2498796 - RNA, 20 nt, Chlamydia trachomatis
cacaguuuacgaguaucugu

SEQ ID NO: 2498797 - RNA, 20 nt, Chlamydia trachomatis
cacauagcgacuaauacuga

SEQ ID NO: 2498798 - RNA, 19 nt, Chlamydia trachomatis
cacauccugagcccaagga

SEQ ID NO: 2498799 - RNA, 14 nt, Chlamydia trachomatis
cacauccuucugcu

SEQ ID NO: 2498800 - RNA, 15 nt, Chlamydia trachomatis
cacaucgaauaaaaa

SEQ ID NO: 2498801 - RNA, 18 nt, Chlamydia trachomatis
cacaucgaauaaaaauuc

SEQ ID NO: 2498802 - RNA, 16 nt, Chlamydia trachomatis
cacaucgaugcucgau

SEQ ID NO: 2498803 - RNA, 22 nt, Chlamydia trachomatis
cacaucuguauccuaacuaaaa

SEQ ID NO: 2498804 - RNA, 15 nt, Chlamydia trachomatis
cacaugguucaaaca

SEQ ID NO: 2498805 - RNA, 22 nt, Chlamydia trachomatis
cacaugguucaaacauagaagg

SEQ ID NO: 2498806 - RNA, 21 nt, Chlamydia trachomatis
cacaugguuuucugggucaua

SEQ ID NO: 2498807 - RNA, 14 nt, Chlamydia trachomatis
cacaugucauccuu

SEQ ID NO: 2498808 - RNA, 16 nt, Chlamydia trachomatis
cacaugucauccuuag

SEQ ID NO: 2498809 - RNA, 17 nt, Chlamydia trachomatis
cacauuaccauucacac

SEQ ID NO: 2498810 - RNA, 19 nt, Chlamydia trachomatis
cacauuaucucgacuugcu

SEQ ID NO: 2498811 - RNA, 15 nt, Chlamydia trachomatis
cacauuauucacacu

SEQ ID NO: 2498812 - RNA, 15 nt, Chlamydia trachomatis
cacauucccuaaaua

SEQ ID NO: 2498813 - RNA, 13 nt, Chlamydia trachomatis
caccaaauccucc

SEQ ID NO: 2498814 - RNA, 19 nt, Chlamydia trachomatis
caccaaguucuucuuuaga

SEQ ID NO: 2498815 - RNA, 14 nt, Chlamydia trachomatis
caccaaucaccgcu

SEQ ID NO: 2498816 - RNA, 17 nt, Chlamydia trachomatis
caccaaucaccgcugcu

SEQ ID NO: 2498817 - RNA, 17 nt, Chlamydia trachomatis
caccacgagaucugcau

SEQ ID NO: 2498818 - RNA, 21 nt, Chlamydia trachomatis
caccacgugaguguagucuuu

SEQ ID NO: 2498819 - RNA, 18 nt, Chlamydia trachomatis
caccacuaaucccaccuu

SEQ ID NO: 2498820 - RNA, 14 nt, Chlamydia trachomatis
caccagccacaucc

SEQ ID NO: 2498821 - RNA, 19 nt, Chlamydia trachomatis
caccagcggacaaguccuu

SEQ ID NO: 2498822 - RNA, 16 nt, Chlamydia trachomatis
caccauagguagaaaa

SEQ ID NO: 2498823 - RNA, 20 nt, Chlamydia trachomatis
caccauagguagaaaaggau

SEQ ID NO: 2498824 - RNA, 15 nt, Chlamydia trachomatis
caccauccaauccug

SEQ ID NO: 2498825 - RNA, 18 nt, Chlamydia trachomatis
caccauuacgaggaagcu

SEQ ID NO: 2498826 - RNA, 19 nt, Chlamydia trachomatis
caccauucagcaaaaaaau

SEQ ID NO: 2498827 - RNA, 14 nt, Chlamydia trachomatis
cacccaaucuucua

SEQ ID NO: 2498828 - RNA, 21 nt, Chlamydia trachomatis
cacccuuuuuauaaucuccua

SEQ ID NO: 2498829 - RNA, 20 nt, Chlamydia trachomatis
caccgcaucagccccaaaaa

SEQ ID NO: 2498830 - RNA, 18 nt, Chlamydia trachomatis
caccguagaauuucuucu

SEQ ID NO: 2498831 - RNA, 19 nt, Chlamydia trachomatis
caccguagaauuucuucuu

SEQ ID NO: 2498832 - RNA, 20 nt, Chlamydia trachomatis
caccgugcucgaaacucauc

SEQ ID NO: 2498833 - RNA, 22 nt, Chlamydia trachomatis
caccuauggguaugugggcuuu

SEQ ID NO: 2498834 - RNA, 13 nt, Chlamydia trachomatis
caccucgucucca

SEQ ID NO: 2498835 - RNA, 11 nt, Chlamydia trachomatis
caccucuuccg

SEQ ID NO: 2498836 - RNA, 22 nt, Chlamydia trachomatis
caccucuugccugcaaauaaua

SEQ ID NO: 2498837 - RNA, 17 nt, Chlamydia trachomatis
caccugagcuauaccgc

SEQ ID NO: 2498838 - RNA, 15 nt, Chlamydia trachomatis
caccugcaagagauc

SEQ ID NO: 2498839 - RNA, 20 nt, Chlamydia trachomatis
caccugcuuucugugcccaa

SEQ ID NO: 2498840 - RNA, 13 nt, Chlamydia trachomatis
caccuucauuuca

SEQ ID NO: 2498841 - RNA, 22 nt, Chlamydia trachomatis
caccuugcuuaacacuucuuua

SEQ ID NO: 2498842 - RNA, 20 nt, Chlamydia trachomatis
cacgaacggaaguucuugcu

SEQ ID NO: 2498843 - RNA, 18 nt, Chlamydia trachomatis
cacgacacuccucugaau

SEQ ID NO: 2498844 - RNA, 15 nt, Chlamydia trachomatis
cacgauauauccauu

SEQ ID NO: 2498845 - RNA, 21 nt, Chlamydia trachomatis
cacgauauauccauucaggau

SEQ ID NO: 2498846 - RNA, 17 nt, Chlamydia trachomatis
cacgcaaaacaucuaga

SEQ ID NO: 2498847 - RNA, 14 nt, Chlamydia trachomatis
cacgccauaucaaa

SEQ ID NO: 2498848 - RNA, 16 nt, Chlamydia trachomatis
cacgcuacuaacgaag

SEQ ID NO: 2498849 - RNA, 15 nt, Chlamydia trachomatis
cacgcugaguuuccu

SEQ ID NO: 2498850 - RNA, 20 nt, Chlamydia trachomatis
cacggaacauaccguagauc

SEQ ID NO: 2498851 - RNA, 17 nt, Chlamydia trachomatis
cacggagagaaagaggg

SEQ ID NO: 2498852 - RNA, 22 nt, Chlamydia trachomatis
cacgguaaucuucacggagaga

SEQ ID NO: 2498853 - RNA, 14 nt, Chlamydia trachomatis
cacggucaccccua

SEQ ID NO: 2498854 - RNA, 13 nt, Chlamydia trachomatis
cacggugcagagg

SEQ ID NO: 2498855 - RNA, 15 nt, Chlamydia trachomatis
cacgugcaacacaac

SEQ ID NO: 2498856 - RNA, 20 nt, Chlamydia trachomatis
cacuaaagagcuucggcuau

SEQ ID NO: 2498857 - RNA, 13 nt, Chlamydia trachomatis
cacuaagaauaaa

SEQ ID NO: 2498858 - RNA, 17 nt, Chlamydia trachomatis
cacuaagaauaaagaug

SEQ ID NO: 2498859 - RNA, 13 nt, Chlamydia trachomatis
cacuaccagcccc

SEQ ID NO: 2498860 - RNA, 14 nt, Chlamydia trachomatis
cacuaccccgccuc

SEQ ID NO: 2498861 - RNA, 22 nt, Chlamydia trachomatis
cacuagagucagaagcuauucc

SEQ ID NO: 2498862 - RNA, 20 nt, Chlamydia trachomatis
cacuaggcucaugagccucu

SEQ ID NO: 2498863 - RNA, 20 nt, Chlamydia trachomatis
cacuaucauugagcaaaaaa

SEQ ID NO: 2498864 - RNA, 14 nt, Chlamydia trachomatis
cacuauuaaaaagg

SEQ ID NO: 2498865 - RNA, 21 nt, Chlamydia trachomatis
cacuauuagggagcccagcau

SEQ ID NO: 2498866 - RNA, 15 nt, Chlamydia trachomatis
cacuccaagaagagu

SEQ ID NO: 2498867 - RNA, 19 nt, Chlamydia trachomatis
cacuccuagggucugaggc

SEQ ID NO: 2498868 - RNA, 14 nt, Chlamydia trachomatis
cacuccuccuccua

SEQ ID NO: 2498869 - RNA, 14 nt, Chlamydia trachomatis
cacuccucugaauc

SEQ ID NO: 2498870 - RNA, 17 nt, Chlamydia trachomatis
cacucgagucaugcaaa

SEQ ID NO: 2498871 - RNA, 18 nt, Chlamydia trachomatis
cacucgagucaugcaaag

SEQ ID NO: 2498872 - RNA, 18 nt, Chlamydia trachomatis
cacucgugaaauaaauca

SEQ ID NO: 2498873 - RNA, 21 nt, Chlamydia trachomatis
cacucucucgaucucaucaaa

SEQ ID NO: 2498874 - RNA, 16 nt, Chlamydia trachomatis
cacucuugauagucuu

SEQ ID NO: 2498875 - RNA, 14 nt, Chlamydia trachomatis
cacugaaucaggaa

SEQ ID NO: 2498876 - RNA, 16 nt, Chlamydia trachomatis
cacugacuauuccuga

SEQ ID NO: 2498877 - RNA, 22 nt, Chlamydia trachomatis
cacugagaggaguuuuuuucac

SEQ ID NO: 2498878 - RNA, 13 nt, Chlamydia trachomatis
cacugcaacuaau

SEQ ID NO: 2498879 - RNA, 16 nt, Chlamydia trachomatis
cacugcaacuaauauu

SEQ ID NO: 2498880 - RNA, 17 nt, Chlamydia trachomatis
cacugcuuccgaaagca

SEQ ID NO: 2498881 - RNA, 13 nt, Chlamydia trachomatis
cacuggaauagcu

SEQ ID NO: 2498882 - RNA, 16 nt, Chlamydia trachomatis
cacuggcaccuuuuuu

SEQ ID NO: 2498883 - RNA, 20 nt, Chlamydia trachomatis
cacuggcaccuuuuuugcua

SEQ ID NO: 2498884 - RNA, 21 nt, Chlamydia trachomatis
cacuggguaucugaacaagaa

SEQ ID NO: 2498885 - RNA, 17 nt, Chlamydia trachomatis
cacugguauucugcaga

SEQ ID NO: 2498886 - RNA, 14 nt, Chlamydia trachomatis
cacuguccacauua

SEQ ID NO: 2498887 - RNA, 21 nt, Chlamydia trachomatis
cacuguccacauuauucacac

SEQ ID NO: 2498888 - RNA, 14 nt, Chlamydia trachomatis
cacugucucaugga

SEQ ID NO: 2498889 - RNA, 15 nt, Chlamydia trachomatis
cacuguugagaaaaa

SEQ ID NO: 2498890 - RNA, 20 nt, Chlamydia trachomatis
cacuuccuugguauuugugu

SEQ ID NO: 2498891 - RNA, 18 nt, Chlamydia trachomatis
cacuugaguuguuugggc

SEQ ID NO: 2498892 - RNA, 21 nt, Chlamydia trachomatis
cacuugaucuaucuuucuuag

SEQ ID NO: 2498893 - RNA, 12 nt, Chlamydia trachomatis
cacuuuccccau

SEQ ID NO: 2498894 - RNA, 19 nt, Chlamydia trachomatis
cacuuuccccauccccuca

SEQ ID NO: 2498895 - RNA, 16 nt, Chlamydia trachomatis
cacuuucccccaccuu

SEQ ID NO: 2498896 - RNA, 14 nt, Chlamydia trachomatis
cacuuuugugaaaa

SEQ ID NO: 2498897 - RNA, 13 nt, Chlamydia trachomatis
cagaaaaaauaau

SEQ ID NO: 2498898 - RNA, 14 nt, Chlamydia trachomatis
cagaaaaaauaaug

SEQ ID NO: 2498899 - RNA, 21 nt, Chlamydia trachomatis
cagaaaacuuagcuaaauuca

SEQ ID NO: 2498900 - RNA, 18 nt, Chlamydia trachomatis
cagaaaagccuucuuuca

SEQ ID NO: 2498901 - RNA, 19 nt, Chlamydia trachomatis
cagaaaauucuacaacagc

SEQ ID NO: 2498902 - RNA, 23 nt, Chlamydia trachomatis
cagaaacaauuucaucacagaua

SEQ ID NO: 2498903 - RNA, 16 nt, Chlamydia trachomatis
cagaaaguccugcuuc

SEQ ID NO: 2498904 - RNA, 21 nt, Chlamydia trachomatis
cagaaaucccaucaaaagcua

SEQ ID NO: 2498905 - RNA, 16 nt, Chlamydia trachomatis
cagaacaaacgaagga

SEQ ID NO: 2498906 - RNA, 22 nt, Chlamydia trachomatis
cagaacaagugcagcguucuga

SEQ ID NO: 2498907 - RNA, 20 nt, Chlamydia trachomatis
cagaacagcucuagcuaaac

SEQ ID NO: 2498908 - RNA, 23 nt, Chlamydia trachomatis
cagaacagcucuagcuaaaccca

SEQ ID NO: 2498909 - RNA, 19 nt, Chlamydia trachomatis
cagaacaugggcgucucuu

SEQ ID NO: 2498910 - RNA, 22 nt, Chlamydia trachomatis
cagaacauuucucgucagggga

SEQ ID NO: 2498911 - RNA, 16 nt, Chlamydia trachomatis
cagaaccuuuuuaaaa

SEQ ID NO: 2498912 - RNA, 19 nt, Chlamydia trachomatis
cagaacucaaaauaaagaa

SEQ ID NO: 2498913 - RNA, 23 nt, Chlamydia trachomatis
cagaacuuaucuguucugcucgu

SEQ ID NO: 2498914 - RNA, 15 nt, Chlamydia trachomatis
cagaagaaccuccau

SEQ ID NO: 2498915 - RNA, 12 nt, Chlamydia trachomatis
cagaagaagagc

SEQ ID NO: 2498916 - RNA, 14 nt, Chlamydia trachomatis
cagaagaagagcug

SEQ ID NO: 2498917 - RNA, 20 nt, Chlamydia trachomatis
cagaagaccagucaauuucu

SEQ ID NO: 2498918 - RNA, 14 nt, Chlamydia trachomatis
cagaagcuauucca

SEQ ID NO: 2498919 - RNA, 13 nt, Chlamydia trachomatis
cagaagcugcaga

SEQ ID NO: 2498920 - RNA, 17 nt, Chlamydia trachomatis
cagaaggaguuuuucuc

SEQ ID NO: 2498921 - RNA, 20 nt, Chlamydia trachomatis
cagaaggaguuuuucuccuc

SEQ ID NO: 2498922 - RNA, 14 nt, Chlamydia trachomatis
cagaaguggcugua

SEQ ID NO: 2498923 - RNA, 21 nt, Chlamydia trachomatis
cagaaguggcuguaauguuaa

SEQ ID NO: 2498924 - RNA, 15 nt, Chlamydia trachomatis
cagaaguuguuggag

SEQ ID NO: 2498925 - RNA, 14 nt, Chlamydia trachomatis
cagaaguuuuaaca

SEQ ID NO: 2498926 - RNA, 15 nt, Chlamydia trachomatis
cagaaucaucuggua

SEQ ID NO: 2498927 - RNA, 14 nt, Chlamydia trachomatis
cagaauccuuuuca

SEQ ID NO: 2498928 - RNA, 20 nt, Chlamydia trachomatis
cagaauccuuuucagaauua

SEQ ID NO: 2498929 - RNA, 23 nt, Chlamydia trachomatis
cagaaucugugcuugcauagaua

SEQ ID NO: 2498930 - RNA, 18 nt, Chlamydia trachomatis
cagaaucuuuggaagcag

SEQ ID NO: 2498931 - RNA, 21 nt, Chlamydia trachomatis
cagaaucuuuggaagcagaaa

SEQ ID NO: 2498932 - RNA, 19 nt, Chlamydia trachomatis
cagaauugagcacaagcug

SEQ ID NO: 2498933 - RNA, 11 nt, Chlamydia trachomatis
cagacaaaaag

SEQ ID NO: 2498934 - RNA, 15 nt, Chlamydia trachomatis
cagacagauguacag

SEQ ID NO: 2498935 - RNA, 13 nt, Chlamydia trachomatis
cagacaucuaaag

SEQ ID NO: 2498936 - RNA, 19 nt, Chlamydia trachomatis
cagacaucuaaagucugaa

SEQ ID NO: 2498937 - RNA, 15 nt, Chlamydia trachomatis
cagacccuuccaaau

SEQ ID NO: 2498938 - RNA, 18 nt, Chlamydia trachomatis
cagacgaaaacgcauuac

SEQ ID NO: 2498939 - RNA, 20 nt, Chlamydia trachomatis
cagacgauauuuaagauaga

SEQ ID NO: 2498940 - RNA, 19 nt, Chlamydia trachomatis
cagacgcccuccuccucgc

SEQ ID NO: 2498941 - RNA, 21 nt, Chlamydia trachomatis
cagacuaaguuguaaaacaac

SEQ ID NO: 2498942 - RNA, 23 nt, Chlamydia trachomatis
cagacuuuguuuauuaucuagaa

SEQ ID NO: 2498943 - RNA, 14 nt, Chlamydia trachomatis
cagagaaaaagauu

SEQ ID NO: 2498944 - RNA, 11 nt, Chlamydia trachomatis
cagagaaaauu

SEQ ID NO: 2498945 - RNA, 17 nt, Chlamydia trachomatis
cagagaaaauuucucuu

SEQ ID NO: 2498946 - RNA, 23 nt, Chlamydia trachomatis
cagagaagaacacacuuucccca

SEQ ID NO: 2498947 - RNA, 15 nt, Chlamydia trachomatis
cagagaaucuuaaac

SEQ ID NO: 2498948 - RNA, 16 nt, Chlamydia trachomatis
cagagaaucuuaaaca

SEQ ID NO: 2498949 - RNA, 13 nt, Chlamydia trachomatis
cagagaggcugua

SEQ ID NO: 2498950 - RNA, 20 nt, Chlamydia trachomatis
cagagaggcuguaacuaaac

SEQ ID NO: 2498951 - RNA, 23 nt, Chlamydia trachomatis
cagagaggugugauaggagagga

SEQ ID NO: 2498952 - RNA, 16 nt, Chlamydia trachomatis
cagagaucuaauugga

SEQ ID NO: 2498953 - RNA, 24 nt, Chlamydia trachomatis
cagagaugauauuuucauccacuu

SEQ ID NO: 2498954 - RNA, 18 nt, Chlamydia trachomatis
cagagcaaauagaauaaa

SEQ ID NO: 2498955 - RNA, 22 nt, Chlamydia trachomatis
cagagcaaauagaauaaaaggc

SEQ ID NO: 2498956 - RNA, 15 nt, Chlamydia trachomatis
cagagcaauagacac

SEQ ID NO: 2498957 - RNA, 20 nt, Chlamydia trachomatis
cagagcauguguuucuggaa

SEQ ID NO: 2498958 - RNA, 15 nt, Chlamydia trachomatis
cagagcccuucuuuu

SEQ ID NO: 2498959 - RNA, 18 nt, Chlamydia trachomatis
cagagcuuugcagauccc

SEQ ID NO: 2498960 - RNA, 20 nt, Chlamydia trachomatis
cagaggauuuauaaagagau

SEQ ID NO: 2498961 - RNA, 23 nt, Chlamydia trachomatis
cagaggauuuauaaagagauggu

SEQ ID NO: 2498962 - RNA, 23 nt, Chlamydia trachomatis
cagaggggggcuugcacaaucuc

SEQ ID NO: 2498963 - RNA, 16 nt, Chlamydia trachomatis
cagauaacuggugugg

SEQ ID NO: 2498964 - RNA, 20 nt, Chlamydia trachomatis
cagauaccaagccauuucca

SEQ ID NO: 2498965 - RNA, 21 nt, Chlamydia trachomatis
cagauaccaagccauuuccag

SEQ ID NO: 2498966 - RNA, 23 nt, Chlamydia trachomatis
cagauauggaagaacagcagcag

SEQ ID NO: 2498967 - RNA, 19 nt, Chlamydia trachomatis
cagaucauccauaaaaacu

SEQ ID NO: 2498968 - RNA, 19 nt, Chlamydia trachomatis
cagaucauuuuaauaagau

SEQ ID NO: 2498969 - RNA, 17 nt, Chlamydia trachomatis
cagaugacucaaacugu

SEQ ID NO: 2498970 - RNA, 22 nt, Chlamydia trachomatis
cagaugauugaaguucuuuuuc

SEQ ID NO: 2498971 - RNA, 17 nt, Chlamydia trachomatis
cagaugcacuuccucug

SEQ ID NO: 2498972 - RNA, 14 nt, Chlamydia trachomatis
cagaugccuugagg

SEQ ID NO: 2498973 - RNA, 15 nt, Chlamydia trachomatis
cagauugcuuuaacu

SEQ ID NO: 2498974 - RNA, 19 nt, Chlamydia trachomatis
cagauuuuguagcacagcu

SEQ ID NO: 2498975 - RNA, 15 nt, Chlamydia trachomatis
cagcaaaaagaggag

SEQ ID NO: 2498976 - RNA, 21 nt, Chlamydia trachomatis
cagcaaaaccuuuugaaacau

SEQ ID NO: 2498977 - RNA, 23 nt, Chlamydia trachomatis
cagcaaaaccuuuugaaacaucu

SEQ ID NO: 2498978 - RNA, 19 nt, Chlamydia trachomatis
cagcaaauguggauagcaa

SEQ ID NO: 2498979 - RNA, 12 nt, Chlamydia trachomatis
cagcaacaugca

SEQ ID NO: 2498980 - RNA, 13 nt, Chlamydia trachomatis
cagcaagagagau

SEQ ID NO: 2498981 - RNA, 14 nt, Chlamydia trachomatis
cagcaagcuugucu

SEQ ID NO: 2498982 - RNA, 18 nt, Chlamydia trachomatis
cagcaauaccgaaucuaa

SEQ ID NO: 2498983 - RNA, 13 nt, Chlamydia trachomatis
cagcacacuccua

SEQ ID NO: 2498984 - RNA, 16 nt, Chlamydia trachomatis
cagcaccaagcuccac

SEQ ID NO: 2498985 - RNA, 19 nt, Chlamydia trachomatis
cagcacccacauuaccauu

SEQ ID NO: 2498986 - RNA, 21 nt, Chlamydia trachomatis
cagcagaacucaacgaaagca

SEQ ID NO: 2498987 - RNA, 14 nt, Chlamydia trachomatis
cagcagacccaaau

SEQ ID NO: 2498988 - RNA, 19 nt, Chlamydia trachomatis
cagcagauauggaagaaca

SEQ ID NO: 2498989 - RNA, 17 nt, Chlamydia trachomatis
cagcagaucauccauaa

SEQ ID NO: 2498990 - RNA, 15 nt, Chlamydia trachomatis
cagcagcuuccugag

SEQ ID NO: 2498991 - RNA, 19 nt, Chlamydia trachomatis
cagcaggcgaacagugaca

SEQ ID NO: 2498992 - RNA, 19 nt, Chlamydia trachomatis
cagcagucgcgcagcuucu

SEQ ID NO: 2498993 - RNA, 20 nt, Chlamydia trachomatis
cagcauaaauccuugagcgu

SEQ ID NO: 2498994 - RNA, 18 nt, Chlamydia trachomatis
cagcaucccaagaauggu

SEQ ID NO: 2498995 - RNA, 18 nt, Chlamydia trachomatis
cagcaucucgguauucuc

SEQ ID NO: 2498996 - RNA, 13 nt, Chlamydia trachomatis
cagcauucauaaa

SEQ ID NO: 2498997 - RNA, 15 nt, Chlamydia trachomatis
cagcauuuacuccua

SEQ ID NO: 2498998 - RNA, 19 nt, Chlamydia trachomatis
cagcauuuuaaaaucacuu

SEQ ID NO: 2498999 - RNA, 22 nt, Chlamydia trachomatis
cagcauuuuaaaaucacuuucu

SEQ ID NO: 2499000 - RNA, 17 nt, Chlamydia trachomatis
cagccacaguacggcag

SEQ ID NO: 2499001 - RNA, 18 nt, Chlamydia trachomatis
cagccacuccugcagcua

SEQ ID NO: 2499002 - RNA, 22 nt, Chlamydia trachomatis
cagccacuugcuccacacaaca

SEQ ID NO: 2499003 - RNA, 18 nt, Chlamydia trachomatis
cagccccuucaauuucuu

SEQ ID NO: 2499004 - RNA, 21 nt, Chlamydia trachomatis
cagccucaucauuaauuagaa

SEQ ID NO: 2499005 - RNA, 14 nt, Chlamydia trachomatis
cagccucuccagaa

SEQ ID NO: 2499006 - RNA, 18 nt, Chlamydia trachomatis
cagccucucuuugcucca

SEQ ID NO: 2499007 - RNA, 19 nt, Chlamydia trachomatis
cagccucucuuugcuccac

SEQ ID NO: 2499008 - RNA, 18 nt, Chlamydia trachomatis
cagccucugccgcuguag

SEQ ID NO: 2499009 - RNA, 20 nt, Chlamydia trachomatis
cagcgaagaaccgaauuugu

SEQ ID NO: 2499010 - RNA, 20 nt, Chlamydia trachomatis
cagcgauugaucuaucgcuu

SEQ ID NO: 2499011 - RNA, 17 nt, Chlamydia trachomatis
cagcgcuuucuaaagca

SEQ ID NO: 2499012 - RNA, 13 nt, Chlamydia trachomatis
cagcgucaucuuu

SEQ ID NO: 2499013 - RNA, 14 nt, Chlamydia trachomatis
cagcuaaccaugcu

SEQ ID NO: 2499014 - RNA, 20 nt, Chlamydia trachomatis
cagcuagaacauacccuaaa

SEQ ID NO: 2499015 - RNA, 16 nt, Chlamydia trachomatis
cagcucaccagcuucc

SEQ ID NO: 2499016 - RNA, 19 nt, Chlamydia trachomatis
cagcuccuaucacucccug

SEQ ID NO: 2499017 - RNA, 16 nt, Chlamydia trachomatis
cagcucgaucaauaag

SEQ ID NO: 2499018 - RNA, 16 nt, Chlamydia trachomatis
cagcucuaauuaauaa

SEQ ID NO: 2499019 - RNA, 15 nt, Chlamydia trachomatis
cagcucuccucguga

SEQ ID NO: 2499020 - RNA, 14 nt, Chlamydia trachomatis
cagcucuuacuccu

SEQ ID NO: 2499021 - RNA, 16 nt, Chlamydia trachomatis
cagcucuuacuccuaa

SEQ ID NO: 2499022 - RNA, 15 nt, Chlamydia trachomatis
cagcugcuuggaaua

SEQ ID NO: 2499023 - RNA, 18 nt, Chlamydia trachomatis
cagcuguacgauggaaau

SEQ ID NO: 2499024 - RNA, 13 nt, Chlamydia trachomatis
cagcuuaaggguu

SEQ ID NO: 2499025 - RNA, 17 nt, Chlamydia trachomatis
cagcuucacguuuuucg

SEQ ID NO: 2499026 - RNA, 17 nt, Chlamydia trachomatis
cagcuucugaacgagaa

SEQ ID NO: 2499027 - RNA, 19 nt, Chlamydia trachomatis
cagcuucugaacgagaaaa

SEQ ID NO: 2499028 - RNA, 23 nt, Chlamydia trachomatis
cagcuucuucuauaagaaacaca

SEQ ID NO: 2499029 - RNA, 22 nt, Chlamydia trachomatis
cagcuucuugaaugccuaacga

SEQ ID NO: 2499030 - RNA, 13 nt, Chlamydia trachomatis
cagcuuucuuuuc

SEQ ID NO: 2499031 - RNA, 23 nt, Chlamydia trachomatis
cagcuuuucuaacguuccuccuc

SEQ ID NO: 2499032 - RNA, 12 nt, Chlamydia trachomatis
caggaaaagcuu

SEQ ID NO: 2499033 - RNA, 14 nt, Chlamydia trachomatis
caggaacuucuuca

SEQ ID NO: 2499034 - RNA, 19 nt, Chlamydia trachomatis
caggacgaacgaagaacga

SEQ ID NO: 2499035 - RNA, 19 nt, Chlamydia trachomatis
caggagagucugcuacaaa

SEQ ID NO: 2499036 - RNA, 23 nt, Chlamydia trachomatis
caggagaguguuugcauucuuuu

SEQ ID NO: 2499037 - RNA, 18 nt, Chlamydia trachomatis
caggagaucccaaaagau

SEQ ID NO: 2499038 - RNA, 21 nt, Chlamydia trachomatis
caggagauguaggauucagag

SEQ ID NO: 2499039 - RNA, 24 nt, Chlamydia trachomatis
caggagcgcuuuuuuuuuagaaca

SEQ ID NO: 2499040 - RNA, 15 nt, Chlamydia trachomatis
caggaguaggaaggu

SEQ ID NO: 2499041 - RNA, 15 nt, Chlamydia trachomatis
caggauauccaucaa

SEQ ID NO: 2499042 - RNA, 20 nt, Chlamydia trachomatis
caggaucuagacaaucuggu

SEQ ID NO: 2499043 - RNA, 19 nt, Chlamydia trachomatis
caggauuccggaagauaca

SEQ ID NO: 2499044 - RNA, 14 nt, Chlamydia trachomatis
caggauuuucuaau

SEQ ID NO: 2499045 - RNA, 23 nt, Chlamydia trachomatis
caggcauuuccgguauuaauaau

SEQ ID NO: 2499046 - RNA, 14 nt, Chlamydia trachomatis
caggccuuccaccu

SEQ ID NO: 2499047 - RNA, 19 nt, Chlamydia trachomatis
caggcgaacagugacagca

SEQ ID NO: 2499048 - RNA, 18 nt, Chlamydia trachomatis
caggcugaucaauaccua

SEQ ID NO: 2499049 - RNA, 16 nt, Chlamydia trachomatis
caggcuuuucuuuuuu

SEQ ID NO: 2499050 - RNA, 17 nt, Chlamydia trachomatis
caggcuuuucuuuuuug

SEQ ID NO: 2499051 - RNA, 17 nt, Chlamydia trachomatis
cagggauaguaaaaacu

SEQ ID NO: 2499052 - RNA, 17 nt, Chlamydia trachomatis
cagggaucgagucccuu

SEQ ID NO: 2499053 - RNA, 18 nt, Chlamydia trachomatis
cagggauggucucacaca

SEQ ID NO: 2499054 - RNA, 17 nt, Chlamydia trachomatis
cagguaccuauaauaau

SEQ ID NO: 2499055 - RNA, 18 nt, Chlamydia trachomatis
cagguaccuauaauaaug

SEQ ID NO: 2499056 - RNA, 14 nt, Chlamydia trachomatis
caggucacauuuuc

SEQ ID NO: 2499057 - RNA, 20 nt, Chlamydia trachomatis
caggucauauccacuuggag

SEQ ID NO: 2499058 - RNA, 15 nt, Chlamydia trachomatis
caggucauucgucaa

SEQ ID NO: 2499059 - RNA, 16 nt, Chlamydia trachomatis
caggugaauucuccag

SEQ ID NO: 2499060 - RNA, 18 nt, Chlamydia trachomatis
cagguucguuauucucaa

SEQ ID NO: 2499061 - RNA, 17 nt, Chlamydia trachomatis
cagguugagcaagcuca

SEQ ID NO: 2499062 - RNA, 22 nt, Chlamydia trachomatis
caguaaagaaaagcuccuagag

SEQ ID NO: 2499063 - RNA, 19 nt, Chlamydia trachomatis
caguaaauuucaucccaca

SEQ ID NO: 2499064 - RNA, 15 nt, Chlamydia trachomatis
caguaaucaaauuuc

SEQ ID NO: 2499065 - RNA, 16 nt, Chlamydia trachomatis
caguaaucaaauuucu

SEQ ID NO: 2499066 - RNA, 15 nt, Chlamydia trachomatis
caguaccauuacuac

SEQ ID NO: 2499067 - RNA, 22 nt, Chlamydia trachomatis
caguaccgucacucuugauagu

SEQ ID NO: 2499068 - RNA, 14 nt, Chlamydia trachomatis
caguacugcuacaa

SEQ ID NO: 2499069 - RNA, 16 nt, Chlamydia trachomatis
caguacugcuacaaaa

SEQ ID NO: 2499070 - RNA, 20 nt, Chlamydia trachomatis
caguagaaacuuacuuuucu

SEQ ID NO: 2499071 - RNA, 12 nt, Chlamydia trachomatis
caguaguuuacu

SEQ ID NO: 2499072 - RNA, 22 nt, Chlamydia trachomatis
cagucaauccacgaauuuucuc

SEQ ID NO: 2499073 - RNA, 12 nt, Chlamydia trachomatis
cagucuguguuu

SEQ ID NO: 2499074 - RNA, 17 nt, Chlamydia trachomatis
cagucuucuuuucugag

SEQ ID NO: 2499075 - RNA, 22 nt, Chlamydia trachomatis
cagucuucuuuucugagacucc

SEQ ID NO: 2499076 - RNA, 19 nt, Chlamydia trachomatis
cagugacauuauuuuuucg

SEQ ID NO: 2499077 - RNA, 13 nt, Chlamydia trachomatis
cagugacuauuuc

SEQ ID NO: 2499078 - RNA, 19 nt, Chlamydia trachomatis
cagugacuugauuggauaa

SEQ ID NO: 2499079 - RNA, 22 nt, Chlamydia trachomatis
cagugcgcuuagcacuugaguu

SEQ ID NO: 2499080 - RNA, 14 nt, Chlamydia trachomatis
cagugcucaaagau

SEQ ID NO: 2499081 - RNA, 21 nt, Chlamydia trachomatis
caguuaaccuugggaaucuuc

SEQ ID NO: 2499082 - RNA, 18 nt, Chlamydia trachomatis
caguuacauuuuucgcua

SEQ ID NO: 2499083 - RNA, 14 nt, Chlamydia trachomatis
caguuacccucuuu

SEQ ID NO: 2499084 - RNA, 18 nt, Chlamydia trachomatis
caguuaggaaaugaggac

SEQ ID NO: 2499085 - RNA, 15 nt, Chlamydia trachomatis
caguuaggcauuccu

SEQ ID NO: 2499086 - RNA, 19 nt, Chlamydia trachomatis
caguuaggcauuccuuucu

SEQ ID NO: 2499087 - RNA, 19 nt, Chlamydia trachomatis
caguuccgcagagaucuaa

SEQ ID NO: 2499088 - RNA, 23 nt, Chlamydia trachomatis
caguucuggagcaacaaccaacu

SEQ ID NO: 2499089 - RNA, 19 nt, Chlamydia trachomatis
caguucuucacuuuucuag

SEQ ID NO: 2499090 - RNA, 18 nt, Chlamydia trachomatis
caguuucaaacauccagu

SEQ ID NO: 2499091 - RNA, 23 nt, Chlamydia trachomatis
caguuucuaggucugaagaaaaa

SEQ ID NO: 2499092 - RNA, 18 nt, Chlamydia trachomatis
caguuugagcuuuauuuu

SEQ ID NO: 2499093 - RNA, 17 nt, Chlamydia trachomatis
caguuugucuuagaaga

SEQ ID NO: 2499094 - RNA, 18 nt, Chlamydia trachomatis
caguuuuuuggggggauu

SEQ ID NO: 2499095 - RNA, 23 nt, Chlamydia trachomatis
cauaaaaacugcugcuaucaucu

SEQ ID NO: 2499096 - RNA, 13 nt, Chlamydia trachomatis
cauaaaaagauag

SEQ ID NO: 2499097 - RNA, 21 nt, Chlamydia trachomatis
cauaaaaagauagugcagaag

SEQ ID NO: 2499098 - RNA, 20 nt, Chlamydia trachomatis
cauaaaacuauggagagggu

SEQ ID NO: 2499099 - RNA, 21 nt, Chlamydia trachomatis
cauaaaacuauggagaggguu

SEQ ID NO: 2499100 - RNA, 22 nt, Chlamydia trachomatis
cauaaaacucuccaaacucuau

SEQ ID NO: 2499101 - RNA, 16 nt, Chlamydia trachomatis
cauaaaagagaagaac

SEQ ID NO: 2499102 - RNA, 23 nt, Chlamydia trachomatis
cauaaacgguggaacagcucuaa

SEQ ID NO: 2499103 - RNA, 12 nt, Chlamydia trachomatis
cauaaaggaaag

SEQ ID NO: 2499104 - RNA, 15 nt, Chlamydia trachomatis
cauaaaggaaagggc

SEQ ID NO: 2499105 - RNA, 15 nt, Chlamydia trachomatis
cauaaauaucuugag

SEQ ID NO: 2499106 - RNA, 23 nt, Chlamydia trachomatis
cauaaauuugcugagaucgagcu

SEQ ID NO: 2499107 - RNA, 16 nt, Chlamydia trachomatis
cauaacacauaucucc

SEQ ID NO: 2499108 - RNA, 23 nt, Chlamydia trachomatis
cauaacacauaucuccaaaaaua

SEQ ID NO: 2499109 - RNA, 21 nt, Chlamydia trachomatis
cauaacaccugcauagcugaa

SEQ ID NO: 2499110 - RNA, 21 nt, Chlamydia trachomatis
cauaacagcaagacaacguua

SEQ ID NO: 2499111 - RNA, 18 nt, Chlamydia trachomatis
cauaacagggaaaaacag

SEQ ID NO: 2499112 - RNA, 17 nt, Chlamydia trachomatis
gauaggacuugaaccua

SEQ ID NO: 2499113 - RNA, 18 nt, Chlamydia trachomatis
gauaggagaggauuaagg

SEQ ID NO: 2499114 - RNA, 20 nt, Chlamydia trachomatis
gauaggagaggauuaaggaa

SEQ ID NO: 2499115 - RNA, 22 nt, Chlamydia trachomatis
gauagguacggcuucauggaau

SEQ ID NO: 2499116 - RNA, 13 nt, Chlamydia trachomatis
gauagucugcauu

SEQ ID NO: 2499117 - RNA, 19 nt, Chlamydia trachomatis
gauagucugcauuaaacac

SEQ ID NO: 2499118 - RNA, 20 nt, Chlamydia trachomatis
gauagucuggagcauaaaga

SEQ ID NO: 2499119 - RNA, 12 nt, Chlamydia trachomatis
gauaguuacaga

SEQ ID NO: 2499120 - RNA, 20 nt, Chlamydia trachomatis
gauaguucuaacacuuuuuu

SEQ ID NO: 2499121 - RNA, 24 nt, Chlamydia trachomatis
gauaguuuuguaaacgagagccca

SEQ ID NO: 2499122 - RNA, 16 nt, Chlamydia trachomatis
gauauaaagaagacuu

SEQ ID NO: 2499123 - RNA, 21 nt, Chlamydia trachomatis
gauauauagaccagagucucc

SEQ ID NO: 2499124 - RNA, 18 nt, Chlamydia trachomatis
gauaucaaucguagaaaa

SEQ ID NO: 2499125 - RNA, 15 nt, Chlamydia trachomatis
gauauccaucauaaa

SEQ ID NO: 2499126 - RNA, 19 nt, Chlamydia trachomatis
gauauccaucauaaaaaga

SEQ ID NO: 2499127 - RNA, 15 nt, Chlamydia trachomatis
gauaucccuuuccaa

SEQ ID NO: 2499128 - RNA, 19 nt, Chlamydia trachomatis
gauaucuaggucucccagg

SEQ ID NO: 2499129 - RNA, 23 nt, Chlamydia trachomatis
gauaucuaggucucccagguugu

SEQ ID NO: 2499130 - RNA, 23 nt, Chlamydia trachomatis
gauaucucccuuagcaacaguca

SEQ ID NO: 2499131 - RNA, 15 nt, Chlamydia trachomatis
gauaucuucuugaau

SEQ ID NO: 2499132 - RNA, 22 nt, Chlamydia trachomatis
gauaucuuuacucuuuucuuua

SEQ ID NO: 2499133 - RNA, 17 nt, Chlamydia trachomatis
gauaugcaaguaaugac

SEQ ID NO: 2499134 - RNA, 16 nt, Chlamydia trachomatis
gauaugcagcauccaa

SEQ ID NO: 2499135 - RNA, 17 nt, Chlamydia trachomatis
gauaugccucuaagcac

SEQ ID NO: 2499136 - RNA, 24 nt, Chlamydia trachomatis
gauaugcuacuccuaaaucgcaaa

SEQ ID NO: 2499137 - RNA, 16 nt, Chlamydia trachomatis
gauauguuaaagccca

SEQ ID NO: 2499138 - RNA, 15 nt, Chlamydia trachomatis
gauauuucuuccugu

SEQ ID NO: 2499139 - RNA, 15 nt, Chlamydia trachomatis
gaucaagaaaagaua

SEQ ID NO: 2499140 - RNA, 21 nt, Chlamydia trachomatis
gaucaauaccuagcaauucau

SEQ ID NO: 2499141 - RNA, 13 nt, Chlamydia trachomatis
gaucaauccccaa

SEQ ID NO: 2499142 - RNA, 17 nt, Chlamydia trachomatis
gaucagagggacgagca

SEQ ID NO: 2499143 - RNA, 15 nt, Chlamydia trachomatis
gaucagcaaaaagag

SEQ ID NO: 2499144 - RNA, 13 nt, Chlamydia trachomatis
gaucauaaagucu

SEQ ID NO: 2499145 - RNA, 14 nt, Chlamydia trachomatis
gaucauagacuguu

SEQ ID NO: 2499146 - RNA, 21 nt, Chlamydia trachomatis
gaucauauccuuaacgauguu

SEQ ID NO: 2499147 - RNA, 22 nt, Chlamydia trachomatis
gaucaugcagaugaagaaucuc

SEQ ID NO: 2499148 - RNA, 13 nt, Chlamydia trachomatis
gaucauugaguuc

SEQ ID NO: 2499149 - RNA, 16 nt, Chlamydia trachomatis
gauccaaggagcuccc

SEQ ID NO: 2499150 - RNA, 22 nt, Chlamydia trachomatis
gauccacuggaauagcuagagc

SEQ ID NO: 2499151 - RNA, 17 nt, Chlamydia trachomatis
gauccaggagauguagg

SEQ ID NO: 2499152 - RNA, 19 nt, Chlamydia trachomatis
gaucccaggaucccucugu

SEQ ID NO: 2499153 - RNA, 16 nt, Chlamydia trachomatis
gaucccauaaucucau

SEQ ID NO: 2499154 - RNA, 20 nt, Chlamydia trachomatis
gauccccacgaccacaaaca

SEQ ID NO: 2499155 - RNA, 20 nt, Chlamydia trachomatis
gaucccuuuuucaggagagu

SEQ ID NO: 2499156 - RNA, 17 nt, Chlamydia trachomatis
gauccgauagcaugcaa

SEQ ID NO: 2499157 - RNA, 19 nt, Chlamydia trachomatis
gauccguuaaagagucuuc

SEQ ID NO: 2499158 - RNA, 16 nt, Chlamydia trachomatis
gaucgaucccuuuuuc

SEQ ID NO: 2499159 - RNA, 15 nt, Chlamydia trachomatis
gaucgcaagccacca

SEQ ID NO: 2499160 - RNA, 18 nt, Chlamydia trachomatis
gaucggagucugcuccac

SEQ ID NO: 2499161 - RNA, 18 nt, Chlamydia trachomatis
gaucuaaagcagaaacaa

SEQ ID NO: 2499162 - RNA, 16 nt, Chlamydia trachomatis
gaucuaauucuagcaa

SEQ ID NO: 2499163 - RNA, 18 nt, Chlamydia trachomatis
gaucuacagcaaaaccuu

SEQ ID NO: 2499164 - RNA, 17 nt, Chlamydia trachomatis
gaucuagaaguuuuccc

SEQ ID NO: 2499165 - RNA, 22 nt, Chlamydia trachomatis
gaucuaucgcuugaaaagaacc

SEQ ID NO: 2499166 - RNA, 18 nt, Chlamydia trachomatis
gaucuaugugcaagauau

SEQ ID NO: 2499167 - RNA, 14 nt, Chlamydia trachomatis
gaucucccucauuu

SEQ ID NO: 2499168 - RNA, 12 nt, Chlamydia trachomatis
gaucuccuuccu

SEQ ID NO: 2499169 - RNA, 19 nt, Chlamydia trachomatis
gaucuccuuccucuuuaac

SEQ ID NO: 2499170 - RNA, 15 nt, Chlamydia trachomatis
gaucucugcagaaga

SEQ ID NO: 2499171 - RNA, 20 nt, Chlamydia trachomatis
gaucucuuagacccucuaau

SEQ ID NO: 2499172 - RNA, 17 nt, Chlamydia trachomatis
gaucugaaaagagaaga

SEQ ID NO: 2499173 - RNA, 20 nt, Chlamydia trachomatis
gaucugcaucuuuauagaau

SEQ ID NO: 2499174 - RNA, 22 nt, Chlamydia trachomatis
gaucugcgguauccauacgaaa

SEQ ID NO: 2499175 - RNA, 15 nt, Chlamydia trachomatis
gaucuguaccgaacu

SEQ ID NO: 2499176 - RNA, 18 nt, Chlamydia trachomatis
gaucuguuagugaagagc

SEQ ID NO: 2499177 - RNA, 19 nt, Chlamydia trachomatis
gaucuguuagugaagagca

SEQ ID NO: 2499178 - RNA, 17 nt, Chlamydia trachomatis
gaucuucagaaaucuuc

SEQ ID NO: 2499179 - RNA, 19 nt, Chlamydia trachomatis
gaucuucagaaaucuucuu

SEQ ID NO: 2499180 - RNA, 22 nt, Chlamydia trachomatis
gaucuuccagccuacaaauaaa

SEQ ID NO: 2499181 - RNA, 20 nt, Chlamydia trachomatis
gaucuugaucugaaaagaga

SEQ ID NO: 2499182 - RNA, 16 nt, Chlamydia trachomatis
gaucuuuaagcucuuc

SEQ ID NO: 2499183 - RNA, 22 nt, Chlamydia trachomatis
gaucuuuccagcaggccucugu

SEQ ID NO: 2499184 - RNA, 17 nt, Chlamydia trachomatis
gaucuuuuuaggaggaa

SEQ ID NO: 2499185 - RNA, 12 nt, Chlamydia trachomatis
gaugaaaaagaa

SEQ ID NO: 2499186 - RNA, 13 nt, Chlamydia trachomatis
gaugaaaaagaag

SEQ ID NO: 2499187 - RNA, 12 nt, Chlamydia trachomatis
gaugaaccauuu

SEQ ID NO: 2499188 - RNA, 20 nt, Chlamydia trachomatis
gaugaauuuuaucuaaaaag

SEQ ID NO: 2499189 - RNA, 15 nt, Chlamydia trachomatis
gaugaccacuacucu

SEQ ID NO: 2499190 - RNA, 19 nt, Chlamydia trachomatis
gaugaggaauccucuuccg

SEQ ID NO: 2499191 - RNA, 21 nt, Chlamydia trachomatis
gaugauuaucaccuauuaaga

SEQ ID NO: 2499192 - RNA, 17 nt, Chlamydia trachomatis
gaugauucccuguagaa

SEQ ID NO: 2499193 - RNA, 16 nt, Chlamydia trachomatis
gaugcaaauaagaaag

SEQ ID NO: 2499194 - RNA, 14 nt, Chlamydia trachomatis
gaugcaccauaaua

SEQ ID NO: 2499195 - RNA, 18 nt, Chlamydia trachomatis
gaugccauccagagcugu

SEQ ID NO: 2499196 - RNA, 16 nt, Chlamydia trachomatis
gaugcccaagaaacug

SEQ ID NO: 2499197 - RNA, 10 nt, Chlamydia trachomatis
gaugccgcag

SEQ ID NO: 2499198 - RNA, 16 nt, Chlamydia trachomatis
gaugccgcagaaaaaa

SEQ ID NO: 2499199 - RNA, 13 nt, Chlamydia trachomatis
gaugccucuaaca

SEQ ID NO: 2499200 - RNA, 16 nt, Chlamydia trachomatis
gaugcgaucuccucau

SEQ ID NO: 2499201 - RNA, 14 nt, Chlamydia trachomatis
gaugcuauuuucag

SEQ ID NO: 2499202 - RNA, 16 nt, Chlamydia trachomatis
gaugcuccucucuuug

SEQ ID NO: 2499203 - RNA, 16 nt, Chlamydia trachomatis
gaugcuucugccuuuu

SEQ ID NO: 2499204 - RNA, 17 nt, Chlamydia trachomatis
gauggagauggaguagg

SEQ ID NO: 2499205 - RNA, 22 nt, Chlamydia trachomatis
gauguaagguuugucuucagau

SEQ ID NO: 2499206 - RNA, 23 nt, Chlamydia trachomatis
gauguaaguaagcgcuuccauuu

SEQ ID NO: 2499207 - RNA, 15 nt, Chlamydia trachomatis
gauguaggauucaga

SEQ ID NO: 2499208 - RNA, 16 nt, Chlamydia trachomatis
gauguccaaagcucuu

SEQ ID NO: 2499209 - RNA, 18 nt, Chlamydia trachomatis
gauguuguuaaagcuuuu

SEQ ID NO: 2499210 - RNA, 18 nt, Chlamydia trachomatis
gauguuuguguuucuaaa

SEQ ID NO: 2499211 - RNA, 16 nt, Chlamydia trachomatis
gauuaaaguuucuaau

SEQ ID NO: 2499212 - RNA, 16 nt, Chlamydia trachomatis
gauuaaccaaaagagc

SEQ ID NO: 2499213 - RNA, 20 nt, Chlamydia trachomatis
gauuaaggaaugauaaggga

SEQ ID NO: 2499214 - RNA, 20 nt, Chlamydia trachomatis
gauuacagcaagaagaagag

SEQ ID NO: 2499215 - RNA, 21 nt, Chlamydia trachomatis
gauuacagcaagaagaagaga

SEQ ID NO: 2499216 - RNA, 15 nt, Chlamydia trachomatis
gauuacuuuuucuac

SEQ ID NO: 2499217 - RNA, 17 nt, Chlamydia trachomatis
gauuagaagauaacaac

SEQ ID NO: 2499218 - RNA, 16 nt, Chlamydia trachomatis
gauuaggaagaagugu

SEQ ID NO: 2499219 - RNA, 14 nt, Chlamydia trachomatis
gauuaggguagucg

SEQ ID NO: 2499220 - RNA, 22 nt, Chlamydia trachomatis
gauuauaccagcagacccaaau

SEQ ID NO: 2499221 - RNA, 19 nt, Chlamydia trachomatis
gauuaucauucaaaaucca

SEQ ID NO: 2499222 - RNA, 13 nt, Chlamydia trachomatis
gauuaucuaaagc

SEQ ID NO: 2499223 - RNA, 15 nt, Chlamydia trachomatis
gauuaucuaaagcca

SEQ ID NO: 2499224 - RNA, 22 nt, Chlamydia trachomatis
gauuaugaaaaagccugugccu

SEQ ID NO: 2499225 - RNA, 14 nt, Chlamydia trachomatis
gauucaaaagcuau

SEQ ID NO: 2499226 - RNA, 20 nt, Chlamydia trachomatis
gauucaaaagcuaucuuugc

SEQ ID NO: 2499227 - RNA, 18 nt, Chlamydia trachomatis
gauucaucaaaauauuuu

SEQ ID NO: 2499228 - RNA, 19 nt, Chlamydia trachomatis
gauucaucaaaauauuuug

SEQ ID NO: 2499229 - RNA, 23 nt, Chlamydia trachomatis
gauucaucaaaauauuuugcugu

SEQ ID NO: 2499230 - RNA, 21 nt, Chlamydia trachomatis
gauuccaguuacccucuuuag

SEQ ID NO: 2499231 - RNA, 19 nt, Chlamydia trachomatis
gauucgcaucaaugaugua

SEQ ID NO: 2499232 - RNA, 19 nt, Chlamydia trachomatis
gauucgguaucugagcuuu

SEQ ID NO: 2499233 - RNA, 23 nt, Chlamydia trachomatis
gauucguuugugcuaaaucucca

SEQ ID NO: 2499234 - RNA, 15 nt, Chlamydia trachomatis
gauucuaugagaaga

SEQ ID NO: 2499235 - RNA, 19 nt, Chlamydia trachomatis
gauucuccgaauaaagcuc

SEQ ID NO: 2499236 - RNA, 20 nt, Chlamydia trachomatis
gauucuccuuagauccggcu

SEQ ID NO: 2499237 - RNA, 22 nt, Chlamydia trachomatis
gauucucugcacaauauuaucu

SEQ ID NO: 2499238 - RNA, 16 nt, Chlamydia trachomatis
gauucugcuccaaaga

SEQ ID NO: 2499239 - RNA, 16 nt, Chlamydia trachomatis
gauucuugauaaauaa

SEQ ID NO: 2499240 - RNA, 17 nt, Chlamydia trachomatis
gauugaauaaaucuauc

SEQ ID NO: 2499241 - RNA, 20 nt, Chlamydia trachomatis
gauugacaacuuucuuuugu

SEQ ID NO: 2499242 - RNA, 15 nt, Chlamydia trachomatis
gauugaugacaacua

SEQ ID NO: 2499243 - RNA, 16 nt, Chlamydia trachomatis
gauugcguuacuucuu

SEQ ID NO: 2499244 - RNA, 16 nt, Chlamydia trachomatis
gauuggaaaauccaaa

SEQ ID NO: 2499245 - RNA, 15 nt, Chlamydia trachomatis
gauuggauaucuugc

SEQ ID NO: 2499246 - RNA, 14 nt, Chlamydia trachomatis
gauuggaucagcuc

SEQ ID NO: 2499247 - RNA, 21 nt, Chlamydia trachomatis
gauuguuguaugcucgccucu

SEQ ID NO: 2499248 - RNA, 20 nt, Chlamydia trachomatis
gauuuagacacauucccuaa

SEQ ID NO: 2499249 - RNA, 16 nt, Chlamydia trachomatis
gauuuccccaagaugc

SEQ ID NO: 2499250 - RNA, 17 nt, Chlamydia trachomatis
gauuuccucuucuagaa

SEQ ID NO: 2499251 - RNA, 14 nt, Chlamydia trachomatis
gauuuccucuucuu

SEQ ID NO: 2499252 - RNA, 15 nt, Chlamydia trachomatis
gauuuccucuucuuc

SEQ ID NO: 2499253 - RNA, 21 nt, Chlamydia trachomatis
gauuucgauuaaugagguuuu

SEQ ID NO: 2499254 - RNA, 10 nt, Chlamydia trachomatis
gauuucuccu

SEQ ID NO: 2499255 - RNA, 16 nt, Chlamydia trachomatis
gauuucugaaucccuc

SEQ ID NO: 2499256 - RNA, 11 nt, Chlamydia trachomatis
gauuucuucug

SEQ ID NO: 2499257 - RNA, 13 nt, Chlamydia trachomatis
gauuucuucuguu

SEQ ID NO: 2499258 - RNA, 23 nt, Chlamydia trachomatis
gauuucuucuuugucauuaaagg

SEQ ID NO: 2499259 - RNA, 16 nt, Chlamydia trachomatis
gauuuguguagcuuuu

SEQ ID NO: 2499260 - RNA, 22 nt, Chlamydia trachomatis
gauuuguucucuaauccguagu

SEQ ID NO: 2499261 - RNA, 22 nt, Chlamydia trachomatis
gauuuuaugacccagaaucauc

SEQ ID NO: 2499262 - RNA, 22 nt, Chlamydia trachomatis
gauuuucuuuaggcauuaaagg

SEQ ID NO: 2499263 - RNA, 17 nt, Chlamydia trachomatis
gauuuugaauaauagaa

SEQ ID NO: 2499264 - RNA, 17 nt, Chlamydia trachomatis
gauuuugucgauaagaa

SEQ ID NO: 2499265 - RNA, 22 nt, Chlamydia trachomatis
gauuuuucaaaaauagcaauaa

SEQ ID NO: 2499266 - RNA, 17 nt, Chlamydia trachomatis
gauuuuucuuucaaaga

SEQ ID NO: 2499267 - RNA, 19 nt, Chlamydia trachomatis
gauuuuuuaauaauaaaga

SEQ ID NO: 2499268 - RNA, 15 nt, Chlamydia trachomatis
gauuuuuuucugcaa

SEQ ID NO: 2499269 - RNA, 21 nt, Chlamydia trachomatis
gcaaaaagugugccagcucua

SEQ ID NO: 2499270 - RNA, 12 nt, Chlamydia trachomatis
gcaaaaaucucu

SEQ ID NO: 2499271 - RNA, 14 nt, Chlamydia trachomatis
gcaaaagaaaaauc

SEQ ID NO: 2499272 - RNA, 22 nt, Chlamydia trachomatis
gcaaaagaugauagcagcaguu

SEQ ID NO: 2499273 - RNA, 17 nt, Chlamydia trachomatis
gcaaaagauuuccccaa

SEQ ID NO: 2499274 - RNA, 20 nt, Chlamydia trachomatis
gcaaaagcgaggcuucaaag

SEQ ID NO: 2499275 - RNA, 21 nt, Chlamydia trachomatis
gcaaaagcgaggcuucaaaga

SEQ ID NO: 2499276 - RNA, 18 nt, Chlamydia trachomatis
gcaaaaucuucauaagaa

SEQ ID NO: 2499277 - RNA, 16 nt, Chlamydia trachomatis
gcaaacugcucuucua

SEQ ID NO: 2499278 - RNA, 23 nt, Chlamydia trachomatis
gcaaacugcucuucuaacuuuuc

SEQ ID NO: 2499279 - RNA, 18 nt, Chlamydia trachomatis
gcaaacuucauauucccu

SEQ ID NO: 2499280 - RNA, 21 nt, Chlamydia trachomatis
gcaaagaaauagcuuaccuca

SEQ ID NO: 2499281 - RNA, 16 nt, Chlamydia trachomatis
gcaaagaacaguucau

SEQ ID NO: 2499282 - RNA, 14 nt, Chlamydia trachomatis
gcaaagagagcaac

SEQ ID NO: 2499283 - RNA, 14 nt, Chlamydia trachomatis
gcaaagaguaggga

SEQ ID NO: 2499284 - RNA, 17 nt, Chlamydia trachomatis
gcaaagugcuaauaacg

SEQ ID NO: 2499285 - RNA, 10 nt, Chlamydia trachomatis
gcaaauaaua

SEQ ID NO: 2499286 - RNA, 16 nt, Chlamydia trachomatis
gcaaauaauaaaccaa

SEQ ID NO: 2499287 - RNA, 22 nt, Chlamydia trachomatis
gcaaauccauucaagacaacuu

SEQ ID NO: 2499288 - RNA, 20 nt, Chlamydia trachomatis
gcaaaucccugugcuaucuu

SEQ ID NO: 2499289 - RNA, 21 nt, Chlamydia trachomatis
gcaaauccugcgcgcaaauca

SEQ ID NO: 2499290 - RNA, 17 nt, Chlamydia trachomatis
gcaaauuaacagauaua

SEQ ID NO: 2499291 - RNA, 15 nt, Chlamydia trachomatis
gcaacaacauaaucu

SEQ ID NO: 2499292 - RNA, 18 nt, Chlamydia trachomatis
gcaacaagaacgcuuucc

SEQ ID NO: 2499293 - RNA, 17 nt, Chlamydia trachomatis
gcaacaauauccuccau

SEQ ID NO: 2499294 - RNA, 18 nt, Chlamydia trachomatis
gcaacacaacuucugcua

SEQ ID NO: 2499295 - RNA, 16 nt, Chlamydia trachomatis
gcaaccauucaucuag

SEQ ID NO: 2499296 - RNA, 21 nt, Chlamydia trachomatis
gcaaccccgcauaccaaagca

SEQ ID NO: 2499297 - RNA, 22 nt, Chlamydia trachomatis
gcaacccucgcagagaaagagc

SEQ ID NO: 2499298 - RNA, 15 nt, Chlamydia trachomatis
gcaacgagaaguccu

SEQ ID NO: 2499299 - RNA, 23 nt, Chlamydia trachomatis
gcaacuaauauuagauagcuucu

SEQ ID NO: 2499300 - RNA, 17 nt, Chlamydia trachomatis
gcaacucucucucccca

SEQ ID NO: 2499301 - RNA, 13 nt, Chlamydia trachomatis
gcaacucuugcca

SEQ ID NO: 2499302 - RNA, 17 nt, Chlamydia trachomatis
gcaacucuuucauaaaa

SEQ ID NO: 2499303 - RNA, 16 nt, Chlamydia trachomatis
gcaacugcuuucuuug

SEQ ID NO: 2499304 - RNA, 16 nt, Chlamydia trachomatis
gcaacuucuggcagua

SEQ ID NO: 2499305 - RNA, 21 nt, Chlamydia trachomatis
gcaagaaaauagguaaagaag

SEQ ID NO: 2499306 - RNA, 13 nt, Chlamydia trachomatis
gcaagaacuguau

SEQ ID NO: 2499307 - RNA, 15 nt, Chlamydia trachomatis
gcaagaauacaagaa

SEQ ID NO: 2499308 - RNA, 17 nt, Chlamydia trachomatis
gcaagaauacaagaaag

SEQ ID NO: 2499309 - RNA, 15 nt, Chlamydia trachomatis
gcaagacaucuauug

SEQ ID NO: 2499310 - RNA, 20 nt, Chlamydia trachomatis
gcaagaucaugggaaauaaa

SEQ ID NO: 2499311 - RNA, 15 nt, Chlamydia trachomatis
gcaagcuugucuccu

SEQ ID NO: 2499312 - RNA, 14 nt, Chlamydia trachomatis
gcaaguaaugacac

SEQ ID NO: 2499313 - RNA, 19 nt, Chlamydia trachomatis
gcaaguaaugacacuggca

SEQ ID NO: 2499314 - RNA, 23 nt, Chlamydia trachomatis
gcaaguaaugacacuggcaccuu

SEQ ID NO: 2499315 - RNA, 18 nt, Chlamydia trachomatis
gcaaguucuccuucuugu

SEQ ID NO: 2499316 - RNA, 18 nt, Chlamydia trachomatis
gcaauaaucuuuuuauug

SEQ ID NO: 2499317 - RNA, 21 nt, Chlamydia trachomatis
gcaauaccgaaucuaauauga

SEQ ID NO: 2499318 - RNA, 12 nt, Chlamydia trachomatis
gcaauagauagu

SEQ ID NO: 2499319 - RNA, 15 nt, Chlamydia trachomatis
gcaauagcaacugcu

SEQ ID NO: 2499320 - RNA, 19 nt, Chlamydia trachomatis
gcaaucaagcuaaucauga

SEQ ID NO: 2499321 - RNA, 20 nt, Chlamydia trachomatis
gcaaucacaugguuuucugg

SEQ ID NO: 2499322 - RNA, 20 nt, Chlamydia trachomatis
gcaaucauuugugugccaau

SEQ ID NO: 2499323 - RNA, 22 nt, Chlamydia trachomatis
gcaauccuuuugauucugcucc

SEQ ID NO: 2499324 - RNA, 11 nt, Chlamydia trachomatis
gcaaucucuug

SEQ ID NO: 2499325 - RNA, 13 nt, Chlamydia trachomatis
gcaaugcgaucag

SEQ ID NO: 2499326 - RNA, 20 nt, Chlamydia trachomatis
gcaauggcaaaaucuucaua

SEQ ID NO: 2499327 - RNA, 16 nt, Chlamydia trachomatis
gcaauggcuaagccau

SEQ ID NO: 2499328 - RNA, 20 nt, Chlamydia trachomatis
gcaauggcuaagccauugcu

SEQ ID NO: 2499329 - RNA, 17 nt, Chlamydia trachomatis
gcaaugguuauaagacc

SEQ ID NO: 2499330 - RNA, 16 nt, Chlamydia trachomatis
gcacaaaaucccuucc

SEQ ID NO: 2499331 - RNA, 14 nt, Chlamydia trachomatis
gcacaaaggaacau

SEQ ID NO: 2499332 - RNA, 14 nt, Chlamydia trachomatis
gcacaaauccagcu

SEQ ID NO: 2499333 - RNA, 22 nt, Chlamydia trachomatis
gcacaaaucuuucuuucuaaga

SEQ ID NO: 2499334 - RNA, 12 nt, Chlamydia trachomatis
gcacaacgccca

SEQ ID NO: 2499335 - RNA, 24 nt, Chlamydia trachomatis
gcacaagcuguuccuaauagaucu

SEQ ID NO: 2499336 - RNA, 14 nt, Chlamydia trachomatis
gcacaauaacagca

SEQ ID NO: 2499337 - RNA, 21 nt, Chlamydia trachomatis
gcacaaucucuuuaagcuggg

SEQ ID NO: 2499338 - RNA, 17 nt, Chlamydia trachomatis
gcacacuccaucucgac

SEQ ID NO: 2499339 - RNA, 17 nt, Chlamydia trachomatis
gcacagcaugaacagcu

SEQ ID NO: 2499340 - RNA, 18 nt, Chlamydia trachomatis
gcacagguguaguaggga

SEQ ID NO: 2499341 - RNA, 13 nt, Chlamydia trachomatis
gcacaucacagau

SEQ ID NO: 2499342 - RNA, 18 nt, Chlamydia trachomatis
gcacaugggcauagaaua

SEQ ID NO: 2499343 - RNA, 12 nt, Chlamydia trachomatis
gcaccauaauau

SEQ ID NO: 2499344 - RNA, 13 nt, Chlamydia trachomatis
gcaccauaauaug

SEQ ID NO: 2499345 - RNA, 18 nt, Chlamydia trachomatis
gcaccauccauagugcca

SEQ ID NO: 2499346 - RNA, 19 nt, Chlamydia trachomatis
gcacccuuucuuacuccuu

SEQ ID NO: 2499347 - RNA, 14 nt, Chlamydia trachomatis
gcaccucuuucaga

SEQ ID NO: 2499348 - RNA, 19 nt, Chlamydia trachomatis
gcaccuuuacaaucaucuu

SEQ ID NO: 2499349 - RNA, 21 nt, Chlamydia trachomatis
gcaccuuuuuugcuaaaagaa

SEQ ID NO: 2499350 - RNA, 18 nt, Chlamydia trachomatis
gcacgcuacuaacgaagc

SEQ ID NO: 2499351 - RNA, 13 nt, Chlamydia trachomatis
gcacuaaagagcu

SEQ ID NO: 2499352 - RNA, 14 nt, Chlamydia trachomatis
gcacuaagaauaaa

SEQ ID NO: 2499353 - RNA, 13 nt, Chlamydia trachomatis
gcacucaaauuuc

SEQ ID NO: 2499354 - RNA, 17 nt, Chlamydia trachomatis
gcacucaaauuucucua

SEQ ID NO: 2499355 - RNA, 17 nt, Chlamydia trachomatis
gcacucgagucaugcaa

SEQ ID NO: 2499356 - RNA, 23 nt, Chlamydia trachomatis
gcacuucuucuuuggaaaaaaaa

SEQ ID NO: 2499357 - RNA, 13 nt, Chlamydia trachomatis
gcagaaaaauuua

SEQ ID NO: 2499358 - RNA, 23 nt, Chlamydia trachomatis
gcagaaacaaauaacuuuuucuc

SEQ ID NO: 2499359 - RNA, 13 nt, Chlamydia trachomatis
gcagaaccuucca

SEQ ID NO: 2499360 - RNA, 16 nt, Chlamydia trachomatis
gcagaacuagucuacu

SEQ ID NO: 2499361 - RNA, 22 nt, Chlamydia trachomatis
gcagacaagccuucaggauucc

SEQ ID NO: 2499362 - RNA, 18 nt, Chlamydia trachomatis
gcagagagccagcgaggc

SEQ ID NO: 2499363 - RNA, 13 nt, Chlamydia trachomatis
gcagagauaaaga

SEQ ID NO: 2499364 - RNA, 19 nt, Chlamydia trachomatis
gcagagaugauauuuucau

SEQ ID NO: 2499365 - RNA, 19 nt, Chlamydia trachomatis
gcagagcacaaaucuuucu

SEQ ID NO: 2499366 - RNA, 15 nt, Chlamydia trachomatis
gcagagccaaaacaa

SEQ ID NO: 2499367 - RNA, 17 nt, Chlamydia trachomatis
gcagaggauuuauaaag

SEQ ID NO: 2499368 - RNA, 15 nt, Chlamydia trachomatis
gcagagguaugcaga

SEQ ID NO: 2499369 - RNA, 16 nt, Chlamydia trachomatis
gcagaugcaucuauug

SEQ ID NO: 2499370 - RNA, 17 nt, Chlamydia trachomatis
gcagcaucuauuuucuc

SEQ ID NO: 2499371 - RNA, 18 nt, Chlamydia trachomatis
gcagcaucuauuuucucu

SEQ ID NO: 2499372 - RNA, 19 nt, Chlamydia trachomatis
gcagcaucuauuuucucuu

SEQ ID NO: 2499373 - RNA, 16 nt, Chlamydia trachomatis
gcagcggcaaugguua

SEQ ID NO: 2499374 - RNA, 22 nt, Chlamydia trachomatis
gcagcguucugagaugaaaaua

SEQ ID NO: 2499375 - RNA, 19 nt, Chlamydia trachomatis
gcagcuaaagaaucuccug

SEQ ID NO: 2499376 - RNA, 19 nt, Chlamydia trachomatis
gcagcuaaccaugcuccuu

SEQ ID NO: 2499377 - RNA, 21 nt, Chlamydia trachomatis
gcagcuagaacauacccuaaa

SEQ ID NO: 2499378 - RNA, 20 nt, Chlamydia trachomatis
gcagcuucggaaggagacaa

SEQ ID NO: 2499379 - RNA, 22 nt, Chlamydia trachomatis
gcagcuuuucuaacguuccucc

SEQ ID NO: 2499380 - RNA, 16 nt, Chlamydia trachomatis
gcaggaacuucuucau

SEQ ID NO: 2499381 - RNA, 19 nt, Chlamydia trachomatis
gcaggaucgcuaucaauaa

SEQ ID NO: 2499382 - RNA, 21 nt, Chlamydia trachomatis
gcaggaucgcuaucaauaaaa

SEQ ID NO: 2499383 - RNA, 23 nt, Chlamydia trachomatis
gcaggcucaugaacagcaagagg

SEQ ID NO: 2499384 - RNA, 15 nt, Chlamydia trachomatis
gcagggagaagggga

SEQ ID NO: 2499385 - RNA, 20 nt, Chlamydia trachomatis
gcagguaccuauaauaauga

SEQ ID NO: 2499386 - RNA, 20 nt, Chlamydia trachomatis
gcagguacuuacccuuauaa

SEQ ID NO: 2499387 - RNA, 17 nt, Chlamydia trachomatis
gcagguaucuagacaaa

SEQ ID NO: 2499388 - RNA, 22 nt, Chlamydia trachomatis
gcaggucgauaucguuagcauc

SEQ ID NO: 2499389 - RNA, 19 nt, Chlamydia trachomatis
gcaggucuaggggaagaau

SEQ ID NO: 2499390 - RNA, 20 nt, Chlamydia trachomatis
gcaguaaaaucuaaaauauc

SEQ ID NO: 2499391 - RNA, 17 nt, Chlamydia trachomatis
gcaguaaagaaaagcuc

SEQ ID NO: 2499392 - RNA, 23 nt, Chlamydia trachomatis
gcaguugaucauugauaaauucu

SEQ ID NO: 2499393 - RNA, 17 nt, Chlamydia trachomatis
gcauaaaagagaagaac

SEQ ID NO: 2499394 - RNA, 21 nt, Chlamydia trachomatis
gcauaagcacuauaucuccaa

SEQ ID NO: 2499395 - RNA, 14 nt, Chlamydia trachomatis
gcauacacaucaaa

SEQ ID NO: 2499396 - RNA, 14 nt, Chlamydia trachomatis
gcauaccaaagcau

SEQ ID NO: 2499397 - RNA, 14 nt, Chlamydia trachomatis
gcauagucucccaa

SEQ ID NO: 2499398 - RNA, 15 nt, Chlamydia trachomatis
gcauagucucccaaa

SEQ ID NO: 2499399 - RNA, 23 nt, Chlamydia trachomatis
gcauaguuccuguauucgcuauu

SEQ ID NO: 2499400 - RNA, 19 nt, Chlamydia trachomatis
gcauauuacugacugguuc

SEQ ID NO: 2499401 - RNA, 18 nt, Chlamydia trachomatis
gcaucaaaggauaugucu

SEQ ID NO: 2499402 - RNA, 18 nt, Chlamydia trachomatis
gcaucccaaaauagcagg

SEQ ID NO: 2499403 - RNA, 13 nt, Chlamydia trachomatis
gcaucuacagagu

SEQ ID NO: 2499404 - RNA, 13 nt, Chlamydia trachomatis
gcaucuccaaaga

SEQ ID NO: 2499405 - RNA, 17 nt, Chlamydia trachomatis
gcaucuccaaagacaca

SEQ ID NO: 2499406 - RNA, 18 nt, Chlamydia trachomatis
gcaucugauguuccaucu

SEQ ID NO: 2499407 - RNA, 20 nt, Chlamydia trachomatis
gcaucuggagauacagaauc

SEQ ID NO: 2499408 - RNA, 15 nt, Chlamydia trachomatis
gcaucuggaguggca

SEQ ID NO: 2499409 - RNA, 20 nt, Chlamydia trachomatis
gcaucuuaggaucuaacgca

SEQ ID NO: 2499410 - RNA, 20 nt, Chlamydia trachomatis
gcaucuucucgaaagagaac

SEQ ID NO: 2499411 - RNA, 11 nt, Chlamydia trachomatis
gcaucuuuucu

SEQ ID NO: 2499412 - RNA, 13 nt, Chlamydia trachomatis
gcaucuuuucuua

SEQ ID NO: 2499413 - RNA, 17 nt, Chlamydia trachomatis
gcaucuuuucuuauaaa

SEQ ID NO: 2499414 - RNA, 18 nt, Chlamydia trachomatis
gcaucuuuucuuauaaag

SEQ ID NO: 2499415 - RNA, 17 nt, Chlamydia trachomatis
gcaugaacauacguuuu

SEQ ID NO: 2499416 - RNA, 17 nt, Chlamydia trachomatis
gcaugacuacacgcuga

SEQ ID NO: 2499417 - RNA, 18 nt, Chlamydia trachomatis
gcaugccgcacauccgcu

SEQ ID NO: 2499418 - RNA, 20 nt, Chlamydia trachomatis
gcaugcuucuuuaagacuca

SEQ ID NO: 2499419 - RNA, 18 nt, Chlamydia trachomatis
gcauguagccaaggaaga

SEQ ID NO: 2499420 - RNA, 23 nt, Chlamydia trachomatis
gcauuaaagggaaaaaacuagaa

SEQ ID NO: 2499421 - RNA, 19 nt, Chlamydia trachomatis
gcauuacgccccuucuuca

SEQ ID NO: 2499422 - RNA, 19 nt, Chlamydia trachomatis
gcauucaggggcaugacga

SEQ ID NO: 2499423 - RNA, 16 nt, Chlamydia trachomatis
gcauuccaagaagaac

SEQ ID NO: 2499424 - RNA, 19 nt, Chlamydia trachomatis
gcauuccaggacgaacgaa

SEQ ID NO: 2499425 - RNA, 16 nt, Chlamydia trachomatis
gcauuccuuucuucca

SEQ ID NO: 2499426 - RNA, 22 nt, Chlamydia trachomatis
gcauucucucauaagaucuuua

SEQ ID NO: 2499427 - RNA, 16 nt, Chlamydia trachomatis
gcauugaacaccauau

SEQ ID NO: 2499428 - RNA, 15 nt, Chlamydia trachomatis
gcauugugaugaaac

SEQ ID NO: 2499429 - RNA, 17 nt, Chlamydia trachomatis
gcauuucucuccaaacc

SEQ ID NO: 2499430 - RNA, 16 nt, Chlamydia trachomatis
gcauuugaaagaaacg

SEQ ID NO: 2499431 - RNA, 15 nt, Chlamydia trachomatis
gcauuuguaguucua

SEQ ID NO: 2499432 - RNA, 22 nt, Chlamydia trachomatis
gccaaaaaccagccuauuagau

SEQ ID NO: 2499433 - RNA, 13 nt, Chlamydia trachomatis
gccaaagaaaaac

SEQ ID NO: 2499434 - RNA, 13 nt, Chlamydia trachomatis
gccaaaggauccu

SEQ ID NO: 2499435 - RNA, 17 nt, Chlamydia trachomatis
gccaaccaccuguugcu

SEQ ID NO: 2499436 - RNA, 14 nt, Chlamydia trachomatis
gccaaccauaggau

SEQ ID NO: 2499437 - RNA, 21 nt, Chlamydia trachomatis
gccaacuauugaaauaccacu

SEQ ID NO: 2499438 - RNA, 19 nt, Chlamydia trachomatis
gccaauccguaugauaaaa

SEQ ID NO: 2499439 - RNA, 21 nt, Chlamydia trachomatis
gccaauuuccauggagcuuca

SEQ ID NO: 2499440 - RNA, 15 nt, Chlamydia trachomatis
gccaauuucucuacc

SEQ ID NO: 2499441 - RNA, 17 nt, Chlamydia trachomatis
gccacaaccacuguuca

SEQ ID NO: 2499442 - RNA, 15 nt, Chlamydia trachomatis
gccacaagaugccgc

SEQ ID NO: 2499443 - RNA, 17 nt, Chlamydia trachomatis
gccacacuuccccauuc

SEQ ID NO: 2499444 - RNA, 21 nt, Chlamydia trachomatis
gccacacuuccccauucuucu

SEQ ID NO: 2499445 - RNA, 14 nt, Chlamydia trachomatis
gccaccaguuguua

SEQ ID NO: 2499446 - RNA, 19 nt, Chlamydia trachomatis
gccaccuugccaaccacug

SEQ ID NO: 2499447 - RNA, 16 nt, Chlamydia trachomatis
gccacugugaaaugcg

SEQ ID NO: 2499448 - RNA, 18 nt, Chlamydia trachomatis
gccacuugcuccacacaa

SEQ ID NO: 2499449 - RNA, 14 nt, Chlamydia trachomatis
gccagaagauccca

SEQ ID NO: 2499450 - RNA, 14 nt, Chlamydia trachomatis
gccagccccucccu

SEQ ID NO: 2499451 - RNA, 16 nt, Chlamydia trachomatis
gccagcuaagagaagc

SEQ ID NO: 2499452 - RNA, 15 nt, Chlamydia trachomatis
gccagcuuuaaagag

SEQ ID NO: 2499453 - RNA, 20 nt, Chlamydia trachomatis
gccaggcgcuucucuuugaa

SEQ ID NO: 2499454 - RNA, 13 nt, Chlamydia trachomatis
gccaguucuucac

SEQ ID NO: 2499455 - RNA, 13 nt, Chlamydia trachomatis
gccauaauaaaag

SEQ ID NO: 2499456 - RNA, 14 nt, Chlamydia trachomatis
gccauacaaagauu

SEQ ID NO: 2499457 - RNA, 20 nt, Chlamydia trachomatis
gccauaucaggaccuagaga

SEQ ID NO: 2499458 - RNA, 14 nt, Chlamydia trachomatis
gccaucauuaucuu

SEQ ID NO: 2499459 - RNA, 20 nt, Chlamydia trachomatis
gccaucauuaucuucuucua

SEQ ID NO: 2499460 - RNA, 14 nt, Chlamydia trachomatis
gcccaaacuccaug

SEQ ID NO: 2499461 - RNA, 18 nt, Chlamydia trachomatis
gcccaagcuuucaucucc

SEQ ID NO: 2499462 - RNA, 21 nt, Chlamydia trachomatis
gcccaagcuuucaucuccuuu

SEQ ID NO: 2499463 - RNA, 19 nt, Chlamydia trachomatis
gcccaaggaaaagaugaag

SEQ ID NO: 2499464 - RNA, 14 nt, Chlamydia trachomatis
gcccagaacaacuu

SEQ ID NO: 2499465 - RNA, 17 nt, Chlamydia trachomatis
gcccaggauaacaaaca

SEQ ID NO: 2499466 - RNA, 11 nt, Chlamydia trachomatis
gcccaucaucg

SEQ ID NO: 2499467 - RNA, 20 nt, Chlamydia trachomatis
gcccaucaucgaugauaucu

SEQ ID NO: 2499468 - RNA, 15 nt, Chlamydia trachomatis
gcccaugagaaacca

SEQ ID NO: 2499469 - RNA, 18 nt, Chlamydia trachomatis
gccccguguugaauuacu

SEQ ID NO: 2499470 - RNA, 20 nt, Chlamydia trachomatis
gccccuaaagccacacaugu

SEQ ID NO: 2499471 - RNA, 18 nt, Chlamydia trachomatis
gccccuauguaaacaaga

SEQ ID NO: 2499472 - RNA, 11 nt, Chlamydia trachomatis
gccccuccgcu

SEQ ID NO: 2499473 - RNA, 15 nt, Chlamydia trachomatis
gccccucuuuuucac

SEQ ID NO: 2499474 - RNA, 14 nt, Chlamydia trachomatis
gcccuaauaaaagg

SEQ ID NO: 2499475 - RNA, 21 nt, Chlamydia trachomatis
gcccuugagaacguuuagcua

SEQ ID NO: 2499476 - RNA, 13 nt, Chlamydia trachomatis
gcccuugagagca

SEQ ID NO: 2499477 - RNA, 22 nt, Chlamydia trachomatis
gcccuuuuaaagggggacaaaa

SEQ ID NO: 2499478 - RNA, 20 nt, Chlamydia trachomatis
gccgaacuaauauaaguuca

SEQ ID NO: 2499479 - RNA, 16 nt, Chlamydia trachomatis
gccgaacucuccucuc

SEQ ID NO: 2499480 - RNA, 18 nt, Chlamydia trachomatis
gccgaacucuccucuccu

SEQ ID NO: 2499481 - RNA, 16 nt, Chlamydia trachomatis
gccgaauaaugauucc

SEQ ID NO: 2499482 - RNA, 18 nt, Chlamydia trachomatis
gccgacuguuuaggaggu

SEQ ID NO: 2499483 - RNA, 20 nt, Chlamydia trachomatis
gccgagcgacuucauacaua

SEQ ID NO: 2499484 - RNA, 19 nt, Chlamydia trachomatis
gccgcagaaaaaaccacag

SEQ ID NO: 2499485 - RNA, 20 nt, Chlamydia trachomatis
gccgcagaaaaaaccacaga

SEQ ID NO: 2499486 - RNA, 16 nt, Chlamydia trachomatis
gccgcuauucacuacc

SEQ ID NO: 2499487 - RNA, 15 nt, Chlamydia trachomatis
gccguaagcauuccc

SEQ ID NO: 2499488 - RNA, 23 nt, Chlamydia trachomatis
gccguuacuaacaucaaagaucu

SEQ ID NO: 2499489 - RNA, 21 nt, Chlamydia trachomatis
gccuaaagagacgcaugcuuc

SEQ ID NO: 2499490 - RNA, 13 nt, Chlamydia trachomatis
gccuacaaauaaa

SEQ ID NO: 2499491 - RNA, 15 nt, Chlamydia trachomatis
gccuacaaauaaagu

SEQ ID NO: 2499492 - RNA, 15 nt, Chlamydia trachomatis
gccuaucgcacacaa

SEQ ID NO: 2499493 - RNA, 23 nt, Chlamydia trachomatis
gccuaucgcacacaauaaaucau

SEQ ID NO: 2499494 - RNA, 14 nt, Chlamydia trachomatis
gccuccaucucugc

SEQ ID NO: 2499495 - RNA, 14 nt, Chlamydia trachomatis
gccucuaucucuuc

SEQ ID NO: 2499496 - RNA, 15 nt, Chlamydia trachomatis
gccucuaucucuucu

SEQ ID NO: 2499497 - RNA, 13 nt, Chlamydia trachomatis
gccucugaacacc

SEQ ID NO: 2499498 - RNA, 16 nt, Chlamydia trachomatis
gccucuucucuuuuag

SEQ ID NO: 2499499 - RNA, 20 nt, Chlamydia trachomatis
gccugcuccggcaaauccug

SEQ ID NO: 2499500 - RNA, 14 nt, Chlamydia trachomatis
gccugcuuucuucu

SEQ ID NO: 2499501 - RNA, 20 nt, Chlamydia trachomatis
gccuggagcacucucaacga

SEQ ID NO: 2499502 - RNA, 23 nt, Chlamydia trachomatis
gccugggcgagcauaucuccuaa

SEQ ID NO: 2499503 - RNA, 14 nt, Chlamydia trachomatis
gccuguuucuuauc

SEQ ID NO: 2499504 - RNA, 20 nt, Chlamydia trachomatis
gccuguuuugcuaugaaaaa

SEQ ID NO: 2499505 - RNA, 23 nt, Chlamydia trachomatis
gccuuaggaccuaauaucugcuc

SEQ ID NO: 2499506 - RNA, 16 nt, Chlamydia trachomatis
gccuucaauucuugcu

SEQ ID NO: 2499507 - RNA, 17 nt, Chlamydia trachomatis
gccuucaauucuugcuu

SEQ ID NO: 2499508 - RNA, 22 nt, Chlamydia trachomatis
gccuucaauucuugcuucaugu

SEQ ID NO: 2499509 - RNA, 23 nt, Chlamydia trachomatis
gccuucccgacagaggauagagc

SEQ ID NO: 2499510 - RNA, 16 nt, Chlamydia trachomatis
gccuucuuuuuccuca

SEQ ID NO: 2499511 - RNA, 19 nt, Chlamydia trachomatis
gccuucuuuuuccucagca

SEQ ID NO: 2499512 - RNA, 16 nt, Chlamydia trachomatis
gccuuuaaccucugca

SEQ ID NO: 2499513 - RNA, 21 nt, Chlamydia trachomatis
gccuuuagauaguuacuucca

SEQ ID NO: 2499514 - RNA, 21 nt, Chlamydia trachomatis
gccuuucucuaaaagaagagc

SEQ ID NO: 2499515 - RNA, 13 nt, Chlamydia trachomatis
gccuuuuauucuu

SEQ ID NO: 2499516 - RNA, 15 nt, Chlamydia trachomatis
gccuuuuauucuuca

SEQ ID NO: 2499517 - RNA, 18 nt, Chlamydia trachomatis
gccuuuuguuuucaaaag

SEQ ID NO: 2499518 - RNA, 16 nt, Chlamydia trachomatis
gccuuuuguuuucuug

SEQ ID NO: 2499519 - RNA, 11 nt, Chlamydia trachomatis
gcgaaaaaaaa

SEQ ID NO: 2499520 - RNA, 15 nt, Chlamydia trachomatis
gcgaaaaaaaaagaa

SEQ ID NO: 2499521 - RNA, 16 nt, Chlamydia trachomatis
gcgaaaauuggaguga

SEQ ID NO: 2499522 - RNA, 13 nt, Chlamydia trachomatis
gcgaacagugaca

SEQ ID NO: 2499523 - RNA, 22 nt, Chlamydia trachomatis
gcgaacagugacagcauagaua

SEQ ID NO: 2499524 - RNA, 16 nt, Chlamydia trachomatis
gcgaauaaauccucuu

SEQ ID NO: 2499525 - RNA, 18 nt, Chlamydia trachomatis
gcgacagcccaagaucuu

SEQ ID NO: 2499526 - RNA, 12 nt, Chlamydia trachomatis
gcgauaguucua

SEQ ID NO: 2499527 - RNA, 16 nt, Chlamydia trachomatis
gcgaucuccuuccucu

SEQ ID NO: 2499528 - RNA, 23 nt, Chlamydia trachomatis
gcgaugauuaucaccuauuaaga

SEQ ID NO: 2499529 - RNA, 18 nt, Chlamydia trachomatis
gcgaugccucuaacacuu

SEQ ID NO: 2499530 - RNA, 15 nt, Chlamydia trachomatis
gcgauguaaaugaug

SEQ ID NO: 2499531 - RNA, 13 nt, Chlamydia trachomatis
gcgcaaaucagga

SEQ ID NO: 2499532 - RNA, 19 nt, Chlamydia trachomatis
gcgcaaucauaucaagaau

SEQ ID NO: 2499533 - RNA, 16 nt, Chlamydia trachomatis
gcgcagaucuccuucu

SEQ ID NO: 2499534 - RNA, 14 nt, Chlamydia trachomatis
gcgccauaccuaaa

SEQ ID NO: 2499535 - RNA, 13 nt, Chlamydia trachomatis
gcgcucccauuuu

SEQ ID NO: 2499536 - RNA, 15 nt, Chlamydia trachomatis
gcgcucccauuuuua

SEQ ID NO: 2499537 - RNA, 14 nt, Chlamydia trachomatis
gcgcuggcuuuguc

SEQ ID NO: 2499538 - RNA, 16 nt, Chlamydia trachomatis
gcgcuggcuuuguccu

SEQ ID NO: 2499539 - RNA, 20 nt, Chlamydia trachomatis
gcgcuucccgcuauuuuccu

SEQ ID NO: 2499540 - RNA, 12 nt, Chlamydia trachomatis
gcgcuuuuucuu

SEQ ID NO: 2499541 - RNA, 15 nt, Chlamydia trachomatis
gcgcuuuuucuucuc

SEQ ID NO: 2499542 - RNA, 16 nt, Chlamydia trachomatis
gcggaacaagcaaaac

SEQ ID NO: 2499543 - RNA, 15 nt, Chlamydia trachomatis
gcggaauaagucugc

SEQ ID NO: 2499544 - RNA, 18 nt, Chlamydia trachomatis
gcggcaaugguuauaaga

SEQ ID NO: 2499545 - RNA, 23 nt, Chlamydia trachomatis
gcggcauggaucuccagcuuaag

SEQ ID NO: 2499546 - RNA, 19 nt, Chlamydia trachomatis
gcggcugcguuaaacacag

SEQ ID NO: 2499547 - RNA, 21 nt, Chlamydia trachomatis
gcggcuuuucuauuucauuua

SEQ ID NO: 2499548 - RNA, 23 nt, Chlamydia trachomatis
gcgggagaaggauucgaaccucc

SEQ ID NO: 2499549 - RNA, 23 nt, Chlamydia trachomatis
gcggguacgcucaucuugcauaa

SEQ ID NO: 2499550 - RNA, 16 nt, Chlamydia trachomatis
gcgguccucgggaaau

SEQ ID NO: 2499551 - RNA, 20 nt, Chlamydia trachomatis
gcggucguggcgggcaccgu

SEQ ID NO: 2499552 - RNA, 18 nt, Chlamydia trachomatis
gcgguggaagaucuucag

SEQ ID NO: 2499553 - RNA, 21 nt, Chlamydia trachomatis
gcgguggaagaucuucagaaa

SEQ ID NO: 2499554 - RNA, 15 nt, Chlamydia trachomatis
gcguaagcaacgaca

SEQ ID NO: 2499555 - RNA, 15 nt, Chlamydia trachomatis
gcguaauuuucuagc

SEQ ID NO: 2499556 - RNA, 21 nt, Chlamydia trachomatis
gcguaauuuucuagcuucuug

SEQ ID NO: 2499557 - RNA, 20 nt, Chlamydia trachomatis
gcguagaucccagaauaaag

SEQ ID NO: 2499558 - RNA, 20 nt, Chlamydia trachomatis
gcguagcucagagauuuccu

SEQ ID NO: 2499559 - RNA, 21 nt, Chlamydia trachomatis
gcguauuugaaaucaaaaggc

SEQ ID NO: 2499560 - RNA, 13 nt, Chlamydia trachomatis
gcgucaucuuuga

SEQ ID NO: 2499561 - RNA, 21 nt, Chlamydia trachomatis
gcguccaaaaagcgugucaau

SEQ ID NO: 2499562 - RNA, 22 nt, Chlamydia trachomatis
gcguccagugacuugaguaauc

SEQ ID NO: 2499563 - RNA, 14 nt, Chlamydia trachomatis
gcgucuuguuuaga

SEQ ID NO: 2499564 - RNA, 16 nt, Chlamydia trachomatis
gcgugucguuuucgga

SEQ ID NO: 2499565 - RNA, 22 nt, Chlamydia trachomatis
gcgugucguuuucggagaagaa

SEQ ID NO: 2499566 - RNA, 21 nt, Chlamydia trachomatis
gcguucgcgucuagcuuuuuu

SEQ ID NO: 2499567 - RNA, 22 nt, Chlamydia trachomatis
gcguucuucuauuaaagcuuua

SEQ ID NO: 2499568 - RNA, 17 nt, Chlamydia trachomatis
gcguucuucugugaggc

SEQ ID NO: 2499569 - RNA, 15 nt, Chlamydia trachomatis
gcguuuaauuccuug

SEQ ID NO: 2499570 - RNA, 18 nt, Chlamydia trachomatis
gcguuuccgcggcugcgu

SEQ ID NO: 2499571 - RNA, 13 nt, Chlamydia trachomatis
gcuaaaaccuuag

SEQ ID NO: 2499572 - RNA, 21 nt, Chlamydia trachomatis
gcuaaaggaucugagcaguga

SEQ ID NO: 2499573 - RNA, 18 nt, Chlamydia trachomatis
gcuaacagcucuucuucu

SEQ ID NO: 2499574 - RNA, 19 nt, Chlamydia trachomatis
gcuaaccaugcuccuuuca

SEQ ID NO: 2499575 - RNA, 16 nt, Chlamydia trachomatis
gcuaaccguucuugac

SEQ ID NO: 2499576 - RNA, 15 nt, Chlamydia trachomatis
gcuaacuuucuucca

SEQ ID NO: 2499577 - RNA, 16 nt, Chlamydia trachomatis
gcuaacuuucuuccau

SEQ ID NO: 2499578 - RNA, 13 nt, Chlamydia trachomatis
gcuaagaaaauaa

SEQ ID NO: 2499579 - RNA, 15 nt, Chlamydia trachomatis
gcuaagaaaauaaac

SEQ ID NO: 2499580 - RNA, 13 nt, Chlamydia trachomatis
gcuaagagaagca

SEQ ID NO: 2499581 - RNA, 15 nt, Chlamydia trachomatis
gcuaaggaaagagag

SEQ ID NO: 2499582 - RNA, 17 nt, Chlamydia trachomatis
gcuaagguaacaaucac

SEQ ID NO: 2499583 - RNA, 18 nt, Chlamydia trachomatis
gcuaaguauagaagccuc

SEQ ID NO: 2499584 - RNA, 22 nt, Chlamydia trachomatis
gcuaaguuggcucguagagaac

SEQ ID NO: 2499585 - RNA, 13 nt, Chlamydia trachomatis
gcuaaucaugaug

SEQ ID NO: 2499586 - RNA, 21 nt, Chlamydia trachomatis
gcuaauuuuucucuaauaguu

SEQ ID NO: 2499587 - RNA, 19 nt, Chlamydia trachomatis
gcuacaaacugcucaagga

SEQ ID NO: 2499588 - RNA, 18 nt, Chlamydia trachomatis
gcuacaagggugcuaacu

SEQ ID NO: 2499589 - RNA, 10 nt, Chlamydia trachomatis
gcuacaccag

SEQ ID NO: 2499590 - RNA, 14 nt, Chlamydia trachomatis
gcuacaguaucugc

SEQ ID NO: 2499591 - RNA, 14 nt, Chlamydia trachomatis
gcuaccaagcuucu

SEQ ID NO: 2499592 - RNA, 17 nt, Chlamydia trachomatis
gcuacccccuucuccuu

SEQ ID NO: 2499593 - RNA, 17 nt, Chlamydia trachomatis
gcuacggaaaccaauaa

SEQ ID NO: 2499594 - RNA, 20 nt, Chlamydia trachomatis
gcuacugucgaacgcuucuu

SEQ ID NO: 2499595 - RNA, 14 nt, Chlamydia trachomatis
gcuagaaaauagca

SEQ ID NO: 2499596 - RNA, 12 nt, Chlamydia trachomatis
gcuagaagaaga

SEQ ID NO: 2499597 - RNA, 15 nt, Chlamydia trachomatis
gcuagaagaagagga

SEQ ID NO: 2499598 - RNA, 22 nt, Chlamydia trachomatis
gcuagaauguguauuugguugu

SEQ ID NO: 2499599 - RNA, 21 nt, Chlamydia trachomatis
gcuagccuggcugcagaagac

SEQ ID NO: 2499600 - RNA, 15 nt, Chlamydia trachomatis
gcuagcuuuccucac

SEQ ID NO: 2499601 - RNA, 13 nt, Chlamydia trachomatis
gcuaggcaaauau

SEQ ID NO: 2499602 - RNA, 19 nt, Chlamydia trachomatis
gcuaggcaaauauccuaaa

SEQ ID NO: 2499603 - RNA, 16 nt, Chlamydia trachomatis
gcuaggguucuaaaga

SEQ ID NO: 2499604 - RNA, 18 nt, Chlamydia trachomatis
gcuaggguucuaaagaaa

SEQ ID NO: 2499605 - RNA, 21 nt, Chlamydia trachomatis
gcuagucguaugcgcccauca

SEQ ID NO: 2499606 - RNA, 15 nt, Chlamydia trachomatis
gcuauauguaagaag

SEQ ID NO: 2499607 - RNA, 21 nt, Chlamydia trachomatis
gcuaucagcgcucauaggaca

SEQ ID NO: 2499608 - RNA, 14 nt, Chlamydia trachomatis
gcuaucauuuccaa

SEQ ID NO: 2499609 - RNA, 15 nt, Chlamydia trachomatis
gcuaucauuuccaaa

SEQ ID NO: 2499610 - RNA, 15 nt, Chlamydia trachomatis
gcuauccugcucaac

SEQ ID NO: 2499611 - RNA, 16 nt, Chlamydia trachomatis
gcuaugaaaaauccuu

SEQ ID NO: 2499612 - RNA, 19 nt, Chlamydia trachomatis
gcuaugaaaaauccuucca

SEQ ID NO: 2499613 - RNA, 18 nt, Chlamydia trachomatis
gcuaugcgcggaaggaaa

SEQ ID NO: 2499614 - RNA, 13 nt, Chlamydia trachomatis
gcuauuacauaua

SEQ ID NO: 2499615 - RNA, 15 nt, Chlamydia trachomatis
gcuauuccauggcgu

SEQ ID NO: 2499616 - RNA, 16 nt, Chlamydia trachomatis
gcuauugguagaggcu

SEQ ID NO: 2499617 - RNA, 18 nt, Chlamydia trachomatis
gcuauuucgaucuuacca

SEQ ID NO: 2499618 - RNA, 22 nt, Chlamydia trachomatis
gcucaacucgcuccagaacgaa

SEQ ID NO: 2499619 - RNA, 11 nt, Chlamydia trachomatis
gcucagaaaac

SEQ ID NO: 2499620 - RNA, 15 nt, Chlamydia trachomatis
gcucagcuucaacug

SEQ ID NO: 2499621 - RNA, 15 nt, Chlamydia trachomatis
gcucaggcuaucaca

SEQ ID NO: 2499622 - RNA, 17 nt, Chlamydia trachomatis
gcucauaaagagccguu

SEQ ID NO: 2499623 - RNA, 18 nt, Chlamydia trachomatis
gcucauaaccaugagcuc

SEQ ID NO: 2499624 - RNA, 18 nt, Chlamydia trachomatis
gcucauagucugauccau

SEQ ID NO: 2499625 - RNA, 14 nt, Chlamydia trachomatis
gcucaucaaacucu

SEQ ID NO: 2499626 - RNA, 19 nt, Chlamydia trachomatis
gcucauuuuguaggagaaa

SEQ ID NO: 2499627 - RNA, 17 nt, Chlamydia trachomatis
gcuccaaaguaaaaugc

SEQ ID NO: 2499628 - RNA, 16 nt, Chlamydia trachomatis
gcuccacaagaaguaa

SEQ ID NO: 2499629 - RNA, 18 nt, Chlamydia trachomatis
gcuccacaagaaguaaca

SEQ ID NO: 2499630 - RNA, 19 nt, Chlamydia trachomatis
gcucccagagaaucuuaaa

SEQ ID NO: 2499631 - RNA, 14 nt, Chlamydia trachomatis
gcucccauuucugg

SEQ ID NO: 2499632 - RNA, 13 nt, Chlamydia trachomatis
gcuccgaucauaa

SEQ ID NO: 2499633 - RNA, 15 nt, Chlamydia trachomatis
gcuccguggcaagca

SEQ ID NO: 2499634 - RNA, 21 nt, Chlamydia trachomatis
gcuccguggcaagcaacgaaa

SEQ ID NO: 2499635 - RNA, 19 nt, Chlamydia trachomatis
gcuccguucaaagcaaacu

SEQ ID NO: 2499636 - RNA, 13 nt, Chlamydia trachomatis
gcuccuaagcagu

SEQ ID NO: 2499637 - RNA, 16 nt, Chlamydia trachomatis
gcuccuaagcagugaa

SEQ ID NO: 2499638 - RNA, 23 nt, Chlamydia trachomatis
gcuccuaaucuuucuaauuuccc

SEQ ID NO: 2499639 - RNA, 20 nt, Chlamydia trachomatis
gcuccuagagccaauccauu

SEQ ID NO: 2499640 - RNA, 20 nt, Chlamydia trachomatis
gcuccuuauaaauccugcgc

SEQ ID NO: 2499641 - RNA, 18 nt, Chlamydia trachomatis
gcucgaaaguugcuccca

SEQ ID NO: 2499642 - RNA, 19 nt, Chlamydia trachomatis
gcucgaaaguugcucccaa

SEQ ID NO: 2499643 - RNA, 24 nt, Chlamydia trachomatis
gcucgcaguacuuuaccuguagga

SEQ ID NO: 2499644 - RNA, 14 nt, Chlamydia trachomatis
gcucuagcaauaga

SEQ ID NO: 2499645 - RNA, 17 nt, Chlamydia trachomatis
gcucuagguagucucua

SEQ ID NO: 2499646 - RNA, 17 nt, Chlamydia trachomatis
gcucuccaaagaauaga

SEQ ID NO: 2499647 - RNA, 20 nt, Chlamydia trachomatis
gcucucgcaguuucuccuaa

SEQ ID NO: 2499648 - RNA, 15 nt, Chlamydia trachomatis
gcucucuagcaaacg

SEQ ID NO: 2499649 - RNA, 14 nt, Chlamydia trachomatis
gcucucuucacaaa

SEQ ID NO: 2499650 - RNA, 17 nt, Chlamydia trachomatis
gcucucuucacaaauuu

SEQ ID NO: 2499651 - RNA, 23 nt, Chlamydia trachomatis
gcucuguucaauuguuggacaaa

SEQ ID NO: 2499652 - RNA, 19 nt, Chlamydia trachomatis
gcucuucucucagaugggu

SEQ ID NO: 2499653 - RNA, 15 nt, Chlamydia trachomatis
gcucuuucagagaaa

SEQ ID NO: 2499654 - RNA, 22 nt, Chlamydia trachomatis
gcucuuucagagaaaauuucuc

SEQ ID NO: 2499655 - RNA, 13 nt, Chlamydia trachomatis
gcucuuuccucua

SEQ ID NO: 2499656 - RNA, 14 nt, Chlamydia trachomatis
gcucuuuuucuucc

SEQ ID NO: 2499657 - RNA, 15 nt, Chlamydia trachomatis
gcucuuuuucuucca

SEQ ID NO: 2499658 - RNA, 11 nt, Chlamydia trachomatis
gcugaaacuug

SEQ ID NO: 2499659 - RNA, 17 nt, Chlamydia trachomatis
gcugacaaagcuuccuu

SEQ ID NO: 2499660 - RNA, 23 nt, Chlamydia trachomatis
gcugacuaaauacaaaucuuuua

SEQ ID NO: 2499661 - RNA, 21 nt, Chlamydia trachomatis
gcugagaaucggauccuucga

SEQ ID NO: 2499662 - RNA, 15 nt, Chlamydia trachomatis
gcugauaaauuucuu

SEQ ID NO: 2499663 - RNA, 18 nt, Chlamydia trachomatis
gcugauaaggaggcuuca

SEQ ID NO: 2499664 - RNA, 20 nt, Chlamydia trachomatis
gcugaucuuucacaacccaa

SEQ ID NO: 2499665 - RNA, 12 nt, Chlamydia trachomatis
gcugauuagaaa

SEQ ID NO: 2499666 - RNA, 15 nt, Chlamydia trachomatis
gcugccaaagcuucg

SEQ ID NO: 2499667 - RNA, 14 nt, Chlamydia trachomatis
gcugcgagagagcu

SEQ ID NO: 2499668 - RNA, 14 nt, Chlamydia trachomatis
gcugcgaugugguc

SEQ ID NO: 2499669 - RNA, 19 nt, Chlamydia trachomatis
gcugcggacugcaucaugu

SEQ ID NO: 2499670 - RNA, 15 nt, Chlamydia trachomatis
gcugcucgaaaaucu

SEQ ID NO: 2499671 - RNA, 19 nt, Chlamydia trachomatis
gcugcugacaauccgaaga

SEQ ID NO: 2499672 - RNA, 16 nt, Chlamydia trachomatis
gcugcugauaaccaga

SEQ ID NO: 2499673 - RNA, 17 nt, Chlamydia trachomatis
gcugcugucagaagaau

SEQ ID NO: 2499674 - RNA, 23 nt, Chlamydia trachomatis
gcugcuuuacaucccuugaacua

SEQ ID NO: 2499675 - RNA, 14 nt, Chlamydia trachomatis
gcugcuuuagcugc

SEQ ID NO: 2499676 - RNA, 15 nt, Chlamydia trachomatis
gcuggcuuuguccuc

SEQ ID NO: 2499677 - RNA, 15 nt, Chlamydia trachomatis
gcuguaaaacauuuc

SEQ ID NO: 2499678 - RNA, 17 nt, Chlamydia trachomatis
gcuguagugaucuuuuu

SEQ ID NO: 2499679 - RNA, 18 nt, Chlamydia trachomatis
gcuguaugccaagaccuc

SEQ ID NO: 2499680 - RNA, 13 nt, Chlamydia trachomatis
gcuguaugccaau

SEQ ID NO: 2499681 - RNA, 14 nt, Chlamydia trachomatis
gcuguauuuccuuc

SEQ ID NO: 2499682 - RNA, 20 nt, Chlamydia trachomatis
gcugucaggauuuaaagccu

SEQ ID NO: 2499683 - RNA, 15 nt, Chlamydia trachomatis
gcuguucagcuucua

SEQ ID NO: 2499684 - RNA, 16 nt, Chlamydia trachomatis
gcuguuccuuuuacuu

SEQ ID NO: 2499685 - RNA, 12 nt, Chlamydia trachomatis
gcuguucuucca

SEQ ID NO: 2499686 - RNA, 15 nt, Chlamydia trachomatis
gcuguugaacggaau

SEQ ID NO: 2499687 - RNA, 23 nt, Chlamydia trachomatis
gcuguuguaucccuaguacaaaa

SEQ ID NO: 2499688 - RNA, 19 nt, Chlamydia trachomatis
gcuguuuguaacgcagcuc

SEQ ID NO: 2499689 - RNA, 23 nt, Chlamydia trachomatis
gcuuaaagauaacacucucaucu

SEQ ID NO: 2499690 - RNA, 19 nt, Chlamydia trachomatis
gcuuaacuuuguuauuuuu

SEQ ID NO: 2499691 - RNA, 22 nt, Chlamydia trachomatis
gcuuaacuuuguuauuuuuuaa

SEQ ID NO: 2499692 - RNA, 14 nt, Chlamydia trachomatis
gcuuagaaacuguc

SEQ ID NO: 2499693 - RNA, 13 nt, Chlamydia trachomatis
gcuuagauuuagc

SEQ ID NO: 2499694 - RNA, 16 nt, Chlamydia trachomatis
gcuuaguuacaagaca

SEQ ID NO: 2499695 - RNA, 16 nt, Chlamydia trachomatis
gcuuauaacuaagauc

SEQ ID NO: 2499696 - RNA, 22 nt, Chlamydia trachomatis
gcuuaugaacggcucuucuuac

SEQ ID NO: 2499697 - RNA, 15 nt, Chlamydia trachomatis
gcuuauuaauuucua

SEQ ID NO: 2499698 - RNA, 19 nt, Chlamydia trachomatis
gcuuauucucuuuauagaa

SEQ ID NO: 2499699 - RNA, 13 nt, Chlamydia trachomatis
gcuucaaaacuaa

SEQ ID NO: 2499700 - RNA, 14 nt, Chlamydia trachomatis
gcuucaaaacuaaa

SEQ ID NO: 2499701 - RNA, 16 nt, Chlamydia trachomatis
gcuucaauaauguuga

SEQ ID NO: 2499702 - RNA, 16 nt, Chlamydia trachomatis
gcuucaggggagaaaa

SEQ ID NO: 2499703 - RNA, 18 nt, Chlamydia trachomatis
gcuucauaaaaaagaccc

SEQ ID NO: 2499704 - RNA, 15 nt, Chlamydia trachomatis
gcuucauacacauga

SEQ ID NO: 2499705 - RNA, 15 nt, Chlamydia trachomatis
gcuucaucauugaaa

SEQ ID NO: 2499706 - RNA, 20 nt, Chlamydia trachomatis
gcuucauggaauaguugcac

SEQ ID NO: 2499707 - RNA, 23 nt, Chlamydia trachomatis
gcuuccaaacgaucgauccuguu

SEQ ID NO: 2499708 - RNA, 19 nt, Chlamydia trachomatis
gcuuccaaaucugcaagaa

SEQ ID NO: 2499709 - RNA, 23 nt, Chlamydia trachomatis
gcuucccgcuauuuuccucuuca

SEQ ID NO: 2499710 - RNA, 15 nt, Chlamydia trachomatis
gcuuccguaacaaua

SEQ ID NO: 2499711 - RNA, 21 nt, Chlamydia trachomatis
gcuuccguccccuuacccaaa

SEQ ID NO: 2499712 - RNA, 16 nt, Chlamydia trachomatis
gcuuccucuccuucua

SEQ ID NO: 2499713 - RNA, 15 nt, Chlamydia trachomatis
gcuuccugaacgaua

SEQ ID NO: 2499714 - RNA, 21 nt, Chlamydia trachomatis
gcuuccugccaguucuucacu

SEQ ID NO: 2499715 - RNA, 19 nt, Chlamydia trachomatis
gcuuccuguuuaucacuau

SEQ ID NO: 2499716 - RNA, 13 nt, Chlamydia trachomatis
gcuucgaaaagag

SEQ ID NO: 2499717 - RNA, 23 nt, Chlamydia trachomatis
gcuucgagcuguuuuugcaacaa

SEQ ID NO: 2499718 - RNA, 18 nt, Chlamydia trachomatis
gcuucgcaagcaugucga

SEQ ID NO: 2499719 - RNA, 22 nt, Chlamydia trachomatis
gcuucgugagacagcacuucuu

SEQ ID NO: 2499720 - RNA, 23 nt, Chlamydia trachomatis
gcuucuagaaauucuucaucuau

SEQ ID NO: 2499721 - RNA, 14 nt, Chlamydia trachomatis
gcuucucaacacug

SEQ ID NO: 2499722 - RNA, 23 nt, Chlamydia trachomatis
gcuucucgcuacaaauccuucag

SEQ ID NO: 2499723 - RNA, 16 nt, Chlamydia trachomatis
gcuucugaacgagaaa

SEQ ID NO: 2499724 - RNA, 18 nt, Chlamydia trachomatis
gcuucuggcgauaguucu

SEQ ID NO: 2499725 - RNA, 22 nt, Chlamydia trachomatis
gcuucuuaacugcagcaucuau

SEQ ID NO: 2499726 - RNA, 14 nt, Chlamydia trachomatis
gcuucuucuucucu

SEQ ID NO: 2499727 - RNA, 15 nt, Chlamydia trachomatis
gcuucuucuucucuu

SEQ ID NO: 2499728 - RNA, 13 nt, Chlamydia trachomatis
gcuucuucuucuu

SEQ ID NO: 2499729 - RNA, 12 nt, Chlamydia trachomatis
gcuugagagcau

SEQ ID NO: 2499730 - RNA, 23 nt, Chlamydia trachomatis
gcuugauauucccuucuauuucu

SEQ ID NO: 2499731 - RNA, 23 nt, Chlamydia trachomatis
gcuugaucaaagaaucuuugucu

SEQ ID NO: 2499732 - RNA, 18 nt, Chlamydia trachomatis
gcuugauucuugaaucag

SEQ ID NO: 2499733 - RNA, 15 nt, Chlamydia trachomatis
gcuugcacagcaagc

SEQ ID NO: 2499734 - RNA, 19 nt, Chlamydia trachomatis
gcuugcagagggccuccca

SEQ ID NO: 2499735 - RNA, 16 nt, Chlamydia trachomatis
gcuugcccaaacucca

SEQ ID NO: 2499736 - RNA, 20 nt, Chlamydia trachomatis
gcuuggcggauaucuucuug

SEQ ID NO: 2499737 - RNA, 17 nt, Chlamydia trachomatis
gcuuguaugguuugucc

SEQ ID NO: 2499738 - RNA, 23 nt, Chlamydia trachomatis
gcuuguaugguuuguccuuuucu

SEQ ID NO: 2499739 - RNA, 14 nt, Chlamydia trachomatis
gcuuuaaagagcau

SEQ ID NO: 2499740 - RNA, 19 nt, Chlamydia trachomatis
gcuuuaacugggauaagaa

SEQ ID NO: 2499741 - RNA, 23 nt, Chlamydia trachomatis
gcuuuacaucccuugaacuagaa

SEQ ID NO: 2499742 - RNA, 12 nt, Chlamydia trachomatis
gcuuuagcagcc

SEQ ID NO: 2499743 - RNA, 17 nt, Chlamydia trachomatis
gcuuuauccaaagauag

SEQ ID NO: 2499744 - RNA, 21 nt, Chlamydia trachomatis
gcuuucgcugcggaaaucuuc

SEQ ID NO: 2499745 - RNA, 16 nt, Chlamydia trachomatis
gcuuucuacauggcca

SEQ ID NO: 2499746 - RNA, 15 nt, Chlamydia trachomatis
gcuuucuuccccaaa

SEQ ID NO: 2499747 - RNA, 16 nt, Chlamydia trachomatis
gcuuucuugaggaaga

SEQ ID NO: 2499748 - RNA, 20 nt, Chlamydia trachomatis
gcuuucuuuuccaucguuua

SEQ ID NO: 2499749 - RNA, 15 nt, Chlamydia trachomatis
gcuuugaucuuuguu

SEQ ID NO: 2499750 - RNA, 16 nt, Chlamydia trachomatis
gcuuugaucuuuguuc

SEQ ID NO: 2499751 - RNA, 17 nt, Chlamydia trachomatis
gcuuugauuaaccaaaa

SEQ ID NO: 2499752 - RNA, 12 nt, Chlamydia trachomatis
gcuuuguccugg

SEQ ID NO: 2499753 - RNA, 14 nt, Chlamydia trachomatis
gcuuugucuauaag

SEQ ID NO: 2499754 - RNA, 15 nt, Chlamydia trachomatis
gcuuuucuauuucau

SEQ ID NO: 2499755 - RNA, 12 nt, Chlamydia trachomatis
gcuuuucuuuuu

SEQ ID NO: 2499756 - RNA, 13 nt, Chlamydia trachomatis
gcuuuucuuuuuu

SEQ ID NO: 2499757 - RNA, 21 nt, Chlamydia trachomatis
gcuuuucuuuuuuguguuucu

SEQ ID NO: 2499758 - RNA, 16 nt, Chlamydia trachomatis
gcuuuugaucuuucca

SEQ ID NO: 2499759 - RNA, 18 nt, Chlamydia trachomatis
gcuuuugcugcuucacua

SEQ ID NO: 2499760 - RNA, 18 nt, Chlamydia trachomatis
gcuuuuuaauauccucca

SEQ ID NO: 2499761 - RNA, 12 nt, Chlamydia trachomatis
gcuuuuuauccu

SEQ ID NO: 2499762 - RNA, 14 nt, Chlamydia trachomatis
gcuuuuuauccuac

SEQ ID NO: 2499763 - RNA, 22 nt, Chlamydia trachomatis
gcuuuuuauccuacgguaucaa

SEQ ID NO: 2499764 - RNA, 21 nt, Chlamydia trachomatis
gcuuuuuccggauaauuuccg

SEQ ID NO: 2499765 - RNA, 17 nt, Chlamydia trachomatis
gcuuuuucuucucuagc

SEQ ID NO: 2499766 - RNA, 14 nt, Chlamydia trachomatis
gcuuuuuucagaaa

SEQ ID NO: 2499767 - RNA, 21 nt, Chlamydia trachomatis
gcuuuuuuuacucgucuuuua

SEQ ID NO: 2499768 - RNA, 19 nt, Chlamydia trachomatis
gcuuuuuuuuuagaacaga

SEQ ID NO: 2499769 - RNA, 17 nt, Chlamydia trachomatis
gcuuuuuuuuucagcaa

SEQ ID NO: 2499770 - RNA, 16 nt, Chlamydia trachomatis
ggaaaaagcuaucauc

SEQ ID NO: 2499771 - RNA, 14 nt, Chlamydia trachomatis
ggaaaaaguuugga

SEQ ID NO: 2499772 - RNA, 14 nt, Chlamydia trachomatis
ggaaaaauuucuuc

SEQ ID NO: 2499773 - RNA, 13 nt, Chlamydia trachomatis
ggaaacaaauucc

SEQ ID NO: 2499774 - RNA, 15 nt, Chlamydia trachomatis
ggaaacguaaaagag

SEQ ID NO: 2499775 - RNA, 13 nt, Chlamydia trachomatis
ggaaagcuaugcc

SEQ ID NO: 2499776 - RNA, 18 nt, Chlamydia trachomatis
ggaaagcuaugcccagga

SEQ ID NO: 2499777 - RNA, 11 nt, Chlamydia trachomatis
ggaaagugcau

SEQ ID NO: 2499778 - RNA, 11 nt, Chlamydia trachomatis
ggaaauaagag

SEQ ID NO: 2499779 - RNA, 16 nt, Chlamydia trachomatis
ggaaauaagagaggcu

SEQ ID NO: 2499780 - RNA, 23 nt, Chlamydia trachomatis
ggaaauauugcucuaaagucuuu

SEQ ID NO: 2499781 - RNA, 16 nt, Chlamydia trachomatis
ggaaaucacugaauca

SEQ ID NO: 2499782 - RNA, 16 nt, Chlamydia trachomatis
ggaaaugaaggccaaa

SEQ ID NO: 2499783 - RNA, 17 nt, Chlamydia trachomatis
ggaaaugaggacagagu

SEQ ID NO: 2499784 - RNA, 23 nt, Chlamydia trachomatis
ggaaaugcuggauuggauaucuu

SEQ ID NO: 2499785 - RNA, 16 nt, Chlamydia trachomatis
ggaacaggggaccaaa

SEQ ID NO: 2499786 - RNA, 15 nt, Chlamydia trachomatis
ggaacaucgagaaaa

SEQ ID NO: 2499787 - RNA, 22 nt, Chlamydia trachomatis
ggaacaucgagaaaaugaugaa

SEQ ID NO: 2499788 - RNA, 20 nt, Chlamydia trachomatis
ggaaccggaggauaaaucag

SEQ ID NO: 2499789 - RNA, 22 nt, Chlamydia trachomatis
ggaaccuagaucuaaggaaugu

SEQ ID NO: 2499790 - RNA, 13 nt, Chlamydia trachomatis
ggaagaacagcag

SEQ ID NO: 2499791 - RNA, 16 nt, Chlamydia trachomatis
ggaagaacagcagcag

SEQ ID NO: 2499792 - RNA, 23 nt, Chlamydia trachomatis
ggaagaacagcagcagugccacu

SEQ ID NO: 2499793 - RNA, 18 nt, Chlamydia trachomatis
ggaagaagaagaacugca

SEQ ID NO: 2499794 - RNA, 23 nt, Chlamydia trachomatis
ggaagaauaucaucuucaagagc

SEQ ID NO: 2499795 - RNA, 20 nt, Chlamydia trachomatis
ggaagagaaaccaacgagug

SEQ ID NO: 2499796 - RNA, 15 nt, Chlamydia trachomatis
ggaagagagaacaaa

SEQ ID NO: 2499797 - RNA, 19 nt, Chlamydia trachomatis
ggaagauaacaauccuaga

SEQ ID NO: 2499798 - RNA, 17 nt, Chlamydia trachomatis
ggaagauaauggcaaaa

SEQ ID NO: 2499799 - RNA, 23 nt, Chlamydia trachomatis
ggaagauaauggcaaaaauacca

SEQ ID NO: 2499800 - RNA, 13 nt, Chlamydia trachomatis
ggaagauagaaga

SEQ ID NO: 2499801 - RNA, 19 nt, Chlamydia trachomatis
ggaagaucucuuucucuag

SEQ ID NO: 2499802 - RNA, 22 nt, Chlamydia trachomatis
ggaagaucucuuucucuagaau

SEQ ID NO: 2499803 - RNA, 12 nt, Chlamydia trachomatis
ggaagcaaaaac

SEQ ID NO: 2499804 - RNA, 21 nt, Chlamydia trachomatis
ggaagcauuucucuccaaacc

SEQ ID NO: 2499805 - RNA, 14 nt, Chlamydia trachomatis
ggaagcuagaagaa

SEQ ID NO: 2499806 - RNA, 22 nt, Chlamydia trachomatis
ggaagcuagaagaagaggagga

SEQ ID NO: 2499807 - RNA, 16 nt, Chlamydia trachomatis
ggaaggauguuucccu

SEQ ID NO: 2499808 - RNA, 18 nt, Chlamydia trachomatis
ggaaggauguuucccuuu

SEQ ID NO: 2499809 - RNA, 15 nt, Chlamydia trachomatis
ggaagugguuaaugu

SEQ ID NO: 2499810 - RNA, 16 nt, Chlamydia trachomatis
ggaauaaaaguacuuc

SEQ ID NO: 2499811 - RNA, 15 nt, Chlamydia trachomatis
ggaauaaaucucuuc

SEQ ID NO: 2499812 - RNA, 20 nt, Chlamydia trachomatis
ggaauaagcgaaaaaaaaag

SEQ ID NO: 2499813 - RNA, 19 nt, Chlamydia trachomatis
ggaauaauuuuccacaaau

SEQ ID NO: 2499814 - RNA, 23 nt, Chlamydia trachomatis
ggaauacuguuuguuaucuaaau

SEQ ID NO: 2499815 - RNA, 19 nt, Chlamydia trachomatis
ggaauagcuacuagauaga

SEQ ID NO: 2499816 - RNA, 17 nt, Chlamydia trachomatis
ggaauagcuagagcaug

SEQ ID NO: 2499817 - RNA, 20 nt, Chlamydia trachomatis
ggaauagguugccuuuaucu

SEQ ID NO: 2499818 - RNA, 17 nt, Chlamydia trachomatis
ggaauaucaaaguagca

SEQ ID NO: 2499819 - RNA, 16 nt, Chlamydia trachomatis
ggaauauuaagaucca

SEQ ID NO: 2499820 - RNA, 22 nt, Chlamydia trachomatis
ggaauccuaagcgaugagcgag

SEQ ID NO: 2499821 - RNA, 20 nt, Chlamydia trachomatis
ggaaucucgagcuaagaaaa

SEQ ID NO: 2499822 - RNA, 14 nt, Chlamydia trachomatis
ggaaugacauuccu

SEQ ID NO: 2499823 - RNA, 16 nt, Chlamydia trachomatis
ggaauggguaggauua

SEQ ID NO: 2499824 - RNA, 24 nt, Chlamydia trachomatis
ggaauguauaaacacugagacgaa

SEQ ID NO: 2499825 - RNA, 17 nt, Chlamydia trachomatis
ggaauucgcuaaugauu

SEQ ID NO: 2499826 - RNA, 11 nt, Chlamydia trachomatis
ggaauucuucg

SEQ ID NO: 2499827 - RNA, 13 nt, Chlamydia trachomatis
ggaauucuuggau

SEQ ID NO: 2499828 - RNA, 15 nt, Chlamydia trachomatis
ggacaaaaauacuuc

SEQ ID NO: 2499829 - RNA, 16 nt, Chlamydia trachomatis
ggacaagcgacuccaa

SEQ ID NO: 2499830 - RNA, 18 nt, Chlamydia trachomatis
ggacaucccgaauggaug

SEQ ID NO: 2499831 - RNA, 18 nt, Chlamydia trachomatis
ggacccaugaacagcauu

SEQ ID NO: 2499832 - RNA, 20 nt, Chlamydia trachomatis
ggacgagcgauaucucccga

SEQ ID NO: 2499833 - RNA, 13 nt, Chlamydia trachomatis
ggacuaguccuga

SEQ ID NO: 2499834 - RNA, 22 nt, Chlamydia trachomatis
ggacuauuuucaaaaccuugau

SEQ ID NO: 2499835 - RNA, 17 nt, Chlamydia trachomatis
ggacuuggguaagagca

SEQ ID NO: 2499836 - RNA, 21 nt, Chlamydia trachomatis
ggagaacaagauaaagacccu

SEQ ID NO: 2499837 - RNA, 13 nt, Chlamydia trachomatis
ggagacuuuagcu

SEQ ID NO: 2499838 - RNA, 21 nt, Chlamydia trachomatis
ggagagagccuugagugaaaa

SEQ ID NO: 2499839 - RNA, 23 nt, Chlamydia trachomatis
ggagaguuuugcuacagcuguug

SEQ ID NO: 2499840 - RNA, 20 nt, Chlamydia trachomatis
ggagauguaggauucagaga

SEQ ID NO: 2499841 - RNA, 14 nt, Chlamydia trachomatis
ggagauuccacaac

SEQ ID NO: 2499842 - RNA, 20 nt, Chlamydia trachomatis
ggagcaagaauacaagaaag

SEQ ID NO: 2499843 - RNA, 20 nt, Chlamydia trachomatis
ggagcauaaauaucuugagu

SEQ ID NO: 2499844 - RNA, 21 nt, Chlamydia trachomatis
ggagcaucuucucgaaagaga

SEQ ID NO: 2499845 - RNA, 22 nt, Chlamydia trachomatis
ggagcaugaaucagcuuuucca

SEQ ID NO: 2499846 - RNA, 20 nt, Chlamydia trachomatis
ggagcauucaucuauuuuua

SEQ ID NO: 2499847 - RNA, 13 nt, Chlamydia trachomatis
ggagcauuccuuc

SEQ ID NO: 2499848 - RNA, 17 nt, Chlamydia trachomatis
ggagccuacguccugau

SEQ ID NO: 2499849 - RNA, 22 nt, Chlamydia trachomatis
ggagcgauagaauuucuuccuc

SEQ ID NO: 2499850 - RNA, 17 nt, Chlamydia trachomatis
ggagcuccaggaaaagc

SEQ ID NO: 2499851 - RNA, 17 nt, Chlamydia trachomatis
ggagcuugagagcauuc

SEQ ID NO: 2499852 - RNA, 18 nt, Chlamydia trachomatis
ggagcuuuuugcaaugca

SEQ ID NO: 2499853 - RNA, 15 nt, Chlamydia trachomatis
ggaggacuaacaugc

SEQ ID NO: 2499854 - RNA, 14 nt, Chlamydia trachomatis
ggaguaccaaaaaa

SEQ ID NO: 2499855 - RNA, 23 nt, Chlamydia trachomatis
ggaguacuucuaaaauuugugug

SEQ ID NO: 2499856 - RNA, 16 nt, Chlamydia trachomatis
ggagucugcuccaccu

SEQ ID NO: 2499857 - RNA, 22 nt, Chlamydia trachomatis
ggauaaagaaagccguucccaa

SEQ ID NO: 2499858 - RNA, 12 nt, Chlamydia trachomatis
ggauaaaucagu

SEQ ID NO: 2499859 - RNA, 23 nt, Chlamydia trachomatis
ggauaagaaaucuucucuugaau

SEQ ID NO: 2499860 - RNA, 17 nt, Chlamydia trachomatis
ggauaagaacuucuccu

SEQ ID NO: 2499861 - RNA, 15 nt, Chlamydia trachomatis
ggauaagaucucauc

SEQ ID NO: 2499862 - RNA, 13 nt, Chlamydia trachomatis
ggauaaggaagaa

SEQ ID NO: 2499863 - RNA, 15 nt, Chlamydia trachomatis
ggauaaggaagaaga

SEQ ID NO: 2499864 - RNA, 17 nt, Chlamydia trachomatis
ggauaaggaagaagaua

SEQ ID NO: 2499865 - RNA, 17 nt, Chlamydia trachomatis
ggauaaucucugaaaga

SEQ ID NO: 2499866 - RNA, 22 nt, Chlamydia trachomatis
ggauagauagcuccaagggagg

SEQ ID NO: 2499867 - RNA, 16 nt, Chlamydia trachomatis
ggauagaucaagaaaa

SEQ ID NO: 2499868 - RNA, 18 nt, Chlamydia trachomatis
ggauaggcugaggauucc

SEQ ID NO: 2499869 - RNA, 14 nt, Chlamydia trachomatis
ggaucaauccccaa

SEQ ID NO: 2499870 - RNA, 15 nt, Chlamydia trachomatis
ggaucaauccccaaa

SEQ ID NO: 2499871 - RNA, 20 nt, Chlamydia trachomatis
ggaucaccgaacaaccuucu

SEQ ID NO: 2499872 - RNA, 11 nt, Chlamydia trachomatis
ggaucagcaug

SEQ ID NO: 2499873 - RNA, 14 nt, Chlamydia trachomatis
ggaucgagaagagc

SEQ ID NO: 2499874 - RNA, 16 nt, Chlamydia trachomatis
ggaucgagucccuuca

SEQ ID NO: 2499875 - RNA, 14 nt, Chlamydia trachomatis
ggaucucagcuggc

SEQ ID NO: 2499876 - RNA, 17 nt, Chlamydia trachomatis
ggaugaagcuaaaaaau

SEQ ID NO: 2499877 - RNA, 23 nt, Chlamydia trachomatis
ggaugaucuucaccccuuacaau

SEQ ID NO: 2499878 - RNA, 15 nt, Chlamydia trachomatis
ggaugauucccugua

SEQ ID NO: 2499879 - RNA, 15 nt, Chlamydia trachomatis
ggaugcgaaugaaga

SEQ ID NO: 2499880 - RNA, 21 nt, Chlamydia trachomatis
ggauuacagcaagaagaagag

SEQ ID NO: 2499881 - RNA, 16 nt, Chlamydia trachomatis
ggauucaucaaaauau

SEQ ID NO: 2499882 - RNA, 21 nt, Chlamydia trachomatis
ggauuccauaaaggguguuuu

SEQ ID NO: 2499883 - RNA, 23 nt, Chlamydia trachomatis
ggauuccggaagauacagccugc

SEQ ID NO: 2499884 - RNA, 16 nt, Chlamydia trachomatis
ggauucgaaaagagcu

SEQ ID NO: 2499885 - RNA, 14 nt, Chlamydia trachomatis
ggauucucugcaca

SEQ ID NO: 2499886 - RNA, 15 nt, Chlamydia trachomatis
ggauugacagcuguu

SEQ ID NO: 2499887 - RNA, 21 nt, Chlamydia trachomatis
ggauugcaauccuuuuuccuu

SEQ ID NO: 2499888 - RNA, 19 nt, Chlamydia trachomatis
ggauuugugugcaaaucac

SEQ ID NO: 2499889 - RNA, 22 nt, Chlamydia trachomatis
ggauuuucuucuuuuuuacaua

SEQ ID NO: 2499890 - RNA, 14 nt, Chlamydia trachomatis
ggcaaagagcuucu

SEQ ID NO: 2499891 - RNA, 22 nt, Chlamydia trachomatis
ggcaacccucgcagagaaagag

SEQ ID NO: 2499892 - RNA, 18 nt, Chlamydia trachomatis
ggcaacucucucucccca

SEQ ID NO: 2499893 - RNA, 21 nt, Chlamydia trachomatis
ggcaacucucucuccccauaa

SEQ ID NO: 2499894 - RNA, 19 nt, Chlamydia trachomatis
ggcaacuugagcaucugga

SEQ ID NO: 2499895 - RNA, 22 nt, Chlamydia trachomatis
ggcaagaagcugcaguuucuga

SEQ ID NO: 2499896 - RNA, 19 nt, Chlamydia trachomatis
ggcaaggcuuucaaaaaga

SEQ ID NO: 2499897 - RNA, 20 nt, Chlamydia trachomatis
ggcaaggcuuucaaaaagag

SEQ ID NO: 2499898 - RNA, 22 nt, Chlamydia trachomatis
ggcaaggcuuucaaaaagagcu

SEQ ID NO: 2499899 - RNA, 13 nt, Chlamydia trachomatis
ggcaauaaaagcu

SEQ ID NO: 2499900 - RNA, 19 nt, Chlamydia trachomatis
ggcaauccuuuugauucug

SEQ ID NO: 2499901 - RNA, 12 nt, Chlamydia trachomatis
ggcaaucugcau

SEQ ID NO: 2499902 - RNA, 13 nt, Chlamydia trachomatis
ggcacacuccauc

SEQ ID NO: 2499903 - RNA, 17 nt, Chlamydia trachomatis
ggcacucaaauuucucu

SEQ ID NO: 2499904 - RNA, 15 nt, Chlamydia trachomatis
ggcagcugcuuggaa

SEQ ID NO: 2499905 - RNA, 20 nt, Chlamydia trachomatis
ggcaguuguugggagagggu

SEQ ID NO: 2499906 - RNA, 17 nt, Chlamydia trachomatis
ggcauaaaagagaagaa

SEQ ID NO: 2499907 - RNA, 15 nt, Chlamydia trachomatis
ggcauggaucuccag

SEQ ID NO: 2499908 - RNA, 21 nt, Chlamydia trachomatis
ggcauuccuuggcaaagagcu

SEQ ID NO: 2499909 - RNA, 19 nt, Chlamydia trachomatis
ggcauuuccgguauuaaua

SEQ ID NO: 2499910 - RNA, 13 nt, Chlamydia trachomatis
ggccacaccauuc

SEQ ID NO: 2499911 - RNA, 22 nt, Chlamydia trachomatis
ggccauagaauggcgcucucug

SEQ ID NO: 2499912 - RNA, 23 nt, Chlamydia trachomatis
ggcccaacuggcaagucuaggag

SEQ ID NO: 2499913 - RNA, 19 nt, Chlamydia trachomatis
ggcccacaguucccaucca

SEQ ID NO: 2499914 - RNA, 19 nt, Chlamydia trachomatis
ggccccuggaauuucucca

SEQ ID NO: 2499915 - RNA, 22 nt, Chlamydia trachomatis
ggccuucuuuuuccucagcaug

SEQ ID NO: 2499916 - RNA, 16 nt, Chlamydia trachomatis
ggcgaaaguuuccuua

SEQ ID NO: 2499917 - RNA, 16 nt, Chlamydia trachomatis
ggcgagcauaucuccu

SEQ ID NO: 2499918 - RNA, 13 nt, Chlamydia trachomatis
ggcgauaguucua

SEQ ID NO: 2499919 - RNA, 20 nt, Chlamydia trachomatis
ggcgcuucucuuugaaagag

SEQ ID NO: 2499920 - RNA, 20 nt, Chlamydia trachomatis
ggcggagagaauaccaaaau

SEQ ID NO: 2499921 - RNA, 14 nt, Chlamydia trachomatis
ggcguuguuucuaa

SEQ ID NO: 2499922 - RNA, 13 nt, Chlamydia trachomatis
ggcuaaagaagag

SEQ ID NO: 2499923 - RNA, 19 nt, Chlamydia trachomatis
ggcuaagaaaaaccuuucu

SEQ ID NO: 2499924 - RNA, 17 nt, Chlamydia trachomatis
ggcucauuuuguaggag

SEQ ID NO: 2499925 - RNA, 16 nt, Chlamydia trachomatis
ggcuccuaacaaagcu

SEQ ID NO: 2499926 - RNA, 19 nt, Chlamydia trachomatis
ggcuccuaacaaagcucua

SEQ ID NO: 2499927 - RNA, 18 nt, Chlamydia trachomatis
ggcucguaaaaaagauaa

SEQ ID NO: 2499928 - RNA, 23 nt, Chlamydia trachomatis
ggcucuguuaacugacaauccag

SEQ ID NO: 2499929 - RNA, 17 nt, Chlamydia trachomatis
ggcucuuuaauauuucc

SEQ ID NO: 2499930 - RNA, 17 nt, Chlamydia trachomatis
ggcugcagaagacuuug

SEQ ID NO: 2499931 - RNA, 14 nt, Chlamydia trachomatis
ggcugcaucagcaa

SEQ ID NO: 2499932 - RNA, 22 nt, Chlamydia trachomatis
ggcugcaucagcaagagucucg

SEQ ID NO: 2499933 - RNA, 15 nt, Chlamydia trachomatis
ggcugcuaucuucua

SEQ ID NO: 2499934 - RNA, 22 nt, Chlamydia trachomatis
ggcugcuaucuucuagaggagu

SEQ ID NO: 2499935 - RNA, 14 nt, Chlamydia trachomatis
ggcugcugcuugga

SEQ ID NO: 2499936 - RNA, 15 nt, Chlamydia trachomatis
ggcugcugcuuggaa

SEQ ID NO: 2499937 - RNA, 12 nt, Chlamydia trachomatis
ggcuucaaagaa

SEQ ID NO: 2499938 - RNA, 14 nt, Chlamydia trachomatis
ggcuuccaaaucug

SEQ ID NO: 2499939 - RNA, 22 nt, Chlamydia trachomatis
ggcuucgggacgcccuacagga

SEQ ID NO: 2499940 - RNA, 22 nt, Chlamydia trachomatis
ggcuucucgcgcuccagcucuu

SEQ ID NO: 2499941 - RNA, 17 nt, Chlamydia trachomatis
ggcuugcccaaacucca

SEQ ID NO: 2499942 - RNA, 17 nt, Chlamydia trachomatis
ggcuuucaaaaagagcu

SEQ ID NO: 2499943 - RNA, 22 nt, Chlamydia trachomatis
ggcuuuguccucggaugaccga

SEQ ID NO: 2499944 - RNA, 11 nt, Chlamydia trachomatis
gggaaagcugc

SEQ ID NO: 2499945 - RNA, 12 nt, Chlamydia trachomatis
gggaagaaucaa

SEQ ID NO: 2499946 - RNA, 13 nt, Chlamydia trachomatis
gggaagaaucaau

SEQ ID NO: 2499947 - RNA, 15 nt, Chlamydia trachomatis
gggaauacaguuaga

SEQ ID NO: 2499948 - RNA, 21 nt, Chlamydia trachomatis
gggaaugaaaucacucgcaca

SEQ ID NO: 2499949 - RNA, 16 nt, Chlamydia trachomatis
gggacaaaaauacuuc

SEQ ID NO: 2499950 - RNA, 19 nt, Chlamydia trachomatis
gggagaugaucgaguucua

SEQ ID NO: 2499951 - RNA, 19 nt, Chlamydia trachomatis
gggagcccaauuaaaacaa

SEQ ID NO: 2499952 - RNA, 18 nt, Chlamydia trachomatis
gggauagaaacucacaaa

SEQ ID NO: 2499953 - RNA, 18 nt, Chlamydia trachomatis
gggauauguuaaagccca

SEQ ID NO: 2499954 - RNA, 20 nt, Chlamydia trachomatis
gggauauguuaaagcccagu

SEQ ID NO: 2499955 - RNA, 16 nt, Chlamydia trachomatis
gggcacaacgcccagg

SEQ ID NO: 2499956 - RNA, 22 nt, Chlamydia trachomatis
gggcaccguagaauuucuucuu

SEQ ID NO: 2499957 - RNA, 15 nt, Chlamydia trachomatis
gggcagcaagagaga

SEQ ID NO: 2499958 - RNA, 14 nt, Chlamydia trachomatis
gggcauaacgagug

SEQ ID NO: 2499959 - RNA, 20 nt, Chlamydia trachomatis
gggccuucuuuuuccucagc

SEQ ID NO: 2499960 - RNA, 13 nt, Chlamydia trachomatis
gggccuugauauc

SEQ ID NO: 2499961 - RNA, 13 nt, Chlamydia trachomatis
gggcucguggagg

SEQ ID NO: 2499962 - RNA, 16 nt, Chlamydia trachomatis
gggcucguggagggga

SEQ ID NO: 2499963 - RNA, 14 nt, Chlamydia trachomatis
gggcugcugcuugg

SEQ ID NO: 2499964 - RNA, 24 nt, Chlamydia trachomatis
gggcuuggcggauaucuucuugaa

SEQ ID NO: 2499965 - RNA, 17 nt, Chlamydia trachomatis
gggcuuuugcaaacaau

SEQ ID NO: 2499966 - RNA, 23 nt, Chlamydia trachomatis
ggggaaaucuuaucgagagaggg

SEQ ID NO: 2499967 - RNA, 20 nt, Chlamydia trachomatis
ggggaaucgguacgaauccu

SEQ ID NO: 2499968 - RNA, 14 nt, Chlamydia trachomatis
ggggaccaaaaaag

SEQ ID NO: 2499969 - RNA, 15 nt, Chlamydia trachomatis
ggggaccaaaaaagc

SEQ ID NO: 2499970 - RNA, 19 nt, Chlamydia trachomatis
ggggagcugauguaagcga

SEQ ID NO: 2499971 - RNA, 22 nt, Chlamydia trachomatis
ggggaucgaucccuuuuucagg

SEQ ID NO: 2499972 - RNA, 15 nt, Chlamydia trachomatis
gggucauagaaaaug

SEQ ID NO: 2499973 - RNA, 21 nt, Chlamydia trachomatis
gggugcauacuucccacauac

SEQ ID NO: 2499974 - RNA, 18 nt, Chlamydia trachomatis
gguaacgaguacagaaua

SEQ ID NO: 2499975 - RNA, 17 nt, Chlamydia trachomatis
gguaauagaguucggga

SEQ ID NO: 2499976 - RNA, 15 nt, Chlamydia trachomatis
gguacacuucuuuaa

SEQ ID NO: 2499977 - RNA, 18 nt, Chlamydia trachomatis
gguacuuucucuucaaga

SEQ ID NO: 2499978 - RNA, 19 nt, Chlamydia trachomatis
gguagcaacgauaaacaga

SEQ ID NO: 2499979 - RNA, 22 nt, Chlamydia trachomatis
gguaucucguucuacaggagua

SEQ ID NO: 2499980 - RNA, 18 nt, Chlamydia trachomatis
gguaucugaaucuguguu

SEQ ID NO: 2499981 - RNA, 19 nt, Chlamydia trachomatis
gguauuaauaaugaaauug

SEQ ID NO: 2499982 - RNA, 19 nt, Chlamydia trachomatis
gguauuuguguauggaagu

SEQ ID NO: 2499983 - RNA, 17 nt, Chlamydia trachomatis
gguauuuuagagaaaag

SEQ ID NO: 2499984 - RNA, 19 nt, Chlamydia trachomatis
ggucaaaauuaucuaaaaa

SEQ ID NO: 2499985 - RNA, 22 nt, Chlamydia trachomatis
ggucaaaauuaucuaaaaaaau

SEQ ID NO: 2499986 - RNA, 19 nt, Chlamydia trachomatis
ggucagcucauuagaauga

SEQ ID NO: 2499987 - RNA, 21 nt, Chlamydia trachomatis
ggucagcuguacgauggaaau

SEQ ID NO: 2499988 - RNA, 18 nt, Chlamydia trachomatis
gguccaaggaauaaacag

SEQ ID NO: 2499989 - RNA, 21 nt, Chlamydia trachomatis
ggucggagguucgaauccuuc

SEQ ID NO: 2499990 - RNA, 23 nt, Chlamydia trachomatis
ggucucauuauauaaagccccuc

SEQ ID NO: 2499991 - RNA, 17 nt, Chlamydia trachomatis
ggugaaagcuagaagaa

SEQ ID NO: 2499992 - RNA, 19 nt, Chlamydia trachomatis
ggugaaagcuagaagaauc

SEQ ID NO: 2499993 - RNA, 22 nt, Chlamydia trachomatis
ggugaaagcuagaagaaucaua

SEQ ID NO: 2499994 - RNA, 22 nt, Chlamydia trachomatis
ggugaagaaggaggggauuuuc

SEQ ID NO: 2499995 - RNA, 12 nt, Chlamydia trachomatis
ggugacgaaucc

SEQ ID NO: 2499996 - RNA, 22 nt, Chlamydia trachomatis
ggugacgaauccagaaagagcg

SEQ ID NO: 2499997 - RNA, 13 nt, Chlamydia trachomatis
ggugaggaaggcu

SEQ ID NO: 2499998 - RNA, 14 nt, Chlamydia trachomatis
ggugagugcauaga

SEQ ID NO: 2499999 - RNA, 20 nt, Chlamydia trachomatis
ggugaguuucccuucguccc

SEQ ID NO: 2500000 - RNA, 16 nt, Chlamydia trachomatis
gguggacuuaacuacu

SEQ ID NO: 2500001 - RNA, 22 nt, Chlamydia trachomatis
gguggacuuaacuacucaacaa

SEQ ID NO: 2500002 - RNA, 21 nt, Chlamydia trachomatis
gguggccauucuuacuaaagc

SEQ ID NO: 2500003 - RNA, 12 nt, Chlamydia trachomatis
ggugugauagga

SEQ ID NO: 2500004 - RNA, 14 nt, Chlamydia trachomatis
gguguuagaaaaua

SEQ ID NO: 2500005 - RNA, 14 nt, Chlamydia trachomatis
gguuaugagcccaa

SEQ ID NO: 2500006 - RNA, 20 nt, Chlamydia trachomatis
gguucuguguauuuauauag

SEQ ID NO: 2500007 - RNA, 19 nt, Chlamydia trachomatis
gguucuuagcgcuuguaug

SEQ ID NO: 2500008 - RNA, 13 nt, Chlamydia trachomatis
gguucuucaacaa

SEQ ID NO: 2500009 - RNA, 16 nt, Chlamydia trachomatis
gguuguagaggagaag

SEQ ID NO: 2500010 - RNA, 14 nt, Chlamydia trachomatis
gguugugaagaacu

SEQ ID NO: 2500011 - RNA, 19 nt, Chlamydia trachomatis
gguuguuacagucuguguu

SEQ ID NO: 2500012 - RNA, 14 nt, Chlamydia trachomatis
gguuucaagagcau

SEQ ID NO: 2500013 - RNA, 16 nt, Chlamydia trachomatis
gguuucuuaaacaaaa

SEQ ID NO: 2500014 - RNA, 21 nt, Chlamydia trachomatis
gguuuuaagaccuaguaagug

SEQ ID NO: 2500015 - RNA, 19 nt, Chlamydia trachomatis
gguuuucuuguucuuuuag

SEQ ID NO: 2500016 - RNA, 12 nt, Chlamydia trachomatis
gguuuugauuuc

SEQ ID NO: 2500017 - RNA, 16 nt, Chlamydia trachomatis
guaaaaauagaaaacg

SEQ ID NO: 2500018 - RNA, 13 nt, Chlamydia trachomatis
guaaaacauuucu

SEQ ID NO: 2500019 - RNA, 22 nt, Chlamydia trachomatis
guaaaagagauucuuugacgau

SEQ ID NO: 2500020 - RNA, 16 nt, Chlamydia trachomatis
guaaaaucuaaaauau

SEQ ID NO: 2500021 - RNA, 15 nt, Chlamydia trachomatis
guaaacaagaauaau

SEQ ID NO: 2500022 - RNA, 16 nt, Chlamydia trachomatis
guaaacaagaauaaua

SEQ ID NO: 2500023 - RNA, 21 nt, Chlamydia trachomatis
guaaacaauauucuuuuccau

SEQ ID NO: 2500024 - RNA, 24 nt, Chlamydia trachomatis
guaaacaauauucuuuuccauauu

SEQ ID NO: 2500025 - RNA, 14 nt, Chlamydia trachomatis
guaaacucaagggc

SEQ ID NO: 2500026 - RNA, 14 nt, Chlamydia trachomatis
guaaagaaaagcuc

SEQ ID NO: 2500027 - RNA, 20 nt, Chlamydia trachomatis
guaaaguaacuacggaaaaa

SEQ ID NO: 2500028 - RNA, 12 nt, Chlamydia trachomatis
guaaauauuuug

SEQ ID NO: 2500029 - RNA, 16 nt, Chlamydia trachomatis
guaaauauuuugccau

SEQ ID NO: 2500030 - RNA, 22 nt, Chlamydia trachomatis
guaaauccuugcuaggagguuu

SEQ ID NO: 2500031 - RNA, 16 nt, Chlamydia trachomatis
guaaauuuucaauagc

SEQ ID NO: 2500032 - RNA, 10 nt, Chlamydia trachomatis
guaacaauau

SEQ ID NO: 2500033 - RNA, 16 nt, Chlamydia trachomatis
guaacaaucacaggcu

SEQ ID NO: 2500034 - RNA, 19 nt, Chlamydia trachomatis
guaacacggccauuauaaa

SEQ ID NO: 2500035 - RNA, 18 nt, Chlamydia trachomatis
guaaccagcggcaaaaau

SEQ ID NO: 2500036 - RNA, 16 nt, Chlamydia trachomatis
guaacuaaauuuuuaa

SEQ ID NO: 2500037 - RNA, 11 nt, Chlamydia trachomatis
guaagaccaaa

SEQ ID NO: 2500038 - RNA, 20 nt, Chlamydia trachomatis
guaagaccgagauuaucauu

SEQ ID NO: 2500039 - RNA, 11 nt, Chlamydia trachomatis
guaagagcaga

SEQ ID NO: 2500040 - RNA, 15 nt, Chlamydia trachomatis
guaagaucuguagca

SEQ ID NO: 2500041 - RNA, 19 nt, Chlamydia trachomatis
guaagaucuguagcaagaa

SEQ ID NO: 2500042 - RNA, 20 nt, Chlamydia trachomatis
guaagaucuguagcaagaag

SEQ ID NO: 2500043 - RNA, 15 nt, Chlamydia trachomatis
guaagcaacgacaaa

SEQ ID NO: 2500044 - RNA, 15 nt, Chlamydia trachomatis
guaagcgcuuccauu

SEQ ID NO: 2500045 - RNA, 14 nt, Chlamydia trachomatis
guaaggagagaaaa

SEQ ID NO: 2500046 - RNA, 17 nt, Chlamydia trachomatis
guaagggacaacagggu

SEQ ID NO: 2500047 - RNA, 20 nt, Chlamydia trachomatis
guaagggagguuuuuggcuu

SEQ ID NO: 2500048 - RNA, 23 nt, Chlamydia trachomatis
guaagggguuuucuuggcaggcg

SEQ ID NO: 2500049 - RNA, 14 nt, Chlamydia trachomatis
guaaguguugagga

SEQ ID NO: 2500050 - RNA, 15 nt, Chlamydia trachomatis
guaauaaacccugga

SEQ ID NO: 2500051 - RNA, 20 nt, Chlamydia trachomatis
guaauaaacccuggaugcac

SEQ ID NO: 2500052 - RNA, 23 nt, Chlamydia trachomatis
guaauaacugagccaagaacaaa

SEQ ID NO: 2500053 - RNA, 11 nt, Chlamydia trachomatis
guaauagcuac

SEQ ID NO: 2500054 - RNA, 11 nt, Chlamydia trachomatis
guaauaucaaa

SEQ ID NO: 2500055 - RNA, 14 nt, Chlamydia trachomatis
guaauaucaaagag

SEQ ID NO: 2500056 - RNA, 15 nt, Chlamydia trachomatis
guaaucaaaaaagga

SEQ ID NO: 2500057 - RNA, 19 nt, Chlamydia trachomatis
guaaucuucacggagagaa

SEQ ID NO: 2500058 - RNA, 14 nt, Chlamydia trachomatis
guaaugaaggaaau

SEQ ID NO: 2500059 - RNA, 22 nt, Chlamydia trachomatis
guaaugagaggugugaauagga

SEQ ID NO: 2500060 - RNA, 23 nt, Chlamydia trachomatis
guaaugagaggugugaauaggaa

SEQ ID NO: 2500061 - RNA, 21 nt, Chlamydia trachomatis
guaaugaucagcaaaaagagg

SEQ ID NO: 2500062 - RNA, 21 nt, Chlamydia trachomatis
guaaugccuuuuguuuucaaa

SEQ ID NO: 2500063 - RNA, 13 nt, Chlamydia trachomatis
guaauguccucuu

SEQ ID NO: 2500064 - RNA, 22 nt, Chlamydia trachomatis
guaauguccucuuuaucuaaag

SEQ ID NO: 2500065 - RNA, 16 nt, Chlamydia trachomatis
guaauucgagccuguu

SEQ ID NO: 2500066 - RNA, 22 nt, Chlamydia trachomatis
guaauucgagccuguuuugcaa

SEQ ID NO: 2500067 - RNA, 16 nt, Chlamydia trachomatis
guaauuuuaaauccug

SEQ ID NO: 2500068 - RNA, 18 nt, Chlamydia trachomatis
guaauuuucuagcuucuu

SEQ ID NO: 2500069 - RNA, 15 nt, Chlamydia trachomatis
guaauuuugacagaa

SEQ ID NO: 2500070 - RNA, 12 nt, Chlamydia trachomatis
guacaaaaauac

SEQ ID NO: 2500071 - RNA, 23 nt, Chlamydia trachomatis
guacaaggcucuugaaaaggagc

SEQ ID NO: 2500072 - RNA, 21 nt, Chlamydia trachomatis
guacacgcugaguuuccuuua

SEQ ID NO: 2500073 - RNA, 16 nt, Chlamydia trachomatis
guacagacugccuacc

SEQ ID NO: 2500074 - RNA, 19 nt, Chlamydia trachomatis
guaccauuacuacaacagg

SEQ ID NO: 2500075 - RNA, 16 nt, Chlamydia trachomatis
guaccucgagcaacga

SEQ ID NO: 2500076 - RNA, 18 nt, Chlamydia trachomatis
guaccuggaaaggagaaa

SEQ ID NO: 2500077 - RNA, 16 nt, Chlamydia trachomatis
guacgaauccucuaau

SEQ ID NO: 2500078 - RNA, 16 nt, Chlamydia trachomatis
guacggaguaucuauc

SEQ ID NO: 2500079 - RNA, 17 nt, Chlamydia trachomatis
guacucgauggcaggga

SEQ ID NO: 2500080 - RNA, 14 nt, Chlamydia trachomatis
guacucugauuaga

SEQ ID NO: 2500081 - RNA, 19 nt, Chlamydia trachomatis
guacucugcaaaaucuucc

SEQ ID NO: 2500082 - RNA, 18 nt, Chlamydia trachomatis
guacuggggucagcauuu

SEQ ID NO: 2500083 - RNA, 14 nt, Chlamydia trachomatis
guacuucuaaaauu

SEQ ID NO: 2500084 - RNA, 12 nt, Chlamydia trachomatis
guacuuucucuu

SEQ ID NO: 2500085 - RNA, 19 nt, Chlamydia trachomatis
guacuuuugguucugccag

SEQ ID NO: 2500086 - RNA, 20 nt, Chlamydia trachomatis
guagaaacuuacuuuucuua

SEQ ID NO: 2500087 - RNA, 19 nt, Chlamydia trachomatis
guagaaagcugggaaaucu

SEQ ID NO: 2500088 - RNA, 16 nt, Chlamydia trachomatis
guagaaccacuuuucu

SEQ ID NO: 2500089 - RNA, 14 nt, Chlamydia trachomatis
guagaauuucuucu

SEQ ID NO: 2500090 - RNA, 17 nt, Chlamydia trachomatis
guagacagcucuugcau

SEQ ID NO: 2500091 - RNA, 22 nt, Chlamydia trachomatis
guagacagcucuugcauuuggg

SEQ ID NO: 2500092 - RNA, 22 nt, Chlamydia trachomatis
guagacuucuuguauaaguucu

SEQ ID NO: 2500093 - RNA, 17 nt, Chlamydia trachomatis
guagagacgagaaaucu

SEQ ID NO: 2500094 - RNA, 12 nt, Chlamydia trachomatis
guagagcaagau

SEQ ID NO: 2500095 - RNA, 17 nt, Chlamydia trachomatis
guagagcauacucuaaa

SEQ ID NO: 2500096 - RNA, 15 nt, Chlamydia trachomatis
guagauaucuuuacu

SEQ ID NO: 2500097 - RNA, 22 nt, Chlamydia trachomatis
guagaucuguuagugaagagca

SEQ ID NO: 2500098 - RNA, 13 nt, Chlamydia trachomatis
guagaucuuuucg

SEQ ID NO: 2500099 - RNA, 19 nt, Chlamydia trachomatis
guagauucagcaagauucu

SEQ ID NO: 2500100 - RNA, 19 nt, Chlamydia trachomatis
guagauucuggaggaggac

SEQ ID NO: 2500101 - RNA, 14 nt, Chlamydia trachomatis
guagccauagcauc

SEQ ID NO: 2500102 - RNA, 15 nt, Chlamydia trachomatis
guagccccuuuagaa

SEQ ID NO: 2500103 - RNA, 17 nt, Chlamydia trachomatis
guagcgagcaagcuuuu

SEQ ID NO: 2500104 - RNA, 23 nt, Chlamydia trachomatis
guagcucguuuuuuuguuguugc

SEQ ID NO: 2500105 - RNA, 14 nt, Chlamydia trachomatis
guagcugaugaagc

SEQ ID NO: 2500106 - RNA, 12 nt, Chlamydia trachomatis
guaggaaugcug

SEQ ID NO: 2500107 - RNA, 15 nt, Chlamydia trachomatis
guaggacucuaagag

SEQ ID NO: 2500108 - RNA, 22 nt, Chlamydia trachomatis
guaggaucgccgguuaacacaa

SEQ ID NO: 2500109 - RNA, 22 nt, Chlamydia trachomatis
guaggcacucgagucaugcaaa

SEQ ID NO: 2500110 - RNA, 14 nt, Chlamydia trachomatis
guagguugucacug

SEQ ID NO: 2500111 - RNA, 20 nt, Chlamydia trachomatis
guagguuucugcuaaaucca

SEQ ID NO: 2500112 - RNA, 23 nt, Chlamydia trachomatis
guaguccacauucacuucaacuc

SEQ ID NO: 2500113 - RNA, 19 nt, Chlamydia trachomatis
guagugccagcauucauaa

SEQ ID NO: 2500114 - RNA, 20 nt, Chlamydia trachomatis
guagugggcucguggagggg

SEQ ID NO: 2500115 - RNA, 14 nt, Chlamydia trachomatis
guaguguuuccuga

SEQ ID NO: 2500116 - RNA, 12 nt, Chlamydia trachomatis
guauaagaaaaa

SEQ ID NO: 2500117 - RNA, 13 nt, Chlamydia trachomatis
guauaagaaaaag

SEQ ID NO: 2500118 - RNA, 17 nt, Chlamydia trachomatis
guauaaguuuuaagaag

SEQ ID NO: 2500119 - RNA, 18 nt, Chlamydia trachomatis
guauaaguuuuaagaaga

SEQ ID NO: 2500120 - RNA, 20 nt, Chlamydia trachomatis
guauagcaaugcgaucagaa

SEQ ID NO: 2500121 - RNA, 21 nt, Chlamydia trachomatis
guaucaaauuuuucagaaaaa

SEQ ID NO: 2500122 - RNA, 14 nt, Chlamydia trachomatis
guaucaacagauga

SEQ ID NO: 2500123 - RNA, 20 nt, Chlamydia trachomatis
guaucaacagaugacucaaa

SEQ ID NO: 2500124 - RNA, 22 nt, Chlamydia trachomatis
guauccauauccaugaagaccc

SEQ ID NO: 2500125 - RNA, 21 nt, Chlamydia trachomatis
guaucccuaguacaaaaauac

SEQ ID NO: 2500126 - RNA, 16 nt, Chlamydia trachomatis
guauccugcagcaaau

SEQ ID NO: 2500127 - RNA, 16 nt, Chlamydia trachomatis
guaucugaacaagaag

SEQ ID NO: 2500128 - RNA, 19 nt, Chlamydia trachomatis
guaucuguuaguagcuucu

SEQ ID NO: 2500129 - RNA, 11 nt, Chlamydia trachomatis
guaugcaucug

SEQ ID NO: 2500130 - RNA, 17 nt, Chlamydia trachomatis
guaugccaagaccucuu

SEQ ID NO: 2500131 - RNA, 20 nt, Chlamydia trachomatis
guaugugcucauuuccuaua

SEQ ID NO: 2500132 - RNA, 22 nt, Chlamydia trachomatis
guauguuuggauugccugcucc

SEQ ID NO: 2500133 - RNA, 22 nt, Chlamydia trachomatis
guauuacggaaaagcuuuuuaa

SEQ ID NO: 2500134 - RNA, 16 nt, Chlamydia trachomatis
guauuccuguagaaag

SEQ ID NO: 2500135 - RNA, 12 nt, Chlamydia trachomatis
guauucuaaagu

SEQ ID NO: 2500136 - RNA, 22 nt, Chlamydia trachomatis
guauuuaggaacucuaaauacc

SEQ ID NO: 2500137 - RNA, 23 nt, Chlamydia trachomatis
guauuuaggaacucuaaauaccu

SEQ ID NO: 2500138 - RNA, 16 nt, Chlamydia trachomatis
guauuuguguauggaa

SEQ ID NO: 2500139 - RNA, 11 nt, Chlamydia trachomatis
guauuuuauuc

SEQ ID NO: 2500140 - RNA, 12 nt, Chlamydia trachomatis
guauuuuauuca

SEQ ID NO: 2500141 - RNA, 14 nt, Chlamydia trachomatis
guauuuuuguuucu

SEQ ID NO: 2500142 - RNA, 15 nt, Chlamydia trachomatis
gucaaaauuaucuaa

SEQ ID NO: 2500143 - RNA, 13 nt, Chlamydia trachomatis
gucaacauaauag

SEQ ID NO: 2500144 - RNA, 22 nt, Chlamydia trachomatis
gucaacaucauaaccaaucgau

SEQ ID NO: 2500145 - RNA, 15 nt, Chlamydia trachomatis
gucaauuucuggaga

SEQ ID NO: 2500146 - RNA, 15 nt, Chlamydia trachomatis
gucacuccuccagcu

SEQ ID NO: 2500147 - RNA, 24 nt, Chlamydia trachomatis
gucacucuugauagucuugcaugg

SEQ ID NO: 2500148 - RNA, 21 nt, Chlamydia trachomatis
gucagaauaauauuuuuuccc

SEQ ID NO: 2500149 - RNA, 19 nt, Chlamydia trachomatis
gucagagagaggcugcauu

SEQ ID NO: 2500150 - RNA, 16 nt, Chlamydia trachomatis
gucagaucauuuuaau

SEQ ID NO: 2500151 - RNA, 22 nt, Chlamydia trachomatis
gucagccaguccucccaaaaua

SEQ ID NO: 2500152 - RNA, 18 nt, Chlamydia trachomatis
gucagcuguacgauggaa

SEQ ID NO: 2500153 - RNA, 21 nt, Chlamydia trachomatis
gucauagaaaauggcugcuug

SEQ ID NO: 2500154 - RNA, 20 nt, Chlamydia trachomatis
gucauagaucgguugcaucc

SEQ ID NO: 2500155 - RNA, 22 nt, Chlamydia trachomatis
gucauauucggcuguagugauc

SEQ ID NO: 2500156 - RNA, 17 nt, Chlamydia trachomatis
gucaucagugucucaug

SEQ ID NO: 2500157 - RNA, 20 nt, Chlamydia trachomatis
gucaugacucggaauaagag

SEQ ID NO: 2500158 - RNA, 13 nt, Chlamydia trachomatis
gucauugauucua

SEQ ID NO: 2500159 - RNA, 23 nt, Chlamydia trachomatis
guccaaaaagcgugucaaugaga

SEQ ID NO: 2500160 - RNA, 13 nt, Chlamydia trachomatis
guccaaagcucuu

SEQ ID NO: 2500161 - RNA, 18 nt, Chlamydia trachomatis
guccacauucacuucaac

SEQ ID NO: 2500162 - RNA, 19 nt, Chlamydia trachomatis
guccaucuaaagggagaau

SEQ ID NO: 2500163 - RNA, 17 nt, Chlamydia trachomatis
guccauucuaaggagca

SEQ ID NO: 2500164 - RNA, 14 nt, Chlamydia trachomatis
gucccaucuugcac

SEQ ID NO: 2500165 - RNA, 20 nt, Chlamydia trachomatis
guccgacuaccgcuaucucc

SEQ ID NO: 2500166 - RNA, 14 nt, Chlamydia trachomatis
guccggacuuuccu

SEQ ID NO: 2500167 - RNA, 18 nt, Chlamydia trachomatis
guccuccugauuccugcu

SEQ ID NO: 2500168 - RNA, 14 nt, Chlamydia trachomatis
guccucuauuuccu

SEQ ID NO: 2500169 - RNA, 13 nt, Chlamydia trachomatis
guccugaagcaau

SEQ ID NO: 2500170 - RNA, 12 nt, Chlamydia trachomatis
guccugagccaa

SEQ ID NO: 2500171 - RNA, 17 nt, Chlamydia trachomatis
guccugcuucuuuuucc

SEQ ID NO: 2500172 - RNA, 23 nt, Chlamydia trachomatis
guccuggccaaaaaaucagcuug

SEQ ID NO: 2500173 - RNA, 19 nt, Chlamydia trachomatis
guccuuccauggauaaaau

SEQ ID NO: 2500174 - RNA, 14 nt, Chlamydia trachomatis
guccuuccauggcc

SEQ ID NO: 2500175 - RNA, 18 nt, Chlamydia trachomatis
guccuucuuuaccgauaa

SEQ ID NO: 2500176 - RNA, 23 nt, Chlamydia trachomatis
guccuucuuuaccgauaauuuua

SEQ ID NO: 2500177 - RNA, 13 nt, Chlamydia trachomatis
guccuuuucuccc

SEQ ID NO: 2500178 - RNA, 14 nt, Chlamydia trachomatis
gucgaaaagcuucu

SEQ ID NO: 2500179 - RNA, 16 nt, Chlamydia trachomatis
gucgaauuuuucugcu

SEQ ID NO: 2500180 - RNA, 22 nt, Chlamydia trachomatis
gucgauaucguuagcaucaucc

SEQ ID NO: 2500181 - RNA, 22 nt, Chlamydia trachomatis
gucgauuggaucagcuccuauc

SEQ ID NO: 2500182 - RNA, 18 nt, Chlamydia trachomatis
gucgauuuuuaaaagacc

SEQ ID NO: 2500183 - RNA, 20 nt, Chlamydia trachomatis
gucgcauuccaagaagaacu

SEQ ID NO: 2500184 - RNA, 12 nt, Chlamydia trachomatis
gucgcgcagcuu

SEQ ID NO: 2500185 - RNA, 19 nt, Chlamydia trachomatis
gucgcuuagauauuuucac

SEQ ID NO: 2500186 - RNA, 18 nt, Chlamydia trachomatis
gucggagguucgaauccu

SEQ ID NO: 2500187 - RNA, 19 nt, Chlamydia trachomatis
gucggcaagacucuuucaa

SEQ ID NO: 2500188 - RNA, 21 nt, Chlamydia trachomatis
gucgggaaacauuccaaauau

SEQ ID NO: 2500189 - RNA, 22 nt, Chlamydia trachomatis
gucguaaacgauuaacucugca

SEQ ID NO: 2500190 - RNA, 18 nt, Chlamydia trachomatis
gucguuuucggagaagaa

SEQ ID NO: 2500191 - RNA, 17 nt, Chlamydia trachomatis
gucuaaaacaauugguu

SEQ ID NO: 2500192 - RNA, 21 nt, Chlamydia trachomatis
gucuaaagaucggcuuacauc

SEQ ID NO: 2500193 - RNA, 20 nt, Chlamydia trachomatis
gucuaagauuuucaucuucc

SEQ ID NO: 2500194 - RNA, 23 nt, Chlamydia trachomatis
gucuacuuuuuguuuagacaauu

SEQ ID NO: 2500195 - RNA, 18 nt, Chlamydia trachomatis
gucuagcuagaagccaau

SEQ ID NO: 2500196 - RNA, 15 nt, Chlamydia trachomatis
gucuagcuuuuuuca

SEQ ID NO: 2500197 - RNA, 19 nt, Chlamydia trachomatis
gucuagcuuuuuucagaaa

SEQ ID NO: 2500198 - RNA, 17 nt, Chlamydia trachomatis
gucuaucuaccuuuuuc

SEQ ID NO: 2500199 - RNA, 21 nt, Chlamydia trachomatis
gucuccaaaaguguuuagaag

SEQ ID NO: 2500200 - RNA, 17 nt, Chlamydia trachomatis
gucuccacugguucucu

SEQ ID NO: 2500201 - RNA, 19 nt, Chlamydia trachomatis
gucucgacgcucauaacca

SEQ ID NO: 2500202 - RNA, 20 nt, Chlamydia trachomatis
gucucgacgcucauaaccau

SEQ ID NO: 2500203 - RNA, 19 nt, Chlamydia trachomatis
gucucgcgcuaaaaccuua

SEQ ID NO: 2500204 - RNA, 22 nt, Chlamydia trachomatis
gucucucuuuaugaacaacaua

SEQ ID NO: 2500205 - RNA, 19 nt, Chlamydia trachomatis
gucucuuauaaucuggaua

SEQ ID NO: 2500206 - RNA, 13 nt, Chlamydia trachomatis
gucucuucacaaa

SEQ ID NO: 2500207 - RNA, 20 nt, Chlamydia trachomatis
gucucuucuccuagagaaac

SEQ ID NO: 2500208 - RNA, 21 nt, Chlamydia trachomatis
gucucuucuccuagagaaaca

SEQ ID NO: 2500209 - RNA, 14 nt, Chlamydia trachomatis
gucugcaagaaaau

SEQ ID NO: 2500210 - RNA, 23 nt, Chlamydia trachomatis
gucugcaagaaaauagguaaaga

SEQ ID NO: 2500211 - RNA, 16 nt, Chlamydia trachomatis
gucugcauuaaacacu

SEQ ID NO: 2500212 - RNA, 20 nt, Chlamydia trachomatis
gucugggcgaucuccuuccu

SEQ ID NO: 2500213 - RNA, 21 nt, Chlamydia trachomatis
gucuguauaacaauuuuaaaa

SEQ ID NO: 2500214 - RNA, 16 nt, Chlamydia trachomatis
gucugugauaucccuu

SEQ ID NO: 2500215 - RNA, 17 nt, Chlamydia trachomatis
gucuguuccuaauacua

SEQ ID NO: 2500216 - RNA, 13 nt, Chlamydia trachomatis
gucuguuucuguc

SEQ ID NO: 2500217 - RNA, 21 nt, Chlamydia trachomatis
gucuuaaaaggguagaaaaag

SEQ ID NO: 2500218 - RNA, 13 nt, Chlamydia trachomatis
gucuuccucugcu

SEQ ID NO: 2500219 - RNA, 21 nt, Chlamydia trachomatis
gucuucuaccgcgagcucguu

SEQ ID NO: 2500220 - RNA, 15 nt, Chlamydia trachomatis
gucuucucgagaaga

SEQ ID NO: 2500221 - RNA, 22 nt, Chlamydia trachomatis
gucuucucugugcacaaucucu

SEQ ID NO: 2500222 - RNA, 14 nt, Chlamydia trachomatis
gucuucuuucucuu

SEQ ID NO: 2500223 - RNA, 22 nt, Chlamydia trachomatis
gucuuguaacuaagcuucucaa

SEQ ID NO: 2500224 - RNA, 15 nt, Chlamydia trachomatis
gucuuguccuucccg

SEQ ID NO: 2500225 - RNA, 19 nt, Chlamydia trachomatis
gucuuuaauaccuucuuac

SEQ ID NO: 2500226 - RNA, 21 nt, Chlamydia trachomatis
gucuuuaauaccuucuuacau

SEQ ID NO: 2500227 - RNA, 18 nt, Chlamydia trachomatis
gucuuuagaagaaaagag

SEQ ID NO: 2500228 - RNA, 23 nt, Chlamydia trachomatis
gucuuuuugcuaccaagcuucuu

SEQ ID NO: 2500229 - RNA, 15 nt, Chlamydia trachomatis
gugaaaagggcaaaa

SEQ ID NO: 2500230 - RNA, 13 nt, Chlamydia trachomatis
gugaagaaacuuc

SEQ ID NO: 2500231 - RNA, 17 nt, Chlamydia trachomatis
gugaagaacugucuucu

SEQ ID NO: 2500232 - RNA, 19 nt, Chlamydia trachomatis
gugaagaaugaaacuuggu

SEQ ID NO: 2500233 - RNA, 19 nt, Chlamydia trachomatis
gugaaguucccuuuacaau

SEQ ID NO: 2500234 - RNA, 20 nt, Chlamydia trachomatis
gugaaucuguucagaacuca

SEQ ID NO: 2500235 - RNA, 21 nt, Chlamydia trachomatis
gugacagcauagauauugccu

SEQ ID NO: 2500236 - RNA, 22 nt, Chlamydia trachomatis
gugaccucugcguagaucccag

SEQ ID NO: 2500237 - RNA, 13 nt, Chlamydia trachomatis
gugagacagcacu

SEQ ID NO: 2500238 - RNA, 18 nt, Chlamydia trachomatis
gugaguccacaugguuca

SEQ ID NO: 2500239 - RNA, 16 nt, Chlamydia trachomatis
gugaguguaccauggg

SEQ ID NO: 2500240 - RNA, 15 nt, Chlamydia trachomatis
gugaguguuuguaua

SEQ ID NO: 2500241 - RNA, 13 nt, Chlamydia trachomatis
gugaguuauauuu

SEQ ID NO: 2500242 - RNA, 22 nt, Chlamydia trachomatis
gugaugaaaccuaauagaaaua

SEQ ID NO: 2500243 - RNA, 12 nt, Chlamydia trachomatis
gugaugaaauug

SEQ ID NO: 2500244 - RNA, 21 nt, Chlamydia trachomatis
gugaugcggagcgaugagcuu

SEQ ID NO: 2500245 - RNA, 18 nt, Chlamydia trachomatis
gugcaacacaacuucugc

SEQ ID NO: 2500246 - RNA, 19 nt, Chlamydia trachomatis
gugcaacacaacuucugcu

SEQ ID NO: 2500247 - RNA, 19 nt, Chlamydia trachomatis
gugcagaagaauaggaauc

SEQ ID NO: 2500248 - RNA, 20 nt, Chlamydia trachomatis
gugcagaggauuuauaaaga

SEQ ID NO: 2500249 - RNA, 18 nt, Chlamydia trachomatis
gugcagcguucugagaug

SEQ ID NO: 2500250 - RNA, 13 nt, Chlamydia trachomatis
gugcauaccuuuu

SEQ ID NO: 2500251 - RNA, 17 nt, Chlamydia trachomatis
gugcaucauuuuguaua

SEQ ID NO: 2500252 - RNA, 23 nt, Chlamydia trachomatis
gugccucaauuuguagcaaaaga

SEQ ID NO: 2500253 - RNA, 15 nt, Chlamydia trachomatis
gugcgaggaauucuu

SEQ ID NO: 2500254 - RNA, 15 nt, Chlamydia trachomatis
gugcuaaaucuccaa

SEQ ID NO: 2500255 - RNA, 15 nt, Chlamydia trachomatis
gugcuaacuuucuuc

SEQ ID NO: 2500256 - RNA, 18 nt, Chlamydia trachomatis
gugcuccugcagacaagc

SEQ ID NO: 2500257 - RNA, 20 nt, Chlamydia trachomatis
gugcuccugguccaaggaau

SEQ ID NO: 2500258 - RNA, 22 nt, Chlamydia trachomatis
gugcuguauuauuagguuuaua

SEQ ID NO: 2500259 - RNA, 18 nt, Chlamydia trachomatis
gugcuugcauagauagau

SEQ ID NO: 2500260 - RNA, 20 nt, Chlamydia trachomatis
guggaacagcucuaaagagc

SEQ ID NO: 2500261 - RNA, 15 nt, Chlamydia trachomatis
guggaacugcuuccc

SEQ ID NO: 2500262 - RNA, 17 nt, Chlamydia trachomatis
guggaauuguauccagc

SEQ ID NO: 2500263 - RNA, 22 nt, Chlamydia trachomatis
guggacuuuagauagucuucua

SEQ ID NO: 2500264 - RNA, 14 nt, Chlamydia trachomatis
guggcaagggggag

SEQ ID NO: 2500265 - RNA, 14 nt, Chlamydia trachomatis
guggcacacuccau

SEQ ID NO: 2500266 - RNA, 16 nt, Chlamydia trachomatis
guggccauucuuacua

SEQ ID NO: 2500267 - RNA, 23 nt, Chlamydia trachomatis
guggcguuguuucuaauggauga

SEQ ID NO: 2500268 - RNA, 17 nt, Chlamydia trachomatis
gugguaacaccaaaaaa

SEQ ID NO: 2500269 - RNA, 22 nt, Chlamydia trachomatis
guguaauuuccuauuucuucgc

SEQ ID NO: 2500270 - RNA, 19 nt, Chlamydia trachomatis
guguacacgcugaguuucc

SEQ ID NO: 2500271 - RNA, 13 nt, Chlamydia trachomatis
guguacauuagca

SEQ ID NO: 2500272 - RNA, 23 nt, Chlamydia trachomatis
guguacuuuugguucugccaguu

SEQ ID NO: 2500273 - RNA, 15 nt, Chlamydia trachomatis
guguagcaaauaggc

SEQ ID NO: 2500274 - RNA, 17 nt, Chlamydia trachomatis
guguaggguagaacagg

SEQ ID NO: 2500275 - RNA, 16 nt, Chlamydia trachomatis
guguaucaaaaucaau

SEQ ID NO: 2500276 - RNA, 24 nt, Chlamydia trachomatis
gugucauaagcucuaacucuucuu

SEQ ID NO: 2500277 - RNA, 16 nt, Chlamydia trachomatis
gugucgaaaaugguuu

SEQ ID NO: 2500278 - RNA, 21 nt, Chlamydia trachomatis
gugucucgguuuucuuuagcc

SEQ ID NO: 2500279 - RNA, 23 nt, Chlamydia trachomatis
gugugacuguaaguuuauuccaa

SEQ ID NO: 2500280 - RNA, 15 nt, Chlamydia trachomatis
guguguaaccuuccc

SEQ ID NO: 2500281 - RNA, 19 nt, Chlamydia trachomatis
guguucuaaacccucugca

SEQ ID NO: 2500282 - RNA, 16 nt, Chlamydia trachomatis
guguugaaugucuuuu

SEQ ID NO: 2500283 - RNA, 20 nt, Chlamydia trachomatis
guguugcauauuccagcucc

SEQ ID NO: 2500284 - RNA, 11 nt, Chlamydia trachomatis
guguuuccaaa

SEQ ID NO: 2500285 - RNA, 17 nt, Chlamydia trachomatis
guguuugcauucuuuua

SEQ ID NO: 2500286 - RNA, 18 nt, Chlamydia trachomatis
guuaaaacuccagaaaau

SEQ ID NO: 2500287 - RNA, 16 nt, Chlamydia trachomatis
guuaacaggcuuccuu

SEQ ID NO: 2500288 - RNA, 20 nt, Chlamydia trachomatis
guuaauaucccacucuuccc

SEQ ID NO: 2500289 - RNA, 16 nt, Chlamydia trachomatis
guuaaugggucaagaa

SEQ ID NO: 2500290 - RNA, 21 nt, Chlamydia trachomatis
guuaaugucucuucacaaaua

SEQ ID NO: 2500291 - RNA, 18 nt, Chlamydia trachomatis
guuaauuaauaagccuuu

SEQ ID NO: 2500292 - RNA, 13 nt, Chlamydia trachomatis
guuacagaugccu

SEQ ID NO: 2500293 - RNA, 23 nt, Chlamydia trachomatis
guuaccucuuuacgcacaaagau

SEQ ID NO: 2500294 - RNA, 21 nt, Chlamydia trachomatis
guuaccugugaagaaacuucu

SEQ ID NO: 2500295 - RNA, 18 nt, Chlamydia trachomatis
guuacuaacaucaaagau

SEQ ID NO: 2500296 - RNA, 19 nt, Chlamydia trachomatis
guuacuucaaguucuucuu

SEQ ID NO: 2500297 - RNA, 19 nt, Chlamydia trachomatis
guuacuugcuccguggcaa

SEQ ID NO: 2500298 - RNA, 16 nt, Chlamydia trachomatis
guuacuuuucucaaaa

SEQ ID NO: 2500299 - RNA, 20 nt, Chlamydia trachomatis
guuacuuuucucaaaacgcu

SEQ ID NO: 2500300 - RNA, 14 nt, Chlamydia trachomatis
guuagaaaugcaaa

SEQ ID NO: 2500301 - RNA, 22 nt, Chlamydia trachomatis
guuagaaauucaucaugagaac

SEQ ID NO: 2500302 - RNA, 14 nt, Chlamydia trachomatis
guuagacaaaaaau

SEQ ID NO: 2500303 - RNA, 13 nt, Chlamydia trachomatis
guuagcaucaucc

SEQ ID NO: 2500304 - RNA, 16 nt, Chlamydia trachomatis
guuagccguaucuccg

SEQ ID NO: 2500305 - RNA, 14 nt, Chlamydia trachomatis
guuagcugaaaugu

SEQ ID NO: 2500306 - RNA, 17 nt, Chlamydia trachomatis
guuaggcauuccuuucu

SEQ ID NO: 2500307 - RNA, 15 nt, Chlamydia trachomatis
guuaggccauuucau

SEQ ID NO: 2500308 - RNA, 15 nt, Chlamydia trachomatis
guuagguaaucuucu

SEQ ID NO: 2500309 - RNA, 22 nt, Chlamydia trachomatis
guuaguauaugcucuuuggugu

SEQ ID NO: 2500310 - RNA, 16 nt, Chlamydia trachomatis
guuagugaagagcaga

SEQ ID NO: 2500311 - RNA, 18 nt, Chlamydia trachomatis
guuagugaagagcagagg

SEQ ID NO: 2500312 - RNA, 20 nt, Chlamydia trachomatis
guuauaacgauauccuucug

SEQ ID NO: 2500313 - RNA, 19 nt, Chlamydia trachomatis
guuauaagaccuaauccac

SEQ ID NO: 2500314 - RNA, 20 nt, Chlamydia trachomatis
guuauauugcuucauaaaaa

SEQ ID NO: 2500315 - RNA, 20 nt, Chlamydia trachomatis
guuauucucaaguugagugc

SEQ ID NO: 2500316 - RNA, 14 nt, Chlamydia trachomatis
guuauuuguucucu

SEQ ID NO: 2500317 - RNA, 17 nt, Chlamydia trachomatis
guuauuuuuuaagaagu

SEQ ID NO: 2500318 - RNA, 23 nt, Chlamydia trachomatis
guucaagagaggccuccauuucc

SEQ ID NO: 2500319 - RNA, 10 nt, Chlamydia trachomatis
guucaccaau

SEQ ID NO: 2500320 - RNA, 20 nt, Chlamydia trachomatis
guucacugacuguagaaaau

SEQ ID NO: 2500321 - RNA, 14 nt, Chlamydia trachomatis
guucagaacucaaa

SEQ ID NO: 2500322 - RNA, 12 nt, Chlamydia trachomatis
guucagaaucug

SEQ ID NO: 2500323 - RNA, 15 nt, Chlamydia trachomatis
guucagacagagaag

SEQ ID NO: 2500324 - RNA, 19 nt, Chlamydia trachomatis
guucagccccuaaagccac

SEQ ID NO: 2500325 - RNA, 21 nt, Chlamydia trachomatis
guucaucaagguggccauucu

SEQ ID NO: 2500326 - RNA, 21 nt, Chlamydia trachomatis
guucauugguaagauucgaag

SEQ ID NO: 2500327 - RNA, 14 nt, Chlamydia trachomatis
guuccaucuccuga

SEQ ID NO: 2500328 - RNA, 14 nt, Chlamydia trachomatis
guuccaucuuccaa

SEQ ID NO: 2500329 - RNA, 15 nt, Chlamydia trachomatis
guucccauccaaagg

SEQ ID NO: 2500330 - RNA, 20 nt, Chlamydia trachomatis
guucccugcaccucuuucag

SEQ ID NO: 2500331 - RNA, 16 nt, Chlamydia trachomatis
guuccuaauagaucua

SEQ ID NO: 2500332 - RNA, 21 nt, Chlamydia trachomatis
guuccuauacaagaaaacagc

SEQ ID NO: 2500333 - RNA, 23 nt, Chlamydia trachomatis
guuccucguuuuuuuagauaaga

SEQ ID NO: 2500334 - RNA, 16 nt, Chlamydia trachomatis
guucgaauccuucucc

SEQ ID NO: 2500335 - RNA, 23 nt, Chlamydia trachomatis
guucgaauccuucucccgcuaau

SEQ ID NO: 2500336 - RNA, 21 nt, Chlamydia trachomatis
guucgcuauaaucccaaaaac

SEQ ID NO: 2500337 - RNA, 17 nt, Chlamydia trachomatis
guucuaaacccucugca

SEQ ID NO: 2500338 - RNA, 18 nt, Chlamydia trachomatis
guucuaaacccucugcau

SEQ ID NO: 2500339 - RNA, 15 nt, Chlamydia trachomatis
guucuaaagaaaagc

SEQ ID NO: 2500340 - RNA, 20 nt, Chlamydia trachomatis
guucuaacacuuuuuuuucu

SEQ ID NO: 2500341 - RNA, 21 nt, Chlamydia trachomatis
guucuaacacuuuuuuuucuu

SEQ ID NO: 2500342 - RNA, 19 nt, Chlamydia trachomatis
guucuacacaucuguaucc

SEQ ID NO: 2500343 - RNA, 19 nt, Chlamydia trachomatis
guucuauaccuaaaaguuu

SEQ ID NO: 2500344 - RNA, 14 nt, Chlamydia trachomatis
guucuauauacauu

SEQ ID NO: 2500345 - RNA, 23 nt, Chlamydia trachomatis
guucuccuuugcuuuuuauccua

SEQ ID NO: 2500346 - RNA, 15 nt, Chlamydia trachomatis
guucucucuaaaauc

SEQ ID NO: 2500347 - RNA, 23 nt, Chlamydia trachomatis
guucucucucagcagcuuccuga

SEQ ID NO: 2500348 - RNA, 23 nt, Chlamydia trachomatis
guucucuuuauccuguucuccaa

SEQ ID NO: 2500349 - RNA, 14 nt, Chlamydia trachomatis
guucuggagcaaca

SEQ ID NO: 2500350 - RNA, 18 nt, Chlamydia trachomatis
guucuucacuuuucuagc

SEQ ID NO: 2500351 - RNA, 17 nt, Chlamydia trachomatis
guucuucugagcuagaa

SEQ ID NO: 2500352 - RNA, 21 nt, Chlamydia trachomatis
guucuugaguagaagaaugaa

SEQ ID NO: 2500353 - RNA, 19 nt, Chlamydia trachomatis
guucuuuuaggcaacagcu

SEQ ID NO: 2500354 - RNA, 19 nt, Chlamydia trachomatis
guugaauuucaggaguagg

SEQ ID NO: 2500355 - RNA, 15 nt, Chlamydia trachomatis
guugagcagcaaaga

SEQ ID NO: 2500356 - RNA, 14 nt, Chlamydia trachomatis
guugauagcguucg

SEQ ID NO: 2500357 - RNA, 17 nt, Chlamydia trachomatis
guugaucuuccucuuga

SEQ ID NO: 2500358 - RNA, 14 nt, Chlamydia trachomatis
guugcaccacgugc

SEQ ID NO: 2500359 - RNA, 13 nt, Chlamydia trachomatis
guugcacuuuccg

SEQ ID NO: 2500360 - RNA, 13 nt, Chlamydia trachomatis
guugcaucaacaa

SEQ ID NO: 2500361 - RNA, 23 nt, Chlamydia trachomatis
guugcgauuugauaucccccuuc

SEQ ID NO: 2500362 - RNA, 18 nt, Chlamydia trachomatis
guugcucccaucaacucu

SEQ ID NO: 2500363 - RNA, 15 nt, Chlamydia trachomatis
guugcucgauccaaa

SEQ ID NO: 2500364 - RNA, 13 nt, Chlamydia trachomatis
guugcugagcuuu

SEQ ID NO: 2500365 - RNA, 14 nt, Chlamydia trachomatis
guugcuuccaaacg

SEQ ID NO: 2500366 - RNA, 15 nt, Chlamydia trachomatis
guuggcauuuugggc

SEQ ID NO: 2500367 - RNA, 15 nt, Chlamydia trachomatis
guuggcgaauuucuu

SEQ ID NO: 2500368 - RNA, 24 nt, Chlamydia trachomatis
guugggagaggguguugaauauuu

SEQ ID NO: 2500369 - RNA, 20 nt, Chlamydia trachomatis
guugguagaggagaacaaga

SEQ ID NO: 2500370 - RNA, 21 nt, Chlamydia trachomatis
guugguuuguuaagaagggag

SEQ ID NO: 2500371 - RNA, 13 nt, Chlamydia trachomatis
guuguagaggaga

SEQ ID NO: 2500372 - RNA, 15 nt, Chlamydia trachomatis
guuguagaggagaag

SEQ ID NO: 2500373 - RNA, 22 nt, Chlamydia trachomatis
guuguaucagcaaccauauauu

SEQ ID NO: 2500374 - RNA, 22 nt, Chlamydia trachomatis
guuguaucccuaguacaaaaau

SEQ ID NO: 2500375 - RNA, 21 nt, Chlamydia trachomatis
guugugcucgaaaguugcucc

SEQ ID NO: 2500376 - RNA, 14 nt, Chlamydia trachomatis
guuuaaaagcccac

SEQ ID NO: 2500377 - RNA, 14 nt, Chlamydia trachomatis
guuuacaaaugauu

SEQ ID NO: 2500378 - RNA, 15 nt, Chlamydia trachomatis
guuuacugcaauaag

SEQ ID NO: 2500379 - RNA, 20 nt, Chlamydia trachomatis
guuuagggugaucuuuugcu

SEQ ID NO: 2500380 - RNA, 16 nt, Chlamydia trachomatis
guuuauaacuccaagg

SEQ ID NO: 2500381 - RNA, 18 nt, Chlamydia trachomatis
guuuaucuaauuuuagau

SEQ ID NO: 2500382 - RNA, 19 nt, Chlamydia trachomatis
guuuaucugcccaucaucg

SEQ ID NO: 2500383 - RNA, 19 nt, Chlamydia trachomatis
guuuauuaucuagaaaaga

SEQ ID NO: 2500384 - RNA, 18 nt, Chlamydia trachomatis
guuucagagaggcuguaa

SEQ ID NO: 2500385 - RNA, 18 nt, Chlamydia trachomatis
guuuccucucucugcaga

SEQ ID NO: 2500386 - RNA, 16 nt, Chlamydia trachomatis
guuucguaguuuucuu

SEQ ID NO: 2500387 - RNA, 16 nt, Chlamydia trachomatis
guuucgucucuuuaag

SEQ ID NO: 2500388 - RNA, 16 nt, Chlamydia trachomatis
guuucuaaaaaacuuu

SEQ ID NO: 2500389 - RNA, 13 nt, Chlamydia trachomatis
guuucuaauaaua

SEQ ID NO: 2500390 - RNA, 19 nt, Chlamydia trachomatis
guuucuagaagaacucccc

SEQ ID NO: 2500391 - RNA, 18 nt, Chlamydia trachomatis
guuucuaugauucuucua

SEQ ID NO: 2500392 - RNA, 17 nt, Chlamydia trachomatis
guuucuccagaggaaau

SEQ ID NO: 2500393 - RNA, 19 nt, Chlamydia trachomatis
guuucuccuaaaguuggua

SEQ ID NO: 2500394 - RNA, 18 nt, Chlamydia trachomatis
guuucugaaucaaacaga

SEQ ID NO: 2500395 - RNA, 22 nt, Chlamydia trachomatis
guuucugaaucaaacagaaccu

SEQ ID NO: 2500396 - RNA, 16 nt, Chlamydia trachomatis
guuucuggaaagagag

SEQ ID NO: 2500397 - RNA, 14 nt, Chlamydia trachomatis
guuucuguaggaga

SEQ ID NO: 2500398 - RNA, 20 nt, Chlamydia trachomatis
guuucuguaggagagaaucu

SEQ ID NO: 2500399 - RNA, 19 nt, Chlamydia trachomatis
guuucuguuacacagaccu

SEQ ID NO: 2500400 - RNA, 20 nt, Chlamydia trachomatis
guuucuguuuucguuuaucu

SEQ ID NO: 2500401 - RNA, 19 nt, Chlamydia trachomatis
guuucuuaaacaaaaauaa

SEQ ID NO: 2500402 - RNA, 20 nt, Chlamydia trachomatis
guuucuuaggaacucccuca

SEQ ID NO: 2500403 - RNA, 22 nt, Chlamydia trachomatis
guuucuucuacaaguucucucu

SEQ ID NO: 2500404 - RNA, 21 nt, Chlamydia trachomatis
guuucuucucauaaggaguuu

SEQ ID NO: 2500405 - RNA, 20 nt, Chlamydia trachomatis
guuugaaucacagaaacuuc

SEQ ID NO: 2500406 - RNA, 13 nt, Chlamydia trachomatis
guuugaucugaga

SEQ ID NO: 2500407 - RNA, 18 nt, Chlamydia trachomatis
guuugauuuccucuucuu

SEQ ID NO: 2500408 - RNA, 14 nt, Chlamydia trachomatis
guuugcacaagaua

SEQ ID NO: 2500409 - RNA, 17 nt, Chlamydia trachomatis
guuugccaguaaucaaa

SEQ ID NO: 2500410 - RNA, 13 nt, Chlamydia trachomatis
guuugucuucaga

SEQ ID NO: 2500411 - RNA, 13 nt, Chlamydia trachomatis
guuuguuuuuuuc

SEQ ID NO: 2500412 - RNA, 18 nt, Chlamydia trachomatis
guuuuaaaugcuucuuaa

SEQ ID NO: 2500413 - RNA, 15 nt, Chlamydia trachomatis
guuuuaacaugaguu

SEQ ID NO: 2500414 - RNA, 16 nt, Chlamydia trachomatis
guuuuaauuccaucuu

SEQ ID NO: 2500415 - RNA, 19 nt, Chlamydia trachomatis
guuuuaauuccaucuuuuc

SEQ ID NO: 2500416 - RNA, 11 nt, Chlamydia trachomatis
guuuucaaaag

SEQ ID NO: 2500417 - RNA, 12 nt, Chlamydia trachomatis
guuuucaaaagc

SEQ ID NO: 2500418 - RNA, 19 nt, Chlamydia trachomatis
guuuuccgcacccaaucuu

SEQ ID NO: 2500419 - RNA, 20 nt, Chlamydia trachomatis
guuuuccgcacccaaucuuc

SEQ ID NO: 2500420 - RNA, 19 nt, Chlamydia trachomatis
guuuucgaauuuuuuucuu

SEQ ID NO: 2500421 - RNA, 15 nt, Chlamydia trachomatis
guuuucuugguuucu

SEQ ID NO: 2500422 - RNA, 18 nt, Chlamydia trachomatis
guuuuguaaaguaacuac

SEQ ID NO: 2500423 - RNA, 21 nt, Chlamydia trachomatis
guuuugucucgcagcaccugu

SEQ ID NO: 2500424 - RNA, 20 nt, Chlamydia trachomatis
guuuuuagcguaauagcucu

SEQ ID NO: 2500425 - RNA, 22 nt, Chlamydia trachomatis
guuuuucuaagugcaucauuuu

SEQ ID NO: 2500426 - RNA, 16 nt, Chlamydia trachomatis
guuuuucuccucucuc

SEQ ID NO: 2500427 - RNA, 18 nt, Chlamydia trachomatis
guuuuucuccucucucuu

SEQ ID NO: 2500428 - RNA, 16 nt, Chlamydia trachomatis
guuuuuuucaaguguu

SEQ ID NO: 2500429 - RNA, 11 nt, Chlamydia trachomatis
guuuuuuucag

SEQ ID NO: 2500430 - RNA, 12 nt, Chlamydia trachomatis
guuuuuuuguuu

SEQ ID NO: 2500431 - RNA, 20 nt, Chlamydia trachomatis
uaaaaaaauucuugccaccg

SEQ ID NO: 2500432 - RNA, 15 nt, Chlamydia trachomatis
uaaaaaacaaaacua

SEQ ID NO: 2500433 - RNA, 24 nt, Chlamydia trachomatis
uaaaaaacaaugauauucuaaucc

SEQ ID NO: 2500434 - RNA, 20 nt, Chlamydia trachomatis
uaaaaaagagguauuuagga

SEQ ID NO: 2500435 - RNA, 23 nt, Chlamydia trachomatis
uaaaaaagagguauuuaggaacu

SEQ ID NO: 2500436 - RNA, 17 nt, Chlamydia trachomatis
uaaaaaagauaauccaa

SEQ ID NO: 2500437 - RNA, 19 nt, Chlamydia trachomatis
uaaaaaagugagcccugcu

SEQ ID NO: 2500438 - RNA, 20 nt, Chlamydia trachomatis
uaaaaaaucuugucguuccu

SEQ ID NO: 2500439 - RNA, 14 nt, Chlamydia trachomatis
uaaaaaauuuugag

SEQ ID NO: 2500440 - RNA, 19 nt, Chlamydia trachomatis
uaaaaaccuugauaagagu

SEQ ID NO: 2500441 - RNA, 24 nt, Chlamydia trachomatis
uaaaaacgggagcgggagagagcc

SEQ ID NO: 2500442 - RNA, 17 nt, Chlamydia trachomatis
uaaaaacuauaaggaau

SEQ ID NO: 2500443 - RNA, 15 nt, Chlamydia trachomatis
uaaaaacucuuucau

SEQ ID NO: 2500444 - RNA, 23 nt, Chlamydia trachomatis
uaaaaacuggagaauccauaacg

SEQ ID NO: 2500445 - RNA, 18 nt, Chlamydia trachomatis
uaaaaagccauacaaaga

SEQ ID NO: 2500446 - RNA, 23 nt, Chlamydia trachomatis
uaaaaagcccuuuccucauaaag

SEQ ID NO: 2500447 - RNA, 19 nt, Chlamydia trachomatis
uaaaaagggggcuuuagca

SEQ ID NO: 2500448 - RNA, 20 nt, Chlamydia trachomatis
uaaaaagggggcuuuagcag

SEQ ID NO: 2500449 - RNA, 17 nt, Chlamydia trachomatis
uaaaaauaauuuaauua

SEQ ID NO: 2500450 - RNA, 17 nt, Chlamydia trachomatis
uaaaaauagaaaacguc

SEQ ID NO: 2500451 - RNA, 14 nt, Chlamydia trachomatis
uaaaaauucuaaag

SEQ ID NO: 2500452 - RNA, 15 nt, Chlamydia trachomatis
uaaaaauucuaaagu

SEQ ID NO: 2500453 - RNA, 20 nt, Chlamydia trachomatis
uaaaacaauuuccuuagaaa

SEQ ID NO: 2500454 - RNA, 15 nt, Chlamydia trachomatis
uaaaacauuucugca

SEQ ID NO: 2500455 - RNA, 22 nt, Chlamydia trachomatis
uaaaacauuucugcaacucucu

SEQ ID NO: 2500456 - RNA, 13 nt, Chlamydia trachomatis
uaaaacauuuuau

SEQ ID NO: 2500457 - RNA, 21 nt, Chlamydia trachomatis
uaaaacgaaaaacagaaagaa

SEQ ID NO: 2500458 - RNA, 22 nt, Chlamydia trachomatis
uaaaagaagcagcgcuuaucag

SEQ ID NO: 2500459 - RNA, 11 nt, Chlamydia trachomatis
uaaaagaagcu

SEQ ID NO: 2500460 - RNA, 17 nt, Chlamydia trachomatis
uaaaagacagaacaaac

SEQ ID NO: 2500461 - RNA, 23 nt, Chlamydia trachomatis
uaaaagagcuucuucuaaagaau

SEQ ID NO: 2500462 - RNA, 15 nt, Chlamydia trachomatis
uaaaagaguaagugc

SEQ ID NO: 2500463 - RNA, 20 nt, Chlamydia trachomatis
uaaaagcacaauaacagcac

SEQ ID NO: 2500464 - RNA, 17 nt, Chlamydia trachomatis
uaaaaggcguaaaccuu

SEQ ID NO: 2500465 - RNA, 18 nt, Chlamydia trachomatis
uaaaaggcguaaaccuuc

SEQ ID NO: 2500466 - RNA, 13 nt, Chlamydia trachomatis
uaaaaggcuacua

SEQ ID NO: 2500467 - RNA, 22 nt, Chlamydia trachomatis
uaaaaggcuuauucucuuuaua

SEQ ID NO: 2500468 - RNA, 16 nt, Chlamydia trachomatis
uaaaaggguagaaaaa

SEQ ID NO: 2500469 - RNA, 19 nt, Chlamydia trachomatis
uaaaaggguagaaaaagag

SEQ ID NO: 2500470 - RNA, 23 nt, Chlamydia trachomatis
uaaaaggguagaaaaagagaaau

SEQ ID NO: 2500471 - RNA, 18 nt, Chlamydia trachomatis
uaaaagucucuaaagcuu

SEQ ID NO: 2500472 - RNA, 17 nt, Chlamydia trachomatis
uaaaauaaucuuguaau

SEQ ID NO: 2500473 - RNA, 13 nt, Chlamydia trachomatis
uaaaauaccuaaa

SEQ ID NO: 2500474 - RNA, 19 nt, Chlamydia trachomatis
uaaaauagcacgcaaaaca

SEQ ID NO: 2500475 - RNA, 21 nt, Chlamydia trachomatis
uaaaauagcacgcaaaacauc

SEQ ID NO: 2500476 - RNA, 18 nt, Chlamydia trachomatis
uaaaaucacuuucugcuu

SEQ ID NO: 2500477 - RNA, 16 nt, Chlamydia trachomatis
uaaaauccaauguaaa

SEQ ID NO: 2500478 - RNA, 20 nt, Chlamydia trachomatis
uaaaauggaaauaaaaagcc

SEQ ID NO: 2500479 - RNA, 22 nt, Chlamydia trachomatis
uaaaauggaaauaaaaagccca

SEQ ID NO: 2500480 - RNA, 14 nt, Chlamydia trachomatis
uaaaauuacaauaa

SEQ ID NO: 2500481 - RNA, 18 nt, Chlamydia trachomatis
uaaaauuuccuuauacau

SEQ ID NO: 2500482 - RNA, 15 nt, Chlamydia trachomatis
uaaaauuuuacguaa

SEQ ID NO: 2500483 - RNA, 17 nt, Chlamydia trachomatis
uaaacaaaaacucucaa

SEQ ID NO: 2500484 - RNA, 21 nt, Chlamydia trachomatis
uaaacaaaaacucucaaaucg

SEQ ID NO: 2500485 - RNA, 21 nt, Chlamydia trachomatis
uaaacaaaagauuauaggggu

SEQ ID NO: 2500486 - RNA, 15 nt, Chlamydia trachomatis
uaaacaaaugucccc

SEQ ID NO: 2500487 - RNA, 23 nt, Chlamydia trachomatis
uaaacaaccaaaugaccuuuccc

SEQ ID NO: 2500488 - RNA, 11 nt, Chlamydia trachomatis
uaaacaagaau

SEQ ID NO: 2500489 - RNA, 21 nt, Chlamydia trachomatis
uaaacacaaguaugagaggaa

SEQ ID NO: 2500490 - RNA, 23 nt, Chlamydia trachomatis
uaaacacaaguaugagaggaaga

SEQ ID NO: 2500491 - RNA, 17 nt, Chlamydia trachomatis
uaaacacuagcccuucc

SEQ ID NO: 2500492 - RNA, 19 nt, Chlamydia trachomatis
uaaacagaucuuuuucauu

SEQ ID NO: 2500493 - RNA, 17 nt, Chlamydia trachomatis
uaaacauacacagauac

SEQ ID NO: 2500494 - RNA, 12 nt, Chlamydia trachomatis
uaaacccacgaa

SEQ ID NO: 2500495 - RNA, 15 nt, Chlamydia trachomatis
uaaacccucugcaua

SEQ ID NO: 2500496 - RNA, 18 nt, Chlamydia trachomatis
uaaacgguggaacagcuc

SEQ ID NO: 2500497 - RNA, 19 nt, Chlamydia trachomatis
uaaacuaucuaaaaucccu

SEQ ID NO: 2500498 - RNA, 21 nt, Chlamydia trachomatis
uaaacucucgggccaaaaaga

SEQ ID NO: 2500499 - RNA, 16 nt, Chlamydia trachomatis
uaaacuucuuguuaau

SEQ ID NO: 2500500 - RNA, 12 nt, Chlamydia trachomatis
uaaagaaaagcu

SEQ ID NO: 2500501 - RNA, 21 nt, Chlamydia trachomatis
uaaagaaagccguucccaaua

SEQ ID NO: 2500502 - RNA, 23 nt, Chlamydia trachomatis
uaaagaaauaaccggaacaauca

SEQ ID NO: 2500503 - RNA, 14 nt, Chlamydia trachomatis
uaaagaagacuucg

SEQ ID NO: 2500504 - RNA, 16 nt, Chlamydia trachomatis
uaaagaagaggagaua

SEQ ID NO: 2500505 - RNA, 22 nt, Chlamydia trachomatis
uaaagaagccauaguagaaauu

SEQ ID NO: 2500506 - RNA, 14 nt, Chlamydia trachomatis
uaaagaagccuucu

SEQ ID NO: 2500507 - RNA, 19 nt, Chlamydia trachomatis
uaaagaagccuucuuccuu

SEQ ID NO: 2500508 - RNA, 17 nt, Chlamydia trachomatis
uaaagaaggaaaaucca

SEQ ID NO: 2500509 - RNA, 23 nt, Chlamydia trachomatis
uaaagaaggaaaauccauugauu

SEQ ID NO: 2500510 - RNA, 17 nt, Chlamydia trachomatis
uaaagacagcauaauug

SEQ ID NO: 2500511 - RNA, 19 nt, Chlamydia trachomatis
uaaagagagaggagaaaaa

SEQ ID NO: 2500512 - RNA, 15 nt, Chlamydia trachomatis
uaaagauccucuuuc

SEQ ID NO: 2500513 - RNA, 15 nt, Chlamydia trachomatis
uaaagcagcuaacca

SEQ ID NO: 2500514 - RNA, 23 nt, Chlamydia trachomatis
uaaagccuuucucuaaaagaaga

SEQ ID NO: 2500515 - RNA, 17 nt, Chlamydia trachomatis
uaaagccuuuuuacgca

SEQ ID NO: 2500516 - RNA, 23 nt, Chlamydia trachomatis
uaaagccuuuuuacgcauuugcu

SEQ ID NO: 2500517 - RNA, 12 nt, Chlamydia trachomatis
uaaagcuagucg

SEQ ID NO: 2500518 - RNA, 19 nt, Chlamydia trachomatis
uaaagcuaucccaaaagaa

SEQ ID NO: 2500519 - RNA, 21 nt, Chlamydia trachomatis
uaaagcucgaaucgaaccuuc

SEQ ID NO: 2500520 - RNA, 21 nt, Chlamydia trachomatis
uaaagcugcuuuacaucccuu

SEQ ID NO: 2500521 - RNA, 17 nt, Chlamydia trachomatis
uaaagcuuuuguuaacc

SEQ ID NO: 2500522 - RNA, 18 nt, Chlamydia trachomatis
uaaaggaaacaagcagau

SEQ ID NO: 2500523 - RNA, 17 nt, Chlamydia trachomatis
uaaaggauaaggaagaa

SEQ ID NO: 2500524 - RNA, 11 nt, Chlamydia trachomatis
uaaaggaucau

SEQ ID NO: 2500525 - RNA, 16 nt, Chlamydia trachomatis
uaaaggcucuguuaac

SEQ ID NO: 2500526 - RNA, 11 nt, Chlamydia trachomatis
uaaagguaauc

SEQ ID NO: 2500527 - RNA, 20 nt, Chlamydia trachomatis
uaaaggugcgauuacuucag

SEQ ID NO: 2500528 - RNA, 15 nt, Chlamydia trachomatis
uaaaguaaguaaaag

SEQ ID NO: 2500529 - RNA, 17 nt, Chlamydia trachomatis
uaaagucgggggagcug

SEQ ID NO: 2500530 - RNA, 19 nt, Chlamydia trachomatis
uaaagucucuuaagcguuu

SEQ ID NO: 2500531 - RNA, 17 nt, Chlamydia trachomatis
uaaagucuuaaaagggu

SEQ ID NO: 2500532 - RNA, 14 nt, Chlamydia trachomatis
uaaagucuuuuccu

SEQ ID NO: 2500533 - RNA, 23 nt, Chlamydia trachomatis
uaaaguugguagaggagaacaag

SEQ ID NO: 2500534 - RNA, 14 nt, Chlamydia trachomatis
uaaauaauacaaag

SEQ ID NO: 2500535 - RNA, 16 nt, Chlamydia trachomatis
uaaauaauacaaagga

SEQ ID NO: 2500536 - RNA, 22 nt, Chlamydia trachomatis
uaaauaaucucguugauuaaag

SEQ ID NO: 2500537 - RNA, 14 nt, Chlamydia trachomatis
uaaauacaaaucuu

SEQ ID NO: 2500538 - RNA, 17 nt, Chlamydia trachomatis
uaaauagcucaguuggu

SEQ ID NO: 2500539 - RNA, 19 nt, Chlamydia trachomatis
uaaauauucauauguuaca

SEQ ID NO: 2500540 - RNA, 14 nt, Chlamydia trachomatis
uaaauauuuugcca

SEQ ID NO: 2500541 - RNA, 13 nt, Chlamydia trachomatis
uaaaucacaaugc

SEQ ID NO: 2500542 - RNA, 20 nt, Chlamydia trachomatis
uaaaucaguggaacugcuuc

SEQ ID NO: 2500543 - RNA, 15 nt, Chlamydia trachomatis
uaaauccuauacccg

SEQ ID NO: 2500544 - RNA, 20 nt, Chlamydia trachomatis
uaaauccucuuugaauaucc

SEQ ID NO: 2500545 - RNA, 21 nt, Chlamydia trachomatis
uaaauccucuuugaauauccg

SEQ ID NO: 2500546 - RNA, 22 nt, Chlamydia trachomatis
uaaauccugcuugaaguagcau

SEQ ID NO: 2500547 - RNA, 22 nt, Chlamydia trachomatis
uaaaucuauccauaauuuucuu

SEQ ID NO: 2500548 - RNA, 17 nt, Chlamydia trachomatis
uaaaucuccuccuauua

SEQ ID NO: 2500549 - RNA, 18 nt, Chlamydia trachomatis
uaaaucucuuggagagaa

SEQ ID NO: 2500550 - RNA, 16 nt, Chlamydia trachomatis
uaaaucugcuaaggcc

SEQ ID NO: 2500551 - RNA, 23 nt, Chlamydia trachomatis
uaaaugaaaccccucuuucucuc

SEQ ID NO: 2500552 - RNA, 19 nt, Chlamydia trachomatis
uaaaugcuucuuaacugca

SEQ ID NO: 2500553 - RNA, 20 nt, Chlamydia trachomatis
uaaaugcuucuuaacugcag

SEQ ID NO: 2500554 - RNA, 16 nt, Chlamydia trachomatis
uaaauggauacuaacg

SEQ ID NO: 2500555 - RNA, 11 nt, Chlamydia trachomatis
uaaauguggag

SEQ ID NO: 2500556 - RNA, 15 nt, Chlamydia trachomatis
uaaauguucaugaaa

SEQ ID NO: 2500557 - RNA, 19 nt, Chlamydia trachomatis
uaaauugaaauucagcuaa

SEQ ID NO: 2500558 - RNA, 21 nt, Chlamydia trachomatis
uaaauuucaucccacaugcua

SEQ ID NO: 2500559 - RNA, 13 nt, Chlamydia trachomatis
uaacaaacaacac

SEQ ID NO: 2500560 - RNA, 20 nt, Chlamydia trachomatis
uaacaaccaucaaagcagcg

SEQ ID NO: 2500561 - RNA, 15 nt, Chlamydia trachomatis
uaacaaggcuuuucc

SEQ ID NO: 2500562 - RNA, 21 nt, Chlamydia trachomatis
uaacaaggcuuuuccauuccu

SEQ ID NO: 2500563 - RNA, 21 nt, Chlamydia trachomatis
uaacaauauuacgaauuucug

SEQ ID NO: 2500564 - RNA, 19 nt, Chlamydia trachomatis
uaacaauccccaaaccagu

SEQ ID NO: 2500565 - RNA, 21 nt, Chlamydia trachomatis
uaacaauccccaaaccaguuu

SEQ ID NO: 2500566 - RNA, 23 nt, Chlamydia trachomatis
uaacaauccuagacgauuaauag

SEQ ID NO: 2500567 - RNA, 18 nt, Chlamydia trachomatis
uaacaaugacucaaaaag

SEQ ID NO: 2500568 - RNA, 21 nt, Chlamydia trachomatis
uaacaaugcugauaaaaauaa

SEQ ID NO: 2500569 - RNA, 15 nt, Chlamydia trachomatis
uaacaauuuuaaaau

SEQ ID NO: 2500570 - RNA, 14 nt, Chlamydia trachomatis
uaacacaagcagac

SEQ ID NO: 2500571 - RNA, 21 nt, Chlamydia trachomatis
uaacacaauuuuuguuccuuu

SEQ ID NO: 2500572 - RNA, 13 nt, Chlamydia trachomatis
uaacaccaaaaaa

SEQ ID NO: 2500573 - RNA, 15 nt, Chlamydia trachomatis
uaacacccucuuccu

SEQ ID NO: 2500574 - RNA, 22 nt, Chlamydia trachomatis
uaacacggccauuauaaacuuu

SEQ ID NO: 2500575 - RNA, 22 nt, Chlamydia trachomatis
uaacacucgcaucauccuugcc

SEQ ID NO: 2500576 - RNA, 17 nt, Chlamydia trachomatis
uaacacucucaucuaaa

SEQ ID NO: 2500577 - RNA, 17 nt, Chlamydia trachomatis
uaacacuuuuuuuucuu

SEQ ID NO: 2500578 - RNA, 18 nt, Chlamydia trachomatis
uaacacuuuuuuuucuuu

SEQ ID NO: 2500579 - RNA, 15 nt, Chlamydia trachomatis
uaacagcaagacaac

SEQ ID NO: 2500580 - RNA, 15 nt, Chlamydia trachomatis
uaacagcacaaacaa

SEQ ID NO: 2500581 - RNA, 16 nt, Chlamydia trachomatis
uaacagcacaaacaaa

SEQ ID NO: 2500582 - RNA, 20 nt, Chlamydia trachomatis
uaacagcacaaacaaauccu

SEQ ID NO: 2500583 - RNA, 12 nt, Chlamydia trachomatis
uaacagcucuuc

SEQ ID NO: 2500584 - RNA, 20 nt, Chlamydia trachomatis
uaacagcucuucuucugaag

SEQ ID NO: 2500585 - RNA, 10 nt, Chlamydia trachomatis
uaacaggaag

SEQ ID NO: 2500586 - RNA, 21 nt, Chlamydia trachomatis
uaacagggauggucucacaca

SEQ ID NO: 2500587 - RNA, 22 nt, Chlamydia trachomatis
uaacagggauggucucacacaa

SEQ ID NO: 2500588 - RNA, 14 nt, Chlamydia trachomatis
uaacaucaacugau

SEQ ID NO: 2500589 - RNA, 19 nt, Chlamydia trachomatis
uaacaucaacugauucguu

SEQ ID NO: 2500590 - RNA, 23 nt, Chlamydia trachomatis
uaacaucuacgaguuucucgcag

SEQ ID NO: 2500591 - RNA, 15 nt, Chlamydia trachomatis
uaaccccauguuuuu

SEQ ID NO: 2500592 - RNA, 13 nt, Chlamydia trachomatis
uaacccuaaaaaa

SEQ ID NO: 2500593 - RNA, 13 nt, Chlamydia trachomatis
uaacccuucagga

SEQ ID NO: 2500594 - RNA, 17 nt, Chlamydia trachomatis
uaaccggaacaaucacg

SEQ ID NO: 2500595 - RNA, 20 nt, Chlamydia trachomatis
uaaccucugcaagaaaauaa

SEQ ID NO: 2500596 - RNA, 22 nt, Chlamydia trachomatis
uaaccuuugcauuuaaaugaau

SEQ ID NO: 2500597 - RNA, 22 nt, Chlamydia trachomatis
uaacgaacgggaaaugcuggau

SEQ ID NO: 2500598 - RNA, 20 nt, Chlamydia trachomatis
uaacgaggcacaaaaucccu

SEQ ID NO: 2500599 - RNA, 22 nt, Chlamydia trachomatis
uaacgaguacagaauagaaauu

SEQ ID NO: 2500600 - RNA, 19 nt, Chlamydia trachomatis
uaacgauaguacaaguaua

SEQ ID NO: 2500601 - RNA, 21 nt, Chlamydia trachomatis
uaacgcagcucaccagcuucc

SEQ ID NO: 2500602 - RNA, 22 nt, Chlamydia trachomatis
uaacgcaucccgaaucccaucu

SEQ ID NO: 2500603 - RNA, 19 nt, Chlamydia trachomatis
uaacgcuuccucuccuucu

SEQ ID NO: 2500604 - RNA, 17 nt, Chlamydia trachomatis
uaacgcuucuucugcag

SEQ ID NO: 2500605 - RNA, 21 nt, Chlamydia trachomatis
uaacggaguagagguuuccuu

SEQ ID NO: 2500606 - RNA, 14 nt, Chlamydia trachomatis
uaacuaaaugucuc

SEQ ID NO: 2500607 - RNA, 15 nt, Chlamydia trachomatis
uaacuacaucuaaaa

SEQ ID NO: 2500608 - RNA, 12 nt, Chlamydia trachomatis
uaacuaggguug

SEQ ID NO: 2500609 - RNA, 18 nt, Chlamydia trachomatis
uaacuaucccuacugaag

SEQ ID NO: 2500610 - RNA, 22 nt, Chlamydia trachomatis
uaacucaccuaaauucagaucc

SEQ ID NO: 2500611 - RNA, 12 nt, Chlamydia trachomatis
uaacuccaucag

SEQ ID NO: 2500612 - RNA, 12 nt, Chlamydia trachomatis
uaacucccauga

SEQ ID NO: 2500613 - RNA, 13 nt, Chlamydia trachomatis
uaacucugcaccg

SEQ ID NO: 2500614 - RNA, 23 nt, Chlamydia trachomatis
uaacugagccaagaacaaagcau

SEQ ID NO: 2500615 - RNA, 15 nt, Chlamydia trachomatis
uaacugcagcaucua

SEQ ID NO: 2500616 - RNA, 13 nt, Chlamydia trachomatis
uaacuggaguuuu

SEQ ID NO: 2500617 - RNA, 16 nt, Chlamydia trachomatis
uaacugggauaagaaa

SEQ ID NO: 2500618 - RNA, 18 nt, Chlamydia trachomatis
uaacugggauaagaaauc

SEQ ID NO: 2500619 - RNA, 20 nt, Chlamydia trachomatis
uaacuguggguuuuuuuauu

SEQ ID NO: 2500620 - RNA, 22 nt, Chlamydia trachomatis
uaacuuaauaagggcuuuugca

SEQ ID NO: 2500621 - RNA, 12 nt, Chlamydia trachomatis
uaacuuaugaaa

SEQ ID NO: 2500622 - RNA, 17 nt, Chlamydia trachomatis
uaacuuaugaaaacuuu

SEQ ID NO: 2500623 - RNA, 22 nt, Chlamydia trachomatis
uaacuuccguaccaaggauuuu

SEQ ID NO: 2500624 - RNA, 19 nt, Chlamydia trachomatis
uaacuuuugaucccuaaua

SEQ ID NO: 2500625 - RNA, 13 nt, Chlamydia trachomatis
uaacuuuuucucu

SEQ ID NO: 2500626 - RNA, 21 nt, Chlamydia trachomatis
uaagaaacacaccgggagcau

SEQ ID NO: 2500627 - RNA, 18 nt, Chlamydia trachomatis
uaagaaauuaacccaaga

SEQ ID NO: 2500628 - RNA, 13 nt, Chlamydia trachomatis
uaagaacaacgcu

SEQ ID NO: 2500629 - RNA, 13 nt, Chlamydia trachomatis
uaagaauacaaag

SEQ ID NO: 2500630 - RNA, 19 nt, Chlamydia trachomatis
uaagaauacaaagcagcca

SEQ ID NO: 2500631 - RNA, 22 nt, Chlamydia trachomatis
uaagaaucgugugugacaaaug

SEQ ID NO: 2500632 - RNA, 19 nt, Chlamydia trachomatis
uaagaccgagauuaucauu

SEQ ID NO: 2500633 - RNA, 15 nt, Chlamydia trachomatis
uaagaccuaguaagu

SEQ ID NO: 2500634 - RNA, 19 nt, Chlamydia trachomatis
uaagaccuaguaagugcau

SEQ ID NO: 2500635 - RNA, 13 nt, Chlamydia trachomatis
uaagacucaaauu

SEQ ID NO: 2500636 - RNA, 21 nt, Chlamydia trachomatis
uaagagcagagcuuuuacuuc

SEQ ID NO: 2500637 - RNA, 16 nt, Chlamydia trachomatis
uaagagcuacaggaac

SEQ ID NO: 2500638 - RNA, 15 nt, Chlamydia trachomatis
uaagaggaucuccag

SEQ ID NO: 2500639 - RNA, 17 nt, Chlamydia trachomatis
uaagaguccuaauaguc

SEQ ID NO: 2500640 - RNA, 16 nt, Chlamydia trachomatis
uaagaucucuacauaa

SEQ ID NO: 2500641 - RNA, 20 nt, Chlamydia trachomatis
uaagaucucuacauaagucu

SEQ ID NO: 2500642 - RNA, 15 nt, Chlamydia trachomatis
uaagaucuguagcaa

SEQ ID NO: 2500643 - RNA, 21 nt, Chlamydia trachomatis
uaagaucuguagcaagaagcu

SEQ ID NO: 2500644 - RNA, 19 nt, Chlamydia trachomatis
uaagaucuuuacuuucuuu

SEQ ID NO: 2500645 - RNA, 16 nt, Chlamydia trachomatis
uaagaugguugcucuu

SEQ ID NO: 2500646 - RNA, 12 nt, Chlamydia trachomatis
uaagauuauaau

SEQ ID NO: 2500647 - RNA, 14 nt, Chlamydia trachomatis
uaagauuccucuug

SEQ ID NO: 2500648 - RNA, 21 nt, Chlamydia trachomatis
uaagauugaugacaacuacaa

SEQ ID NO: 2500649 - RNA, 18 nt, Chlamydia trachomatis
uaagauuuucaucuucca

SEQ ID NO: 2500650 - RNA, 15 nt, Chlamydia trachomatis
uaagcaacaauaucc

SEQ ID NO: 2500651 - RNA, 21 nt, Chlamydia trachomatis
uaagcaacaauauccuccaua

SEQ ID NO: 2500652 - RNA, 19 nt, Chlamydia trachomatis
uaagcaccuuuacaaucau

SEQ ID NO: 2500653 - RNA, 18 nt, Chlamydia trachomatis
uaagcacuauaucuccaa

SEQ ID NO: 2500654 - RNA, 19 nt, Chlamydia trachomatis
uaagcacuauaucuccaac

SEQ ID NO: 2500655 - RNA, 19 nt, Chlamydia trachomatis
uaagcauuacacaacucuu

SEQ ID NO: 2500656 - RNA, 15 nt, Chlamydia trachomatis
uaagccgcucuguca

SEQ ID NO: 2500657 - RNA, 16 nt, Chlamydia trachomatis
uaagccucauccccuu

SEQ ID NO: 2500658 - RNA, 13 nt, Chlamydia trachomatis
uaagcgaaaaaaa

SEQ ID NO: 2500659 - RNA, 17 nt, Chlamydia trachomatis
uaagcgaaaaaaaaaga

SEQ ID NO: 2500660 - RNA, 13 nt, Chlamydia trachomatis
uaagcgcaagaaa

SEQ ID NO: 2500661 - RNA, 14 nt, Chlamydia trachomatis
uaagcgcaagaaac

SEQ ID NO: 2500662 - RNA, 22 nt, Chlamydia trachomatis
uaagcgcaagaaacugaaagau

SEQ ID NO: 2500663 - RNA, 18 nt, Chlamydia trachomatis
uaagcguuuucuagugca

SEQ ID NO: 2500664 - RNA, 21 nt, Chlamydia trachomatis
uaagcucuaacucuucuuuau

SEQ ID NO: 2500665 - RNA, 17 nt, Chlamydia trachomatis
uaagcuucucaacacug

SEQ ID NO: 2500666 - RNA, 19 nt, Chlamydia trachomatis
uaaggaaauaccuuguuuu

SEQ ID NO: 2500667 - RNA, 18 nt, Chlamydia trachomatis
uaaggacguuuggagcau

SEQ ID NO: 2500668 - RNA, 20 nt, Chlamydia trachomatis
uaaggacuaguccugaagca

SEQ ID NO: 2500669 - RNA, 16 nt, Chlamydia trachomatis
uaaggagagaaaagag

SEQ ID NO: 2500670 - RNA, 15 nt, Chlamydia trachomatis
uaaggaguuuaacag

SEQ ID NO: 2500671 - RNA, 18 nt, Chlamydia trachomatis
uaaggauggugcggagca

SEQ ID NO: 2500672 - RNA, 23 nt, Chlamydia trachomatis
uaaggcaugagauauagucgagu

SEQ ID NO: 2500673 - RNA, 20 nt, Chlamydia trachomatis
uaagggaaucauaaggaaga

SEQ ID NO: 2500674 - RNA, 15 nt, Chlamydia trachomatis
uaaggggaagauuga

SEQ ID NO: 2500675 - RNA, 20 nt, Chlamydia trachomatis
uaagguggcacacuccaucu

SEQ ID NO: 2500676 - RNA, 17 nt, Chlamydia trachomatis
uaagguuugucuucaga

SEQ ID NO: 2500677 - RNA, 18 nt, Chlamydia trachomatis
uaaguaucguaaacaaaa

SEQ ID NO: 2500678 - RNA, 19 nt, Chlamydia trachomatis
uaaguaucguaaacaaaag

SEQ ID NO: 2500679 - RNA, 17 nt, Chlamydia trachomatis
uaaguguugaggaacau

SEQ ID NO: 2500680 - RNA, 20 nt, Chlamydia trachomatis
uaaguuaacccuaccccuaa

SEQ ID NO: 2500681 - RNA, 22 nt, Chlamydia trachomatis
uaaguucacugacuguagaaaa

SEQ ID NO: 2500682 - RNA, 20 nt, Chlamydia trachomatis
uaaguuccgcucgauauccu

SEQ ID NO: 2500683 - RNA, 11 nt, Chlamydia trachomatis
uaauaacugca

SEQ ID NO: 2500684 - RNA, 15 nt, Chlamydia trachomatis
uaauaagcuuuuucc

SEQ ID NO: 2500685 - RNA, 14 nt, Chlamydia trachomatis
uaauaaguuuuuca

SEQ ID NO: 2500686 - RNA, 21 nt, Chlamydia trachomatis
uaauaaucugugccagcugcu

SEQ ID NO: 2500687 - RNA, 13 nt, Chlamydia trachomatis
uaauacaaagcac

SEQ ID NO: 2500688 - RNA, 16 nt, Chlamydia trachomatis
uaauacgaauaagagu

SEQ ID NO: 2500689 - RNA, 14 nt, Chlamydia trachomatis
uaauacgagaacau

SEQ ID NO: 2500690 - RNA, 13 nt, Chlamydia trachomatis
uaauacucuucua

SEQ ID NO: 2500691 - RNA, 19 nt, Chlamydia trachomatis
uaauacuuguccccuacua

SEQ ID NO: 2500692 - RNA, 15 nt, Chlamydia trachomatis
uaauagcauuaauau

SEQ ID NO: 2500693 - RNA, 16 nt, Chlamydia trachomatis
uaauagcuugcacagc

SEQ ID NO: 2500694 - RNA, 23 nt, Chlamydia trachomatis
uaauagcuugcacagcaagcgaa

SEQ ID NO: 2500695 - RNA, 17 nt, Chlamydia trachomatis
uaauaggauaggaaaug

SEQ ID NO: 2500696 - RNA, 13 nt, Chlamydia trachomatis
uaauaucagcaga

SEQ ID NO: 2500697 - RNA, 18 nt, Chlamydia trachomatis
uaauauccuccaaagaug

SEQ ID NO: 2500698 - RNA, 20 nt, Chlamydia trachomatis
uaauauccuccaaagaugcu

SEQ ID NO: 2500699 - RNA, 22 nt, Chlamydia trachomatis
uaauaucucaggauaaaacccu

SEQ ID NO: 2500700 - RNA, 23 nt, Chlamydia trachomatis
uaauaugaagaacuuuagaagac

SEQ ID NO: 2500701 - RNA, 18 nt, Chlamydia trachomatis
uaauauggacuucccuaa

SEQ ID NO: 2500702 - RNA, 18 nt, Chlamydia trachomatis
uaauauugagaaauaauc

SEQ ID NO: 2500703 - RNA, 17 nt, Chlamydia trachomatis
uaauauuuuuugcgaag

SEQ ID NO: 2500704 - RNA, 15 nt, Chlamydia trachomatis
uaaucaaaccuaagu

SEQ ID NO: 2500705 - RNA, 15 nt, Chlamydia trachomatis
uaaucaauugaaagu

SEQ ID NO: 2500706 - RNA, 19 nt, Chlamydia trachomatis
uaaucaguugaaagacuug

SEQ ID NO: 2500707 - RNA, 21 nt, Chlamydia trachomatis
uaaucaguuguggggcuccua

SEQ ID NO: 2500708 - RNA, 14 nt, Chlamydia trachomatis
uaaucauagccauc

SEQ ID NO: 2500709 - RNA, 15 nt, Chlamydia trachomatis
uaaucauuuucugua

SEQ ID NO: 2500710 - RNA, 18 nt, Chlamydia trachomatis
uaauccaugcaucuccuc

SEQ ID NO: 2500711 - RNA, 20 nt, Chlamydia trachomatis
uaaucccauaaaagccauag

SEQ ID NO: 2500712 - RNA, 21 nt, Chlamydia trachomatis
uaauccuaauguagaaauuuu

SEQ ID NO: 2500713 - RNA, 22 nt, Chlamydia trachomatis
uaauccuaugacaggcagcaga

SEQ ID NO: 2500714 - RNA, 23 nt, Chlamydia trachomatis
uaauccuaugacaggcagcagag

SEQ ID NO: 2500715 - RNA, 14 nt, Chlamydia trachomatis
uaaucgaucacaga

SEQ ID NO: 2500716 - RNA, 17 nt, Chlamydia trachomatis
uaaucgaucacagaaac

SEQ ID NO: 2500717 - RNA, 14 nt, Chlamydia trachomatis
uaaucgcuucugcu

SEQ ID NO: 2500718 - RNA, 22 nt, Chlamydia trachomatis
uaaucggcaaaagaucucauag

SEQ ID NO: 2500719 - RNA, 16 nt, Chlamydia trachomatis
uaaucucguuucuguu

SEQ ID NO: 2500720 - RNA, 17 nt, Chlamydia trachomatis
uaaucuuggacuuucua

SEQ ID NO: 2500721 - RNA, 13 nt, Chlamydia trachomatis
uaaugaaggaaau

SEQ ID NO: 2500722 - RNA, 14 nt, Chlamydia trachomatis
uaaugaaggaaauc

SEQ ID NO: 2500723 - RNA, 23 nt, Chlamydia trachomatis
uaaugagcagaauagauucccuu

SEQ ID NO: 2500724 - RNA, 16 nt, Chlamydia trachomatis
uaaugaucagcaaaaa

SEQ ID NO: 2500725 - RNA, 17 nt, Chlamydia trachomatis
uaaugaucagcaaaaag

SEQ ID NO: 2500726 - RNA, 15 nt, Chlamydia trachomatis
uaaugaugagaauaa

SEQ ID NO: 2500727 - RNA, 20 nt, Chlamydia trachomatis
uaaugauucaacgccaugua

SEQ ID NO: 2500728 - RNA, 16 nt, Chlamydia trachomatis
uaaugauuuuuuuauu

SEQ ID NO: 2500729 - RNA, 18 nt, Chlamydia trachomatis
uaaugcaggcgagucuuu

SEQ ID NO: 2500730 - RNA, 21 nt, Chlamydia trachomatis
uaaugccuuuugcacaaagga

SEQ ID NO: 2500731 - RNA, 15 nt, Chlamydia trachomatis
uaauggaugaucugu

SEQ ID NO: 2500732 - RNA, 20 nt, Chlamydia trachomatis
uaaugucucuucacaaauau

SEQ ID NO: 2500733 - RNA, 13 nt, Chlamydia trachomatis
uaauuaaaggcuc

SEQ ID NO: 2500734 - RNA, 18 nt, Chlamydia trachomatis
uaauuaaagguuucccaa

SEQ ID NO: 2500735 - RNA, 19 nt, Chlamydia trachomatis
uaauuaaagguuucccaaa

SEQ ID NO: 2500736 - RNA, 16 nt, Chlamydia trachomatis
uaauuagaauuuccag

SEQ ID NO: 2500737 - RNA, 17 nt, Chlamydia trachomatis
uaauuagaauuuccagc

SEQ ID NO: 2500738 - RNA, 16 nt, Chlamydia trachomatis
uaauuaugaucacuaa

SEQ ID NO: 2500739 - RNA, 22 nt, Chlamydia trachomatis
uaauucaacauaauaaauauua

SEQ ID NO: 2500740 - RNA, 17 nt, Chlamydia trachomatis
uaauuccaaauaauacu

SEQ ID NO: 2500741 - RNA, 22 nt, Chlamydia trachomatis
uaauucuaaugcuuuguagaua

SEQ ID NO: 2500742 - RNA, 14 nt, Chlamydia trachomatis
uaauucuaggaagc

SEQ ID NO: 2500743 - RNA, 18 nt, Chlamydia trachomatis
uaauucucgcaaagaauc

SEQ ID NO: 2500744 - RNA, 22 nt, Chlamydia trachomatis
uaauucucgcaaagaaucaaaa

SEQ ID NO: 2500745 - RNA, 13 nt, Chlamydia trachomatis
uaauucuucuuga

SEQ ID NO: 2500746 - RNA, 20 nt, Chlamydia trachomatis
uaauugcgaagguucaagau

SEQ ID NO: 2500747 - RNA, 17 nt, Chlamydia trachomatis
uaauuuaauuaaagaga

SEQ ID NO: 2500748 - RNA, 16 nt, Chlamydia trachomatis
uaauuuaucuagaaaa

SEQ ID NO: 2500749 - RNA, 23 nt, Chlamydia trachomatis
uaauuucugaguccucuaaagua

SEQ ID NO: 2500750 - RNA, 16 nt, Chlamydia trachomatis
uaauuugaauaggggg

SEQ ID NO: 2500751 - RNA, 22 nt, Chlamydia trachomatis
uaauuuuaccgauaucucccuu

SEQ ID NO: 2500752 - RNA, 13 nt, Chlamydia trachomatis
uaauuuuagauaa

SEQ ID NO: 2500753 - RNA, 17 nt, Chlamydia trachomatis
uaauuuucuagcuucuu

SEQ ID NO: 2500754 - RNA, 13 nt, Chlamydia trachomatis
uaauuuuucucua

SEQ ID NO: 2500755 - RNA, 16 nt, Chlamydia trachomatis
uaauuuuuuagauugu

SEQ ID NO: 2500756 - RNA, 12 nt, Chlamydia trachomatis
uacaaaaauacu

SEQ ID NO: 2500757 - RNA, 21 nt, Chlamydia trachomatis
uacaaaagauuucuucuguag

SEQ ID NO: 2500758 - RNA, 18 nt, Chlamydia trachomatis
uacaaaccgaagagggaa

SEQ ID NO: 2500759 - RNA, 20 nt, Chlamydia trachomatis
uacaaaccgaagagggaaga

SEQ ID NO: 2500760 - RNA, 21 nt, Chlamydia trachomatis
uacaaagauaaucaaaccuaa

SEQ ID NO: 2500761 - RNA, 19 nt, Chlamydia trachomatis
uacaaagcagccacuccug

SEQ ID NO: 2500762 - RNA, 19 nt, Chlamydia trachomatis
uacaaauaguguaaggaga

SEQ ID NO: 2500763 - RNA, 18 nt, Chlamydia trachomatis
uacaacaaguuccuggau

SEQ ID NO: 2500764 - RNA, 23 nt, Chlamydia trachomatis
uacaacgaguugaucuuccucuu

SEQ ID NO: 2500765 - RNA, 17 nt, Chlamydia trachomatis
uacaacucugaacaacu

SEQ ID NO: 2500766 - RNA, 23 nt, Chlamydia trachomatis
uacaacucugaacaacugcugau

SEQ ID NO: 2500767 - RNA, 22 nt, Chlamydia trachomatis
uacaacuucagcgcgaauaaau

SEQ ID NO: 2500768 - RNA, 14 nt, Chlamydia trachomatis
uacaagaaaacagc

SEQ ID NO: 2500769 - RNA, 21 nt, Chlamydia trachomatis
uacaaggcucuugaaaaggag

SEQ ID NO: 2500770 - RNA, 22 nt, Chlamydia trachomatis
uacaagggugcuaacuuucuuc

SEQ ID NO: 2500771 - RNA, 14 nt, Chlamydia trachomatis
uacaaguucucucu

SEQ ID NO: 2500772 - RNA, 17 nt, Chlamydia trachomatis
uacaauaauacaaagca

SEQ ID NO: 2500773 - RNA, 19 nt, Chlamydia trachomatis
uacaauagguuuaaauaag

SEQ ID NO: 2500774 - RNA, 14 nt, Chlamydia trachomatis
uacaaucaguaagu

SEQ ID NO: 2500775 - RNA, 14 nt, Chlamydia trachomatis
uacaaucaucuucc

SEQ ID NO: 2500776 - RNA, 14 nt, Chlamydia trachomatis
uacaauguaaacaa

SEQ ID NO: 2500777 - RNA, 19 nt, Chlamydia trachomatis
uacaauguacgcuaaaaac

SEQ ID NO: 2500778 - RNA, 22 nt, Chlamydia trachomatis
uacacagaaagaaccuccuuua

SEQ ID NO: 2500779 - RNA, 17 nt, Chlamydia trachomatis
uacacagcaucaagaau

SEQ ID NO: 2500780 - RNA, 22 nt, Chlamydia trachomatis
uacacaggggggaagucaagau

SEQ ID NO: 2500781 - RNA, 16 nt, Chlamydia trachomatis
uacacaucaaaaugau

SEQ ID NO: 2500782 - RNA, 21 nt, Chlamydia trachomatis
uacacaucuguauccuaacua

SEQ ID NO: 2500783 - RNA, 20 nt, Chlamydia trachomatis
uacaccaccgcaugaaagua

SEQ ID NO: 2500784 - RNA, 16 nt, Chlamydia trachomatis
uacaccagauccgaua

SEQ ID NO: 2500785 - RNA, 19 nt, Chlamydia trachomatis
uacaccgcaucagccccaa

SEQ ID NO: 2500786 - RNA, 22 nt, Chlamydia trachomatis
uacaccugcaagagaucguaca

SEQ ID NO: 2500787 - RNA, 20 nt, Chlamydia trachomatis
uacacgauguuccccauuca

SEQ ID NO: 2500788 - RNA, 19 nt, Chlamydia trachomatis
uacacgcugaguuuccuuu

SEQ ID NO: 2500789 - RNA, 17 nt, Chlamydia trachomatis
uacagaagaaccuccau

SEQ ID NO: 2500790 - RNA, 16 nt, Chlamydia trachomatis
uacagacaucuaaagu

SEQ ID NO: 2500791 - RNA, 20 nt, Chlamydia trachomatis
uacagacaucuaaagucuga

SEQ ID NO: 2500792 - RNA, 13 nt, Chlamydia trachomatis
uacagacgaaaac

SEQ ID NO: 2500793 - RNA, 14 nt, Chlamydia trachomatis
uacagagaaaaaga

SEQ ID NO: 2500794 - RNA, 19 nt, Chlamydia trachomatis
uacagaguuaccaaucacg

SEQ ID NO: 2500795 - RNA, 23 nt, Chlamydia trachomatis
uacagauaccaagccauuuccag

SEQ ID NO: 2500796 - RNA, 21 nt, Chlamydia trachomatis
uacagaucauaggcuccugca

SEQ ID NO: 2500797 - RNA, 17 nt, Chlamydia trachomatis
uacagauuuuucgaaaa

SEQ ID NO: 2500798 - RNA, 22 nt, Chlamydia trachomatis
uacagcaaaaccuuuugaaaca

SEQ ID NO: 2500799 - RNA, 17 nt, Chlamydia trachomatis
uacagcaagaagaagag

SEQ ID NO: 2500800 - RNA, 18 nt, Chlamydia trachomatis
uacagcaugccuucuucc

SEQ ID NO: 2500801 - RNA, 19 nt, Chlamydia trachomatis
uacagcaugccuucuuccu

SEQ ID NO: 2500802 - RNA, 13 nt, Chlamydia trachomatis
uacagccuccucu

SEQ ID NO: 2500803 - RNA, 13 nt, Chlamydia trachomatis
uacagcgaaauac

SEQ ID NO: 2500804 - RNA, 19 nt, Chlamydia trachomatis
uacagcgacacguuuuccu

SEQ ID NO: 2500805 - RNA, 17 nt, Chlamydia trachomatis
uacagcggauuagucgu

SEQ ID NO: 2500806 - RNA, 14 nt, Chlamydia trachomatis
uacagcuagaauag

SEQ ID NO: 2500807 - RNA, 20 nt, Chlamydia trachomatis
uacagcuagcucuccauuua

SEQ ID NO: 2500808 - RNA, 13 nt, Chlamydia trachomatis
uacaggaggucuc

SEQ ID NO: 2500809 - RNA, 21 nt, Chlamydia trachomatis
uacaggucaagccuacagcua

SEQ ID NO: 2500810 - RNA, 15 nt, Chlamydia trachomatis
uacaguaaggcucuc

SEQ ID NO: 2500811 - RNA, 19 nt, Chlamydia trachomatis
uacauaagauccaucucuc

SEQ ID NO: 2500812 - RNA, 24 nt, Chlamydia trachomatis
uacauaggcauacaggagagacau

SEQ ID NO: 2500813 - RNA, 17 nt, Chlamydia trachomatis
uacaucagagcaauaga

SEQ ID NO: 2500814 - RNA, 10 nt, Chlamydia trachomatis
uacaucaucu

SEQ ID NO: 2500815 - RNA, 13 nt, Chlamydia trachomatis
uacaucaucucuc

SEQ ID NO: 2500816 - RNA, 19 nt, Chlamydia trachomatis
uacaucaucucucagcaga

SEQ ID NO: 2500817 - RNA, 20 nt, Chlamydia trachomatis
uacaucccuugaacuagaaa

SEQ ID NO: 2500818 - RNA, 17 nt, Chlamydia trachomatis
uacaucgguguugaacc

SEQ ID NO: 2500819 - RNA, 22 nt, Chlamydia trachomatis
uacaugauagucagaauaauau

SEQ ID NO: 2500820 - RNA, 15 nt, Chlamydia trachomatis
uacaugcaggauauu

SEQ ID NO: 2500821 - RNA, 18 nt, Chlamydia trachomatis
uacauguaguaaucugcu

SEQ ID NO: 2500822 - RNA, 16 nt, Chlamydia trachomatis
uacauucagaauauag

SEQ ID NO: 2500823 - RNA, 21 nt, Chlamydia trachomatis
uacauucgccucuucucuuuu

SEQ ID NO: 2500824 - RNA, 23 nt, Chlamydia trachomatis
uacauugagaugaucccaucggc

SEQ ID NO: 2500825 - RNA, 16 nt, Chlamydia trachomatis
uaccaaaaaacauucc

SEQ ID NO: 2500826 - RNA, 19 nt, Chlamydia trachomatis
uaccaaaaaacauuccugc

SEQ ID NO: 2500827 - RNA, 22 nt, Chlamydia trachomatis
uaccaaaaaggaaaucacugaa

SEQ ID NO: 2500828 - RNA, 17 nt, Chlamydia trachomatis
uaccaaaauaucauaau

SEQ ID NO: 2500829 - RNA, 13 nt, Chlamydia trachomatis
uaccaaaauccuu

SEQ ID NO: 2500830 - RNA, 22 nt, Chlamydia trachomatis
uaccaaaccuuaaaagcaaggc

SEQ ID NO: 2500831 - RNA, 17 nt, Chlamydia trachomatis
uaccaaaccuuucaaau

SEQ ID NO: 2500832 - RNA, 16 nt, Chlamydia trachomatis
uaccaaagaauucuug

SEQ ID NO: 2500833 - RNA, 20 nt, Chlamydia trachomatis
uaccaacugagcuauuuagg

SEQ ID NO: 2500834 - RNA, 12 nt, Chlamydia trachomatis
uaccaagauuag

SEQ ID NO: 2500835 - RNA, 18 nt, Chlamydia trachomatis
uaccacaauuuuucuugu

SEQ ID NO: 2500836 - RNA, 15 nt, Chlamydia trachomatis
uaccacauucucuuu

SEQ ID NO: 2500837 - RNA, 16 nt, Chlamydia trachomatis
uaccacgagcauaaga

SEQ ID NO: 2500838 - RNA, 21 nt, Chlamydia trachomatis
uaccacgagcauaagaauaaa

SEQ ID NO: 2500839 - RNA, 17 nt, Chlamydia trachomatis
uaccacggauaaagaaa

SEQ ID NO: 2500840 - RNA, 13 nt, Chlamydia trachomatis
uaccagccccaca

SEQ ID NO: 2500841 - RNA, 17 nt, Chlamydia trachomatis
uaccagccccacaagug

SEQ ID NO: 2500842 - RNA, 14 nt, Chlamydia trachomatis
uaccaguucuugga

SEQ ID NO: 2500843 - RNA, 14 nt, Chlamydia trachomatis
uaccauagguucuu

SEQ ID NO: 2500844 - RNA, 14 nt, Chlamydia trachomatis
uaccauucacaccg

SEQ ID NO: 2500845 - RNA, 15 nt, Chlamydia trachomatis
uaccauucacaccga

SEQ ID NO: 2500846 - RNA, 16 nt, Chlamydia trachomatis
uacccgacuaaaaaau

SEQ ID NO: 2500847 - RNA, 17 nt, Chlamydia trachomatis
uacccgauucaaaaauc

SEQ ID NO: 2500848 - RNA, 19 nt, Chlamydia trachomatis
uacccugaaagacuuucca

SEQ ID NO: 2500849 - RNA, 14 nt, Chlamydia trachomatis
uacccugugcuaaa

SEQ ID NO: 2500850 - RNA, 21 nt, Chlamydia trachomatis
uaccgacaauauuccauaaua

SEQ ID NO: 2500851 - RNA, 15 nt, Chlamydia trachomatis
uaccgauaauuuuac

SEQ ID NO: 2500852 - RNA, 23 nt, Chlamydia trachomatis
uaccgccucaaacaaucuaaaaa

SEQ ID NO: 2500853 - RNA, 21 nt, Chlamydia trachomatis
uaccuaaacaaggauuuucuu

SEQ ID NO: 2500854 - RNA, 14 nt, Chlamydia trachomatis
uaccuaaagaagcc

SEQ ID NO: 2500855 - RNA, 16 nt, Chlamydia trachomatis
uaccuaaagaagccau

SEQ ID NO: 2500856 - RNA, 15 nt, Chlamydia trachomatis
uaccuagugauuuua

SEQ ID NO: 2500857 - RNA, 16 nt, Chlamydia trachomatis
uaccuagugauuuuaa

SEQ ID NO: 2500858 - RNA, 18 nt, Chlamydia trachomatis
uaccuagugauuuuaaac

SEQ ID NO: 2500859 - RNA, 20 nt, Chlamydia trachomatis
uaccuauuccaaauccuccu

SEQ ID NO: 2500860 - RNA, 14 nt, Chlamydia trachomatis
uaccucuuuacgca

SEQ ID NO: 2500861 - RNA, 20 nt, Chlamydia trachomatis
uaccucuuuacgcacaaaga

SEQ ID NO: 2500862 - RNA, 22 nt, Chlamydia trachomatis
uaccucuuuuuuucccuagaaa

SEQ ID NO: 2500863 - RNA, 15 nt, Chlamydia trachomatis
uaccugcuucuauag

SEQ ID NO: 2500864 - RNA, 23 nt, Chlamydia trachomatis
uaccuggaaaggagaaaguaauu

SEQ ID NO: 2500865 - RNA, 14 nt, Chlamydia trachomatis
uaccuguaggagga

SEQ ID NO: 2500866 - RNA, 23 nt, Chlamydia trachomatis
uaccuguaggaggacaagcgacu

SEQ ID NO: 2500867 - RNA, 16 nt, Chlamydia trachomatis
uaccuucuuacauaag

SEQ ID NO: 2500868 - RNA, 21 nt, Chlamydia trachomatis
uaccuugaguccgcaaacaaa

SEQ ID NO: 2500869 - RNA, 16 nt, Chlamydia trachomatis
uaccuuguuuuuuaag

SEQ ID NO: 2500870 - RNA, 14 nt, Chlamydia trachomatis
uaccuuuugcaauc

SEQ ID NO: 2500871 - RNA, 16 nt, Chlamydia trachomatis
uacgaacaagaugacu

SEQ ID NO: 2500872 - RNA, 17 nt, Chlamydia trachomatis
uacgaacgccuguuuuc

SEQ ID NO: 2500873 - RNA, 18 nt, Chlamydia trachomatis
uacgcaaagugcuaauaa

SEQ ID NO: 2500874 - RNA, 21 nt, Chlamydia trachomatis
uacgcaaguauuggagacaac

SEQ ID NO: 2500875 - RNA, 20 nt, Chlamydia trachomatis
uacgcacaaagauuucuucu

SEQ ID NO: 2500876 - RNA, 11 nt, Chlamydia trachomatis
uacgcacagca

SEQ ID NO: 2500877 - RNA, 16 nt, Chlamydia trachomatis
uacgcacauagcgacu

SEQ ID NO: 2500878 - RNA, 19 nt, Chlamydia trachomatis
uacgcuaaaaacucuuuca

SEQ ID NO: 2500879 - RNA, 20 nt, Chlamydia trachomatis
uacgcuaaaaacucuuucau

SEQ ID NO: 2500880 - RNA, 16 nt, Chlamydia trachomatis
uacgcucuuucuuacg

SEQ ID NO: 2500881 - RNA, 15 nt, Chlamydia trachomatis
uacgcugguauacca

SEQ ID NO: 2500882 - RNA, 19 nt, Chlamydia trachomatis
uacgcuuccuacagcuaga

SEQ ID NO: 2500883 - RNA, 21 nt, Chlamydia trachomatis
uacggaagagucuguuucugu

SEQ ID NO: 2500884 - RNA, 23 nt, Chlamydia trachomatis
uacggaauagccuccaaacauuu

SEQ ID NO: 2500885 - RNA, 17 nt, Chlamydia trachomatis
uacggaguaucuaucaa

SEQ ID NO: 2500886 - RNA, 20 nt, Chlamydia trachomatis
uacggcaaaagguuguugcc

SEQ ID NO: 2500887 - RNA, 14 nt, Chlamydia trachomatis
uacguacauaggca

SEQ ID NO: 2500888 - RNA, 15 nt, Chlamydia trachomatis
uacguuagcaaagac

SEQ ID NO: 2500889 - RNA, 18 nt, Chlamydia trachomatis
uacguuuaccgcucuucc

SEQ ID NO: 2500890 - RNA, 13 nt, Chlamydia trachomatis
uacguuuucucug

SEQ ID NO: 2500891 - RNA, 19 nt, Chlamydia trachomatis
uacuaacaaauagggaggu

SEQ ID NO: 2500892 - RNA, 19 nt, Chlamydia trachomatis
uacuaaggugaguuucccu

SEQ ID NO: 2500893 - RNA, 20 nt, Chlamydia trachomatis
uacuaaggugaguuucccuu

SEQ ID NO: 2500894 - RNA, 20 nt, Chlamydia trachomatis
uacuacaacaggaccagaga

SEQ ID NO: 2500895 - RNA, 23 nt, Chlamydia trachomatis
uacuaucaggaauaaugauuuuu

SEQ ID NO: 2500896 - RNA, 14 nt, Chlamydia trachomatis
uacuauccgaagcu

SEQ ID NO: 2500897 - RNA, 14 nt, Chlamydia trachomatis
uacuauucgagaau

SEQ ID NO: 2500898 - RNA, 15 nt, Chlamydia trachomatis
uacucaacacgaaca

SEQ ID NO: 2500899 - RNA, 21 nt, Chlamydia trachomatis
uacucaacuccagagcaaaua

SEQ ID NO: 2500900 - RNA, 18 nt, Chlamydia trachomatis
uacucauccuaacuguac

SEQ ID NO: 2500901 - RNA, 19 nt, Chlamydia trachomatis
uacucauccuaacuguaca

SEQ ID NO: 2500902 - RNA, 12 nt, Chlamydia trachomatis
uacucaucuuuu

SEQ ID NO: 2500903 - RNA, 21 nt, Chlamydia trachomatis
uacuccaauggaaauaagaga

SEQ ID NO: 2500904 - RNA, 14 nt, Chlamydia trachomatis
uacuccaccuagga

SEQ ID NO: 2500905 - RNA, 20 nt, Chlamydia trachomatis
uacucccaaaucaaaccaaa

SEQ ID NO: 2500906 - RNA, 15 nt, Chlamydia trachomatis
uacuccgaucaauuc

SEQ ID NO: 2500907 - RNA, 17 nt, Chlamydia trachomatis
uacucggauaaucaaau

SEQ ID NO: 2500908 - RNA, 21 nt, Chlamydia trachomatis
uacucuaaaaagcguucuccg

SEQ ID NO: 2500909 - RNA, 23 nt, Chlamydia trachomatis
uacucuaaaaagcguucuccgag

SEQ ID NO: 2500910 - RNA, 13 nt, Chlamydia trachomatis
uacucuuccuuga

SEQ ID NO: 2500911 - RNA, 20 nt, Chlamydia trachomatis
uacugacccauccaaaacau

SEQ ID NO: 2500912 - RNA, 13 nt, Chlamydia trachomatis
uacugcaauaagg

SEQ ID NO: 2500913 - RNA, 12 nt, Chlamydia trachomatis
uacugcuacaaa

SEQ ID NO: 2500914 - RNA, 16 nt, Chlamydia trachomatis
uacuggagaacagucu

SEQ ID NO: 2500915 - RNA, 14 nt, Chlamydia trachomatis
uacuggcagggaua

SEQ ID NO: 2500916 - RNA, 14 nt, Chlamydia trachomatis
uacugggaaaucau

SEQ ID NO: 2500917 - RNA, 12 nt, Chlamydia trachomatis
uacuguacuccu

SEQ ID NO: 2500918 - RNA, 21 nt, Chlamydia trachomatis
uacugucagaccuacaaagau

SEQ ID NO: 2500919 - RNA, 22 nt, Chlamydia trachomatis
uacugucagaccuacaaagaua

SEQ ID NO: 2500920 - RNA, 20 nt, Chlamydia trachomatis
uacugucgaacgcuucuucc

SEQ ID NO: 2500921 - RNA, 17 nt, Chlamydia trachomatis
uacuguuuguuaucuaa

SEQ ID NO: 2500922 - RNA, 17 nt, Chlamydia trachomatis
uacuucaaguucuucuu

SEQ ID NO: 2500923 - RNA, 16 nt, Chlamydia trachomatis
uacuucauguaaauuu

SEQ ID NO: 2500924 - RNA, 15 nt, Chlamydia trachomatis
uacuucauuuuugcu

SEQ ID NO: 2500925 - RNA, 13 nt, Chlamydia trachomatis
uacuucgccuuua

SEQ ID NO: 2500926 - RNA, 15 nt, Chlamydia trachomatis
uacuucuagauagaa

SEQ ID NO: 2500927 - RNA, 20 nt, Chlamydia trachomatis
uacuucuaguuauauugcuu

SEQ ID NO: 2500928 - RNA, 23 nt, Chlamydia trachomatis
uacuucuauguaaaaauucuaaa

SEQ ID NO: 2500929 - RNA, 21 nt, Chlamydia trachomatis
uacuucuggaggaguauccag

SEQ ID NO: 2500930 - RNA, 20 nt, Chlamydia trachomatis
uacuucuuacuuaaaaaaca

SEQ ID NO: 2500931 - RNA, 21 nt, Chlamydia trachomatis
uacuucuugcgaugccucuaa

SEQ ID NO: 2500932 - RNA, 10 nt, Chlamydia trachomatis
uacuucuuuu

SEQ ID NO: 2500933 - RNA, 14 nt, Chlamydia trachomatis
uacuugccucuuca

SEQ ID NO: 2500934 - RNA, 21 nt, Chlamydia trachomatis
uacuugccucuucaaccuaga

SEQ ID NO: 2500935 - RNA, 17 nt, Chlamydia trachomatis
uacuugcuccguggcaa

SEQ ID NO: 2500936 - RNA, 16 nt, Chlamydia trachomatis
uacuuuaccuguagga

SEQ ID NO: 2500937 - RNA, 16 nt, Chlamydia trachomatis
uacuuuaggagaaaga

SEQ ID NO: 2500938 - RNA, 15 nt, Chlamydia trachomatis
uacuuucccuauuuu

SEQ ID NO: 2500939 - RNA, 17 nt, Chlamydia trachomatis
uacuuucccuauuuuuu

SEQ ID NO: 2500940 - RNA, 13 nt, Chlamydia trachomatis
uacuuucucuuca

SEQ ID NO: 2500941 - RNA, 23 nt, Chlamydia trachomatis
uacuuucucuucaagaucaaagu

SEQ ID NO: 2500942 - RNA, 16 nt, Chlamydia trachomatis
uacuuucuuugcuauu

SEQ ID NO: 2500943 - RNA, 16 nt, Chlamydia trachomatis
uagaaaaaaacagcuc

SEQ ID NO: 2500944 - RNA, 12 nt, Chlamydia trachomatis
uagaaaaacuau

SEQ ID NO: 2500945 - RNA, 20 nt, Chlamydia trachomatis
uagaaaaagggagaggauuc

SEQ ID NO: 2500946 - RNA, 12 nt, Chlamydia trachomatis
uagaaaaucuau

SEQ ID NO: 2500947 - RNA, 13 nt, Chlamydia trachomatis
uagaaacagccug

SEQ ID NO: 2500948 - RNA, 22 nt, Chlamydia trachomatis
uagaaacuccguaguccacauu

SEQ ID NO: 2500949 - RNA, 14 nt, Chlamydia trachomatis
uagaaacuuacuuu

SEQ ID NO: 2500950 - RNA, 17 nt, Chlamydia trachomatis
uagaaagaaccacaaaa

SEQ ID NO: 2500951 - RNA, 11 nt, Chlamydia trachomatis
uagaaagaauu

SEQ ID NO: 2500952 - RNA, 16 nt, Chlamydia trachomatis
uagaaagggcuuuaua

SEQ ID NO: 2500953 - RNA, 18 nt, Chlamydia trachomatis
uagaaaguccaagauuau

SEQ ID NO: 2500954 - RNA, 18 nt, Chlamydia trachomatis
uagaaaugcaaauuugca

SEQ ID NO: 2500955 - RNA, 17 nt, Chlamydia trachomatis
uagaacagauuuagaga

SEQ ID NO: 2500956 - RNA, 21 nt, Chlamydia trachomatis
uagaacagauuuagagaauaa

SEQ ID NO: 2500957 - RNA, 17 nt, Chlamydia trachomatis
uagaagaaaagagcuuu

SEQ ID NO: 2500958 - RNA, 13 nt, Chlamydia trachomatis
uagaagaagagga

SEQ ID NO: 2500959 - RNA, 18 nt, Chlamydia trachomatis
uagaagaaucauagaaac

SEQ ID NO: 2500960 - RNA, 17 nt, Chlamydia trachomatis
uagaagauaacaacucu

SEQ ID NO: 2500961 - RNA, 12 nt, Chlamydia trachomatis
uagaaggucuga

SEQ ID NO: 2500962 - RNA, 21 nt, Chlamydia trachomatis
uagaaucucggucaucuguuu

SEQ ID NO: 2500963 - RNA, 17 nt, Chlamydia trachomatis
uagaaugcguucuucua

SEQ ID NO: 2500964 - RNA, 13 nt, Chlamydia trachomatis
uagaaugggaagc

SEQ ID NO: 2500965 - RNA, 14 nt, Chlamydia trachomatis
uagaauuucuuccu

SEQ ID NO: 2500966 - RNA, 17 nt, Chlamydia trachomatis
uagaauuucuuccucua

SEQ ID NO: 2500967 - RNA, 12 nt, Chlamydia trachomatis
uagaauuuuguc

SEQ ID NO: 2500968 - RNA, 20 nt, Chlamydia trachomatis
uagacaacguuuaaugaaua

SEQ ID NO: 2500969 - RNA, 20 nt, Chlamydia trachomatis
uagaccaggauuccccguca

SEQ ID NO: 2500970 - RNA, 18 nt, Chlamydia trachomatis
uagacgauccgcuuccug

SEQ ID NO: 2500971 - RNA, 19 nt, Chlamydia trachomatis
uagacgauccgcuuccugc

SEQ ID NO: 2500972 - RNA, 19 nt, Chlamydia trachomatis
uagacugcgcauccacuac

SEQ ID NO: 2500973 - RNA, 12 nt, Chlamydia trachomatis
uagagaaaagaa

SEQ ID NO: 2500974 - RNA, 13 nt, Chlamydia trachomatis
uagagaaaagaaa

SEQ ID NO: 2500975 - RNA, 14 nt, Chlamydia trachomatis
uagagaaaagaaaa

SEQ ID NO: 2500976 - RNA, 18 nt, Chlamydia trachomatis
uagagaaaagaaaagggg

SEQ ID NO: 2500977 - RNA, 16 nt, Chlamydia trachomatis
uagagaacguacuuua

SEQ ID NO: 2500978 - RNA, 15 nt, Chlamydia trachomatis
uagagauaaaaucag

SEQ ID NO: 2500979 - RNA, 19 nt, Chlamydia trachomatis
uagagcauaucaugugggu

SEQ ID NO: 2500980 - RNA, 19 nt, Chlamydia trachomatis
uagagccaugaucaaagaa

SEQ ID NO: 2500981 - RNA, 23 nt, Chlamydia trachomatis
uagagccccuauguaaacaagaa

SEQ ID NO: 2500982 - RNA, 13 nt, Chlamydia trachomatis
uagagccugcaag

SEQ ID NO: 2500983 - RNA, 13 nt, Chlamydia trachomatis
uagagcucuucuc

SEQ ID NO: 2500984 - RNA, 16 nt, Chlamydia trachomatis
uagaggcuauugauuu

SEQ ID NO: 2500985 - RNA, 16 nt, Chlamydia trachomatis
uagaguccugagccaa

SEQ ID NO: 2500986 - RNA, 14 nt, Chlamydia trachomatis
uagaguuuuaaguu

SEQ ID NO: 2500987 - RNA, 12 nt, Chlamydia trachomatis
uagauaaaagaa

SEQ ID NO: 2500988 - RNA, 12 nt, Chlamydia trachomatis
uagauaaugaca

SEQ ID NO: 2500989 - RNA, 16 nt, Chlamydia trachomatis
uagauacugguaacug

SEQ ID NO: 2500990 - RNA, 15 nt, Chlamydia trachomatis
uagauagaagagcuu

SEQ ID NO: 2500991 - RNA, 13 nt, Chlamydia trachomatis
uagauagcuccaa

SEQ ID NO: 2500992 - RNA, 15 nt, Chlamydia trachomatis
uagauagcuccaagg

SEQ ID NO: 2500993 - RNA, 17 nt, Chlamydia trachomatis
uagauauaaauuuggau

SEQ ID NO: 2500994 - RNA, 17 nt, Chlamydia trachomatis
uagauaucuuuacucuu

SEQ ID NO: 2500995 - RNA, 17 nt, Chlamydia trachomatis
uagaucaagaaaagaua

SEQ ID NO: 2500996 - RNA, 17 nt, Chlamydia trachomatis
uagaucccuuucauucu

SEQ ID NO: 2500997 - RNA, 22 nt, Chlamydia trachomatis
uagaucuaaagcagaaacaauu

SEQ ID NO: 2500998 - RNA, 20 nt, Chlamydia trachomatis
uagaucuaaggaauguggag

SEQ ID NO: 2500999 - RNA, 23 nt, Chlamydia trachomatis
uagaucuaaggaauguggagcua

SEQ ID NO: 2501000 - RNA, 20 nt, Chlamydia trachomatis
uagaucuguuagugaagagc

SEQ ID NO: 2501001 - RNA, 17 nt, Chlamydia trachomatis
uagaugcaauaaacgcu

SEQ ID NO: 2501002 - RNA, 22 nt, Chlamydia trachomatis
uagauguuguggguuuggaaau

SEQ ID NO: 2501003 - RNA, 15 nt, Chlamydia trachomatis
uagauucagaacaag

SEQ ID NO: 2501004 - RNA, 20 nt, Chlamydia trachomatis
uagauucagcaagauucucc

SEQ ID NO: 2501005 - RNA, 19 nt, Chlamydia trachomatis
uagauucccuuuaaagaaa

SEQ ID NO: 2501006 - RNA, 22 nt, Chlamydia trachomatis
uagauucuggaggaggaccucu

SEQ ID NO: 2501007 - RNA, 19 nt, Chlamydia trachomatis
uagauuuagcuguuaugaa

SEQ ID NO: 2501008 - RNA, 18 nt, Chlamydia trachomatis
uagauuuguuuaaaagaa

SEQ ID NO: 2501009 - RNA, 19 nt, Chlamydia trachomatis
uagauuuguuuaaaagaag

SEQ ID NO: 2501010 - RNA, 12 nt, Chlamydia trachomatis
uagauuuucaug

SEQ ID NO: 2501011 - RNA, 14 nt, Chlamydia trachomatis
uagauuuucaugca

SEQ ID NO: 2501012 - RNA, 20 nt, Chlamydia trachomatis
uagcaaagcgaucagcucuc

SEQ ID NO: 2501013 - RNA, 13 nt, Chlamydia trachomatis
uagcaaauaauag

SEQ ID NO: 2501014 - RNA, 22 nt, Chlamydia trachomatis
uagcaaaucuggcugaagaagu

SEQ ID NO: 2501015 - RNA, 18 nt, Chlamydia trachomatis
uagcaaccgauucuucac

SEQ ID NO: 2501016 - RNA, 18 nt, Chlamydia trachomatis
uagcaacgaacuuuccau

SEQ ID NO: 2501017 - RNA, 11 nt, Chlamydia trachomatis
uagcaagacau

SEQ ID NO: 2501018 - RNA, 16 nt, Chlamydia trachomatis
uagcaagacaucuauu

SEQ ID NO: 2501019 - RNA, 23 nt, Chlamydia trachomatis
uagcaaugaaggcgcuagggucu

SEQ ID NO: 2501020 - RNA, 21 nt, Chlamydia trachomatis
uagcaccagcuaauaaguuca

SEQ ID NO: 2501021 - RNA, 22 nt, Chlamydia trachomatis
uagcacccuuuuuauaaucucc

SEQ ID NO: 2501022 - RNA, 15 nt, Chlamydia trachomatis
uagcacgcaaaacau

SEQ ID NO: 2501023 - RNA, 22 nt, Chlamydia trachomatis
uagcagauaauucucgcaaaga

SEQ ID NO: 2501024 - RNA, 23 nt, Chlamydia trachomatis
uagcagauaauucucgcaaagaa

SEQ ID NO: 2501025 - RNA, 13 nt, Chlamydia trachomatis
uagcaucuggaac

SEQ ID NO: 2501026 - RNA, 10 nt, Chlamydia trachomatis
uagcaugccg

SEQ ID NO: 2501027 - RNA, 16 nt, Chlamydia trachomatis
uagcauggaagacaac

SEQ ID NO: 2501028 - RNA, 22 nt, Chlamydia trachomatis
uagcauugcgcagaucuccuuc

SEQ ID NO: 2501029 - RNA, 18 nt, Chlamydia trachomatis
uagccaaagguuguugcu

SEQ ID NO: 2501030 - RNA, 14 nt, Chlamydia trachomatis
uagccaauuuccau

SEQ ID NO: 2501031 - RNA, 20 nt, Chlamydia trachomatis
uagccacugcacaucacaga

SEQ ID NO: 2501032 - RNA, 12 nt, Chlamydia trachomatis
uagccaucaucg

SEQ ID NO: 2501033 - RNA, 13 nt, Chlamydia trachomatis
uagccauccgguc

SEQ ID NO: 2501034 - RNA, 23 nt, Chlamydia trachomatis
uagcccuccuacuccaauggaaa

SEQ ID NO: 2501035 - RNA, 20 nt, Chlamydia trachomatis
uagccuccaaacauuuugag

SEQ ID NO: 2501036 - RNA, 18 nt, Chlamydia trachomatis
uagccuccgcuaauuuuu

SEQ ID NO: 2501037 - RNA, 19 nt, Chlamydia trachomatis
uagccuccgcuaauuuuug

SEQ ID NO: 2501038 - RNA, 22 nt, Chlamydia trachomatis
uagccuuuagauaguuacuucc

SEQ ID NO: 2501039 - RNA, 17 nt, Chlamydia trachomatis
uagcgaaaaaucacaau

SEQ ID NO: 2501040 - RNA, 19 nt, Chlamydia trachomatis
uagcgaagucuucuaucac

SEQ ID NO: 2501041 - RNA, 16 nt, Chlamydia trachomatis
uagcguaaaagagauu

SEQ ID NO: 2501042 - RNA, 19 nt, Chlamydia trachomatis
uagcuaaaagcucuugucg

SEQ ID NO: 2501043 - RNA, 14 nt, Chlamydia trachomatis
uagcuaaacccaau

SEQ ID NO: 2501044 - RNA, 20 nt, Chlamydia trachomatis
uagcuaaagcagaaacagcu

SEQ ID NO: 2501045 - RNA, 16 nt, Chlamydia trachomatis
uagcuaaauucaacug

SEQ ID NO: 2501046 - RNA, 14 nt, Chlamydia trachomatis
uagcuacagcaaua

SEQ ID NO: 2501047 - RNA, 14 nt, Chlamydia trachomatis
uagcuacuagauag

SEQ ID NO: 2501048 - RNA, 15 nt, Chlamydia trachomatis
uagcuacuuucgcuu

SEQ ID NO: 2501049 - RNA, 20 nt, Chlamydia trachomatis
uagcuagaguagugccagca

SEQ ID NO: 2501050 - RNA, 13 nt, Chlamydia trachomatis
uagcucagagauu

SEQ ID NO: 2501051 - RNA, 14 nt, Chlamydia trachomatis
uagcuccaagggag

SEQ ID NO: 2501052 - RNA, 21 nt, Chlamydia trachomatis
uagcucguuuuuuuguuguug

SEQ ID NO: 2501053 - RNA, 15 nt, Chlamydia trachomatis
uagcugaugaagcga

SEQ ID NO: 2501054 - RNA, 14 nt, Chlamydia trachomatis
uagcuucagaagaa

SEQ ID NO: 2501055 - RNA, 20 nt, Chlamydia trachomatis
uagcuucauacacaugagca

SEQ ID NO: 2501056 - RNA, 19 nt, Chlamydia trachomatis
uagcuucguagagcaagau

SEQ ID NO: 2501057 - RNA, 24 nt, Chlamydia trachomatis
uagcuucuaauuucuuucucaugc

SEQ ID NO: 2501058 - RNA, 17 nt, Chlamydia trachomatis
uagcuugaugauagucu

SEQ ID NO: 2501059 - RNA, 17 nt, Chlamydia trachomatis
uagcuuuccucacacac

SEQ ID NO: 2501060 - RNA, 20 nt, Chlamydia trachomatis
uagcuuuccucacacacaaa

SEQ ID NO: 2501061 - RNA, 22 nt, Chlamydia trachomatis
uagcuuuccucacacacaaaaa

SEQ ID NO: 2501062 - RNA, 15 nt, Chlamydia trachomatis
uaggaaaugagagcu

SEQ ID NO: 2501063 - RNA, 19 nt, Chlamydia trachomatis
uaggaacuacauucgccuc

SEQ ID NO: 2501064 - RNA, 21 nt, Chlamydia trachomatis
uaggaacuacauucgccucuu

SEQ ID NO: 2501065 - RNA, 18 nt, Chlamydia trachomatis
uaggaaggguuuugaagc

SEQ ID NO: 2501066 - RNA, 14 nt, Chlamydia trachomatis
uaggaaugcccaaa

SEQ ID NO: 2501067 - RNA, 13 nt, Chlamydia trachomatis
uaggacucuaaga

SEQ ID NO: 2501068 - RNA, 22 nt, Chlamydia trachomatis
uaggacugccgaacugcuuucc

SEQ ID NO: 2501069 - RNA, 11 nt, Chlamydia trachomatis
uaggagaaaga

SEQ ID NO: 2501070 - RNA, 13 nt, Chlamydia trachomatis
uaggagagaaucu

SEQ ID NO: 2501071 - RNA, 13 nt, Chlamydia trachomatis
uaggagaggauua

SEQ ID NO: 2501072 - RNA, 21 nt, Chlamydia trachomatis
uaggaggaacccuuuguaguu

SEQ ID NO: 2501073 - RNA, 17 nt, Chlamydia trachomatis
uaggaggucgcccucuu

SEQ ID NO: 2501074 - RNA, 17 nt, Chlamydia trachomatis
uaggauaggaaaugaga

SEQ ID NO: 2501075 - RNA, 21 nt, Chlamydia trachomatis
uaggauccccacgaccacaaa

SEQ ID NO: 2501076 - RNA, 15 nt, Chlamydia trachomatis
uaggaugucugcggu

SEQ ID NO: 2501077 - RNA, 20 nt, Chlamydia trachomatis
uaggcaacuugagcaucugg

SEQ ID NO: 2501078 - RNA, 19 nt, Chlamydia trachomatis
uaggcauaauuaugaucac

SEQ ID NO: 2501079 - RNA, 16 nt, Chlamydia trachomatis
uaggcauacaggagag

SEQ ID NO: 2501080 - RNA, 19 nt, Chlamydia trachomatis
uaggcgugaagagagacac

SEQ ID NO: 2501081 - RNA, 21 nt, Chlamydia trachomatis
uagggaaaaacuuuucuuccu

SEQ ID NO: 2501082 - RNA, 22 nt, Chlamydia trachomatis
uagggagcacauuacuguacuc

SEQ ID NO: 2501083 - RNA, 17 nt, Chlamydia trachomatis
uagggagguauuccugu

SEQ ID NO: 2501084 - RNA, 15 nt, Chlamydia trachomatis
uagggagguuuuguu

SEQ ID NO: 2501085 - RNA, 17 nt, Chlamydia trachomatis
uagggaucccacaaaga

SEQ ID NO: 2501086 - RNA, 19 nt, Chlamydia trachomatis
uagggggaguucuauuuau

SEQ ID NO: 2501087 - RNA, 17 nt, Chlamydia trachomatis
uaggguuguuuuagaau

SEQ ID NO: 2501088 - RNA, 20 nt, Chlamydia trachomatis
uaggguuguuuuagaaugcg

SEQ ID NO: 2501089 - RNA, 22 nt, Chlamydia trachomatis
uagguaaagguuucuggaaaau

SEQ ID NO: 2501090 - RNA, 15 nt, Chlamydia trachomatis
uagguagaaaaggau

SEQ ID NO: 2501091 - RNA, 23 nt, Chlamydia trachomatis
uagguaucgaaaguaaaauuccu

SEQ ID NO: 2501092 - RNA, 15 nt, Chlamydia trachomatis
uagguaucugaaucu

SEQ ID NO: 2501093 - RNA, 22 nt, Chlamydia trachomatis
uaggucucccuagcagcucuua

SEQ ID NO: 2501094 - RNA, 16 nt, Chlamydia trachomatis
uaggucugaagaaaaa

SEQ ID NO: 2501095 - RNA, 17 nt, Chlamydia trachomatis
uaggucugaagaaaaau

SEQ ID NO: 2501096 - RNA, 20 nt, Chlamydia trachomatis
uagguucuuugaucaaaucc

SEQ ID NO: 2501097 - RNA, 14 nt, Chlamydia trachomatis
uagguuuaaauaag

SEQ ID NO: 2501098 - RNA, 15 nt, Chlamydia trachomatis
uaguaacggaacucu

SEQ ID NO: 2501099 - RNA, 14 nt, Chlamydia trachomatis
uaguaauaaaggaa

SEQ ID NO: 2501100 - RNA, 18 nt, Chlamydia trachomatis
uaguaaugugucuaaaga

SEQ ID NO: 2501101 - RNA, 15 nt, Chlamydia trachomatis
uaguacaaaaauacu

SEQ ID NO: 2501102 - RNA, 16 nt, Chlamydia trachomatis
uaguacaaaaauacuu

SEQ ID NO: 2501103 - RNA, 18 nt, Chlamydia trachomatis
uaguacguguuaucaaag

SEQ ID NO: 2501104 - RNA, 18 nt, Chlamydia trachomatis
uaguagagaauuagagau

SEQ ID NO: 2501105 - RNA, 17 nt, Chlamydia trachomatis
uaguauuaaacuucaaa

SEQ ID NO: 2501106 - RNA, 20 nt, Chlamydia trachomatis
uaguauuaaacuucaaacuc

SEQ ID NO: 2501107 - RNA, 23 nt, Chlamydia trachomatis
uaguauucuuugcguagcucaga

SEQ ID NO: 2501108 - RNA, 23 nt, Chlamydia trachomatis
uagucauugauucuaugagaaga

SEQ ID NO: 2501109 - RNA, 15 nt, Chlamydia trachomatis
uaguccuaucaccac

SEQ ID NO: 2501110 - RNA, 15 nt, Chlamydia trachomatis
uagucgcuuagauau

SEQ ID NO: 2501111 - RNA, 20 nt, Chlamydia trachomatis
uagucuauagacgauauugu

SEQ ID NO: 2501112 - RNA, 21 nt, Chlamydia trachomatis
uagucugcaauccaauuacca

SEQ ID NO: 2501113 - RNA, 15 nt, Chlamydia trachomatis
uagugaagagcagag

SEQ ID NO: 2501114 - RNA, 18 nt, Chlamydia trachomatis
uaguguaaggagagaaaa

SEQ ID NO: 2501115 - RNA, 19 nt, Chlamydia trachomatis
uaguguagucagaagauac

SEQ ID NO: 2501116 - RNA, 19 nt, Chlamydia trachomatis
uaguuacauacuuuucucc

SEQ ID NO: 2501117 - RNA, 18 nt, Chlamydia trachomatis
uaguuagguaaucuucua

SEQ ID NO: 2501118 - RNA, 21 nt, Chlamydia trachomatis
uaguuauauugcuucauaaaa

SEQ ID NO: 2501119 - RNA, 17 nt, Chlamydia trachomatis
uaguucuaacaucaacu

SEQ ID NO: 2501120 - RNA, 14 nt, Chlamydia trachomatis
uaguugcaaaaaga

SEQ ID NO: 2501121 - RNA, 15 nt, Chlamydia trachomatis
uaguugcaaaaagaa

SEQ ID NO: 2501122 - RNA, 19 nt, Chlamydia trachomatis
uaguuucgaguaauuccaa

SEQ ID NO: 2501123 - RNA, 20 nt, Chlamydia trachomatis
uaguuuuaauuccaucuuuu

SEQ ID NO: 2501124 - RNA, 22 nt, Chlamydia trachomatis
uaguuuucccaucuacaaaacc

SEQ ID NO: 2501125 - RNA, 20 nt, Chlamydia trachomatis
uauaaacccacgaaaagacu

SEQ ID NO: 2501126 - RNA, 17 nt, Chlamydia trachomatis
uauaaagccccuccgcu

SEQ ID NO: 2501127 - RNA, 18 nt, Chlamydia trachomatis
uauaaauccugcgcuguu

SEQ ID NO: 2501128 - RNA, 14 nt, Chlamydia trachomatis
uauaaauuauacaa

SEQ ID NO: 2501129 - RNA, 22 nt, Chlamydia trachomatis
uauaaauuuggauuagaaaaag

SEQ ID NO: 2501130 - RNA, 17 nt, Chlamydia trachomatis
uauaacauuauuccgcu

SEQ ID NO: 2501131 - RNA, 22 nt, Chlamydia trachomatis
uauaagagaagguaacaaugcu

SEQ ID NO: 2501132 - RNA, 16 nt, Chlamydia trachomatis
uauaagguucaaggaa

SEQ ID NO: 2501133 - RNA, 18 nt, Chlamydia trachomatis
uauaagguucaaggaagu

SEQ ID NO: 2501134 - RNA, 20 nt, Chlamydia trachomatis
uauaaguaucguaaacaaaa

SEQ ID NO: 2501135 - RNA, 16 nt, Chlamydia trachomatis
uauaagucaaaagaau

SEQ ID NO: 2501136 - RNA, 20 nt, Chlamydia trachomatis
uauaaguucuuuuuguugcu

SEQ ID NO: 2501137 - RNA, 19 nt, Chlamydia trachomatis
uauaauccgagcauuuucc

SEQ ID NO: 2501138 - RNA, 12 nt, Chlamydia trachomatis
uauaaucuggau

SEQ ID NO: 2501139 - RNA, 15 nt, Chlamydia trachomatis
uauacaagaaaacag

SEQ ID NO: 2501140 - RNA, 20 nt, Chlamydia trachomatis
uauacaagaaaacagccaag

SEQ ID NO: 2501141 - RNA, 18 nt, Chlamydia trachomatis
uauacaaguauuucuugu

SEQ ID NO: 2501142 - RNA, 17 nt, Chlamydia trachomatis
uauacccgacuaaaaaa

SEQ ID NO: 2501143 - RNA, 16 nt, Chlamydia trachomatis
uauaccgccucaaaca

SEQ ID NO: 2501144 - RNA, 17 nt, Chlamydia trachomatis
uauacgaaauaacaaag

SEQ ID NO: 2501145 - RNA, 18 nt, Chlamydia trachomatis
uauacgaaauaacaaagc

SEQ ID NO: 2501146 - RNA, 19 nt, Chlamydia trachomatis
uauacgaaauaacaaagca

SEQ ID NO: 2501147 - RNA, 14 nt, Chlamydia trachomatis
uauacgcucuuuca

SEQ ID NO: 2501148 - RNA, 11 nt, Chlamydia trachomatis
uauacucagag

SEQ ID NO: 2501149 - RNA, 12 nt, Chlamydia trachomatis
uauacucagaga

SEQ ID NO: 2501150 - RNA, 15 nt, Chlamydia trachomatis
uauacucuaaaaguu

SEQ ID NO: 2501151 - RNA, 20 nt, Chlamydia trachomatis
uauagaauuuuucuaaaauc

SEQ ID NO: 2501152 - RNA, 21 nt, Chlamydia trachomatis
uauagaauuuuucuaaaaucu

SEQ ID NO: 2501153 - RNA, 17 nt, Chlamydia trachomatis
uauagagcaaucucuua

SEQ ID NO: 2501154 - RNA, 20 nt, Chlamydia trachomatis
uauagcaaugcgaucagaaa

SEQ ID NO: 2501155 - RNA, 11 nt, Chlamydia trachomatis
uauagcaugau

SEQ ID NO: 2501156 - RNA, 17 nt, Chlamydia trachomatis
uauagcugcggagagaa

SEQ ID NO: 2501157 - RNA, 21 nt, Chlamydia trachomatis
uauaguuuucgacggaacucu

SEQ ID NO: 2501158 - RNA, 21 nt, Chlamydia trachomatis
uauauaaagccccuccgcuga

SEQ ID NO: 2501159 - RNA, 15 nt, Chlamydia trachomatis
uauauaggcuuccaa

SEQ ID NO: 2501160 - RNA, 16 nt, Chlamydia trachomatis
uauaucggaaagauag

SEQ ID NO: 2501161 - RNA, 12 nt, Chlamydia trachomatis
uauaucuguaac

SEQ ID NO: 2501162 - RNA, 13 nt, Chlamydia trachomatis
uauaugcucuuug

SEQ ID NO: 2501163 - RNA, 22 nt, Chlamydia trachomatis
uauauggacaagcaauagcuua

SEQ ID NO: 2501164 - RNA, 18 nt, Chlamydia trachomatis
uauauucuucuucugcaa

SEQ ID NO: 2501165 - RNA, 19 nt, Chlamydia trachomatis
uauauugcuucauaaaaaa

SEQ ID NO: 2501166 - RNA, 21 nt, Chlamydia trachomatis
uauauugcuucauaaaaaaga

SEQ ID NO: 2501167 - RNA, 19 nt, Chlamydia trachomatis
uauauuggaagauaacaau

SEQ ID NO: 2501168 - RNA, 13 nt, Chlamydia trachomatis
uaucaaaaucaau

SEQ ID NO: 2501169 - RNA, 14 nt, Chlamydia trachomatis
uaucaaaaucaaua

SEQ ID NO: 2501170 - RNA, 16 nt, Chlamydia trachomatis
uaucaaaaucaauaau

SEQ ID NO: 2501171 - RNA, 13 nt, Chlamydia trachomatis
uaucaaagagugu

SEQ ID NO: 2501172 - RNA, 21 nt, Chlamydia trachomatis
uaucaaauuuuucagaaaaag

SEQ ID NO: 2501173 - RNA, 19 nt, Chlamydia trachomatis
uaucaagaauuucuugaau

SEQ ID NO: 2501174 - RNA, 20 nt, Chlamydia trachomatis
uaucaagaauuucuugaauu

SEQ ID NO: 2501175 - RNA, 13 nt, Chlamydia trachomatis
uaucaauuccugu

SEQ ID NO: 2501176 - RNA, 12 nt, Chlamydia trachomatis
uaucaccuauua

SEQ ID NO: 2501177 - RNA, 22 nt, Chlamydia trachomatis
uaucacuaccagccccacaagu

SEQ ID NO: 2501178 - RNA, 20 nt, Chlamydia trachomatis
uaucacuaucugcaaaagca

SEQ ID NO: 2501179 - RNA, 19 nt, Chlamydia trachomatis
uaucacuguugagaaaaac

SEQ ID NO: 2501180 - RNA, 14 nt, Chlamydia trachomatis
uaucagcauacaga

SEQ ID NO: 2501181 - RNA, 13 nt, Chlamydia trachomatis
uaucagcauccca

SEQ ID NO: 2501182 - RNA, 20 nt, Chlamydia trachomatis
uaucagcgcucauaggacaa

SEQ ID NO: 2501183 - RNA, 14 nt, Chlamydia trachomatis
uaucauguagcccu

SEQ ID NO: 2501184 - RNA, 21 nt, Chlamydia trachomatis
uaucauguggguaugucugug

SEQ ID NO: 2501185 - RNA, 12 nt, Chlamydia trachomatis
uaucauucccua

SEQ ID NO: 2501186 - RNA, 14 nt, Chlamydia trachomatis
uauccaaaaaagug

SEQ ID NO: 2501187 - RNA, 22 nt, Chlamydia trachomatis
uauccaaagcugcuuuagcugc

SEQ ID NO: 2501188 - RNA, 21 nt, Chlamydia trachomatis
uauccaaauaaacacacuggg

SEQ ID NO: 2501189 - RNA, 17 nt, Chlamydia trachomatis
uauccaagcacuccuca

SEQ ID NO: 2501190 - RNA, 19 nt, Chlamydia trachomatis
uauccaagcacuccucagc

SEQ ID NO: 2501191 - RNA, 16 nt, Chlamydia trachomatis
uauccagaaguuuuaa

SEQ ID NO: 2501192 - RNA, 14 nt, Chlamydia trachomatis
uauccauaaaaaua

SEQ ID NO: 2501193 - RNA, 21 nt, Chlamydia trachomatis
uauccauacaugauagucaga

SEQ ID NO: 2501194 - RNA, 14 nt, Chlamydia trachomatis
uauccaucauaaaa

SEQ ID NO: 2501195 - RNA, 16 nt, Chlamydia trachomatis
uauccaucauaaaaag

SEQ ID NO: 2501196 - RNA, 21 nt, Chlamydia trachomatis
uauccaucauaaaaagauagu

SEQ ID NO: 2501197 - RNA, 22 nt, Chlamydia trachomatis
uauccaugaucucugcagaaga

SEQ ID NO: 2501198 - RNA, 16 nt, Chlamydia trachomatis
uauccccaucucuuuu

SEQ ID NO: 2501199 - RNA, 18 nt, Chlamydia trachomatis
uaucccuaguacaaaaau

SEQ ID NO: 2501200 - RNA, 19 nt, Chlamydia trachomatis
uaucccugcauaauagcuu

SEQ ID NO: 2501201 - RNA, 19 nt, Chlamydia trachomatis
uauccgcaguaaaaucuaa

SEQ ID NO: 2501202 - RNA, 23 nt, Chlamydia trachomatis
uauccgcaguaaaaucuaaaaua

SEQ ID NO: 2501203 - RNA, 16 nt, Chlamydia trachomatis
uauccguaaggaagcc

SEQ ID NO: 2501204 - RNA, 15 nt, Chlamydia trachomatis
uauccuaacuaaaaa

SEQ ID NO: 2501205 - RNA, 14 nt, Chlamydia trachomatis
uauccuucuguguu

SEQ ID NO: 2501206 - RNA, 21 nt, Chlamydia trachomatis
uaucgaaaguaaaauuccuga

SEQ ID NO: 2501207 - RNA, 17 nt, Chlamydia trachomatis
uaucguuagcaucaucc

SEQ ID NO: 2501208 - RNA, 14 nt, Chlamydia trachomatis
uaucuaaagaaaug

SEQ ID NO: 2501209 - RNA, 13 nt, Chlamydia trachomatis
uaucuaaaucuaa

SEQ ID NO: 2501210 - RNA, 15 nt, Chlamydia trachomatis
uaucuaacaauacua

SEQ ID NO: 2501211 - RNA, 12 nt, Chlamydia trachomatis
uaucuaaucucg

SEQ ID NO: 2501212 - RNA, 23 nt, Chlamydia trachomatis
uaucuaauuuuagauaaaagaag

SEQ ID NO: 2501213 - RNA, 13 nt, Chlamydia trachomatis
uaucuagaaaacg

SEQ ID NO: 2501214 - RNA, 14 nt, Chlamydia trachomatis
uaucuagaaaagag

SEQ ID NO: 2501215 - RNA, 17 nt, Chlamydia trachomatis
uaucuagaaaagagcag

SEQ ID NO: 2501216 - RNA, 16 nt, Chlamydia trachomatis
uaucucaggauaaaac

SEQ ID NO: 2501217 - RNA, 15 nt, Chlamydia trachomatis
uaucuccaacaguga

SEQ ID NO: 2501218 - RNA, 23 nt, Chlamydia trachomatis
uaucugcccaucaucgaugauau

SEQ ID NO: 2501219 - RNA, 21 nt, Chlamydia trachomatis
uaucugcuaguccuccuguag

SEQ ID NO: 2501220 - RNA, 23 nt, Chlamydia trachomatis
uaucugcucggauaggcugagga

SEQ ID NO: 2501221 - RNA, 17 nt, Chlamydia trachomatis
uaucuucaaagaacaag

SEQ ID NO: 2501222 - RNA, 13 nt, Chlamydia trachomatis
uaucuucuucuaa

SEQ ID NO: 2501223 - RNA, 21 nt, Chlamydia trachomatis
uaucuuggguaagaccaaaaa

SEQ ID NO: 2501224 - RNA, 16 nt, Chlamydia trachomatis
uaucuuguguagaaga

SEQ ID NO: 2501225 - RNA, 15 nt, Chlamydia trachomatis
uaugaaaguagacca

SEQ ID NO: 2501226 - RNA, 23 nt, Chlamydia trachomatis
uaugaacaacauaaaauccuucu

SEQ ID NO: 2501227 - RNA, 22 nt, Chlamydia trachomatis
uaugaauccuugaaccaaacga

SEQ ID NO: 2501228 - RNA, 13 nt, Chlamydia trachomatis
uaugacagagccc

SEQ ID NO: 2501229 - RNA, 15 nt, Chlamydia trachomatis
uaugacagagcccuu

SEQ ID NO: 2501230 - RNA, 22 nt, Chlamydia trachomatis
uaugacaggcccaacuggcaag

SEQ ID NO: 2501231 - RNA, 22 nt, Chlamydia trachomatis
uaugauuccgcugcucuaacca

SEQ ID NO: 2501232 - RNA, 16 nt, Chlamydia trachomatis
uaugcaaaaagagcau

SEQ ID NO: 2501233 - RNA, 17 nt, Chlamydia trachomatis
uaugcaaccuucuccaa

SEQ ID NO: 2501234 - RNA, 21 nt, Chlamydia trachomatis
uaugcaucugauguuccaucu

SEQ ID NO: 2501235 - RNA, 16 nt, Chlamydia trachomatis
uaugcgucuucccuga

SEQ ID NO: 2501236 - RNA, 17 nt, Chlamydia trachomatis
uaugcuacuccuaaauc

SEQ ID NO: 2501237 - RNA, 21 nt, Chlamydia trachomatis
uaugcuuuuuaauauccucca

SEQ ID NO: 2501238 - RNA, 21 nt, Chlamydia trachomatis
uauggcaaucgcggaagaaag

SEQ ID NO: 2501239 - RNA, 20 nt, Chlamydia trachomatis
uauggcauucaaccucucau

SEQ ID NO: 2501240 - RNA, 12 nt, Chlamydia trachomatis
uauguaaaaauu

SEQ ID NO: 2501241 - RNA, 14 nt, Chlamydia trachomatis
uauguaaaaauucu

SEQ ID NO: 2501242 - RNA, 19 nt, Chlamydia trachomatis
uauguaaacaagaauaaua

SEQ ID NO: 2501243 - RNA, 22 nt, Chlamydia trachomatis
uauguaagccuaaaacucccau

SEQ ID NO: 2501244 - RNA, 14 nt, Chlamydia trachomatis
uauguaaggaaaua

SEQ ID NO: 2501245 - RNA, 17 nt, Chlamydia trachomatis
uauguaaggaaauaccu

SEQ ID NO: 2501246 - RNA, 20 nt, Chlamydia trachomatis
uauguauaccgcguaagcaa

SEQ ID NO: 2501247 - RNA, 17 nt, Chlamydia trachomatis
uaugugaaaauaucuaa

SEQ ID NO: 2501248 - RNA, 14 nt, Chlamydia trachomatis
uauguucagcaucc

SEQ ID NO: 2501249 - RNA, 19 nt, Chlamydia trachomatis
uauguucuuaauaaucugu

SEQ ID NO: 2501250 - RNA, 19 nt, Chlamydia trachomatis
uauguuggucaaugcugcu

SEQ ID NO: 2501251 - RNA, 20 nt, Chlamydia trachomatis
uauuaaaaaggcuagagaua

SEQ ID NO: 2501252 - RNA, 14 nt, Chlamydia trachomatis
uauuaaacucccaa

SEQ ID NO: 2501253 - RNA, 17 nt, Chlamydia trachomatis
uauuaaacucccaaaac

SEQ ID NO: 2501254 - RNA, 13 nt, Chlamydia trachomatis
uauuaauaaugaa

SEQ ID NO: 2501255 - RNA, 14 nt, Chlamydia trachomatis
uauuaauuucuaga

SEQ ID NO: 2501256 - RNA, 20 nt, Chlamydia trachomatis
uauuacggaaaagcuuuuua

SEQ ID NO: 2501257 - RNA, 14 nt, Chlamydia trachomatis
uauuagauagcuuc

SEQ ID NO: 2501258 - RNA, 15 nt, Chlamydia trachomatis
uauuaucuagaaaag

SEQ ID NO: 2501259 - RNA, 17 nt, Chlamydia trachomatis
uauucacccaaauauac

SEQ ID NO: 2501260 - RNA, 16 nt, Chlamydia trachomatis
uauucacgcaucccaa

SEQ ID NO: 2501261 - RNA, 13 nt, Chlamydia trachomatis
uauuccaaauccu

SEQ ID NO: 2501262 - RNA, 23 nt, Chlamydia trachomatis
uauuccagcuccuuauaaauccu

SEQ ID NO: 2501263 - RNA, 15 nt, Chlamydia trachomatis
uauucccaaagcuag

SEQ ID NO: 2501264 - RNA, 13 nt, Chlamydia trachomatis
uauuccgagagaa

SEQ ID NO: 2501265 - RNA, 16 nt, Chlamydia trachomatis
uauuccgagagaagcu

SEQ ID NO: 2501266 - RNA, 18 nt, Chlamydia trachomatis
uauuccgcuucuauuucc

SEQ ID NO: 2501267 - RNA, 23 nt, Chlamydia trachomatis
uauucgcuauuucgaucuuacca

SEQ ID NO: 2501268 - RNA, 18 nt, Chlamydia trachomatis
uauucguaggguuguuuu

SEQ ID NO: 2501269 - RNA, 16 nt, Chlamydia trachomatis
uauucucaaguugagu

SEQ ID NO: 2501270 - RNA, 12 nt, Chlamydia trachomatis
uauucuccuuuu

SEQ ID NO: 2501271 - RNA, 21 nt, Chlamydia trachomatis
uauucucgcccccauaacggu

SEQ ID NO: 2501272 - RNA, 17 nt, Chlamydia trachomatis
uauucugcagaaaaauu

SEQ ID NO: 2501273 - RNA, 16 nt, Chlamydia trachomatis
uauucuguaaaaggaa

SEQ ID NO: 2501274 - RNA, 18 nt, Chlamydia trachomatis
uauucuucuucugcaaga

SEQ ID NO: 2501275 - RNA, 14 nt, Chlamydia trachomatis
uauucuuucuuauc

SEQ ID NO: 2501276 - RNA, 12 nt, Chlamydia trachomatis
uauucuuuucca

SEQ ID NO: 2501277 - RNA, 13 nt, Chlamydia trachomatis
uauucuuuuccau

SEQ ID NO: 2501278 - RNA, 22 nt, Chlamydia trachomatis
uauugagaagacuuacucucua

SEQ ID NO: 2501279 - RNA, 19 nt, Chlamydia trachomatis
uauugccaaaaagaaaauc

SEQ ID NO: 2501280 - RNA, 15 nt, Chlamydia trachomatis
uauuggacucagaau

SEQ ID NO: 2501281 - RNA, 14 nt, Chlamydia trachomatis
uauuuaagaagcua

SEQ ID NO: 2501282 - RNA, 18 nt, Chlamydia trachomatis
uauuuaagaagcuaucua

SEQ ID NO: 2501283 - RNA, 17 nt, Chlamydia trachomatis
uauuuacagaauagugg

SEQ ID NO: 2501284 - RNA, 20 nt, Chlamydia trachomatis
uauuuaccuugaguccgcaa

SEQ ID NO: 2501285 - RNA, 17 nt, Chlamydia trachomatis
uauuuccagcauuuuaa

SEQ ID NO: 2501286 - RNA, 20 nt, Chlamydia trachomatis
uauuucccaugucuguugaa

SEQ ID NO: 2501287 - RNA, 23 nt, Chlamydia trachomatis
uauuuccccuacaaacauccuua

SEQ ID NO: 2501288 - RNA, 21 nt, Chlamydia trachomatis
uauuucugucuuagcaaagaa

SEQ ID NO: 2501289 - RNA, 17 nt, Chlamydia trachomatis
uauuuggaucucuuaga

SEQ ID NO: 2501290 - RNA, 18 nt, Chlamydia trachomatis
uauuuggaucucuuagac

SEQ ID NO: 2501291 - RNA, 23 nt, Chlamydia trachomatis
uauuugguggaguguggaagcua

SEQ ID NO: 2501292 - RNA, 20 nt, Chlamydia trachomatis
uauuuuaggcggcuuuucua

SEQ ID NO: 2501293 - RNA, 23 nt, Chlamydia trachomatis
uauuuuauucaaaucuucuucua

SEQ ID NO: 2501294 - RNA, 12 nt, Chlamydia trachomatis
uauuuuuggaug

SEQ ID NO: 2501295 - RNA, 16 nt, Chlamydia trachomatis
uauuuuugggaaaaaa

SEQ ID NO: 2501296 - RNA, 11 nt, Chlamydia trachomatis
uauuuuuuccg

SEQ ID NO: 2501297 - RNA, 16 nt, Chlamydia trachomatis
ucaaaaaaggaaucug

SEQ ID NO: 2501298 - RNA, 22 nt, Chlamydia trachomatis
ucaaaaaaggcauaaaagagaa

SEQ ID NO: 2501299 - RNA, 16 nt, Chlamydia trachomatis
ucaaaaaauguuuuug

SEQ ID NO: 2501300 - RNA, 18 nt, Chlamydia trachomatis
ucaaaaaauguuuuugau

SEQ ID NO: 2501301 - RNA, 21 nt, Chlamydia trachomatis
ucaaaacgcucagaaaacuua

SEQ ID NO: 2501302 - RNA, 16 nt, Chlamydia trachomatis
ucaaaacgcucuccaa

SEQ ID NO: 2501303 - RNA, 16 nt, Chlamydia trachomatis
ucaaaagcuaucuuug

SEQ ID NO: 2501304 - RNA, 15 nt, Chlamydia trachomatis
ucaaaagcuuuuccg

SEQ ID NO: 2501305 - RNA, 23 nt, Chlamydia trachomatis
ucaaaagcuuuuccgcugcaauc

SEQ ID NO: 2501306 - RNA, 15 nt, Chlamydia trachomatis
ucaaaauaaagaaau

SEQ ID NO: 2501307 - RNA, 20 nt, Chlamydia trachomatis
ucaaaauaauguuuuguagu

SEQ ID NO: 2501308 - RNA, 15 nt, Chlamydia trachomatis
ucaaaaucaauaaug

SEQ ID NO: 2501309 - RNA, 11 nt, Chlamydia trachomatis
ucaaaaugaua

SEQ ID NO: 2501310 - RNA, 22 nt, Chlamydia trachomatis
ucaaaaugaucgccucuaaagc

SEQ ID NO: 2501311 - RNA, 19 nt, Chlamydia trachomatis
ucaaacacucgugaaauaa

SEQ ID NO: 2501312 - RNA, 21 nt, Chlamydia trachomatis
ucaaacagaaccuuuuuaaaa

SEQ ID NO: 2501313 - RNA, 23 nt, Chlamydia trachomatis
ucaaacagaaccuuuuuaaaaua

SEQ ID NO: 2501314 - RNA, 15 nt, Chlamydia trachomatis
ucaaacauagaagga

SEQ ID NO: 2501315 - RNA, 19 nt, Chlamydia trachomatis
ucaaaccuaaguagcaaau

SEQ ID NO: 2501316 - RNA, 17 nt, Chlamydia trachomatis
ucaaacgaucugcgaug

SEQ ID NO: 2501317 - RNA, 15 nt, Chlamydia trachomatis
ucaaacuaggcaauc

SEQ ID NO: 2501318 - RNA, 20 nt, Chlamydia trachomatis
ucaaacugugaagaaugaaa

SEQ ID NO: 2501319 - RNA, 18 nt, Chlamydia trachomatis
ucaaagaaguaaugaagg

SEQ ID NO: 2501320 - RNA, 15 nt, Chlamydia trachomatis
ucaaagaucuuucua

SEQ ID NO: 2501321 - RNA, 18 nt, Chlamydia trachomatis
ucaaagaucuuucuacau

SEQ ID NO: 2501322 - RNA, 20 nt, Chlamydia trachomatis
ucaaagaugcgaucuccuca

SEQ ID NO: 2501323 - RNA, 19 nt, Chlamydia trachomatis
ucaaagauuuuaugaccca

SEQ ID NO: 2501324 - RNA, 22 nt, Chlamydia trachomatis
ucaaauauuuuacggaaagagu

SEQ ID NO: 2501325 - RNA, 17 nt, Chlamydia trachomatis
ucaaaucacugagagga

SEQ ID NO: 2501326 - RNA, 15 nt, Chlamydia trachomatis
ucaaaucuucuucua

SEQ ID NO: 2501327 - RNA, 16 nt, Chlamydia trachomatis
ucaaaucuucuucuaa

SEQ ID NO: 2501328 - RNA, 12 nt, Chlamydia trachomatis
ucaaauuucucu

SEQ ID NO: 2501329 - RNA, 13 nt, Chlamydia trachomatis
ucaaauuucucua

SEQ ID NO: 2501330 - RNA, 17 nt, Chlamydia trachomatis
ucaaauuuucaugaaaa

SEQ ID NO: 2501331 - RNA, 20 nt, Chlamydia trachomatis
ucaaauuuucaugaaaagcu

SEQ ID NO: 2501332 - RNA, 22 nt, Chlamydia trachomatis
ucaacaagauuuuuuacaaugu

SEQ ID NO: 2501333 - RNA, 23 nt, Chlamydia trachomatis
ucaacauaauaaauauuaucaga

SEQ ID NO: 2501334 - RNA, 14 nt, Chlamydia trachomatis
ucaacauagauccc

SEQ ID NO: 2501335 - RNA, 16 nt, Chlamydia trachomatis
ucaaccucucaucagu

SEQ ID NO: 2501336 - RNA, 19 nt, Chlamydia trachomatis
ucaaccucucaucaguaaa

SEQ ID NO: 2501337 - RNA, 15 nt, Chlamydia trachomatis
ucaacuccagagcaa

SEQ ID NO: 2501338 - RNA, 19 nt, Chlamydia trachomatis
ucaacuccagagcaaauag

SEQ ID NO: 2501339 - RNA, 21 nt, Chlamydia trachomatis
ucaacuccagagcaaauagaa

SEQ ID NO: 2501340 - RNA, 18 nt, Chlamydia trachomatis
ucaacucgaaccuuuacc

SEQ ID NO: 2501341 - RNA, 22 nt, Chlamydia trachomatis
ucaagagaaaucagaugccauc

SEQ ID NO: 2501342 - RNA, 22 nt, Chlamydia trachomatis
ucaagagagaucuaugaaaaaa

SEQ ID NO: 2501343 - RNA, 15 nt, Chlamydia trachomatis
ucaagagggaaauau

SEQ ID NO: 2501344 - RNA, 15 nt, Chlamydia trachomatis
ucaagccuacagcua

SEQ ID NO: 2501345 - RNA, 16 nt, Chlamydia trachomatis
ucaagccuacagcuag

SEQ ID NO: 2501346 - RNA, 15 nt, Chlamydia trachomatis
ucaaguauugugcca

SEQ ID NO: 2501347 - RNA, 18 nt, Chlamydia trachomatis
ucaaguauugugccaccg

SEQ ID NO: 2501348 - RNA, 19 nt, Chlamydia trachomatis
ucaagugacuuuuagcaaa

SEQ ID NO: 2501349 - RNA, 19 nt, Chlamydia trachomatis
ucaaguucuaacuuuugau

SEQ ID NO: 2501350 - RNA, 15 nt, Chlamydia trachomatis
ucaauaaugucucca

SEQ ID NO: 2501351 - RNA, 18 nt, Chlamydia trachomatis
ucaauaauguugaagucu

SEQ ID NO: 2501352 - RNA, 19 nt, Chlamydia trachomatis
ucaauaccuagcaauucau

SEQ ID NO: 2501353 - RNA, 15 nt, Chlamydia trachomatis
ucaauacgacagcac

SEQ ID NO: 2501354 - RNA, 16 nt, Chlamydia trachomatis
ucaauaucaacguuuu

SEQ ID NO: 2501355 - RNA, 16 nt, Chlamydia trachomatis
ucaaucacuccuccuc

SEQ ID NO: 2501356 - RNA, 19 nt, Chlamydia trachomatis
ucaauccagacucuuguag

SEQ ID NO: 2501357 - RNA, 19 nt, Chlamydia trachomatis
ucaaugagcgcuuuuucuu

SEQ ID NO: 2501358 - RNA, 14 nt, Chlamydia trachomatis
ucaaugcuucuauu

SEQ ID NO: 2501359 - RNA, 17 nt, Chlamydia trachomatis
ucaauguggcugauuaa

SEQ ID NO: 2501360 - RNA, 15 nt, Chlamydia trachomatis
ucaauuacagcaucu

SEQ ID NO: 2501361 - RNA, 19 nt, Chlamydia trachomatis
ucaauuacagcaucuacag

SEQ ID NO: 2501362 - RNA, 14 nt, Chlamydia trachomatis
ucaauuguuguaca

SEQ ID NO: 2501363 - RNA, 14 nt, Chlamydia trachomatis
ucaauuuuuccauu

SEQ ID NO: 2501364 - RNA, 19 nt, Chlamydia trachomatis
ucacaaaagcgaauaaguu

SEQ ID NO: 2501365 - RNA, 16 nt, Chlamydia trachomatis
ucacaaagagaaggcc

SEQ ID NO: 2501366 - RNA, 22 nt, Chlamydia trachomatis
ucacaaauaacagaaacguuua

SEQ ID NO: 2501367 - RNA, 17 nt, Chlamydia trachomatis
ucacaaauuaccccaaa

SEQ ID NO: 2501368 - RNA, 18 nt, Chlamydia trachomatis
ucacaaauuuaucugcua

SEQ ID NO: 2501369 - RNA, 14 nt, Chlamydia trachomatis
ucacaauuuuucuu

SEQ ID NO: 2501370 - RNA, 18 nt, Chlamydia trachomatis
ucacacaacacuccugaa

SEQ ID NO: 2501371 - RNA, 15 nt, Chlamydia trachomatis
ucacagaaacggaag

SEQ ID NO: 2501372 - RNA, 15 nt, Chlamydia trachomatis
ucacagaaacuucuu

SEQ ID NO: 2501373 - RNA, 19 nt, Chlamydia trachomatis
ucacagaaacuucuucuaa

SEQ ID NO: 2501374 - RNA, 12 nt, Chlamydia trachomatis
ucacagaaaguc

SEQ ID NO: 2501375 - RNA, 18 nt, Chlamydia trachomatis
ucacagaaaguccugcuu

SEQ ID NO: 2501376 - RNA, 17 nt, Chlamydia trachomatis
ucacagcaauagccauu

SEQ ID NO: 2501377 - RNA, 16 nt, Chlamydia trachomatis
ucacaugcucaucaaa

SEQ ID NO: 2501378 - RNA, 13 nt, Chlamydia trachomatis
ucacaugguuuuc

SEQ ID NO: 2501379 - RNA, 18 nt, Chlamydia trachomatis
ucaccacgagaucugcau

SEQ ID NO: 2501380 - RNA, 13 nt, Chlamydia trachomatis
ucaccagcaaaag

SEQ ID NO: 2501381 - RNA, 19 nt, Chlamydia trachomatis
ucaccauauccauaacuuu

SEQ ID NO: 2501382 - RNA, 22 nt, Chlamydia trachomatis
ucaccccaucccuugcaaaaau

SEQ ID NO: 2501383 - RNA, 15 nt, Chlamydia trachomatis
ucaccucuugccugc

SEQ ID NO: 2501384 - RNA, 18 nt, Chlamydia trachomatis
ucacgaaguuuuuuuaaa

SEQ ID NO: 2501385 - RNA, 19 nt, Chlamydia trachomatis
ucacgcaucccaaaauagc

SEQ ID NO: 2501386 - RNA, 18 nt, Chlamydia trachomatis
ucacgccagcuaagagaa

SEQ ID NO: 2501387 - RNA, 21 nt, Chlamydia trachomatis
ucacgccagcuaagagaagca

SEQ ID NO: 2501388 - RNA, 18 nt, Chlamydia trachomatis
ucacguagacgauccgcu

SEQ ID NO: 2501389 - RNA, 12 nt, Chlamydia trachomatis
ucacuaauauag

SEQ ID NO: 2501390 - RNA, 22 nt, Chlamydia trachomatis
ucacuaggcucaugagccucua

SEQ ID NO: 2501391 - RNA, 13 nt, Chlamydia trachomatis
ucacuauccaaag

SEQ ID NO: 2501392 - RNA, 20 nt, Chlamydia trachomatis
ucacuaugaacaaacagcug

SEQ ID NO: 2501393 - RNA, 14 nt, Chlamydia trachomatis
ucacucgcacacga

SEQ ID NO: 2501394 - RNA, 22 nt, Chlamydia trachomatis
ucacugacuguagaaaaucaua

SEQ ID NO: 2501395 - RNA, 23 nt, Chlamydia trachomatis
ucacugagaggaguuuuuuucac

SEQ ID NO: 2501396 - RNA, 19 nt, Chlamydia trachomatis
ucacugcaacuaauauuag

SEQ ID NO: 2501397 - RNA, 13 nt, Chlamydia trachomatis
ucacuugaaucac

SEQ ID NO: 2501398 - RNA, 22 nt, Chlamydia trachomatis
ucacuuucccccaccuuuucuc

SEQ ID NO: 2501399 - RNA, 13 nt, Chlamydia trachomatis
ucacuuucugcuu

SEQ ID NO: 2501400 - RNA, 23 nt, Chlamydia trachomatis
ucacuuuucuagcagccucucuu

SEQ ID NO: 2501401 - RNA, 14 nt, Chlamydia trachomatis
ucagaaaacuuagc

SEQ ID NO: 2501402 - RNA, 14 nt, Chlamydia trachomatis
ucagaacaagugca

SEQ ID NO: 2501403 - RNA, 16 nt, Chlamydia trachomatis
ucagaacaagugcagc

SEQ ID NO: 2501404 - RNA, 15 nt, Chlamydia trachomatis
ucagaacucaaaaua

SEQ ID NO: 2501405 - RNA, 16 nt, Chlamydia trachomatis
ucagaacucaaaauaa

SEQ ID NO: 2501406 - RNA, 23 nt, Chlamydia trachomatis
ucagaacucaaaauaaagaaauu

SEQ ID NO: 2501407 - RNA, 12 nt, Chlamydia trachomatis
ucagaagaagag

SEQ ID NO: 2501408 - RNA, 23 nt, Chlamydia trachomatis
ucagaagaggcaaaaaucugcaa

SEQ ID NO: 2501409 - RNA, 13 nt, Chlamydia trachomatis
ucagaagcuauuc

SEQ ID NO: 2501410 - RNA, 16 nt, Chlamydia trachomatis
ucagaauuacccugaa

SEQ ID NO: 2501411 - RNA, 15 nt, Chlamydia trachomatis
ucagaccuacaaaga

SEQ ID NO: 2501412 - RNA, 17 nt, Chlamydia trachomatis
ucagaccuuuuguuuuu

SEQ ID NO: 2501413 - RNA, 18 nt, Chlamydia trachomatis
ucagagaaaauuucucuu

SEQ ID NO: 2501414 - RNA, 19 nt, Chlamydia trachomatis
ucagagaaaauuucucuuc

SEQ ID NO: 2501415 - RNA, 18 nt, Chlamydia trachomatis
ucagagaucccugucaua

SEQ ID NO: 2501416 - RNA, 19 nt, Chlamydia trachomatis
ucagagcuuugcagauccc

SEQ ID NO: 2501417 - RNA, 18 nt, Chlamydia trachomatis
ucagagggacgagcagcc

SEQ ID NO: 2501418 - RNA, 13 nt, Chlamydia trachomatis
ucagaugccaucc

SEQ ID NO: 2501419 - RNA, 15 nt, Chlamydia trachomatis
ucagcaaaaagagga

SEQ ID NO: 2501420 - RNA, 21 nt, Chlamydia trachomatis
ucagcaaaaagaggagaacau

SEQ ID NO: 2501421 - RNA, 24 nt, Chlamydia trachomatis
ucagcaaauguggauagcaacgaa

SEQ ID NO: 2501422 - RNA, 15 nt, Chlamydia trachomatis
ucagcaagauucucc

SEQ ID NO: 2501423 - RNA, 11 nt, Chlamydia trachomatis
ucagcaauaau

SEQ ID NO: 2501424 - RNA, 13 nt, Chlamydia trachomatis
ucagcaauaauac

SEQ ID NO: 2501425 - RNA, 21 nt, Chlamydia trachomatis
ucagcagauauggaagaacag

SEQ ID NO: 2501426 - RNA, 16 nt, Chlamydia trachomatis
ucagcaucaauaaugg

SEQ ID NO: 2501427 - RNA, 13 nt, Chlamydia trachomatis
ucagccccaaaaa

SEQ ID NO: 2501428 - RNA, 20 nt, Chlamydia trachomatis
ucagccgaugcccaagaaac

SEQ ID NO: 2501429 - RNA, 21 nt, Chlamydia trachomatis
ucagccgaugcccaagaaacu

SEQ ID NO: 2501430 - RNA, 17 nt, Chlamydia trachomatis
ucagcgcucauaggaca

SEQ ID NO: 2501431 - RNA, 15 nt, Chlamydia trachomatis
ucagcgguugccuua

SEQ ID NO: 2501432 - RNA, 17 nt, Chlamydia trachomatis
ucagcuguacgauggaa

SEQ ID NO: 2501433 - RNA, 16 nt, Chlamydia trachomatis
ucagcuguuccuuuua

SEQ ID NO: 2501434 - RNA, 13 nt, Chlamydia trachomatis
ucagcuucaaccu

SEQ ID NO: 2501435 - RNA, 12 nt, Chlamydia trachomatis
ucagcuucaacu

SEQ ID NO: 2501436 - RNA, 13 nt, Chlamydia trachomatis
ucagcuucaacug

SEQ ID NO: 2501437 - RNA, 14 nt, Chlamydia trachomatis
ucagcuuuuccaca

SEQ ID NO: 2501438 - RNA, 18 nt, Chlamydia trachomatis
ucaggagaguguuugcau

SEQ ID NO: 2501439 - RNA, 15 nt, Chlamydia trachomatis
ucaggagcaugaauc

SEQ ID NO: 2501440 - RNA, 17 nt, Chlamydia trachomatis
ucaggagcaugaaucag

SEQ ID NO: 2501441 - RNA, 18 nt, Chlamydia trachomatis
ucaggagcaugaaucagc

SEQ ID NO: 2501442 - RNA, 22 nt, Chlamydia trachomatis
ucaggaucagcauguacuucgc

SEQ ID NO: 2501443 - RNA, 16 nt, Chlamydia trachomatis
ucaggauuggaaaauc

SEQ ID NO: 2501444 - RNA, 14 nt, Chlamydia trachomatis
ucaggcucuuucag

SEQ ID NO: 2501445 - RNA, 20 nt, Chlamydia trachomatis
ucaggggaucuguaccgaac

SEQ ID NO: 2501446 - RNA, 12 nt, Chlamydia trachomatis
ucaggugaucuc

SEQ ID NO: 2501447 - RNA, 17 nt, Chlamydia trachomatis
ucagguuauccaaauaa

SEQ ID NO: 2501448 - RNA, 18 nt, Chlamydia trachomatis
ucagguugcuugaauaag

SEQ ID NO: 2501449 - RNA, 12 nt, Chlamydia trachomatis
ucagguuugcau

SEQ ID NO: 2501450 - RNA, 16 nt, Chlamydia trachomatis
ucagucgcucugccug

SEQ ID NO: 2501451 - RNA, 17 nt, Chlamydia trachomatis
ucaguggaacugcuucc

SEQ ID NO: 2501452 - RNA, 14 nt, Chlamydia trachomatis
ucaguuaggaaaug

SEQ ID NO: 2501453 - RNA, 17 nt, Chlamydia trachomatis
ucaguugcuccuccgug

SEQ ID NO: 2501454 - RNA, 22 nt, Chlamydia trachomatis
ucaguuugaaucacagaaacuu

SEQ ID NO: 2501455 - RNA, 13 nt, Chlamydia trachomatis
ucauaaaaaagac

SEQ ID NO: 2501456 - RNA, 16 nt, Chlamydia trachomatis
ucauaaaggaaagggc

SEQ ID NO: 2501457 - RNA, 23 nt, Chlamydia trachomatis
ucauaagcagggcuguauucauc

SEQ ID NO: 2501458 - RNA, 16 nt, Chlamydia trachomatis
ucauaauaguccuacu

SEQ ID NO: 2501459 - RNA, 13 nt, Chlamydia trachomatis
ucauaauccgcgu

SEQ ID NO: 2501460 - RNA, 20 nt, Chlamydia trachomatis
ucauaauuaaagguuuccca

SEQ ID NO: 2501461 - RNA, 21 nt, Chlamydia trachomatis
ucauaauuaaagguuucccaa

SEQ ID NO: 2501462 - RNA, 23 nt, Chlamydia trachomatis
ucauacgagccuguuucuuauca

SEQ ID NO: 2501463 - RNA, 14 nt, Chlamydia trachomatis
ucauagaaaugaug

SEQ ID NO: 2501464 - RNA, 22 nt, Chlamydia trachomatis
ucauagauugugguuagaaauu

SEQ ID NO: 2501465 - RNA, 14 nt, Chlamydia trachomatis
ucauagcuucuaau

SEQ ID NO: 2501466 - RNA, 14 nt, Chlamydia trachomatis
ucauaggaauguau

SEQ ID NO: 2501467 - RNA, 13 nt, Chlamydia trachomatis
ucauaggcuccug

SEQ ID NO: 2501468 - RNA, 17 nt, Chlamydia trachomatis
ucauaguauaacgauua

SEQ ID NO: 2501469 - RNA, 18 nt, Chlamydia trachomatis
ucauagucugauccauuu

SEQ ID NO: 2501470 - RNA, 17 nt, Chlamydia trachomatis
ucauauuccaaagaaau

SEQ ID NO: 2501471 - RNA, 16 nt, Chlamydia trachomatis
ucauauucuuugucac

SEQ ID NO: 2501472 - RNA, 15 nt, Chlamydia trachomatis
ucaucaaaauauuuu

SEQ ID NO: 2501473 - RNA, 15 nt, Chlamydia trachomatis
ucaucauggaaaaua

SEQ ID NO: 2501474 - RNA, 16 nt, Chlamydia trachomatis
ucaucauggaaaauau

SEQ ID NO: 2501475 - RNA, 14 nt, Chlamydia trachomatis
ucauccuuggcuuu

SEQ ID NO: 2501476 - RNA, 22 nt, Chlamydia trachomatis
ucauccuuuuggaagaucucuu

SEQ ID NO: 2501477 - RNA, 13 nt, Chlamydia trachomatis
ucaucgaaaacaa

SEQ ID NO: 2501478 - RNA, 21 nt, Chlamydia trachomatis
ucaucgagaagaucuuuccuu

SEQ ID NO: 2501479 - RNA, 22 nt, Chlamydia trachomatis
ucaucgagaagaucuuuccuug

SEQ ID NO: 2501480 - RNA, 19 nt, Chlamydia trachomatis
ucaucgaugauaucuucug

SEQ ID NO: 2501481 - RNA, 21 nt, Chlamydia trachomatis
ucaucgaugauaucuucugaa

SEQ ID NO: 2501482 - RNA, 23 nt, Chlamydia trachomatis
ucaucuauaggaugguauucgcu

SEQ ID NO: 2501483 - RNA, 21 nt, Chlamydia trachomatis
ucaucucucagcagaucaucc

SEQ ID NO: 2501484 - RNA, 16 nt, Chlamydia trachomatis
ucaucugguauucuaa

SEQ ID NO: 2501485 - RNA, 17 nt, Chlamydia trachomatis
ucaucugguauucuaaa

SEQ ID NO: 2501486 - RNA, 22 nt, Chlamydia trachomatis
ucaucuucccaagacucaauca

SEQ ID NO: 2501487 - RNA, 18 nt, Chlamydia trachomatis
ucaucuuuugccuauaga

SEQ ID NO: 2501488 - RNA, 20 nt, Chlamydia trachomatis
ucaugagccucuaacucuuc

SEQ ID NO: 2501489 - RNA, 22 nt, Chlamydia trachomatis
ucaugcaaaggauaaauauuuu

SEQ ID NO: 2501490 - RNA, 14 nt, Chlamydia trachomatis
ucaugcaaguaauu

SEQ ID NO: 2501491 - RNA, 13 nt, Chlamydia trachomatis
ucaugcaccaacu

SEQ ID NO: 2501492 - RNA, 14 nt, Chlamydia trachomatis
ucaugcaccaacuu

SEQ ID NO: 2501493 - RNA, 16 nt, Chlamydia trachomatis
ucaugcagaugaagaa

SEQ ID NO: 2501494 - RNA, 21 nt, Chlamydia trachomatis
ucauggaaaauauggcuccca

SEQ ID NO: 2501495 - RNA, 16 nt, Chlamydia trachomatis
ucauggaauaguugca

SEQ ID NO: 2501496 - RNA, 20 nt, Chlamydia trachomatis
ucaugucggccgacuaccug

SEQ ID NO: 2501497 - RNA, 18 nt, Chlamydia trachomatis
ucauguugcguuuguaag

SEQ ID NO: 2501498 - RNA, 18 nt, Chlamydia trachomatis
ucauuaaaggaauaauuu

SEQ ID NO: 2501499 - RNA, 19 nt, Chlamydia trachomatis
ucauuaggauuaaaaucca

SEQ ID NO: 2501500 - RNA, 14 nt, Chlamydia trachomatis
ucauuauccauaaa

SEQ ID NO: 2501501 - RNA, 20 nt, Chlamydia trachomatis
ucauuaucguucucuaaaga

SEQ ID NO: 2501502 - RNA, 16 nt, Chlamydia trachomatis
ucauuaucuucuucua

SEQ ID NO: 2501503 - RNA, 21 nt, Chlamydia trachomatis
ucauucaaaauccauucccag

SEQ ID NO: 2501504 - RNA, 16 nt, Chlamydia trachomatis
ucauugaaaucagaaa

SEQ ID NO: 2501505 - RNA, 19 nt, Chlamydia trachomatis
ucauugaaaucagaaacaa

SEQ ID NO: 2501506 - RNA, 18 nt, Chlamydia trachomatis
ucauugagcaaaaaaaga

SEQ ID NO: 2501507 - RNA, 18 nt, Chlamydia trachomatis
ucauugauucuaugagaa

SEQ ID NO: 2501508 - RNA, 12 nt, Chlamydia trachomatis
ucauuuaaaagu

SEQ ID NO: 2501509 - RNA, 12 nt, Chlamydia trachomatis
ucauuuaauaag

SEQ ID NO: 2501510 - RNA, 14 nt, Chlamydia trachomatis
ucauuuaauaaguu

SEQ ID NO: 2501511 - RNA, 20 nt, Chlamydia trachomatis
ucauuuaauaaguuuuucaa

SEQ ID NO: 2501512 - RNA, 15 nt, Chlamydia trachomatis
ucauuuuaauaagau

SEQ ID NO: 2501513 - RNA, 19 nt, Chlamydia trachomatis
ucauuuuauguaaauauuu

SEQ ID NO: 2501514 - RNA, 23 nt, Chlamydia trachomatis
ucauuuuauguaaauauuuugcc

SEQ ID NO: 2501515 - RNA, 14 nt, Chlamydia trachomatis
ucauuuuguauaaa

SEQ ID NO: 2501516 - RNA, 19 nt, Chlamydia trachomatis
ucauuuuucuguaauaagu

SEQ ID NO: 2501517 - RNA, 14 nt, Chlamydia trachomatis
uccaaaaaagaauc

SEQ ID NO: 2501518 - RNA, 23 nt, Chlamydia trachomatis
uccaaaaaagaaucuaaaaagcc

SEQ ID NO: 2501519 - RNA, 19 nt, Chlamydia trachomatis
uccaaaaauauggggccag

SEQ ID NO: 2501520 - RNA, 17 nt, Chlamydia trachomatis
uccaaaacaucccagca

SEQ ID NO: 2501521 - RNA, 14 nt, Chlamydia trachomatis
uccaaaaucuucaa

SEQ ID NO: 2501522 - RNA, 14 nt, Chlamydia trachomatis
uccaaagaauagaa

SEQ ID NO: 2501523 - RNA, 22 nt, Chlamydia trachomatis
uccaaagauauagguuccaucu

SEQ ID NO: 2501524 - RNA, 23 nt, Chlamydia trachomatis
uccaaagaugcuccuacaaaaua

SEQ ID NO: 2501525 - RNA, 18 nt, Chlamydia trachomatis
uccaaagcuuuaauaaua

SEQ ID NO: 2501526 - RNA, 22 nt, Chlamydia trachomatis
uccaaagcuuuaauaauaagag

SEQ ID NO: 2501527 - RNA, 14 nt, Chlamydia trachomatis
uccaaagguaacug

SEQ ID NO: 2501528 - RNA, 19 nt, Chlamydia trachomatis
uccaaaguacucagucaau

SEQ ID NO: 2501529 - RNA, 23 nt, Chlamydia trachomatis
uccaaauaggauccccacgacca

SEQ ID NO: 2501530 - RNA, 22 nt, Chlamydia trachomatis
uccaaauuucccucuucccgcc

SEQ ID NO: 2501531 - RNA, 22 nt, Chlamydia trachomatis
uccaaauuuuguuuaaucagug

SEQ ID NO: 2501532 - RNA, 15 nt, Chlamydia trachomatis
uccaacaagagagac

SEQ ID NO: 2501533 - RNA, 16 nt, Chlamydia trachomatis
uccaacaauuuucguu

SEQ ID NO: 2501534 - RNA, 13 nt, Chlamydia trachomatis
uccaagaaaaaua

SEQ ID NO: 2501535 - RNA, 21 nt, Chlamydia trachomatis
uccaagaaucaaaaaguucuc

SEQ ID NO: 2501536 - RNA, 15 nt, Chlamydia trachomatis
uccaagcacuccuca

SEQ ID NO: 2501537 - RNA, 15 nt, Chlamydia trachomatis
uccaaggaaaccaag

SEQ ID NO: 2501538 - RNA, 20 nt, Chlamydia trachomatis
uccaaggaauaaacagguaa

SEQ ID NO: 2501539 - RNA, 15 nt, Chlamydia trachomatis
uccaagggaggcggc

SEQ ID NO: 2501540 - RNA, 17 nt, Chlamydia trachomatis
uccaaguuuuguaaagu

SEQ ID NO: 2501541 - RNA, 16 nt, Chlamydia trachomatis
uccaauggaaauaaga

SEQ ID NO: 2501542 - RNA, 20 nt, Chlamydia trachomatis
uccacaacacgucuuaaagg

SEQ ID NO: 2501543 - RNA, 13 nt, Chlamydia trachomatis
uccacaagaagua

SEQ ID NO: 2501544 - RNA, 17 nt, Chlamydia trachomatis
uccacaaggagauauuu

SEQ ID NO: 2501545 - RNA, 19 nt, Chlamydia trachomatis
uccacacaacauaacucug

SEQ ID NO: 2501546 - RNA, 17 nt, Chlamydia trachomatis
uccacauuauucacacu

SEQ ID NO: 2501547 - RNA, 24 nt, Chlamydia trachomatis
uccaccagacuauuucuucuagau

SEQ ID NO: 2501548 - RNA, 23 nt, Chlamydia trachomatis
uccaccagcagucgcgcagcuuc

SEQ ID NO: 2501549 - RNA, 16 nt, Chlamydia trachomatis
uccaccguagaacaau

SEQ ID NO: 2501550 - RNA, 15 nt, Chlamydia trachomatis
uccaccguagauacu

SEQ ID NO: 2501551 - RNA, 13 nt, Chlamydia trachomatis
uccacgaagagca

SEQ ID NO: 2501552 - RNA, 16 nt, Chlamydia trachomatis
uccacgaauuuucucu

SEQ ID NO: 2501553 - RNA, 17 nt, Chlamydia trachomatis
uccacgaauuuucucuc

SEQ ID NO: 2501554 - RNA, 19 nt, Chlamydia trachomatis
uccacgaauuuucucucua

SEQ ID NO: 2501555 - RNA, 13 nt, Chlamydia trachomatis
uccacgcuauaga

SEQ ID NO: 2501556 - RNA, 19 nt, Chlamydia trachomatis
uccagaaacaggagaaaga

SEQ ID NO: 2501557 - RNA, 16 nt, Chlamydia trachomatis
uccagaagcacacagc

SEQ ID NO: 2501558 - RNA, 14 nt, Chlamydia trachomatis
uccagaagggaagu

SEQ ID NO: 2501559 - RNA, 20 nt, Chlamydia trachomatis
uccagagcaaauagaauaaa

SEQ ID NO: 2501560 - RNA, 22 nt, Chlamydia trachomatis
uccagagcauguguuucuggaa

SEQ ID NO: 2501561 - RNA, 23 nt, Chlamydia trachomatis
uccagagcauguguuucuggaaa

SEQ ID NO: 2501562 - RNA, 16 nt, Chlamydia trachomatis
uccagaggaaauauug

SEQ ID NO: 2501563 - RNA, 19 nt, Chlamydia trachomatis
uccagaguucauuuuuucu

SEQ ID NO: 2501564 - RNA, 16 nt, Chlamydia trachomatis
uccagcaucuuuucuu

SEQ ID NO: 2501565 - RNA, 21 nt, Chlamydia trachomatis
uccagcaucuuuucuuauaaa

SEQ ID NO: 2501566 - RNA, 19 nt, Chlamydia trachomatis
uccagccucuccagaaaaa

SEQ ID NO: 2501567 - RNA, 13 nt, Chlamydia trachomatis
uccagcgcacacu

SEQ ID NO: 2501568 - RNA, 14 nt, Chlamydia trachomatis
uccagcuucuccau

SEQ ID NO: 2501569 - RNA, 21 nt, Chlamydia trachomatis
uccaggagagucugcuacaaa

SEQ ID NO: 2501570 - RNA, 19 nt, Chlamydia trachomatis
uccaggagucucuagguau

SEQ ID NO: 2501571 - RNA, 18 nt, Chlamydia trachomatis
uccagggaaaagagcuag

SEQ ID NO: 2501572 - RNA, 16 nt, Chlamydia trachomatis
uccaguacugcuacaa

SEQ ID NO: 2501573 - RNA, 17 nt, Chlamydia trachomatis
uccagucuacagccucc

SEQ ID NO: 2501574 - RNA, 17 nt, Chlamydia trachomatis
uccaguucuggagcaac

SEQ ID NO: 2501575 - RNA, 22 nt, Chlamydia trachomatis
uccaguucuggagcaacaacca

SEQ ID NO: 2501576 - RNA, 22 nt, Chlamydia trachomatis
uccauaauuaaaggcucuguua

SEQ ID NO: 2501577 - RNA, 14 nt, Chlamydia trachomatis
uccauaauuucuag

SEQ ID NO: 2501578 - RNA, 23 nt, Chlamydia trachomatis
uccauacaucaucucucagcaga

SEQ ID NO: 2501579 - RNA, 14 nt, Chlamydia trachomatis
uccauacgcugcug

SEQ ID NO: 2501580 - RNA, 12 nt, Chlamydia trachomatis
uccauagugcca

SEQ ID NO: 2501581 - RNA, 20 nt, Chlamydia trachomatis
uccauaguuacaacuucagc

SEQ ID NO: 2501582 - RNA, 16 nt, Chlamydia trachomatis
uccauauauucagaag

SEQ ID NO: 2501583 - RNA, 13 nt, Chlamydia trachomatis
uccauaucuacag

SEQ ID NO: 2501584 - RNA, 19 nt, Chlamydia trachomatis
uccauauucuugcuaagaa

SEQ ID NO: 2501585 - RNA, 15 nt, Chlamydia trachomatis
uccaucaacuguucu

SEQ ID NO: 2501586 - RNA, 15 nt, Chlamydia trachomatis
uccaucauaaaaaga

SEQ ID NO: 2501587 - RNA, 11 nt, Chlamydia trachomatis
uccauccugcg

SEQ ID NO: 2501588 - RNA, 19 nt, Chlamydia trachomatis
uccauccugcguguacauu

SEQ ID NO: 2501589 - RNA, 22 nt, Chlamydia trachomatis
uccaucuaaaggcaacucucuc

SEQ ID NO: 2501590 - RNA, 15 nt, Chlamydia trachomatis
uccaucuaaagggag

SEQ ID NO: 2501591 - RNA, 17 nt, Chlamydia trachomatis
uccaucuaaagggagaa

SEQ ID NO: 2501592 - RNA, 20 nt, Chlamydia trachomatis
uccaucucuccggagaacag

SEQ ID NO: 2501593 - RNA, 14 nt, Chlamydia trachomatis
uccaucucugcuuc

SEQ ID NO: 2501594 - RNA, 18 nt, Chlamydia trachomatis
uccaucugacuuuuuagc

SEQ ID NO: 2501595 - RNA, 16 nt, Chlamydia trachomatis
uccaucuugacuuccc

SEQ ID NO: 2501596 - RNA, 19 nt, Chlamydia trachomatis
uccaucuuuaaagaggauc

SEQ ID NO: 2501597 - RNA, 22 nt, Chlamydia trachomatis
uccaugaagacccguuuucucu

SEQ ID NO: 2501598 - RNA, 23 nt, Chlamydia trachomatis
uccaugaagacccguuuucucuu

SEQ ID NO: 2501599 - RNA, 20 nt, Chlamydia trachomatis
uccaugauccccuacgcuac

SEQ ID NO: 2501600 - RNA, 16 nt, Chlamydia trachomatis
uccaugaucucugcag

SEQ ID NO: 2501601 - RNA, 22 nt, Chlamydia trachomatis
uccaugaucucugcagaagaag

SEQ ID NO: 2501602 - RNA, 23 nt, Chlamydia trachomatis
uccaugauuucuuuaacaucuuu

SEQ ID NO: 2501603 - RNA, 23 nt, Chlamydia trachomatis
uccauggcaauggcuaagccauu

SEQ ID NO: 2501604 - RNA, 13 nt, Chlamydia trachomatis
uccauguauucuc

SEQ ID NO: 2501605 - RNA, 18 nt, Chlamydia trachomatis
uccauucgcauuaaauaa

SEQ ID NO: 2501606 - RNA, 15 nt, Chlamydia trachomatis
uccauugauagguac

SEQ ID NO: 2501607 - RNA, 15 nt, Chlamydia trachomatis
uccauugcaggagau

SEQ ID NO: 2501608 - RNA, 16 nt, Chlamydia trachomatis
uccauugcaggagauc

SEQ ID NO: 2501609 - RNA, 14 nt, Chlamydia trachomatis
uccauuuccagaac

SEQ ID NO: 2501610 - RNA, 15 nt, Chlamydia trachomatis
ucccaaaucaaacca

SEQ ID NO: 2501611 - RNA, 17 nt, Chlamydia trachomatis
ucccaaaucaaaccaaa

SEQ ID NO: 2501612 - RNA, 18 nt, Chlamydia trachomatis
ucccaagaaacuuuucug

SEQ ID NO: 2501613 - RNA, 19 nt, Chlamydia trachomatis
ucccacaaacaaaaaagaa

SEQ ID NO: 2501614 - RNA, 16 nt, Chlamydia trachomatis
ucccacaacuugcguu

SEQ ID NO: 2501615 - RNA, 15 nt, Chlamydia trachomatis
ucccaccuuaaaugc

SEQ ID NO: 2501616 - RNA, 23 nt, Chlamydia trachomatis
ucccacucuuccccuucuuuaua

SEQ ID NO: 2501617 - RNA, 11 nt, Chlamydia trachomatis
ucccagagaau

SEQ ID NO: 2501618 - RNA, 18 nt, Chlamydia trachomatis
ucccagagaaucuuaaac

SEQ ID NO: 2501619 - RNA, 19 nt, Chlamydia trachomatis
ucccagagaaucuuaaaca

SEQ ID NO: 2501620 - RNA, 18 nt, Chlamydia trachomatis
ucccaggaucccucuguc

SEQ ID NO: 2501621 - RNA, 15 nt, Chlamydia trachomatis
ucccagugaugaaau

SEQ ID NO: 2501622 - RNA, 20 nt, Chlamydia trachomatis
ucccaguuaggcauuccuuu

SEQ ID NO: 2501623 - RNA, 13 nt, Chlamydia trachomatis
ucccaguuauaac

SEQ ID NO: 2501624 - RNA, 18 nt, Chlamydia trachomatis
ucccauaaaagccauagc

SEQ ID NO: 2501625 - RNA, 14 nt, Chlamydia trachomatis
ucccauacaaaagc

SEQ ID NO: 2501626 - RNA, 15 nt, Chlamydia trachomatis
ucccauagcuucuua

SEQ ID NO: 2501627 - RNA, 18 nt, Chlamydia trachomatis
ucccaucuugcacauuuu

SEQ ID NO: 2501628 - RNA, 13 nt, Chlamydia trachomatis
ucccauggcaguu

SEQ ID NO: 2501629 - RNA, 20 nt, Chlamydia trachomatis
ucccauucugcguuuaauuc

SEQ ID NO: 2501630 - RNA, 18 nt, Chlamydia trachomatis
uccccaaagucaucgcua

SEQ ID NO: 2501631 - RNA, 20 nt, Chlamydia trachomatis
uccccacgaccacaaacaau

SEQ ID NO: 2501632 - RNA, 18 nt, Chlamydia trachomatis
uccccagaagccauaaua

SEQ ID NO: 2501633 - RNA, 15 nt, Chlamydia trachomatis
uccccagucucucca

SEQ ID NO: 2501634 - RNA, 20 nt, Chlamydia trachomatis
uccccagucucuccaucgcu

SEQ ID NO: 2501635 - RNA, 14 nt, Chlamydia trachomatis
uccccauucuucuc

SEQ ID NO: 2501636 - RNA, 15 nt, Chlamydia trachomatis
uccccauucuucucg

SEQ ID NO: 2501637 - RNA, 13 nt, Chlamydia trachomatis
uccccccgaccuu

SEQ ID NO: 2501638 - RNA, 18 nt, Chlamydia trachomatis
uccccgauauaucuguaa

SEQ ID NO: 2501639 - RNA, 20 nt, Chlamydia trachomatis
ucccgaacuuuauuauugaa

SEQ ID NO: 2501640 - RNA, 16 nt, Chlamydia trachomatis
ucccgauuacuugaga

SEQ ID NO: 2501641 - RNA, 23 nt, Chlamydia trachomatis
ucccgcguaguguagucagaaga

SEQ ID NO: 2501642 - RNA, 19 nt, Chlamydia trachomatis
ucccgcuauuuuccucuuc

SEQ ID NO: 2501643 - RNA, 18 nt, Chlamydia trachomatis
ucccguuuuucacaagac

SEQ ID NO: 2501644 - RNA, 14 nt, Chlamydia trachomatis
ucccuaagaucucu

SEQ ID NO: 2501645 - RNA, 17 nt, Chlamydia trachomatis
ucccuaauacaaucagu

SEQ ID NO: 2501646 - RNA, 22 nt, Chlamydia trachomatis
ucccuaccuaaagggugcacaa

SEQ ID NO: 2501647 - RNA, 16 nt, Chlamydia trachomatis
ucccuagaaaaucuau

SEQ ID NO: 2501648 - RNA, 13 nt, Chlamydia trachomatis
ucccuccaaaaaa

SEQ ID NO: 2501649 - RNA, 17 nt, Chlamydia trachomatis
ucccucguaauaacuga

SEQ ID NO: 2501650 - RNA, 14 nt, Chlamydia trachomatis
ucccucuagcaacc

SEQ ID NO: 2501651 - RNA, 20 nt, Chlamydia trachomatis
ucccucuguccauucuaagg

SEQ ID NO: 2501652 - RNA, 23 nt, Chlamydia trachomatis
ucccugcaauuuacuaucaggaa

SEQ ID NO: 2501653 - RNA, 14 nt, Chlamydia trachomatis
ucccugucauacca

SEQ ID NO: 2501654 - RNA, 17 nt, Chlamydia trachomatis
ucccugucauaccaaga

SEQ ID NO: 2501655 - RNA, 22 nt, Chlamydia trachomatis
ucccugugucucgguuuucuuu

SEQ ID NO: 2501656 - RNA, 23 nt, Chlamydia trachomatis
ucccugugucucgguuuucuuua

SEQ ID NO: 2501657 - RNA, 13 nt, Chlamydia trachomatis
ucccuuagcaaca

SEQ ID NO: 2501658 - RNA, 16 nt, Chlamydia trachomatis
ucccuuagcaacaguc

SEQ ID NO: 2501659 - RNA, 22 nt, Chlamydia trachomatis
ucccuuuccauacaucaucucu

SEQ ID NO: 2501660 - RNA, 16 nt, Chlamydia trachomatis
ucccuuuuucaagaaa

SEQ ID NO: 2501661 - RNA, 16 nt, Chlamydia trachomatis
uccgaauaaguccaca

SEQ ID NO: 2501662 - RNA, 19 nt, Chlamydia trachomatis
uccgaauucuucuccuaua

SEQ ID NO: 2501663 - RNA, 21 nt, Chlamydia trachomatis
uccgaguaaucaaaaaaggaa

SEQ ID NO: 2501664 - RNA, 23 nt, Chlamydia trachomatis
uccgauaaacguuuggaaauccu

SEQ ID NO: 2501665 - RNA, 15 nt, Chlamydia trachomatis
uccgauagcaugcaa

SEQ ID NO: 2501666 - RNA, 17 nt, Chlamydia trachomatis
uccgauagcaugcaaaa

SEQ ID NO: 2501667 - RNA, 17 nt, Chlamydia trachomatis
uccgauccaaggagcuc

SEQ ID NO: 2501668 - RNA, 17 nt, Chlamydia trachomatis
uccgcaaacaaaauaau

SEQ ID NO: 2501669 - RNA, 11 nt, Chlamydia trachomatis
uccgcagagau

SEQ ID NO: 2501670 - RNA, 13 nt, Chlamydia trachomatis
uccgcagcaugaa

SEQ ID NO: 2501671 - RNA, 21 nt, Chlamydia trachomatis
uccgcaguaaaaucuaaaaua

SEQ ID NO: 2501672 - RNA, 15 nt, Chlamydia trachomatis
uccgccaacuauuga

SEQ ID NO: 2501673 - RNA, 16 nt, Chlamydia trachomatis
uccgccuccggcuccc

SEQ ID NO: 2501674 - RNA, 19 nt, Chlamydia trachomatis
uccgcuccccuuccuguuc

SEQ ID NO: 2501675 - RNA, 14 nt, Chlamydia trachomatis
uccgcuccuucuuu

SEQ ID NO: 2501676 - RNA, 16 nt, Chlamydia trachomatis
uccgcugauuagaaag

SEQ ID NO: 2501677 - RNA, 17 nt, Chlamydia trachomatis
uccgcugcaaucucuug

SEQ ID NO: 2501678 - RNA, 14 nt, Chlamydia trachomatis
uccgcuuaaaacua

SEQ ID NO: 2501679 - RNA, 17 nt, Chlamydia trachomatis
uccggaagauacagccu

SEQ ID NO: 2501680 - RNA, 14 nt, Chlamydia trachomatis
uccggaauuuuaag

SEQ ID NO: 2501681 - RNA, 13 nt, Chlamydia trachomatis
uccggacuuuccu

SEQ ID NO: 2501682 - RNA, 22 nt, Chlamydia trachomatis
uccggagaacaguguccuucca

SEQ ID NO: 2501683 - RNA, 23 nt, Chlamydia trachomatis
uccggagaacaguguccuuccau

SEQ ID NO: 2501684 - RNA, 17 nt, Chlamydia trachomatis
uccggaucaauccccaa

SEQ ID NO: 2501685 - RNA, 16 nt, Chlamydia trachomatis
uccgguucucuuggcu

SEQ ID NO: 2501686 - RNA, 15 nt, Chlamydia trachomatis
uccgguucuuuugua

SEQ ID NO: 2501687 - RNA, 23 nt, Chlamydia trachomatis
uccguaaaagucucuaaagcuuu

SEQ ID NO: 2501688 - RNA, 20 nt, Chlamydia trachomatis
uccguaaugaucagcaaaaa

SEQ ID NO: 2501689 - RNA, 13 nt, Chlamydia trachomatis
uccguaguccaca

SEQ ID NO: 2501690 - RNA, 23 nt, Chlamydia trachomatis
uccguuguagagauaaaaucagc

SEQ ID NO: 2501691 - RNA, 14 nt, Chlamydia trachomatis
uccguuucuagaag

SEQ ID NO: 2501692 - RNA, 14 nt, Chlamydia trachomatis
uccuaaaaaaaacc

SEQ ID NO: 2501693 - RNA, 19 nt, Chlamydia trachomatis
uccuaaacaaaaacucuca

SEQ ID NO: 2501694 - RNA, 12 nt, Chlamydia trachomatis
uccuaaacaaau

SEQ ID NO: 2501695 - RNA, 14 nt, Chlamydia trachomatis
uccuaaaggaagau

SEQ ID NO: 2501696 - RNA, 19 nt, Chlamydia trachomatis
uccuaaaggaagauuccuu

SEQ ID NO: 2501697 - RNA, 21 nt, Chlamydia trachomatis
uccuaaaguaagauuuuucag

SEQ ID NO: 2501698 - RNA, 16 nt, Chlamydia trachomatis
uccuaaauuauaauga

SEQ ID NO: 2501699 - RNA, 12 nt, Chlamydia trachomatis
uccuaacaaagc

SEQ ID NO: 2501700 - RNA, 13 nt, Chlamydia trachomatis
uccuaacuaaaaa

SEQ ID NO: 2501701 - RNA, 13 nt, Chlamydia trachomatis
uccuaauacuaaa

SEQ ID NO: 2501702 - RNA, 16 nt, Chlamydia trachomatis
uccuaauacuaaacua

SEQ ID NO: 2501703 - RNA, 20 nt, Chlamydia trachomatis
uccuaauguagaaauuuuaa

SEQ ID NO: 2501704 - RNA, 14 nt, Chlamydia trachomatis
uccuaauuuaaaau

SEQ ID NO: 2501705 - RNA, 20 nt, Chlamydia trachomatis
uccuaccaauauucccugua

SEQ ID NO: 2501706 - RNA, 14 nt, Chlamydia trachomatis
uccuacucaauccu

SEQ ID NO: 2501707 - RNA, 20 nt, Chlamydia trachomatis
uccuacucggccagagcuca

SEQ ID NO: 2501708 - RNA, 18 nt, Chlamydia trachomatis
uccuagaaagaaccacaa

SEQ ID NO: 2501709 - RNA, 17 nt, Chlamydia trachomatis
uccuagcagcuaauacu

SEQ ID NO: 2501710 - RNA, 21 nt, Chlamydia trachomatis
uccuaggauuacuuuuucuac

SEQ ID NO: 2501711 - RNA, 22 nt, Chlamydia trachomatis
uccuaggggauuuuaugaagca

SEQ ID NO: 2501712 - RNA, 14 nt, Chlamydia trachomatis
gagcuuugaucuuu

SEQ ID NO: 2501713 - RNA, 21 nt, Chlamydia trachomatis
gagcuuugauuaaccaaaaga

SEQ ID NO: 2501714 - RNA, 22 nt, Chlamydia trachomatis
gagcuuuuuuuuucagcaauaa

SEQ ID NO: 2501715 - RNA, 17 nt, Chlamydia trachomatis
gaggaaauauugaucuc

SEQ ID NO: 2501716 - RNA, 19 nt, Chlamydia trachomatis
gaggaacccuuuguaguua

SEQ ID NO: 2501717 - RNA, 15 nt, Chlamydia trachomatis
gaggaagagagaaca

SEQ ID NO: 2501718 - RNA, 22 nt, Chlamydia trachomatis
gaggaauaagaggacuuucuuu

SEQ ID NO: 2501719 - RNA, 16 nt, Chlamydia trachomatis
gaggaauacuagauuu

SEQ ID NO: 2501720 - RNA, 14 nt, Chlamydia trachomatis
gaggaauauuaaac

SEQ ID NO: 2501721 - RNA, 14 nt, Chlamydia trachomatis
gaggaaugugaaga

SEQ ID NO: 2501722 - RNA, 15 nt, Chlamydia trachomatis
gaggacuuucuuuaa

SEQ ID NO: 2501723 - RNA, 12 nt, Chlamydia trachomatis
gaggagaggcua

SEQ ID NO: 2501724 - RNA, 18 nt, Chlamydia trachomatis
gaggagcuugagagcauu

SEQ ID NO: 2501725 - RNA, 15 nt, Chlamydia trachomatis
gaggaguucccguua

SEQ ID NO: 2501726 - RNA, 19 nt, Chlamydia trachomatis
gaggauccuaaccaaaaaa

SEQ ID NO: 2501727 - RNA, 14 nt, Chlamydia trachomatis
gaggaucuccagaa

SEQ ID NO: 2501728 - RNA, 21 nt, Chlamydia trachomatis
gaggauguggacgaacaaaaa

SEQ ID NO: 2501729 - RNA, 22 nt, Chlamydia trachomatis
gaggauuauuccgagagaagcu

SEQ ID NO: 2501730 - RNA, 17 nt, Chlamydia trachomatis
gaggauuccaagggaga

SEQ ID NO: 2501731 - RNA, 20 nt, Chlamydia trachomatis
gaggauucgguaucugagcu

SEQ ID NO: 2501732 - RNA, 15 nt, Chlamydia trachomatis
gaggcacaaaauccc

SEQ ID NO: 2501733 - RNA, 15 nt, Chlamydia trachomatis
gaggcagucucugag

SEQ ID NO: 2501734 - RNA, 21 nt, Chlamydia trachomatis
gaggcagucucugaggcaaag

SEQ ID NO: 2501735 - RNA, 23 nt, Chlamydia trachomatis
gaggcagugguuaacaggcuucc

SEQ ID NO: 2501736 - RNA, 17 nt, Chlamydia trachomatis
gaggcaugauuuccuga

SEQ ID NO: 2501737 - RNA, 17 nt, Chlamydia trachomatis
gaggccuccauuuccau

SEQ ID NO: 2501738 - RNA, 15 nt, Chlamydia trachomatis
gaggcgaaaguuucc

SEQ ID NO: 2501739 - RNA, 23 nt, Chlamydia trachomatis
gaggcuccgccuucugcaaugag

SEQ ID NO: 2501740 - RNA, 21 nt, Chlamydia trachomatis
gaggcuuaaagauaacacucu

SEQ ID NO: 2501741 - RNA, 18 nt, Chlamydia trachomatis
gaggcuuuguccuggcca

SEQ ID NO: 2501742 - RNA, 15 nt, Chlamydia trachomatis
gagggacgagcagcc

SEQ ID NO: 2501743 - RNA, 18 nt, Chlamydia trachomatis
gagggauauuucuuccug

SEQ ID NO: 2501744 - RNA, 14 nt, Chlamydia trachomatis
gagggugaggucca

SEQ ID NO: 2501745 - RNA, 15 nt, Chlamydia trachomatis
gagguauguuuggau

SEQ ID NO: 2501746 - RNA, 16 nt, Chlamydia trachomatis
gagguauuuaggaacu

SEQ ID NO: 2501747 - RNA, 21 nt, Chlamydia trachomatis
gagguccaaaauuucagggaa

SEQ ID NO: 2501748 - RNA, 17 nt, Chlamydia trachomatis
gaggucugugcuauuug

SEQ ID NO: 2501749 - RNA, 18 nt, Chlamydia trachomatis
gaggugugaauaggaaga

SEQ ID NO: 2501750 - RNA, 18 nt, Chlamydia trachomatis
gagguuguuacagucugu

SEQ ID NO: 2501751 - RNA, 16 nt, Chlamydia trachomatis
gaguaaucaaaaaagg

SEQ ID NO: 2501752 - RNA, 15 nt, Chlamydia trachomatis
gaguaauuccaaaua

SEQ ID NO: 2501753 - RNA, 19 nt, Chlamydia trachomatis
gaguaucuagacauagcuu

SEQ ID NO: 2501754 - RNA, 17 nt, Chlamydia trachomatis
gaguccauugcaggaga

SEQ ID NO: 2501755 - RNA, 16 nt, Chlamydia trachomatis
gaguccgcaaacaaaa

SEQ ID NO: 2501756 - RNA, 18 nt, Chlamydia trachomatis
gagucucuaacaacaguu

SEQ ID NO: 2501757 - RNA, 14 nt, Chlamydia trachomatis
gagucucugcaguc

SEQ ID NO: 2501758 - RNA, 22 nt, Chlamydia trachomatis
gagucugcuccaccuucuuugg

SEQ ID NO: 2501759 - RNA, 13 nt, Chlamydia trachomatis
gagucuucccuua

SEQ ID NO: 2501760 - RNA, 20 nt, Chlamydia trachomatis
gagugacuagccaauacgaa

SEQ ID NO: 2501761 - RNA, 16 nt, Chlamydia trachomatis
gagugcauagcuuguu

SEQ ID NO: 2501762 - RNA, 16 nt, Chlamydia trachomatis
gagugccgaauaauga

SEQ ID NO: 2501763 - RNA, 18 nt, Chlamydia trachomatis
gagugccgaauaaugauu

SEQ ID NO: 2501764 - RNA, 12 nt, Chlamydia trachomatis
gagugugcuucu

SEQ ID NO: 2501765 - RNA, 16 nt, Chlamydia trachomatis
gaguguguaguuaucu

SEQ ID NO: 2501766 - RNA, 12 nt, Chlamydia trachomatis
gaguguuuucug

SEQ ID NO: 2501767 - RNA, 17 nt, Chlamydia trachomatis
gaguucccguuaauggg

SEQ ID NO: 2501768 - RNA, 14 nt, Chlamydia trachomatis
gaguuccgaacaaa

SEQ ID NO: 2501769 - RNA, 15 nt, Chlamydia trachomatis
gaguuccgaacaaaa

SEQ ID NO: 2501770 - RNA, 10 nt, Chlamydia trachomatis
gaguucuccu

SEQ ID NO: 2501771 - RNA, 20 nt, Chlamydia trachomatis
gaguucuccucccagauuuu

SEQ ID NO: 2501772 - RNA, 23 nt, Chlamydia trachomatis
gaguuguagaaccacaaaccauc

SEQ ID NO: 2501773 - RNA, 17 nt, Chlamydia trachomatis
gaguuguuugggcugcu

SEQ ID NO: 2501774 - RNA, 20 nt, Chlamydia trachomatis
gaguuguuugggcugcugcu

SEQ ID NO: 2501775 - RNA, 22 nt, Chlamydia trachomatis
gaguuuguagauguagcagaau

SEQ ID NO: 2501776 - RNA, 19 nt, Chlamydia trachomatis
gauaaaaacucucuuccac

SEQ ID NO: 2501777 - RNA, 13 nt, Chlamydia trachomatis
gauaaaacccuaa

SEQ ID NO: 2501778 - RNA, 19 nt, Chlamydia trachomatis
gauaaaacccuaagacuau

SEQ ID NO: 2501779 - RNA, 18 nt, Chlamydia trachomatis
gauaaacagaucuaggau

SEQ ID NO: 2501780 - RNA, 24 nt, Chlamydia trachomatis
gauaaacucggguuuuaaaugcuu

SEQ ID NO: 2501781 - RNA, 14 nt, Chlamydia trachomatis
gauaaauaaucucg

SEQ ID NO: 2501782 - RNA, 16 nt, Chlamydia trachomatis
gauaaauaaucucguu

SEQ ID NO: 2501783 - RNA, 15 nt, Chlamydia trachomatis
gauaacaacaauaaa

SEQ ID NO: 2501784 - RNA, 13 nt, Chlamydia trachomatis
gauaacaaccauc

SEQ ID NO: 2501785 - RNA, 18 nt, Chlamydia trachomatis
gauaacaacucuccuaau

SEQ ID NO: 2501786 - RNA, 18 nt, Chlamydia trachomatis
gauaacacucucaucuaa

SEQ ID NO: 2501787 - RNA, 13 nt, Chlamydia trachomatis
gauaagaaaucuu

SEQ ID NO: 2501788 - RNA, 19 nt, Chlamydia trachomatis
gauaagaagguugaauuuc

SEQ ID NO: 2501789 - RNA, 14 nt, Chlamydia trachomatis
gauaagcucuagga

SEQ ID NO: 2501790 - RNA, 14 nt, Chlamydia trachomatis
gauaaggaggcuuc

SEQ ID NO: 2501791 - RNA, 17 nt, Chlamydia trachomatis
gauaagggaaucauaag

SEQ ID NO: 2501792 - RNA, 20 nt, Chlamydia trachomatis
gauaagggaaucauaaggaa

SEQ ID NO: 2501793 - RNA, 20 nt, Chlamydia trachomatis
gauaaguccaucuaaaggga

SEQ ID NO: 2501794 - RNA, 22 nt, Chlamydia trachomatis
gauaaguccaucuaaagggaga

SEQ ID NO: 2501795 - RNA, 16 nt, Chlamydia trachomatis
gauaauacucuucuau

SEQ ID NO: 2501796 - RNA, 17 nt, Chlamydia trachomatis
gauaauacucuucuauc

SEQ ID NO: 2501797 - RNA, 21 nt, Chlamydia trachomatis
gauaaucuuggacuuucuacc

SEQ ID NO: 2501798 - RNA, 23 nt, Chlamydia trachomatis
gauaaugccuuuugcacaaagga

SEQ ID NO: 2501799 - RNA, 18 nt, Chlamydia trachomatis
gauacaagacucacagca

SEQ ID NO: 2501800 - RNA, 19 nt, Chlamydia trachomatis
gauacaagacucacagcaa

SEQ ID NO: 2501801 - RNA, 17 nt, Chlamydia trachomatis
gauacaagagagaacaa

SEQ ID NO: 2501802 - RNA, 18 nt, Chlamydia trachomatis
gauaccaagccauuucca

SEQ ID NO: 2501803 - RNA, 19 nt, Chlamydia trachomatis
gauaccaagccauuuccag

SEQ ID NO: 2501804 - RNA, 22 nt, Chlamydia trachomatis
gauacgcauaugcgucuucccu

SEQ ID NO: 2501805 - RNA, 14 nt, Chlamydia trachomatis
gauacggacuucuu

SEQ ID NO: 2501806 - RNA, 19 nt, Chlamydia trachomatis
gauacucaacgucuugucu

SEQ ID NO: 2501807 - RNA, 21 nt, Chlamydia trachomatis
gauacuuuaccgcaaauaucc

SEQ ID NO: 2501808 - RNA, 11 nt, Chlamydia trachomatis
gauagaaaaaa

SEQ ID NO: 2501809 - RNA, 20 nt, Chlamydia trachomatis
gauagaaaaaaacagcucug

SEQ ID NO: 2501810 - RNA, 12 nt, Chlamydia trachomatis
gauagaaacucc

SEQ ID NO: 2501811 - RNA, 16 nt, Chlamydia trachomatis
gauagaauuucuuccu

SEQ ID NO: 2501812 - RNA, 19 nt, Chlamydia trachomatis
gauagaauuucuuccucua

SEQ ID NO: 2501813 - RNA, 13 nt, Chlamydia trachomatis
gauagacaagacu

SEQ ID NO: 2501814 - RNA, 16 nt, Chlamydia trachomatis
gauagagaagaauuga

SEQ ID NO: 2501815 - RNA, 15 nt, Chlamydia trachomatis
gauagagauuccacu

SEQ ID NO: 2501816 - RNA, 18 nt, Chlamydia trachomatis
gauagaggaaacacugua

SEQ ID NO: 2501817 - RNA, 19 nt, Chlamydia trachomatis
gauagaucuaaagcagaaa

SEQ ID NO: 2501818 - RNA, 20 nt, Chlamydia trachomatis
gauagcaacgaacuuuccau

SEQ ID NO: 2501819 - RNA, 12 nt, Chlamydia trachomatis
gauagcaacgag

SEQ ID NO: 2501820 - RNA, 15 nt, Chlamydia trachomatis
gauagcagcaguuuu

SEQ ID NO: 2501821 - RNA, 15 nt, Chlamydia trachomatis
gauagcaugcaaaac

SEQ ID NO: 2501822 - RNA, 21 nt, Chlamydia trachomatis
gauagccuccgcuaauuuuug

SEQ ID NO: 2501823 - RNA, 16 nt, Chlamydia trachomatis
gauaggaaaaagcuau

SEQ ID NO: 2501824 - RNA, 20 nt, Chlamydia trachomatis
gauaggaacuacauucgccu

SEQ ID NO: 2501825 - RNA, 13 nt, Chlamydia trachomatis
aaaaaaaaagagg

SEQ ID NO: 2501826 - RNA, 13 nt, Chlamydia trachomatis
aaaaaaaaccaaa

SEQ ID NO: 2501827 - RNA, 13 nt, Chlamydia trachomatis
aaaaaaaagaggg

SEQ ID NO: 2501828 - RNA, 18 nt, Chlamydia trachomatis
aaaaaaagagagcccuaa

SEQ ID NO: 2501829 - RNA, 19 nt, Chlamydia trachomatis
aaaaaaagagguauuuaga

SEQ ID NO: 2501830 - RNA, 21 nt, Chlamydia trachomatis
aaaaaaagaggucuuauuaaa

SEQ ID NO: 2501831 - RNA, 12 nt, Chlamydia trachomatis
aaaaaaagauac

SEQ ID NO: 2501832 - RNA, 12 nt, Chlamydia trachomatis
aaaaaacaaaac

SEQ ID NO: 2501833 - RNA, 23 nt, Chlamydia trachomatis
aaaaaagcuaugcgcggaaggaa

SEQ ID NO: 2501834 - RNA, 21 nt, Chlamydia trachomatis
aaaaaaggcuccccucuuuuu

SEQ ID NO: 2501835 - RNA, 17 nt, Chlamydia trachomatis
aaaaaaggucucucuuu

SEQ ID NO: 2501836 - RNA, 21 nt, Chlamydia trachomatis
aaaaaaguguaaucauuuucu

SEQ ID NO: 2501837 - RNA, 16 nt, Chlamydia trachomatis
aaaaaauccaccguag

SEQ ID NO: 2501838 - RNA, 22 nt, Chlamydia trachomatis
aaaaaauccaccguagaacaau

SEQ ID NO: 2501839 - RNA, 16 nt, Chlamydia trachomatis
aaaaaauguuuuugau

SEQ ID NO: 2501840 - RNA, 13 nt, Chlamydia trachomatis
aaaaacaaaacua

SEQ ID NO: 2501841 - RNA, 14 nt, Chlamydia trachomatis
aaaaacaacaauca

SEQ ID NO: 2501842 - RNA, 13 nt, Chlamydia trachomatis
aaaaacaaucaaa

SEQ ID NO: 2501843 - RNA, 20 nt, Chlamydia trachomatis
aaaaacaaugauauucuaau

SEQ ID NO: 2501844 - RNA, 13 nt, Chlamydia trachomatis
aaaaacagaaaga

SEQ ID NO: 2501845 - RNA, 11 nt, Chlamydia trachomatis
aaaaacagcag

SEQ ID NO: 2501846 - RNA, 16 nt, Chlamydia trachomatis
aaaaaccacagacuca

SEQ ID NO: 2501847 - RNA, 21 nt, Chlamydia trachomatis
aaaaaccaccuucugcaugca

SEQ ID NO: 2501848 - RNA, 17 nt, Chlamydia trachomatis
aaaaacuauaaggaauc

SEQ ID NO: 2501849 - RNA, 17 nt, Chlamydia trachomatis
aaaaacucucaaaucgu

SEQ ID NO: 2501850 - RNA, 17 nt, Chlamydia trachomatis
aaaaacuuuucuuccuc

SEQ ID NO: 2501851 - RNA, 13 nt, Chlamydia trachomatis
aaaaagaaaaaaa

SEQ ID NO: 2501852 - RNA, 14 nt, Chlamydia trachomatis
aaaaagaaaaaaag

SEQ ID NO: 2501853 - RNA, 14 nt, Chlamydia trachomatis
aaaaagaaauaacc

SEQ ID NO: 2501854 - RNA, 22 nt, Chlamydia trachomatis
aaaaagaacucccuccaaaaaa

SEQ ID NO: 2501855 - RNA, 23 nt, Chlamydia trachomatis
aaaaagaagcuuuucccuaggua

SEQ ID NO: 2501856 - RNA, 15 nt, Chlamydia trachomatis
aaaaagaaucuaaaa

SEQ ID NO: 2501857 - RNA, 20 nt, Chlamydia trachomatis
aaaaagaggaggucucccuc

SEQ ID NO: 2501858 - RNA, 21 nt, Chlamydia trachomatis
aaaaagaggucuuauuaaaag

SEQ ID NO: 2501859 - RNA, 13 nt, Chlamydia trachomatis
aaaaagaucuuca

SEQ ID NO: 2501860 - RNA, 19 nt, Chlamydia trachomatis
aaaaagaucuucaacaaga

SEQ ID NO: 2501861 - RNA, 18 nt, Chlamydia trachomatis
aaaaagauggagaggagu

SEQ ID NO: 2501862 - RNA, 17 nt, Chlamydia trachomatis
aaaaagauuuccccuuu

SEQ ID NO: 2501863 - RNA, 15 nt, Chlamydia trachomatis
aaaaagccauacaaa

SEQ ID NO: 2501864 - RNA, 23 nt, Chlamydia trachomatis
aaaaagccugugccuuucguuag

SEQ ID NO: 2501865 - RNA, 21 nt, Chlamydia trachomatis
aaaaagcugggcagcaagaga

SEQ ID NO: 2501866 - RNA, 23 nt, Chlamydia trachomatis
aaaaagcugggcagcaagagaga

SEQ ID NO: 2501867 - RNA, 21 nt, Chlamydia trachomatis
aaaaaggaaucuguccaaaga

SEQ ID NO: 2501868 - RNA, 18 nt, Chlamydia trachomatis
aaaaaggcauaaaagaga

SEQ ID NO: 2501869 - RNA, 21 nt, Chlamydia trachomatis
aaaaaggucucucuuuaugaa

SEQ ID NO: 2501870 - RNA, 19 nt, Chlamydia trachomatis
aaaaaguccgcuaauccau

SEQ ID NO: 2501871 - RNA, 21 nt, Chlamydia trachomatis
aaaaagucuguuccuaauacu

SEQ ID NO: 2501872 - RNA, 17 nt, Chlamydia trachomatis
aaaaaguuuggagcagc

SEQ ID NO: 2501873 - RNA, 14 nt, Chlamydia trachomatis
aaaaauaaaaauag

SEQ ID NO: 2501874 - RNA, 21 nt, Chlamydia trachomatis
aaaaauaaagaaauaaaaagc

SEQ ID NO: 2501875 - RNA, 13 nt, Chlamydia trachomatis
aaaaauacuucuu

SEQ ID NO: 2501876 - RNA, 13 nt, Chlamydia trachomatis
aaaaauacuugau

SEQ ID NO: 2501877 - RNA, 12 nt, Chlamydia trachomatis
aaaaaucacaau

SEQ ID NO: 2501878 - RNA, 15 nt, Chlamydia trachomatis
aaaaaucagcuugau

SEQ ID NO: 2501879 - RNA, 21 nt, Chlamydia trachomatis
aaaaaucagcuugauauuccc

SEQ ID NO: 2501880 - RNA, 23 nt, Chlamydia trachomatis
aaaaauccaccguagaacaaucu

SEQ ID NO: 2501881 - RNA, 16 nt, Chlamydia trachomatis
aaaaaucguccaaaau

SEQ ID NO: 2501882 - RNA, 20 nt, Chlamydia trachomatis
aaaaaucguccaaaaucauc

SEQ ID NO: 2501883 - RNA, 17 nt, Chlamydia trachomatis
aaaaaucugcaacaaau

SEQ ID NO: 2501884 - RNA, 11 nt, Chlamydia trachomatis
aaaaauguuuu

SEQ ID NO: 2501885 - RNA, 18 nt, Chlamydia trachomatis
aaaaauuagggaaaaacu

SEQ ID NO: 2501886 - RNA, 21 nt, Chlamydia trachomatis
aaaaauuagggaaaaacuuuu

SEQ ID NO: 2501887 - RNA, 14 nt, Chlamydia trachomatis
aaaaauuccauguu

SEQ ID NO: 2501888 - RNA, 14 nt, Chlamydia trachomatis
aaaaauuccucauu

SEQ ID NO: 2501889 - RNA, 15 nt, Chlamydia trachomatis
aaaaauugaaagaga

SEQ ID NO: 2501890 - RNA, 14 nt, Chlamydia trachomatis
aaaaauugcaaaga

SEQ ID NO: 2501891 - RNA, 19 nt, Chlamydia trachomatis
aaaaauuuggcaauggcaa

SEQ ID NO: 2501892 - RNA, 14 nt, Chlamydia trachomatis
aaaacaaacaauaa

SEQ ID NO: 2501893 - RNA, 12 nt, Chlamydia trachomatis
aaaacaaagagu

SEQ ID NO: 2501894 - RNA, 23 nt, Chlamydia trachomatis
aaaacaauuuccuuagaaagaau

SEQ ID NO: 2501895 - RNA, 13 nt, Chlamydia trachomatis
aaaacagaaagaa

SEQ ID NO: 2501896 - RNA, 14 nt, Chlamydia trachomatis
aaaacagccaagca

SEQ ID NO: 2501897 - RNA, 21 nt, Chlamydia trachomatis
aaaacauccaugucuaaggau

SEQ ID NO: 2501898 - RNA, 14 nt, Chlamydia trachomatis
aaaaccuuuugaaa

SEQ ID NO: 2501899 - RNA, 15 nt, Chlamydia trachomatis
aaaacgaaaaacaga

SEQ ID NO: 2501900 - RNA, 16 nt, Chlamydia trachomatis
aaaacgauaaaaagcu

SEQ ID NO: 2501901 - RNA, 18 nt, Chlamydia trachomatis
aaaacgcucagaaaacuu

SEQ ID NO: 2501902 - RNA, 19 nt, Chlamydia trachomatis
aaaacgcucagaaaacuua

SEQ ID NO: 2501903 - RNA, 15 nt, Chlamydia trachomatis
aaaacgcuccaaaua

SEQ ID NO: 2501904 - RNA, 17 nt, Chlamydia trachomatis
aaaacgcuccaaauaaa

SEQ ID NO: 2501905 - RNA, 22 nt, Chlamydia trachomatis
aaaacgcuccaaauaaaacgaa

SEQ ID NO: 2501906 - RNA, 14 nt, Chlamydia trachomatis
aaaacgcucuccaa

SEQ ID NO: 2501907 - RNA, 23 nt, Chlamydia trachomatis
aaaacgcucuccaaagaauagaa

SEQ ID NO: 2501908 - RNA, 22 nt, Chlamydia trachomatis
aaaacggucuauggcaaaaggu

SEQ ID NO: 2501909 - RNA, 20 nt, Chlamydia trachomatis
aaaacgguguuagaaaauac

SEQ ID NO: 2501910 - RNA, 15 nt, Chlamydia trachomatis
aaaacuccaagcacu

SEQ ID NO: 2501911 - RNA, 15 nt, Chlamydia trachomatis
aaaacuccagaaaau

SEQ ID NO: 2501912 - RNA, 21 nt, Chlamydia trachomatis
aaaacuugucuaaaagaauau

SEQ ID NO: 2501913 - RNA, 20 nt, Chlamydia trachomatis
aaaacuuucucgcaauauau

SEQ ID NO: 2501914 - RNA, 17 nt, Chlamydia trachomatis
aaaacuuugacaagcag

SEQ ID NO: 2501915 - RNA, 11 nt, Chlamydia trachomatis
aaaagaaaaaa

SEQ ID NO: 2501916 - RNA, 13 nt, Chlamydia trachomatis
aaaagaaagccuu

SEQ ID NO: 2501917 - RNA, 18 nt, Chlamydia trachomatis
aaaagaaagccuucucuu

SEQ ID NO: 2501918 - RNA, 23 nt, Chlamydia trachomatis
aaaagaacucccuccaaaaaaga

SEQ ID NO: 2501919 - RNA, 13 nt, Chlamydia trachomatis
aaaagaacuuccu

SEQ ID NO: 2501920 - RNA, 16 nt, Chlamydia trachomatis
aaaagaagaaucuucu

SEQ ID NO: 2501921 - RNA, 19 nt, Chlamydia trachomatis
aaaagaagcuaauagcuug

SEQ ID NO: 2501922 - RNA, 15 nt, Chlamydia trachomatis
aaaagaaucuaaaaa

SEQ ID NO: 2501923 - RNA, 13 nt, Chlamydia trachomatis
aaaagacccagua

SEQ ID NO: 2501924 - RNA, 20 nt, Chlamydia trachomatis
aaaagacccaguaguuuacu

SEQ ID NO: 2501925 - RNA, 21 nt, Chlamydia trachomatis
aaaagacucucccucuuguaa

SEQ ID NO: 2501926 - RNA, 14 nt, Chlamydia trachomatis
aaaagagcauaaua

SEQ ID NO: 2501927 - RNA, 18 nt, Chlamydia trachomatis
aaaagagcuucuucuaaa

SEQ ID NO: 2501928 - RNA, 14 nt, Chlamydia trachomatis
aaaagagcuuuucu

SEQ ID NO: 2501929 - RNA, 15 nt, Chlamydia trachomatis
aaaagagcuuuucuu

SEQ ID NO: 2501930 - RNA, 22 nt, Chlamydia trachomatis
aaaagauagugcagaagauaag

SEQ ID NO: 2501931 - RNA, 16 nt, Chlamydia trachomatis
aaaagaucucauagca

SEQ ID NO: 2501932 - RNA, 19 nt, Chlamydia trachomatis
aaaagaucuucaacaagau

SEQ ID NO: 2501933 - RNA, 21 nt, Chlamydia trachomatis
aaaagaucuucaacaagauuu

SEQ ID NO: 2501934 - RNA, 21 nt, Chlamydia trachomatis
aaaagaugauagcagcaguuu

SEQ ID NO: 2501935 - RNA, 22 nt, Chlamydia trachomatis
aaaagaugauagcagcaguuuu

SEQ ID NO: 2501936 - RNA, 13 nt, Chlamydia trachomatis
aaaagauuucccc

SEQ ID NO: 2501937 - RNA, 18 nt, Chlamydia trachomatis
aaaagauuuucaacggga

SEQ ID NO: 2501938 - RNA, 13 nt, Chlamydia trachomatis
aaaagauuuugaa

SEQ ID NO: 2501939 - RNA, 20 nt, Chlamydia trachomatis
aaaagcacugcguauuugaa

SEQ ID NO: 2501940 - RNA, 14 nt, Chlamydia trachomatis
aaaagccauagcca

SEQ ID NO: 2501941 - RNA, 15 nt, Chlamydia trachomatis
aaaagcccagaacaa

SEQ ID NO: 2501942 - RNA, 18 nt, Chlamydia trachomatis
aaaagccucgcaaaagcg

SEQ ID NO: 2501943 - RNA, 20 nt, Chlamydia trachomatis
aaaagccucgcaaaagcgag

SEQ ID NO: 2501944 - RNA, 21 nt, Chlamydia trachomatis
aaaagcgaggcuucaaagaac

SEQ ID NO: 2501945 - RNA, 17 nt, Chlamydia trachomatis
aaaagcgcuccuaguga

SEQ ID NO: 2501946 - RNA, 14 nt, Chlamydia trachomatis
aaaagcuaucuuug

SEQ ID NO: 2501947 - RNA, 15 nt, Chlamydia trachomatis
aaaagcuccuaaaga

SEQ ID NO: 2501948 - RNA, 20 nt, Chlamydia trachomatis
aaaagcugcuuuauccaaag

SEQ ID NO: 2501949 - RNA, 17 nt, Chlamydia trachomatis
aaaaggaaucuguccaa

SEQ ID NO: 2501950 - RNA, 23 nt, Chlamydia trachomatis
aaaaggaaucuguccaaagagau

SEQ ID NO: 2501951 - RNA, 11 nt, Chlamydia trachomatis
aaaaggauggc

SEQ ID NO: 2501952 - RNA, 16 nt, Chlamydia trachomatis
aaaaggcauaaaagag

SEQ ID NO: 2501953 - RNA, 19 nt, Chlamydia trachomatis
aaaaggcguaaaccuucuu

SEQ ID NO: 2501954 - RNA, 14 nt, Chlamydia trachomatis
aaaaggcuacuaaa

SEQ ID NO: 2501955 - RNA, 16 nt, Chlamydia trachomatis
aaaaggcuacuaaaga

SEQ ID NO: 2501956 - RNA, 18 nt, Chlamydia trachomatis
aaaaggcuagagauauca

SEQ ID NO: 2501957 - RNA, 22 nt, Chlamydia trachomatis
aaaaggcuuacagagagcuuuu

SEQ ID NO: 2501958 - RNA, 20 nt, Chlamydia trachomatis
aaaaggugguacuucauuuu

SEQ ID NO: 2501959 - RNA, 21 nt, Chlamydia trachomatis
aaaaguaguccuaucaccacu

SEQ ID NO: 2501960 - RNA, 23 nt, Chlamydia trachomatis
aaaagucgguuuacaauagguuu

SEQ ID NO: 2501961 - RNA, 14 nt, Chlamydia trachomatis
aaaaguucauagau

SEQ ID NO: 2501962 - RNA, 13 nt, Chlamydia trachomatis
aaaaguuuucgaa

SEQ ID NO: 2501963 - RNA, 23 nt, Chlamydia trachomatis
aaaaguuuucgaauuuuuuucuu

SEQ ID NO: 2501964 - RNA, 12 nt, Chlamydia trachomatis
aaaauaaaaaaa

SEQ ID NO: 2501965 - RNA, 14 nt, Chlamydia trachomatis
aaaauaaaaaaaaa

SEQ ID NO: 2501966 - RNA, 13 nt, Chlamydia trachomatis
aaaauaaagaaau

SEQ ID NO: 2501967 - RNA, 16 nt, Chlamydia trachomatis
aaaauaaguccauuga

SEQ ID NO: 2501968 - RNA, 22 nt, Chlamydia trachomatis
aaaauaauuuaauuaaagagau

SEQ ID NO: 2501969 - RNA, 20 nt, Chlamydia trachomatis
aaaauacagcggauuagucg

SEQ ID NO: 2501970 - RNA, 16 nt, Chlamydia trachomatis
aaaauaccuaaagaag

SEQ ID NO: 2501971 - RNA, 16 nt, Chlamydia trachomatis
aaaauacgcgcgcuaa

SEQ ID NO: 2501972 - RNA, 12 nt, Chlamydia trachomatis
aaaauagaaaac

SEQ ID NO: 2501973 - RNA, 16 nt, Chlamydia trachomatis
aaaauagcacgcaaaa

SEQ ID NO: 2501974 - RNA, 20 nt, Chlamydia trachomatis
aaaauagcagugaaaucaga

SEQ ID NO: 2501975 - RNA, 16 nt, Chlamydia trachomatis
aaaauauacucagaga

SEQ ID NO: 2501976 - RNA, 13 nt, Chlamydia trachomatis
aaaauauagacug

SEQ ID NO: 2501977 - RNA, 15 nt, Chlamydia trachomatis
aaaaucacuuucugc

SEQ ID NO: 2501978 - RNA, 23 nt, Chlamydia trachomatis
aaaaucacuuucugcuuggaccu

SEQ ID NO: 2501979 - RNA, 11 nt, Chlamydia trachomatis
aaaauccauug

SEQ ID NO: 2501980 - RNA, 16 nt, Chlamydia trachomatis
aaaaucccuucccagc

SEQ ID NO: 2501981 - RNA, 13 nt, Chlamydia trachomatis
aaaaucgcagcuu

SEQ ID NO: 2501982 - RNA, 19 nt, Chlamydia trachomatis
aaaaucgcagcuucggaag

SEQ ID NO: 2501983 - RNA, 21 nt, Chlamydia trachomatis
aaaaucgcugagcucuuuccu

SEQ ID NO: 2501984 - RNA, 20 nt, Chlamydia trachomatis
aaaaucguccaaaaucauca

SEQ ID NO: 2501985 - RNA, 14 nt, Chlamydia trachomatis
aaaaucuaaaauau

SEQ ID NO: 2501986 - RNA, 15 nt, Chlamydia trachomatis
aaaaucuaaaauauc

SEQ ID NO: 2501987 - RNA, 18 nt, Chlamydia trachomatis
aaaaucugccgagcauug

SEQ ID NO: 2501988 - RNA, 22 nt, Chlamydia trachomatis
aaaaucuucaaugcuguuucag

SEQ ID NO: 2501989 - RNA, 16 nt, Chlamydia trachomatis
aaaaucuucauaagaa

SEQ ID NO: 2501990 - RNA, 20 nt, Chlamydia trachomatis
aaaaucuucauaagaaaauu

SEQ ID NO: 2501991 - RNA, 22 nt, Chlamydia trachomatis
aaaaucuucauaagaaaauucu

SEQ ID NO: 2501992 - RNA, 12 nt, Chlamydia trachomatis
aaaaucuuccau

SEQ ID NO: 2501993 - RNA, 18 nt, Chlamydia trachomatis
aaaaucuuccauaaaauc

SEQ ID NO: 2501994 - RNA, 20 nt, Chlamydia trachomatis
aaaaucuucuggagcaacuu

SEQ ID NO: 2501995 - RNA, 12 nt, Chlamydia trachomatis
aaaaucuugucg

SEQ ID NO: 2501996 - RNA, 19 nt, Chlamydia trachomatis
aaaaucuugucguuccucu

SEQ ID NO: 2501997 - RNA, 18 nt, Chlamydia trachomatis
aaaaugagaaauaaaaac

SEQ ID NO: 2501998 - RNA, 22 nt, Chlamydia trachomatis
aaaaugaucgccucuaaagcuu

SEQ ID NO: 2501999 - RNA, 19 nt, Chlamydia trachomatis
aaaaugaucuaaaggaaaa

SEQ ID NO: 2502000 - RNA, 22 nt, Chlamydia trachomatis
aaaaugaucuaaaggaaaaauu

SEQ ID NO: 2502001 - RNA, 20 nt, Chlamydia trachomatis
aaaaugaugaaaaagaagcu

SEQ ID NO: 2502002 - RNA, 14 nt, Chlamydia trachomatis
aaaaugcaaagcuu

SEQ ID NO: 2502003 - RNA, 21 nt, Chlamydia trachomatis
aaaaugcuugcguauagagca

SEQ ID NO: 2502004 - RNA, 18 nt, Chlamydia trachomatis
aaaauggaaauaaaaagc

SEQ ID NO: 2502005 - RNA, 14 nt, Chlamydia trachomatis
aaaauguuugagua

SEQ ID NO: 2502006 - RNA, 22 nt, Chlamydia trachomatis
aaaauuacaauaauacaaagca

SEQ ID NO: 2502007 - RNA, 23 nt, Chlamydia trachomatis
aaaauuacaauaauacaaagcac

SEQ ID NO: 2502008 - RNA, 13 nt, Chlamydia trachomatis
aaaauuaucuaaa

SEQ ID NO: 2502009 - RNA, 20 nt, Chlamydia trachomatis
aaaauucuguacgucugcaa

SEQ ID NO: 2502010 - RNA, 12 nt, Chlamydia trachomatis
aaaauuucucuu

SEQ ID NO: 2502011 - RNA, 14 nt, Chlamydia trachomatis
aaaauuucucuucc

SEQ ID NO: 2502012 - RNA, 15 nt, Chlamydia trachomatis
aaaauuuuacguaau

SEQ ID NO: 2502013 - RNA, 22 nt, Chlamydia trachomatis
aaaauuuuacguaauucaugau

SEQ ID NO: 2502014 - RNA, 15 nt, Chlamydia trachomatis
aaaauuuuucugcuc

SEQ ID NO: 2502015 - RNA, 18 nt, Chlamydia trachomatis
aaacaaaaacucucaaau

SEQ ID NO: 2502016 - RNA, 13 nt, Chlamydia trachomatis
aaacaaacaauaa

SEQ ID NO: 2502017 - RNA, 21 nt, Chlamydia trachomatis
aaacaaauaacuuuuucucuu

SEQ ID NO: 2502018 - RNA, 13 nt, Chlamydia trachomatis
aaacaaauguccc

SEQ ID NO: 2502019 - RNA, 19 nt, Chlamydia trachomatis
aaacaacacugacuauucc

SEQ ID NO: 2502020 - RNA, 12 nt, Chlamydia trachomatis
aaacaagaauaa

SEQ ID NO: 2502021 - RNA, 13 nt, Chlamydia trachomatis
aaacaagaauaau

SEQ ID NO: 2502022 - RNA, 14 nt, Chlamydia trachomatis
aaacaaggauuuuc

SEQ ID NO: 2502023 - RNA, 13 nt, Chlamydia trachomatis
aaacaauaaguua

SEQ ID NO: 2502024 - RNA, 21 nt, Chlamydia trachomatis
aaacaauauucuuuuccauau

SEQ ID NO: 2502025 - RNA, 14 nt, Chlamydia trachomatis
aaacaaucaaagca

SEQ ID NO: 2502026 - RNA, 14 nt, Chlamydia trachomatis
aaacaaucuaaaaa

SEQ ID NO: 2502027 - RNA, 13 nt, Chlamydia trachomatis
aaacaauuuccuu

SEQ ID NO: 2502028 - RNA, 13 nt, Chlamydia trachomatis
aaacacaaaagca

SEQ ID NO: 2502029 - RNA, 18 nt, Chlamydia trachomatis
aaacacaaaagcauugaa

SEQ ID NO: 2502030 - RNA, 24 nt, Chlamydia trachomatis
aaacacaccgggagcauggucucu

SEQ ID NO: 2502031 - RNA, 13 nt, Chlamydia trachomatis
aaacacacugggu

SEQ ID NO: 2502032 - RNA, 15 nt, Chlamydia trachomatis
aaacaccauccaauc

SEQ ID NO: 2502033 - RNA, 22 nt, Chlamydia trachomatis
aaacaccucaacgccuguuagu

SEQ ID NO: 2502034 - RNA, 22 nt, Chlamydia trachomatis
aaacacgcaacccuaaaucucc

SEQ ID NO: 2502035 - RNA, 13 nt, Chlamydia trachomatis
aaacacugcaaca

SEQ ID NO: 2502036 - RNA, 14 nt, Chlamydia trachomatis
aaacagaaagaaau

SEQ ID NO: 2502037 - RNA, 15 nt, Chlamydia trachomatis
aaacagaaagaaaug

SEQ ID NO: 2502038 - RNA, 20 nt, Chlamydia trachomatis
aaacagacuaaguuguaaaa

SEQ ID NO: 2502039 - RNA, 14 nt, Chlamydia trachomatis
aaacagccaagcaa

SEQ ID NO: 2502040 - RNA, 18 nt, Chlamydia trachomatis
aaacagcuucuucuucuc

SEQ ID NO: 2502041 - RNA, 22 nt, Chlamydia trachomatis
aaacagcuucuucuucucuuuc

SEQ ID NO: 2502042 - RNA, 23 nt, Chlamydia trachomatis
aaacaggagaaagaaccucaaua

SEQ ID NO: 2502043 - RNA, 13 nt, Chlamydia trachomatis
aaacauaagagca

SEQ ID NO: 2502044 - RNA, 21 nt, Chlamydia trachomatis
aaacauaagaggcaccucuuu

SEQ ID NO: 2502045 - RNA, 21 nt, Chlamydia trachomatis
aaacauauguccauacaaagg

SEQ ID NO: 2502046 - RNA, 20 nt, Chlamydia trachomatis
aaacauccaguaauuuaucu

SEQ ID NO: 2502047 - RNA, 17 nt, Chlamydia trachomatis
aaacauccaugucuaag

SEQ ID NO: 2502048 - RNA, 14 nt, Chlamydia trachomatis
aaacaucccagcaa

SEQ ID NO: 2502049 - RNA, 16 nt, Chlamydia trachomatis
aaacaucccagcaaua

SEQ ID NO: 2502050 - RNA, 14 nt, Chlamydia trachomatis
aaacaucuuuuaaa

SEQ ID NO: 2502051 - RNA, 18 nt, Chlamydia trachomatis
aaacaucuuuuaaaguaa

SEQ ID NO: 2502052 - RNA, 16 nt, Chlamydia trachomatis
aaacaugauuaauucu

SEQ ID NO: 2502053 - RNA, 15 nt, Chlamydia trachomatis
aaacauuccaaauau

SEQ ID NO: 2502054 - RNA, 20 nt, Chlamydia trachomatis
aaacauuccugccaaaaacc

SEQ ID NO: 2502055 - RNA, 22 nt, Chlamydia trachomatis
aaacauuugcgugauaaaaacu

SEQ ID NO: 2502056 - RNA, 15 nt, Chlamydia trachomatis
aaaccaaaaauauca

SEQ ID NO: 2502057 - RNA, 16 nt, Chlamydia trachomatis
aaaccaaacugguugg

SEQ ID NO: 2502058 - RNA, 17 nt, Chlamydia trachomatis
aaaccaaaggcaacaaa

SEQ ID NO: 2502059 - RNA, 17 nt, Chlamydia trachomatis
aaaccaacaagagccaa

SEQ ID NO: 2502060 - RNA, 22 nt, Chlamydia trachomatis
aaaccaacgagugccgaauaau

SEQ ID NO: 2502061 - RNA, 16 nt, Chlamydia trachomatis
aaaccagcucaucaaa

SEQ ID NO: 2502062 - RNA, 12 nt, Chlamydia trachomatis
aaaccaguucug

SEQ ID NO: 2502063 - RNA, 20 nt, Chlamydia trachomatis
aaaccaguucugguuuuugu

SEQ ID NO: 2502064 - RNA, 18 nt, Chlamydia trachomatis
aaaccaucuguaaagcuu

SEQ ID NO: 2502065 - RNA, 20 nt, Chlamydia trachomatis
aaacccucugcauagcuaua

SEQ ID NO: 2502066 - RNA, 13 nt, Chlamydia trachomatis
aaaccgaagaggg

SEQ ID NO: 2502067 - RNA, 14 nt, Chlamydia trachomatis
aaaccgaagaggga

SEQ ID NO: 2502068 - RNA, 12 nt, Chlamydia trachomatis
aaaccgaauaau

SEQ ID NO: 2502069 - RNA, 15 nt, Chlamydia trachomatis
aaaccgaauguuagu

SEQ ID NO: 2502070 - RNA, 23 nt, Chlamydia trachomatis
aaaccgaucccugaauaguugua

SEQ ID NO: 2502071 - RNA, 16 nt, Chlamydia trachomatis
aaaccuguuucugaau

SEQ ID NO: 2502072 - RNA, 12 nt, Chlamydia trachomatis
aaaccuuucaaa

SEQ ID NO: 2502073 - RNA, 15 nt, Chlamydia trachomatis
aaaccuuuugaaaca

SEQ ID NO: 2502074 - RNA, 14 nt, Chlamydia trachomatis
aaacgaaaaacaga

SEQ ID NO: 2502075 - RNA, 22 nt, Chlamydia trachomatis
aaacgaagcugccgaaacuagg

SEQ ID NO: 2502076 - RNA, 19 nt, Chlamydia trachomatis
aaacgaaggagcuuugauu

SEQ ID NO: 2502077 - RNA, 13 nt, Chlamydia trachomatis
aaacgaggaauau

SEQ ID NO: 2502078 - RNA, 18 nt, Chlamydia trachomatis
aaacgauaaaaagcuggg

SEQ ID NO: 2502079 - RNA, 23 nt, Chlamydia trachomatis
aaacgcauuacauauagcaugga

SEQ ID NO: 2502080 - RNA, 16 nt, Chlamydia trachomatis
aaacgcuccaaauaaa

SEQ ID NO: 2502081 - RNA, 13 nt, Chlamydia trachomatis
aaacggugacugu

SEQ ID NO: 2502082 - RNA, 16 nt, Chlamydia trachomatis
aaacgucgaaaagcuu

SEQ ID NO: 2502083 - RNA, 22 nt, Chlamydia trachomatis
aaacgucgugccaccgaaggga

SEQ ID NO: 2502084 - RNA, 23 nt, Chlamydia trachomatis
aaacguguaauuuccuauuucuu

SEQ ID NO: 2502085 - RNA, 13 nt, Chlamydia trachomatis
aaacuacagaaag

SEQ ID NO: 2502086 - RNA, 18 nt, Chlamydia trachomatis
aaacuacccgauucaaaa

SEQ ID NO: 2502087 - RNA, 15 nt, Chlamydia trachomatis
aaacuaguuugguuu

SEQ ID NO: 2502088 - RNA, 18 nt, Chlamydia trachomatis
aaacuaguuugguuuuuu

SEQ ID NO: 2502089 - RNA, 12 nt, Chlamydia trachomatis
aaacuauaagga

SEQ ID NO: 2502090 - RNA, 18 nt, Chlamydia trachomatis
aaacuaucuaaaaucccu

SEQ ID NO: 2502091 - RNA, 22 nt, Chlamydia trachomatis
aaacuauggagaggguucucuu

SEQ ID NO: 2502092 - RNA, 23 nt, Chlamydia trachomatis
aaacuauggagaggguucucuuu

SEQ ID NO: 2502093 - RNA, 19 nt, Chlamydia trachomatis
aaacucucaaaucguucua

SEQ ID NO: 2502094 - RNA, 23 nt, Chlamydia trachomatis
aaacucucgggccaaaaagacua

SEQ ID NO: 2502095 - RNA, 13 nt, Chlamydia trachomatis
aaacucuuaaaag

SEQ ID NO: 2502096 - RNA, 15 nt, Chlamydia trachomatis
aaacucuuuuuaaau

SEQ ID NO: 2502097 - RNA, 16 nt, Chlamydia trachomatis
aaacucuuuuuaaauc

SEQ ID NO: 2502098 - RNA, 16 nt, Chlamydia trachomatis
aaacucuuuuucagac

SEQ ID NO: 2502099 - RNA, 19 nt, Chlamydia trachomatis
aaacucuuuuucagacaaa

SEQ ID NO: 2502100 - RNA, 20 nt, Chlamydia trachomatis
aaacucuuuuucagacaaaa

SEQ ID NO: 2502101 - RNA, 20 nt, Chlamydia trachomatis
aaacugcucaaggaaacucu

SEQ ID NO: 2502102 - RNA, 18 nt, Chlamydia trachomatis
aaacugcugcuaucaucu

SEQ ID NO: 2502103 - RNA, 21 nt, Chlamydia trachomatis
aaacugguuggacaaacuagu

SEQ ID NO: 2502104 - RNA, 22 nt, Chlamydia trachomatis
aaacuguccuuuauucaauauc

SEQ ID NO: 2502105 - RNA, 15 nt, Chlamydia trachomatis
aaacugugaagaaug

SEQ ID NO: 2502106 - RNA, 17 nt, Chlamydia trachomatis
aaacuucaaacucgucc

SEQ ID NO: 2502107 - RNA, 11 nt, Chlamydia trachomatis
aaacuucugga

SEQ ID NO: 2502108 - RNA, 23 nt, Chlamydia trachomatis
aaacuucuggagauugaauaaau

SEQ ID NO: 2502109 - RNA, 20 nt, Chlamydia trachomatis
aaacuugucuaaaagaauau

SEQ ID NO: 2502110 - RNA, 18 nt, Chlamydia trachomatis
aaacuuugacaagcagua

SEQ ID NO: 2502111 - RNA, 11 nt, Chlamydia trachomatis
aaacuuuucug

SEQ ID NO: 2502112 - RNA, 12 nt, Chlamydia trachomatis
aaagaaaaauaa

SEQ ID NO: 2502113 - RNA, 16 nt, Chlamydia trachomatis
aaagaaaaauaaaaau

SEQ ID NO: 2502114 - RNA, 21 nt, Chlamydia trachomatis
aaaguagaccauuuagaccag

SEQ ID NO: 2502115 - RNA, 20 nt, Chlamydia trachomatis
aaaguagacgaaguaggaga

SEQ ID NO: 2502116 - RNA, 15 nt, Chlamydia trachomatis
aaaguagcaaucacu

SEQ ID NO: 2502117 - RNA, 18 nt, Chlamydia trachomatis
aaaguaguccuaucacca

SEQ ID NO: 2502118 - RNA, 13 nt, Chlamydia trachomatis
aaagucaagacag

SEQ ID NO: 2502119 - RNA, 18 nt, Chlamydia trachomatis
aaagucaagacagaugcc

SEQ ID NO: 2502120 - RNA, 20 nt, Chlamydia trachomatis
aaagucaggauuuucuaggu

SEQ ID NO: 2502121 - RNA, 17 nt, Chlamydia trachomatis
aaagucaucgcuaaucu

SEQ ID NO: 2502122 - RNA, 18 nt, Chlamydia trachomatis
aaaguccgcuaauccaug

SEQ ID NO: 2502123 - RNA, 13 nt, Chlamydia trachomatis
aaaguccugcuuc

SEQ ID NO: 2502124 - RNA, 19 nt, Chlamydia trachomatis
aaagucuccauaagaaugu

SEQ ID NO: 2502125 - RNA, 18 nt, Chlamydia trachomatis
aaagucucuaaagcuuuu

SEQ ID NO: 2502126 - RNA, 22 nt, Chlamydia trachomatis
aaagucuguuccuaauacuaaa

SEQ ID NO: 2502127 - RNA, 23 nt, Chlamydia trachomatis
aaagucuuaaaaggguagaaaaa

SEQ ID NO: 2502128 - RNA, 23 nt, Chlamydia trachomatis
aaagucuuuuccuccauaggaau

SEQ ID NO: 2502129 - RNA, 23 nt, Chlamydia trachomatis
aaagugagaugcuccucucuuug

SEQ ID NO: 2502130 - RNA, 13 nt, Chlamydia trachomatis
aaaguguuuagaa

SEQ ID NO: 2502131 - RNA, 14 nt, Chlamydia trachomatis
aaaguucucucccu

SEQ ID NO: 2502132 - RNA, 20 nt, Chlamydia trachomatis
aaaguucucucccuuccuga

SEQ ID NO: 2502133 - RNA, 20 nt, Chlamydia trachomatis
aaaguuggucgcagaauaag

SEQ ID NO: 2502134 - RNA, 22 nt, Chlamydia trachomatis
aaaguuuucgaauuuuuuucuu

SEQ ID NO: 2502135 - RNA, 20 nt, Chlamydia trachomatis
aaauaaaaaaaaagaggagg

SEQ ID NO: 2502136 - RNA, 13 nt, Chlamydia trachomatis
aaauaaaaagccc

SEQ ID NO: 2502137 - RNA, 14 nt, Chlamydia trachomatis
aaauaaaacgaaaa

SEQ ID NO: 2502138 - RNA, 17 nt, Chlamydia trachomatis
aaauaaaacgaaaaaca

SEQ ID NO: 2502139 - RNA, 12 nt, Chlamydia trachomatis
aaauaaagaaau

SEQ ID NO: 2502140 - RNA, 15 nt, Chlamydia trachomatis
aaauaaguaggugag

SEQ ID NO: 2502141 - RNA, 17 nt, Chlamydia trachomatis
aaauaaguccuuaucuu

SEQ ID NO: 2502142 - RNA, 19 nt, Chlamydia trachomatis
aaauaaguccuuaucuucu

SEQ ID NO: 2502143 - RNA, 21 nt, Chlamydia trachomatis
aaauaagucuuuuacuuugaa

SEQ ID NO: 2502144 - RNA, 17 nt, Chlamydia trachomatis
aaauaaguuaccucuuu

SEQ ID NO: 2502145 - RNA, 17 nt, Chlamydia trachomatis
aaauaauacaaaggagc

SEQ ID NO: 2502146 - RNA, 21 nt, Chlamydia trachomatis
aaauaaucggcaaaagaucuc

SEQ ID NO: 2502147 - RNA, 20 nt, Chlamydia trachomatis
aaauaaugccaccuaauaug

SEQ ID NO: 2502148 - RNA, 23 nt, Chlamydia trachomatis
aaauaauuuccugacucgaagga

SEQ ID NO: 2502149 - RNA, 16 nt, Chlamydia trachomatis
aaauacaaaucuuuua

SEQ ID NO: 2502150 - RNA, 14 nt, Chlamydia trachomatis
aaauacacagcauc

SEQ ID NO: 2502151 - RNA, 15 nt, Chlamydia trachomatis
aaauacacagcauca

SEQ ID NO: 2502152 - RNA, 14 nt, Chlamydia trachomatis
aaauaccaaaauau

SEQ ID NO: 2502153 - RNA, 17 nt, Chlamydia trachomatis
aaauaccaaaauaucau

SEQ ID NO: 2502154 - RNA, 20 nt, Chlamydia trachomatis
aaauaccaaaauaucauaau

SEQ ID NO: 2502155 - RNA, 14 nt, Chlamydia trachomatis
aaauaccacucauu

SEQ ID NO: 2502156 - RNA, 15 nt, Chlamydia trachomatis
aaauaccacucauua

SEQ ID NO: 2502157 - RNA, 18 nt, Chlamydia trachomatis
aaauacgcgcgcuaagac

SEQ ID NO: 2502158 - RNA, 22 nt, Chlamydia trachomatis
aaauacgcgcgcuaagacuuuc

SEQ ID NO: 2502159 - RNA, 22 nt, Chlamydia trachomatis
aaauacggacggacaaauuucu

SEQ ID NO: 2502160 - RNA, 14 nt, Chlamydia trachomatis
aaauacuugauuuu

SEQ ID NO: 2502161 - RNA, 18 nt, Chlamydia trachomatis
aaauagcacgcaaaacau

SEQ ID NO: 2502162 - RNA, 20 nt, Chlamydia trachomatis
aaauagcacgcaaaacaucu

SEQ ID NO: 2502163 - RNA, 19 nt, Chlamydia trachomatis
aaauagcuucguagagcaa

SEQ ID NO: 2502164 - RNA, 11 nt, Chlamydia trachomatis
aaauaggaucc

SEQ ID NO: 2502165 - RNA, 12 nt, Chlamydia trachomatis
aaauaggaugga

SEQ ID NO: 2502166 - RNA, 20 nt, Chlamydia trachomatis
aaauaggcgaauuucucuau

SEQ ID NO: 2502167 - RNA, 17 nt, Chlamydia trachomatis
aaauagguaaagaaguu

SEQ ID NO: 2502168 - RNA, 19 nt, Chlamydia trachomatis
aaauaguguaaggagagaa

SEQ ID NO: 2502169 - RNA, 15 nt, Chlamydia trachomatis
aaauaguucacucca

SEQ ID NO: 2502170 - RNA, 20 nt, Chlamydia trachomatis
aaauauagacugucuauuug

SEQ ID NO: 2502171 - RNA, 18 nt, Chlamydia trachomatis
aaauauaggguccaaaca

SEQ ID NO: 2502172 - RNA, 20 nt, Chlamydia trachomatis
aaauauaggguccaaacaua

SEQ ID NO: 2502173 - RNA, 14 nt, Chlamydia trachomatis
aaauaucaauuccu

SEQ ID NO: 2502174 - RNA, 17 nt, Chlamydia trachomatis
aaauaucuacuucuugu

SEQ ID NO: 2502175 - RNA, 14 nt, Chlamydia trachomatis
aaauaucuugaguc

SEQ ID NO: 2502176 - RNA, 16 nt, Chlamydia trachomatis
aaauaugacagagccc

SEQ ID NO: 2502177 - RNA, 18 nt, Chlamydia trachomatis
aaauauggggccagcaua

SEQ ID NO: 2502178 - RNA, 13 nt, Chlamydia trachomatis
aaauauugcucua

SEQ ID NO: 2502179 - RNA, 14 nt, Chlamydia trachomatis
aaauauugcucuaa

SEQ ID NO: 2502180 - RNA, 19 nt, Chlamydia trachomatis
aaauauugcucuaaagucu

SEQ ID NO: 2502181 - RNA, 18 nt, Chlamydia trachomatis
aaauauuuauuggcggca

SEQ ID NO: 2502182 - RNA, 13 nt, Chlamydia trachomatis
aaauauuuugcug

SEQ ID NO: 2502183 - RNA, 20 nt, Chlamydia trachomatis
aaauauuuuugggaaaaaau

SEQ ID NO: 2502184 - RNA, 16 nt, Chlamydia trachomatis
aaaucaaaccaaaaau

SEQ ID NO: 2502185 - RNA, 15 nt, Chlamydia trachomatis
aaaucaauaaugucu

SEQ ID NO: 2502186 - RNA, 23 nt, Chlamydia trachomatis
aaaucaauaaugucuccaggaga

SEQ ID NO: 2502187 - RNA, 17 nt, Chlamydia trachomatis
aaaucacaaugcgcucc

SEQ ID NO: 2502188 - RNA, 15 nt, Chlamydia trachomatis
aaaucacaauuuuuc

SEQ ID NO: 2502189 - RNA, 18 nt, Chlamydia trachomatis
aaaucaccauauccauaa

SEQ ID NO: 2502190 - RNA, 23 nt, Chlamydia trachomatis
aaaucaccauauccauaacuuua

SEQ ID NO: 2502191 - RNA, 20 nt, Chlamydia trachomatis
aaaucacgcacuuuuuguuu

SEQ ID NO: 2502192 - RNA, 15 nt, Chlamydia trachomatis
aaaucacuuucugcu

SEQ ID NO: 2502193 - RNA, 16 nt, Chlamydia trachomatis
aaaucacuuucugcuu

SEQ ID NO: 2502194 - RNA, 19 nt, Chlamydia trachomatis
aaaucacuuuuaccguucc

SEQ ID NO: 2502195 - RNA, 21 nt, Chlamydia trachomatis
aaaucacuuuuaccguuccau

SEQ ID NO: 2502196 - RNA, 22 nt, Chlamydia trachomatis
aaaucaguggaacugcuucccu

SEQ ID NO: 2502197 - RNA, 23 nt, Chlamydia trachomatis
aaaucaguggaacugcuucccuc

SEQ ID NO: 2502198 - RNA, 16 nt, Chlamydia trachomatis
aaaucauagauaauga

SEQ ID NO: 2502199 - RNA, 19 nt, Chlamydia trachomatis
aaauccagcgugucuacca

SEQ ID NO: 2502200 - RNA, 20 nt, Chlamydia trachomatis
aaauccauucgcauuaaaua

SEQ ID NO: 2502201 - RNA, 20 nt, Chlamydia trachomatis
aaaucccaucaaaagcuauc

SEQ ID NO: 2502202 - RNA, 18 nt, Chlamydia trachomatis
aaauccccagucucucca

SEQ ID NO: 2502203 - RNA, 14 nt, Chlamydia trachomatis
aaaucccuaacucu

SEQ ID NO: 2502204 - RNA, 19 nt, Chlamydia trachomatis
aaauccuacacaagcuuuu

SEQ ID NO: 2502205 - RNA, 23 nt, Chlamydia trachomatis
aaauccuauacccgacuaaaaaa

SEQ ID NO: 2502206 - RNA, 11 nt, Chlamydia trachomatis
aaauccugcuu

SEQ ID NO: 2502207 - RNA, 23 nt, Chlamydia trachomatis
aaaucgaaacuguugacaucacc

SEQ ID NO: 2502208 - RNA, 17 nt, Chlamydia trachomatis
aaaucgaggugauuuuc

SEQ ID NO: 2502209 - RNA, 13 nt, Chlamydia trachomatis
aaaucuaaaauau

SEQ ID NO: 2502210 - RNA, 15 nt, Chlamydia trachomatis
aaaucuaaaauauca

SEQ ID NO: 2502211 - RNA, 12 nt, Chlamydia trachomatis
aaaucuaaaauu

SEQ ID NO: 2502212 - RNA, 14 nt, Chlamydia trachomatis
aaaucuauccauaa

SEQ ID NO: 2502213 - RNA, 18 nt, Chlamydia trachomatis
aaaucucaaaguuuuugu

SEQ ID NO: 2502214 - RNA, 18 nt, Chlamydia trachomatis
aaaucuccaaaauucugu

SEQ ID NO: 2502215 - RNA, 21 nt, Chlamydia trachomatis
aaaucuccuccgagaaauacg

SEQ ID NO: 2502216 - RNA, 21 nt, Chlamydia trachomatis
aaaucugcaagaacaaagaau

SEQ ID NO: 2502217 - RNA, 17 nt, Chlamydia trachomatis
aaaucugcuaaggccuu

SEQ ID NO: 2502218 - RNA, 18 nt, Chlamydia trachomatis
aaaucugggaggagaacu

SEQ ID NO: 2502219 - RNA, 18 nt, Chlamydia trachomatis
aaaucuucauaagaaaau

SEQ ID NO: 2502220 - RNA, 19 nt, Chlamydia trachomatis
aaaucuucauaagaaaauu

SEQ ID NO: 2502221 - RNA, 23 nt, Chlamydia trachomatis
aaaucuuucgaggaguacuucua

SEQ ID NO: 2502222 - RNA, 13 nt, Chlamydia trachomatis
aaaucuuuuaucu

SEQ ID NO: 2502223 - RNA, 20 nt, Chlamydia trachomatis
aaaucuuuuaucuucuuaau

SEQ ID NO: 2502224 - RNA, 22 nt, Chlamydia trachomatis
aaaugaaaccccucuuucucuc

SEQ ID NO: 2502225 - RNA, 13 nt, Chlamydia trachomatis
aacagauucuaua

SEQ ID NO: 2502226 - RNA, 16 nt, Chlamydia trachomatis
aacagcacaaacaaau

SEQ ID NO: 2502227 - RNA, 22 nt, Chlamydia trachomatis
aacagcacaaacaaauccuaga

SEQ ID NO: 2502228 - RNA, 14 nt, Chlamydia trachomatis
aacagcagaacuca

SEQ ID NO: 2502229 - RNA, 17 nt, Chlamydia trachomatis
aacagcucuaaagagcc

SEQ ID NO: 2502230 - RNA, 18 nt, Chlamydia trachomatis
aacagcucuucuucugaa

SEQ ID NO: 2502231 - RNA, 21 nt, Chlamydia trachomatis
aacagcuucuucuucucuuuc

SEQ ID NO: 2502232 - RNA, 17 nt, Chlamydia trachomatis
aacaggaccagagauca

SEQ ID NO: 2502233 - RNA, 14 nt, Chlamydia trachomatis
aacaggagaugaau

SEQ ID NO: 2502234 - RNA, 18 nt, Chlamydia trachomatis
aacaggggaccaaaaaag

SEQ ID NO: 2502235 - RNA, 23 nt, Chlamydia trachomatis
aacaggggaccaaaaaagcgucu

SEQ ID NO: 2502236 - RNA, 20 nt, Chlamydia trachomatis
aacagguuucuuacaagggc

SEQ ID NO: 2502237 - RNA, 16 nt, Chlamydia trachomatis
aacagucguaauugcu

SEQ ID NO: 2502238 - RNA, 21 nt, Chlamydia trachomatis
aacauaaaauccuucugccuc

SEQ ID NO: 2502239 - RNA, 13 nt, Chlamydia trachomatis
aacauaauaaaua

SEQ ID NO: 2502240 - RNA, 13 nt, Chlamydia trachomatis
aacauaauagcgg

SEQ ID NO: 2502241 - RNA, 20 nt, Chlamydia trachomatis
aacauacacagauacugagu

SEQ ID NO: 2502242 - RNA, 17 nt, Chlamydia trachomatis
aacauacccuaaauucc

SEQ ID NO: 2502243 - RNA, 16 nt, Chlamydia trachomatis
aacauaccguagaucc

SEQ ID NO: 2502244 - RNA, 14 nt, Chlamydia trachomatis
aacauaugcucagg

SEQ ID NO: 2502245 - RNA, 18 nt, Chlamydia trachomatis
aacauauuaggagcaaga

SEQ ID NO: 2502246 - RNA, 14 nt, Chlamydia trachomatis
aacaucaaaauucu

SEQ ID NO: 2502247 - RNA, 14 nt, Chlamydia trachomatis
aacaucaaccaggu

SEQ ID NO: 2502248 - RNA, 13 nt, Chlamydia trachomatis
aacaucaacugau

SEQ ID NO: 2502249 - RNA, 16 nt, Chlamydia trachomatis
aacauccaccagcagu

SEQ ID NO: 2502250 - RNA, 18 nt, Chlamydia trachomatis
aacaucgagaaaaugaug

SEQ ID NO: 2502251 - RNA, 19 nt, Chlamydia trachomatis
aacaucgagaaaaugauga

SEQ ID NO: 2502252 - RNA, 18 nt, Chlamydia trachomatis
aacaucuucccaauauau

SEQ ID NO: 2502253 - RNA, 15 nt, Chlamydia trachomatis
aacaucuuuuaaagu

SEQ ID NO: 2502254 - RNA, 23 nt, Chlamydia trachomatis
aacaucuuuuaaaguaaguaaaa

SEQ ID NO: 2502255 - RNA, 18 nt, Chlamydia trachomatis
aacaugaaccgcagcaac

SEQ ID NO: 2502256 - RNA, 24 nt, Chlamydia trachomatis
aacaugaguugcucaauuguugua

SEQ ID NO: 2502257 - RNA, 16 nt, Chlamydia trachomatis
aacaugauucaaaaua

SEQ ID NO: 2502258 - RNA, 18 nt, Chlamydia trachomatis
aacaugcucaacauuaga

SEQ ID NO: 2502259 - RNA, 15 nt, Chlamydia trachomatis
aacauuauuccgcuu

SEQ ID NO: 2502260 - RNA, 14 nt, Chlamydia trachomatis
aacauuuuauuaaa

SEQ ID NO: 2502261 - RNA, 12 nt, Chlamydia trachomatis
aaccaaaagagc

SEQ ID NO: 2502262 - RNA, 13 nt, Chlamydia trachomatis
aaccaaaagagcg

SEQ ID NO: 2502263 - RNA, 11 nt, Chlamydia trachomatis
aaccaaaccag

SEQ ID NO: 2502264 - RNA, 16 nt, Chlamydia trachomatis
aaccaaacgauuaugu

SEQ ID NO: 2502265 - RNA, 18 nt, Chlamydia trachomatis
aaccaaaggcaacaaagg

SEQ ID NO: 2502266 - RNA, 12 nt, Chlamydia trachomatis
aaccaacucucc

SEQ ID NO: 2502267 - RNA, 22 nt, Chlamydia trachomatis
aaccaaggacggauguugauau

SEQ ID NO: 2502268 - RNA, 17 nt, Chlamydia trachomatis
aaccaagggaauaaaaa

SEQ ID NO: 2502269 - RNA, 13 nt, Chlamydia trachomatis
aaccaaguuuuuu

SEQ ID NO: 2502270 - RNA, 20 nt, Chlamydia trachomatis
aaccacaaaaucagcaaaug

SEQ ID NO: 2502271 - RNA, 18 nt, Chlamydia trachomatis
aaccacacuucucgaaaa

SEQ ID NO: 2502272 - RNA, 21 nt, Chlamydia trachomatis
aaccacacuucucgaaaaaau

SEQ ID NO: 2502273 - RNA, 23 nt, Chlamydia trachomatis
aaccacacuucucgaaaaaaugc

SEQ ID NO: 2502274 - RNA, 12 nt, Chlamydia trachomatis
aaccacuuuucu

SEQ ID NO: 2502275 - RNA, 15 nt, Chlamydia trachomatis
aaccacuuuucugua

SEQ ID NO: 2502276 - RNA, 17 nt, Chlamydia trachomatis
aaccagaauauaagcac

SEQ ID NO: 2502277 - RNA, 20 nt, Chlamydia trachomatis
aaccagaauccuuuucagaa

SEQ ID NO: 2502278 - RNA, 21 nt, Chlamydia trachomatis
aaccagaauccuuuucagaau

SEQ ID NO: 2502279 - RNA, 17 nt, Chlamydia trachomatis
aaccagccuauuagauu

SEQ ID NO: 2502280 - RNA, 15 nt, Chlamydia trachomatis
aaccaggucacauuu

SEQ ID NO: 2502281 - RNA, 18 nt, Chlamydia trachomatis
aaccaggucacauuuucc

SEQ ID NO: 2502282 - RNA, 20 nt, Chlamydia trachomatis
aaccaggucacauuuuccgu

SEQ ID NO: 2502283 - RNA, 21 nt, Chlamydia trachomatis
aaccaggucacauuuuccguu

SEQ ID NO: 2502284 - RNA, 21 nt, Chlamydia trachomatis
aaccaguucugguuuuuguaa

SEQ ID NO: 2502285 - RNA, 19 nt, Chlamydia trachomatis
aaccaguuucuucuacaag

SEQ ID NO: 2502286 - RNA, 17 nt, Chlamydia trachomatis
aaccaucccguucuuga

SEQ ID NO: 2502287 - RNA, 18 nt, Chlamydia trachomatis
aaccaucuguaaagcuuc

SEQ ID NO: 2502288 - RNA, 23 nt, Chlamydia trachomatis
aacccaacgcaucuccaaagaca

SEQ ID NO: 2502289 - RNA, 17 nt, Chlamydia trachomatis
aacccaaucgaguagca

SEQ ID NO: 2502290 - RNA, 21 nt, Chlamydia trachomatis
aaccccaucgauuuuugcuaa

SEQ ID NO: 2502291 - RNA, 17 nt, Chlamydia trachomatis
aaccccgcauaccaaag

SEQ ID NO: 2502292 - RNA, 14 nt, Chlamydia trachomatis
aaccccucuuuuuu

SEQ ID NO: 2502293 - RNA, 15 nt, Chlamydia trachomatis
aacccuaaaucuccu

SEQ ID NO: 2502294 - RNA, 21 nt, Chlamydia trachomatis
aacccuaauaaaggccaggcu

SEQ ID NO: 2502295 - RNA, 17 nt, Chlamydia trachomatis
aacccuagucgagaaga

SEQ ID NO: 2502296 - RNA, 22 nt, Chlamydia trachomatis
aacccuagucgagaagaagguu

SEQ ID NO: 2502297 - RNA, 20 nt, Chlamydia trachomatis
aacccuccgacccaagacac

SEQ ID NO: 2502298 - RNA, 18 nt, Chlamydia trachomatis
aacccucgcagagaaaga

SEQ ID NO: 2502299 - RNA, 19 nt, Chlamydia trachomatis
aacccucugcauagcuaua

SEQ ID NO: 2502300 - RNA, 23 nt, Chlamydia trachomatis
aacccucugcauagcuauaaaau

SEQ ID NO: 2502301 - RNA, 18 nt, Chlamydia trachomatis
aacccuucaggaaagccu

SEQ ID NO: 2502302 - RNA, 19 nt, Chlamydia trachomatis
aaccgaagagggaagagaa

SEQ ID NO: 2502303 - RNA, 14 nt, Chlamydia trachomatis
aaccgcgcgaaaau

SEQ ID NO: 2502304 - RNA, 21 nt, Chlamydia trachomatis
aaccguucuugacaaaacccu

SEQ ID NO: 2502305 - RNA, 20 nt, Chlamydia trachomatis
aaccuaagcgcaagaaacug

SEQ ID NO: 2502306 - RNA, 22 nt, Chlamydia trachomatis
aaccuguuucugaaucaaacag

SEQ ID NO: 2502307 - RNA, 21 nt, Chlamydia trachomatis
aaccuuccacuuuugugaaaa

SEQ ID NO: 2502308 - RNA, 11 nt, Chlamydia trachomatis
aaccuucugac

SEQ ID NO: 2502309 - RNA, 16 nt, Chlamydia trachomatis
aaccuugggaaucuuc

SEQ ID NO: 2502310 - RNA, 15 nt, Chlamydia trachomatis
aaccuuucaaauacc

SEQ ID NO: 2502311 - RNA, 18 nt, Chlamydia trachomatis
aaccuuucaaauacccaa

SEQ ID NO: 2502312 - RNA, 18 nt, Chlamydia trachomatis
aaccuuuccuguauaaga

SEQ ID NO: 2502313 - RNA, 17 nt, Chlamydia trachomatis
aaccuuuuuaaaauaau

SEQ ID NO: 2502314 - RNA, 16 nt, Chlamydia trachomatis
aacgaaaccaaaauau

SEQ ID NO: 2502315 - RNA, 18 nt, Chlamydia trachomatis
aacgaacuuuccauagca

SEQ ID NO: 2502316 - RNA, 20 nt, Chlamydia trachomatis
aacgaacuuuccauagcaug

SEQ ID NO: 2502317 - RNA, 12 nt, Chlamydia trachomatis
aacgaagauuaa

SEQ ID NO: 2502318 - RNA, 14 nt, Chlamydia trachomatis
aacgaagauuaaga

SEQ ID NO: 2502319 - RNA, 22 nt, Chlamydia trachomatis
aacgaagccaaaagaucuugau

SEQ ID NO: 2502320 - RNA, 13 nt, Chlamydia trachomatis
aacgaaucgcuga

SEQ ID NO: 2502321 - RNA, 21 nt, Chlamydia trachomatis
aacgagaugaccacuacucua

SEQ ID NO: 2502322 - RNA, 15 nt, Chlamydia trachomatis
aacgaggcacaaaau

SEQ ID NO: 2502323 - RNA, 22 nt, Chlamydia trachomatis
aacgaguguaggguagaacagg

SEQ ID NO: 2502324 - RNA, 14 nt, Chlamydia trachomatis
aacgauauccuucu

SEQ ID NO: 2502325 - RNA, 16 nt, Chlamydia trachomatis
aacgaucugcgaugcc

SEQ ID NO: 2502326 - RNA, 18 nt, Chlamydia trachomatis
aacgauuaacucugcacc

SEQ ID NO: 2502327 - RNA, 13 nt, Chlamydia trachomatis
aacgauuauguuc

SEQ ID NO: 2502328 - RNA, 19 nt, Chlamydia trachomatis
aacgauucaauccagacuc

SEQ ID NO: 2502329 - RNA, 16 nt, Chlamydia trachomatis
aacgauuguuucugua

SEQ ID NO: 2502330 - RNA, 21 nt, Chlamydia trachomatis
aacgauuuugucgauaagaag

SEQ ID NO: 2502331 - RNA, 23 nt, Chlamydia trachomatis
aacgauuuugucgauaagaaggu

SEQ ID NO: 2502332 - RNA, 23 nt, Chlamydia trachomatis
aacgcacuccaauauauggacaa

SEQ ID NO: 2502333 - RNA, 19 nt, Chlamydia trachomatis
aacgcaucccgaaucccau

SEQ ID NO: 2502334 - RNA, 14 nt, Chlamydia trachomatis
aacgcaucuccaaa

SEQ ID NO: 2502335 - RNA, 20 nt, Chlamydia trachomatis
aacgcaucuccaaagacaca

SEQ ID NO: 2502336 - RNA, 14 nt, Chlamydia trachomatis
aagaaaucuucucu

SEQ ID NO: 2502337 - RNA, 20 nt, Chlamydia trachomatis
aagaaaucuucucuugaauc

SEQ ID NO: 2502338 - RNA, 17 nt, Chlamydia trachomatis
aagaaauggucucuucu

SEQ ID NO: 2502339 - RNA, 16 nt, Chlamydia trachomatis
aagaaauuaacaccaa

SEQ ID NO: 2502340 - RNA, 21 nt, Chlamydia trachomatis
aagaaauugucgaauuuuucu

SEQ ID NO: 2502341 - RNA, 18 nt, Chlamydia trachomatis
aagaacacacuuucccca

SEQ ID NO: 2502342 - RNA, 19 nt, Chlamydia trachomatis
aagaacacacuuuccccau

SEQ ID NO: 2502343 - RNA, 18 nt, Chlamydia trachomatis
aagaacagauugagaaua

SEQ ID NO: 2502344 - RNA, 21 nt, Chlamydia trachomatis
aagaacauauuaggagcaaga

SEQ ID NO: 2502345 - RNA, 23 nt, Chlamydia trachomatis
aagaaccacaaccucucuaaaaa

SEQ ID NO: 2502346 - RNA, 16 nt, Chlamydia trachomatis
aagaacccuauccccc

SEQ ID NO: 2502347 - RNA, 16 nt, Chlamydia trachomatis
aagaacgccugaucaa

SEQ ID NO: 2502348 - RNA, 19 nt, Chlamydia trachomatis
aagaacgccugaucaaauc

SEQ ID NO: 2502349 - RNA, 16 nt, Chlamydia trachomatis
aagaacucaaaagcuu

SEQ ID NO: 2502350 - RNA, 18 nt, Chlamydia trachomatis
aagaacucccuccaaaaa

SEQ ID NO: 2502351 - RNA, 22 nt, Chlamydia trachomatis
aagaacucccuccaaaaaagag

SEQ ID NO: 2502352 - RNA, 17 nt, Chlamydia trachomatis
aagaagacgcucauaaa

SEQ ID NO: 2502353 - RNA, 21 nt, Chlamydia trachomatis
aagaagagguauguuuggauu

SEQ ID NO: 2502354 - RNA, 22 nt, Chlamydia trachomatis
aagaagaucccauaaucucaua

SEQ ID NO: 2502355 - RNA, 14 nt, Chlamydia trachomatis
aagaagauguuguu

SEQ ID NO: 2502356 - RNA, 23 nt, Chlamydia trachomatis
aagaagauguuguuaaagcuuuu

SEQ ID NO: 2502357 - RNA, 16 nt, Chlamydia trachomatis
aagaagauuuuuagaa

SEQ ID NO: 2502358 - RNA, 19 nt, Chlamydia trachomatis
aagaagccccaauagcuaa

SEQ ID NO: 2502359 - RNA, 12 nt, Chlamydia trachomatis
aagaagcuaucu

SEQ ID NO: 2502360 - RNA, 14 nt, Chlamydia trachomatis
aagaaggcuuuucu

SEQ ID NO: 2502361 - RNA, 16 nt, Chlamydia trachomatis
aagaaggcuuuucuau

SEQ ID NO: 2502362 - RNA, 18 nt, Chlamydia trachomatis
aagaagggagugcauagc

SEQ ID NO: 2502363 - RNA, 21 nt, Chlamydia trachomatis
aagaagguugaauuucaggag

SEQ ID NO: 2502364 - RNA, 12 nt, Chlamydia trachomatis
aagaagguugug

SEQ ID NO: 2502365 - RNA, 16 nt, Chlamydia trachomatis
aagaaguaaugaaggu

SEQ ID NO: 2502366 - RNA, 18 nt, Chlamydia trachomatis
aagaagucuuguccuucc

SEQ ID NO: 2502367 - RNA, 21 nt, Chlamydia trachomatis
aagaaguuggucgggaaacau

SEQ ID NO: 2502368 - RNA, 19 nt, Chlamydia trachomatis
aagaaguugguuuggguuu

SEQ ID NO: 2502369 - RNA, 19 nt, Chlamydia trachomatis
aagaaguuuacgaacaaga

SEQ ID NO: 2502370 - RNA, 15 nt, Chlamydia trachomatis
aagaauaaaacauuu

SEQ ID NO: 2502371 - RNA, 16 nt, Chlamydia trachomatis
aagaauaaaacauuuu

SEQ ID NO: 2502372 - RNA, 13 nt, Chlamydia trachomatis
aagaauaauagag

SEQ ID NO: 2502373 - RNA, 17 nt, Chlamydia trachomatis
aagaauacaaagcagcc

SEQ ID NO: 2502374 - RNA, 14 nt, Chlamydia trachomatis
aagaauacaagaaa

SEQ ID NO: 2502375 - RNA, 21 nt, Chlamydia trachomatis
aagaauagaauauuggagccu

SEQ ID NO: 2502376 - RNA, 23 nt, Chlamydia trachomatis
aagaauagcuuuuaacuucccac

SEQ ID NO: 2502377 - RNA, 21 nt, Chlamydia trachomatis
aagaauagggagguuuuguuc

SEQ ID NO: 2502378 - RNA, 17 nt, Chlamydia trachomatis
aagaauaucaucuucaa

SEQ ID NO: 2502379 - RNA, 12 nt, Chlamydia trachomatis
aagaaucaaaaa

SEQ ID NO: 2502380 - RNA, 19 nt, Chlamydia trachomatis
aagaaucauagaaacgagg

SEQ ID NO: 2502381 - RNA, 15 nt, Chlamydia trachomatis
aagaaucuucuucga

SEQ ID NO: 2502382 - RNA, 21 nt, Chlamydia trachomatis
aagaaugaucacuugaaucac

SEQ ID NO: 2502383 - RNA, 15 nt, Chlamydia trachomatis
aagaauuaacccaaa

SEQ ID NO: 2502384 - RNA, 17 nt, Chlamydia trachomatis
aagaauucgcacuaucu

SEQ ID NO: 2502385 - RNA, 18 nt, Chlamydia trachomatis
aagaauugaaguaugcuc

SEQ ID NO: 2502386 - RNA, 22 nt, Chlamydia trachomatis
aagaauugaaguaugcucgagc

SEQ ID NO: 2502387 - RNA, 14 nt, Chlamydia trachomatis
aagaauuucuugaa

SEQ ID NO: 2502388 - RNA, 23 nt, Chlamydia trachomatis
aagacaaauugcacuaaagagcu

SEQ ID NO: 2502389 - RNA, 23 nt, Chlamydia trachomatis
aagacacuaucacuguugagaaa

SEQ ID NO: 2502390 - RNA, 15 nt, Chlamydia trachomatis
aagacccguuuucuc

SEQ ID NO: 2502391 - RNA, 17 nt, Chlamydia trachomatis
aagacccguuuucucuu

SEQ ID NO: 2502392 - RNA, 23 nt, Chlamydia trachomatis
aagacgaacgcuagaaacagccu

SEQ ID NO: 2502393 - RNA, 13 nt, Chlamydia trachomatis
aagacuaaucuuc

SEQ ID NO: 2502394 - RNA, 18 nt, Chlamydia trachomatis
aagacuacaaaacgcucu

SEQ ID NO: 2502395 - RNA, 16 nt, Chlamydia trachomatis
aagacucaaucaccac

SEQ ID NO: 2502396 - RNA, 22 nt, Chlamydia trachomatis
aagacucacagcaaauaaagag

SEQ ID NO: 2502397 - RNA, 18 nt, Chlamydia trachomatis
aagacuuucucuaacaau

SEQ ID NO: 2502398 - RNA, 23 nt, Chlamydia trachomatis
aagacuuucucuaacaaugacuc

SEQ ID NO: 2502399 - RNA, 12 nt, Chlamydia trachomatis
aagagaaaaauu

SEQ ID NO: 2502400 - RNA, 18 nt, Chlamydia trachomatis
aagagaagguaacaaugc

SEQ ID NO: 2502401 - RNA, 19 nt, Chlamydia trachomatis
aagagaccgagccuccgcu

SEQ ID NO: 2502402 - RNA, 15 nt, Chlamydia trachomatis
aagagagaacaaaag

SEQ ID NO: 2502403 - RNA, 21 nt, Chlamydia trachomatis
aagagagaucuaugaaaaaag

SEQ ID NO: 2502404 - RNA, 21 nt, Chlamydia trachomatis
aagagaggccuccauuuccau

SEQ ID NO: 2502405 - RNA, 21 nt, Chlamydia trachomatis
aagagauguuuguguuucuaa

SEQ ID NO: 2502406 - RNA, 20 nt, Chlamydia trachomatis
aagagcagcuauuucuuuuu

SEQ ID NO: 2502407 - RNA, 23 nt, Chlamydia trachomatis
aagagcauccauauauucagaag

SEQ ID NO: 2502408 - RNA, 16 nt, Chlamydia trachomatis
aagagccaaaauauac

SEQ ID NO: 2502409 - RNA, 24 nt, Chlamydia trachomatis
aagagccaaaauauacucagagau

SEQ ID NO: 2502410 - RNA, 16 nt, Chlamydia trachomatis
aagagcugaggaggga

SEQ ID NO: 2502411 - RNA, 18 nt, Chlamydia trachomatis
aagagcugcugucagaag

SEQ ID NO: 2502412 - RNA, 20 nt, Chlamydia trachomatis
aagagcugcugucagaagaa

SEQ ID NO: 2502413 - RNA, 13 nt, Chlamydia trachomatis
aagagcuucuucu

SEQ ID NO: 2502414 - RNA, 20 nt, Chlamydia trachomatis
aagagcuucuucuaaagaau

SEQ ID NO: 2502415 - RNA, 13 nt, Chlamydia trachomatis
aagagcuucuugu

SEQ ID NO: 2502416 - RNA, 23 nt, Chlamydia trachomatis
aagagcuucuuguuuagaggaga

SEQ ID NO: 2502417 - RNA, 11 nt, Chlamydia trachomatis
aagaggaucuc

SEQ ID NO: 2502418 - RNA, 17 nt, Chlamydia trachomatis
aagaggcaccucuuuuu

SEQ ID NO: 2502419 - RNA, 15 nt, Chlamydia trachomatis
aagaggcccuucuug

SEQ ID NO: 2502420 - RNA, 18 nt, Chlamydia trachomatis
aagaggcccuucuugagg

SEQ ID NO: 2502421 - RNA, 19 nt, Chlamydia trachomatis
aagaggcgcccacagaaca

SEQ ID NO: 2502422 - RNA, 14 nt, Chlamydia trachomatis
aagagggaagagaa

SEQ ID NO: 2502423 - RNA, 14 nt, Chlamydia trachomatis
aagagguauguuug

SEQ ID NO: 2502424 - RNA, 23 nt, Chlamydia trachomatis
aagaggucuuauuaaaagaccuc

SEQ ID NO: 2502425 - RNA, 20 nt, Chlamydia trachomatis
aagaguaaucggauagagaa

SEQ ID NO: 2502426 - RNA, 17 nt, Chlamydia trachomatis
aagaguagggagcaaag

SEQ ID NO: 2502427 - RNA, 14 nt, Chlamydia trachomatis
aagagucuucauca

SEQ ID NO: 2502428 - RNA, 14 nt, Chlamydia trachomatis
aagaguuucuuugu

SEQ ID NO: 2502429 - RNA, 19 nt, Chlamydia trachomatis
aagauaaaacuaccugaua

SEQ ID NO: 2502430 - RNA, 17 nt, Chlamydia trachomatis
aagauaaccaagcugca

SEQ ID NO: 2502431 - RNA, 17 nt, Chlamydia trachomatis
aagauaagcagcaauag

SEQ ID NO: 2502432 - RNA, 19 nt, Chlamydia trachomatis
aagauacaaggcuccuuuu

SEQ ID NO: 2502433 - RNA, 22 nt, Chlamydia trachomatis
aagauagauaggcaggaagaga

SEQ ID NO: 2502434 - RNA, 12 nt, Chlamydia trachomatis
aagauaggagca

SEQ ID NO: 2502435 - RNA, 14 nt, Chlamydia trachomatis
aagauaguagagaa

SEQ ID NO: 2502436 - RNA, 15 nt, Chlamydia trachomatis
aagauauaaacaaua

SEQ ID NO: 2502437 - RNA, 17 nt, Chlamydia trachomatis
aagauauaaacaauaag

SEQ ID NO: 2502438 - RNA, 15 nt, Chlamydia trachomatis
aagauauagguucca

SEQ ID NO: 2502439 - RNA, 22 nt, Chlamydia trachomatis
aagauauagguuccaucuaaag

SEQ ID NO: 2502440 - RNA, 13 nt, Chlamydia trachomatis
aagauauccauag

SEQ ID NO: 2502441 - RNA, 15 nt, Chlamydia trachomatis
aagaucaaggaucca

SEQ ID NO: 2502442 - RNA, 23 nt, Chlamydia trachomatis
aagauccacuggaauagcuagag

SEQ ID NO: 2502443 - RNA, 21 nt, Chlamydia trachomatis
aagaucgguucauaaaauuuc

SEQ ID NO: 2502444 - RNA, 13 nt, Chlamydia trachomatis
aagaucucuacau

SEQ ID NO: 2502445 - RNA, 23 nt, Chlamydia trachomatis
aagaucucuacauaagucucuug

SEQ ID NO: 2502446 - RNA, 18 nt, Chlamydia trachomatis
aagaucucuuucucuaga

SEQ ID NO: 2502447 - RNA, 13 nt, Chlamydia trachomatis
aagcuugaucaaa

SEQ ID NO: 2502448 - RNA, 22 nt, Chlamydia trachomatis
aagcuugucuccuucuuugaca

SEQ ID NO: 2502449 - RNA, 12 nt, Chlamydia trachomatis
aagcuuuagcuc

SEQ ID NO: 2502450 - RNA, 16 nt, Chlamydia trachomatis
aagcuuucaucuccuu

SEQ ID NO: 2502451 - RNA, 18 nt, Chlamydia trachomatis
aagcuuucugccaaagac

SEQ ID NO: 2502452 - RNA, 14 nt, Chlamydia trachomatis
aagcuuuuuccaaa

SEQ ID NO: 2502453 - RNA, 15 nt, Chlamydia trachomatis
aagcuuuuuccaaag

SEQ ID NO: 2502454 - RNA, 20 nt, Chlamydia trachomatis
aagcuuuuuccaaagcuucu

SEQ ID NO: 2502455 - RNA, 23 nt, Chlamydia trachomatis
aagcuuuuucuacuguagcacca

SEQ ID NO: 2502456 - RNA, 17 nt, Chlamydia trachomatis
aaggaaaaagaaaaaaa

SEQ ID NO: 2502457 - RNA, 16 nt, Chlamydia trachomatis
aaggaaacaagcagau

SEQ ID NO: 2502458 - RNA, 21 nt, Chlamydia trachomatis
aaggaaaccaagggaauaaaa

SEQ ID NO: 2502459 - RNA, 15 nt, Chlamydia trachomatis
aaggaaaugaaggcc

SEQ ID NO: 2502460 - RNA, 18 nt, Chlamydia trachomatis
aaggaacaucgagaaaau

SEQ ID NO: 2502461 - RNA, 14 nt, Chlamydia trachomatis
aaggaagaagauag

SEQ ID NO: 2502462 - RNA, 15 nt, Chlamydia trachomatis
aaggaagaucaagga

SEQ ID NO: 2502463 - RNA, 15 nt, Chlamydia trachomatis
aaggaagcaaaaacu

SEQ ID NO: 2502464 - RNA, 12 nt, Chlamydia trachomatis
aaggaagccagc

SEQ ID NO: 2502465 - RNA, 19 nt, Chlamydia trachomatis
aaggaauacccagaaguau

SEQ ID NO: 2502466 - RNA, 21 nt, Chlamydia trachomatis
aaggaaugauaagggaaucau

SEQ ID NO: 2502467 - RNA, 22 nt, Chlamydia trachomatis
aaggaauggguaggauuacaaa

SEQ ID NO: 2502468 - RNA, 19 nt, Chlamydia trachomatis
aaggaaugguuacuugccu

SEQ ID NO: 2502469 - RNA, 20 nt, Chlamydia trachomatis
aaggaauguggagcuaucau

SEQ ID NO: 2502470 - RNA, 18 nt, Chlamydia trachomatis
aaggacaagcucgucuuu

SEQ ID NO: 2502471 - RNA, 20 nt, Chlamydia trachomatis
aaggaccguuagcauagccu

SEQ ID NO: 2502472 - RNA, 17 nt, Chlamydia trachomatis
aaggacguuuggagcau

SEQ ID NO: 2502473 - RNA, 16 nt, Chlamydia trachomatis
aaggacuaguccugaa

SEQ ID NO: 2502474 - RNA, 21 nt, Chlamydia trachomatis
aaggacuaguccugaagcaau

SEQ ID NO: 2502475 - RNA, 16 nt, Chlamydia trachomatis
aaggagagaaaagagg

SEQ ID NO: 2502476 - RNA, 15 nt, Chlamydia trachomatis
aaggagcuaagaacc

SEQ ID NO: 2502477 - RNA, 19 nt, Chlamydia trachomatis
aaggagcuaagaaccacaa

SEQ ID NO: 2502478 - RNA, 20 nt, Chlamydia trachomatis
aaggagugugaucgagaacg

SEQ ID NO: 2502479 - RNA, 14 nt, Chlamydia trachomatis
aaggauaaggaaga

SEQ ID NO: 2502480 - RNA, 15 nt, Chlamydia trachomatis
aaggauaaggaagaa

SEQ ID NO: 2502481 - RNA, 18 nt, Chlamydia trachomatis
aaggaugcaaauaagaaa

SEQ ID NO: 2502482 - RNA, 23 nt, Chlamydia trachomatis
aaggauuuuuuucccacaaacaa

SEQ ID NO: 2502483 - RNA, 15 nt, Chlamydia trachomatis
aaggcaacucucucu

SEQ ID NO: 2502484 - RNA, 20 nt, Chlamydia trachomatis
aaggcauaaaagagaagaac

SEQ ID NO: 2502485 - RNA, 17 nt, Chlamydia trachomatis
aaggcaugagauauagu

SEQ ID NO: 2502486 - RNA, 21 nt, Chlamydia trachomatis
aaggccuauccaaggaaacca

SEQ ID NO: 2502487 - RNA, 22 nt, Chlamydia trachomatis
aaggccuauccaaggaaaccaa

SEQ ID NO: 2502488 - RNA, 23 nt, Chlamydia trachomatis
aaggccuuuuuuuauaaaggugg

SEQ ID NO: 2502489 - RNA, 20 nt, Chlamydia trachomatis
aaggcgcagcuuucguugau

SEQ ID NO: 2502490 - RNA, 16 nt, Chlamydia trachomatis
aaggcucucgcaguuu

SEQ ID NO: 2502491 - RNA, 15 nt, Chlamydia trachomatis
aaggcuuacagagag

SEQ ID NO: 2502492 - RNA, 19 nt, Chlamydia trachomatis
aaggcuuauucucuuuaua

SEQ ID NO: 2502493 - RNA, 13 nt, Chlamydia trachomatis
aaggcuuuuccau

SEQ ID NO: 2502494 - RNA, 17 nt, Chlamydia trachomatis
aagggaaaaaacuagaa

SEQ ID NO: 2502495 - RNA, 22 nt, Chlamydia trachomatis
aagggaaucauaaggaagaugg

SEQ ID NO: 2502496 - RNA, 19 nt, Chlamydia trachomatis
aagggaugaagcuaaaaaa

SEQ ID NO: 2502497 - RNA, 13 nt, Chlamydia trachomatis
aagggauguguua

SEQ ID NO: 2502498 - RNA, 13 nt, Chlamydia trachomatis
aagggcaaaacuc

SEQ ID NO: 2502499 - RNA, 20 nt, Chlamydia trachomatis
aagggcuuuauacuagggaa

SEQ ID NO: 2502500 - RNA, 12 nt, Chlamydia trachomatis
aaggggaagaaa

SEQ ID NO: 2502501 - RNA, 18 nt, Chlamydia trachomatis
aagggggcuuuagcagcc

SEQ ID NO: 2502502 - RNA, 13 nt, Chlamydia trachomatis
aaggguagaaaaa

SEQ ID NO: 2502503 - RNA, 18 nt, Chlamydia trachomatis
aaggguagaaaaagagaa

SEQ ID NO: 2502504 - RNA, 19 nt, Chlamydia trachomatis
aagguaacuguggguuuuu

SEQ ID NO: 2502505 - RNA, 20 nt, Chlamydia trachomatis
aagguaaucuguagagagcc

SEQ ID NO: 2502506 - RNA, 23 nt, Chlamydia trachomatis
aagguagauccgauaucagcaaa

SEQ ID NO: 2502507 - RNA, 16 nt, Chlamydia trachomatis
aagguauuuuagagaa

SEQ ID NO: 2502508 - RNA, 23 nt, Chlamydia trachomatis
aagguauuuuagagaaaagaaaa

SEQ ID NO: 2502509 - RNA, 15 nt, Chlamydia trachomatis
aaggucugaacaacu

SEQ ID NO: 2502510 - RNA, 18 nt, Chlamydia trachomatis
aagguguguacgcuuugg

SEQ ID NO: 2502511 - RNA, 20 nt, Chlamydia trachomatis
aagguguguacgcuuuggua

SEQ ID NO: 2502512 - RNA, 14 nt, Chlamydia trachomatis
aagguugaacuaga

SEQ ID NO: 2502513 - RNA, 12 nt, Chlamydia trachomatis
aaguaaaaugcc

SEQ ID NO: 2502514 - RNA, 19 nt, Chlamydia trachomatis
aaguaacuacggaaaaaga

SEQ ID NO: 2502515 - RNA, 21 nt, Chlamydia trachomatis
aaguaacuacggaaaaagaag

SEQ ID NO: 2502516 - RNA, 22 nt, Chlamydia trachomatis
aaguaacuacggaaaaagaaga

SEQ ID NO: 2502517 - RNA, 17 nt, Chlamydia trachomatis
aaguaagcgaagaagga

SEQ ID NO: 2502518 - RNA, 21 nt, Chlamydia trachomatis
aaguaaugaagguuucuaaaa

SEQ ID NO: 2502519 - RNA, 11 nt, Chlamydia trachomatis
aaguaauucuu

SEQ ID NO: 2502520 - RNA, 21 nt, Chlamydia trachomatis
aaguagaaccacuuuucugua

SEQ ID NO: 2502521 - RNA, 12 nt, Chlamydia trachomatis
aaguagcaauca

SEQ ID NO: 2502522 - RNA, 14 nt, Chlamydia trachomatis
aaguagcaaucacu

SEQ ID NO: 2502523 - RNA, 12 nt, Chlamydia trachomatis
aaguagcuaaau

SEQ ID NO: 2502524 - RNA, 21 nt, Chlamydia trachomatis
aaguagguuuaaccuuugcau

SEQ ID NO: 2502525 - RNA, 17 nt, Chlamydia trachomatis
aaguaucguaaacaaaa

SEQ ID NO: 2502526 - RNA, 12 nt, Chlamydia trachomatis
aaguauucuucu

SEQ ID NO: 2502527 - RNA, 12 nt, Chlamydia trachomatis
aagucaccauuu

SEQ ID NO: 2502528 - RNA, 16 nt, Chlamydia trachomatis
aagucaccauuuucuc

SEQ ID NO: 2502529 - RNA, 21 nt, Chlamydia trachomatis
aagucacuacuucaucgagaa

SEQ ID NO: 2502530 - RNA, 21 nt, Chlamydia trachomatis
aagucagagauauugucuacu

SEQ ID NO: 2502531 - RNA, 17 nt, Chlamydia trachomatis
aagucaggauuuucuag

SEQ ID NO: 2502532 - RNA, 23 nt, Chlamydia trachomatis
aagucaggauuuucuagguacca

SEQ ID NO: 2502533 - RNA, 21 nt, Chlamydia trachomatis
aagucaugcggauuaaagaag

SEQ ID NO: 2502534 - RNA, 14 nt, Chlamydia trachomatis
aaguccuuaucuuc

SEQ ID NO: 2502535 - RNA, 19 nt, Chlamydia trachomatis
aaguccuuaucuucuugag

SEQ ID NO: 2502536 - RNA, 16 nt, Chlamydia trachomatis
aagucgguuuacaaua

SEQ ID NO: 2502537 - RNA, 14 nt, Chlamydia trachomatis
aagucgugucuuua

SEQ ID NO: 2502538 - RNA, 18 nt, Chlamydia trachomatis
aagucuaggagauaagca

SEQ ID NO: 2502539 - RNA, 18 nt, Chlamydia trachomatis
aagucuccacugguucuc

SEQ ID NO: 2502540 - RNA, 22 nt, Chlamydia trachomatis
aagucuccacugguucucuuua

SEQ ID NO: 2502541 - RNA, 23 nt, Chlamydia trachomatis
aagucuccauaagaauguuuccu

SEQ ID NO: 2502542 - RNA, 15 nt, Chlamydia trachomatis
aagucuuaaaagggu

SEQ ID NO: 2502543 - RNA, 20 nt, Chlamydia trachomatis
aagucuuaaaaggguagaaa

SEQ ID NO: 2502544 - RNA, 21 nt, Chlamydia trachomatis
aagucuuaaaaggguagaaaa

SEQ ID NO: 2502545 - RNA, 15 nt, Chlamydia trachomatis
aagucuuuaauaccu

SEQ ID NO: 2502546 - RNA, 15 nt, Chlamydia trachomatis
aagugaauuugaaca

SEQ ID NO: 2502547 - RNA, 19 nt, Chlamydia trachomatis
aagugaauuugaacagcga

SEQ ID NO: 2502548 - RNA, 20 nt, Chlamydia trachomatis
aagugcaucauuuuguauaa

SEQ ID NO: 2502549 - RNA, 19 nt, Chlamydia trachomatis
aagugcgcgcuuaauuuuu

SEQ ID NO: 2502550 - RNA, 18 nt, Chlamydia trachomatis
aagugcuaacgcuucuuc

SEQ ID NO: 2502551 - RNA, 19 nt, Chlamydia trachomatis
aagugcuaacgcuucuucu

SEQ ID NO: 2502552 - RNA, 23 nt, Chlamydia trachomatis
aaguucccuuuuguuccagaaaa

SEQ ID NO: 2502553 - RNA, 19 nt, Chlamydia trachomatis
aaguuccuuagcuaaaagc

SEQ ID NO: 2502554 - RNA, 22 nt, Chlamydia trachomatis
aaguuccuuagcuaaaagcucu

SEQ ID NO: 2502555 - RNA, 17 nt, Chlamydia trachomatis
accucuuuuuuugcuca

SEQ ID NO: 2502556 - RNA, 22 nt, Chlamydia trachomatis
accucuuuuuuugcucaaugau

SEQ ID NO: 2502557 - RNA, 14 nt, Chlamydia trachomatis
accugaccuugaac

SEQ ID NO: 2502558 - RNA, 23 nt, Chlamydia trachomatis
accugcaagagaucguacaauga

SEQ ID NO: 2502559 - RNA, 18 nt, Chlamydia trachomatis
accuggaaaggagaaagu

SEQ ID NO: 2502560 - RNA, 13 nt, Chlamydia trachomatis
acguuuaaugaau

SEQ ID NO: 2502561 - RNA, 15 nt, Chlamydia trachomatis
acuaaacuaucuaaa

SEQ ID NO: 2502562 - RNA, 16 nt, Chlamydia trachomatis
acuaaaggaaacaagc

SEQ ID NO: 2502563 - RNA, 20 nt, Chlamydia trachomatis
acuaaaucucuuggagagaa

SEQ ID NO: 2502564 - RNA, 18 nt, Chlamydia trachomatis
acuaaaugucucuaagua

SEQ ID NO: 2502565 - RNA, 12 nt, Chlamydia trachomatis
acuaacaaauag

SEQ ID NO: 2502566 - RNA, 13 nt, Chlamydia trachomatis
acuaacaucaaag

SEQ ID NO: 2502567 - RNA, 22 nt, Chlamydia trachomatis
acuaacaugcucaacauuagaa

SEQ ID NO: 2502568 - RNA, 17 nt, Chlamydia trachomatis
acuaagaauaaagauga

SEQ ID NO: 2502569 - RNA, 23 nt, Chlamydia trachomatis
acuaagauccacuggaauagcua

SEQ ID NO: 2502570 - RNA, 16 nt, Chlamydia trachomatis
acuaagucuguugccu

SEQ ID NO: 2502571 - RNA, 16 nt, Chlamydia trachomatis
acuaaguuguaaaaca

SEQ ID NO: 2502572 - RNA, 16 nt, Chlamydia trachomatis
acuaauucuaaugcuu

SEQ ID NO: 2502573 - RNA, 18 nt, Chlamydia trachomatis
acuacagucuuccucugc

SEQ ID NO: 2502574 - RNA, 13 nt, Chlamydia trachomatis
acuacagucuucu

SEQ ID NO: 2502575 - RNA, 22 nt, Chlamydia trachomatis
acuacauucgccucuucucuuu

SEQ ID NO: 2502576 - RNA, 22 nt, Chlamydia trachomatis
acuaccccaccuauggcauuca

SEQ ID NO: 2502577 - RNA, 18 nt, Chlamydia trachomatis
acuacugucagaccuaca

SEQ ID NO: 2502578 - RNA, 18 nt, Chlamydia trachomatis
acuacuucaggaucuuca

SEQ ID NO: 2502579 - RNA, 21 nt, Chlamydia trachomatis
acuagauuugugaguuauauu

SEQ ID NO: 2502580 - RNA, 15 nt, Chlamydia trachomatis
acuaguuuacgcacu

SEQ ID NO: 2502581 - RNA, 17 nt, Chlamydia trachomatis
acuaucagaagauagua

SEQ ID NO: 2502582 - RNA, 19 nt, Chlamydia trachomatis
acuaucauugagcaaaaaa

SEQ ID NO: 2502583 - RNA, 12 nt, Chlamydia trachomatis
acuaucccuacu

SEQ ID NO: 2502584 - RNA, 17 nt, Chlamydia trachomatis
acuaucccuacugaagu

SEQ ID NO: 2502585 - RNA, 23 nt, Chlamydia trachomatis
acuauccgaagcugcaauagaaa

SEQ ID NO: 2502586 - RNA, 12 nt, Chlamydia trachomatis
acuaucugcaaa

SEQ ID NO: 2502587 - RNA, 14 nt, Chlamydia trachomatis
acuaugaacaaaca

SEQ ID NO: 2502588 - RNA, 15 nt, Chlamydia trachomatis
acuaugaacaaacag

SEQ ID NO: 2502589 - RNA, 22 nt, Chlamydia trachomatis
acuaugcaaaguuucugaaaag

SEQ ID NO: 2502590 - RNA, 19 nt, Chlamydia trachomatis
acuaugcucacaaaccaaa

SEQ ID NO: 2502591 - RNA, 20 nt, Chlamydia trachomatis
acuaugcucacaaaccaaaa

SEQ ID NO: 2502592 - RNA, 17 nt, Chlamydia trachomatis
acuauuaaaaaggcuag

SEQ ID NO: 2502593 - RNA, 15 nt, Chlamydia trachomatis
acuauucgagaauga

SEQ ID NO: 2502594 - RNA, 18 nt, Chlamydia trachomatis
acuauucgagaaugaaua

SEQ ID NO: 2502595 - RNA, 14 nt, Chlamydia trachomatis
acuauugaucaaag

SEQ ID NO: 2502596 - RNA, 13 nt, Chlamydia trachomatis
acuauuucuucua

SEQ ID NO: 2502597 - RNA, 13 nt, Chlamydia trachomatis
acuauuuucaaaa

SEQ ID NO: 2502598 - RNA, 13 nt, Chlamydia trachomatis
acucaaaaauucc

SEQ ID NO: 2502599 - RNA, 16 nt, Chlamydia trachomatis
acucaaaauaaagaaa

SEQ ID NO: 2502600 - RNA, 20 nt, Chlamydia trachomatis
acucaaacugugaagaauga

SEQ ID NO: 2502601 - RNA, 18 nt, Chlamydia trachomatis
acucaaauuuucaugaaa

SEQ ID NO: 2502602 - RNA, 22 nt, Chlamydia trachomatis
acucaacgaaagcauccccaaa

SEQ ID NO: 2502603 - RNA, 18 nt, Chlamydia trachomatis
acucaacuccagagcaaa

SEQ ID NO: 2502604 - RNA, 19 nt, Chlamydia trachomatis
acucaacuccagagcaaau

SEQ ID NO: 2502605 - RNA, 17 nt, Chlamydia trachomatis
acucaauccuuuaacua

SEQ ID NO: 2502606 - RNA, 24 nt, Chlamydia trachomatis
acucagaaucuuuggaagcagaaa

SEQ ID NO: 2502607 - RNA, 19 nt, Chlamydia trachomatis
acucagagauauaagagaa

SEQ ID NO: 2502608 - RNA, 20 nt, Chlamydia trachomatis
acucagcuuccuuggcuuuu

SEQ ID NO: 2502609 - RNA, 20 nt, Chlamydia trachomatis
acucagguuauccaaauaaa

SEQ ID NO: 2502610 - RNA, 18 nt, Chlamydia trachomatis
acucauccuagcagcuaa

SEQ ID NO: 2502611 - RNA, 19 nt, Chlamydia trachomatis
acucaucuuuuuuaaaaag

SEQ ID NO: 2502612 - RNA, 12 nt, Chlamydia trachomatis
acuccaagaaga

SEQ ID NO: 2502613 - RNA, 14 nt, Chlamydia trachomatis
acuccaagaagagu

SEQ ID NO: 2502614 - RNA, 16 nt, Chlamydia trachomatis
acuccaccuaggauag

SEQ ID NO: 2502615 - RNA, 15 nt, Chlamydia trachomatis
acuccagagcaaaua

SEQ ID NO: 2502616 - RNA, 22 nt, Chlamydia trachomatis
acuccagagcaaauagaauaaa

SEQ ID NO: 2502617 - RNA, 16 nt, Chlamydia trachomatis
acuccauaaaaagcca

SEQ ID NO: 2502618 - RNA, 20 nt, Chlamydia trachomatis
acuccaucucgacaguuuga

SEQ ID NO: 2502619 - RNA, 13 nt, Chlamydia trachomatis
acuccauuuuaag

SEQ ID NO: 2502620 - RNA, 15 nt, Chlamydia trachomatis
acucccccuuucaaa

SEQ ID NO: 2502621 - RNA, 15 nt, Chlamydia trachomatis
acucccuccaaaaaa

SEQ ID NO: 2502622 - RNA, 23 nt, Chlamydia trachomatis
acuccuaaaguaagauuuuucag

SEQ ID NO: 2502623 - RNA, 19 nt, Chlamydia trachomatis
acuccuccuccuaaacaaa

SEQ ID NO: 2502624 - RNA, 16 nt, Chlamydia trachomatis
acuccucgucgaagaa

SEQ ID NO: 2502625 - RNA, 21 nt, Chlamydia trachomatis
acuccugaaaguuuuuucccc

SEQ ID NO: 2502626 - RNA, 21 nt, Chlamydia trachomatis
acuccugcagcuaaagaaucu

SEQ ID NO: 2502627 - RNA, 12 nt, Chlamydia trachomatis
acuccuucucug

SEQ ID NO: 2502628 - RNA, 21 nt, Chlamydia trachomatis
acucgcacacgauuaucuaaa

SEQ ID NO: 2502629 - RNA, 16 nt, Chlamydia trachomatis
acucgcaucauccuug

SEQ ID NO: 2502630 - RNA, 20 nt, Chlamydia trachomatis
acucgcaucauccuugccca

SEQ ID NO: 2502631 - RNA, 14 nt, Chlamydia trachomatis
acucggaaucucug

SEQ ID NO: 2502632 - RNA, 12 nt, Chlamydia trachomatis
acucuaaagaau

SEQ ID NO: 2502633 - RNA, 14 nt, Chlamydia trachomatis
acucuaaagaauag

SEQ ID NO: 2502634 - RNA, 13 nt, Chlamydia trachomatis
acucuaaauaccu

SEQ ID NO: 2502635 - RNA, 12 nt, Chlamydia trachomatis
acucuauuaaga

SEQ ID NO: 2502636 - RNA, 17 nt, Chlamydia trachomatis
acucuauuaagaaucuu

SEQ ID NO: 2502637 - RNA, 22 nt, Chlamydia trachomatis
acucucaaaucguucuaccaga

SEQ ID NO: 2502638 - RNA, 14 nt, Chlamydia trachomatis
acucucauaagaau

SEQ ID NO: 2502639 - RNA, 21 nt, Chlamydia trachomatis
acucucauaagaauacaaagc

SEQ ID NO: 2502640 - RNA, 16 nt, Chlamydia trachomatis
acucuccaaacucuau

SEQ ID NO: 2502641 - RNA, 22 nt, Chlamydia trachomatis
acucucccuguagagacuagau

SEQ ID NO: 2502642 - RNA, 21 nt, Chlamydia trachomatis
acucuccuaauucaacauaau

SEQ ID NO: 2502643 - RNA, 15 nt, Chlamydia trachomatis
acucugcaaaaucuu

SEQ ID NO: 2502644 - RNA, 17 nt, Chlamydia trachomatis
acucugcaaaaucuucc

SEQ ID NO: 2502645 - RNA, 19 nt, Chlamydia trachomatis
acucugcaccggcaaagaa

SEQ ID NO: 2502646 - RNA, 18 nt, Chlamydia trachomatis
acucugcggcuccuucuu

SEQ ID NO: 2502647 - RNA, 17 nt, Chlamydia trachomatis
acucuuccuugauuaag

SEQ ID NO: 2502648 - RNA, 17 nt, Chlamydia trachomatis
acugaaaaucgcuauuu

SEQ ID NO: 2502649 - RNA, 20 nt, Chlamydia trachomatis
acugaaagauucacgaguuu

SEQ ID NO: 2502650 - RNA, 21 nt, Chlamydia trachomatis
acugaagguaacgaguacaga

SEQ ID NO: 2502651 - RNA, 19 nt, Chlamydia trachomatis
acugaaucaggaauauuaa

SEQ ID NO: 2502652 - RNA, 24 nt, Chlamydia trachomatis
acugaccgaagaacucaaaagcuu

SEQ ID NO: 2502653 - RNA, 16 nt, Chlamydia trachomatis
acugagagagcaauac

SEQ ID NO: 2502654 - RNA, 22 nt, Chlamydia trachomatis
acugcauaguccaugugagaac

SEQ ID NO: 2502655 - RNA, 19 nt, Chlamydia trachomatis
acugcaucauguugcguuu

SEQ ID NO: 2502656 - RNA, 17 nt, Chlamydia trachomatis
acugcguauuugaaauc

SEQ ID NO: 2502657 - RNA, 20 nt, Chlamydia trachomatis
acugcgugaccguuaauauc

SEQ ID NO: 2502658 - RNA, 15 nt, Chlamydia trachomatis
acugcucugccauaa

SEQ ID NO: 2502659 - RNA, 16 nt, Chlamydia trachomatis
acugcucuucuaacuu

SEQ ID NO: 2502660 - RNA, 18 nt, Chlamydia trachomatis
acugcucuucuaacuuuu

SEQ ID NO: 2502661 - RNA, 13 nt, Chlamydia trachomatis
acugcugcuauca

SEQ ID NO: 2502662 - RNA, 16 nt, Chlamydia trachomatis
acugcuuccgaaagca

SEQ ID NO: 2502663 - RNA, 21 nt, Chlamydia trachomatis
acugcuuccgaaagcauguuu

SEQ ID NO: 2502664 - RNA, 19 nt, Chlamydia trachomatis
acugcuuuccuuaguuuua

SEQ ID NO: 2502665 - RNA, 17 nt, Chlamydia trachomatis
acuggcauagucuugau

SEQ ID NO: 2502666 - RNA, 18 nt, Chlamydia trachomatis
acugggucuuuuuuauga

SEQ ID NO: 2502667 - RNA, 16 nt, Chlamydia trachomatis
acugguaaaggaaguu

SEQ ID NO: 2502668 - RNA, 16 nt, Chlamydia trachomatis
acugguguggguaaga

SEQ ID NO: 2502669 - RNA, 22 nt, Chlamydia trachomatis
acuguagaugcuuuguaaaaua

SEQ ID NO: 2502670 - RNA, 21 nt, Chlamydia trachomatis
acugucagaccuacaaagaua

SEQ ID NO: 2502671 - RNA, 15 nt, Chlamydia trachomatis
agaaauuaacaccaa

SEQ ID NO: 2502672 - RNA, 15 nt, Chlamydia trachomatis
agaaauucuucaucu

SEQ ID NO: 2502673 - RNA, 22 nt, Chlamydia trachomatis
agaaauugauagugaaauaagu

SEQ ID NO: 2502674 - RNA, 16 nt, Chlamydia trachomatis
agaaauugcucaggaa

SEQ ID NO: 2502675 - RNA, 22 nt, Chlamydia trachomatis
agaaauugucgaauuuuucugc

SEQ ID NO: 2502676 - RNA, 13 nt, Chlamydia trachomatis
agaaauuuuaaau

SEQ ID NO: 2502677 - RNA, 18 nt, Chlamydia trachomatis
agaacagauuuagagaau

SEQ ID NO: 2502678 - RNA, 17 nt, Chlamydia trachomatis
agaacaguguccuucca

SEQ ID NO: 2502679 - RNA, 13 nt, Chlamydia trachomatis
agaacauaacaca

SEQ ID NO: 2502680 - RNA, 18 nt, Chlamydia trachomatis
agaacaucaacagaagaa

SEQ ID NO: 2502681 - RNA, 20 nt, Chlamydia trachomatis
agaacaucucggucuuagaa

SEQ ID NO: 2502682 - RNA, 14 nt, Chlamydia trachomatis
agaaccaaugaaac

SEQ ID NO: 2502683 - RNA, 16 nt, Chlamydia trachomatis
agaaccacaaaaucag

SEQ ID NO: 2502684 - RNA, 17 nt, Chlamydia trachomatis
agaaccucaauagcuga

SEQ ID NO: 2502685 - RNA, 11 nt, Chlamydia trachomatis
agaaccuucca

SEQ ID NO: 2502686 - RNA, 19 nt, Chlamydia trachomatis
agaacgaagcccaaacccu

SEQ ID NO: 2502687 - RNA, 22 nt, Chlamydia trachomatis
agaacgauuuugucgauaagaa

SEQ ID NO: 2502688 - RNA, 18 nt, Chlamydia trachomatis
agaacggcuguuguccuu

SEQ ID NO: 2502689 - RNA, 24 nt, Chlamydia trachomatis
agaacguacuuuaggagaaagaau

SEQ ID NO: 2502690 - RNA, 20 nt, Chlamydia trachomatis
agaacguuuagcuaacucuu

SEQ ID NO: 2502691 - RNA, 16 nt, Chlamydia trachomatis
agaacucaaaauaaag

SEQ ID NO: 2502692 - RNA, 13 nt, Chlamydia trachomatis
agaacucccccuu

SEQ ID NO: 2502693 - RNA, 18 nt, Chlamydia trachomatis
agaacucccuccaaaaaa

SEQ ID NO: 2502694 - RNA, 12 nt, Chlamydia trachomatis
agaacugcagug

SEQ ID NO: 2502695 - RNA, 14 nt, Chlamydia trachomatis
agaacugucuucuu

SEQ ID NO: 2502696 - RNA, 22 nt, Chlamydia trachomatis
agaacugucuucuuucaaagaa

SEQ ID NO: 2502697 - RNA, 16 nt, Chlamydia trachomatis
agaacuucuccuggaa

SEQ ID NO: 2502698 - RNA, 23 nt, Chlamydia trachomatis
agaacuuugugcagcacugagau

SEQ ID NO: 2502699 - RNA, 19 nt, Chlamydia trachomatis
agaagaaaagagcuuuucu

SEQ ID NO: 2502700 - RNA, 15 nt, Chlamydia trachomatis
agaagaacucuucua

SEQ ID NO: 2502701 - RNA, 15 nt, Chlamydia trachomatis
agaagaagaacugca

SEQ ID NO: 2502702 - RNA, 15 nt, Chlamydia trachomatis
agaagaagagagaag

SEQ ID NO: 2502703 - RNA, 11 nt, Chlamydia trachomatis
agaagaagagg

SEQ ID NO: 2502704 - RNA, 20 nt, Chlamydia trachomatis
agaagaagccccaauagcua

SEQ ID NO: 2502705 - RNA, 22 nt, Chlamydia trachomatis
agaagaagccccaauagcuaag

SEQ ID NO: 2502706 - RNA, 17 nt, Chlamydia trachomatis
agaagaaggaagaggag

SEQ ID NO: 2502707 - RNA, 15 nt, Chlamydia trachomatis
agaagaaucuucuuc

SEQ ID NO: 2502708 - RNA, 20 nt, Chlamydia trachomatis
agaagaaucuucuucgaaau

SEQ ID NO: 2502709 - RNA, 21 nt, Chlamydia trachomatis
agaagacgcucauaaagagcc

SEQ ID NO: 2502710 - RNA, 17 nt, Chlamydia trachomatis
agaagacuuuggaagag

SEQ ID NO: 2502711 - RNA, 19 nt, Chlamydia trachomatis
agaagacuuuggaagaggc

SEQ ID NO: 2502712 - RNA, 22 nt, Chlamydia trachomatis
agaagagcuguuguuaauauca

SEQ ID NO: 2502713 - RNA, 15 nt, Chlamydia trachomatis
agaagagguauguuu

SEQ ID NO: 2502714 - RNA, 14 nt, Chlamydia trachomatis
agaagagucucuaa

SEQ ID NO: 2502715 - RNA, 13 nt, Chlamydia trachomatis
agaagaucccaua

SEQ ID NO: 2502716 - RNA, 20 nt, Chlamydia trachomatis
agaagcaugcaauccuucuu

SEQ ID NO: 2502717 - RNA, 16 nt, Chlamydia trachomatis
agaagccaauguucua

SEQ ID NO: 2502718 - RNA, 19 nt, Chlamydia trachomatis
agaagccauaauaaaaggc

SEQ ID NO: 2502719 - RNA, 22 nt, Chlamydia trachomatis
agaagccauaguagaaauuaca

SEQ ID NO: 2502720 - RNA, 13 nt, Chlamydia trachomatis
agaagccuugagc

SEQ ID NO: 2502721 - RNA, 21 nt, Chlamydia trachomatis
agaagccuugagccuucaauu

SEQ ID NO: 2502722 - RNA, 21 nt, Chlamydia trachomatis
agaagcuaauagcuugaagaa

SEQ ID NO: 2502723 - RNA, 21 nt, Chlamydia trachomatis
agaagcuaugagaauuuccag

SEQ ID NO: 2502724 - RNA, 22 nt, Chlamydia trachomatis
agaagcuaugagaauuuccagc

SEQ ID NO: 2502725 - RNA, 21 nt, Chlamydia trachomatis
agaagcuccuuuaccuuucac

SEQ ID NO: 2502726 - RNA, 22 nt, Chlamydia trachomatis
agaagcuccuuuaccuuucacu

SEQ ID NO: 2502727 - RNA, 15 nt, Chlamydia trachomatis
agaagcugcagagau

SEQ ID NO: 2502728 - RNA, 12 nt, Chlamydia trachomatis
agaagcugcaua

SEQ ID NO: 2502729 - RNA, 14 nt, Chlamydia trachomatis
agaaggaagaggag

SEQ ID NO: 2502730 - RNA, 12 nt, Chlamydia trachomatis
agaaggaaugca

SEQ ID NO: 2502731 - RNA, 18 nt, Chlamydia trachomatis
agaaggcccaguaaacua

SEQ ID NO: 2502732 - RNA, 14 nt, Chlamydia trachomatis
agaaggccuuuuuu

SEQ ID NO: 2502733 - RNA, 15 nt, Chlamydia trachomatis
agaaggcuuuucuau

SEQ ID NO: 2502734 - RNA, 23 nt, Chlamydia trachomatis
agaaggggcauuacgccccuucu

SEQ ID NO: 2502735 - RNA, 19 nt, Chlamydia trachomatis
agaagguccgccaacuauu

SEQ ID NO: 2502736 - RNA, 15 nt, Chlamydia trachomatis
agaaggucugaacaa

SEQ ID NO: 2502737 - RNA, 14 nt, Chlamydia trachomatis
agaaguaaaacaga

SEQ ID NO: 2502738 - RNA, 15 nt, Chlamydia trachomatis
agaaguccuggaggg

SEQ ID NO: 2502739 - RNA, 23 nt, Chlamydia trachomatis
agaagucuaccguauuaucugca

SEQ ID NO: 2502740 - RNA, 22 nt, Chlamydia trachomatis
agaaguugguuuggguuuuaau

SEQ ID NO: 2502741 - RNA, 13 nt, Chlamydia trachomatis
agaaguuuuaaca

SEQ ID NO: 2502742 - RNA, 15 nt, Chlamydia trachomatis
agaauaaaaggcuac

SEQ ID NO: 2502743 - RNA, 22 nt, Chlamydia trachomatis
agaauaaaaggcuacuaaagac

SEQ ID NO: 2502744 - RNA, 22 nt, Chlamydia trachomatis
agaauaauacaggaggucucac

SEQ ID NO: 2502745 - RNA, 13 nt, Chlamydia trachomatis
agaauacaaagca

SEQ ID NO: 2502746 - RNA, 14 nt, Chlamydia trachomatis
agaauacaagaaag

SEQ ID NO: 2502747 - RNA, 13 nt, Chlamydia trachomatis
agaauaccaacuu

SEQ ID NO: 2502748 - RNA, 12 nt, Chlamydia trachomatis
agaauaccacca

SEQ ID NO: 2502749 - RNA, 23 nt, Chlamydia trachomatis
agaauauagcuguaauaaacacu

SEQ ID NO: 2502750 - RNA, 17 nt, Chlamydia trachomatis
agaauaugcgacaguac

SEQ ID NO: 2502751 - RNA, 23 nt, Chlamydia trachomatis
agaaucaaaacgcucagaaaacu

SEQ ID NO: 2502752 - RNA, 22 nt, Chlamydia trachomatis
agaaucaucugguauucuaaau

SEQ ID NO: 2502753 - RNA, 12 nt, Chlamydia trachomatis
agaauccaaagu

SEQ ID NO: 2502754 - RNA, 17 nt, Chlamydia trachomatis
agaauccaaauuuuguu

SEQ ID NO: 2502755 - RNA, 16 nt, Chlamydia trachomatis
agaauccuuuucagaa

SEQ ID NO: 2502756 - RNA, 22 nt, Chlamydia trachomatis
agaaucuaccacggauaaagaa

SEQ ID NO: 2502757 - RNA, 20 nt, Chlamydia trachomatis
agaaucugcucacuaucugu

SEQ ID NO: 2502758 - RNA, 16 nt, Chlamydia trachomatis
agaaucugucuaagau

SEQ ID NO: 2502759 - RNA, 15 nt, Chlamydia trachomatis
agaaucuuaaacaag

SEQ ID NO: 2502760 - RNA, 17 nt, Chlamydia trachomatis
agaaucuuaaacaagau

SEQ ID NO: 2502761 - RNA, 13 nt, Chlamydia trachomatis
agaaucuuuggaa

SEQ ID NO: 2502762 - RNA, 24 nt, Chlamydia trachomatis
agaaucuuuggaagcagaaagaau

SEQ ID NO: 2502763 - RNA, 15 nt, Chlamydia trachomatis
agaaugaucacuuga

SEQ ID NO: 2502764 - RNA, 17 nt, Chlamydia trachomatis
agaaugauugauaaagc

SEQ ID NO: 2502765 - RNA, 18 nt, Chlamydia trachomatis
agaaugguucuuagcgcu

SEQ ID NO: 2502766 - RNA, 18 nt, Chlamydia trachomatis
agaaugugacuaaaggcg

SEQ ID NO: 2502767 - RNA, 13 nt, Chlamydia trachomatis
agaauuacccuga

SEQ ID NO: 2502768 - RNA, 19 nt, Chlamydia trachomatis
agaauucgagucggacagu

SEQ ID NO: 2502769 - RNA, 15 nt, Chlamydia trachomatis
agaauuggaaacucu

SEQ ID NO: 2502770 - RNA, 15 nt, Chlamydia trachomatis
agaauuucuuccucu

SEQ ID NO: 2502771 - RNA, 17 nt, Chlamydia trachomatis
agaauuucuuccucuaa

SEQ ID NO: 2502772 - RNA, 19 nt, Chlamydia trachomatis
agaauuucuuccucuaauu

SEQ ID NO: 2502773 - RNA, 13 nt, Chlamydia trachomatis
agaauuuuaaaca

SEQ ID NO: 2502774 - RNA, 21 nt, Chlamydia trachomatis
agacaaaaaaugcgcucuuua

SEQ ID NO: 2502775 - RNA, 15 nt, Chlamydia trachomatis
agacaaaacuucuuc

SEQ ID NO: 2502776 - RNA, 21 nt, Chlamydia trachomatis
agacaaagaucguaaaauagc

SEQ ID NO: 2502777 - RNA, 21 nt, Chlamydia trachomatis
agacaaagguguguucccaga

SEQ ID NO: 2502778 - RNA, 18 nt, Chlamydia trachomatis
agacaagacuucuucuaa

SEQ ID NO: 2502779 - RNA, 15 nt, Chlamydia trachomatis
agacaagccuucagg

SEQ ID NO: 2502780 - RNA, 16 nt, Chlamydia trachomatis
agacacuauuaaaaag

SEQ ID NO: 2502781 - RNA, 19 nt, Chlamydia trachomatis
agacacuauuaaaaaggcu

SEQ ID NO: 2502782 - RNA, 20 nt, Chlamydia trachomatis
agaccuacaaagauaaucaa

SEQ ID NO: 2502783 - RNA, 17 nt, Chlamydia trachomatis
agaccuaguaagugcau

SEQ ID NO: 2502784 - RNA, 19 nt, Chlamydia trachomatis
agaccuaguaagugcauac

SEQ ID NO: 2502785 - RNA, 18 nt, Chlamydia trachomatis
agaccucuccauccugcg

SEQ ID NO: 2502786 - RNA, 19 nt, Chlamydia trachomatis
agacgaaguaggagaugcu

SEQ ID NO: 2502787 - RNA, 18 nt, Chlamydia trachomatis
agacgauucucaugcacu

SEQ ID NO: 2502788 - RNA, 21 nt, Chlamydia trachomatis
agacgcuuuagcuaaguuggc

SEQ ID NO: 2502789 - RNA, 15 nt, Chlamydia trachomatis
agacggucuacaaau

SEQ ID NO: 2502790 - RNA, 16 nt, Chlamydia trachomatis
agacguucuugcugag

SEQ ID NO: 2502791 - RNA, 17 nt, Chlamydia trachomatis
agacguucuugcugaga

SEQ ID NO: 2502792 - RNA, 20 nt, Chlamydia trachomatis
agacguucuugcugagaauc

SEQ ID NO: 2502793 - RNA, 20 nt, Chlamydia trachomatis
agacuaaucuuccagcguug

SEQ ID NO: 2502794 - RNA, 16 nt, Chlamydia trachomatis
agacuagaugcaauaa

SEQ ID NO: 2502795 - RNA, 21 nt, Chlamydia trachomatis
agacucacagcaaauaaagag

SEQ ID NO: 2502796 - RNA, 16 nt, Chlamydia trachomatis
agacucagguuaucca

SEQ ID NO: 2502797 - RNA, 19 nt, Chlamydia trachomatis
agacuccagcuucuccauc

SEQ ID NO: 2502798 - RNA, 22 nt, Chlamydia trachomatis
agacuccagcuucuccaucuga

SEQ ID NO: 2502799 - RNA, 20 nt, Chlamydia trachomatis
agacucuaauaaaucugcua

SEQ ID NO: 2502800 - RNA, 15 nt, Chlamydia trachomatis
agacucuuucaauag

SEQ ID NO: 2502801 - RNA, 13 nt, Chlamydia trachomatis
agacugccuaccu

SEQ ID NO: 2502802 - RNA, 15 nt, Chlamydia trachomatis
agacugccuaccugc

SEQ ID NO: 2502803 - RNA, 20 nt, Chlamydia trachomatis
agacugccuaccugcucugg

SEQ ID NO: 2502804 - RNA, 21 nt, Chlamydia trachomatis
agacuguggcaaggcuuucaa

SEQ ID NO: 2502805 - RNA, 13 nt, Chlamydia trachomatis
agacuucuucuaa

SEQ ID NO: 2502806 - RNA, 20 nt, Chlamydia trachomatis
agacuucuucuaaaggauag

SEQ ID NO: 2502807 - RNA, 15 nt, Chlamydia trachomatis
agacuucuuguauaa

SEQ ID NO: 2502808 - RNA, 19 nt, Chlamydia trachomatis
agacuuugugcaaccucua

SEQ ID NO: 2502809 - RNA, 17 nt, Chlamydia trachomatis
agagaaaagaaaagggg

SEQ ID NO: 2502810 - RNA, 13 nt, Chlamydia trachomatis
agagaaaaucaua

SEQ ID NO: 2502811 - RNA, 12 nt, Chlamydia trachomatis
agagaaaccaac

SEQ ID NO: 2502812 - RNA, 12 nt, Chlamydia trachomatis
agagaaagcucg

SEQ ID NO: 2502813 - RNA, 19 nt, Chlamydia trachomatis
agagaaagcucgaauacga

SEQ ID NO: 2502814 - RNA, 23 nt, Chlamydia trachomatis
agagaaagcucgaauacgaggag

SEQ ID NO: 2502815 - RNA, 14 nt, Chlamydia trachomatis
agagaagaauugaa

SEQ ID NO: 2502816 - RNA, 18 nt, Chlamydia trachomatis
agagaagcuccucuucuu

SEQ ID NO: 2502817 - RNA, 17 nt, Chlamydia trachomatis
agagaagguaacaaugc

SEQ ID NO: 2502818 - RNA, 18 nt, Chlamydia trachomatis
agagaagguaacaaugcu

SEQ ID NO: 2502819 - RNA, 15 nt, Chlamydia trachomatis
agagaauuagagaua

SEQ ID NO: 2502820 - RNA, 18 nt, Chlamydia trachomatis
agagaauuagagauaauu

SEQ ID NO: 2502821 - RNA, 22 nt, Chlamydia trachomatis
agagacacuauuaaaaaggcua

SEQ ID NO: 2502822 - RNA, 18 nt, Chlamydia trachomatis
agagaccgcucucuuuuc

SEQ ID NO: 2502823 - RNA, 21 nt, Chlamydia trachomatis
agagaccugcuucagcagcau

SEQ ID NO: 2502824 - RNA, 17 nt, Chlamydia trachomatis
agagacggcacaggugu

SEQ ID NO: 2502825 - RNA, 19 nt, Chlamydia trachomatis
agagacuuguuuagcaaga

SEQ ID NO: 2502826 - RNA, 19 nt, Chlamydia trachomatis
agagagccccaccagagau

SEQ ID NO: 2502827 - RNA, 23 nt, Chlamydia trachomatis
agagagccccaccagagauaaag

SEQ ID NO: 2502828 - RNA, 20 nt, Chlamydia trachomatis
agagagcgggcgguaaaagg

SEQ ID NO: 2502829 - RNA, 22 nt, Chlamydia trachomatis
agagagcguccucggauguaag

SEQ ID NO: 2502830 - RNA, 19 nt, Chlamydia trachomatis
agagagcuuugaucuuugu

SEQ ID NO: 2502831 - RNA, 21 nt, Chlamydia trachomatis
agagagcuuugaucuuuguuc

SEQ ID NO: 2502832 - RNA, 14 nt, Chlamydia trachomatis
agagaggagaaaaa

SEQ ID NO: 2502833 - RNA, 22 nt, Chlamydia trachomatis
agagaggcgucugcauaaaacu

SEQ ID NO: 2502834 - RNA, 15 nt, Chlamydia trachomatis
agagaggcugcauua

SEQ ID NO: 2502835 - RNA, 22 nt, Chlamydia trachomatis
agagaggggagaguuaggcugc

SEQ ID NO: 2502836 - RNA, 20 nt, Chlamydia trachomatis
agagauaaagcuuuuucuac

SEQ ID NO: 2502837 - RNA, 14 nt, Chlamydia trachomatis
agagauauaagaga

SEQ ID NO: 2502838 - RNA, 20 nt, Chlamydia trachomatis
agagauauaagagaagguaa

SEQ ID NO: 2502839 - RNA, 19 nt, Chlamydia trachomatis
agagauaucacuaccagcc

SEQ ID NO: 2502840 - RNA, 22 nt, Chlamydia trachomatis
agagauauugucuacuuuuugu

SEQ ID NO: 2502841 - RNA, 15 nt, Chlamydia trachomatis
agagaucguacaaug

SEQ ID NO: 2502842 - RNA, 22 nt, Chlamydia trachomatis
agagaucugcauuccaggacga

SEQ ID NO: 2502843 - RNA, 14 nt, Chlamydia trachomatis
agagaucuucugaa

SEQ ID NO: 2502844 - RNA, 15 nt, Chlamydia trachomatis
agagaugaaccauuu

SEQ ID NO: 2502845 - RNA, 17 nt, Chlamydia trachomatis
agagaugauauuuucau

SEQ ID NO: 2502846 - RNA, 12 nt, Chlamydia trachomatis
agagaugcguug

SEQ ID NO: 2502847 - RNA, 21 nt, Chlamydia trachomatis
agagaugggucuuuuugcuac

SEQ ID NO: 2502848 - RNA, 22 nt, Chlamydia trachomatis
agagauguuuguguuucuaaaa

SEQ ID NO: 2502849 - RNA, 22 nt, Chlamydia trachomatis
agagauuccacuaccccaccua

SEQ ID NO: 2502850 - RNA, 11 nt, Chlamydia trachomatis
agagauuuccu

SEQ ID NO: 2502851 - RNA, 15 nt, Chlamydia trachomatis
agagauuuccucuuc

SEQ ID NO: 2502852 - RNA, 21 nt, Chlamydia trachomatis
agagauuuuuugagcaaaaua

SEQ ID NO: 2502853 - RNA, 13 nt, Chlamydia trachomatis
agagcaauauguu

SEQ ID NO: 2502854 - RNA, 13 nt, Chlamydia trachomatis
agagcaaucucuu

SEQ ID NO: 2502855 - RNA, 21 nt, Chlamydia trachomatis
agagcaucgaagcguuuacaa

SEQ ID NO: 2502856 - RNA, 15 nt, Chlamydia trachomatis
agagccaaaacaaac

SEQ ID NO: 2502857 - RNA, 12 nt, Chlamydia trachomatis
agagccaaaaua

SEQ ID NO: 2502858 - RNA, 22 nt, Chlamydia trachomatis
agagccaugaucaaagaaagcu

SEQ ID NO: 2502859 - RNA, 21 nt, Chlamydia trachomatis
agagccguucucucuaaaauc

SEQ ID NO: 2502860 - RNA, 18 nt, Chlamydia trachomatis
agagcucauagucugauc

SEQ ID NO: 2502861 - RNA, 18 nt, Chlamydia trachomatis
agagcugaggagggauaa

SEQ ID NO: 2502862 - RNA, 18 nt, Chlamydia trachomatis
agagcugcugucagaaga

SEQ ID NO: 2502863 - RNA, 19 nt, Chlamydia trachomatis
agagcuucuucuaaagaau

SEQ ID NO: 2502864 - RNA, 23 nt, Chlamydia trachomatis
agagcuuugaucuuuguucucua

SEQ ID NO: 2502865 - RNA, 20 nt, Chlamydia trachomatis
agagcuuugcacaccugcuu

SEQ ID NO: 2502866 - RNA, 13 nt, Chlamydia trachomatis
agagcuuuucuuc

SEQ ID NO: 2502867 - RNA, 15 nt, Chlamydia trachomatis
agagcuuuucuuccc

SEQ ID NO: 2502868 - RNA, 16 nt, Chlamydia trachomatis
agaggaauaagaggac

SEQ ID NO: 2502869 - RNA, 14 nt, Chlamydia trachomatis
agaggagaaaaacu

SEQ ID NO: 2502870 - RNA, 23 nt, Chlamydia trachomatis
agaggagggagaauuaauaggaa

SEQ ID NO: 2502871 - RNA, 13 nt, Chlamydia trachomatis
agaggagggagau

SEQ ID NO: 2502872 - RNA, 17 nt, Chlamydia trachomatis
agaggaguuuuuuucac

SEQ ID NO: 2502873 - RNA, 18 nt, Chlamydia trachomatis
agaggauagaucaagaaa

SEQ ID NO: 2502874 - RNA, 22 nt, Chlamydia trachomatis
agaggaucagcguugggauaga

SEQ ID NO: 2502875 - RNA, 21 nt, Chlamydia trachomatis
agaggauuauuccgagagaag

SEQ ID NO: 2502876 - RNA, 13 nt, Chlamydia trachomatis
agaggcaccucuu

SEQ ID NO: 2502877 - RNA, 16 nt, Chlamydia trachomatis
agaggcauggaauggg

SEQ ID NO: 2502878 - RNA, 20 nt, Chlamydia trachomatis
agaggcauggaauggggagg

SEQ ID NO: 2502879 - RNA, 16 nt, Chlamydia trachomatis
agaggcccuucuugag

SEQ ID NO: 2502880 - RNA, 18 nt, Chlamydia trachomatis
agaggcgcccacagaaca

SEQ ID NO: 2502881 - RNA, 23 nt, Chlamydia trachomatis
agaggcuaguaaugugucuaaag

SEQ ID NO: 2502882 - RNA, 17 nt, Chlamydia trachomatis
agaggcuauugauuuuu

SEQ ID NO: 2502883 - RNA, 13 nt, Chlamydia trachomatis
agaggcuugagaa

SEQ ID NO: 2502884 - RNA, 20 nt, Chlamydia trachomatis
agaggguguugaauauuucc

SEQ ID NO: 2502885 - RNA, 21 nt, Chlamydia trachomatis
agaggguguugaauauuuccc

SEQ ID NO: 2502886 - RNA, 16 nt, Chlamydia trachomatis
agagguagccaaagaa

SEQ ID NO: 2502887 - RNA, 21 nt, Chlamydia trachomatis
agagguauuuuauucaaaucu

SEQ ID NO: 2502888 - RNA, 16 nt, Chlamydia trachomatis
agagguccagucuaca

SEQ ID NO: 2502889 - RNA, 20 nt, Chlamydia trachomatis
agaggugugauaggagagga

SEQ ID NO: 2502890 - RNA, 19 nt, Chlamydia trachomatis
agagguuguuacagucugu

SEQ ID NO: 2502891 - RNA, 22 nt, Chlamydia trachomatis
agagguuguuacagucuguguu

SEQ ID NO: 2502892 - RNA, 22 nt, Chlamydia trachomatis
agagucucuaacaacaguucuu

SEQ ID NO: 2502893 - RNA, 17 nt, Chlamydia trachomatis
agagucugcuacaaacu

SEQ ID NO: 2502894 - RNA, 15 nt, Chlamydia trachomatis
agaguggacuuuaga

SEQ ID NO: 2502895 - RNA, 22 nt, Chlamydia trachomatis
agagugugcuucuggacuauuu

SEQ ID NO: 2502896 - RNA, 14 nt, Chlamydia trachomatis
agaguuaccaauca

SEQ ID NO: 2502897 - RNA, 13 nt, Chlamydia trachomatis
agaguucucugag

SEQ ID NO: 2502898 - RNA, 22 nt, Chlamydia trachomatis
agaguucucugagggugagguc

SEQ ID NO: 2502899 - RNA, 20 nt, Chlamydia trachomatis
agaguucuucaaaugcggua

SEQ ID NO: 2502900 - RNA, 17 nt, Chlamydia trachomatis
agaguuuaggcccacag

SEQ ID NO: 2502901 - RNA, 19 nt, Chlamydia trachomatis
agaguuuguagauguagca

SEQ ID NO: 2502902 - RNA, 21 nt, Chlamydia trachomatis
agaguuugugauuuagacaca

SEQ ID NO: 2502903 - RNA, 11 nt, Chlamydia trachomatis
agauaaaagaa

SEQ ID NO: 2502904 - RNA, 22 nt, Chlamydia trachomatis
agauaaagcuuuuucuacugua

SEQ ID NO: 2502905 - RNA, 20 nt, Chlamydia trachomatis
agauaacugguguggguaag

SEQ ID NO: 2502906 - RNA, 18 nt, Chlamydia trachomatis
agauaacuuugaacaaau

SEQ ID NO: 2502907 - RNA, 20 nt, Chlamydia trachomatis
agauaagcaagcauaauucc

SEQ ID NO: 2502908 - RNA, 22 nt, Chlamydia trachomatis
agauaaguccaucuaaagggag

SEQ ID NO: 2502909 - RNA, 22 nt, Chlamydia trachomatis
agauaaugacagguuucaugac

SEQ ID NO: 2502910 - RNA, 13 nt, Chlamydia trachomatis
agauaauggcaaa

SEQ ID NO: 2502911 - RNA, 19 nt, Chlamydia trachomatis
agauacaaggcuccuuuuc

SEQ ID NO: 2502912 - RNA, 18 nt, Chlamydia trachomatis
agauacagacaucuaaag

SEQ ID NO: 2502913 - RNA, 22 nt, Chlamydia trachomatis
agauacaguaaggcucucgcag

SEQ ID NO: 2502914 - RNA, 16 nt, Chlamydia trachomatis
agauacuaacaaauag

SEQ ID NO: 2502915 - RNA, 19 nt, Chlamydia trachomatis
agauacugguaacugugga

SEQ ID NO: 2502916 - RNA, 23 nt, Chlamydia trachomatis
agauacuuuaccgcaaauaucca

SEQ ID NO: 2502917 - RNA, 22 nt, Chlamydia trachomatis
agauacuuuccgcuggaaacau

SEQ ID NO: 2502918 - RNA, 14 nt, Chlamydia trachomatis
agauagaagagcuu

SEQ ID NO: 2502919 - RNA, 21 nt, Chlamydia trachomatis
agauagccuccgcuaauuuuu

SEQ ID NO: 2502920 - RNA, 12 nt, Chlamydia trachomatis
agauagcuccaa

SEQ ID NO: 2502921 - RNA, 15 nt, Chlamydia trachomatis
agauaggcaggaaga

SEQ ID NO: 2502922 - RNA, 20 nt, Chlamydia trachomatis
agauaggggaaacuagcaaa

SEQ ID NO: 2502923 - RNA, 14 nt, Chlamydia trachomatis
agauaguagagaau

SEQ ID NO: 2502924 - RNA, 17 nt, Chlamydia trachomatis
agauauaaacaauaaga

SEQ ID NO: 2502925 - RNA, 20 nt, Chlamydia trachomatis
agauauaaucuaaagacaaa

SEQ ID NO: 2502926 - RNA, 13 nt, Chlamydia trachomatis
agauauccaaucc

SEQ ID NO: 2502927 - RNA, 13 nt, Chlamydia trachomatis
agauaucuuuacu

SEQ ID NO: 2502928 - RNA, 20 nt, Chlamydia trachomatis
agauaucuuuacucuuuucu

SEQ ID NO: 2502929 - RNA, 20 nt, Chlamydia trachomatis
agauaugaguggcaaggggg

SEQ ID NO: 2502930 - RNA, 19 nt, Chlamydia trachomatis
agauauucacgcaucccaa

SEQ ID NO: 2502931 - RNA, 19 nt, Chlamydia trachomatis
agauauucaggucauucgu

SEQ ID NO: 2502932 - RNA, 21 nt, Chlamydia trachomatis
agauauugucuacuuuuuguu

SEQ ID NO: 2502933 - RNA, 22 nt, Chlamydia trachomatis
agauauuuccauaagagaggcu

SEQ ID NO: 2502934 - RNA, 13 nt, Chlamydia trachomatis
agauauuuucaca

SEQ ID NO: 2502935 - RNA, 17 nt, Chlamydia trachomatis
agaucaaggauccagga

SEQ ID NO: 2502936 - RNA, 21 nt, Chlamydia trachomatis
agaucaaggauccaggagaug

SEQ ID NO: 2502937 - RNA, 22 nt, Chlamydia trachomatis
agaucauaggcuccugcaaggg

SEQ ID NO: 2502938 - RNA, 14 nt, Chlamydia trachomatis
agaucauaucugca

SEQ ID NO: 2502939 - RNA, 22 nt, Chlamydia trachomatis
agauccacuggaauagcuagag

SEQ ID NO: 2502940 - RNA, 21 nt, Chlamydia trachomatis
agaucccaaaagauuuucaac

SEQ ID NO: 2502941 - RNA, 19 nt, Chlamydia trachomatis
agaucccagaauaaaggau

SEQ ID NO: 2502942 - RNA, 16 nt, Chlamydia trachomatis
agaucccauaaucuca

SEQ ID NO: 2502943 - RNA, 23 nt, Chlamydia trachomatis
agauccggauaugcaaguaauga

SEQ ID NO: 2502944 - RNA, 22 nt, Chlamydia trachomatis
agauccguuuuucuacaacuau

SEQ ID NO: 2502945 - RNA, 13 nt, Chlamydia trachomatis
agauccucuuucg

SEQ ID NO: 2502946 - RNA, 16 nt, Chlamydia trachomatis
agaucgaauaguagga

SEQ ID NO: 2502947 - RNA, 15 nt, Chlamydia trachomatis
agaucguugcuucca

SEQ ID NO: 2502948 - RNA, 19 nt, Chlamydia trachomatis
agaucuaaggaauguggag

SEQ ID NO: 2502949 - RNA, 21 nt, Chlamydia trachomatis
agaucucauagcaccagcuaa

SEQ ID NO: 2502950 - RNA, 15 nt, Chlamydia trachomatis
agaucucaucaggau

SEQ ID NO: 2502951 - RNA, 21 nt, Chlamydia trachomatis
agaucucuccagaguucauuu

SEQ ID NO: 2502952 - RNA, 22 nt, Chlamydia trachomatis
agaucucuccagaguucauuuu

SEQ ID NO: 2502953 - RNA, 16 nt, Chlamydia trachomatis
agaucugguccuccag

SEQ ID NO: 2502954 - RNA, 16 nt, Chlamydia trachomatis
agaucuguagcaagaa

SEQ ID NO: 2502955 - RNA, 16 nt, Chlamydia trachomatis
agaucuuuucgucuuc

SEQ ID NO: 2502956 - RNA, 15 nt, Chlamydia trachomatis
agaucuuuuucauuu

SEQ ID NO: 2502957 - RNA, 16 nt, Chlamydia trachomatis
agaugaauugaauaca

SEQ ID NO: 2502958 - RNA, 21 nt, Chlamydia trachomatis
agaugacucaaacugugaaga

SEQ ID NO: 2502959 - RNA, 23 nt, Chlamydia trachomatis
agaugacucaaacugugaagaau

SEQ ID NO: 2502960 - RNA, 18 nt, Chlamydia trachomatis
agaugacuugcccgacag

SEQ ID NO: 2502961 - RNA, 22 nt, Chlamydia trachomatis
agaugacuuuggcaugcccuaa

SEQ ID NO: 2502962 - RNA, 21 nt, Chlamydia trachomatis
agaugauuguuuugauuucau

SEQ ID NO: 2502963 - RNA, 15 nt, Chlamydia trachomatis
agaugcuuuguaaaa

SEQ ID NO: 2502964 - RNA, 19 nt, Chlamydia trachomatis
agauggguuuguagguacu

SEQ ID NO: 2502965 - RNA, 16 nt, Chlamydia trachomatis
agauguuaucucuggu

SEQ ID NO: 2502966 - RNA, 13 nt, Chlamydia trachomatis
agauguugugggu

SEQ ID NO: 2502967 - RNA, 17 nt, Chlamydia trachomatis
agauuauaauuccaaug

SEQ ID NO: 2502968 - RNA, 15 nt, Chlamydia trachomatis
agauuauaccagcag

SEQ ID NO: 2502969 - RNA, 22 nt, Chlamydia trachomatis
agauuaucauucaaaauccauu

SEQ ID NO: 2502970 - RNA, 16 nt, Chlamydia trachomatis
agauucagcaagauuc

SEQ ID NO: 2502971 - RNA, 20 nt, Chlamydia trachomatis
agauucagcaagauucuccu

SEQ ID NO: 2502972 - RNA, 11 nt, Chlamydia trachomatis
agauuccacaa

SEQ ID NO: 2502973 - RNA, 19 nt, Chlamydia trachomatis
agauuccacuaccccaccu

SEQ ID NO: 2502974 - RNA, 14 nt, Chlamydia trachomatis
agauucccuuuaaa

SEQ ID NO: 2502975 - RNA, 13 nt, Chlamydia trachomatis
agauucgcugcug

SEQ ID NO: 2502976 - RNA, 19 nt, Chlamydia trachomatis
agauucuuugguaauagca

SEQ ID NO: 2502977 - RNA, 21 nt, Chlamydia trachomatis
agauugauuguugcauaucca

SEQ ID NO: 2502978 - RNA, 21 nt, Chlamydia trachomatis
agauugccuuuucuauuuaga

SEQ ID NO: 2502979 - RNA, 18 nt, Chlamydia trachomatis
agauuguuguaugcucgc

SEQ ID NO: 2502980 - RNA, 20 nt, Chlamydia trachomatis
agauuuagagaauaaucgag

SEQ ID NO: 2502981 - RNA, 13 nt, Chlamydia trachomatis
agauuuccagcuu

SEQ ID NO: 2502982 - RNA, 12 nt, Chlamydia trachomatis
agauuucuucug

SEQ ID NO: 2502983 - RNA, 20 nt, Chlamydia trachomatis
agauuucuucuguagcccca

SEQ ID NO: 2502984 - RNA, 21 nt, Chlamydia trachomatis
agauuucuucuguagccccag

SEQ ID NO: 2502985 - RNA, 14 nt, Chlamydia trachomatis
agauuucuucuuug

SEQ ID NO: 2502986 - RNA, 20 nt, Chlamydia trachomatis
agauuuguuuaaaagaagcu

SEQ ID NO: 2502987 - RNA, 13 nt, Chlamydia trachomatis
agauuuucaucuu

SEQ ID NO: 2502988 - RNA, 23 nt, Chlamydia trachomatis
agauuuucuagggaaaaaaagag

SEQ ID NO: 2502989 - RNA, 23 nt, Chlamydia trachomatis
agauuuugaauaauagaaaaacu

SEQ ID NO: 2502990 - RNA, 16 nt, Chlamydia trachomatis
agauuuuuagaaggaa

SEQ ID NO: 2502991 - RNA, 20 nt, Chlamydia trachomatis
agauuuuuugagcaaaauag

SEQ ID NO: 2502992 - RNA, 15 nt, Chlamydia trachomatis
agcaaaaaaagaggu

SEQ ID NO: 2502993 - RNA, 15 nt, Chlamydia trachomatis
agcaaaaagaggaga

SEQ ID NO: 2502994 - RNA, 19 nt, Chlamydia trachomatis
agcaaaaagaggagaacau

SEQ ID NO: 2502995 - RNA, 14 nt, Chlamydia trachomatis
agcaaaacauccau

SEQ ID NO: 2502996 - RNA, 17 nt, Chlamydia trachomatis
agcaaaacgcccuccaa

SEQ ID NO: 2502997 - RNA, 19 nt, Chlamydia trachomatis
agcaaaagaagaaucuucu

SEQ ID NO: 2502998 - RNA, 13 nt, Chlamydia trachomatis
agcaaaaucuucu

SEQ ID NO: 2502999 - RNA, 16 nt, Chlamydia trachomatis
agcaaacagauucuau

SEQ ID NO: 2503000 - RNA, 20 nt, Chlamydia trachomatis
agcaaacagauucuauagga

SEQ ID NO: 2503001 - RNA, 15 nt, Chlamydia trachomatis
agcaaacuucauauu

SEQ ID NO: 2503002 - RNA, 19 nt, Chlamydia trachomatis
agcaaacuuuuuguaggua

SEQ ID NO: 2503003 - RNA, 20 nt, Chlamydia trachomatis
agcaaagcuauuugcaagaa

SEQ ID NO: 2503004 - RNA, 15 nt, Chlamydia trachomatis
agcaaauaaagaggu

SEQ ID NO: 2503005 - RNA, 21 nt, Chlamydia trachomatis
agcaaauagauaacuuugaac

SEQ ID NO: 2503006 - RNA, 22 nt, Chlamydia trachomatis
agcaaauccugcgcgcaaauca

SEQ ID NO: 2503007 - RNA, 15 nt, Chlamydia trachomatis
agcaaauuaacagau

SEQ ID NO: 2503008 - RNA, 17 nt, Chlamydia trachomatis
agcaaauuaacagauau

SEQ ID NO: 2503009 - RNA, 18 nt, Chlamydia trachomatis
agcaaauuaacagauaua

SEQ ID NO: 2503010 - RNA, 14 nt, Chlamydia trachomatis
agcaacaauauccu

SEQ ID NO: 2503011 - RNA, 17 nt, Chlamydia trachomatis
agcaaccgauucuucac

SEQ ID NO: 2503012 - RNA, 18 nt, Chlamydia trachomatis
agcaaccgauucuucaca

SEQ ID NO: 2503013 - RNA, 20 nt, Chlamydia trachomatis
agcaaccgauucuucacagc

SEQ ID NO: 2503014 - RNA, 14 nt, Chlamydia trachomatis
agcaaccuuaucuu

SEQ ID NO: 2503015 - RNA, 17 nt, Chlamydia trachomatis
agcaacgaaaccaaaau

SEQ ID NO: 2503016 - RNA, 15 nt, Chlamydia trachomatis
agcaacgagcaauag

SEQ ID NO: 2503017 - RNA, 14 nt, Chlamydia trachomatis
agcaacuauauuug

SEQ ID NO: 2503018 - RNA, 15 nt, Chlamydia trachomatis
agcaacugcuuucuu

SEQ ID NO: 2503019 - RNA, 16 nt, Chlamydia trachomatis
agcaagaagaagagag

SEQ ID NO: 2503020 - RNA, 14 nt, Chlamydia trachomatis
agcaagaauacaag

SEQ ID NO: 2503021 - RNA, 17 nt, Chlamydia trachomatis
agcaagaauacaagaaa

SEQ ID NO: 2503022 - RNA, 16 nt, Chlamydia trachomatis
agcaagauagucugga

SEQ ID NO: 2503023 - RNA, 17 nt, Chlamydia trachomatis
agcaagauauaaacaau

SEQ ID NO: 2503024 - RNA, 22 nt, Chlamydia trachomatis
agcaagauauaaacaauaagaa

SEQ ID NO: 2503025 - RNA, 15 nt, Chlamydia trachomatis
agcaagauucuccuu

SEQ ID NO: 2503026 - RNA, 23 nt, Chlamydia trachomatis
agcaagccccgaaacccaacgca

SEQ ID NO: 2503027 - RNA, 14 nt, Chlamydia trachomatis
agcaagcccuugag

SEQ ID NO: 2503028 - RNA, 15 nt, Chlamydia trachomatis
agcaagcccuugaga

SEQ ID NO: 2503029 - RNA, 15 nt, Chlamydia trachomatis
agcaagcucaacaag

SEQ ID NO: 2503030 - RNA, 14 nt, Chlamydia trachomatis
agcaauagcaacug

SEQ ID NO: 2503031 - RNA, 21 nt, Chlamydia trachomatis
agcaaugccgaaaccaacaag

SEQ ID NO: 2503032 - RNA, 17 nt, Chlamydia trachomatis
agcaaugcgaucagaaa

SEQ ID NO: 2503033 - RNA, 16 nt, Chlamydia trachomatis
agcaauucaucagcac

SEQ ID NO: 2503034 - RNA, 23 nt, Chlamydia trachomatis
agcacaaguugguagcagcuaga

SEQ ID NO: 2503035 - RNA, 14 nt, Chlamydia trachomatis
agcacaucacuaua

SEQ ID NO: 2503036 - RNA, 23 nt, Chlamydia trachomatis
agcaccaagcuccacaggugaau

SEQ ID NO: 2503037 - RNA, 14 nt, Chlamydia trachomatis
agcaccaaguucuu

SEQ ID NO: 2503038 - RNA, 23 nt, Chlamydia trachomatis
agcaccaaguucuucuuuagaaa

SEQ ID NO: 2503039 - RNA, 16 nt, Chlamydia trachomatis
agcacccacauuacca

SEQ ID NO: 2503040 - RNA, 21 nt, Chlamydia trachomatis
agcacccuuucuuacuccuuc

SEQ ID NO: 2503041 - RNA, 19 nt, Chlamydia trachomatis
agcaccuguuuaucuucau

SEQ ID NO: 2503042 - RNA, 16 nt, Chlamydia trachomatis
agcaccuuuacaauca

SEQ ID NO: 2503043 - RNA, 22 nt, Chlamydia trachomatis
agcaccuuuacaaucaucuucc

SEQ ID NO: 2503044 - RNA, 23 nt, Chlamydia trachomatis
agcaccuuuacaaucaucuuccc

SEQ ID NO: 2503045 - RNA, 17 nt, Chlamydia trachomatis
agcacgcaaaacaucua

SEQ ID NO: 2503046 - RNA, 14 nt, Chlamydia trachomatis
agcacucaaacacu

SEQ ID NO: 2503047 - RNA, 22 nt, Chlamydia trachomatis
agcacucaaacacucgugaaau

SEQ ID NO: 2503048 - RNA, 19 nt, Chlamydia trachomatis
agcacucucaacgaaagcu

SEQ ID NO: 2503049 - RNA, 16 nt, Chlamydia trachomatis
agcacuggauccuaaa

SEQ ID NO: 2503050 - RNA, 20 nt, Chlamydia trachomatis
agcacuggauccuaaaucca

SEQ ID NO: 2503051 - RNA, 13 nt, Chlamydia trachomatis
agcacuucuucuu

SEQ ID NO: 2503052 - RNA, 20 nt, Chlamydia trachomatis
agcagaaacagcuucuucuu

SEQ ID NO: 2503053 - RNA, 16 nt, Chlamydia trachomatis
agcagaaagaaugcuu

SEQ ID NO: 2503054 - RNA, 15 nt, Chlamydia trachomatis
agcagauauggaaga

SEQ ID NO: 2503055 - RNA, 12 nt, Chlamydia trachomatis
agcagaucaucc

SEQ ID NO: 2503056 - RNA, 20 nt, Chlamydia trachomatis
agcagaucauccauaaaaac

SEQ ID NO: 2503057 - RNA, 16 nt, Chlamydia trachomatis
agcagcagaaggugug

SEQ ID NO: 2503058 - RNA, 20 nt, Chlamydia trachomatis
agcagcauucguguguagga

SEQ ID NO: 2503059 - RNA, 23 nt, Chlamydia trachomatis
agcagcauucguguguaggaaug

SEQ ID NO: 2503060 - RNA, 23 nt, Chlamydia trachomatis
agcagccaauuucucuacccagg

SEQ ID NO: 2503061 - RNA, 15 nt, Chlamydia trachomatis
agcagccucucuuug

SEQ ID NO: 2503062 - RNA, 21 nt, Chlamydia trachomatis
agcagcgcuuaucagcuucac

SEQ ID NO: 2503063 - RNA, 17 nt, Chlamydia trachomatis
agcagcuaacagcucuu

SEQ ID NO: 2503064 - RNA, 14 nt, Chlamydia trachomatis
agcagcuaauacuu

SEQ ID NO: 2503065 - RNA, 11 nt, Chlamydia trachomatis
agcagcucuua

SEQ ID NO: 2503066 - RNA, 23 nt, Chlamydia trachomatis
agcagcuuccugagggccuucuu

SEQ ID NO: 2503067 - RNA, 12 nt, Chlamydia trachomatis
agcaggaacuuc

SEQ ID NO: 2503068 - RNA, 15 nt, Chlamydia trachomatis
agcaggaacuucuuc

SEQ ID NO: 2503069 - RNA, 19 nt, Chlamydia trachomatis
agcaggcgaacagugacag

SEQ ID NO: 2503070 - RNA, 21 nt, Chlamydia trachomatis
agcagggaacacagagucugu

SEQ ID NO: 2503071 - RNA, 14 nt, Chlamydia trachomatis
agcaguagcuacuu

SEQ ID NO: 2503072 - RNA, 21 nt, Chlamydia trachomatis
agcaguagcuacuucagggug

SEQ ID NO: 2503073 - RNA, 21 nt, Chlamydia trachomatis
agcagugagcugguaauuggc

SEQ ID NO: 2503074 - RNA, 17 nt, Chlamydia trachomatis
agcaguuacauuuuucg

SEQ ID NO: 2503075 - RNA, 13 nt, Chlamydia trachomatis
agcauaaauccuu

SEQ ID NO: 2503076 - RNA, 13 nt, Chlamydia trachomatis
agcauaauauccc

SEQ ID NO: 2503077 - RNA, 15 nt, Chlamydia trachomatis
agcauaauaucccca

SEQ ID NO: 2503078 - RNA, 21 nt, Chlamydia trachomatis
agcauagcgcuucccgcuauu

SEQ ID NO: 2503079 - RNA, 14 nt, Chlamydia trachomatis
agcauagcuucuug

SEQ ID NO: 2503080 - RNA, 16 nt, Chlamydia trachomatis
agcauagggaucccac

SEQ ID NO: 2503081 - RNA, 22 nt, Chlamydia trachomatis
agcauagggaucccacaaagaa

SEQ ID NO: 2503082 - RNA, 22 nt, Chlamydia trachomatis
agcauaguauuacggaaaagcu

SEQ ID NO: 2503083 - RNA, 15 nt, Chlamydia trachomatis
agcauaucuccuaaa

SEQ ID NO: 2503084 - RNA, 16 nt, Chlamydia trachomatis
agcaucaguaaaaaua

SEQ ID NO: 2503085 - RNA, 18 nt, Chlamydia trachomatis
agcaucauccccagaagc

SEQ ID NO: 2503086 - RNA, 17 nt, Chlamydia trachomatis
agcauccccaaaaggau

SEQ ID NO: 2503087 - RNA, 19 nt, Chlamydia trachomatis
agcauccugaacccgcugc

SEQ ID NO: 2503088 - RNA, 23 nt, Chlamydia trachomatis
agcaucgagauaauauugagaaa

SEQ ID NO: 2503089 - RNA, 19 nt, Chlamydia trachomatis
agcaucuacugaugcuugg

SEQ ID NO: 2503090 - RNA, 15 nt, Chlamydia trachomatis
agcaucuucacaguu

SEQ ID NO: 2503091 - RNA, 23 nt, Chlamydia trachomatis
agcaucuucucgaaagagaacac

SEQ ID NO: 2503092 - RNA, 18 nt, Chlamydia trachomatis
agcaucuuuaccauuucc

SEQ ID NO: 2503093 - RNA, 19 nt, Chlamydia trachomatis
agcaucuuuucuuauaaag

SEQ ID NO: 2503094 - RNA, 14 nt, Chlamydia trachomatis
agcaugaccucaga

SEQ ID NO: 2503095 - RNA, 18 nt, Chlamydia trachomatis
agcaugauauuuugaaga

SEQ ID NO: 2503096 - RNA, 17 nt, Chlamydia trachomatis
agcaugcaaaacagcuc

SEQ ID NO: 2503097 - RNA, 14 nt, Chlamydia trachomatis
agcaugcacaucua

SEQ ID NO: 2503098 - RNA, 14 nt, Chlamydia trachomatis
agcauggaagacaa

SEQ ID NO: 2503099 - RNA, 12 nt, Chlamydia trachomatis
agcuccaaagaa

SEQ ID NO: 2503100 - RNA, 22 nt, Chlamydia trachomatis
agcuccuaaucuuucuaauuuc

SEQ ID NO: 2503101 - RNA, 16 nt, Chlamydia trachomatis
agcuccuagagccaau

SEQ ID NO: 2503102 - RNA, 20 nt, Chlamydia trachomatis
agcuccuaucacucccugca

SEQ ID NO: 2503103 - RNA, 12 nt, Chlamydia trachomatis
agcucgagucuc

SEQ ID NO: 2503104 - RNA, 22 nt, Chlamydia trachomatis
agcucguucacuaugaacaaac

SEQ ID NO: 2503105 - RNA, 13 nt, Chlamydia trachomatis
agcucuaaagagc

SEQ ID NO: 2503106 - RNA, 17 nt, Chlamydia trachomatis
agcucuaacucuucuuu

SEQ ID NO: 2503107 - RNA, 23 nt, Chlamydia trachomatis
agcucuaauuaauaacgcccucu

SEQ ID NO: 2503108 - RNA, 19 nt, Chlamydia trachomatis
agcucugcagauuuuguag

SEQ ID NO: 2503109 - RNA, 19 nt, Chlamydia trachomatis
agcucuucgagucuucccu

SEQ ID NO: 2503110 - RNA, 20 nt, Chlamydia trachomatis
agcucuucuucugaagagaa

SEQ ID NO: 2503111 - RNA, 12 nt, Chlamydia trachomatis
agcucuuuccuc

SEQ ID NO: 2503112 - RNA, 17 nt, Chlamydia trachomatis
agcucuuugauaugcag

SEQ ID NO: 2503113 - RNA, 19 nt, Chlamydia trachomatis
agcugcaguuucugagaaa

SEQ ID NO: 2503114 - RNA, 15 nt, Chlamydia trachomatis
agcugccgaaacuag

SEQ ID NO: 2503115 - RNA, 15 nt, Chlamydia trachomatis
agcugcugcccaaga

SEQ ID NO: 2503116 - RNA, 23 nt, Chlamydia trachomatis
agcugcugcccaagagauuuuuu

SEQ ID NO: 2503117 - RNA, 13 nt, Chlamydia trachomatis
agcugcugcuugg

SEQ ID NO: 2503118 - RNA, 12 nt, Chlamydia trachomatis
agcugcugucag

SEQ ID NO: 2503119 - RNA, 16 nt, Chlamydia trachomatis
agcugcugucagaaga

SEQ ID NO: 2503120 - RNA, 17 nt, Chlamydia trachomatis
agcugcuuuacaucccu

SEQ ID NO: 2503121 - RNA, 15 nt, Chlamydia trachomatis
agcugggaaagcugc

SEQ ID NO: 2503122 - RNA, 21 nt, Chlamydia trachomatis
agcugggaaaucuugugcuaa

SEQ ID NO: 2503123 - RNA, 13 nt, Chlamydia trachomatis
agcuguaaauguu

SEQ ID NO: 2503124 - RNA, 14 nt, Chlamydia trachomatis
agcuguaauaaaca

SEQ ID NO: 2503125 - RNA, 18 nt, Chlamydia trachomatis
agcuguacgauggaaaua

SEQ ID NO: 2503126 - RNA, 15 nt, Chlamydia trachomatis
agcugucccccagau

SEQ ID NO: 2503127 - RNA, 18 nt, Chlamydia trachomatis
agcugucccccagauaac

SEQ ID NO: 2503128 - RNA, 16 nt, Chlamydia trachomatis
agcuguuucauucacu

SEQ ID NO: 2503129 - RNA, 17 nt, Chlamydia trachomatis
agcuuaguuacaagaca

SEQ ID NO: 2503130 - RNA, 18 nt, Chlamydia trachomatis
agcuuauuaauuucuaga

SEQ ID NO: 2503131 - RNA, 19 nt, Chlamydia trachomatis
agcuuauuaauuucuagau

SEQ ID NO: 2503132 - RNA, 17 nt, Chlamydia trachomatis
agcuuccugagggccuu

SEQ ID NO: 2503133 - RNA, 21 nt, Chlamydia trachomatis
agcuuccugagggccuucuuu

SEQ ID NO: 2503134 - RNA, 20 nt, Chlamydia trachomatis
agcuuccuuacggaaaguuc

SEQ ID NO: 2503135 - RNA, 16 nt, Chlamydia trachomatis
agcuucgaggagucuc

SEQ ID NO: 2503136 - RNA, 14 nt, Chlamydia trachomatis
agcuucguagagca

SEQ ID NO: 2503137 - RNA, 18 nt, Chlamydia trachomatis
agcuucuaauuucuuucu

SEQ ID NO: 2503138 - RNA, 16 nt, Chlamydia trachomatis
agcuucuagaaauucu

SEQ ID NO: 2503139 - RNA, 22 nt, Chlamydia trachomatis
agcuucucaacacugaaaaucg

SEQ ID NO: 2503140 - RNA, 19 nt, Chlamydia trachomatis
agcuucucgaucagcccaa

SEQ ID NO: 2503141 - RNA, 17 nt, Chlamydia trachomatis
agcuucucgcuacaaau

SEQ ID NO: 2503142 - RNA, 22 nt, Chlamydia trachomatis
agcuucugacucuaguguuugu

SEQ ID NO: 2503143 - RNA, 23 nt, Chlamydia trachomatis
agcuucugguguaggaaaauaca

SEQ ID NO: 2503144 - RNA, 11 nt, Chlamydia trachomatis
agcuucuucuu

SEQ ID NO: 2503145 - RNA, 15 nt, Chlamydia trachomatis
agcuucuucuucucu

SEQ ID NO: 2503146 - RNA, 16 nt, Chlamydia trachomatis
agcuugaucaaagaau

SEQ ID NO: 2503147 - RNA, 12 nt, Chlamydia trachomatis
agcuugcaacac

SEQ ID NO: 2503148 - RNA, 15 nt, Chlamydia trachomatis
agcuugcacagcaag

SEQ ID NO: 2503149 - RNA, 18 nt, Chlamydia trachomatis
agcuugucuccuucuuug

SEQ ID NO: 2503150 - RNA, 22 nt, Chlamydia trachomatis
agcuuguuccguuguagagaua

SEQ ID NO: 2503151 - RNA, 23 nt, Chlamydia trachomatis
agcuuuaaagagcaugaccucag

SEQ ID NO: 2503152 - RNA, 14 nt, Chlamydia trachomatis
agcuuuauuuucau

SEQ ID NO: 2503153 - RNA, 20 nt, Chlamydia trachomatis
agcuuuccucacacacaaaa

SEQ ID NO: 2503154 - RNA, 20 nt, Chlamydia trachomatis
agcuuucgcugcggaaaucu

SEQ ID NO: 2503155 - RNA, 21 nt, Chlamydia trachomatis
agcuuucgcugcggaaaucuu

SEQ ID NO: 2503156 - RNA, 16 nt, Chlamydia trachomatis
agcuuucguugaucac

SEQ ID NO: 2503157 - RNA, 21 nt, Chlamydia trachomatis
agcuuugauuaaccaaaagag

SEQ ID NO: 2503158 - RNA, 20 nt, Chlamydia trachomatis
agcuuuguuaaucgauucuu

SEQ ID NO: 2503159 - RNA, 15 nt, Chlamydia trachomatis
agcuuuuccgcugca

SEQ ID NO: 2503160 - RNA, 16 nt, Chlamydia trachomatis
agcuuuuccgcugcaa

SEQ ID NO: 2503161 - RNA, 15 nt, Chlamydia trachomatis
agcuuuucuaacguu

SEQ ID NO: 2503162 - RNA, 16 nt, Chlamydia trachomatis
agcuuuucuccuucuu

SEQ ID NO: 2503163 - RNA, 20 nt, Chlamydia trachomatis
agcuuuucuucccugagaaa

SEQ ID NO: 2503164 - RNA, 13 nt, Chlamydia trachomatis
agcuuuuuccaaa

SEQ ID NO: 2503165 - RNA, 14 nt, Chlamydia trachomatis
agcuuuuuucagaa

SEQ ID NO: 2503166 - RNA, 15 nt, Chlamydia trachomatis
agcuuuuuucagaaa

SEQ ID NO: 2503167 - RNA, 15 nt, Chlamydia trachomatis
agcuuuuuuucacug

SEQ ID NO: 2503168 - RNA, 18 nt, Chlamydia trachomatis
aggaaaaagaaaaaaaga

SEQ ID NO: 2503169 - RNA, 14 nt, Chlamydia trachomatis
aggaaaagaugaag

SEQ ID NO: 2503170 - RNA, 15 nt, Chlamydia trachomatis
aggaaacucuuaaaa

SEQ ID NO: 2503171 - RNA, 18 nt, Chlamydia trachomatis
aggaaagcuaugcccagg

SEQ ID NO: 2503172 - RNA, 13 nt, Chlamydia trachomatis
aggaaaugaaggc

SEQ ID NO: 2503173 - RNA, 15 nt, Chlamydia trachomatis
aggaaaugagagcua

SEQ ID NO: 2503174 - RNA, 20 nt, Chlamydia trachomatis
aggaacucccucauuaagaa

SEQ ID NO: 2503175 - RNA, 14 nt, Chlamydia trachomatis
aggaacuucuucau

SEQ ID NO: 2503176 - RNA, 13 nt, Chlamydia trachomatis
aggaagaaauguu

SEQ ID NO: 2503177 - RNA, 19 nt, Chlamydia trachomatis
aggaagaauaauacaggag

SEQ ID NO: 2503178 - RNA, 20 nt, Chlamydia trachomatis
aggaagaauaauacaggagg

SEQ ID NO: 2503179 - RNA, 14 nt, Chlamydia trachomatis
aggaagaaugacaa

SEQ ID NO: 2503180 - RNA, 12 nt, Chlamydia trachomatis
aggaagcaaaaa

SEQ ID NO: 2503181 - RNA, 12 nt, Chlamydia trachomatis
aggaagcugaga

SEQ ID NO: 2503182 - RNA, 14 nt, Chlamydia trachomatis
aggaaguagagaau

SEQ ID NO: 2503183 - RNA, 17 nt, Chlamydia trachomatis
aggaaguugagaagcga

SEQ ID NO: 2503184 - RNA, 16 nt, Chlamydia trachomatis
aggaauaaacagguaa

SEQ ID NO: 2503185 - RNA, 16 nt, Chlamydia trachomatis
aggaauagcuacagca

SEQ ID NO: 2503186 - RNA, 21 nt, Chlamydia trachomatis
aggaauagcuacagcaauaga

SEQ ID NO: 2503187 - RNA, 16 nt, Chlamydia trachomatis
aggaauagcuacuaga

SEQ ID NO: 2503188 - RNA, 20 nt, Chlamydia trachomatis
aggaauagcuacuagauaga

SEQ ID NO: 2503189 - RNA, 20 nt, Chlamydia trachomatis
aggaaucacuaagucuguug

SEQ ID NO: 2503190 - RNA, 21 nt, Chlamydia trachomatis
aggaauccuuaaccgugaacu

SEQ ID NO: 2503191 - RNA, 15 nt, Chlamydia trachomatis
aggaaugguuacuug

SEQ ID NO: 2503192 - RNA, 22 nt, Chlamydia trachomatis
aggaaugguuacuugccucuuc

SEQ ID NO: 2503193 - RNA, 15 nt, Chlamydia trachomatis
aggaauguggagcua

SEQ ID NO: 2503194 - RNA, 19 nt, Chlamydia trachomatis
aggaccuaauaucugcucu

SEQ ID NO: 2503195 - RNA, 16 nt, Chlamydia trachomatis
aggaccuagagaggga

SEQ ID NO: 2503196 - RNA, 18 nt, Chlamydia trachomatis
aggaccucugucaauaaa

SEQ ID NO: 2503197 - RNA, 13 nt, Chlamydia trachomatis
aggacgaguguug

SEQ ID NO: 2503198 - RNA, 18 nt, Chlamydia trachomatis
aggacgaucauuaggauu

SEQ ID NO: 2503199 - RNA, 18 nt, Chlamydia trachomatis
aggacguuuggagcaugu

SEQ ID NO: 2503200 - RNA, 19 nt, Chlamydia trachomatis
aggagaaacgacaggcuau

SEQ ID NO: 2503201 - RNA, 11 nt, Chlamydia trachomatis
aggagaagagg

SEQ ID NO: 2503202 - RNA, 17 nt, Chlamydia trachomatis
aggagaauaccaccaua

SEQ ID NO: 2503203 - RNA, 21 nt, Chlamydia trachomatis
aggagaauaccaccauaggua

SEQ ID NO: 2503204 - RNA, 15 nt, Chlamydia trachomatis
aggagagaaaagagg

SEQ ID NO: 2503205 - RNA, 15 nt, Chlamydia trachomatis
aggagagucugcuac

SEQ ID NO: 2503206 - RNA, 18 nt, Chlamydia trachomatis
aggagauaauuuucugac

SEQ ID NO: 2503207 - RNA, 19 nt, Chlamydia trachomatis
aggagauccggauaugcaa

SEQ ID NO: 2503208 - RNA, 19 nt, Chlamydia trachomatis
aggaguacuucuaaaauuu

SEQ ID NO: 2503209 - RNA, 18 nt, Chlamydia trachomatis
aggaguauccagaaguuu

SEQ ID NO: 2503210 - RNA, 18 nt, Chlamydia trachomatis
aggagucggaccaugaau

SEQ ID NO: 2503211 - RNA, 12 nt, Chlamydia trachomatis
agguauuccugu

SEQ ID NO: 2503212 - RNA, 13 nt, Chlamydia trachomatis
agguauuccugua

SEQ ID NO: 2503213 - RNA, 17 nt, Chlamydia trachomatis
agguauuuuagagaaaa

SEQ ID NO: 2503214 - RNA, 21 nt, Chlamydia trachomatis
aggucauucgucaaagaagua

SEQ ID NO: 2503215 - RNA, 22 nt, Chlamydia trachomatis
aggucauucgucaaagaaguaa

SEQ ID NO: 2503216 - RNA, 17 nt, Chlamydia trachomatis
aggucucucuuuaugaa

SEQ ID NO: 2503217 - RNA, 18 nt, Chlamydia trachomatis
aggucuuaauaauagaaa

SEQ ID NO: 2503218 - RNA, 15 nt, Chlamydia trachomatis
aggucuuauuaaaag

SEQ ID NO: 2503219 - RNA, 18 nt, Chlamydia trachomatis
aggugugaauaggaagaa

SEQ ID NO: 2503220 - RNA, 23 nt, Chlamydia trachomatis
agguucguuauucucaaguugag

SEQ ID NO: 2503221 - RNA, 15 nt, Chlamydia trachomatis
agguucuucaacaac

SEQ ID NO: 2503222 - RNA, 18 nt, Chlamydia trachomatis
agguucuucaacaacuuc

SEQ ID NO: 2503223 - RNA, 21 nt, Chlamydia trachomatis
agguucuuugaucaaauccug

SEQ ID NO: 2503224 - RNA, 15 nt, Chlamydia trachomatis
agguugugaagaacu

SEQ ID NO: 2503225 - RNA, 18 nt, Chlamydia trachomatis
agguuguuacagucugug

SEQ ID NO: 2503226 - RNA, 16 nt, Chlamydia trachomatis
agguuguuauguagau

SEQ ID NO: 2503227 - RNA, 18 nt, Chlamydia trachomatis
agguuuaggagagagccc

SEQ ID NO: 2503228 - RNA, 13 nt, Chlamydia trachomatis
agguuucuaaaaa

SEQ ID NO: 2503229 - RNA, 14 nt, Chlamydia trachomatis
agguuucuaaaaaa

SEQ ID NO: 2503230 - RNA, 20 nt, Chlamydia trachomatis
agguuucuauacgcacauag

SEQ ID NO: 2503231 - RNA, 20 nt, Chlamydia trachomatis
agguuucugcuaaauccauu

SEQ ID NO: 2503232 - RNA, 16 nt, Chlamydia trachomatis
agguuuuuucuucuuu

SEQ ID NO: 2503233 - RNA, 17 nt, Chlamydia trachomatis
aguaaaaauaauuuccu

SEQ ID NO: 2503234 - RNA, 14 nt, Chlamydia trachomatis
aguaaaaucuaaaa

SEQ ID NO: 2503235 - RNA, 15 nt, Chlamydia trachomatis
aguaaaaucuaaaau

SEQ ID NO: 2503236 - RNA, 18 nt, Chlamydia trachomatis
aguaaacugucuauugga

SEQ ID NO: 2503237 - RNA, 20 nt, Chlamydia trachomatis
aguaaaggaugaucuucacc

SEQ ID NO: 2503238 - RNA, 13 nt, Chlamydia trachomatis
aguaacaccucuu

SEQ ID NO: 2503239 - RNA, 20 nt, Chlamydia trachomatis
aguaacuacggaaaaagaag

SEQ ID NO: 2503240 - RNA, 21 nt, Chlamydia trachomatis
aguaacuuaugaaaacuuugu

SEQ ID NO: 2503241 - RNA, 18 nt, Chlamydia trachomatis
aguaagaccgagauuauc

SEQ ID NO: 2503242 - RNA, 19 nt, Chlamydia trachomatis
aguaagaccgagauuauca

SEQ ID NO: 2503243 - RNA, 20 nt, Chlamydia trachomatis
aguaagcuaauuuuucucua

SEQ ID NO: 2503244 - RNA, 22 nt, Chlamydia trachomatis
aguaaguuucuauacagcauca

SEQ ID NO: 2503245 - RNA, 14 nt, Chlamydia trachomatis
aguaaucaaaaaag

SEQ ID NO: 2503246 - RNA, 15 nt, Chlamydia trachomatis
aguaaucggauagag

SEQ ID NO: 2503247 - RNA, 16 nt, Chlamydia trachomatis
aguaaugacacuggca

SEQ ID NO: 2503248 - RNA, 18 nt, Chlamydia trachomatis
aguaauuccaaauaauac

SEQ ID NO: 2503249 - RNA, 15 nt, Chlamydia trachomatis
aguacaaaaauacuu

SEQ ID NO: 2503250 - RNA, 14 nt, Chlamydia trachomatis
aguaccaaaaaauc

SEQ ID NO: 2503251 - RNA, 17 nt, Chlamydia trachomatis
aguaccauaauccuaug

SEQ ID NO: 2503252 - RNA, 21 nt, Chlamydia trachomatis
aguaccucgagcaacgaggac

SEQ ID NO: 2503253 - RNA, 15 nt, Chlamydia trachomatis
aguacguguuaucaa

SEQ ID NO: 2503254 - RNA, 18 nt, Chlamydia trachomatis
aguacguguuaucaaagu

SEQ ID NO: 2503255 - RNA, 19 nt, Chlamydia trachomatis
aguagaaacuuacuuuucu

SEQ ID NO: 2503256 - RNA, 16 nt, Chlamydia trachomatis
aguagacagcucuugc

SEQ ID NO: 2503257 - RNA, 14 nt, Chlamydia trachomatis
aguagaccauuuag

SEQ ID NO: 2503258 - RNA, 16 nt, Chlamydia trachomatis
aguagacgaaguagga

SEQ ID NO: 2503259 - RNA, 19 nt, Chlamydia trachomatis
aguagcaaauuaacagaua

SEQ ID NO: 2503260 - RNA, 12 nt, Chlamydia trachomatis
aguagcauaagc

SEQ ID NO: 2503261 - RNA, 21 nt, Chlamydia trachomatis
aguagcauugcgcagaucucc

SEQ ID NO: 2503262 - RNA, 15 nt, Chlamydia trachomatis
aguaggggaauuuau

SEQ ID NO: 2503263 - RNA, 22 nt, Chlamydia trachomatis
aguagguaucugaaucuguguu

SEQ ID NO: 2503264 - RNA, 20 nt, Chlamydia trachomatis
aguagugguaagggguuuuc

SEQ ID NO: 2503265 - RNA, 16 nt, Chlamydia trachomatis
aguauaaaaaaagucu

SEQ ID NO: 2503266 - RNA, 20 nt, Chlamydia trachomatis
aguauccagaaguuuuaaca

SEQ ID NO: 2503267 - RNA, 19 nt, Chlamydia trachomatis
aguauccauauccaugaag

SEQ ID NO: 2503268 - RNA, 22 nt, Chlamydia trachomatis
aguaucuguuaguagcuucucu

SEQ ID NO: 2503269 - RNA, 22 nt, Chlamydia trachomatis
aguaucuuugauagcaacaguu

SEQ ID NO: 2503270 - RNA, 20 nt, Chlamydia trachomatis
aguauuaaacuucaaacucg

SEQ ID NO: 2503271 - RNA, 13 nt, Chlamydia trachomatis
aguauuaaggaaa

SEQ ID NO: 2503272 - RNA, 18 nt, Chlamydia trachomatis
aguauucuguaaaaggaa

SEQ ID NO: 2503273 - RNA, 20 nt, Chlamydia trachomatis
aguauuggagacaacaaguu

SEQ ID NO: 2503274 - RNA, 12 nt, Chlamydia trachomatis
aguauuuucaaa

SEQ ID NO: 2503275 - RNA, 23 nt, Chlamydia trachomatis
agucaauccacgaauuuucucuc

SEQ ID NO: 2503276 - RNA, 19 nt, Chlamydia trachomatis
agucacggcaggaaagugc

SEQ ID NO: 2503277 - RNA, 18 nt, Chlamydia trachomatis
agucagaugaguuuaucu

SEQ ID NO: 2503278 - RNA, 21 nt, Chlamydia trachomatis
agucagaugaguuuaucucau

SEQ ID NO: 2503279 - RNA, 23 nt, Chlamydia trachomatis
agucaggauuuucuagguaccac

SEQ ID NO: 2503280 - RNA, 14 nt, Chlamydia trachomatis
aguccaagauuauc

SEQ ID NO: 2503281 - RNA, 18 nt, Chlamydia trachomatis
aguccagggaaaagagcu

SEQ ID NO: 2503282 - RNA, 19 nt, Chlamydia trachomatis
aguccagggaaaagagcua

SEQ ID NO: 2503283 - RNA, 21 nt, Chlamydia trachomatis
agucccuccuacuaaggauuu

SEQ ID NO: 2503284 - RNA, 14 nt, Chlamydia trachomatis
aguccggacuuucc

SEQ ID NO: 2503285 - RNA, 23 nt, Chlamydia trachomatis
aguccggacuuuccucugguacu

SEQ ID NO: 2503286 - RNA, 19 nt, Chlamydia trachomatis
aguccuccuguagcucuua

SEQ ID NO: 2503287 - RNA, 18 nt, Chlamydia trachomatis
aguccucuaaaguauucu

SEQ ID NO: 2503288 - RNA, 15 nt, Chlamydia trachomatis
aguccugagccaauc

SEQ ID NO: 2503289 - RNA, 19 nt, Chlamydia trachomatis
aguccugcuucuuuuuccc

SEQ ID NO: 2503290 - RNA, 19 nt, Chlamydia trachomatis
aguccuggagggaaaacac

SEQ ID NO: 2503291 - RNA, 18 nt, Chlamydia trachomatis
aguccuuaucuucuugag

SEQ ID NO: 2503292 - RNA, 19 nt, Chlamydia trachomatis
aguccuuaucuucuugaga

SEQ ID NO: 2503293 - RNA, 14 nt, Chlamydia trachomatis
aguccuucuccacc

SEQ ID NO: 2503294 - RNA, 16 nt, Chlamydia trachomatis
agucgauucuggcaua

SEQ ID NO: 2503295 - RNA, 19 nt, Chlamydia trachomatis
agucgugugaacggaggau

SEQ ID NO: 2503296 - RNA, 16 nt, Chlamydia trachomatis
agucuagagguuuaag

SEQ ID NO: 2503297 - RNA, 14 nt, Chlamydia trachomatis
agucuccauaagaa

SEQ ID NO: 2503298 - RNA, 16 nt, Chlamydia trachomatis
agucuccgacaccagg

SEQ ID NO: 2503299 - RNA, 21 nt, Chlamydia trachomatis
agucuccgacaccaggcaaug

SEQ ID NO: 2503300 - RNA, 20 nt, Chlamydia trachomatis
agucucgaauucuaucaaca

SEQ ID NO: 2503301 - RNA, 22 nt, Chlamydia trachomatis
agucucgaauucuaucaacauc

SEQ ID NO: 2503302 - RNA, 19 nt, Chlamydia trachomatis
agucucgcgcuaaaaccuu

SEQ ID NO: 2503303 - RNA, 20 nt, Chlamydia trachomatis
agucucgcgcuaaaaccuua

SEQ ID NO: 2503304 - RNA, 20 nt, Chlamydia trachomatis
agucucguccaugaccaagg

SEQ ID NO: 2503305 - RNA, 13 nt, Chlamydia trachomatis
agucucuaacaac

SEQ ID NO: 2503306 - RNA, 14 nt, Chlamydia trachomatis
agucucugccaccu

SEQ ID NO: 2503307 - RNA, 18 nt, Chlamydia trachomatis
agucucugccaccucauu

SEQ ID NO: 2503308 - RNA, 16 nt, Chlamydia trachomatis
agucugcaauccaauu

SEQ ID NO: 2503309 - RNA, 16 nt, Chlamydia trachomatis
agucugcuccaccuuc

SEQ ID NO: 2503310 - RNA, 18 nt, Chlamydia trachomatis
agucuggacgaugccauc

SEQ ID NO: 2503311 - RNA, 12 nt, Chlamydia trachomatis
agucuguauauc

SEQ ID NO: 2503312 - RNA, 18 nt, Chlamydia trachomatis
agucuguguuugcacaau

SEQ ID NO: 2503313 - RNA, 14 nt, Chlamydia trachomatis
agucuuaaaagggu

SEQ ID NO: 2503314 - RNA, 18 nt, Chlamydia trachomatis
agucuucaggagcaugaa

SEQ ID NO: 2503315 - RNA, 21 nt, Chlamydia trachomatis
agucuucaggagcaugaauca

SEQ ID NO: 2503316 - RNA, 17 nt, Chlamydia trachomatis
agucuucuaucacagcu

SEQ ID NO: 2503317 - RNA, 14 nt, Chlamydia trachomatis
agucuugugcucug

SEQ ID NO: 2503318 - RNA, 15 nt, Chlamydia trachomatis
agucuuuauaucuug

SEQ ID NO: 2503319 - RNA, 19 nt, Chlamydia trachomatis
agucuuuauuuaaguagaa

SEQ ID NO: 2503320 - RNA, 17 nt, Chlamydia trachomatis
agucuuuuacuuugaaa

SEQ ID NO: 2503321 - RNA, 16 nt, Chlamydia trachomatis
agugaaugcuccauac

SEQ ID NO: 2503322 - RNA, 17 nt, Chlamydia trachomatis
auaaaagacagaacaaa

SEQ ID NO: 2503323 - RNA, 14 nt, Chlamydia trachomatis
auaaaagagaagaa

SEQ ID NO: 2503324 - RNA, 14 nt, Chlamydia trachomatis
auaaaagccugaau

SEQ ID NO: 2503325 - RNA, 19 nt, Chlamydia trachomatis
auaaaagcuccuaaagaag

SEQ ID NO: 2503326 - RNA, 20 nt, Chlamydia trachomatis
auaaaaggcuacuaaagaca

SEQ ID NO: 2503327 - RNA, 18 nt, Chlamydia trachomatis
auaaaaggcuuauucucu

SEQ ID NO: 2503328 - RNA, 19 nt, Chlamydia trachomatis
auaaaagggcucucuccua

SEQ ID NO: 2503329 - RNA, 15 nt, Chlamydia trachomatis
auaaaaucaaauaaa

SEQ ID NO: 2503330 - RNA, 23 nt, Chlamydia trachomatis
auaaaauccuucugccucuuuua

SEQ ID NO: 2503331 - RNA, 15 nt, Chlamydia trachomatis
auaaaauggaaauaa

SEQ ID NO: 2503332 - RNA, 22 nt, Chlamydia trachomatis
auaaaauggaaauaaaaagccc

SEQ ID NO: 2503333 - RNA, 23 nt, Chlamydia trachomatis
auaaaauggaaauaaaaagccca

SEQ ID NO: 2503334 - RNA, 14 nt, Chlamydia trachomatis
auaaacacaaguau

SEQ ID NO: 2503335 - RNA, 22 nt, Chlamydia trachomatis
auaaacacaaguaugagaggaa

SEQ ID NO: 2503336 - RNA, 15 nt, Chlamydia trachomatis
auaaacaggagcgcu

SEQ ID NO: 2503337 - RNA, 21 nt, Chlamydia trachomatis
auaaaccaaaggcaacaaagg

SEQ ID NO: 2503338 - RNA, 18 nt, Chlamydia trachomatis
auaaacguuuggaaaucc

SEQ ID NO: 2503339 - RNA, 17 nt, Chlamydia trachomatis
auaaacucggguuuuaa

SEQ ID NO: 2503340 - RNA, 23 nt, Chlamydia trachomatis
auaaacuuuaccgacuucaacuu

SEQ ID NO: 2503341 - RNA, 13 nt, Chlamydia trachomatis
auaaagaagacuu

SEQ ID NO: 2503342 - RNA, 17 nt, Chlamydia trachomatis
auaaagacccucuaaau

SEQ ID NO: 2503343 - RNA, 19 nt, Chlamydia trachomatis
auaaagacccucuaaauuc

SEQ ID NO: 2503344 - RNA, 22 nt, Chlamydia trachomatis
auaaagagagaggagaaaaacu

SEQ ID NO: 2503345 - RNA, 23 nt, Chlamydia trachomatis
auaaagagagaggagaaaaacuc

SEQ ID NO: 2503346 - RNA, 12 nt, Chlamydia trachomatis
auaaagauagca

SEQ ID NO: 2503347 - RNA, 12 nt, Chlamydia trachomatis
auaaagaugaau

SEQ ID NO: 2503348 - RNA, 19 nt, Chlamydia trachomatis
auaaagcggcuaaagaaga

SEQ ID NO: 2503349 - RNA, 15 nt, Chlamydia trachomatis
auaaaggaaagggcu

SEQ ID NO: 2503350 - RNA, 17 nt, Chlamydia trachomatis
auaaagguaaucuguag

SEQ ID NO: 2503351 - RNA, 18 nt, Chlamydia trachomatis
auaaagucacuacuucau

SEQ ID NO: 2503352 - RNA, 22 nt, Chlamydia trachomatis
auaaaguccggacuuuccucug

SEQ ID NO: 2503353 - RNA, 14 nt, Chlamydia trachomatis
auaaaucacaaugc

SEQ ID NO: 2503354 - RNA, 21 nt, Chlamydia trachomatis
auaaauccucuuugaauaucc

SEQ ID NO: 2503355 - RNA, 15 nt, Chlamydia trachomatis
auaaaugauaauccu

SEQ ID NO: 2503356 - RNA, 18 nt, Chlamydia trachomatis
auaaaugucccugaacau

SEQ ID NO: 2503357 - RNA, 20 nt, Chlamydia trachomatis
auaaauuucuuaaaagcaca

SEQ ID NO: 2503358 - RNA, 12 nt, Chlamydia trachomatis
auaaauuugcug

SEQ ID NO: 2503359 - RNA, 15 nt, Chlamydia trachomatis
auaacaaacaacacu

SEQ ID NO: 2503360 - RNA, 14 nt, Chlamydia trachomatis
auaacaacaauaaa

SEQ ID NO: 2503361 - RNA, 14 nt, Chlamydia trachomatis
auaacaaccaucaa

SEQ ID NO: 2503362 - RNA, 17 nt, Chlamydia trachomatis
auaacaaggcuuuucca

SEQ ID NO: 2503363 - RNA, 18 nt, Chlamydia trachomatis
auaacaaggcuuuuccau

SEQ ID NO: 2503364 - RNA, 12 nt, Chlamydia trachomatis
auaacaauccua

SEQ ID NO: 2503365 - RNA, 14 nt, Chlamydia trachomatis
auaacaauccuaga

SEQ ID NO: 2503366 - RNA, 14 nt, Chlamydia trachomatis
auaacaauuuuaaa

SEQ ID NO: 2503367 - RNA, 17 nt, Chlamydia trachomatis
auaacacucucaucuaa

SEQ ID NO: 2503368 - RNA, 15 nt, Chlamydia trachomatis
auaacagcaagacaa

SEQ ID NO: 2503369 - RNA, 16 nt, Chlamydia trachomatis
auaacagcaagacaac

SEQ ID NO: 2503370 - RNA, 16 nt, Chlamydia trachomatis
auaacagcacaaacaa

SEQ ID NO: 2503371 - RNA, 17 nt, Chlamydia trachomatis
auaacauuauuccgcuu

SEQ ID NO: 2503372 - RNA, 20 nt, Chlamydia trachomatis
auaacauucugaacauacaa

SEQ ID NO: 2503373 - RNA, 17 nt, Chlamydia trachomatis
auaaccagaauccuuuu

SEQ ID NO: 2503374 - RNA, 19 nt, Chlamydia trachomatis
auaaccagaauccuuuuca

SEQ ID NO: 2503375 - RNA, 15 nt, Chlamydia trachomatis
auaaccugaagauuu

SEQ ID NO: 2503376 - RNA, 17 nt, Chlamydia trachomatis
auaacgcccucuuuuca

SEQ ID NO: 2503377 - RNA, 21 nt, Chlamydia trachomatis
auaacuaagaucuccaugauc

SEQ ID NO: 2503378 - RNA, 13 nt, Chlamydia trachomatis
auaacuccaaggg

SEQ ID NO: 2503379 - RNA, 23 nt, Chlamydia trachomatis
auaacucugcggcuccuucuuga

SEQ ID NO: 2503380 - RNA, 23 nt, Chlamydia trachomatis
auaacugagccaagaacaaagca

SEQ ID NO: 2503381 - RNA, 23 nt, Chlamydia trachomatis
auaacugguguggguaagaauaa

SEQ ID NO: 2503382 - RNA, 11 nt, Chlamydia trachomatis
auaagaaaaaa

SEQ ID NO: 2503383 - RNA, 12 nt, Chlamydia trachomatis
auaagaaaaaaa

SEQ ID NO: 2503384 - RNA, 13 nt, Chlamydia trachomatis
auaagaaaauucu

SEQ ID NO: 2503385 - RNA, 21 nt, Chlamydia trachomatis
auaagaaacacaccgggagca

SEQ ID NO: 2503386 - RNA, 19 nt, Chlamydia trachomatis
auaagaaaucuucucuuga

SEQ ID NO: 2503387 - RNA, 16 nt, Chlamydia trachomatis
auaagaacuucuccug

SEQ ID NO: 2503388 - RNA, 13 nt, Chlamydia trachomatis
auaagaauacaaa

SEQ ID NO: 2503389 - RNA, 18 nt, Chlamydia trachomatis
auaagaauguuuccuaau

SEQ ID NO: 2503390 - RNA, 22 nt, Chlamydia trachomatis
auaagacuuugugcaaccucua

SEQ ID NO: 2503391 - RNA, 19 nt, Chlamydia trachomatis
auaagagaacccuaauaaa

SEQ ID NO: 2503392 - RNA, 13 nt, Chlamydia trachomatis
auaagagcaucuu

SEQ ID NO: 2503393 - RNA, 19 nt, Chlamydia trachomatis
auaagaguugcaaguuggu

SEQ ID NO: 2503394 - RNA, 18 nt, Chlamydia trachomatis
auaagaucuuuacuuucu

SEQ ID NO: 2503395 - RNA, 18 nt, Chlamydia trachomatis
auaagcaagcauaauucc

SEQ ID NO: 2503396 - RNA, 19 nt, Chlamydia trachomatis
auaagcacccuuucuuacu

SEQ ID NO: 2503397 - RNA, 21 nt, Chlamydia trachomatis
auaagccgcucugucaucacu

SEQ ID NO: 2503398 - RNA, 15 nt, Chlamydia trachomatis
auaagccuuugcuau

SEQ ID NO: 2503399 - RNA, 18 nt, Chlamydia trachomatis
auaagcugaaaaugcucu

SEQ ID NO: 2503400 - RNA, 20 nt, Chlamydia trachomatis
auaagcugaaaaugcucuaa

SEQ ID NO: 2503401 - RNA, 15 nt, Chlamydia trachomatis
auaaggaagcaaaaa

SEQ ID NO: 2503402 - RNA, 20 nt, Chlamydia trachomatis
auaaggaauccgcuccccuu

SEQ ID NO: 2503403 - RNA, 20 nt, Chlamydia trachomatis
auaagggaaucauaaggaag

SEQ ID NO: 2503404 - RNA, 20 nt, Chlamydia trachomatis
auaagggcuuuugcaaacaa

SEQ ID NO: 2503405 - RNA, 15 nt, Chlamydia trachomatis
auaagguucaaggaa

SEQ ID NO: 2503406 - RNA, 23 nt, Chlamydia trachomatis
auaaguaaauugcgacaccuaau

SEQ ID NO: 2503407 - RNA, 17 nt, Chlamydia trachomatis
auaaguaucguaaacaa

SEQ ID NO: 2503408 - RNA, 22 nt, Chlamydia trachomatis
auaaguaucguaaacaaaagau

SEQ ID NO: 2503409 - RNA, 15 nt, Chlamydia trachomatis
auaagucaaaagaau

SEQ ID NO: 2503410 - RNA, 21 nt, Chlamydia trachomatis
auaagucugccacuacuucag

SEQ ID NO: 2503411 - RNA, 17 nt, Chlamydia trachomatis
auaaguucacugacugu

SEQ ID NO: 2503412 - RNA, 22 nt, Chlamydia trachomatis
auaaguuccgcucgauauccug

SEQ ID NO: 2503413 - RNA, 17 nt, Chlamydia trachomatis
auaauaaaccaaaggca

SEQ ID NO: 2503414 - RNA, 18 nt, Chlamydia trachomatis
auaauaaaccaaaggcaa

SEQ ID NO: 2503415 - RNA, 13 nt, Chlamydia trachomatis
auaauaaagauag

SEQ ID NO: 2503416 - RNA, 16 nt, Chlamydia trachomatis
auaauaaagauagcau

SEQ ID NO: 2503417 - RNA, 13 nt, Chlamydia trachomatis
auaauacaaagca

SEQ ID NO: 2503418 - RNA, 14 nt, Chlamydia trachomatis
auaauacaaaggag

SEQ ID NO: 2503419 - RNA, 14 nt, Chlamydia trachomatis
auaauacagauuuu

SEQ ID NO: 2503420 - RNA, 21 nt, Chlamydia trachomatis
auaauacagauuuuucgaaaa

SEQ ID NO: 2503421 - RNA, 17 nt, Chlamydia trachomatis
auaauacuccaccuagg

SEQ ID NO: 2503422 - RNA, 22 nt, Chlamydia trachomatis
auaauacuccaccuaggauagc

SEQ ID NO: 2503423 - RNA, 21 nt, Chlamydia trachomatis
auaauagcuugcacagcaagc

SEQ ID NO: 2503424 - RNA, 13 nt, Chlamydia trachomatis
auaauagucauac

SEQ ID NO: 2503425 - RNA, 18 nt, Chlamydia trachomatis
auaauaugguaauggcug

SEQ ID NO: 2503426 - RNA, 19 nt, Chlamydia trachomatis
auaauaugguaauggcugu

SEQ ID NO: 2503427 - RNA, 13 nt, Chlamydia trachomatis
auaaucccaaaaa

SEQ ID NO: 2503428 - RNA, 21 nt, Chlamydia trachomatis
auaauccuaugcaguaaagaa

SEQ ID NO: 2503429 - RNA, 22 nt, Chlamydia trachomatis
auaauccuaugcaguaaagaaa

SEQ ID NO: 2503430 - RNA, 21 nt, Chlamydia trachomatis
auaaucgagcaaccagcgcau

SEQ ID NO: 2503431 - RNA, 17 nt, Chlamydia trachomatis
auaaucgaucacagaaa

SEQ ID NO: 2503432 - RNA, 15 nt, Chlamydia trachomatis
auaaucuauuuuaua

SEQ ID NO: 2503433 - RNA, 21 nt, Chlamydia trachomatis
auaggcuccugcaagggaaca

SEQ ID NO: 2503434 - RNA, 18 nt, Chlamydia trachomatis
auagggagguauuccugu

SEQ ID NO: 2503435 - RNA, 15 nt, Chlamydia trachomatis
auagggauuuuaaag

SEQ ID NO: 2503436 - RNA, 17 nt, Chlamydia trachomatis
auagggggaguucuauu

SEQ ID NO: 2503437 - RNA, 18 nt, Chlamydia trachomatis
auaggguugugaauacaa

SEQ ID NO: 2503438 - RNA, 16 nt, Chlamydia trachomatis
auagguaaagaaguuu

SEQ ID NO: 2503439 - RNA, 18 nt, Chlamydia trachomatis
auagguagaaaaggauag

SEQ ID NO: 2503440 - RNA, 21 nt, Chlamydia trachomatis
auagguagguuucugcuaaau

SEQ ID NO: 2503441 - RNA, 17 nt, Chlamydia trachomatis
auagguaugugcucauu

SEQ ID NO: 2503442 - RNA, 17 nt, Chlamydia trachomatis
auagguucgugugacug

SEQ ID NO: 2503443 - RNA, 16 nt, Chlamydia trachomatis
auaguaacggaacucu

SEQ ID NO: 2503444 - RNA, 15 nt, Chlamydia trachomatis
auaguacaaguauau

SEQ ID NO: 2503445 - RNA, 13 nt, Chlamydia trachomatis
auaguaccauaau

SEQ ID NO: 2503446 - RNA, 19 nt, Chlamydia trachomatis
auaguaccauaauccuaug

SEQ ID NO: 2503447 - RNA, 22 nt, Chlamydia trachomatis
auaguauuacggaaaagcuuuu

SEQ ID NO: 2503448 - RNA, 20 nt, Chlamydia trachomatis
auaguauuuuugaaaccaag

SEQ ID NO: 2503449 - RNA, 19 nt, Chlamydia trachomatis
auagucccuaccuucagca

SEQ ID NO: 2503450 - RNA, 20 nt, Chlamydia trachomatis
auaguccuucggagagcagu

SEQ ID NO: 2503451 - RNA, 12 nt, Chlamydia trachomatis
auagucucccaa

SEQ ID NO: 2503452 - RNA, 23 nt, Chlamydia trachomatis
auagugacgugaggaaguucugc

SEQ ID NO: 2503453 - RNA, 17 nt, Chlamydia trachomatis
auagugcagaagauaag

SEQ ID NO: 2503454 - RNA, 18 nt, Chlamydia trachomatis
auaguguaaggagagaaa

SEQ ID NO: 2503455 - RNA, 19 nt, Chlamydia trachomatis
auaguguaaggagagaaaa

SEQ ID NO: 2503456 - RNA, 20 nt, Chlamydia trachomatis
auaguguaaggagagaaaag

SEQ ID NO: 2503457 - RNA, 17 nt, Chlamydia trachomatis
auaguugcaaaaagaac

SEQ ID NO: 2503458 - RNA, 20 nt, Chlamydia trachomatis
auaguuuaggcggcauuuua

SEQ ID NO: 2503459 - RNA, 22 nt, Chlamydia trachomatis
auaguuuaggcggcauuuuauu

SEQ ID NO: 2503460 - RNA, 13 nt, Chlamydia trachomatis
auaguuucgagua

SEQ ID NO: 2503461 - RNA, 19 nt, Chlamydia trachomatis
auaguuucgaguaauucca

SEQ ID NO: 2503462 - RNA, 14 nt, Chlamydia trachomatis
auauaaagaagacu

SEQ ID NO: 2503463 - RNA, 18 nt, Chlamydia trachomatis
auauaaagccccuccgcu

SEQ ID NO: 2503464 - RNA, 19 nt, Chlamydia trachomatis
auauaaagucacuacuuca

SEQ ID NO: 2503465 - RNA, 23 nt, Chlamydia trachomatis
auauaagagaagguaacaaugcu

SEQ ID NO: 2503466 - RNA, 21 nt, Chlamydia trachomatis
auauaaguaucguaaacaaaa

SEQ ID NO: 2503467 - RNA, 19 nt, Chlamydia trachomatis
auauaaguucagccccuaa

SEQ ID NO: 2503468 - RNA, 20 nt, Chlamydia trachomatis
auauaccacggaacauaccg

SEQ ID NO: 2503469 - RNA, 13 nt, Chlamydia trachomatis
auauacccauuug

SEQ ID NO: 2503470 - RNA, 17 nt, Chlamydia trachomatis
auauaccccuaaaggaa

SEQ ID NO: 2503471 - RNA, 12 nt, Chlamydia trachomatis
auauacucagag

SEQ ID NO: 2503472 - RNA, 16 nt, Chlamydia trachomatis
auauagaccagagucu

SEQ ID NO: 2503473 - RNA, 19 nt, Chlamydia trachomatis
auauagauuuuagaaggau

SEQ ID NO: 2503474 - RNA, 15 nt, Chlamydia trachomatis
auauagcauggaaga

SEQ ID NO: 2503475 - RNA, 20 nt, Chlamydia trachomatis
auauagcauggaagacaaca

SEQ ID NO: 2503476 - RNA, 23 nt, Chlamydia trachomatis
auauagguuccaucuaaaggcaa

SEQ ID NO: 2503477 - RNA, 20 nt, Chlamydia trachomatis
auauagucgaguuuugagga

SEQ ID NO: 2503478 - RNA, 11 nt, Chlamydia trachomatis
auauaguuuuc

SEQ ID NO: 2503479 - RNA, 13 nt, Chlamydia trachomatis
auauauccauuca

SEQ ID NO: 2503480 - RNA, 13 nt, Chlamydia trachomatis
auauaucuguaac

SEQ ID NO: 2503481 - RNA, 18 nt, Chlamydia trachomatis
auauauggacaagcaaua

SEQ ID NO: 2503482 - RNA, 15 nt, Chlamydia trachomatis
auauauuuaagaagc

SEQ ID NO: 2503483 - RNA, 16 nt, Chlamydia trachomatis
auauauuuaagaagcu

SEQ ID NO: 2503484 - RNA, 15 nt, Chlamydia trachomatis
auaucaaaaauagca

SEQ ID NO: 2503485 - RNA, 14 nt, Chlamydia trachomatis
auaucaaagagugu

SEQ ID NO: 2503486 - RNA, 19 nt, Chlamydia trachomatis
auaucaacguuuucacuag

SEQ ID NO: 2503487 - RNA, 21 nt, Chlamydia trachomatis
auaucaaucguagaaaaccga

SEQ ID NO: 2503488 - RNA, 13 nt, Chlamydia trachomatis
auaucaauuccug

SEQ ID NO: 2503489 - RNA, 18 nt, Chlamydia trachomatis
auaucacuaccagcccca

SEQ ID NO: 2503490 - RNA, 14 nt, Chlamydia trachomatis
auauccaucaauca

SEQ ID NO: 2503491 - RNA, 20 nt, Chlamydia trachomatis
auauccaucauaaaaagaua

SEQ ID NO: 2503492 - RNA, 15 nt, Chlamydia trachomatis
auauccaucuacagc

SEQ ID NO: 2503493 - RNA, 17 nt, Chlamydia trachomatis
auauccaugaucucugc

SEQ ID NO: 2503494 - RNA, 18 nt, Chlamydia trachomatis
auauccaugaucucugca

SEQ ID NO: 2503495 - RNA, 19 nt, Chlamydia trachomatis
auauccguaaggaagccag

SEQ ID NO: 2503496 - RNA, 14 nt, Chlamydia trachomatis
auauccuccaaaga

SEQ ID NO: 2503497 - RNA, 18 nt, Chlamydia trachomatis
auaucgagcucauuuucu

SEQ ID NO: 2503498 - RNA, 23 nt, Chlamydia trachomatis
auaucgcguccaaaaagcguguc

SEQ ID NO: 2503499 - RNA, 15 nt, Chlamydia trachomatis
auaucguaaacaacc

SEQ ID NO: 2503500 - RNA, 17 nt, Chlamydia trachomatis
auaucuacuucuuguuc

SEQ ID NO: 2503501 - RNA, 16 nt, Chlamydia trachomatis
auaucuaggucuccca

SEQ ID NO: 2503502 - RNA, 17 nt, Chlamydia trachomatis
auaucuaggucucccag

SEQ ID NO: 2503503 - RNA, 21 nt, Chlamydia trachomatis
auaucuagguugaagaggcaa

SEQ ID NO: 2503504 - RNA, 19 nt, Chlamydia trachomatis
auaucuccaccauagcacu

SEQ ID NO: 2503505 - RNA, 12 nt, Chlamydia trachomatis
auaucuucugaa

SEQ ID NO: 2503506 - RNA, 15 nt, Chlamydia trachomatis
auaucuugucccauu

SEQ ID NO: 2503507 - RNA, 22 nt, Chlamydia trachomatis
auaugaguggcaagggggagca

SEQ ID NO: 2503508 - RNA, 14 nt, Chlamydia trachomatis
auaugcacuaacga

SEQ ID NO: 2503509 - RNA, 17 nt, Chlamydia trachomatis
auaugcagaagaccagu

SEQ ID NO: 2503510 - RNA, 17 nt, Chlamydia trachomatis
auaugcagcauccaaua

SEQ ID NO: 2503511 - RNA, 23 nt, Chlamydia trachomatis
auaugccucuaagcaccuuuaca

SEQ ID NO: 2503512 - RNA, 15 nt, Chlamydia trachomatis
auaugccugcaaaaa

SEQ ID NO: 2503513 - RNA, 17 nt, Chlamydia trachomatis
auaugcgacaguaccgu

SEQ ID NO: 2503514 - RNA, 17 nt, Chlamydia trachomatis
auaugcucuuucccgau

SEQ ID NO: 2503515 - RNA, 23 nt, Chlamydia trachomatis
auaugcucuuucccgauauguuc

SEQ ID NO: 2503516 - RNA, 16 nt, Chlamydia trachomatis
auaugcuuuuuaauau

SEQ ID NO: 2503517 - RNA, 19 nt, Chlamydia trachomatis
auaugcuuuuuaauauccu

SEQ ID NO: 2503518 - RNA, 20 nt, Chlamydia trachomatis
auaugcuuuuuaauauccuc

SEQ ID NO: 2503519 - RNA, 17 nt, Chlamydia trachomatis
auauggacaagcaauag

SEQ ID NO: 2503520 - RNA, 21 nt, Chlamydia trachomatis
auauggacuucccuaauacaa

SEQ ID NO: 2503521 - RNA, 23 nt, Chlamydia trachomatis
auauggacuucccuaauacaauc

SEQ ID NO: 2503522 - RNA, 18 nt, Chlamydia trachomatis
auauggcucccagagaau

SEQ ID NO: 2503523 - RNA, 16 nt, Chlamydia trachomatis
auaugguaauggcugu

SEQ ID NO: 2503524 - RNA, 17 nt, Chlamydia trachomatis
auauggucgucucagcu

SEQ ID NO: 2503525 - RNA, 19 nt, Chlamydia trachomatis
auaugugccucuaggcaua

SEQ ID NO: 2503526 - RNA, 15 nt, Chlamydia trachomatis
auauuaagauccauu

SEQ ID NO: 2503527 - RNA, 14 nt, Chlamydia trachomatis
auauuaguuaguga

SEQ ID NO: 2503528 - RNA, 17 nt, Chlamydia trachomatis
auauuaguuagugaagu

SEQ ID NO: 2503529 - RNA, 19 nt, Chlamydia trachomatis
auauuauuuacgagagggu

SEQ ID NO: 2503530 - RNA, 13 nt, Chlamydia trachomatis
auauucagaagaa

SEQ ID NO: 2503531 - RNA, 14 nt, Chlamydia trachomatis
auauucagaagaag

SEQ ID NO: 2503532 - RNA, 22 nt, Chlamydia trachomatis
auauucagaagaagagcugcug

SEQ ID NO: 2503533 - RNA, 15 nt, Chlamydia trachomatis
auauucauauguuac

SEQ ID NO: 2503534 - RNA, 19 nt, Chlamydia trachomatis
auauucaugugaacagagc

SEQ ID NO: 2503535 - RNA, 17 nt, Chlamydia trachomatis
auauuccaaagaaaugu

SEQ ID NO: 2503536 - RNA, 19 nt, Chlamydia trachomatis
auauuccauaauaguuaaa

SEQ ID NO: 2503537 - RNA, 17 nt, Chlamydia trachomatis
auauucccuucuauuuc

SEQ ID NO: 2503538 - RNA, 21 nt, Chlamydia trachomatis
auauucuugcuaagaacauaa

SEQ ID NO: 2503539 - RNA, 22 nt, Chlamydia trachomatis
auauucuuugucacaaauuacc

SEQ ID NO: 2503540 - RNA, 13 nt, Chlamydia trachomatis
auauucuuuucca

SEQ ID NO: 2503541 - RNA, 23 nt, Chlamydia trachomatis
auauugacggccuguaugugaaa

SEQ ID NO: 2503542 - RNA, 19 nt, Chlamydia trachomatis
auauugccuacaagaccuc

SEQ ID NO: 2503543 - RNA, 21 nt, Chlamydia trachomatis
auauugcuucauaaaaaagac

SEQ ID NO: 2503544 - RNA, 12 nt, Chlamydia trachomatis
auccaucucucc

SEQ ID NO: 2503545 - RNA, 17 nt, Chlamydia trachomatis
auccaugaggcuccgcc

SEQ ID NO: 2503546 - RNA, 19 nt, Chlamydia trachomatis
auccaugaggcuccgccuu

SEQ ID NO: 2503547 - RNA, 16 nt, Chlamydia trachomatis
auccauguuucgccaa

SEQ ID NO: 2503548 - RNA, 16 nt, Chlamydia trachomatis
auccauucccagauua

SEQ ID NO: 2503549 - RNA, 18 nt, Chlamydia trachomatis
auccauucccagauuaca

SEQ ID NO: 2503550 - RNA, 21 nt, Chlamydia trachomatis
auccauucgcauuaaauaaua

SEQ ID NO: 2503551 - RNA, 21 nt, Chlamydia trachomatis
auccauuggugguaacaccaa

SEQ ID NO: 2503552 - RNA, 19 nt, Chlamydia trachomatis
auccauuuggacuaugcuc

SEQ ID NO: 2503553 - RNA, 14 nt, Chlamydia trachomatis
aucccaaaaacaau

SEQ ID NO: 2503554 - RNA, 16 nt, Chlamydia trachomatis
aucccaaagcuuuacu

SEQ ID NO: 2503555 - RNA, 19 nt, Chlamydia trachomatis
aucccaaagcuuuacugaa

SEQ ID NO: 2503556 - RNA, 13 nt, Chlamydia trachomatis
aucccaaggaaau

SEQ ID NO: 2503557 - RNA, 23 nt, Chlamydia trachomatis
aucccagccugugcauuugugga

SEQ ID NO: 2503558 - RNA, 16 nt, Chlamydia trachomatis
aucccagggagagaga

SEQ ID NO: 2503559 - RNA, 16 nt, Chlamydia trachomatis
aucccauaaaagccau

SEQ ID NO: 2503560 - RNA, 14 nt, Chlamydia trachomatis
aucccauaaucuca

SEQ ID NO: 2503561 - RNA, 21 nt, Chlamydia trachomatis
auccccacgaccacaaacaau

SEQ ID NO: 2503562 - RNA, 19 nt, Chlamydia trachomatis
auccccagaagccauaaua

SEQ ID NO: 2503563 - RNA, 16 nt, Chlamydia trachomatis
auccccagucucucca

SEQ ID NO: 2503564 - RNA, 17 nt, Chlamydia trachomatis
auccccaucucuuuugu

SEQ ID NO: 2503565 - RNA, 18 nt, Chlamydia trachomatis
auccccaucucuuuuguu

SEQ ID NO: 2503566 - RNA, 16 nt, Chlamydia trachomatis
auccccccgaccuuug

SEQ ID NO: 2503567 - RNA, 20 nt, Chlamydia trachomatis
auccccucaaaaaauguuuu

SEQ ID NO: 2503568 - RNA, 15 nt, Chlamydia trachomatis
aucccgaauggaugc

SEQ ID NO: 2503569 - RNA, 16 nt, Chlamydia trachomatis
aucccggaggaauuga

SEQ ID NO: 2503570 - RNA, 14 nt, Chlamydia trachomatis
aucccggaggcaac

SEQ ID NO: 2503571 - RNA, 17 nt, Chlamydia trachomatis
aucccuaguacaaaaau

SEQ ID NO: 2503572 - RNA, 17 nt, Chlamydia trachomatis
aucccucuagcaaccaa

SEQ ID NO: 2503573 - RNA, 22 nt, Chlamydia trachomatis
aucccucuagcaaccaauucuc

SEQ ID NO: 2503574 - RNA, 16 nt, Chlamydia trachomatis
aucccugugcuaucuu

SEQ ID NO: 2503575 - RNA, 15 nt, Chlamydia trachomatis
aucccuuucauucuu

SEQ ID NO: 2503576 - RNA, 15 nt, Chlamydia trachomatis
aucccuuuuucagga

SEQ ID NO: 2503577 - RNA, 20 nt, Chlamydia trachomatis
auccgaaugaauuuccccug

SEQ ID NO: 2503578 - RNA, 19 nt, Chlamydia trachomatis
auccgagcauuuuccaaga

SEQ ID NO: 2503579 - RNA, 16 nt, Chlamydia trachomatis
auccgcaccaaucacc

SEQ ID NO: 2503580 - RNA, 16 nt, Chlamydia trachomatis
auccgcaguaaaaucu

SEQ ID NO: 2503581 - RNA, 22 nt, Chlamydia trachomatis
auccgcaguaaaaucuaaaaua

SEQ ID NO: 2503582 - RNA, 14 nt, Chlamydia trachomatis
auccgcuaaaggau

SEQ ID NO: 2503583 - RNA, 23 nt, Chlamydia trachomatis
auccgcuccccuuccuguucuuc

SEQ ID NO: 2503584 - RNA, 14 nt, Chlamydia trachomatis
auccgcuucuucug

SEQ ID NO: 2503585 - RNA, 21 nt, Chlamydia trachomatis
auccgcuuggaauacaucacu

SEQ ID NO: 2503586 - RNA, 18 nt, Chlamydia trachomatis
auccgggaaugauuagac

SEQ ID NO: 2503587 - RNA, 23 nt, Chlamydia trachomatis
auccgugauuuccguaaugauca

SEQ ID NO: 2503588 - RNA, 14 nt, Chlamydia trachomatis
auccuacacaagcu

SEQ ID NO: 2503589 - RNA, 23 nt, Chlamydia trachomatis
auccucaaaaaaggcauaaaaga

SEQ ID NO: 2503590 - RNA, 16 nt, Chlamydia trachomatis
auccucuuugaauauc

SEQ ID NO: 2503591 - RNA, 17 nt, Chlamydia trachomatis
auccugaacccgcugcu

SEQ ID NO: 2503592 - RNA, 16 nt, Chlamydia trachomatis
auccugcagcaaauaa

SEQ ID NO: 2503593 - RNA, 20 nt, Chlamydia trachomatis
auccugcauuuauccacagg

SEQ ID NO: 2503594 - RNA, 15 nt, Chlamydia trachomatis
auccugcucaacaua

SEQ ID NO: 2503595 - RNA, 17 nt, Chlamydia trachomatis
auccuggaguauuuuca

SEQ ID NO: 2503596 - RNA, 14 nt, Chlamydia trachomatis
auccuguagggaag

SEQ ID NO: 2503597 - RNA, 11 nt, Chlamydia trachomatis
auccuguucuc

SEQ ID NO: 2503598 - RNA, 21 nt, Chlamydia trachomatis
auccuuaguuagcugaaaugu

SEQ ID NO: 2503599 - RNA, 21 nt, Chlamydia trachomatis
auccuucgcaggggaauacag

SEQ ID NO: 2503600 - RNA, 12 nt, Chlamydia trachomatis
auccuucugcua

SEQ ID NO: 2503601 - RNA, 17 nt, Chlamydia trachomatis
auccuuuucagaauuac

SEQ ID NO: 2503602 - RNA, 18 nt, Chlamydia trachomatis
auccuuuuggaagaucuc

SEQ ID NO: 2503603 - RNA, 21 nt, Chlamydia trachomatis
auccuuuuggaagaucucuuu

SEQ ID NO: 2503604 - RNA, 14 nt, Chlamydia trachomatis
auccuuuuuccuua

SEQ ID NO: 2503605 - RNA, 15 nt, Chlamydia trachomatis
aucgaaaacaaagag

SEQ ID NO: 2503606 - RNA, 13 nt, Chlamydia trachomatis
aucgaauaaaaau

SEQ ID NO: 2503607 - RNA, 12 nt, Chlamydia trachomatis
aucgagagaggg

SEQ ID NO: 2503608 - RNA, 15 nt, Chlamydia trachomatis
aucgaguagcaauaa

SEQ ID NO: 2503609 - RNA, 18 nt, Chlamydia trachomatis
aucgagucccuucaauca

SEQ ID NO: 2503610 - RNA, 12 nt, Chlamydia trachomatis
aucgauaggcau

SEQ ID NO: 2503611 - RNA, 13 nt, Chlamydia trachomatis
aucgaucacagaa

SEQ ID NO: 2503612 - RNA, 19 nt, Chlamydia trachomatis
aucgaucgaagcauuucgu

SEQ ID NO: 2503613 - RNA, 20 nt, Chlamydia trachomatis
aucgcacacaauaaaucaug

SEQ ID NO: 2503614 - RNA, 17 nt, Chlamydia trachomatis
aucgcagcugaucgaua

SEQ ID NO: 2503615 - RNA, 19 nt, Chlamydia trachomatis
aucgccaaaaaucauuucc

SEQ ID NO: 2503616 - RNA, 20 nt, Chlamydia trachomatis
aucgccaaaaaucauuucca

SEQ ID NO: 2503617 - RNA, 18 nt, Chlamydia trachomatis
aucgccgguuaacacaau

SEQ ID NO: 2503618 - RNA, 23 nt, Chlamydia trachomatis
aucgccuauagaagacuaaucuu

SEQ ID NO: 2503619 - RNA, 20 nt, Chlamydia trachomatis
aucgcgacuaaagacuguuu

SEQ ID NO: 2503620 - RNA, 14 nt, Chlamydia trachomatis
aucgcggaagaaag

SEQ ID NO: 2503621 - RNA, 16 nt, Chlamydia trachomatis
aucgcggaagaaagca

SEQ ID NO: 2503622 - RNA, 16 nt, Chlamydia trachomatis
aucgcuaugacaggcc

SEQ ID NO: 2503623 - RNA, 18 nt, Chlamydia trachomatis
aucgcugacggauccugc

SEQ ID NO: 2503624 - RNA, 15 nt, Chlamydia trachomatis
aucgcuucugcugaa

SEQ ID NO: 2503625 - RNA, 18 nt, Chlamydia trachomatis
aucgcuuuuccaauauua

SEQ ID NO: 2503626 - RNA, 12 nt, Chlamydia trachomatis
aucggaauagca

SEQ ID NO: 2503627 - RNA, 19 nt, Chlamydia trachomatis
aucggaccacauucuuucu

SEQ ID NO: 2503628 - RNA, 13 nt, Chlamydia trachomatis
aucggagucugcu

SEQ ID NO: 2503629 - RNA, 19 nt, Chlamydia trachomatis
aucgguaacuaaauuuuua

SEQ ID NO: 2503630 - RNA, 16 nt, Chlamydia trachomatis
aucgguucauaaaauu

SEQ ID NO: 2503631 - RNA, 15 nt, Chlamydia trachomatis
aucguaaccaagcuu

SEQ ID NO: 2503632 - RNA, 17 nt, Chlamydia trachomatis
aucguaagcaacaauau

SEQ ID NO: 2503633 - RNA, 19 nt, Chlamydia trachomatis
aucguagagaucuucugaa

SEQ ID NO: 2503634 - RNA, 14 nt, Chlamydia trachomatis
aucgugagcgucuu

SEQ ID NO: 2503635 - RNA, 20 nt, Chlamydia trachomatis
aucgugagcgucuuuucaca

SEQ ID NO: 2503636 - RNA, 16 nt, Chlamydia trachomatis
aucguuagcaucaucc

SEQ ID NO: 2503637 - RNA, 23 nt, Chlamydia trachomatis
aucuaaaaaaauucuugccaccg

SEQ ID NO: 2503638 - RNA, 13 nt, Chlamydia trachomatis
aucuaaaaagcca

SEQ ID NO: 2503639 - RNA, 14 nt, Chlamydia trachomatis
aucuaaaaagccau

SEQ ID NO: 2503640 - RNA, 11 nt, Chlamydia trachomatis
aucuaaaaagg

SEQ ID NO: 2503641 - RNA, 20 nt, Chlamydia trachomatis
aucuaaaagaguuucuuugu

SEQ ID NO: 2503642 - RNA, 16 nt, Chlamydia trachomatis
aucuaaaauaucaucc

SEQ ID NO: 2503643 - RNA, 22 nt, Chlamydia trachomatis
aucuaaaauaucauccgcuaaa

SEQ ID NO: 2503644 - RNA, 14 nt, Chlamydia trachomatis
aucuaaagaaaugg

SEQ ID NO: 2503645 - RNA, 19 nt, Chlamydia trachomatis
aucuaaagaaauggucucu

SEQ ID NO: 2503646 - RNA, 21 nt, Chlamydia trachomatis
aucuaaagacaaaacuucuuc

SEQ ID NO: 2503647 - RNA, 12 nt, Chlamydia trachomatis
aucuaaaggcaa

SEQ ID NO: 2503648 - RNA, 18 nt, Chlamydia trachomatis
aucuaaagucugaauaua

SEQ ID NO: 2503649 - RNA, 16 nt, Chlamydia trachomatis
aucuaaggaaugugga

SEQ ID NO: 2503650 - RNA, 15 nt, Chlamydia trachomatis
aucuaauucuagcaa

SEQ ID NO: 2503651 - RNA, 16 nt, Chlamydia trachomatis
aucuacaaaaccaaaa

SEQ ID NO: 2503652 - RNA, 18 nt, Chlamydia trachomatis
aucuacaaaaccaaaauc

SEQ ID NO: 2503653 - RNA, 22 nt, Chlamydia trachomatis
aucuacaugguaccuucucaaa

SEQ ID NO: 2503654 - RNA, 20 nt, Chlamydia trachomatis
aucuaccacggauaaagaaa

SEQ ID NO: 2503655 - RNA, 21 nt, Chlamydia trachomatis
aucuacgaguuucucgcagau

SEQ ID NO: 2503656 - RNA, 18 nt, Chlamydia trachomatis
augaagguuucuaaaaaa

SEQ ID NO: 2503657 - RNA, 19 nt, Chlamydia trachomatis
augaagguuucuaaaaaac

SEQ ID NO: 2503658 - RNA, 15 nt, Chlamydia trachomatis
augaaugagcuuaga

SEQ ID NO: 2503659 - RNA, 23 nt, Chlamydia trachomatis
augaauuuuaucuaaaaaggcac

SEQ ID NO: 2503660 - RNA, 14 nt, Chlamydia trachomatis
augacaaacuuucu

SEQ ID NO: 2503661 - RNA, 15 nt, Chlamydia trachomatis
augacaaacuuucuc

SEQ ID NO: 2503662 - RNA, 16 nt, Chlamydia trachomatis
augacagcuucuugaa

SEQ ID NO: 2503663 - RNA, 18 nt, Chlamydia trachomatis
augacagguuucaugaca

SEQ ID NO: 2503664 - RNA, 20 nt, Chlamydia trachomatis
augacauaagcaaauccugc

SEQ ID NO: 2503665 - RNA, 21 nt, Chlamydia trachomatis
augacgaggggcuaccucuaa

SEQ ID NO: 2503666 - RNA, 16 nt, Chlamydia trachomatis
augacgcagcaacaac

SEQ ID NO: 2503667 - RNA, 20 nt, Chlamydia trachomatis
augagaaauaaaaaccuuga

SEQ ID NO: 2503668 - RNA, 23 nt, Chlamydia trachomatis
augagaagaaaggucugcauauu

SEQ ID NO: 2503669 - RNA, 22 nt, Chlamydia trachomatis
augagaaucgcuaugacaggcc

SEQ ID NO: 2503670 - RNA, 16 nt, Chlamydia trachomatis
augagaccgucaaaaa

SEQ ID NO: 2503671 - RNA, 20 nt, Chlamydia trachomatis
augagagcuuccacagcagu

SEQ ID NO: 2503672 - RNA, 24 nt, Chlamydia trachomatis
augagccgauccaucaacuguucu

SEQ ID NO: 2503673 - RNA, 12 nt, Chlamydia trachomatis
augagccuugcc

SEQ ID NO: 2503674 - RNA, 23 nt, Chlamydia trachomatis
augagccuugccuacagaaucag

SEQ ID NO: 2503675 - RNA, 16 nt, Chlamydia trachomatis
augagcgcuuuuucuu

SEQ ID NO: 2503676 - RNA, 20 nt, Chlamydia trachomatis
augagcgcuuuuucuucucu

SEQ ID NO: 2503677 - RNA, 16 nt, Chlamydia trachomatis
augagcuccaaaguaa

SEQ ID NO: 2503678 - RNA, 19 nt, Chlamydia trachomatis
augagcuuagauuuagcug

SEQ ID NO: 2503679 - RNA, 15 nt, Chlamydia trachomatis
augagcuuaucacaa

SEQ ID NO: 2503680 - RNA, 22 nt, Chlamydia trachomatis
augaggacagaguucucugagg

SEQ ID NO: 2503681 - RNA, 17 nt, Chlamydia trachomatis
augaggauguggacgaa

SEQ ID NO: 2503682 - RNA, 11 nt, Chlamydia trachomatis
augagguaaug

SEQ ID NO: 2503683 - RNA, 21 nt, Chlamydia trachomatis
augaguaucuagacauagcuu

SEQ ID NO: 2503684 - RNA, 14 nt, Chlamydia trachomatis
augauaagggaauc

SEQ ID NO: 2503685 - RNA, 15 nt, Chlamydia trachomatis
augauauagauuuua

SEQ ID NO: 2503686 - RNA, 22 nt, Chlamydia trachomatis
augauauuuugaagauaaaacu

SEQ ID NO: 2503687 - RNA, 19 nt, Chlamydia trachomatis
augaucacaugaucauagu

SEQ ID NO: 2503688 - RNA, 13 nt, Chlamydia trachomatis
augaucagcaaaa

SEQ ID NO: 2503689 - RNA, 16 nt, Chlamydia trachomatis
augaucagcaaaaaga

SEQ ID NO: 2503690 - RNA, 22 nt, Chlamydia trachomatis
augaucuaaaggaaaaauuucu

SEQ ID NO: 2503691 - RNA, 17 nt, Chlamydia trachomatis
augaucucgauaagcuc

SEQ ID NO: 2503692 - RNA, 18 nt, Chlamydia trachomatis
augaucuguaaugugaug

SEQ ID NO: 2503693 - RNA, 23 nt, Chlamydia trachomatis
augaucuucaccccuuacaaugu

SEQ ID NO: 2503694 - RNA, 15 nt, Chlamydia trachomatis
augaugagagcagcu

SEQ ID NO: 2503695 - RNA, 16 nt, Chlamydia trachomatis
augaugaguggauacg

SEQ ID NO: 2503696 - RNA, 14 nt, Chlamydia trachomatis
augaugcugagcau

SEQ ID NO: 2503697 - RNA, 15 nt, Chlamydia trachomatis
augauuaauucuagg

SEQ ID NO: 2503698 - RNA, 21 nt, Chlamydia trachomatis
augauugaaguucuuuuuccu

SEQ ID NO: 2503699 - RNA, 13 nt, Chlamydia trachomatis
augauugauaaag

SEQ ID NO: 2503700 - RNA, 14 nt, Chlamydia trachomatis
augauugauaaagc

SEQ ID NO: 2503701 - RNA, 15 nt, Chlamydia trachomatis
augauuucuuuaaca

SEQ ID NO: 2503702 - RNA, 13 nt, Chlamydia trachomatis
augcaaaacauaa

SEQ ID NO: 2503703 - RNA, 14 nt, Chlamydia trachomatis
augcaaagcuuuuc

SEQ ID NO: 2503704 - RNA, 21 nt, Chlamydia trachomatis
augcaaauaagaaaguuuuuu

SEQ ID NO: 2503705 - RNA, 23 nt, Chlamydia trachomatis
augcaaauuugcagaagcuccaa

SEQ ID NO: 2503706 - RNA, 15 nt, Chlamydia trachomatis
augcaacaacauaau

SEQ ID NO: 2503707 - RNA, 13 nt, Chlamydia trachomatis
augcaacccccac

SEQ ID NO: 2503708 - RNA, 17 nt, Chlamydia trachomatis
augcaaucccguauauu

SEQ ID NO: 2503709 - RNA, 16 nt, Chlamydia trachomatis
augcaauccuucuuga

SEQ ID NO: 2503710 - RNA, 14 nt, Chlamydia trachomatis
augcaauugauucc

SEQ ID NO: 2503711 - RNA, 13 nt, Chlamydia trachomatis
augcacaucuaau

SEQ ID NO: 2503712 - RNA, 21 nt, Chlamydia trachomatis
augcagacucaaagcuucccu

SEQ ID NO: 2503713 - RNA, 20 nt, Chlamydia trachomatis
augcaggauauucggagcaa

SEQ ID NO: 2503714 - RNA, 21 nt, Chlamydia trachomatis
augcaggcgagucuuucuaga

SEQ ID NO: 2503715 - RNA, 14 nt, Chlamydia trachomatis
augcaguaaagaaa

SEQ ID NO: 2503716 - RNA, 21 nt, Chlamydia trachomatis
augcaguaaagaaaagcuccu

SEQ ID NO: 2503717 - RNA, 18 nt, Chlamydia trachomatis
augcauagucuucaggau

SEQ ID NO: 2503718 - RNA, 21 nt, Chlamydia trachomatis
augccaagccauuuuguaauu

SEQ ID NO: 2503719 - RNA, 17 nt, Chlamydia trachomatis
augccacacuuccccau

SEQ ID NO: 2503720 - RNA, 17 nt, Chlamydia trachomatis
augccaccuaauaugca

SEQ ID NO: 2503721 - RNA, 21 nt, Chlamydia trachomatis
augccauccauaacgaagauu

SEQ ID NO: 2503722 - RNA, 13 nt, Chlamydia trachomatis
augcccaggauaa

SEQ ID NO: 2503723 - RNA, 14 nt, Chlamydia trachomatis
augcccuaaagaga

SEQ ID NO: 2503724 - RNA, 16 nt, Chlamydia trachomatis
augccgcccaaggaaa

SEQ ID NO: 2503725 - RNA, 22 nt, Chlamydia trachomatis
augccgcccaaggaaaagauga

SEQ ID NO: 2503726 - RNA, 16 nt, Chlamydia trachomatis
augccuucuuccuuca

SEQ ID NO: 2503727 - RNA, 18 nt, Chlamydia trachomatis
augccuuuugcacaaagg

SEQ ID NO: 2503728 - RNA, 20 nt, Chlamydia trachomatis
augccuuuugcacaaaggaa

SEQ ID NO: 2503729 - RNA, 21 nt, Chlamydia trachomatis
augccuuuugcacaaaggaac

SEQ ID NO: 2503730 - RNA, 21 nt, Chlamydia trachomatis
augccuuuuguuuucaaaagc

SEQ ID NO: 2503731 - RNA, 22 nt, Chlamydia trachomatis
augccuuuuguuuucaaaagcu

SEQ ID NO: 2503732 - RNA, 17 nt, Chlamydia trachomatis
augcgcaauccuuuuaa

SEQ ID NO: 2503733 - RNA, 15 nt, Chlamydia trachomatis
augcgcggaaggaaa

SEQ ID NO: 2503734 - RNA, 20 nt, Chlamydia trachomatis
augcggauuaaagaaggaaa

SEQ ID NO: 2503735 - RNA, 18 nt, Chlamydia trachomatis
augcggcccacacuaccc

SEQ ID NO: 2503736 - RNA, 22 nt, Chlamydia trachomatis
augcgucuucccugaggcuuua

SEQ ID NO: 2503737 - RNA, 17 nt, Chlamydia trachomatis
augcguuaaacuuucuu

SEQ ID NO: 2503738 - RNA, 23 nt, Chlamydia trachomatis
augcucacaaaccaaaaccacac

SEQ ID NO: 2503739 - RNA, 23 nt, Chlamydia trachomatis
augcucagggcuauauguaagaa

SEQ ID NO: 2503740 - RNA, 23 nt, Chlamydia trachomatis
augcuccauacgcugcugacaau

SEQ ID NO: 2503741 - RNA, 22 nt, Chlamydia trachomatis
augcucuaaaggauaaggaaga

SEQ ID NO: 2503742 - RNA, 17 nt, Chlamydia trachomatis
augcugaagcuacuaaa

SEQ ID NO: 2503743 - RNA, 22 nt, Chlamydia trachomatis
augcugcccuugagcaaguaaa

SEQ ID NO: 2503744 - RNA, 18 nt, Chlamydia trachomatis
augcuguuucaggcauaa

SEQ ID NO: 2503745 - RNA, 18 nt, Chlamydia trachomatis
augcuucuauucgcagua

SEQ ID NO: 2503746 - RNA, 19 nt, Chlamydia trachomatis
augcuugcguauagagcau

SEQ ID NO: 2503747 - RNA, 16 nt, Chlamydia trachomatis
augcuuguucucguau

SEQ ID NO: 2503748 - RNA, 15 nt, Chlamydia trachomatis
auggaaauaaaaagc

SEQ ID NO: 2503749 - RNA, 14 nt, Chlamydia trachomatis
auggaauggggagg

SEQ ID NO: 2503750 - RNA, 16 nt, Chlamydia trachomatis
auggacaagcaauagc

SEQ ID NO: 2503751 - RNA, 18 nt, Chlamydia trachomatis
auggagaauggccuguuu

SEQ ID NO: 2503752 - RNA, 13 nt, Chlamydia trachomatis
auggagaggagua

SEQ ID NO: 2503753 - RNA, 22 nt, Chlamydia trachomatis
auggagcagcauucguguguag

SEQ ID NO: 2503754 - RNA, 17 nt, Chlamydia trachomatis
auggauaguuucuuucu

SEQ ID NO: 2503755 - RNA, 16 nt, Chlamydia trachomatis
auggcaaaaucuucau

SEQ ID NO: 2503756 - RNA, 15 nt, Chlamydia trachomatis
auggcagacaaaaca

SEQ ID NO: 2503757 - RNA, 18 nt, Chlamydia trachomatis
auggcauucaaccucuca

SEQ ID NO: 2503758 - RNA, 15 nt, Chlamydia trachomatis
auggcauuuacaaac

SEQ ID NO: 2503759 - RNA, 16 nt, Chlamydia trachomatis
auggcauuuacaaacg

SEQ ID NO: 2503760 - RNA, 18 nt, Chlamydia trachomatis
auggccuuaugugcuccu

SEQ ID NO: 2503761 - RNA, 14 nt, Chlamydia trachomatis
auggcgguguuucu

SEQ ID NO: 2503762 - RNA, 15 nt, Chlamydia trachomatis
auggcucguaaaaaa

SEQ ID NO: 2503763 - RNA, 19 nt, Chlamydia trachomatis
augggaagcucggucucau

SEQ ID NO: 2503764 - RNA, 19 nt, Chlamydia trachomatis
augggcugcaucagcaaga

SEQ ID NO: 2503765 - RNA, 19 nt, Chlamydia trachomatis
auggggguuacuucaaguu

SEQ ID NO: 2503766 - RNA, 17 nt, Chlamydia trachomatis
auggguaaggggaagau

SEQ ID NO: 2503767 - RNA, 18 nt, Chlamydia trachomatis
auucaucuauuuuuauug

SEQ ID NO: 2503768 - RNA, 15 nt, Chlamydia trachomatis
auucaugugaacaga

SEQ ID NO: 2503769 - RNA, 15 nt, Chlamydia trachomatis
auuccaaagaaaugu

SEQ ID NO: 2503770 - RNA, 23 nt, Chlamydia trachomatis
auuccaaauccuccugcaggagg

SEQ ID NO: 2503771 - RNA, 13 nt, Chlamydia trachomatis
auuccaagggaga

SEQ ID NO: 2503772 - RNA, 19 nt, Chlamydia trachomatis
auuccacaacggcccuucc

SEQ ID NO: 2503773 - RNA, 23 nt, Chlamydia trachomatis
auuccacgaagagcaaaaucauu

SEQ ID NO: 2503774 - RNA, 18 nt, Chlamydia trachomatis
auuccacuaccccaccua

SEQ ID NO: 2503775 - RNA, 19 nt, Chlamydia trachomatis
auuccaguuacccucuuua

SEQ ID NO: 2503776 - RNA, 23 nt, Chlamydia trachomatis
auuccaguuacccucuuuagcca

SEQ ID NO: 2503777 - RNA, 20 nt, Chlamydia trachomatis
auuccauaaaggguguuuuu

SEQ ID NO: 2503778 - RNA, 17 nt, Chlamydia trachomatis
auuccauaaucguggaa

SEQ ID NO: 2503779 - RNA, 13 nt, Chlamydia trachomatis
auuccaucuuuuc

SEQ ID NO: 2503780 - RNA, 16 nt, Chlamydia trachomatis
auucccacuacauucu

SEQ ID NO: 2503781 - RNA, 20 nt, Chlamydia trachomatis
auuccccgagacgcaucacg

SEQ ID NO: 2503782 - RNA, 14 nt, Chlamydia trachomatis
auucccuguagaau

SEQ ID NO: 2503783 - RNA, 19 nt, Chlamydia trachomatis
auuccgagagaagcuccuc

SEQ ID NO: 2503784 - RNA, 19 nt, Chlamydia trachomatis
auuccguacucugauuaga

SEQ ID NO: 2503785 - RNA, 15 nt, Chlamydia trachomatis
auuccuacgcagaua

SEQ ID NO: 2503786 - RNA, 19 nt, Chlamydia trachomatis
auuccuacgcagauauuca

SEQ ID NO: 2503787 - RNA, 19 nt, Chlamydia trachomatis
auuccugaauggucaauaa

SEQ ID NO: 2503788 - RNA, 15 nt, Chlamydia trachomatis
auuccugccaaaaac

SEQ ID NO: 2503789 - RNA, 20 nt, Chlamydia trachomatis
auuccugcugaucagaggga

SEQ ID NO: 2503790 - RNA, 21 nt, Chlamydia trachomatis
auuccuucagagguagccaaa

SEQ ID NO: 2503791 - RNA, 14 nt, Chlamydia trachomatis
auuccuuggauacg

SEQ ID NO: 2503792 - RNA, 19 nt, Chlamydia trachomatis
auuccuuggcaaagagcuu

SEQ ID NO: 2503793 - RNA, 14 nt, Chlamydia trachomatis
auuccuuucuucca

SEQ ID NO: 2503794 - RNA, 14 nt, Chlamydia trachomatis
auucgaaaagagcu

SEQ ID NO: 2503795 - RNA, 15 nt, Chlamydia trachomatis
auucgaaaagagcua

SEQ ID NO: 2503796 - RNA, 19 nt, Chlamydia trachomatis
auucgauauacgcucuuuc

SEQ ID NO: 2503797 - RNA, 14 nt, Chlamydia trachomatis
auucgcauuaaaua

SEQ ID NO: 2503798 - RNA, 15 nt, Chlamydia trachomatis
auucgccacgaggau

SEQ ID NO: 2503799 - RNA, 18 nt, Chlamydia trachomatis
auucgcuaaugauucuug

SEQ ID NO: 2503800 - RNA, 18 nt, Chlamydia trachomatis
auucgcuaccaaaaauuu

SEQ ID NO: 2503801 - RNA, 21 nt, Chlamydia trachomatis
auucgcuaccaaaaauuuuuu

SEQ ID NO: 2503802 - RNA, 19 nt, Chlamydia trachomatis
auucguaggguuguuuuag

SEQ ID NO: 2503803 - RNA, 12 nt, Chlamydia trachomatis
auucguuaucaa

SEQ ID NO: 2503804 - RNA, 21 nt, Chlamydia trachomatis
auucguuugugcuaaaucucc

SEQ ID NO: 2503805 - RNA, 21 nt, Chlamydia trachomatis
auucuaaacgagcuagcucuu

SEQ ID NO: 2503806 - RNA, 23 nt, Chlamydia trachomatis
auucuaacgccauggaauagcuu

SEQ ID NO: 2503807 - RNA, 23 nt, Chlamydia trachomatis
auucuaaugcuuuguagauacug

SEQ ID NO: 2503808 - RNA, 18 nt, Chlamydia trachomatis
auucuagcaaccgauucu

SEQ ID NO: 2503809 - RNA, 11 nt, Chlamydia trachomatis
auucuaugaau

SEQ ID NO: 2503810 - RNA, 23 nt, Chlamydia trachomatis
auucucaaguugagugcagagga

SEQ ID NO: 2503811 - RNA, 15 nt, Chlamydia trachomatis
auucucaucuugcgc

SEQ ID NO: 2503812 - RNA, 14 nt, Chlamydia trachomatis
auucuccaggagau

SEQ ID NO: 2503813 - RNA, 14 nt, Chlamydia trachomatis
auucuccgaauaaa

SEQ ID NO: 2503814 - RNA, 22 nt, Chlamydia trachomatis
auucuccgauaauuuuccuuuu

SEQ ID NO: 2503815 - RNA, 21 nt, Chlamydia trachomatis
auucucgcaaagaaucaaaac

SEQ ID NO: 2503816 - RNA, 18 nt, Chlamydia trachomatis
auucucggaaaagauauc

SEQ ID NO: 2503817 - RNA, 20 nt, Chlamydia trachomatis
auucucucauaagaucuuua

SEQ ID NO: 2503818 - RNA, 23 nt, Chlamydia trachomatis
auucucugcacaauauuaucuac

SEQ ID NO: 2503819 - RNA, 17 nt, Chlamydia trachomatis
auucugcagaaaaauuu

SEQ ID NO: 2503820 - RNA, 23 nt, Chlamydia trachomatis
auucugcuaaaggugcgauuacu

SEQ ID NO: 2503821 - RNA, 15 nt, Chlamydia trachomatis
auucuggaggaggac

SEQ ID NO: 2503822 - RNA, 20 nt, Chlamydia trachomatis
auucuggaggaggaccucug

SEQ ID NO: 2503823 - RNA, 14 nt, Chlamydia trachomatis
auucuggcauagca

SEQ ID NO: 2503824 - RNA, 17 nt, Chlamydia trachomatis
auucuucucgaacucag

SEQ ID NO: 2503825 - RNA, 22 nt, Chlamydia trachomatis
auucuucugaacaacauccuuu

SEQ ID NO: 2503826 - RNA, 20 nt, Chlamydia trachomatis
auucuucuugaucggagucu

SEQ ID NO: 2503827 - RNA, 18 nt, Chlamydia trachomatis
auucuugauaaauaaucu

SEQ ID NO: 2503828 - RNA, 23 nt, Chlamydia trachomatis
auucuuucauucguuucuucccu

SEQ ID NO: 2503829 - RNA, 14 nt, Chlamydia trachomatis
auucuuucgauauc

SEQ ID NO: 2503830 - RNA, 19 nt, Chlamydia trachomatis
auucuuucuggagcaucag

SEQ ID NO: 2503831 - RNA, 17 nt, Chlamydia trachomatis
auucuuucuuaucuguc

SEQ ID NO: 2503832 - RNA, 19 nt, Chlamydia trachomatis
auucuuugguaauagcaaa

SEQ ID NO: 2503833 - RNA, 18 nt, Chlamydia trachomatis
auucuuuuaagaaugcgg

SEQ ID NO: 2503834 - RNA, 15 nt, Chlamydia trachomatis
auucuuuuacagagg

SEQ ID NO: 2503835 - RNA, 18 nt, Chlamydia trachomatis
auugaaaaagcuuucuuc

SEQ ID NO: 2503836 - RNA, 14 nt, Chlamydia trachomatis
auugaaacaguaga

SEQ ID NO: 2503837 - RNA, 14 nt, Chlamydia trachomatis
auugaaguucuuuu

SEQ ID NO: 2503838 - RNA, 15 nt, Chlamydia trachomatis
auugaauaaaucuau

SEQ ID NO: 2503839 - RNA, 16 nt, Chlamydia trachomatis
auugacaacuuucuuu

SEQ ID NO: 2503840 - RNA, 20 nt, Chlamydia trachomatis
auugacagcaccaagcucca

SEQ ID NO: 2503841 - RNA, 14 nt, Chlamydia trachomatis
auugagaacauaac

SEQ ID NO: 2503842 - RNA, 15 nt, Chlamydia trachomatis
auugagcaaaaaaag

SEQ ID NO: 2503843 - RNA, 17 nt, Chlamydia trachomatis
auugagcaaaaaaagag

SEQ ID NO: 2503844 - RNA, 21 nt, Chlamydia trachomatis
auugagcacaagcuguuccua

SEQ ID NO: 2503845 - RNA, 21 nt, Chlamydia trachomatis
auugaguucugcuugcgaaua

SEQ ID NO: 2503846 - RNA, 19 nt, Chlamydia trachomatis
auugauaggguugugaaua

SEQ ID NO: 2503847 - RNA, 20 nt, Chlamydia trachomatis
auugaucuuguguaguauuu

SEQ ID NO: 2503848 - RNA, 17 nt, Chlamydia trachomatis
auugaugacaacuacaa

SEQ ID NO: 2503849 - RNA, 22 nt, Chlamydia trachomatis
auugaugcugaaugguggcaua

SEQ ID NO: 2503850 - RNA, 19 nt, Chlamydia trachomatis
auugauuccauuugcuaca

SEQ ID NO: 2503851 - RNA, 20 nt, Chlamydia trachomatis
auugauucuaugagaagaaa

SEQ ID NO: 2503852 - RNA, 17 nt, Chlamydia trachomatis
auugauuuuuucgcuuu

SEQ ID NO: 2503853 - RNA, 22 nt, Chlamydia trachomatis
auugauuuuuucgcuuuugguu

SEQ ID NO: 2503854 - RNA, 15 nt, Chlamydia trachomatis
auugcaacucuugcc

SEQ ID NO: 2503855 - RNA, 23 nt, Chlamydia trachomatis
auugcacuaaagagcuucggcua

SEQ ID NO: 2503856 - RNA, 16 nt, Chlamydia trachomatis
auugcaguauagagaa

SEQ ID NO: 2503857 - RNA, 14 nt, Chlamydia trachomatis
auugccaaaaagaa

SEQ ID NO: 2503858 - RNA, 15 nt, Chlamydia trachomatis
auugccaaaaagaaa

SEQ ID NO: 2503859 - RNA, 22 nt, Chlamydia trachomatis
auugccaaaaagaaaaucagaa

SEQ ID NO: 2503860 - RNA, 15 nt, Chlamydia trachomatis
auugccauguuuuuc

SEQ ID NO: 2503861 - RNA, 19 nt, Chlamydia trachomatis
auugcgagggauauuucuu

SEQ ID NO: 2503862 - RNA, 19 nt, Chlamydia trachomatis
auugcgcagaucuccuucu

SEQ ID NO: 2503863 - RNA, 21 nt, Chlamydia trachomatis
auugcgccuugucuauaggaa

SEQ ID NO: 2503864 - RNA, 17 nt, Chlamydia trachomatis
auugcuaaggaaagaga

SEQ ID NO: 2503865 - RNA, 20 nt, Chlamydia trachomatis
auugcucuaaagucuuucca

SEQ ID NO: 2503866 - RNA, 23 nt, Chlamydia trachomatis
auugcucuaaagucuuuccauuu

SEQ ID NO: 2503867 - RNA, 20 nt, Chlamydia trachomatis
auugcugaugcauagcucgc

SEQ ID NO: 2503868 - RNA, 17 nt, Chlamydia trachomatis
auugcuucauaaaaaag

SEQ ID NO: 2503869 - RNA, 20 nt, Chlamydia trachomatis
auuggaauuuucaucaaaau

SEQ ID NO: 2503870 - RNA, 13 nt, Chlamydia trachomatis
auuggacucagaa

SEQ ID NO: 2503871 - RNA, 14 nt, Chlamydia trachomatis
auuggcggcaguuu

SEQ ID NO: 2503872 - RNA, 20 nt, Chlamydia trachomatis
auuggggauccuacagcaga

SEQ ID NO: 2503873 - RNA, 15 nt, Chlamydia trachomatis
auuggugaucauuuu

SEQ ID NO: 2503874 - RNA, 20 nt, Chlamydia trachomatis
auugucuacuuuuuguuuag

SEQ ID NO: 2503875 - RNA, 12 nt, Chlamydia trachomatis
auugugccaccg

SEQ ID NO: 2503876 - RNA, 23 nt, Chlamydia trachomatis
auuuaaaagugagaugcuccucu

SEQ ID NO: 2503877 - RNA, 14 nt, Chlamydia trachomatis
caaaacaagccuuu

SEQ ID NO: 2503878 - RNA, 15 nt, Chlamydia trachomatis
caaaacaucccagca

SEQ ID NO: 2503879 - RNA, 23 nt, Chlamydia trachomatis
caaaaccacacuucucgaaaaaa

SEQ ID NO: 2503880 - RNA, 18 nt, Chlamydia trachomatis
caaaaccuuuuacaguuc

SEQ ID NO: 2503881 - RNA, 13 nt, Chlamydia trachomatis
caaaacgcucucc

SEQ ID NO: 2503882 - RNA, 18 nt, Chlamydia trachomatis
caaaacgcucuccaaaga

SEQ ID NO: 2503883 - RNA, 19 nt, Chlamydia trachomatis
caaaacgcucuccaaagaa

SEQ ID NO: 2503884 - RNA, 21 nt, Chlamydia trachomatis
caaaacgcucuccaaagaaua

SEQ ID NO: 2503885 - RNA, 18 nt, Chlamydia trachomatis
caaaacgcucuuuuucuu

SEQ ID NO: 2503886 - RNA, 15 nt, Chlamydia trachomatis
caaaacuaaaaguug

SEQ ID NO: 2503887 - RNA, 13 nt, Chlamydia trachomatis
caaaagaaaaauc

SEQ ID NO: 2503888 - RNA, 14 nt, Chlamydia trachomatis
caaaagaagaaucu

SEQ ID NO: 2503889 - RNA, 16 nt, Chlamydia trachomatis
caaaagaagaaucuuc

SEQ ID NO: 2503890 - RNA, 21 nt, Chlamydia trachomatis
caaaagaagaaucuucuucga

SEQ ID NO: 2503891 - RNA, 22 nt, Chlamydia trachomatis
caaaagaagaaucuucuucgaa

SEQ ID NO: 2503892 - RNA, 18 nt, Chlamydia trachomatis
caaaagaaggcuuuucua

SEQ ID NO: 2503893 - RNA, 19 nt, Chlamydia trachomatis
caaaagaaggcuuuucuau

SEQ ID NO: 2503894 - RNA, 20 nt, Chlamydia trachomatis
caaaagaugccccaauuccu

SEQ ID NO: 2503895 - RNA, 19 nt, Chlamydia trachomatis
caaaagauuucuucuguag

SEQ ID NO: 2503896 - RNA, 23 nt, Chlamydia trachomatis
caaaagauuucuucuguagcccc

SEQ ID NO: 2503897 - RNA, 19 nt, Chlamydia trachomatis
caaaagcgaggcuucaaag

SEQ ID NO: 2503898 - RNA, 12 nt, Chlamydia trachomatis
caaaagcuaucu

SEQ ID NO: 2503899 - RNA, 11 nt, Chlamydia trachomatis
caaaaggccaa

SEQ ID NO: 2503900 - RNA, 22 nt, Chlamydia trachomatis
caaaagguuguugccaaucugu

SEQ ID NO: 2503901 - RNA, 20 nt, Chlamydia trachomatis
caaaaguguuuagaagugcu

SEQ ID NO: 2503902 - RNA, 15 nt, Chlamydia trachomatis
caaaauagcaggaau

SEQ ID NO: 2503903 - RNA, 17 nt, Chlamydia trachomatis
caaaauaucuacuucuu

SEQ ID NO: 2503904 - RNA, 13 nt, Chlamydia trachomatis
caaaaucaauaau

SEQ ID NO: 2503905 - RNA, 16 nt, Chlamydia trachomatis
caaaaucaauaauguc

SEQ ID NO: 2503906 - RNA, 20 nt, Chlamydia trachomatis
caaaaucaauaaugucucca

SEQ ID NO: 2503907 - RNA, 13 nt, Chlamydia trachomatis
caaaaucagcaaa

SEQ ID NO: 2503908 - RNA, 17 nt, Chlamydia trachomatis
caaaaucagcaaaugug

SEQ ID NO: 2503909 - RNA, 21 nt, Chlamydia trachomatis
caaaauccauucccagauuac

SEQ ID NO: 2503910 - RNA, 18 nt, Chlamydia trachomatis
caaaaucuucauaagaaa

SEQ ID NO: 2503911 - RNA, 18 nt, Chlamydia trachomatis
caaaaugauaaucgagca

SEQ ID NO: 2503912 - RNA, 22 nt, Chlamydia trachomatis
caaaaugaucuaaaggaaaaau

SEQ ID NO: 2503913 - RNA, 17 nt, Chlamydia trachomatis
caaaauuaucuaaaaaa

SEQ ID NO: 2503914 - RNA, 17 nt, Chlamydia trachomatis
caaaauucuguacgucu

SEQ ID NO: 2503915 - RNA, 13 nt, Chlamydia trachomatis
caaaauuuuucug

SEQ ID NO: 2503916 - RNA, 21 nt, Chlamydia trachomatis
caaaauuuuucugcuccaaag

SEQ ID NO: 2503917 - RNA, 14 nt, Chlamydia trachomatis
caaacaaaaaagaa

SEQ ID NO: 2503918 - RNA, 13 nt, Chlamydia trachomatis
caaacaaaauaau

SEQ ID NO: 2503919 - RNA, 16 nt, Chlamydia trachomatis
caaacaaucuaaaaaa

SEQ ID NO: 2503920 - RNA, 18 nt, Chlamydia trachomatis
caaacaaucuaaaaaauu

SEQ ID NO: 2503921 - RNA, 14 nt, Chlamydia trachomatis
caaacacugcaaca

SEQ ID NO: 2503922 - RNA, 14 nt, Chlamydia trachomatis
caaacagaaccuuu

SEQ ID NO: 2503923 - RNA, 21 nt, Chlamydia trachomatis
caaacagaaccuuuuuaaaau

SEQ ID NO: 2503924 - RNA, 13 nt, Chlamydia trachomatis
caaacauuuugag

SEQ ID NO: 2503925 - RNA, 15 nt, Chlamydia trachomatis
caaaccaauuaaguu

SEQ ID NO: 2503926 - RNA, 22 nt, Chlamydia trachomatis
caaaccagcucaucaaauagca

SEQ ID NO: 2503927 - RNA, 15 nt, Chlamydia trachomatis
caaaccaugaugcug

SEQ ID NO: 2503928 - RNA, 13 nt, Chlamydia trachomatis
caaaccgaagagg

SEQ ID NO: 2503929 - RNA, 18 nt, Chlamydia trachomatis
caaaccgaagagggaaga

SEQ ID NO: 2503930 - RNA, 14 nt, Chlamydia trachomatis
caaaccuccuaaau

SEQ ID NO: 2503931 - RNA, 13 nt, Chlamydia trachomatis
caaacgaaggagc

SEQ ID NO: 2503932 - RNA, 21 nt, Chlamydia trachomatis
caaacgaucgauccuguuugu

SEQ ID NO: 2503933 - RNA, 16 nt, Chlamydia trachomatis
caaacggcacucaaau

SEQ ID NO: 2503934 - RNA, 19 nt, Chlamydia trachomatis
caaacguccuccugauucc

SEQ ID NO: 2503935 - RNA, 20 nt, Chlamydia trachomatis
caaacucuuuuucagacaaa

SEQ ID NO: 2503936 - RNA, 18 nt, Chlamydia trachomatis
caaacugcucaaggaaac

SEQ ID NO: 2503937 - RNA, 20 nt, Chlamydia trachomatis
caaacugcucuucuaacuuu

SEQ ID NO: 2503938 - RNA, 14 nt, Chlamydia trachomatis
caaacugugaagaa

SEQ ID NO: 2503939 - RNA, 19 nt, Chlamydia trachomatis
caaacugugaagaaugaaa

SEQ ID NO: 2503940 - RNA, 22 nt, Chlamydia trachomatis
caaagaacaguucaugcaccaa

SEQ ID NO: 2503941 - RNA, 15 nt, Chlamydia trachomatis
caaagaaguaaugaa

SEQ ID NO: 2503942 - RNA, 13 nt, Chlamydia trachomatis
caaagaauagaau

SEQ ID NO: 2503943 - RNA, 16 nt, Chlamydia trachomatis
caaagaauucuugcua

SEQ ID NO: 2503944 - RNA, 14 nt, Chlamydia trachomatis
caaagaauuuuuag

SEQ ID NO: 2503945 - RNA, 17 nt, Chlamydia trachomatis
caaagacauaaaagcug

SEQ ID NO: 2503946 - RNA, 9 nt, Chlamydia trachomatis
caaagagau

SEQ ID NO: 2503947 - RNA, 21 nt, Chlamydia trachomatis
caaagaucuuucuacauuuug

SEQ ID NO: 2503948 - RNA, 20 nt, Chlamydia trachomatis
caaagaugcuccuacaaaau

SEQ ID NO: 2503949 - RNA, 18 nt, Chlamydia trachomatis
caaagauugcguuacuuc

SEQ ID NO: 2503950 - RNA, 20 nt, Chlamydia trachomatis
caaagauugcguuacuucuu

SEQ ID NO: 2503951 - RNA, 22 nt, Chlamydia trachomatis
caaagauugcguuacuucuugc

SEQ ID NO: 2503952 - RNA, 17 nt, Chlamydia trachomatis
caaagauuucuucuuug

SEQ ID NO: 2503953 - RNA, 19 nt, Chlamydia trachomatis
caaagcacgauaaaagaca

SEQ ID NO: 2503954 - RNA, 18 nt, Chlamydia trachomatis
caaagcagucuagagguu

SEQ ID NO: 2503955 - RNA, 14 nt, Chlamydia trachomatis
caaagcuauuugca

SEQ ID NO: 2503956 - RNA, 20 nt, Chlamydia trachomatis
caaagcuauuugcaagaacu

SEQ ID NO: 2503957 - RNA, 20 nt, Chlamydia trachomatis
caaagcucuagcaauagaga

SEQ ID NO: 2503958 - RNA, 22 nt, Chlamydia trachomatis
caaagcugcuuuagcugcuuua

SEQ ID NO: 2503959 - RNA, 13 nt, Chlamydia trachomatis
caaagcuucuaac

SEQ ID NO: 2503960 - RNA, 18 nt, Chlamydia trachomatis
caaagcuucuaacgcuuc

SEQ ID NO: 2503961 - RNA, 16 nt, Chlamydia trachomatis
caaaggaacaucgaga

SEQ ID NO: 2503962 - RNA, 22 nt, Chlamydia trachomatis
caaaggaacaucgagaaaauga

SEQ ID NO: 2503963 - RNA, 16 nt, Chlamydia trachomatis
caaaggcaacaaaggc

SEQ ID NO: 2503964 - RNA, 21 nt, Chlamydia trachomatis
caaagguagauccgauaucag

SEQ ID NO: 2503965 - RNA, 20 nt, Chlamydia trachomatis
caaaguacgccucuuuugca

SEQ ID NO: 2503966 - RNA, 19 nt, Chlamydia trachomatis
caaaguggcguuguuucua

SEQ ID NO: 2503967 - RNA, 17 nt, Chlamydia trachomatis
caaaguuucugaaaagu

SEQ ID NO: 2503968 - RNA, 18 nt, Chlamydia trachomatis
caaaguuuuuguuuuuuu

SEQ ID NO: 2503969 - RNA, 12 nt, Chlamydia trachomatis
caaauaaaacga

SEQ ID NO: 2503970 - RNA, 20 nt, Chlamydia trachomatis
caaauaaagcggcuaaagaa

SEQ ID NO: 2503971 - RNA, 13 nt, Chlamydia trachomatis
caaauaacagaaa

SEQ ID NO: 2503972 - RNA, 16 nt, Chlamydia trachomatis
caaauaacagaaacgu

SEQ ID NO: 2503973 - RNA, 16 nt, Chlamydia trachomatis
caaauaagaaaguuuu

SEQ ID NO: 2503974 - RNA, 22 nt, Chlamydia trachomatis
caaauaagaaaguuuuuuucag

SEQ ID NO: 2503975 - RNA, 18 nt, Chlamydia trachomatis
caaauaauaaaccaaagg

SEQ ID NO: 2503976 - RNA, 12 nt, Chlamydia trachomatis
caaauaccaaaa

SEQ ID NO: 2503977 - RNA, 17 nt, Chlamydia trachomatis
caaauaggcgaauuucu

SEQ ID NO: 2503978 - RNA, 18 nt, Chlamydia trachomatis
caaauagguaugugcuca

SEQ ID NO: 2503979 - RNA, 19 nt, Chlamydia trachomatis
caaauaguguaaggagaga

SEQ ID NO: 2503980 - RNA, 22 nt, Chlamydia trachomatis
caaauauuuuugggaaaaaauu

SEQ ID NO: 2503981 - RNA, 23 nt, Chlamydia trachomatis
caaauauuuuugggaaaaaauua

SEQ ID NO: 2503982 - RNA, 17 nt, Chlamydia trachomatis
caaaucaggaaucacua

SEQ ID NO: 2503983 - RNA, 22 nt, Chlamydia trachomatis
caaauccuacacaagcuuuuuu

SEQ ID NO: 2503984 - RNA, 16 nt, Chlamydia trachomatis
caaauccuagaagagc

SEQ ID NO: 2503985 - RNA, 13 nt, Chlamydia trachomatis
caaauccuccaua

SEQ ID NO: 2503986 - RNA, 15 nt, Chlamydia trachomatis
caaauccuccauaac

SEQ ID NO: 2503987 - RNA, 20 nt, Chlamydia trachomatis
caaauccugcauuuauccac

SEQ ID NO: 2503988 - RNA, 15 nt, Chlamydia trachomatis
caaggaaaagaugaa

SEQ ID NO: 2503989 - RNA, 17 nt, Chlamydia trachomatis
caaggaaauaaagaucu

SEQ ID NO: 2503990 - RNA, 20 nt, Chlamydia trachomatis
caaggagaauaccaccauag

SEQ ID NO: 2503991 - RNA, 13 nt, Chlamydia trachomatis
caaggauucauau

SEQ ID NO: 2503992 - RNA, 23 nt, Chlamydia trachomatis
caaggauuuucuucuuuuuuaca

SEQ ID NO: 2503993 - RNA, 17 nt, Chlamydia trachomatis
caaggauuuuuuuccca

SEQ ID NO: 2503994 - RNA, 17 nt, Chlamydia trachomatis
caaggcaggaaaaggca

SEQ ID NO: 2503995 - RNA, 15 nt, Chlamydia trachomatis
caaggcuaagaaaaa

SEQ ID NO: 2503996 - RNA, 14 nt, Chlamydia trachomatis
caaggcuaagaaag

SEQ ID NO: 2503997 - RNA, 17 nt, Chlamydia trachomatis
caaggcucuugaaaagg

SEQ ID NO: 2503998 - RNA, 18 nt, Chlamydia trachomatis
caaggcuuucaaaaagag

SEQ ID NO: 2503999 - RNA, 13 nt, Chlamydia trachomatis
caagggagauguu

SEQ ID NO: 2504000 - RNA, 22 nt, Chlamydia trachomatis
caagggaugaagcuaaaaaauc

SEQ ID NO: 2504001 - RNA, 22 nt, Chlamydia trachomatis
caagggccacaccauucagcaa

SEQ ID NO: 2504002 - RNA, 18 nt, Chlamydia trachomatis
caagggggguuaagaaaa

SEQ ID NO: 2504003 - RNA, 14 nt, Chlamydia trachomatis
caaggugaccucug

SEQ ID NO: 2504004 - RNA, 12 nt, Chlamydia trachomatis
caagguucuuca

SEQ ID NO: 2504005 - RNA, 22 nt, Chlamydia trachomatis
caagguucuucaacaacuucaa

SEQ ID NO: 2504006 - RNA, 20 nt, Chlamydia trachomatis
caagguugacuuucccugca

SEQ ID NO: 2504007 - RNA, 22 nt, Chlamydia trachomatis
caaguaaccauuccuucguccc

SEQ ID NO: 2504008 - RNA, 20 nt, Chlamydia trachomatis
caaguaauuuggcucuuuaa

SEQ ID NO: 2504009 - RNA, 16 nt, Chlamydia trachomatis
caaguaugagaggaag

SEQ ID NO: 2504010 - RNA, 14 nt, Chlamydia trachomatis
caagucauuuugag

SEQ ID NO: 2504011 - RNA, 23 nt, Chlamydia trachomatis
caaguccuuugauuucugcagag

SEQ ID NO: 2504012 - RNA, 13 nt, Chlamydia trachomatis
caagucuccacug

SEQ ID NO: 2504013 - RNA, 23 nt, Chlamydia trachomatis
caagugacauuuccaacaaaaag

SEQ ID NO: 2504014 - RNA, 18 nt, Chlamydia trachomatis
caagugccaacaucaaaa

SEQ ID NO: 2504015 - RNA, 23 nt, Chlamydia trachomatis
caagugugcgaggaauucuucuu

SEQ ID NO: 2504016 - RNA, 13 nt, Chlamydia trachomatis
caaguuccuggau

SEQ ID NO: 2504017 - RNA, 23 nt, Chlamydia trachomatis
caaguucuccuucuugugagaga

SEQ ID NO: 2504018 - RNA, 18 nt, Chlamydia trachomatis
caaguucuucuuccacag

SEQ ID NO: 2504019 - RNA, 20 nt, Chlamydia trachomatis
caaguugagugcagaggauu

SEQ ID NO: 2504020 - RNA, 21 nt, Chlamydia trachomatis
caaguuuauggaaaagaucuu

SEQ ID NO: 2504021 - RNA, 21 nt, Chlamydia trachomatis
caauaaaaacuggagaaucca

SEQ ID NO: 2504022 - RNA, 20 nt, Chlamydia trachomatis
caauaaaagcugguuuuuuu

SEQ ID NO: 2504023 - RNA, 19 nt, Chlamydia trachomatis
caauaaacgaggaauauau

SEQ ID NO: 2504024 - RNA, 14 nt, Chlamydia trachomatis
caauaaagaaauaa

SEQ ID NO: 2504025 - RNA, 20 nt, Chlamydia trachomatis
caauaacagcacaaacaaau

SEQ ID NO: 2504026 - RNA, 22 nt, Chlamydia trachomatis
caauaaccugaccuugaacccc

SEQ ID NO: 2504027 - RNA, 19 nt, Chlamydia trachomatis
caauaaguuacuguggcca

SEQ ID NO: 2504028 - RNA, 22 nt, Chlamydia trachomatis
caauaaguuacuguggccacca

SEQ ID NO: 2504029 - RNA, 16 nt, Chlamydia trachomatis
caauaauacaaagcac

SEQ ID NO: 2504030 - RNA, 14 nt, Chlamydia trachomatis
caauaaucuuuuua

SEQ ID NO: 2504031 - RNA, 20 nt, Chlamydia trachomatis
caauaauucaggcucuuuca

SEQ ID NO: 2504032 - RNA, 13 nt, Chlamydia trachomatis
caauaauuucccc

SEQ ID NO: 2504033 - RNA, 15 nt, Chlamydia trachomatis
caauaauuuccccua

SEQ ID NO: 2504034 - RNA, 17 nt, Chlamydia trachomatis
caauaccuagcaauuca

SEQ ID NO: 2504035 - RNA, 18 nt, Chlamydia trachomatis
caauagagauaucaaucg

SEQ ID NO: 2504036 - RNA, 17 nt, Chlamydia trachomatis
caauagauagucugcau

SEQ ID NO: 2504037 - RNA, 20 nt, Chlamydia trachomatis
caauagcaggaacuucuuca

SEQ ID NO: 2504038 - RNA, 14 nt, Chlamydia trachomatis
caauagcauuucug

SEQ ID NO: 2504039 - RNA, 18 nt, Chlamydia trachomatis
caauagccauuaacaaca

SEQ ID NO: 2504040 - RNA, 19 nt, Chlamydia trachomatis
caauagccauuaacaacaa

SEQ ID NO: 2504041 - RNA, 18 nt, Chlamydia trachomatis
caauagguuuaaauaagu

SEQ ID NO: 2504042 - RNA, 19 nt, Chlamydia trachomatis
caauagugacuagguguug

SEQ ID NO: 2504043 - RNA, 14 nt, Chlamydia trachomatis
caauauaacuagaa

SEQ ID NO: 2504044 - RNA, 23 nt, Chlamydia trachomatis
caauaucuagguugaagaggcaa

SEQ ID NO: 2504045 - RNA, 14 nt, Chlamydia trachomatis
caauauuacgaauu

SEQ ID NO: 2504046 - RNA, 17 nt, Chlamydia trachomatis
caauauuacgaauuucu

SEQ ID NO: 2504047 - RNA, 21 nt, Chlamydia trachomatis
caauauucccuguauucugag

SEQ ID NO: 2504048 - RNA, 18 nt, Chlamydia trachomatis
caauauuuuuucuaucag

SEQ ID NO: 2504049 - RNA, 24 nt, Chlamydia trachomatis
caaucaaaaacgcgauauccuuuu

SEQ ID NO: 2504050 - RNA, 20 nt, Chlamydia trachomatis
caaucaccacgagaucugca

SEQ ID NO: 2504051 - RNA, 23 nt, Chlamydia trachomatis
caaucaccgcugcuaaagcagca

SEQ ID NO: 2504052 - RNA, 23 nt, Chlamydia trachomatis
caaucacuaaaaguaguccuauc

SEQ ID NO: 2504053 - RNA, 11 nt, Chlamydia trachomatis
caaucagcucu

SEQ ID NO: 2504054 - RNA, 20 nt, Chlamydia trachomatis
caaucaguugauacaccucu

SEQ ID NO: 2504055 - RNA, 20 nt, Chlamydia trachomatis
caaucauaucaagaauuucu

SEQ ID NO: 2504056 - RNA, 20 nt, Chlamydia trachomatis
caauccacgaauuuucucuc

SEQ ID NO: 2504057 - RNA, 12 nt, Chlamydia trachomatis
caauccccaaac

SEQ ID NO: 2504058 - RNA, 15 nt, Chlamydia trachomatis
caauccgaagauuau

SEQ ID NO: 2504059 - RNA, 15 nt, Chlamydia trachomatis
caauccgaauaaguc

SEQ ID NO: 2504060 - RNA, 13 nt, Chlamydia trachomatis
caauccgccuccg

SEQ ID NO: 2504061 - RNA, 20 nt, Chlamydia trachomatis
caauccgccuccggcuccca

SEQ ID NO: 2504062 - RNA, 22 nt, Chlamydia trachomatis
caauccuuuuaagauauccaua

SEQ ID NO: 2504063 - RNA, 22 nt, Chlamydia trachomatis
caaucgagagguccagucuaca

SEQ ID NO: 2504064 - RNA, 19 nt, Chlamydia trachomatis
caaucgaucgauaccuauu

SEQ ID NO: 2504065 - RNA, 15 nt, Chlamydia trachomatis
caaucgcaauuugau

SEQ ID NO: 2504066 - RNA, 12 nt, Chlamydia trachomatis
caaucuaaaaaa

SEQ ID NO: 2504067 - RNA, 18 nt, Chlamydia trachomatis
caaucucaaaaacacuac

SEQ ID NO: 2504068 - RNA, 19 nt, Chlamydia trachomatis
caaucuguaauaaacccug

SEQ ID NO: 2504069 - RNA, 19 nt, Chlamydia trachomatis
caaucuucuaaaugcugua

SEQ ID NO: 2504070 - RNA, 16 nt, Chlamydia trachomatis
caaugaaacggaauga

SEQ ID NO: 2504071 - RNA, 20 nt, Chlamydia trachomatis
caaugacucaaaaagcugua

SEQ ID NO: 2504072 - RNA, 22 nt, Chlamydia trachomatis
caaugagcgcuuuuucuucucu

SEQ ID NO: 2504073 - RNA, 12 nt, Chlamydia trachomatis
caaugaggaugu

SEQ ID NO: 2504074 - RNA, 16 nt, Chlamydia trachomatis
caaugaucuuuaagcu

SEQ ID NO: 2504075 - RNA, 17 nt, Chlamydia trachomatis
caauguaaaaugagaaa

SEQ ID NO: 2504076 - RNA, 20 nt, Chlamydia trachomatis
caauguaaaaugagaaauaa

SEQ ID NO: 2504077 - RNA, 23 nt, Chlamydia trachomatis
caauguaaaaugagaaauaaaaa

SEQ ID NO: 2504078 - RNA, 17 nt, Chlamydia trachomatis
caauguacgcuaaaaac

SEQ ID NO: 2504079 - RNA, 18 nt, Chlamydia trachomatis
caauguacgcuaaaaacu

SEQ ID NO: 2504080 - RNA, 14 nt, Chlamydia trachomatis
caaugucaacauaa

SEQ ID NO: 2504081 - RNA, 16 nt, Chlamydia trachomatis
caauguucuauauaca

SEQ ID NO: 2504082 - RNA, 13 nt, Chlamydia trachomatis
caauucagaaaua

SEQ ID NO: 2504083 - RNA, 23 nt, Chlamydia trachomatis
caauuccacgaagagcaaaauca

SEQ ID NO: 2504084 - RNA, 22 nt, Chlamydia trachomatis
caauuccucuaaacaagguucu

SEQ ID NO: 2504085 - RNA, 12 nt, Chlamydia trachomatis
caauuccugcuc

SEQ ID NO: 2504086 - RNA, 22 nt, Chlamydia trachomatis
caauuccugcucagagauccca

SEQ ID NO: 2504087 - RNA, 20 nt, Chlamydia trachomatis
caauuguugagcagcaaaga

SEQ ID NO: 2504088 - RNA, 21 nt, Chlamydia trachomatis
caauuguugagcagcaaagau

SEQ ID NO: 2504089 - RNA, 13 nt, Chlamydia trachomatis
caauuguuggaca

SEQ ID NO: 2504090 - RNA, 21 nt, Chlamydia trachomatis
caauuuacuaucaggaauaau

SEQ ID NO: 2504091 - RNA, 23 nt, Chlamydia trachomatis
caauuuacuaucaggaauaauga

SEQ ID NO: 2504092 - RNA, 16 nt, Chlamydia trachomatis
caauuucaucacagau

SEQ ID NO: 2504093 - RNA, 19 nt, Chlamydia trachomatis
caauuucaucacagauaau

SEQ ID NO: 2504094 - RNA, 18 nt, Chlamydia trachomatis
caauuuccuuagaaagaa

SEQ ID NO: 2504095 - RNA, 23 nt, Chlamydia trachomatis
caauuucuacgagcugaccuuuu

SEQ ID NO: 2504096 - RNA, 15 nt, Chlamydia trachomatis
caauuucucuaccca

SEQ ID NO: 2504097 - RNA, 23 nt, Chlamydia trachomatis
caauuuuucuuugagaaaguuaa

SEQ ID NO: 2504098 - RNA, 21 nt, Chlamydia trachomatis
cacuuccucucucucaccgaa

SEQ ID NO: 2504099 - RNA, 16 nt, Chlamydia trachomatis
cacuucucgaaaaaau

SEQ ID NO: 2504100 - RNA, 17 nt, Chlamydia trachomatis
cacuugaucuaucuuuc

SEQ ID NO: 2504101 - RNA, 19 nt, Chlamydia trachomatis
cacuugaucuaucuuucuu

SEQ ID NO: 2504102 - RNA, 15 nt, Chlamydia trachomatis
cacuuuauuagaguu

SEQ ID NO: 2504103 - RNA, 23 nt, Chlamydia trachomatis
cacuuuccgaaauaauugcgaag

SEQ ID NO: 2504104 - RNA, 15 nt, Chlamydia trachomatis
cacuuugauaauacu

SEQ ID NO: 2504105 - RNA, 21 nt, Chlamydia trachomatis
cacuuugauaauacucuucua

SEQ ID NO: 2504106 - RNA, 20 nt, Chlamydia trachomatis
cacuuuuaccguuccaucuu

SEQ ID NO: 2504107 - RNA, 15 nt, Chlamydia trachomatis
cacuuuugugaaaau

SEQ ID NO: 2504108 - RNA, 14 nt, Chlamydia trachomatis
cagaaaaaguaagc

SEQ ID NO: 2504109 - RNA, 23 nt, Chlamydia trachomatis
cagaaaaaguaagcgaagaagga

SEQ ID NO: 2504110 - RNA, 23 nt, Chlamydia trachomatis
cagaaaauucuacaacagcaaau

SEQ ID NO: 2504111 - RNA, 18 nt, Chlamydia trachomatis
cagaaacaaauaacuuuu

SEQ ID NO: 2504112 - RNA, 17 nt, Chlamydia trachomatis
cagaaacacuaucuccu

SEQ ID NO: 2504113 - RNA, 14 nt, Chlamydia trachomatis
cagaaacguuuacu

SEQ ID NO: 2504114 - RNA, 17 nt, Chlamydia trachomatis
cagaaacuucaguuugu

SEQ ID NO: 2504115 - RNA, 15 nt, Chlamydia trachomatis
cagaaacuucuucua

SEQ ID NO: 2504116 - RNA, 23 nt, Chlamydia trachomatis
cagaaagaaaugcguuucuucug

SEQ ID NO: 2504117 - RNA, 15 nt, Chlamydia trachomatis
cagaaagagaaucau

SEQ ID NO: 2504118 - RNA, 16 nt, Chlamydia trachomatis
cagaaagagaaucauc

SEQ ID NO: 2504119 - RNA, 23 nt, Chlamydia trachomatis
cagaaagagucacggcaggaaag

SEQ ID NO: 2504120 - RNA, 24 nt, Chlamydia trachomatis
cagaaaggaauccuuaaccgugaa

SEQ ID NO: 2504121 - RNA, 15 nt, Chlamydia trachomatis
cagaaaguccugcuu

SEQ ID NO: 2504122 - RNA, 20 nt, Chlamydia trachomatis
cagaaauaugacagagcccu

SEQ ID NO: 2504123 - RNA, 15 nt, Chlamydia trachomatis
cagaacaacuucucu

SEQ ID NO: 2504124 - RNA, 16 nt, Chlamydia trachomatis
cagaacaagugcagcg

SEQ ID NO: 2504125 - RNA, 12 nt, Chlamydia trachomatis
cagaaccuucca

SEQ ID NO: 2504126 - RNA, 22 nt, Chlamydia trachomatis
cagaaccuuccacuuuugugaa

SEQ ID NO: 2504127 - RNA, 21 nt, Chlamydia trachomatis
cagaacucgcguauuuuuguu

SEQ ID NO: 2504128 - RNA, 18 nt, Chlamydia trachomatis
cagaagaaccuccauaag

SEQ ID NO: 2504129 - RNA, 19 nt, Chlamydia trachomatis
cagaagaagagcugcuguc

SEQ ID NO: 2504130 - RNA, 22 nt, Chlamydia trachomatis
cagaagaagagcugcugucaga

SEQ ID NO: 2504131 - RNA, 12 nt, Chlamydia trachomatis
cagaagaauagg

SEQ ID NO: 2504132 - RNA, 15 nt, Chlamydia trachomatis
cagaagaauaggaau

SEQ ID NO: 2504133 - RNA, 20 nt, Chlamydia trachomatis
cagaagacuuuggaagaggc

SEQ ID NO: 2504134 - RNA, 16 nt, Chlamydia trachomatis
cagaagaggcaaaaau

SEQ ID NO: 2504135 - RNA, 21 nt, Chlamydia trachomatis
cagaagaucccaacaggagau

SEQ ID NO: 2504136 - RNA, 18 nt, Chlamydia trachomatis
cagaagcaagaaucaaag

SEQ ID NO: 2504137 - RNA, 12 nt, Chlamydia trachomatis
cagaagcuccaa

SEQ ID NO: 2504138 - RNA, 16 nt, Chlamydia trachomatis
cagaagcuccaaagaa

SEQ ID NO: 2504139 - RNA, 16 nt, Chlamydia trachomatis
cagaaggaguuuuucu

SEQ ID NO: 2504140 - RNA, 17 nt, Chlamydia trachomatis
cagaaguaucuaacaau

SEQ ID NO: 2504141 - RNA, 16 nt, Chlamydia trachomatis
cagaaguuagaaucug

SEQ ID NO: 2504142 - RNA, 16 nt, Chlamydia trachomatis
cagaaguugagcaacu

SEQ ID NO: 2504143 - RNA, 13 nt, Chlamydia trachomatis
cagaaguuuuaac

SEQ ID NO: 2504144 - RNA, 17 nt, Chlamydia trachomatis
cagaaguuuuaacauga

SEQ ID NO: 2504145 - RNA, 23 nt, Chlamydia trachomatis
cagaaucaucugguauucuaaau

SEQ ID NO: 2504146 - RNA, 18 nt, Chlamydia trachomatis
cagaauccuuuucagaau

SEQ ID NO: 2504147 - RNA, 15 nt, Chlamydia trachomatis
cagaauuacccugaa

SEQ ID NO: 2504148 - RNA, 16 nt, Chlamydia trachomatis
cagacaaaaagaaagc

SEQ ID NO: 2504149 - RNA, 13 nt, Chlamydia trachomatis
cagacaaaacaag

SEQ ID NO: 2504150 - RNA, 21 nt, Chlamydia trachomatis
cagacaagccuucaggauucc

SEQ ID NO: 2504151 - RNA, 14 nt, Chlamydia trachomatis
cagacaauggucuc

SEQ ID NO: 2504152 - RNA, 14 nt, Chlamydia trachomatis
cagacagagaagaa

SEQ ID NO: 2504153 - RNA, 24 nt, Chlamydia trachomatis
cagacccuuccaaauuucccucuu

SEQ ID NO: 2504154 - RNA, 15 nt, Chlamydia trachomatis
cagaccuacaaagau

SEQ ID NO: 2504155 - RNA, 16 nt, Chlamydia trachomatis
cagaccuacaaagaua

SEQ ID NO: 2504156 - RNA, 18 nt, Chlamydia trachomatis
cagaccuacaaagauaau

SEQ ID NO: 2504157 - RNA, 17 nt, Chlamydia trachomatis
cagacgcauagaaucuc

SEQ ID NO: 2504158 - RNA, 16 nt, Chlamydia trachomatis
cagacgcccuccuccu

SEQ ID NO: 2504159 - RNA, 17 nt, Chlamydia trachomatis
cagacuaaguuguaaaa

SEQ ID NO: 2504160 - RNA, 16 nt, Chlamydia trachomatis
cagacuauuucuucua

SEQ ID NO: 2504161 - RNA, 22 nt, Chlamydia trachomatis
cagacucagguuauccaaauaa

SEQ ID NO: 2504162 - RNA, 18 nt, Chlamydia trachomatis
cagacugccuaccugcuc

SEQ ID NO: 2504163 - RNA, 20 nt, Chlamydia trachomatis
cagacuuuguuuauuaucua

SEQ ID NO: 2504164 - RNA, 19 nt, Chlamydia trachomatis
cagagaagaacacacuuuc

SEQ ID NO: 2504165 - RNA, 19 nt, Chlamydia trachomatis
cagagagccagcgaggcuu

SEQ ID NO: 2504166 - RNA, 13 nt, Chlamydia trachomatis
cagagauaaagac

SEQ ID NO: 2504167 - RNA, 14 nt, Chlamydia trachomatis
cagagauauaagag

SEQ ID NO: 2504168 - RNA, 17 nt, Chlamydia trachomatis
cagagauauaaucuaaa

SEQ ID NO: 2504169 - RNA, 18 nt, Chlamydia trachomatis
cagagauauaaucuaaag

SEQ ID NO: 2504170 - RNA, 23 nt, Chlamydia trachomatis
cagagauauaaucuaaagacaaa

SEQ ID NO: 2504171 - RNA, 17 nt, Chlamydia trachomatis
cagagaucccagggaga

SEQ ID NO: 2504172 - RNA, 19 nt, Chlamydia trachomatis
cagagaucccagggagaga

SEQ ID NO: 2504173 - RNA, 21 nt, Chlamydia trachomatis
cagagcacaaaucuuucuuuc

SEQ ID NO: 2504174 - RNA, 18 nt, Chlamydia trachomatis
cagagccaaaacaaacaa

SEQ ID NO: 2504175 - RNA, 19 nt, Chlamydia trachomatis
cagagccagcuuuaaagag

SEQ ID NO: 2504176 - RNA, 21 nt, Chlamydia trachomatis
cagagccuuuuauucuucagu

SEQ ID NO: 2504177 - RNA, 15 nt, Chlamydia trachomatis
cagagcuuuuacuuc

SEQ ID NO: 2504178 - RNA, 17 nt, Chlamydia trachomatis
cagaggagggagaugau

SEQ ID NO: 2504179 - RNA, 15 nt, Chlamydia trachomatis
cagagggacgagcag

SEQ ID NO: 2504180 - RNA, 14 nt, Chlamydia trachomatis
cagagggccuccca

SEQ ID NO: 2504181 - RNA, 15 nt, Chlamydia trachomatis
cagagguagccaaag

SEQ ID NO: 2504182 - RNA, 16 nt, Chlamydia trachomatis
cagagguaugcagacu

SEQ ID NO: 2504183 - RNA, 17 nt, Chlamydia trachomatis
cagaguuaacuauuucu

SEQ ID NO: 2504184 - RNA, 13 nt, Chlamydia trachomatis
cagaguucucuga

SEQ ID NO: 2504185 - RNA, 18 nt, Chlamydia trachomatis
cagauaacuggugugggu

SEQ ID NO: 2504186 - RNA, 17 nt, Chlamydia trachomatis
cagauaaucaguugugg

SEQ ID NO: 2504187 - RNA, 20 nt, Chlamydia trachomatis
cagauaauucucgcaaagaa

SEQ ID NO: 2504188 - RNA, 19 nt, Chlamydia trachomatis
cagauaccaagccauuucc

SEQ ID NO: 2504189 - RNA, 13 nt, Chlamydia trachomatis
cagauauaacaac

SEQ ID NO: 2504190 - RNA, 19 nt, Chlamydia trachomatis
cagauauggaagaacagca

SEQ ID NO: 2504191 - RNA, 13 nt, Chlamydia trachomatis
cagaucauaggcu

SEQ ID NO: 2504192 - RNA, 14 nt, Chlamydia trachomatis
cagaucauaucugc

SEQ ID NO: 2504193 - RNA, 15 nt, Chlamydia trachomatis
cagaucauccauaaa

SEQ ID NO: 2504194 - RNA, 16 nt, Chlamydia trachomatis
cagaucauccauaaaa

SEQ ID NO: 2504195 - RNA, 20 nt, Chlamydia trachomatis
cagaucccagccugugcauu

SEQ ID NO: 2504196 - RNA, 20 nt, Chlamydia trachomatis
cagaucccggcuugccugga

SEQ ID NO: 2504197 - RNA, 16 nt, Chlamydia trachomatis
cagaucuugaucugaa

SEQ ID NO: 2504198 - RNA, 13 nt, Chlamydia trachomatis
cagaucuuuuuca

SEQ ID NO: 2504199 - RNA, 17 nt, Chlamydia trachomatis
cagaucuuuuucauuuu

SEQ ID NO: 2504200 - RNA, 21 nt, Chlamydia trachomatis
cagaucuuuuucauuuuaugu

SEQ ID NO: 2504201 - RNA, 14 nt, Chlamydia trachomatis
cagaugcacuuccu

SEQ ID NO: 2504202 - RNA, 15 nt, Chlamydia trachomatis
cagaugcaucuauug

SEQ ID NO: 2504203 - RNA, 17 nt, Chlamydia trachomatis
cagaugcaucuauugua

SEQ ID NO: 2504204 - RNA, 19 nt, Chlamydia trachomatis
cagaugccauccagagcug

SEQ ID NO: 2504205 - RNA, 21 nt, Chlamydia trachomatis
cagaugcuucugccuuuugau

SEQ ID NO: 2504206 - RNA, 14 nt, Chlamydia trachomatis
cagauuuagagaau

SEQ ID NO: 2504207 - RNA, 17 nt, Chlamydia trachomatis
cagauuuagagaauaau

SEQ ID NO: 2504208 - RNA, 18 nt, Chlamydia trachomatis
cagauuuagagaauaauc

SEQ ID NO: 2504209 - RNA, 16 nt, Chlamydia trachomatis
caguacaucaaauaau

SEQ ID NO: 2504210 - RNA, 17 nt, Chlamydia trachomatis
caguacugcuacaaaag

SEQ ID NO: 2504211 - RNA, 19 nt, Chlamydia trachomatis
caguacuuacgagaucgcc

SEQ ID NO: 2504212 - RNA, 22 nt, Chlamydia trachomatis
caguacuuuaccuguaggagga

SEQ ID NO: 2504213 - RNA, 18 nt, Chlamydia trachomatis
caguagaaacuuacuuuu

SEQ ID NO: 2504214 - RNA, 21 nt, Chlamydia trachomatis
caguagugguaagggguuuuc

SEQ ID NO: 2504215 - RNA, 20 nt, Chlamydia trachomatis
caguauauccucucuucuua

SEQ ID NO: 2504216 - RNA, 22 nt, Chlamydia trachomatis
caguccucccaaaauaccuuug

SEQ ID NO: 2504217 - RNA, 19 nt, Chlamydia trachomatis
cagucgcgcagcuucuggu

SEQ ID NO: 2504218 - RNA, 17 nt, Chlamydia trachomatis
cagucucugaggcaaag

SEQ ID NO: 2504219 - RNA, 19 nt, Chlamydia trachomatis
cagucucuuauaaucugga

SEQ ID NO: 2504220 - RNA, 15 nt, Chlamydia trachomatis
cagucuuccucugcu

SEQ ID NO: 2504221 - RNA, 17 nt, Chlamydia trachomatis
cagucuuccucugcuuc

SEQ ID NO: 2504222 - RNA, 14 nt, Chlamydia trachomatis
cagucuucuuuucu

SEQ ID NO: 2504223 - RNA, 16 nt, Chlamydia trachomatis
caguggaacugcuucc

SEQ ID NO: 2504224 - RNA, 17 nt, Chlamydia trachomatis
caguggaagauagaaga

SEQ ID NO: 2504225 - RNA, 16 nt, Chlamydia trachomatis
caguuaagccuucucc

SEQ ID NO: 2504226 - RNA, 15 nt, Chlamydia trachomatis
caguuacauuuuucg

SEQ ID NO: 2504227 - RNA, 16 nt, Chlamydia trachomatis
caguuacccucuuuag

SEQ ID NO: 2504228 - RNA, 22 nt, Chlamydia trachomatis
caguuauaacgauauccuucug

SEQ ID NO: 2504229 - RNA, 16 nt, Chlamydia trachomatis
caguucugguuuuugu

SEQ ID NO: 2504230 - RNA, 21 nt, Chlamydia trachomatis
caguugaguaaucacucucuc

SEQ ID NO: 2504231 - RNA, 22 nt, Chlamydia trachomatis
caguugcuccuccgugacgaau

SEQ ID NO: 2504232 - RNA, 19 nt, Chlamydia trachomatis
caguuguugggagagggug

SEQ ID NO: 2504233 - RNA, 17 nt, Chlamydia trachomatis
caguuuacugcaauaag

SEQ ID NO: 2504234 - RNA, 14 nt, Chlamydia trachomatis
caguuuaggacgcu

SEQ ID NO: 2504235 - RNA, 15 nt, Chlamydia trachomatis
caguuucuccuaaag

SEQ ID NO: 2504236 - RNA, 18 nt, Chlamydia trachomatis
caguuucuccuaaaguug

SEQ ID NO: 2504237 - RNA, 23 nt, Chlamydia trachomatis
caguuucuccuaaaguugguaga

SEQ ID NO: 2504238 - RNA, 21 nt, Chlamydia trachomatis
caguuugaaucacagaaacuu

SEQ ID NO: 2504239 - RNA, 23 nt, Chlamydia trachomatis
caguuugaaucacagaaacuucu

SEQ ID NO: 2504240 - RNA, 15 nt, Chlamydia trachomatis
caguuugucuuagaa

SEQ ID NO: 2504241 - RNA, 14 nt, Chlamydia trachomatis
cauaaaaaagaccc

SEQ ID NO: 2504242 - RNA, 21 nt, Chlamydia trachomatis
cauaaaaaagacccaguaguu

SEQ ID NO: 2504243 - RNA, 16 nt, Chlamydia trachomatis
cauaaaaaagagguau

SEQ ID NO: 2504244 - RNA, 23 nt, Chlamydia trachomatis
cauaaaaaagagguauuuaggaa

SEQ ID NO: 2504245 - RNA, 23 nt, Chlamydia trachomatis
cauaaaaagauagugcagaagau

SEQ ID NO: 2504246 - RNA, 12 nt, Chlamydia trachomatis
cauaaaacugcg

SEQ ID NO: 2504247 - RNA, 14 nt, Chlamydia trachomatis
cauaaaagagaaga

SEQ ID NO: 2504248 - RNA, 19 nt, Chlamydia trachomatis
cauaaaauccaauguaaaa

SEQ ID NO: 2504249 - RNA, 23 nt, Chlamydia trachomatis
cauaaaauuucauacgcacagca

SEQ ID NO: 2504250 - RNA, 12 nt, Chlamydia trachomatis
cauaaauuugcu

SEQ ID NO: 2504251 - RNA, 22 nt, Chlamydia trachomatis
cauaaauuugcugagaucgagc

SEQ ID NO: 2504252 - RNA, 16 nt, Chlamydia trachomatis
cauaacaucuaacaga

SEQ ID NO: 2504253 - RNA, 13 nt, Chlamydia trachomatis
cauaacgagugua

SEQ ID NO: 2504254 - RNA, 18 nt, Chlamydia trachomatis
cauaacgaguguagggua

SEQ ID NO: 2504255 - RNA, 23 nt, Chlamydia trachomatis
cauaagaaaauucuucugauaaa

SEQ ID NO: 2504256 - RNA, 18 nt, Chlamydia trachomatis
cauaagaaauuaacacca

SEQ ID NO: 2504257 - RNA, 14 nt, Chlamydia trachomatis
cauaagagcaucuu

SEQ ID NO: 2504258 - RNA, 15 nt, Chlamydia trachomatis
cauaagcaaauccug

SEQ ID NO: 2504259 - RNA, 16 nt, Chlamydia trachomatis
cauaagcagggcugua

SEQ ID NO: 2504260 - RNA, 19 nt, Chlamydia trachomatis
cauaaggaagaugggcaua

SEQ ID NO: 2504261 - RNA, 18 nt, Chlamydia trachomatis
cauaaggaagcaaaaacu

SEQ ID NO: 2504262 - RNA, 19 nt, Chlamydia trachomatis
cauaaggaagcaaaaacug

SEQ ID NO: 2504263 - RNA, 22 nt, Chlamydia trachomatis
cauaaggaagcaaaaacugucu

SEQ ID NO: 2504264 - RNA, 15 nt, Chlamydia trachomatis
cauaauccuaugcag

SEQ ID NO: 2504265 - RNA, 22 nt, Chlamydia trachomatis
cauaauccuaugcaguaaagaa

SEQ ID NO: 2504266 - RNA, 23 nt, Chlamydia trachomatis
cauaauccuaugcaguaaagaaa

SEQ ID NO: 2504267 - RNA, 20 nt, Chlamydia trachomatis
cauaaugaucauguccaugu

SEQ ID NO: 2504268 - RNA, 20 nt, Chlamydia trachomatis
cauaauuacauugcaguaca

SEQ ID NO: 2504269 - RNA, 20 nt, Chlamydia trachomatis
cauaauuucuaggcugacuu

SEQ ID NO: 2504270 - RNA, 16 nt, Chlamydia trachomatis
cauaauuuucuucacu

SEQ ID NO: 2504271 - RNA, 12 nt, Chlamydia trachomatis
cauacaaaagcg

SEQ ID NO: 2504272 - RNA, 14 nt, Chlamydia trachomatis
cauacaggagagac

SEQ ID NO: 2504273 - RNA, 15 nt, Chlamydia trachomatis
cauacaggagagaca

SEQ ID NO: 2504274 - RNA, 16 nt, Chlamydia trachomatis
cauacaugcuuuugau

SEQ ID NO: 2504275 - RNA, 13 nt, Chlamydia trachomatis
cauaccaaagcau

SEQ ID NO: 2504276 - RNA, 19 nt, Chlamydia trachomatis
cauaccaagcuuucugcca

SEQ ID NO: 2504277 - RNA, 17 nt, Chlamydia trachomatis
cauaccaauauuuuuuc

SEQ ID NO: 2504278 - RNA, 22 nt, Chlamydia trachomatis
cauacccuaacgaggcacaaaa

SEQ ID NO: 2504279 - RNA, 21 nt, Chlamydia trachomatis
cauaccgaggauccuaaccaa

SEQ ID NO: 2504280 - RNA, 18 nt, Chlamydia trachomatis
cauacucuaaaaagcguu

SEQ ID NO: 2504281 - RNA, 18 nt, Chlamydia trachomatis
cauacuucccacauacuu

SEQ ID NO: 2504282 - RNA, 21 nt, Chlamydia trachomatis
cauacuuuucaauuacagcau

SEQ ID NO: 2504283 - RNA, 20 nt, Chlamydia trachomatis
cauagaaaauggcugcuugg

SEQ ID NO: 2504284 - RNA, 15 nt, Chlamydia trachomatis
cauagaaggaaugca

SEQ ID NO: 2504285 - RNA, 21 nt, Chlamydia trachomatis
cauagauaaugacagguuuca

SEQ ID NO: 2504286 - RNA, 18 nt, Chlamydia trachomatis
cauagaucccuuucauuc

SEQ ID NO: 2504287 - RNA, 17 nt, Chlamydia trachomatis
cauagauucaugagacc

SEQ ID NO: 2504288 - RNA, 19 nt, Chlamydia trachomatis
cauagauucaugagaccgu

SEQ ID NO: 2504289 - RNA, 20 nt, Chlamydia trachomatis
cauagcaugggcugcaucag

SEQ ID NO: 2504290 - RNA, 16 nt, Chlamydia trachomatis
cauagccaucaguccu

SEQ ID NO: 2504291 - RNA, 13 nt, Chlamydia trachomatis
cauagccaucauc

SEQ ID NO: 2504292 - RNA, 22 nt, Chlamydia trachomatis
cauagccuuuagauaguuacuu

SEQ ID NO: 2504293 - RNA, 18 nt, Chlamydia trachomatis
cauagcggacauuucacu

SEQ ID NO: 2504294 - RNA, 15 nt, Chlamydia trachomatis
cauagcucgcauuug

SEQ ID NO: 2504295 - RNA, 17 nt, Chlamydia trachomatis
cauagcugaacccuuca

SEQ ID NO: 2504296 - RNA, 13 nt, Chlamydia trachomatis
cauagcuucuugc

SEQ ID NO: 2504297 - RNA, 14 nt, Chlamydia trachomatis
cauagcuucuugcg

SEQ ID NO: 2504298 - RNA, 21 nt, Chlamydia trachomatis
cauaggcuccugcaagggaac

SEQ ID NO: 2504299 - RNA, 20 nt, Chlamydia trachomatis
cauagggaucccacaaagaa

SEQ ID NO: 2504300 - RNA, 21 nt, Chlamydia trachomatis
cauaguauuacggaaaagcuu

SEQ ID NO: 2504301 - RNA, 17 nt, Chlamydia trachomatis
cauaguugcaggcaaau

SEQ ID NO: 2504302 - RNA, 18 nt, Chlamydia trachomatis
cauaguugucuguauaga

SEQ ID NO: 2504303 - RNA, 16 nt, Chlamydia trachomatis
cauauagcauggaaga

SEQ ID NO: 2504304 - RNA, 18 nt, Chlamydia trachomatis
cauauaggcugaaacuug

SEQ ID NO: 2504305 - RNA, 18 nt, Chlamydia trachomatis
cauauauucagaagaaga

SEQ ID NO: 2504306 - RNA, 20 nt, Chlamydia trachomatis
cauaucaggaccuagagagg

SEQ ID NO: 2504307 - RNA, 21 nt, Chlamydia trachomatis
cauauccuuugaugagcuuua

SEQ ID NO: 2504308 - RNA, 14 nt, Chlamydia trachomatis
cauaucuccuaaaa

SEQ ID NO: 2504309 - RNA, 16 nt, Chlamydia trachomatis
cauaugcagaagacca

SEQ ID NO: 2504310 - RNA, 16 nt, Chlamydia trachomatis
cauaugcgucuucccu

SEQ ID NO: 2504311 - RNA, 13 nt, Chlamydia trachomatis
cauaugcucuuuc

SEQ ID NO: 2504312 - RNA, 21 nt, Chlamydia trachomatis
cauauguccauacaaagguaa

SEQ ID NO: 2504313 - RNA, 14 nt, Chlamydia trachomatis
cauauuagacacua

SEQ ID NO: 2504314 - RNA, 16 nt, Chlamydia trachomatis
cauauuagacacuaaa

SEQ ID NO: 2504315 - RNA, 19 nt, Chlamydia trachomatis
cauauuuaauugcauuaau

SEQ ID NO: 2504316 - RNA, 13 nt, Chlamydia trachomatis
caucaaaauauag

SEQ ID NO: 2504317 - RNA, 18 nt, Chlamydia trachomatis
caucaaaauauuuugcug

SEQ ID NO: 2504318 - RNA, 14 nt, Chlamydia trachomatis
caucaaaauucuau

SEQ ID NO: 2504319 - RNA, 17 nt, Chlamydia trachomatis
caucaaagaucuuucua

SEQ ID NO: 2504320 - RNA, 18 nt, Chlamydia trachomatis
cauuaccuaggacagaca

SEQ ID NO: 2504321 - RNA, 16 nt, Chlamydia trachomatis
cauuacgaggaagcug

SEQ ID NO: 2504322 - RNA, 21 nt, Chlamydia trachomatis
cauuacgaggaagcuguuuau

SEQ ID NO: 2504323 - RNA, 16 nt, Chlamydia trachomatis
cauuacuguacuccuc

SEQ ID NO: 2504324 - RNA, 18 nt, Chlamydia trachomatis
cauuaggauuaaaaucca

SEQ ID NO: 2504325 - RNA, 19 nt, Chlamydia trachomatis
cauuauccauaaaaauaau

SEQ ID NO: 2504326 - RNA, 16 nt, Chlamydia trachomatis
cauuaucguucucuaa

SEQ ID NO: 2504327 - RNA, 14 nt, Chlamydia trachomatis
cauuaucucgacuu

SEQ ID NO: 2504328 - RNA, 15 nt, Chlamydia trachomatis
cauuaucuucuucua

SEQ ID NO: 2504329 - RNA, 16 nt, Chlamydia trachomatis
cauuauguaagaguuu

SEQ ID NO: 2504330 - RNA, 19 nt, Chlamydia trachomatis
cauuauuauuuaaaacaau

SEQ ID NO: 2504331 - RNA, 21 nt, Chlamydia trachomatis
cauuauuuuuucgagaacgaa

SEQ ID NO: 2504332 - RNA, 15 nt, Chlamydia trachomatis
cauucaaaauccauu

SEQ ID NO: 2504333 - RNA, 12 nt, Chlamydia trachomatis
cauucaauaagc

SEQ ID NO: 2504334 - RNA, 16 nt, Chlamydia trachomatis
cauuccacgcuauaga

SEQ ID NO: 2504335 - RNA, 18 nt, Chlamydia trachomatis
cauucccgccaauuuuuu

SEQ ID NO: 2504336 - RNA, 18 nt, Chlamydia trachomatis
cauuccggcucucuucac

SEQ ID NO: 2504337 - RNA, 15 nt, Chlamydia trachomatis
cauuccuuggcaaag

SEQ ID NO: 2504338 - RNA, 13 nt, Chlamydia trachomatis
cauucgaaucauu

SEQ ID NO: 2504339 - RNA, 15 nt, Chlamydia trachomatis
cauucgccucuucuc

SEQ ID NO: 2504340 - RNA, 14 nt, Chlamydia trachomatis
cauucgucaaagaa

SEQ ID NO: 2504341 - RNA, 14 nt, Chlamydia trachomatis
cauucuuacuaaag

SEQ ID NO: 2504342 - RNA, 22 nt, Chlamydia trachomatis
cauucuuagugaaugcuccaua

SEQ ID NO: 2504343 - RNA, 20 nt, Chlamydia trachomatis
cauucuucugaacaacaucc

SEQ ID NO: 2504344 - RNA, 19 nt, Chlamydia trachomatis
cauugauaaguacgugcau

SEQ ID NO: 2504345 - RNA, 13 nt, Chlamydia trachomatis
cauugauuccauu

SEQ ID NO: 2504346 - RNA, 18 nt, Chlamydia trachomatis
cauugauuccauuugcua

SEQ ID NO: 2504347 - RNA, 14 nt, Chlamydia trachomatis
cauugauucuauga

SEQ ID NO: 2504348 - RNA, 15 nt, Chlamydia trachomatis
cauugguauugccau

SEQ ID NO: 2504349 - RNA, 21 nt, Chlamydia trachomatis
cauuguaucugggauggaaau

SEQ ID NO: 2504350 - RNA, 12 nt, Chlamydia trachomatis
cauuuaaaaguc

SEQ ID NO: 2504351 - RNA, 12 nt, Chlamydia trachomatis
cauuuacaaacg

SEQ ID NO: 2504352 - RNA, 18 nt, Chlamydia trachomatis
cauuuagaccaggauucc

SEQ ID NO: 2504353 - RNA, 18 nt, Chlamydia trachomatis
cauuucaagagagaucua

SEQ ID NO: 2504354 - RNA, 20 nt, Chlamydia trachomatis
cauuucacuauccaaagcug

SEQ ID NO: 2504355 - RNA, 20 nt, Chlamydia trachomatis
cauuuccacaagauuuugaa

SEQ ID NO: 2504356 - RNA, 22 nt, Chlamydia trachomatis
cauuuccagccucuccagaaaa

SEQ ID NO: 2504357 - RNA, 16 nt, Chlamydia trachomatis
cauuuccauagaaaga

SEQ ID NO: 2504358 - RNA, 19 nt, Chlamydia trachomatis
cauuuccauagaaagauag

SEQ ID NO: 2504359 - RNA, 17 nt, Chlamydia trachomatis
cauuuccuaaggcuugg

SEQ ID NO: 2504360 - RNA, 14 nt, Chlamydia trachomatis
cauuugccaaaaag

SEQ ID NO: 2504361 - RNA, 15 nt, Chlamydia trachomatis
cauuugccaaaaagg

SEQ ID NO: 2504362 - RNA, 17 nt, Chlamydia trachomatis
cauuugccaaugaaaua

SEQ ID NO: 2504363 - RNA, 19 nt, Chlamydia trachomatis
cauuugccaaugaaauauc

SEQ ID NO: 2504364 - RNA, 24 nt, Chlamydia trachomatis
cauuugccaaugaaauaucauucc

SEQ ID NO: 2504365 - RNA, 20 nt, Chlamydia trachomatis
cauuugcgugauaaaaacuc

SEQ ID NO: 2504366 - RNA, 21 nt, Chlamydia trachomatis
cauuugcgugauaaaaacucu

SEQ ID NO: 2504367 - RNA, 14 nt, Chlamydia trachomatis
cauuugcucuucca

SEQ ID NO: 2504368 - RNA, 13 nt, Chlamydia trachomatis
cauuugugugagu

SEQ ID NO: 2504369 - RNA, 15 nt, Chlamydia trachomatis
cauuuuaauaagauu

SEQ ID NO: 2504370 - RNA, 22 nt, Chlamydia trachomatis
cauuuuauccgcaguaaaaucu

SEQ ID NO: 2504371 - RNA, 20 nt, Chlamydia trachomatis
cauuuuauuggcguaggcuu

SEQ ID NO: 2504372 - RNA, 17 nt, Chlamydia trachomatis
cauuuuccaagaaaaau

SEQ ID NO: 2504373 - RNA, 22 nt, Chlamydia trachomatis
ccaaaaaaaggcucuauacaga

SEQ ID NO: 2504374 - RNA, 23 nt, Chlamydia trachomatis
ccaaaaaagaaucuaaaaagcca

SEQ ID NO: 2504375 - RNA, 16 nt, Chlamydia trachomatis
ccaaaaacaaucaaag

SEQ ID NO: 2504376 - RNA, 19 nt, Chlamydia trachomatis
ccaaaaacaaucaaagcac

SEQ ID NO: 2504377 - RNA, 21 nt, Chlamydia trachomatis
ccaaaaaguccgcuaauccau

SEQ ID NO: 2504378 - RNA, 19 nt, Chlamydia trachomatis
ccaaaacaucccagcaaua

SEQ ID NO: 2504379 - RNA, 21 nt, Chlamydia trachomatis
ccaaaagaucuugaucugugg

SEQ ID NO: 2504380 - RNA, 23 nt, Chlamydia trachomatis
ccaaaagaucuugaucuguggag

SEQ ID NO: 2504381 - RNA, 20 nt, Chlamydia trachomatis
ccaaaauaucuacuucuugu

SEQ ID NO: 2504382 - RNA, 22 nt, Chlamydia trachomatis
ccaaaauuuuucugcuccaaag

SEQ ID NO: 2504383 - RNA, 20 nt, Chlamydia trachomatis
ccaaacacugcaacaguaaa

SEQ ID NO: 2504384 - RNA, 19 nt, Chlamydia trachomatis
ccaaacauuuugaggcuuu

SEQ ID NO: 2504385 - RNA, 15 nt, Chlamydia trachomatis
ccaaaccaugaugcu

SEQ ID NO: 2504386 - RNA, 21 nt, Chlamydia trachomatis
ccaaacccauccauggcaaug

SEQ ID NO: 2504387 - RNA, 23 nt, Chlamydia trachomatis
ccaaagaaauagcuaucaauaaa

SEQ ID NO: 2504388 - RNA, 22 nt, Chlamydia trachomatis
ccaaagagauuguaaucuaucu

SEQ ID NO: 2504389 - RNA, 17 nt, Chlamydia trachomatis
ccaaagcugcuuuagcu

SEQ ID NO: 2504390 - RNA, 15 nt, Chlamydia trachomatis
ccaaauaaaacgaaa

SEQ ID NO: 2504391 - RNA, 23 nt, Chlamydia trachomatis
ccaaauaaaacgaaaaacagaaa

SEQ ID NO: 2504392 - RNA, 15 nt, Chlamydia trachomatis
ccaaauaaucccaca

SEQ ID NO: 2504393 - RNA, 17 nt, Chlamydia trachomatis
ccaaauagguaugugcu

SEQ ID NO: 2504394 - RNA, 18 nt, Chlamydia trachomatis
ccaaaucaaaccaaaaau

SEQ ID NO: 2504395 - RNA, 14 nt, Chlamydia trachomatis
ccaaauccuccugc

SEQ ID NO: 2504396 - RNA, 19 nt, Chlamydia trachomatis
ccaaaucugcaagaacaaa

SEQ ID NO: 2504397 - RNA, 23 nt, Chlamydia trachomatis
ccaaaucugcaagaacaaagaau

SEQ ID NO: 2504398 - RNA, 16 nt, Chlamydia trachomatis
ccaaaugaccuuuccc

SEQ ID NO: 2504399 - RNA, 20 nt, Chlamydia trachomatis
ccaaaugcggcccacacuac

SEQ ID NO: 2504400 - RNA, 14 nt, Chlamydia trachomatis
ccaacaagggaaug

SEQ ID NO: 2504401 - RNA, 17 nt, Chlamydia trachomatis
ccaacaagggaaugaaa

SEQ ID NO: 2504402 - RNA, 23 nt, Chlamydia trachomatis
ccaacgagaugaccacuacucua

SEQ ID NO: 2504403 - RNA, 18 nt, Chlamydia trachomatis
ccaacgcauguaauucau

SEQ ID NO: 2504404 - RNA, 20 nt, Chlamydia trachomatis
ccaacgcauguaauucaugg

SEQ ID NO: 2504405 - RNA, 20 nt, Chlamydia trachomatis
ccaacgcuugcacagcacga

SEQ ID NO: 2504406 - RNA, 12 nt, Chlamydia trachomatis
ccaacugagcua

SEQ ID NO: 2504407 - RNA, 17 nt, Chlamydia trachomatis
ccaacuggcaagucuag

SEQ ID NO: 2504408 - RNA, 22 nt, Chlamydia trachomatis
ccaacuuacguccgacugcucc

SEQ ID NO: 2504409 - RNA, 12 nt, Chlamydia trachomatis
ccaagaaacugu

SEQ ID NO: 2504410 - RNA, 20 nt, Chlamydia trachomatis
ccaagaaacuuuucugcaga

SEQ ID NO: 2504411 - RNA, 13 nt, Chlamydia trachomatis
ccaagaacaaagc

SEQ ID NO: 2504412 - RNA, 16 nt, Chlamydia trachomatis
ccaagaacaaagcauc

SEQ ID NO: 2504413 - RNA, 17 nt, Chlamydia trachomatis
ccaagaacaaagcaucu

SEQ ID NO: 2504414 - RNA, 22 nt, Chlamydia trachomatis
ccaagacgauucucaugcacug

SEQ ID NO: 2504415 - RNA, 19 nt, Chlamydia trachomatis
ccaagcaagauauaaacaa

SEQ ID NO: 2504416 - RNA, 21 nt, Chlamydia trachomatis
ccaagcaagauauaaacaaua

SEQ ID NO: 2504417 - RNA, 14 nt, Chlamydia trachomatis
ccaagcacuccuca

SEQ ID NO: 2504418 - RNA, 18 nt, Chlamydia trachomatis
ccaagcacuccucagcau

SEQ ID NO: 2504419 - RNA, 18 nt, Chlamydia trachomatis
ccaagcucgagucucuug

SEQ ID NO: 2504420 - RNA, 13 nt, Chlamydia trachomatis
ccaagcuucuugg

SEQ ID NO: 2504421 - RNA, 16 nt, Chlamydia trachomatis
ccaaggaaaagaugaa

SEQ ID NO: 2504422 - RNA, 22 nt, Chlamydia trachomatis
ccaauauuauuuacgagagggu

SEQ ID NO: 2504423 - RNA, 23 nt, Chlamydia trachomatis
ccaauauuauuuacgagaggguu

SEQ ID NO: 2504424 - RNA, 12 nt, Chlamydia trachomatis
ccaaucacagca

SEQ ID NO: 2504425 - RNA, 13 nt, Chlamydia trachomatis
ccaaucacagcaa

SEQ ID NO: 2504426 - RNA, 15 nt, Chlamydia trachomatis
ccaaucacagcaaua

SEQ ID NO: 2504427 - RNA, 14 nt, Chlamydia trachomatis
ccaaucaccgcugc

SEQ ID NO: 2504428 - RNA, 18 nt, Chlamydia trachomatis
ccaauccuuggcaagaag

SEQ ID NO: 2504429 - RNA, 16 nt, Chlamydia trachomatis
ccaaucuucuaaaugc

SEQ ID NO: 2504430 - RNA, 13 nt, Chlamydia trachomatis
ccaauucucugcc

SEQ ID NO: 2504431 - RNA, 21 nt, Chlamydia trachomatis
uggucaaugcugcuguuuauu

SEQ ID NO: 2504432 - RNA, 14 nt, Chlamydia trachomatis
uggucacaagaaca

SEQ ID NO: 2504433 - RNA, 21 nt, Chlamydia trachomatis
uggucacaagaacaucuccaa

SEQ ID NO: 2504434 - RNA, 17 nt, Chlamydia trachomatis
uggucagcucauuagaa

SEQ ID NO: 2504435 - RNA, 15 nt, Chlamydia trachomatis
uggucucacacaaca

SEQ ID NO: 2504436 - RNA, 18 nt, Chlamydia trachomatis
uggucucuguagugggcu

SEQ ID NO: 2504437 - RNA, 19 nt, Chlamydia trachomatis
ugguggcgagauuuccagc

SEQ ID NO: 2504438 - RNA, 17 nt, Chlamydia trachomatis
ugguguaggaaaauaca

SEQ ID NO: 2504439 - RNA, 17 nt, Chlamydia trachomatis
ugguuaacaggcuuccu

SEQ ID NO: 2504440 - RNA, 15 nt, Chlamydia trachomatis
ugguuacuugccucu

SEQ ID NO: 2504441 - RNA, 17 nt, Chlamydia trachomatis
ugguucaaacauagaag

SEQ ID NO: 2504442 - RNA, 18 nt, Chlamydia trachomatis
ugguuucuuaaacaaaaa

SEQ ID NO: 2504443 - RNA, 17 nt, Chlamydia trachomatis
uguaaaaggaauucuuc

SEQ ID NO: 2504444 - RNA, 13 nt, Chlamydia trachomatis
uguaaacaauauu

SEQ ID NO: 2504445 - RNA, 19 nt, Chlamydia trachomatis
uguaaagcauucguuauca

SEQ ID NO: 2504446 - RNA, 13 nt, Chlamydia trachomatis
uguaaaguaacua

SEQ ID NO: 2504447 - RNA, 22 nt, Chlamydia trachomatis
uguaaaguaacuacggaaaaag

SEQ ID NO: 2504448 - RNA, 19 nt, Chlamydia trachomatis
uguaacgcagcucaccagc

SEQ ID NO: 2504449 - RNA, 20 nt, Chlamydia trachomatis
uguaacgcagcucaccagcu

SEQ ID NO: 2504450 - RNA, 13 nt, Chlamydia trachomatis
uguaacuaagcuu

SEQ ID NO: 2504451 - RNA, 23 nt, Chlamydia trachomatis
uguaacuaagcuucucaacacug

SEQ ID NO: 2504452 - RNA, 15 nt, Chlamydia trachomatis
uguaacuacaucuaa

SEQ ID NO: 2504453 - RNA, 14 nt, Chlamydia trachomatis
uguaauaucaaaga

SEQ ID NO: 2504454 - RNA, 20 nt, Chlamydia trachomatis
uguaaugcaggcgagucuuu

SEQ ID NO: 2504455 - RNA, 16 nt, Chlamydia trachomatis
uguaauuuuaaauccu

SEQ ID NO: 2504456 - RNA, 12 nt, Chlamydia trachomatis
uguacaaacacu

SEQ ID NO: 2504457 - RNA, 15 nt, Chlamydia trachomatis
uguacacgauguucc

SEQ ID NO: 2504458 - RNA, 16 nt, Chlamydia trachomatis
uguacagagaaaaaga

SEQ ID NO: 2504459 - RNA, 21 nt, Chlamydia trachomatis
uguacagcgacacguuuuccu

SEQ ID NO: 2504460 - RNA, 15 nt, Chlamydia trachomatis
uguacuuuugguucu

SEQ ID NO: 2504461 - RNA, 21 nt, Chlamydia trachomatis
uguacuuuugguucugccagu

SEQ ID NO: 2504462 - RNA, 17 nt, Chlamydia trachomatis
uguagaaagacuuacca

SEQ ID NO: 2504463 - RNA, 23 nt, Chlamydia trachomatis
uguagaaugugugguuguagagg

SEQ ID NO: 2504464 - RNA, 20 nt, Chlamydia trachomatis
uguagcaccaaguucuucuu

SEQ ID NO: 2504465 - RNA, 14 nt, Chlamydia trachomatis
uguagccuucuaua

SEQ ID NO: 2504466 - RNA, 20 nt, Chlamydia trachomatis
uguagcugucccccagauaa

SEQ ID NO: 2504467 - RNA, 22 nt, Chlamydia trachomatis
uguaggaaaauacacagcauca

SEQ ID NO: 2504468 - RNA, 13 nt, Chlamydia trachomatis
uguagguuuuaaa

SEQ ID NO: 2504469 - RNA, 19 nt, Chlamydia trachomatis
uguagugaucuuuuuagga

SEQ ID NO: 2504470 - RNA, 17 nt, Chlamydia trachomatis
uguaguugccccuuauu

SEQ ID NO: 2504471 - RNA, 18 nt, Chlamydia trachomatis
uguauaacaauuuuaaaa

SEQ ID NO: 2504472 - RNA, 16 nt, Chlamydia trachomatis
uguauaagaaaaaggu

SEQ ID NO: 2504473 - RNA, 21 nt, Chlamydia trachomatis
uguauagaguaaguuucuaua

SEQ ID NO: 2504474 - RNA, 16 nt, Chlamydia trachomatis
uguauagauacuaaca

SEQ ID NO: 2504475 - RNA, 14 nt, Chlamydia trachomatis
uguaucaaaaucaa

SEQ ID NO: 2504476 - RNA, 15 nt, Chlamydia trachomatis
uguaucaaaaucaau

SEQ ID NO: 2504477 - RNA, 23 nt, Chlamydia trachomatis
uguaucccuaguacaaaaauacu

SEQ ID NO: 2504478 - RNA, 14 nt, Chlamydia trachomatis
uguaucuugugcaa

SEQ ID NO: 2504479 - RNA, 13 nt, Chlamydia trachomatis
uguauuaacgauu

SEQ ID NO: 2504480 - RNA, 17 nt, Chlamydia trachomatis
uguauugguuauaugaa

SEQ ID NO: 2504481 - RNA, 15 nt, Chlamydia trachomatis
ugucaacauaauagc

SEQ ID NO: 2504482 - RNA, 19 nt, Chlamydia trachomatis
ugucagaagaggcaaaaau

SEQ ID NO: 2504483 - RNA, 21 nt, Chlamydia trachomatis
ugucagucuucuuuucugaga

SEQ ID NO: 2504484 - RNA, 14 nt, Chlamydia trachomatis
ugucauaagcucua

SEQ ID NO: 2504485 - RNA, 14 nt, Chlamydia trachomatis
ugucauagaucggu

SEQ ID NO: 2504486 - RNA, 15 nt, Chlamydia trachomatis
uguccaaagcucuuu

SEQ ID NO: 2504487 - RNA, 23 nt, Chlamydia trachomatis
uguccaagcucgagucucuugug

SEQ ID NO: 2504488 - RNA, 22 nt, Chlamydia trachomatis
ugucccugaacauccaccagca

SEQ ID NO: 2504489 - RNA, 23 nt, Chlamydia trachomatis
ugucccugcuccgaucauaauua

SEQ ID NO: 2504490 - RNA, 20 nt, Chlamydia trachomatis
uguccuaccaauauucccug

SEQ ID NO: 2504491 - RNA, 15 nt, Chlamydia trachomatis
uguccugaccaauac

SEQ ID NO: 2504492 - RNA, 18 nt, Chlamydia trachomatis
ugucgcagcuuucuuuuc

SEQ ID NO: 2504493 - RNA, 12 nt, Chlamydia trachomatis
ugucgcugaggc

SEQ ID NO: 2504494 - RNA, 14 nt, Chlamydia trachomatis
ugucggugaaagcu

SEQ ID NO: 2504495 - RNA, 17 nt, Chlamydia trachomatis
ugucguuuucggagaag

SEQ ID NO: 2504496 - RNA, 14 nt, Chlamydia trachomatis
ugucuaagauuuuc

SEQ ID NO: 2504497 - RNA, 15 nt, Chlamydia trachomatis
ugucuaagauuuuca

SEQ ID NO: 2504498 - RNA, 22 nt, Chlamydia trachomatis
ugucuaagauuuucaucuucca

SEQ ID NO: 2504499 - RNA, 20 nt, Chlamydia trachomatis
ugucuaaggaugcaaauaag

SEQ ID NO: 2504500 - RNA, 23 nt, Chlamydia trachomatis
ugucuaaggaugcaaauaagaaa

SEQ ID NO: 2504501 - RNA, 18 nt, Chlamydia trachomatis
ugucuauaggaauagccu

SEQ ID NO: 2504502 - RNA, 22 nt, Chlamydia trachomatis
ugucucaugcggagcuccagga

SEQ ID NO: 2504503 - RNA, 17 nt, Chlamydia trachomatis
ugucugugauaucccuu

SEQ ID NO: 2504504 - RNA, 14 nt, Chlamydia trachomatis
ugucuucuuucaaa

SEQ ID NO: 2504505 - RNA, 15 nt, Chlamydia trachomatis
ugucuucuuucucuu

SEQ ID NO: 2504506 - RNA, 20 nt, Chlamydia trachomatis
ugugaaaaaaaacuucuucc

SEQ ID NO: 2504507 - RNA, 18 nt, Chlamydia trachomatis
ugugaaaauaaguccauu

SEQ ID NO: 2504508 - RNA, 14 nt, Chlamydia trachomatis
ugugaaagaaaaau

SEQ ID NO: 2504509 - RNA, 16 nt, Chlamydia trachomatis
ugugaauggagcagca

SEQ ID NO: 2504510 - RNA, 22 nt, Chlamydia trachomatis
ugugacguauauuucacaacua

SEQ ID NO: 2504511 - RNA, 13 nt, Chlamydia trachomatis
ugugacuccuucu

SEQ ID NO: 2504512 - RNA, 11 nt, Chlamydia trachomatis
ugugagaguuu

SEQ ID NO: 2504513 - RNA, 16 nt, Chlamydia trachomatis
ugugagucuaucuuca

SEQ ID NO: 2504514 - RNA, 21 nt, Chlamydia trachomatis
ugugagucuaucuucagguuu

SEQ ID NO: 2504515 - RNA, 22 nt, Chlamydia trachomatis
ugugcacugguauucugcagaa

SEQ ID NO: 2504516 - RNA, 16 nt, Chlamydia trachomatis
ugugcagaucccggcu

SEQ ID NO: 2504517 - RNA, 22 nt, Chlamydia trachomatis
ugugcagaucccggcuugccug

SEQ ID NO: 2504518 - RNA, 14 nt, Chlamydia trachomatis
ugugcauaaaagcc

SEQ ID NO: 2504519 - RNA, 16 nt, Chlamydia trachomatis
ugugccagcucuaauu

SEQ ID NO: 2504520 - RNA, 21 nt, Chlamydia trachomatis
ugugcgaggaauucuucuucu

SEQ ID NO: 2504521 - RNA, 17 nt, Chlamydia trachomatis
ugugcuaaaucuccaaa

SEQ ID NO: 2504522 - RNA, 14 nt, Chlamydia trachomatis
uguggaagcuagaa

SEQ ID NO: 2504523 - RNA, 20 nt, Chlamydia trachomatis
uguggagcuaucauuuccaa

SEQ ID NO: 2504524 - RNA, 23 nt, Chlamydia trachomatis
uguggcauuauuaacaggaagaa

SEQ ID NO: 2504525 - RNA, 17 nt, Chlamydia trachomatis
uguguaauagcuaccac

SEQ ID NO: 2504526 - RNA, 19 nt, Chlamydia trachomatis
uguguacaaggcaggaaaa

SEQ ID NO: 2504527 - RNA, 16 nt, Chlamydia trachomatis
uguguacgcuuuggua

SEQ ID NO: 2504528 - RNA, 17 nt, Chlamydia trachomatis
uguguacuuuugguucu

SEQ ID NO: 2504529 - RNA, 16 nt, Chlamydia trachomatis
uguguagaagaaggaa

SEQ ID NO: 2504530 - RNA, 13 nt, Chlamydia trachomatis
uguguagcuuuuc

SEQ ID NO: 2504531 - RNA, 15 nt, Chlamydia trachomatis
uguguuaaacaucaa

SEQ ID NO: 2504532 - RNA, 23 nt, Chlamydia trachomatis
uguguugcaaagagagcaacgag

SEQ ID NO: 2504533 - RNA, 18 nt, Chlamydia trachomatis
uguguugcuucccagagu

SEQ ID NO: 2504534 - RNA, 13 nt, Chlamydia trachomatis
uguuaaacaucaa

SEQ ID NO: 2504535 - RNA, 12 nt, Chlamydia trachomatis
uguuaaaucauu

SEQ ID NO: 2504536 - RNA, 20 nt, Chlamydia trachomatis
uguuacacagaccuugccau

SEQ ID NO: 2504537 - RNA, 16 nt, Chlamydia trachomatis
uguuacagucuguguu

SEQ ID NO: 2504538 - RNA, 18 nt, Chlamydia trachomatis
uguuaccugggaaaacuu

SEQ ID NO: 2504539 - RNA, 19 nt, Chlamydia trachomatis
uguuaccugggaaaacuuu

SEQ ID NO: 2504540 - RNA, 14 nt, Chlamydia trachomatis
uguuagugaagagc

SEQ ID NO: 2504541 - RNA, 20 nt, Chlamydia trachomatis
uguuauuuguucucuuagaa

SEQ ID NO: 2504542 - RNA, 17 nt, Chlamydia trachomatis
uguuauuuuuuaagaag

SEQ ID NO: 2504543 - RNA, 14 nt, Chlamydia trachomatis
uguucaauuguugg

SEQ ID NO: 2504544 - RNA, 13 nt, Chlamydia trachomatis
uguucacagaaag

SEQ ID NO: 2504545 - RNA, 20 nt, Chlamydia trachomatis
uguucacagaaaguccugcu

SEQ ID NO: 2504546 - RNA, 21 nt, Chlamydia trachomatis
uguucacagaaaguccugcuu

SEQ ID NO: 2504547 - RNA, 15 nt, Chlamydia trachomatis
uguuccagaaaaaau

SEQ ID NO: 2504548 - RNA, 13 nt, Chlamydia trachomatis
uguuccaucuuuu

SEQ ID NO: 2504549 - RNA, 14 nt, Chlamydia trachomatis
uguuccccauucaa

SEQ ID NO: 2504550 - RNA, 18 nt, Chlamydia trachomatis
uguucccgcauuuguugu

SEQ ID NO: 2504551 - RNA, 15 nt, Chlamydia trachomatis
uguuccuacuaaaau

SEQ ID NO: 2504552 - RNA, 16 nt, Chlamydia trachomatis
uguuccuacuaaaaug

SEQ ID NO: 2504553 - RNA, 22 nt, Chlamydia trachomatis
uguuccuuccucgaagcuacug

SEQ ID NO: 2504554 - RNA, 15 nt, Chlamydia trachomatis
uguucguagacuucu

SEQ ID NO: 2504555 - RNA, 20 nt, Chlamydia trachomatis
uguucguagacuucuuguau

SEQ ID NO: 2504556 - RNA, 18 nt, Chlamydia trachomatis
uguucuaaacccucugca

SEQ ID NO: 2504557 - RNA, 16 nt, Chlamydia trachomatis
uguucugcgaaagaaa

SEQ ID NO: 2504558 - RNA, 17 nt, Chlamydia trachomatis
uguucugggcugacaga

SEQ ID NO: 2504559 - RNA, 20 nt, Chlamydia trachomatis
uguucuuaauaaucugugcc

SEQ ID NO: 2504560 - RNA, 16 nt, Chlamydia trachomatis
uguucuucgaaauauu

SEQ ID NO: 2504561 - RNA, 19 nt, Chlamydia trachomatis
uguucuucgaaauauugua

SEQ ID NO: 2504562 - RNA, 20 nt, Chlamydia trachomatis
uguugaauaacguuuuaaac

SEQ ID NO: 2504563 - RNA, 20 nt, Chlamydia trachomatis
uguugagcagcaaagaucgu

SEQ ID NO: 2504564 - RNA, 15 nt, Chlamydia trachomatis
uguugcagcccggua

SEQ ID NO: 2504565 - RNA, 21 nt, Chlamydia trachomatis
uguugcguuuguaagaucugu

SEQ ID NO: 2504566 - RNA, 19 nt, Chlamydia trachomatis
uguugcuaaccguucuuga

SEQ ID NO: 2504567 - RNA, 19 nt, Chlamydia trachomatis
uguugcucuauaacauucu

SEQ ID NO: 2504568 - RNA, 22 nt, Chlamydia trachomatis
uguuggacaaagguguuuucua

SEQ ID NO: 2504569 - RNA, 15 nt, Chlamydia trachomatis
uguugggagagggug

SEQ ID NO: 2504570 - RNA, 22 nt, Chlamydia trachomatis
uguuguggguuuggaaauauca

SEQ ID NO: 2504571 - RNA, 14 nt, Chlamydia trachomatis
uguuguuaauauca

SEQ ID NO: 2504572 - RNA, 17 nt, Chlamydia trachomatis
uguuguugcugagcuuu

SEQ ID NO: 2504573 - RNA, 21 nt, Chlamydia trachomatis
uguuuaacccucgacgcuguc

SEQ ID NO: 2504574 - RNA, 12 nt, Chlamydia trachomatis
uguuuaaucagu

SEQ ID NO: 2504575 - RNA, 18 nt, Chlamydia trachomatis
uguuuacugacaaggcug

SEQ ID NO: 2504576 - RNA, 11 nt, Chlamydia trachomatis
uguuuaggagg

SEQ ID NO: 2504577 - RNA, 17 nt, Chlamydia trachomatis
uguuuaucacuaucugc

SEQ ID NO: 2504578 - RNA, 14 nt, Chlamydia trachomatis
uguuuauucucacc

SEQ ID NO: 2504579 - RNA, 20 nt, Chlamydia trachomatis
uguuucaaagaugcgaucuc

SEQ ID NO: 2504580 - RNA, 18 nt, Chlamydia trachomatis
uguuucagaaacuuccca

SEQ ID NO: 2504581 - RNA, 20 nt, Chlamydia trachomatis
uguuucccuuugguuuugau

SEQ ID NO: 2504582 - RNA, 17 nt, Chlamydia trachomatis
uguuucgccaaugaucu

SEQ ID NO: 2504583 - RNA, 21 nt, Chlamydia trachomatis
uguuucgccaaugaucuuuaa

SEQ ID NO: 2504584 - RNA, 20 nt, Chlamydia trachomatis
uguuucggaauucauagaag

SEQ ID NO: 2504585 - RNA, 19 nt, Chlamydia trachomatis
uguuucuaauggaugaucu

SEQ ID NO: 2504586 - RNA, 16 nt, Chlamydia trachomatis
uguuucugggaauuca

SEQ ID NO: 2504587 - RNA, 12 nt, Chlamydia trachomatis
uguuugcauucu

SEQ ID NO: 2504588 - RNA, 16 nt, Chlamydia trachomatis
uguuugcauucuuuua

SEQ ID NO: 2504589 - RNA, 18 nt, Chlamydia trachomatis
uguuuggauaagaacuuc

SEQ ID NO: 2504590 - RNA, 14 nt, Chlamydia trachomatis
uguuuguauagaac

SEQ ID NO: 2504591 - RNA, 16 nt, Chlamydia trachomatis
uguuuucuuguagaaa

SEQ ID NO: 2504592 - RNA, 12 nt, Chlamydia trachomatis
uguuuuguaguu

SEQ ID NO: 2504593 - RNA, 12 nt, Chlamydia trachomatis
uguuuuuuucaa

SEQ ID NO: 2504594 - RNA, 17 nt, Chlamydia trachomatis
uguuuuuuuuuauagga

SEQ ID NO: 2504595 - RNA, 14 nt, Chlamydia trachomatis
uuaaaaaacaaaac

SEQ ID NO: 2504596 - RNA, 16 nt, Chlamydia trachomatis
uuaaaaagaaacaaaa

SEQ ID NO: 2504597 - RNA, 20 nt, Chlamydia trachomatis
uuaaaagaccauaguugcag

SEQ ID NO: 2504598 - RNA, 23 nt, Chlamydia trachomatis
uuaaaaggccguuuaccaaugaa

SEQ ID NO: 2504599 - RNA, 19 nt, Chlamydia trachomatis
uuaaaaggguagaaaaaga

SEQ ID NO: 2504600 - RNA, 20 nt, Chlamydia trachomatis
uuaaaccacccuucccaaca

SEQ ID NO: 2504601 - RNA, 23 nt, Chlamydia trachomatis
uuaaagaaggaaaauccauugau

SEQ ID NO: 2504602 - RNA, 20 nt, Chlamydia trachomatis
uuaaagccacugugaaaugc

SEQ ID NO: 2504603 - RNA, 15 nt, Chlamydia trachomatis
uuaaagcccaguuaa

SEQ ID NO: 2504604 - RNA, 19 nt, Chlamydia trachomatis
uuaaagccuuuuuacgcau

SEQ ID NO: 2504605 - RNA, 13 nt, Chlamydia trachomatis
uuaaagcuuuagc

SEQ ID NO: 2504606 - RNA, 13 nt, Chlamydia trachomatis
uuaaagcuuuuuc

SEQ ID NO: 2504607 - RNA, 17 nt, Chlamydia trachomatis
uuaaagcuuuuuccaaa

SEQ ID NO: 2504608 - RNA, 19 nt, Chlamydia trachomatis
uuaaagcuuuuuccaaagc

SEQ ID NO: 2504609 - RNA, 14 nt, Chlamydia trachomatis
uuaaagggaaaaaa

SEQ ID NO: 2504610 - RNA, 18 nt, Chlamydia trachomatis
uuaaagggggacaaaaau

SEQ ID NO: 2504611 - RNA, 19 nt, Chlamydia trachomatis
uuaaagggggacaaaaaua

SEQ ID NO: 2504612 - RNA, 20 nt, Chlamydia trachomatis
uuaaagggggacaaaaauac

SEQ ID NO: 2504613 - RNA, 15 nt, Chlamydia trachomatis
uuaaaguauaauccg

SEQ ID NO: 2504614 - RNA, 22 nt, Chlamydia trachomatis
uuaaaguauaauccgagcauuu

SEQ ID NO: 2504615 - RNA, 18 nt, Chlamydia trachomatis
uuaaaguuucuaauaaua

SEQ ID NO: 2504616 - RNA, 21 nt, Chlamydia trachomatis
uuaaauaaguccuuaucuucu

SEQ ID NO: 2504617 - RNA, 16 nt, Chlamydia trachomatis
uuaaaucugcuccuag

SEQ ID NO: 2504618 - RNA, 15 nt, Chlamydia trachomatis
uuaaaugcuucuuaa

SEQ ID NO: 2504619 - RNA, 20 nt, Chlamydia trachomatis
uuaaaugcuucuuaacugca

SEQ ID NO: 2504620 - RNA, 23 nt, Chlamydia trachomatis
uuaacaacaaugucaacauaaua

SEQ ID NO: 2504621 - RNA, 17 nt, Chlamydia trachomatis
uuaacaucuuuagaauc

SEQ ID NO: 2504622 - RNA, 19 nt, Chlamydia trachomatis
uuaacaugauucaaaauaa

SEQ ID NO: 2504623 - RNA, 20 nt, Chlamydia trachomatis
uuaacccuucaggaaagccu

SEQ ID NO: 2504624 - RNA, 17 nt, Chlamydia trachomatis
uuaacugggauaagaaa

SEQ ID NO: 2504625 - RNA, 12 nt, Chlamydia trachomatis
uuaagaagagag

SEQ ID NO: 2504626 - RNA, 13 nt, Chlamydia trachomatis
uuaagaagagagg

SEQ ID NO: 2504627 - RNA, 11 nt, Chlamydia trachomatis
uuaagaagucu

SEQ ID NO: 2504628 - RNA, 23 nt, Chlamydia trachomatis
uuaagacucaaauuuucaugaaa

SEQ ID NO: 2504629 - RNA, 13 nt, Chlamydia trachomatis
uuaagauuauaau

SEQ ID NO: 2504630 - RNA, 22 nt, Chlamydia trachomatis
uuaaggguugcgcuggcuuugu

SEQ ID NO: 2504631 - RNA, 21 nt, Chlamydia trachomatis
uuaagguuuguuaaugcugcu

SEQ ID NO: 2504632 - RNA, 24 nt, Chlamydia trachomatis
uuaaguccagggaaaagagcuagg

SEQ ID NO: 2504633 - RNA, 16 nt, Chlamydia trachomatis
uuaauaaagccauacu

SEQ ID NO: 2504634 - RNA, 12 nt, Chlamydia trachomatis
uuaauaacugca

SEQ ID NO: 2504635 - RNA, 23 nt, Chlamydia trachomatis
uuaauaacugcauaguccaugug

SEQ ID NO: 2504636 - RNA, 16 nt, Chlamydia trachomatis
uuaauaagaccucuuu

SEQ ID NO: 2504637 - RNA, 16 nt, Chlamydia trachomatis
uuaauaauaaagauag

SEQ ID NO: 2504638 - RNA, 21 nt, Chlamydia trachomatis
uuaauaauaagagcuacagga

SEQ ID NO: 2504639 - RNA, 16 nt, Chlamydia trachomatis
uuaauaaugaaauugc

SEQ ID NO: 2504640 - RNA, 18 nt, Chlamydia trachomatis
uuaauaccuucuuacaua

SEQ ID NO: 2504641 - RNA, 16 nt, Chlamydia trachomatis
uuaauauacucaacac

SEQ ID NO: 2504642 - RNA, 21 nt, Chlamydia trachomatis
uuaaucaguuccggaucaauc

SEQ ID NO: 2504643 - RNA, 19 nt, Chlamydia trachomatis
uuaaucccauaaaagccau

SEQ ID NO: 2504644 - RNA, 23 nt, Chlamydia trachomatis
uuaauccuugcacuaagaauaaa

SEQ ID NO: 2504645 - RNA, 17 nt, Chlamydia trachomatis
uuaaugucucuucacaa

SEQ ID NO: 2504646 - RNA, 18 nt, Chlamydia trachomatis
uuaaugucucuucacaaa

SEQ ID NO: 2504647 - RNA, 17 nt, Chlamydia trachomatis
uuaauuagaauuuccag

SEQ ID NO: 2504648 - RNA, 14 nt, Chlamydia trachomatis
uuaauuccaucuuu

SEQ ID NO: 2504649 - RNA, 13 nt, Chlamydia trachomatis
uuaauuccuugga

SEQ ID NO: 2504650 - RNA, 21 nt, Chlamydia trachomatis
uuaauuccuuggauacguaca

SEQ ID NO: 2504651 - RNA, 13 nt, Chlamydia trachomatis
uuaauugaaauau

SEQ ID NO: 2504652 - RNA, 17 nt, Chlamydia trachomatis
uuaauuuucugcagaga

SEQ ID NO: 2504653 - RNA, 19 nt, Chlamydia trachomatis
uuacaacuaaaggaaacaa

SEQ ID NO: 2504654 - RNA, 15 nt, Chlamydia trachomatis
uuacaagucugcuag

SEQ ID NO: 2504655 - RNA, 14 nt, Chlamydia trachomatis
uuacaauagcauuu

SEQ ID NO: 2504656 - RNA, 22 nt, Chlamydia trachomatis
uuacaauguacgcuaaaaacuc

SEQ ID NO: 2504657 - RNA, 22 nt, Chlamydia trachomatis
uuacagaagaaccuccauaaga

SEQ ID NO: 2504658 - RNA, 20 nt, Chlamydia trachomatis
uuacaucaggggaauucgcu

SEQ ID NO: 2504659 - RNA, 14 nt, Chlamydia trachomatis
uuaccauaucaaaa

SEQ ID NO: 2504660 - RNA, 24 nt, Chlamydia trachomatis
uuaccucaauagcagcauucucua

SEQ ID NO: 2504661 - RNA, 14 nt, Chlamydia trachomatis
uuaccucuccauuu

SEQ ID NO: 2504662 - RNA, 18 nt, Chlamydia trachomatis
uuaccuguaggaggacaa

SEQ ID NO: 2504663 - RNA, 18 nt, Chlamydia trachomatis
uuaccuugaguccgcaaa

SEQ ID NO: 2504664 - RNA, 20 nt, Chlamydia trachomatis
uuaccuuguuagaaaugcaa

SEQ ID NO: 2504665 - RNA, 18 nt, Chlamydia trachomatis
uuacgaacaagaugacuu

SEQ ID NO: 2504666 - RNA, 19 nt, Chlamydia trachomatis
uuacgaagucgugucaggc

SEQ ID NO: 2504667 - RNA, 14 nt, Chlamydia trachomatis
uuacgagaggguuu

SEQ ID NO: 2504668 - RNA, 16 nt, Chlamydia trachomatis
uuacgcacaaagauuu

SEQ ID NO: 2504669 - RNA, 15 nt, Chlamydia trachomatis
uuacgcccacguuuc

SEQ ID NO: 2504670 - RNA, 21 nt, Chlamydia trachomatis
uuacgcguaaagauuuuccuc

SEQ ID NO: 2504671 - RNA, 20 nt, Chlamydia trachomatis
uuacgcgucuaaaacaauug

SEQ ID NO: 2504672 - RNA, 15 nt, Chlamydia trachomatis
uuacgcucuuucuua

SEQ ID NO: 2504673 - RNA, 21 nt, Chlamydia trachomatis
uuacggaaaguuccaucuccu

SEQ ID NO: 2504674 - RNA, 20 nt, Chlamydia trachomatis
uuacggccccuggaauuucu

SEQ ID NO: 2504675 - RNA, 22 nt, Chlamydia trachomatis
uuacggccccuggaauuucucc

SEQ ID NO: 2504676 - RNA, 18 nt, Chlamydia trachomatis
uuacuaacuaaagucuuu

SEQ ID NO: 2504677 - RNA, 22 nt, Chlamydia trachomatis
uuacuaucaggaauaaugauuu

SEQ ID NO: 2504678 - RNA, 19 nt, Chlamydia trachomatis
uuacuccuucucugaaaga

SEQ ID NO: 2504679 - RNA, 21 nt, Chlamydia trachomatis
uuacuuaaaaaacaaaacuac

SEQ ID NO: 2504680 - RNA, 15 nt, Chlamydia trachomatis
uuacuuucuuugcua

SEQ ID NO: 2504681 - RNA, 15 nt, Chlamydia trachomatis
uuagaaauucaucau

SEQ ID NO: 2504682 - RNA, 21 nt, Chlamydia trachomatis
uuagaacagauuuagagaaua

SEQ ID NO: 2504683 - RNA, 12 nt, Chlamydia trachomatis
uuagaagaaaag

SEQ ID NO: 2504684 - RNA, 13 nt, Chlamydia trachomatis
uuagaagaaaaga

SEQ ID NO: 2504685 - RNA, 21 nt, Chlamydia trachomatis
uuagaagaaaagagcuuuucu

SEQ ID NO: 2504686 - RNA, 15 nt, Chlamydia trachomatis
uuagaaggaaagcua

SEQ ID NO: 2504687 - RNA, 14 nt, Chlamydia trachomatis
uuagaauccaaagu

SEQ ID NO: 2504688 - RNA, 15 nt, Chlamydia trachomatis
uuagagaaaagaaaa

SEQ ID NO: 2504689 - RNA, 21 nt, Chlamydia trachomatis
uuagagaagucagaugaguuu

SEQ ID NO: 2504690 - RNA, 17 nt, Chlamydia trachomatis
uuagagcagcggaauca

SEQ ID NO: 2504691 - RNA, 19 nt, Chlamydia trachomatis
uuagauuuguuuaaaagaa

SEQ ID NO: 2504692 - RNA, 15 nt, Chlamydia trachomatis
uuagcaaauaauagc

SEQ ID NO: 2504693 - RNA, 17 nt, Chlamydia trachomatis
uuagcaaauaauagcuu

SEQ ID NO: 2504694 - RNA, 22 nt, Chlamydia trachomatis
uuagcauaguauuacggaaaag

SEQ ID NO: 2504695 - RNA, 14 nt, Chlamydia trachomatis
uuagcauuucuuug

SEQ ID NO: 2504696 - RNA, 22 nt, Chlamydia trachomatis
uuagccaauuuccauggagcuu

SEQ ID NO: 2504697 - RNA, 19 nt, Chlamydia trachomatis
uuagcuagaguagugccag

SEQ ID NO: 2504698 - RNA, 22 nt, Chlamydia trachomatis
uuagcucguuuagcagccugag

SEQ ID NO: 2504699 - RNA, 14 nt, Chlamydia trachomatis
uuagcugcuuuaaa

SEQ ID NO: 2504700 - RNA, 14 nt, Chlamydia trachomatis
uuaggagaaagaau

SEQ ID NO: 2504701 - RNA, 14 nt, Chlamydia trachomatis
uuaggauccgcuuc

SEQ ID NO: 2504702 - RNA, 13 nt, Chlamydia trachomatis
uuaggcauuccuu

SEQ ID NO: 2504703 - RNA, 21 nt, Chlamydia trachomatis
uuagugaagagcagagguaug

SEQ ID NO: 2504704 - RNA, 17 nt, Chlamydia trachomatis
uuaguggacgcugauca

SEQ ID NO: 2504705 - RNA, 23 nt, Chlamydia trachomatis
uuaguuacaagacaauaaacaag

SEQ ID NO: 2504706 - RNA, 18 nt, Chlamydia trachomatis
uuaguuaccaaaaaggaa

SEQ ID NO: 2504707 - RNA, 17 nt, Chlamydia trachomatis
uuaguuuuaauuccauc

SEQ ID NO: 2504708 - RNA, 19 nt, Chlamydia trachomatis
uuauaacgauauccuucug

SEQ ID NO: 2504709 - RNA, 19 nt, Chlamydia trachomatis
uuauaacuaagaucuccau

SEQ ID NO: 2504710 - RNA, 20 nt, Chlamydia trachomatis
uuauaagagaacccuaauaa

SEQ ID NO: 2504711 - RNA, 19 nt, Chlamydia trachomatis
uuauaaucgaucacagaaa

SEQ ID NO: 2504712 - RNA, 13 nt, Chlamydia trachomatis
uuauaaugaaaga

SEQ ID NO: 2504713 - RNA, 22 nt, Chlamydia trachomatis
uuauacuucuuacuuaaaaaac

SEQ ID NO: 2504714 - RNA, 23 nt, Chlamydia trachomatis
uuauacuucuuacuuaaaaaaca

SEQ ID NO: 2504715 - RNA, 14 nt, Chlamydia trachomatis
uuauagcaagcccu

SEQ ID NO: 2504716 - RNA, 22 nt, Chlamydia trachomatis
uuauaggggugauaacaaccau

SEQ ID NO: 2504717 - RNA, 15 nt, Chlamydia trachomatis
uuauauaggcuucca

SEQ ID NO: 2504718 - RNA, 13 nt, Chlamydia trachomatis
uuauauugcuuca

SEQ ID NO: 2504719 - RNA, 18 nt, Chlamydia trachomatis
uuauauugcuucauaaaa

SEQ ID NO: 2504720 - RNA, 19 nt, Chlamydia trachomatis
uuauauugcuucauaaaaa

SEQ ID NO: 2504721 - RNA, 20 nt, Chlamydia trachomatis
uuauauugcuucauaaaaaa

SEQ ID NO: 2504722 - RNA, 17 nt, Chlamydia trachomatis
uuaucacauucuuagau

SEQ ID NO: 2504723 - RNA, 14 nt, Chlamydia trachomatis
uuaucaccuauuaa

SEQ ID NO: 2504724 - RNA, 20 nt, Chlamydia trachomatis
uuaucacuaucugcaaaagc

SEQ ID NO: 2504725 - RNA, 21 nt, Chlamydia trachomatis
uuaucacuaucugcaaaagca

SEQ ID NO: 2504726 - RNA, 20 nt, Chlamydia trachomatis
uuaucauugggucugaucca

SEQ ID NO: 2504727 - RNA, 16 nt, Chlamydia trachomatis
uuauccaaaaaagugu

SEQ ID NO: 2504728 - RNA, 13 nt, Chlamydia trachomatis
uuauccaaauaaa

SEQ ID NO: 2504729 - RNA, 13 nt, Chlamydia trachomatis
uuauccaagcacu

SEQ ID NO: 2504730 - RNA, 17 nt, Chlamydia trachomatis
uuauccgcaguaaaauc

SEQ ID NO: 2504731 - RNA, 18 nt, Chlamydia trachomatis
uuauccgcaguaaaaucu

SEQ ID NO: 2504732 - RNA, 20 nt, Chlamydia trachomatis
uuauccuguucuccaaauug

SEQ ID NO: 2504733 - RNA, 15 nt, Chlamydia trachomatis
uuaucguagagaucu

SEQ ID NO: 2504734 - RNA, 19 nt, Chlamydia trachomatis
uuaucguagagaucuucug

SEQ ID NO: 2504735 - RNA, 13 nt, Chlamydia trachomatis
uuaucuaaagaaa

SEQ ID NO: 2504736 - RNA, 21 nt, Chlamydia trachomatis
uuaucuaaagaaauggucucu

SEQ ID NO: 2504737 - RNA, 15 nt, Chlamydia trachomatis
uuaucuccuaagaca

SEQ ID NO: 2504738 - RNA, 18 nt, Chlamydia trachomatis
uuaucugcuauagaaagc

SEQ ID NO: 2504739 - RNA, 22 nt, Chlamydia trachomatis
uuaucuugagagaccugcuuca

SEQ ID NO: 2504740 - RNA, 20 nt, Chlamydia trachomatis
uuaugaaccagggagagcuu

SEQ ID NO: 2504741 - RNA, 22 nt, Chlamydia trachomatis
uuaugagcauuugccaaugaaa

SEQ ID NO: 2504742 - RNA, 17 nt, Chlamydia trachomatis
uuauggcucagcuucaa

SEQ ID NO: 2504743 - RNA, 17 nt, Chlamydia trachomatis
uuaugggugaagaagga

SEQ ID NO: 2504744 - RNA, 14 nt, Chlamydia trachomatis
uuauguaaauauuu

SEQ ID NO: 2504745 - RNA, 16 nt, Chlamydia trachomatis
uuauuaaaagaccucu

SEQ ID NO: 2504746 - RNA, 18 nt, Chlamydia trachomatis
uuauuaucuagaaaagag

SEQ ID NO: 2504747 - RNA, 12 nt, Chlamydia trachomatis
uuauucucaagu

SEQ ID NO: 2504748 - RNA, 14 nt, Chlamydia trachomatis
uuauucuucaguuu

SEQ ID NO: 2504749 - RNA, 11 nt, Chlamydia trachomatis
uucaaaaagag

SEQ ID NO: 2504750 - RNA, 21 nt, Chlamydia trachomatis
uucaaaaagagcuaaacuucu

SEQ ID NO: 2504751 - RNA, 12 nt, Chlamydia trachomatis
uucaaaagaagg

SEQ ID NO: 2504752 - RNA, 22 nt, Chlamydia trachomatis
uucaaaagaaggcuuuucuauu

SEQ ID NO: 2504753 - RNA, 19 nt, Chlamydia trachomatis
uucaaaagcucgucagcca

SEQ ID NO: 2504754 - RNA, 16 nt, Chlamydia trachomatis
uucaaacauagaagga

SEQ ID NO: 2504755 - RNA, 11 nt, Chlamydia trachomatis
uucaaagaagc

SEQ ID NO: 2504756 - RNA, 17 nt, Chlamydia trachomatis
uucaaagagaucugcau

SEQ ID NO: 2504757 - RNA, 15 nt, Chlamydia trachomatis
uucaaagcgaucuuu

SEQ ID NO: 2504758 - RNA, 22 nt, Chlamydia trachomatis
uucaaaguuuuguguuuccaaa

SEQ ID NO: 2504759 - RNA, 20 nt, Chlamydia trachomatis
uucaaaucuucuucuaagcu

SEQ ID NO: 2504760 - RNA, 15 nt, Chlamydia trachomatis
uucaacauaauaaau

SEQ ID NO: 2504761 - RNA, 15 nt, Chlamydia trachomatis
uucaacauaugcuca

SEQ ID NO: 2504762 - RNA, 14 nt, Chlamydia trachomatis
uucaaccucucauc

SEQ ID NO: 2504763 - RNA, 17 nt, Chlamydia trachomatis
uucaacgggaacaaaac

SEQ ID NO: 2504764 - RNA, 16 nt, Chlamydia trachomatis
uucaacuggccuuuuu

SEQ ID NO: 2504765 - RNA, 17 nt, Chlamydia trachomatis
uucaagaucaaagucag

SEQ ID NO: 2504766 - RNA, 18 nt, Chlamydia trachomatis
uucaaguucuaacuuuug

SEQ ID NO: 2504767 - RNA, 17 nt, Chlamydia trachomatis
uucaaguucuucuucca

SEQ ID NO: 2504768 - RNA, 19 nt, Chlamydia trachomatis
uucaauaauguugaagucu

SEQ ID NO: 2504769 - RNA, 22 nt, Chlamydia trachomatis
uucaauagcaggaacuucuuca

SEQ ID NO: 2504770 - RNA, 18 nt, Chlamydia trachomatis
uucaauaucaacguuuuc

SEQ ID NO: 2504771 - RNA, 18 nt, Chlamydia trachomatis
uucaaugcggucaugcaa

SEQ ID NO: 2504772 - RNA, 13 nt, Chlamydia trachomatis
uucacaaagagaa

SEQ ID NO: 2504773 - RNA, 19 nt, Chlamydia trachomatis
uucacaaagagaaggccuu

SEQ ID NO: 2504774 - RNA, 18 nt, Chlamydia trachomatis
uucacaaauuuaucugcu

SEQ ID NO: 2504775 - RNA, 19 nt, Chlamydia trachomatis
uucacaaauuuaucugcua

SEQ ID NO: 2504776 - RNA, 19 nt, Chlamydia trachomatis
uucacagaaaguccugcuu

SEQ ID NO: 2504777 - RNA, 17 nt, Chlamydia trachomatis
uucacagagcuucucua

SEQ ID NO: 2504778 - RNA, 21 nt, Chlamydia trachomatis
uucacagagcuucucuaaaug

SEQ ID NO: 2504779 - RNA, 22 nt, Chlamydia trachomatis
uucacagcacgacacuccucug

SEQ ID NO: 2504780 - RNA, 19 nt, Chlamydia trachomatis
uucacaucgaauaaaaauu

SEQ ID NO: 2504781 - RNA, 20 nt, Chlamydia trachomatis
uucacccaaauauacucaac

SEQ ID NO: 2504782 - RNA, 18 nt, Chlamydia trachomatis
uucacgucggcuuuagga

SEQ ID NO: 2504783 - RNA, 17 nt, Chlamydia trachomatis
uucacuaccagaggagg

SEQ ID NO: 2504784 - RNA, 13 nt, Chlamydia trachomatis
uucacuaggguaa

SEQ ID NO: 2504785 - RNA, 22 nt, Chlamydia trachomatis
uucacuuugauaauacucuucu

SEQ ID NO: 2504786 - RNA, 14 nt, Chlamydia trachomatis
uucagaaaagccuu

SEQ ID NO: 2504787 - RNA, 17 nt, Chlamydia trachomatis
uucagaacaagugcagc

SEQ ID NO: 2504788 - RNA, 13 nt, Chlamydia trachomatis
uucagaacucaaa

SEQ ID NO: 2504789 - RNA, 15 nt, Chlamydia trachomatis
uucagaacucaaaau

SEQ ID NO: 2504790 - RNA, 15 nt, Chlamydia trachomatis
uucagaagaagagcu

SEQ ID NO: 2504791 - RNA, 21 nt, Chlamydia trachomatis
uucagaauauagcuguaauaa

SEQ ID NO: 2504792 - RNA, 12 nt, Chlamydia trachomatis
uucagacaaaaa

SEQ ID NO: 2504793 - RNA, 10 nt, Chlamydia trachomatis
uucagagagg

SEQ ID NO: 2504794 - RNA, 22 nt, Chlamydia trachomatis
uucagagguagccaaagaauuu

SEQ ID NO: 2504795 - RNA, 15 nt, Chlamydia trachomatis
uucagaucccauccu

SEQ ID NO: 2504796 - RNA, 15 nt, Chlamydia trachomatis
uucagcaagauucuc

SEQ ID NO: 2504797 - RNA, 11 nt, Chlamydia trachomatis
uucagcaauaa

SEQ ID NO: 2504798 - RNA, 14 nt, Chlamydia trachomatis
uucagcauccugaa

SEQ ID NO: 2504799 - RNA, 20 nt, Chlamydia trachomatis
uucagccgaugcccaagaaa

SEQ ID NO: 2504800 - RNA, 14 nt, Chlamydia trachomatis
uucagcuuuucuuu

SEQ ID NO: 2504801 - RNA, 17 nt, Chlamydia trachomatis
uucagcuuuucuuuccu

SEQ ID NO: 2504802 - RNA, 18 nt, Chlamydia trachomatis
uucaggagcaugaaucag

SEQ ID NO: 2504803 - RNA, 22 nt, Chlamydia trachomatis
uucaggguguaugaugucauca

SEQ ID NO: 2504804 - RNA, 18 nt, Chlamydia trachomatis
uucagguugagcaagcuc

SEQ ID NO: 2504805 - RNA, 20 nt, Chlamydia trachomatis
uucagguugagcaagcucaa

SEQ ID NO: 2504806 - RNA, 21 nt, Chlamydia trachomatis
uucaguguugagaagcuuagu

SEQ ID NO: 2504807 - RNA, 21 nt, Chlamydia trachomatis
uucaguucgaaguucccuuuu

SEQ ID NO: 2504808 - RNA, 14 nt, Chlamydia trachomatis
uucauaaaaaagac

SEQ ID NO: 2504809 - RNA, 19 nt, Chlamydia trachomatis
uucauaacaccugcauagc

SEQ ID NO: 2504810 - RNA, 14 nt, Chlamydia trachomatis
uucauaagaaaauu

SEQ ID NO: 2504811 - RNA, 17 nt, Chlamydia trachomatis
uucauaagccucauccc

SEQ ID NO: 2504812 - RNA, 13 nt, Chlamydia trachomatis
uucauacauaacu

SEQ ID NO: 2504813 - RNA, 16 nt, Chlamydia trachomatis
uucauacgagccuguu

SEQ ID NO: 2504814 - RNA, 14 nt, Chlamydia trachomatis
uucaucaaguauug

SEQ ID NO: 2504815 - RNA, 13 nt, Chlamydia trachomatis
uucaucacagaua

SEQ ID NO: 2504816 - RNA, 16 nt, Chlamydia trachomatis
uucaucagcacccaca

SEQ ID NO: 2504817 - RNA, 16 nt, Chlamydia trachomatis
uucaucccacaugcua

SEQ ID NO: 2504818 - RNA, 14 nt, Chlamydia trachomatis
uucaugaaaagcuu

SEQ ID NO: 2504819 - RNA, 19 nt, Chlamydia trachomatis
uucaugaaaagcuuucaaa

SEQ ID NO: 2504820 - RNA, 21 nt, Chlamydia trachomatis
uucaugaaaagcuuucaaagc

SEQ ID NO: 2504821 - RNA, 20 nt, Chlamydia trachomatis
uucaugacagcuucuugaau

SEQ ID NO: 2504822 - RNA, 22 nt, Chlamydia trachomatis
uucaugagaccgucaaaaagau

SEQ ID NO: 2504823 - RNA, 17 nt, Chlamydia trachomatis
uucauggcugcaauucu

SEQ ID NO: 2504824 - RNA, 13 nt, Chlamydia trachomatis
uucaugugaacag

SEQ ID NO: 2504825 - RNA, 15 nt, Chlamydia trachomatis
uucauucuuucgaua

SEQ ID NO: 2504826 - RNA, 22 nt, Chlamydia trachomatis
uucauuuaauaaguuuuucaaa

SEQ ID NO: 2504827 - RNA, 14 nt, Chlamydia trachomatis
uucauuuuauguaa

SEQ ID NO: 2504828 - RNA, 18 nt, Chlamydia trachomatis
uucauuuuauguaaauau

SEQ ID NO: 2504829 - RNA, 20 nt, Chlamydia trachomatis
uucauuuuauguaaauauuu

SEQ ID NO: 2504830 - RNA, 13 nt, Chlamydia trachomatis
uuccaaagcuucu

SEQ ID NO: 2504831 - RNA, 21 nt, Chlamydia trachomatis
uuccaaauagggucuuaaaaa

SEQ ID NO: 2504832 - RNA, 15 nt, Chlamydia trachomatis
uuccaacaaaaagcg

SEQ ID NO: 2504833 - RNA, 17 nt, Chlamydia trachomatis
uuccaacgauaagauga

SEQ ID NO: 2504834 - RNA, 13 nt, Chlamydia trachomatis
uuccaagaagaac

SEQ ID NO: 2504835 - RNA, 16 nt, Chlamydia trachomatis
uuccaagaaucaaaaa

SEQ ID NO: 2504836 - RNA, 19 nt, Chlamydia trachomatis
uuccaauauuauuuacgag

SEQ ID NO: 2504837 - RNA, 13 nt, Chlamydia trachomatis
uuccacaaauauu

SEQ ID NO: 2504838 - RNA, 22 nt, Chlamydia trachomatis
uuccaccuugcuuaacacuucu

SEQ ID NO: 2504839 - RNA, 15 nt, Chlamydia trachomatis
uuccacgaagagcaa

SEQ ID NO: 2504840 - RNA, 20 nt, Chlamydia trachomatis
uuccacgaagagcaaaauca

SEQ ID NO: 2504841 - RNA, 16 nt, Chlamydia trachomatis
uuccagaaaaaauaau

SEQ ID NO: 2504842 - RNA, 15 nt, Chlamydia trachomatis
uuccagacaaaaaga

SEQ ID NO: 2504843 - RNA, 23 nt, Chlamydia trachomatis
uuccagagcauguguuucuggaa

SEQ ID NO: 2504844 - RNA, 18 nt, Chlamydia trachomatis
uuccagcauuuuaaaauc

SEQ ID NO: 2504845 - RNA, 15 nt, Chlamydia trachomatis
uuccagccuacaaau

SEQ ID NO: 2504846 - RNA, 18 nt, Chlamydia trachomatis
uuccagccuacaaauaaa

SEQ ID NO: 2504847 - RNA, 22 nt, Chlamydia trachomatis
uuccaggacgaacgaagaacga

SEQ ID NO: 2504848 - RNA, 14 nt, Chlamydia trachomatis
uuccagucuuaaca

SEQ ID NO: 2504849 - RNA, 14 nt, Chlamydia trachomatis
uuccaguuacccuc

SEQ ID NO: 2504850 - RNA, 20 nt, Chlamydia trachomatis
uuccauacaucaucucucag

SEQ ID NO: 2504851 - RNA, 22 nt, Chlamydia trachomatis
uuccaucguaagcaacaauauc

SEQ ID NO: 2504852 - RNA, 19 nt, Chlamydia trachomatis
uuccaucguuuaugaagcc

SEQ ID NO: 2504853 - RNA, 14 nt, Chlamydia trachomatis
uuccauuaaacuau

SEQ ID NO: 2504854 - RNA, 18 nt, Chlamydia trachomatis
uuccauuaaacuaugcaa

SEQ ID NO: 2504855 - RNA, 21 nt, Chlamydia trachomatis
uucccaaaauuuuucugcucc

SEQ ID NO: 2504856 - RNA, 22 nt, Chlamydia trachomatis
uucccaaaauuuuucugcucca

SEQ ID NO: 2504857 - RNA, 20 nt, Chlamydia trachomatis
uucccacaaacaaaaaagaa

SEQ ID NO: 2504858 - RNA, 19 nt, Chlamydia trachomatis
uucccaucuacaaaaccaa

SEQ ID NO: 2504859 - RNA, 23 nt, Chlamydia trachomatis
uuccccaaagcagucuagagguu

SEQ ID NO: 2504860 - RNA, 18 nt, Chlamydia trachomatis
uuccccauucuucucgaa

SEQ ID NO: 2504861 - RNA, 22 nt, Chlamydia trachomatis
uucccgauauguucagccauuu

SEQ ID NO: 2504862 - RNA, 16 nt, Chlamydia trachomatis
uucccgcuauuuuccu

SEQ ID NO: 2504863 - RNA, 20 nt, Chlamydia trachomatis
uucccgcuauuuuccucuuc

SEQ ID NO: 2504864 - RNA, 23 nt, Chlamydia trachomatis
uucccuaagccgaguagacucua

SEQ ID NO: 2504865 - RNA, 23 nt, Chlamydia trachomatis
uucccuagguaucgaaaguaaaa

SEQ ID NO: 2504866 - RNA, 15 nt, Chlamydia trachomatis
uucccuccuagaaag

SEQ ID NO: 2504867 - RNA, 15 nt, Chlamydia trachomatis
uucccuguauucuga

SEQ ID NO: 2504868 - RNA, 14 nt, Chlamydia trachomatis
uucccuucuuucuu

SEQ ID NO: 2504869 - RNA, 23 nt, Chlamydia trachomatis
uucccuucuuucuucuaagaagu

SEQ ID NO: 2504870 - RNA, 23 nt, Chlamydia trachomatis
uucccuugguagaggcuauugau

SEQ ID NO: 2504871 - RNA, 20 nt, Chlamydia trachomatis
uucccuuuaaagaaagcccu

SEQ ID NO: 2504872 - RNA, 19 nt, Chlamydia trachomatis
uucccuuuuguuccagaaa

SEQ ID NO: 2504873 - RNA, 15 nt, Chlamydia trachomatis
uuccgaauaagcauu

SEQ ID NO: 2504874 - RNA, 20 nt, Chlamydia trachomatis
uuccgagagaagcuccucuu

SEQ ID NO: 2504875 - RNA, 22 nt, Chlamydia trachomatis
uuccgagagcgaagacagaauc

SEQ ID NO: 2504876 - RNA, 21 nt, Chlamydia trachomatis
uuccgcagagaucuaauugga

SEQ ID NO: 2504877 - RNA, 15 nt, Chlamydia trachomatis
uuccgcugcaaucuc

SEQ ID NO: 2504878 - RNA, 19 nt, Chlamydia trachomatis
uuccgguauauucuucacc

SEQ ID NO: 2504879 - RNA, 13 nt, Chlamydia trachomatis
uuccguccccuua

SEQ ID NO: 2504880 - RNA, 15 nt, Chlamydia trachomatis
uuccguuucuuagga

SEQ ID NO: 2504881 - RNA, 23 nt, Chlamydia trachomatis
uuccuaaacaaaaacucucaaau

SEQ ID NO: 2504882 - RNA, 23 nt, Chlamydia trachomatis
uuccuaauacuaaacuaucuaaa

SEQ ID NO: 2504883 - RNA, 17 nt, Chlamydia trachomatis
uuccuacagcuagaaua

SEQ ID NO: 2504884 - RNA, 14 nt, Chlamydia trachomatis
uuccuacuaaaaug

SEQ ID NO: 2504885 - RNA, 16 nt, Chlamydia trachomatis
uuccuauacaagaaaa

SEQ ID NO: 2504886 - RNA, 15 nt, Chlamydia trachomatis
uuccucaguauaaaa

SEQ ID NO: 2504887 - RNA, 16 nt, Chlamydia trachomatis
uuccucauaaaggaaa

SEQ ID NO: 2504888 - RNA, 20 nt, Chlamydia trachomatis
uuccuccucccuuuccauac

SEQ ID NO: 2504889 - RNA, 15 nt, Chlamydia trachomatis
uuccucuagcagaga

SEQ ID NO: 2504890 - RNA, 21 nt, Chlamydia trachomatis
uuccucuucacagagcuucuc

SEQ ID NO: 2504891 - RNA, 17 nt, Chlamydia trachomatis
uuccucuucuagaagac

SEQ ID NO: 2504892 - RNA, 14 nt, Chlamydia trachomatis
uuccugaauacuca

SEQ ID NO: 2504893 - RNA, 20 nt, Chlamydia trachomatis
uuccugaauacucaaaaauu

SEQ ID NO: 2504894 - RNA, 17 nt, Chlamydia trachomatis
uuccugagacaucuccu

SEQ ID NO: 2504895 - RNA, 15 nt, Chlamydia trachomatis
uuccugcuucaaaaa

SEQ ID NO: 2504896 - RNA, 16 nt, Chlamydia trachomatis
uuccugcuucaaaaaa

SEQ ID NO: 2504897 - RNA, 19 nt, Chlamydia trachomatis
uuccugcuucaaaaaagau

SEQ ID NO: 2504898 - RNA, 22 nt, Chlamydia trachomatis
uuccuggauccaaaaaagaauc

SEQ ID NO: 2504899 - RNA, 16 nt, Chlamydia trachomatis
uuccuguauaagaaaa

SEQ ID NO: 2504900 - RNA, 16 nt, Chlamydia trachomatis
uuccuuagaaagaauu

SEQ ID NO: 2504901 - RNA, 22 nt, Chlamydia trachomatis
uuccuuaguuuuaauuccaucu

SEQ ID NO: 2504902 - RNA, 23 nt, Chlamydia trachomatis
uuccuuaguuuuaauuccaucuu

SEQ ID NO: 2504903 - RNA, 20 nt, Chlamydia trachomatis
uuccuucagagguagccaaa

SEQ ID NO: 2504904 - RNA, 22 nt, Chlamydia trachomatis
uuccuucgguauccugcagcaa

SEQ ID NO: 2504905 - RNA, 18 nt, Chlamydia trachomatis
uuccuuguagaaagcugg

SEQ ID NO: 2504906 - RNA, 12 nt, Chlamydia trachomatis
uuccuuuuacuu

SEQ ID NO: 2504907 - RNA, 13 nt, Chlamydia trachomatis
uucgaaaagaguu

SEQ ID NO: 2504908 - RNA, 14 nt, Chlamydia trachomatis
uucgaauccuaaaa

SEQ ID NO: 2504909 - RNA, 14 nt, Chlamydia trachomatis
uucgaauccuucuc

SEQ ID NO: 2504910 - RNA, 20 nt, Chlamydia trachomatis
uucgagaauauuggugauca

SEQ ID NO: 2504911 - RNA, 13 nt, Chlamydia trachomatis
uucgagcuguuuu

SEQ ID NO: 2504912 - RNA, 19 nt, Chlamydia trachomatis
uucgaggagucucugcagu

SEQ ID NO: 2504913 - RNA, 15 nt, Chlamydia trachomatis
uucgaggcuucuucu

SEQ ID NO: 2504914 - RNA, 14 nt, Chlamydia trachomatis
uucgauaagaaaaa

SEQ ID NO: 2504915 - RNA, 20 nt, Chlamydia trachomatis
uucgauauacgcucuuucag

SEQ ID NO: 2504916 - RNA, 20 nt, Chlamydia trachomatis
uucgauguuguaagaacccu

SEQ ID NO: 2504917 - RNA, 22 nt, Chlamydia trachomatis
uucgcaaacugcucuucuaacu

SEQ ID NO: 2504918 - RNA, 19 nt, Chlamydia trachomatis
uucgcaggggaauacaguu

SEQ ID NO: 2504919 - RNA, 22 nt, Chlamydia trachomatis
uucgcauuaaauaauacaaagg

SEQ ID NO: 2504920 - RNA, 12 nt, Chlamydia trachomatis
uucgccaaacac

SEQ ID NO: 2504921 - RNA, 16 nt, Chlamydia trachomatis
uucgcgucaguucgga

SEQ ID NO: 2504922 - RNA, 14 nt, Chlamydia trachomatis
uucgcuaccaaaaa

SEQ ID NO: 2504923 - RNA, 17 nt, Chlamydia trachomatis
uucggaauacuguuugu

SEQ ID NO: 2504924 - RNA, 14 nt, Chlamydia trachomatis
uucggcagaagcug

SEQ ID NO: 2504925 - RNA, 24 nt, Chlamydia trachomatis
uucggcuauagcgucuugcuaaug

SEQ ID NO: 2504926 - RNA, 17 nt, Chlamydia trachomatis
uucgggacgcccuacag

SEQ ID NO: 2504927 - RNA, 13 nt, Chlamydia trachomatis
uucgggauaagau

SEQ ID NO: 2504928 - RNA, 19 nt, Chlamydia trachomatis
uucgguauugaaagcaugu

SEQ ID NO: 2504929 - RNA, 19 nt, Chlamydia trachomatis
uucgguuuugcuaaccaaa

SEQ ID NO: 2504930 - RNA, 14 nt, Chlamydia trachomatis
uucguacugcauug

SEQ ID NO: 2504931 - RNA, 19 nt, Chlamydia trachomatis
uucguaguaacuuaugaaa

SEQ ID NO: 2504932 - RNA, 13 nt, Chlamydia trachomatis
uucgucaaagaag

SEQ ID NO: 2504933 - RNA, 23 nt, Chlamydia trachomatis
uucgucaaagaaguaaugaaggu

SEQ ID NO: 2504934 - RNA, 19 nt, Chlamydia trachomatis
uucguuacgcguaaagauu

SEQ ID NO: 2504935 - RNA, 22 nt, Chlamydia trachomatis
uucguugcucccaucaacucuc

SEQ ID NO: 2504936 - RNA, 14 nt, Chlamydia trachomatis
uucuaaaauuugug

SEQ ID NO: 2504937 - RNA, 15 nt, Chlamydia trachomatis
uucuaaagaaaagcu

SEQ ID NO: 2504938 - RNA, 17 nt, Chlamydia trachomatis
uucuaacuggccaccuu

SEQ ID NO: 2504939 - RNA, 14 nt, Chlamydia trachomatis
uucuaagaaauugu

SEQ ID NO: 2504940 - RNA, 16 nt, Chlamydia trachomatis
uucuaagcuagaaaau

SEQ ID NO: 2504941 - RNA, 13 nt, Chlamydia trachomatis
uucuaaguauucu

SEQ ID NO: 2504942 - RNA, 21 nt, Chlamydia trachomatis
uucuaauaauacagauuuuuc

SEQ ID NO: 2504943 - RNA, 17 nt, Chlamydia trachomatis
uucuacaacuaucagaa

SEQ ID NO: 2504944 - RNA, 19 nt, Chlamydia trachomatis
uucuacguaguaauuuuga

SEQ ID NO: 2504945 - RNA, 21 nt, Chlamydia trachomatis
uucuacguaguaauuuugaca

SEQ ID NO: 2504946 - RNA, 21 nt, Chlamydia trachomatis
uucuacuccugcaacaagaac

SEQ ID NO: 2504947 - RNA, 12 nt, Chlamydia trachomatis
uucuacuuuuug

SEQ ID NO: 2504948 - RNA, 21 nt, Chlamydia trachomatis
uucuacuuuuugggaacccgu

SEQ ID NO: 2504949 - RNA, 22 nt, Chlamydia trachomatis
uucuagaagaccaaaaaugaac

SEQ ID NO: 2504950 - RNA, 14 nt, Chlamydia trachomatis
uucuagauagaaga

SEQ ID NO: 2504951 - RNA, 22 nt, Chlamydia trachomatis
uucuagauagaagagcuuugca

SEQ ID NO: 2504952 - RNA, 15 nt, Chlamydia trachomatis
uucuagcaaccgauu

SEQ ID NO: 2504953 - RNA, 16 nt, Chlamydia trachomatis
uucuaggaagcugaga

SEQ ID NO: 2504954 - RNA, 20 nt, Chlamydia trachomatis
uucuaggucugaagaaaaau

SEQ ID NO: 2504955 - RNA, 21 nt, Chlamydia trachomatis
uucuaggucugaagaaaaauc

SEQ ID NO: 2504956 - RNA, 15 nt, Chlamydia trachomatis
uucuauaagaaacac

SEQ ID NO: 2504957 - RNA, 22 nt, Chlamydia trachomatis
uucuauccggaguaccaaaaaa

SEQ ID NO: 2504958 - RNA, 18 nt, Chlamydia trachomatis
uucuauucgcaguaucuu

SEQ ID NO: 2504959 - RNA, 16 nt, Chlamydia trachomatis
uucuauuucucuuccu

SEQ ID NO: 2504960 - RNA, 18 nt, Chlamydia trachomatis
uucuauuucucuuccuga

SEQ ID NO: 2504961 - RNA, 19 nt, Chlamydia trachomatis
uucucaaaacgcucuccaa

SEQ ID NO: 2504962 - RNA, 22 nt, Chlamydia trachomatis
uucucaaaacgcucuccaaaga

SEQ ID NO: 2504963 - RNA, 18 nt, Chlamydia trachomatis
uucucaauccaugaggcu

SEQ ID NO: 2504964 - RNA, 20 nt, Chlamydia trachomatis
uucucaggaucuaauucuag

SEQ ID NO: 2504965 - RNA, 23 nt, Chlamydia trachomatis
uucucaugcguuaauuaauaagc

SEQ ID NO: 2504966 - RNA, 17 nt, Chlamydia trachomatis
uucuccgauaauuuucc

SEQ ID NO: 2504967 - RNA, 13 nt, Chlamydia trachomatis
uucuccuaaaguu

SEQ ID NO: 2504968 - RNA, 13 nt, Chlamydia trachomatis
uucuccucccaga

SEQ ID NO: 2504969 - RNA, 18 nt, Chlamydia trachomatis
uucuccucccagauuuua

SEQ ID NO: 2504970 - RNA, 22 nt, Chlamydia trachomatis
uucuccucuggaacguuugucu

SEQ ID NO: 2504971 - RNA, 13 nt, Chlamydia trachomatis
uucucgaaaaaau

SEQ ID NO: 2504972 - RNA, 14 nt, Chlamydia trachomatis
uucucgagaagaaa

SEQ ID NO: 2504973 - RNA, 17 nt, Chlamydia trachomatis
uucucgagaagaaaaac

SEQ ID NO: 2504974 - RNA, 22 nt, Chlamydia trachomatis
uucucgcaauauauccaucuac

SEQ ID NO: 2504975 - RNA, 18 nt, Chlamydia trachomatis
uucucgcuaaauugaaau

SEQ ID NO: 2504976 - RNA, 18 nt, Chlamydia trachomatis
uucucgcuacaaauccuu

SEQ ID NO: 2504977 - RNA, 17 nt, Chlamydia trachomatis
uucucggaaaagauauc

SEQ ID NO: 2504978 - RNA, 16 nt, Chlamydia trachomatis
uucucuagaaaaggcc

SEQ ID NO: 2504979 - RNA, 16 nt, Chlamydia trachomatis
uucucuagaauuuccc

SEQ ID NO: 2504980 - RNA, 22 nt, Chlamydia trachomatis
uucucuagaauuucccuaagcc

SEQ ID NO: 2504981 - RNA, 14 nt, Chlamydia trachomatis
uucucuagacuauc

SEQ ID NO: 2504982 - RNA, 23 nt, Chlamydia trachomatis
uucucuccgugaagauuaccgug

SEQ ID NO: 2504983 - RNA, 12 nt, Chlamydia trachomatis
uucucucuaaaa

SEQ ID NO: 2504984 - RNA, 18 nt, Chlamydia trachomatis
uucucucuaaaaucacac

SEQ ID NO: 2504985 - RNA, 11 nt, Chlamydia trachomatis
uucucucuagc

SEQ ID NO: 2504986 - RNA, 20 nt, Chlamydia trachomatis
uucucugagggugaggucca

SEQ ID NO: 2504987 - RNA, 14 nt, Chlamydia trachomatis
uucucugccuauag

SEQ ID NO: 2504988 - RNA, 15 nt, Chlamydia trachomatis
uucucugcuucgcca

SEQ ID NO: 2504989 - RNA, 12 nt, Chlamydia trachomatis
uucucuuagaag

SEQ ID NO: 2504990 - RNA, 20 nt, Chlamydia trachomatis
uucucuuagaagcucucaag

SEQ ID NO: 2504991 - RNA, 15 nt, Chlamydia trachomatis
uucucuuccugaaua

SEQ ID NO: 2504992 - RNA, 20 nt, Chlamydia trachomatis
uucucuugaaucaaaaaguu

SEQ ID NO: 2504993 - RNA, 16 nt, Chlamydia trachomatis
uucucuugcagaacag

SEQ ID NO: 2504994 - RNA, 19 nt, Chlamydia trachomatis
uucucuuuaauaacugcau

SEQ ID NO: 2504995 - RNA, 18 nt, Chlamydia trachomatis
uucucuuuuuaaaaggcu

SEQ ID NO: 2504996 - RNA, 22 nt, Chlamydia trachomatis
uucugaaacgcacuccaauaua

SEQ ID NO: 2504997 - RNA, 14 nt, Chlamydia trachomatis
uucugaaaggccag

SEQ ID NO: 2504998 - RNA, 23 nt, Chlamydia trachomatis
uucugaaggugugaaagaaaaau

SEQ ID NO: 2504999 - RNA, 20 nt, Chlamydia trachomatis
uucugaaucaacgcuucaua

SEQ ID NO: 2505000 - RNA, 19 nt, Chlamydia trachomatis
uucugagaaaucuaaaaca

SEQ ID NO: 2505001 - RNA, 19 nt, Chlamydia trachomatis
uucugagcuagaaugugua

SEQ ID NO: 2505002 - RNA, 19 nt, Chlamydia trachomatis
uucugagggauaucuggau

SEQ ID NO: 2505003 - RNA, 23 nt, Chlamydia trachomatis
uucugaguccucuaaaguauucu

SEQ ID NO: 2505004 - RNA, 22 nt, Chlamydia trachomatis
uucugauaaaugucccugaaca

SEQ ID NO: 2505005 - RNA, 13 nt, Chlamydia trachomatis
uucugcaacucuc

SEQ ID NO: 2505006 - RNA, 20 nt, Chlamydia trachomatis
uucugcaggcucaugaacag

SEQ ID NO: 2505007 - RNA, 21 nt, Chlamydia trachomatis
uucugcauaacagcaagacaa

SEQ ID NO: 2505008 - RNA, 17 nt, Chlamydia trachomatis
uucugcaugcaaauaag

SEQ ID NO: 2505009 - RNA, 18 nt, Chlamydia trachomatis
uucugccauuucuaaagg

SEQ ID NO: 2505010 - RNA, 22 nt, Chlamydia trachomatis
uucugccucuuuuaccgagaga

SEQ ID NO: 2505011 - RNA, 10 nt, Chlamydia trachomatis
uucugcuaaa

SEQ ID NO: 2505012 - RNA, 16 nt, Chlamydia trachomatis
uucugcuaaauccauu

SEQ ID NO: 2505013 - RNA, 22 nt, Chlamydia trachomatis
uucugcuccaaagauauagguu

SEQ ID NO: 2505014 - RNA, 12 nt, Chlamydia trachomatis
uucuggaaagag

SEQ ID NO: 2505015 - RNA, 15 nt, Chlamydia trachomatis
uucuggaaagagaga

SEQ ID NO: 2505016 - RNA, 23 nt, Chlamydia trachomatis
uucuggcaguaacaagcacagaa

SEQ ID NO: 2505017 - RNA, 16 nt, Chlamydia trachomatis
uucuggcgaaugcccu

SEQ ID NO: 2505018 - RNA, 16 nt, Chlamydia trachomatis
uucuguuauuuguucu

SEQ ID NO: 2505019 - RNA, 18 nt, Chlamydia trachomatis
uucuguugacuuuagcaa

SEQ ID NO: 2505020 - RNA, 15 nt, Chlamydia trachomatis
uucuuaaacaaaaau

SEQ ID NO: 2505021 - RNA, 19 nt, Chlamydia trachomatis
uucuuaacugcagcaucua

SEQ ID NO: 2505022 - RNA, 15 nt, Chlamydia trachomatis
uucuuacuaaagcca

SEQ ID NO: 2505023 - RNA, 16 nt, Chlamydia trachomatis
uucuuacuuaaaaaac

SEQ ID NO: 2505024 - RNA, 16 nt, Chlamydia trachomatis
uucuuagcccagauuu

SEQ ID NO: 2505025 - RNA, 15 nt, Chlamydia trachomatis
uucuuagccuuguuu

SEQ ID NO: 2505026 - RNA, 13 nt, Chlamydia trachomatis
uucuuaguggcuu

SEQ ID NO: 2505027 - RNA, 17 nt, Chlamydia trachomatis
uucuuauacagcaugcc

SEQ ID NO: 2505028 - RNA, 23 nt, Chlamydia trachomatis
uucuuauacagcaugccuucuuc

SEQ ID NO: 2505029 - RNA, 15 nt, Chlamydia trachomatis
uucuuaucagcaucc

SEQ ID NO: 2505030 - RNA, 22 nt, Chlamydia trachomatis
uucuuaucugucagucuucuuu

SEQ ID NO: 2505031 - RNA, 13 nt, Chlamydia trachomatis
uucuucaagaagg

SEQ ID NO: 2505032 - RNA, 21 nt, Chlamydia trachomatis
uucuucacccauaaaaaagag

SEQ ID NO: 2505033 - RNA, 14 nt, Chlamydia trachomatis
uucuucaccuuuuc

SEQ ID NO: 2505034 - RNA, 13 nt, Chlamydia trachomatis
uucuucauagcuu

SEQ ID NO: 2505035 - RNA, 19 nt, Chlamydia trachomatis
uucuuccaaauagggucuu

SEQ ID NO: 2505036 - RNA, 21 nt, Chlamydia trachomatis
uucuuccauacccauaauucu

SEQ ID NO: 2505037 - RNA, 22 nt, Chlamydia trachomatis
uucuuccauacccauaauucuu

SEQ ID NO: 2505038 - RNA, 23 nt, Chlamydia trachomatis
uucuuccaucacuccaagaagag

SEQ ID NO: 2505039 - RNA, 11 nt, Chlamydia trachomatis
uucuucccaac

SEQ ID NO: 2505040 - RNA, 22 nt, Chlamydia trachomatis
uucuucgcuuccugcaugaagu

SEQ ID NO: 2505041 - RNA, 17 nt, Chlamydia trachomatis
uucuucggaaagcacuu

SEQ ID NO: 2505042 - RNA, 23 nt, Chlamydia trachomatis
uucuucgguuugauuuccucuuc

SEQ ID NO: 2505043 - RNA, 21 nt, Chlamydia trachomatis
uucuucgucgucguacuccuc

SEQ ID NO: 2505044 - RNA, 23 nt, Chlamydia trachomatis
uucuucuaagcuagaaaauagca

SEQ ID NO: 2505045 - RNA, 14 nt, Chlamydia trachomatis
uucuucuacaaguu

SEQ ID NO: 2505046 - RNA, 16 nt, Chlamydia trachomatis
uucuucugaacaacau

SEQ ID NO: 2505047 - RNA, 12 nt, Chlamydia trachomatis
uucuucugcagg

SEQ ID NO: 2505048 - RNA, 22 nt, Chlamydia trachomatis
uucuucugccgaaggcaauucc

SEQ ID NO: 2505049 - RNA, 18 nt, Chlamydia trachomatis
uucuucugccuguugcaa

SEQ ID NO: 2505050 - RNA, 12 nt, Chlamydia trachomatis
uucuugacaaaa

SEQ ID NO: 2505051 - RNA, 13 nt, Chlamydia trachomatis
uucuugagaaaac

SEQ ID NO: 2505052 - RNA, 23 nt, Chlamydia trachomatis
uucuuggaaaaaaggucucucuu

SEQ ID NO: 2505053 - RNA, 13 nt, Chlamydia trachomatis
uucuuggcaggcg

SEQ ID NO: 2505054 - RNA, 18 nt, Chlamydia trachomatis
uucuuggcggaauuuguu

SEQ ID NO: 2505055 - RNA, 20 nt, Chlamydia trachomatis
uucuugggauaugccucuaa

SEQ ID NO: 2505056 - RNA, 18 nt, Chlamydia trachomatis
uucuugguauuccguacu

SEQ ID NO: 2505057 - RNA, 12 nt, Chlamydia trachomatis
uucuuguauaag

SEQ ID NO: 2505058 - RNA, 14 nt, Chlamydia trachomatis
uucuugugggauug

SEQ ID NO: 2505059 - RNA, 20 nt, Chlamydia trachomatis
uucuuguuuuauacucuaaa

SEQ ID NO: 2505060 - RNA, 14 nt, Chlamydia trachomatis
uucuuuaagaagau

SEQ ID NO: 2505061 - RNA, 17 nt, Chlamydia trachomatis
uucuuuaagcaacaacu

SEQ ID NO: 2505062 - RNA, 14 nt, Chlamydia trachomatis
uucuuuagccccuu

SEQ ID NO: 2505063 - RNA, 18 nt, Chlamydia trachomatis
uucuuuagccccuuguuc

SEQ ID NO: 2505064 - RNA, 14 nt, Chlamydia trachomatis
uucuuucaaagaga

SEQ ID NO: 2505065 - RNA, 18 nt, Chlamydia trachomatis
uucuuucauucguuucuu

SEQ ID NO: 2505066 - RNA, 15 nt, Chlamydia trachomatis
uucuuuuuccucagc

SEQ ID NO: 2505067 - RNA, 19 nt, Chlamydia trachomatis
uugaaaggggcuuuuuuua

SEQ ID NO: 2505068 - RNA, 16 nt, Chlamydia trachomatis
uugaaaucaaaaggcc

SEQ ID NO: 2505069 - RNA, 17 nt, Chlamydia trachomatis
uugaauaacguuuuaaa

SEQ ID NO: 2505070 - RNA, 19 nt, Chlamydia trachomatis
uugaauaacguuuuaaaca

SEQ ID NO: 2505071 - RNA, 16 nt, Chlamydia trachomatis
uugaauaucguaaaca

SEQ ID NO: 2505072 - RNA, 20 nt, Chlamydia trachomatis
uugaauaucguaaacaacca

SEQ ID NO: 2505073 - RNA, 19 nt, Chlamydia trachomatis
uugaaucacacgggucucu

SEQ ID NO: 2505074 - RNA, 18 nt, Chlamydia trachomatis
uugaauggcaaggacaag

SEQ ID NO: 2505075 - RNA, 15 nt, Chlamydia trachomatis
uugaauuagguaagc

SEQ ID NO: 2505076 - RNA, 14 nt, Chlamydia trachomatis
uugacaagcaguag

SEQ ID NO: 2505077 - RNA, 15 nt, Chlamydia trachomatis
uugacuaucugcucg

SEQ ID NO: 2505078 - RNA, 19 nt, Chlamydia trachomatis
uugagaaaguuaaagaaua

SEQ ID NO: 2505079 - RNA, 23 nt, Chlamydia trachomatis
uugagaaauaaucaucucaaguc

SEQ ID NO: 2505080 - RNA, 20 nt, Chlamydia trachomatis
uugagagaccugcuucagca

SEQ ID NO: 2505081 - RNA, 21 nt, Chlamydia trachomatis
uugagagcauucuucugaaca

SEQ ID NO: 2505082 - RNA, 21 nt, Chlamydia trachomatis
uugagaugaaucggaugagga

SEQ ID NO: 2505083 - RNA, 22 nt, Chlamydia trachomatis
uugaggaggcggcgguggaaga

SEQ ID NO: 2505084 - RNA, 20 nt, Chlamydia trachomatis
uugaggcggagauucuaauc

SEQ ID NO: 2505085 - RNA, 13 nt, Chlamydia trachomatis
uugaguaaucagu

SEQ ID NO: 2505086 - RNA, 18 nt, Chlamydia trachomatis
uugaguccgcaaacaaaa

SEQ ID NO: 2505087 - RNA, 11 nt, Chlamydia trachomatis
uugaguucauc

SEQ ID NO: 2505088 - RNA, 23 nt, Chlamydia trachomatis
uugaguucugcuugcgaauaacu

SEQ ID NO: 2505089 - RNA, 21 nt, Chlamydia trachomatis
uugauaagcugaaaaugcucu

SEQ ID NO: 2505090 - RNA, 21 nt, Chlamydia trachomatis
uugauacaccucuugugauga

SEQ ID NO: 2505091 - RNA, 15 nt, Chlamydia trachomatis
uugauagcuucauac

SEQ ID NO: 2505092 - RNA, 13 nt, Chlamydia trachomatis
uugauauucccuu

SEQ ID NO: 2505093 - RNA, 14 nt, Chlamydia trachomatis
uugaucaaagaauc

SEQ ID NO: 2505094 - RNA, 19 nt, Chlamydia trachomatis
uugaucuacagcaaaaccu

SEQ ID NO: 2505095 - RNA, 15 nt, Chlamydia trachomatis
uugaucuaucgcuug

SEQ ID NO: 2505096 - RNA, 21 nt, Chlamydia trachomatis
uugaucugaaaagagaagaag

SEQ ID NO: 2505097 - RNA, 17 nt, Chlamydia trachomatis
uugaucugagaaagcuu

SEQ ID NO: 2505098 - RNA, 21 nt, Chlamydia trachomatis
uugaucuuauuaaccaacucu

SEQ ID NO: 2505099 - RNA, 14 nt, Chlamydia trachomatis
uugaucuuuccagc

SEQ ID NO: 2505100 - RNA, 17 nt, Chlamydia trachomatis
uugaugauguccaaagc

SEQ ID NO: 2505101 - RNA, 20 nt, Chlamydia trachomatis
uugaugcccaggauaacaaa

SEQ ID NO: 2505102 - RNA, 15 nt, Chlamydia trachomatis
uugauuaggaagaag

SEQ ID NO: 2505103 - RNA, 13 nt, Chlamydia trachomatis
uugauuauaaaug

SEQ ID NO: 2505104 - RNA, 16 nt, Chlamydia trachomatis
uugauucuaugagaag

SEQ ID NO: 2505105 - RNA, 12 nt, Chlamydia trachomatis
uugauucugcuu

SEQ ID NO: 2505106 - RNA, 13 nt, Chlamydia trachomatis
uugauuuuuucgc

SEQ ID NO: 2505107 - RNA, 11 nt, Chlamydia trachomatis
uugcaaaaauc

SEQ ID NO: 2505108 - RNA, 12 nt, Chlamydia trachomatis
uugcaaagagua

SEQ ID NO: 2505109 - RNA, 18 nt, Chlamydia trachomatis
uugcaauccuuuuuccuu

SEQ ID NO: 2505110 - RNA, 13 nt, Chlamydia trachomatis
uugcacaaaucca

SEQ ID NO: 2505111 - RNA, 20 nt, Chlamydia trachomatis
uugcacaaucucaaaaacac

SEQ ID NO: 2505112 - RNA, 12 nt, Chlamydia trachomatis
uugcacagcaag

SEQ ID NO: 2505113 - RNA, 15 nt, Chlamydia trachomatis
uugcaccacgugcaa

SEQ ID NO: 2505114 - RNA, 13 nt, Chlamydia trachomatis
uugcacuaagaau

SEQ ID NO: 2505115 - RNA, 17 nt, Chlamydia trachomatis
uugcacuaagaauaaag

SEQ ID NO: 2505116 - RNA, 18 nt, Chlamydia trachomatis
uugcacuaagaauaaaga

SEQ ID NO: 2505117 - RNA, 21 nt, Chlamydia trachomatis
uugcacuaagaauaaagauga

SEQ ID NO: 2505118 - RNA, 12 nt, Chlamydia trachomatis
uugcacuuuccg

SEQ ID NO: 2505119 - RNA, 23 nt, Chlamydia trachomatis
uugcagcauccucaaaaaaggca

SEQ ID NO: 2505120 - RNA, 16 nt, Chlamydia trachomatis
uugcagccuuucccuu

SEQ ID NO: 2505121 - RNA, 18 nt, Chlamydia trachomatis
uugcaggagauaauuuuc

SEQ ID NO: 2505122 - RNA, 14 nt, Chlamydia trachomatis
uugcauaaggaagc

SEQ ID NO: 2505123 - RNA, 17 nt, Chlamydia trachomatis
uugccaguaaucaaauu

SEQ ID NO: 2505124 - RNA, 21 nt, Chlamydia trachomatis
uugccaucauuaucuucuucu

SEQ ID NO: 2505125 - RNA, 16 nt, Chlamydia trachomatis
uugccauguuuuucag

SEQ ID NO: 2505126 - RNA, 14 nt, Chlamydia trachomatis
uugcccaaacucca

SEQ ID NO: 2505127 - RNA, 16 nt, Chlamydia trachomatis
uugccgaaucaaagac

SEQ ID NO: 2505128 - RNA, 13 nt, Chlamydia trachomatis
uugccuacagaau

SEQ ID NO: 2505129 - RNA, 13 nt, Chlamydia trachomatis
uugccuuacucuu

SEQ ID NO: 2505130 - RNA, 19 nt, Chlamydia trachomatis
uugccuuuucuauuuagag

SEQ ID NO: 2505131 - RNA, 22 nt, Chlamydia trachomatis
uugcgaagguucaagaugcgcu

SEQ ID NO: 2505132 - RNA, 21 nt, Chlamydia trachomatis
uugcguagcucagagauuucc

SEQ ID NO: 2505133 - RNA, 14 nt, Chlamydia trachomatis
uugcuaaccaaaca

SEQ ID NO: 2505134 - RNA, 14 nt, Chlamydia trachomatis
uugcuacaguaucu

SEQ ID NO: 2505135 - RNA, 20 nt, Chlamydia trachomatis
uugcuacaguaucugcuagu

SEQ ID NO: 2505136 - RNA, 18 nt, Chlamydia trachomatis
uugcuccacaagaaguaa

SEQ ID NO: 2505137 - RNA, 23 nt, Chlamydia trachomatis
uugcucuaccaacugagcuauuu

SEQ ID NO: 2505138 - RNA, 17 nt, Chlamydia trachomatis
uugcuggguuuuaucaa

SEQ ID NO: 2505139 - RNA, 21 nt, Chlamydia trachomatis
uugcuggguuuuaucaagaga

SEQ ID NO: 2505140 - RNA, 15 nt, Chlamydia trachomatis
uugcuguauagagua

SEQ ID NO: 2505141 - RNA, 16 nt, Chlamydia trachomatis
uugcuguauagaguaa

SEQ ID NO: 2505142 - RNA, 17 nt, Chlamydia trachomatis
uugcuguauagaguaag

SEQ ID NO: 2505143 - RNA, 22 nt, Chlamydia trachomatis
uugcuguuaagauaagcagcaa

SEQ ID NO: 2505144 - RNA, 17 nt, Chlamydia trachomatis
uugcuguugaacggaau

SEQ ID NO: 2505145 - RNA, 18 nt, Chlamydia trachomatis
uugcuuuucgaaugacau

SEQ ID NO: 2505146 - RNA, 15 nt, Chlamydia trachomatis
uuggaaaauccaaag

SEQ ID NO: 2505147 - RNA, 23 nt, Chlamydia trachomatis
uuggaagaggcgcccacagaaca

SEQ ID NO: 2505148 - RNA, 18 nt, Chlamydia trachomatis
uuggacaaaaaucucaaa

SEQ ID NO: 2505149 - RNA, 14 nt, Chlamydia trachomatis
uuggacguuggaga

SEQ ID NO: 2505150 - RNA, 18 nt, Chlamydia trachomatis
uuggacuaugcucacaaa

SEQ ID NO: 2505151 - RNA, 23 nt, Chlamydia trachomatis
uuggacuaugcucacaaaccaaa

SEQ ID NO: 2505152 - RNA, 19 nt, Chlamydia trachomatis
uuggagaacgcauaagcac

SEQ ID NO: 2505153 - RNA, 16 nt, Chlamydia trachomatis
uuggagagaaugaaga

SEQ ID NO: 2505154 - RNA, 18 nt, Chlamydia trachomatis
uuggauaacgucauugcu

SEQ ID NO: 2505155 - RNA, 22 nt, Chlamydia trachomatis
uuggauaucuugcggagccgau

SEQ ID NO: 2505156 - RNA, 13 nt, Chlamydia trachomatis
uuggaucucuuag

SEQ ID NO: 2505157 - RNA, 23 nt, Chlamydia trachomatis
uuggauuagaaaaagggagagga

SEQ ID NO: 2505158 - RNA, 16 nt, Chlamydia trachomatis
uuggcaauggcaaaau

SEQ ID NO: 2505159 - RNA, 13 nt, Chlamydia trachomatis
uuggcucuuuaau

SEQ ID NO: 2505160 - RNA, 13 nt, Chlamydia trachomatis
uugggugacugcg

SEQ ID NO: 2505161 - RNA, 22 nt, Chlamydia trachomatis
uugguaaaguaguugaauauac

SEQ ID NO: 2505162 - RNA, 21 nt, Chlamydia trachomatis
uuggucgggaaacauuccaaa

SEQ ID NO: 2505163 - RNA, 16 nt, Chlamydia trachomatis
uugguuuggguuuuaa

SEQ ID NO: 2505164 - RNA, 14 nt, Chlamydia trachomatis
uuguaaaacaacca

SEQ ID NO: 2505165 - RNA, 23 nt, Chlamydia trachomatis
uuguaaagcauucguuaucaaua

SEQ ID NO: 2505166 - RNA, 16 nt, Chlamydia trachomatis
uuguaaauagacuucu

SEQ ID NO: 2505167 - RNA, 19 nt, Chlamydia trachomatis
uuguaaauagacuucuucg

SEQ ID NO: 2505168 - RNA, 17 nt, Chlamydia trachomatis
uuguaagaacccuuugu

SEQ ID NO: 2505169 - RNA, 14 nt, Chlamydia trachomatis
uuguaauaucaaag

SEQ ID NO: 2505170 - RNA, 17 nt, Chlamydia trachomatis
uuguaauaucaaagagu

SEQ ID NO: 2505171 - RNA, 20 nt, Chlamydia trachomatis
uuguacacgauguuccccau

SEQ ID NO: 2505172 - RNA, 22 nt, Chlamydia trachomatis
uuguagaccuaagcuauguaaa

SEQ ID NO: 2505173 - RNA, 22 nt, Chlamydia trachomatis
uuguagauacugguaacugugg

SEQ ID NO: 2505174 - RNA, 20 nt, Chlamydia trachomatis
uuguagcaaaagauuuugaa

SEQ ID NO: 2505175 - RNA, 14 nt, Chlamydia trachomatis
uuguagccuucuau

SEQ ID NO: 2505176 - RNA, 19 nt, Chlamydia trachomatis
uuguagugaaguucccuuu

SEQ ID NO: 2505177 - RNA, 21 nt, Chlamydia trachomatis
uuguaguugcgccuucugcug

SEQ ID NO: 2505178 - RNA, 22 nt, Chlamydia trachomatis
uuguauaaacccacgaaaagac

SEQ ID NO: 2505179 - RNA, 13 nt, Chlamydia trachomatis
uuguauagaaccu

SEQ ID NO: 2505180 - RNA, 18 nt, Chlamydia trachomatis
uuguaucaacagaugacu

SEQ ID NO: 2505181 - RNA, 22 nt, Chlamydia trachomatis
uuguaucccuaguacaaaaaua

SEQ ID NO: 2505182 - RNA, 15 nt, Chlamydia trachomatis
uuguaucuugugcaa

SEQ ID NO: 2505183 - RNA, 14 nt, Chlamydia trachomatis
uugucaaggcuccg

SEQ ID NO: 2505184 - RNA, 22 nt, Chlamydia trachomatis
uugucaaggcuccguucaaagc

SEQ ID NO: 2505185 - RNA, 23 nt, Chlamydia trachomatis
uugucaaggcuccguucaaagca

SEQ ID NO: 2505186 - RNA, 22 nt, Chlamydia trachomatis
uugucacugcuuccgaaagcau

SEQ ID NO: 2505187 - RNA, 21 nt, Chlamydia trachomatis
uugucagaagaggcaaaaauc

SEQ ID NO: 2505188 - RNA, 22 nt, Chlamydia trachomatis
uugucagaagaggcaaaaaucu

SEQ ID NO: 2505189 - RNA, 22 nt, Chlamydia trachomatis
uugucaugacucggaauaagag

SEQ ID NO: 2505190 - RNA, 20 nt, Chlamydia trachomatis
uugucauugaucacauuuuc

SEQ ID NO: 2505191 - RNA, 18 nt, Chlamydia trachomatis
uuguccuggccaaaaaau

SEQ ID NO: 2505192 - RNA, 21 nt, Chlamydia trachomatis
uugucgauaacgaagcaaaac

SEQ ID NO: 2505193 - RNA, 16 nt, Chlamydia trachomatis
uugucuuagaagaucc

SEQ ID NO: 2505194 - RNA, 18 nt, Chlamydia trachomatis
uugugaaaagggcaaaac

SEQ ID NO: 2505195 - RNA, 17 nt, Chlamydia trachomatis
uugugaagaacugucuu

SEQ ID NO: 2505196 - RNA, 15 nt, Chlamydia trachomatis
uugugaggagcucuc

SEQ ID NO: 2505197 - RNA, 15 nt, Chlamydia trachomatis
uugugauuucugaau

SEQ ID NO: 2505198 - RNA, 18 nt, Chlamydia trachomatis
uugugcaaacaaaagaga

SEQ ID NO: 2505199 - RNA, 21 nt, Chlamydia trachomatis
uugugcagcacugagauguuu

SEQ ID NO: 2505200 - RNA, 19 nt, Chlamydia trachomatis
uugugcgcuuucagacucu

SEQ ID NO: 2505201 - RNA, 16 nt, Chlamydia trachomatis
uuguggguuuggaaau

SEQ ID NO: 2505202 - RNA, 15 nt, Chlamydia trachomatis
uuguguuucuaaaau

SEQ ID NO: 2505203 - RNA, 18 nt, Chlamydia trachomatis
uuguuaaugacaaacuuu

SEQ ID NO: 2505204 - RNA, 17 nt, Chlamydia trachomatis
uuguuauccaaaaggau

SEQ ID NO: 2505205 - RNA, 20 nt, Chlamydia trachomatis
uuguuccuaauuuaaaaucu

SEQ ID NO: 2505206 - RNA, 23 nt, Chlamydia trachomatis
uuguucugggcugacagaagcug

SEQ ID NO: 2505207 - RNA, 15 nt, Chlamydia trachomatis
uuguugacacugcuu

SEQ ID NO: 2505208 - RNA, 13 nt, Chlamydia trachomatis
uuguugagcagca

SEQ ID NO: 2505209 - RNA, 13 nt, Chlamydia trachomatis
uuguuuaaucagu

SEQ ID NO: 2505210 - RNA, 13 nt, Chlamydia trachomatis
uuguuuagaaaau

SEQ ID NO: 2505211 - RNA, 16 nt, Chlamydia trachomatis
uuguuuagaaaauacg

SEQ ID NO: 2505212 - RNA, 16 nt, Chlamydia trachomatis
uuguuuagcauuucuu

SEQ ID NO: 2505213 - RNA, 20 nt, Chlamydia trachomatis
uuguuucuguaggagagaau

SEQ ID NO: 2505214 - RNA, 13 nt, Chlamydia trachomatis
uuguuuuuuucaa

SEQ ID NO: 2505215 - RNA, 23 nt, Chlamydia trachomatis
uuuaaaagugagaugcuccucuc

SEQ ID NO: 2505216 - RNA, 23 nt, Chlamydia trachomatis
uuuaaagggggacaaaaauacuu

SEQ ID NO: 2505217 - RNA, 22 nt, Chlamydia trachomatis
uuuaaaguauaauccgagcauu

SEQ ID NO: 2505218 - RNA, 15 nt, Chlamydia trachomatis
uuuaaaucaauuucu

SEQ ID NO: 2505219 - RNA, 14 nt, Chlamydia trachomatis
uuuaaccuuugcau

SEQ ID NO: 2505220 - RNA, 20 nt, Chlamydia trachomatis
uuuaacugggauaagaaauc

SEQ ID NO: 2505221 - RNA, 22 nt, Chlamydia trachomatis
uuuaagaccuaguaagugcaua

SEQ ID NO: 2505222 - RNA, 15 nt, Chlamydia trachomatis
uuuaagaguuuuuug

SEQ ID NO: 2505223 - RNA, 19 nt, Chlamydia trachomatis
uuuaaggacuucaacaaac

SEQ ID NO: 2505224 - RNA, 22 nt, Chlamydia trachomatis
uuuaagguuucuauacgcacau

SEQ ID NO: 2505225 - RNA, 23 nt, Chlamydia trachomatis
uuuaaguccagggaaaagagcua

SEQ ID NO: 2505226 - RNA, 17 nt, Chlamydia trachomatis
uuuaauaaguuuuucaa

SEQ ID NO: 2505227 - RNA, 15 nt, Chlamydia trachomatis
uuuaauaauaaagau

SEQ ID NO: 2505228 - RNA, 14 nt, Chlamydia trachomatis
uuuaauauuuuuug

SEQ ID NO: 2505229 - RNA, 15 nt, Chlamydia trachomatis
uuuaauugagaagua

SEQ ID NO: 2505230 - RNA, 15 nt, Chlamydia trachomatis
uuuacaagucugcua

SEQ ID NO: 2505231 - RNA, 21 nt, Chlamydia trachomatis
uuuacaauguacgcuaaaaac

SEQ ID NO: 2505232 - RNA, 21 nt, Chlamydia trachomatis
uuuacaguuccgcagagaucu

SEQ ID NO: 2505233 - RNA, 23 nt, Chlamydia trachomatis
uuuacaucccuugaacuagaaau

SEQ ID NO: 2505234 - RNA, 14 nt, Chlamydia trachomatis
uuuaccaaaccuuu

SEQ ID NO: 2505235 - RNA, 15 nt, Chlamydia trachomatis
uuuaccaaugaagca

SEQ ID NO: 2505236 - RNA, 19 nt, Chlamydia trachomatis
uuuacgcacaaagauuucu

SEQ ID NO: 2505237 - RNA, 20 nt, Chlamydia trachomatis
uuuacgcauuugcucuucca

SEQ ID NO: 2505238 - RNA, 15 nt, Chlamydia trachomatis
uuuacgcucuuucuu

SEQ ID NO: 2505239 - RNA, 11 nt, Chlamydia trachomatis
uuuacuaucag

SEQ ID NO: 2505240 - RNA, 13 nt, Chlamydia trachomatis
uuuacucuuuucu

SEQ ID NO: 2505241 - RNA, 14 nt, Chlamydia trachomatis
uuuacucuuuucuu

SEQ ID NO: 2505242 - RNA, 17 nt, Chlamydia trachomatis
uuuacuucaaggucuuu

SEQ ID NO: 2505243 - RNA, 14 nt, Chlamydia trachomatis
uuuagaaauugucc

SEQ ID NO: 2505244 - RNA, 22 nt, Chlamydia trachomatis
uuuagaauccaaagucucgaau

SEQ ID NO: 2505245 - RNA, 17 nt, Chlamydia trachomatis
uuuagacaauucagaaa

SEQ ID NO: 2505246 - RNA, 19 nt, Chlamydia trachomatis
uuuagagaguucguuagga

SEQ ID NO: 2505247 - RNA, 17 nt, Chlamydia trachomatis
uuuagauagucuucuac

SEQ ID NO: 2505248 - RNA, 12 nt, Chlamydia trachomatis
uuuagcaucuga

SEQ ID NO: 2505249 - RNA, 23 nt, Chlamydia trachomatis
uuuagcgaucucccguacuuucu

SEQ ID NO: 2505250 - RNA, 15 nt, Chlamydia trachomatis
uuuagcuaguucaga

SEQ ID NO: 2505251 - RNA, 23 nt, Chlamydia trachomatis
uuuaggcuaacuccauaaaaagc

SEQ ID NO: 2505252 - RNA, 18 nt, Chlamydia trachomatis
uuuaguaccauaacaucu

SEQ ID NO: 2505253 - RNA, 15 nt, Chlamydia trachomatis
uuuaguccacagauc

SEQ ID NO: 2505254 - RNA, 13 nt, Chlamydia trachomatis
uuuauaaauuucu

SEQ ID NO: 2505255 - RNA, 16 nt, Chlamydia trachomatis
uuuauaaauuucuaaa

SEQ ID NO: 2505256 - RNA, 18 nt, Chlamydia trachomatis
uuuauccaaaaaagugua

SEQ ID NO: 2505257 - RNA, 14 nt, Chlamydia trachomatis
uuuauccaaagaua

SEQ ID NO: 2505258 - RNA, 15 nt, Chlamydia trachomatis
uuuaucuucaaagaa

SEQ ID NO: 2505259 - RNA, 14 nt, Chlamydia trachomatis
uuuaugaacaacau

SEQ ID NO: 2505260 - RNA, 14 nt, Chlamydia trachomatis
uuuauggaaaagau

SEQ ID NO: 2505261 - RNA, 17 nt, Chlamydia trachomatis
uuuauggaaaagaucuu

SEQ ID NO: 2505262 - RNA, 21 nt, Chlamydia trachomatis
uuuauggaaaagaucuuguuu

SEQ ID NO: 2505263 - RNA, 16 nt, Chlamydia trachomatis
uuuauguaaauauuuu

SEQ ID NO: 2505264 - RNA, 21 nt, Chlamydia trachomatis
uuuauuacgaugaugcugagc

SEQ ID NO: 2505265 - RNA, 13 nt, Chlamydia trachomatis
uuuauucaaaucu

SEQ ID NO: 2505266 - RNA, 21 nt, Chlamydia trachomatis
uuuauuuaaguagaaccacuu

SEQ ID NO: 2505267 - RNA, 20 nt, Chlamydia trachomatis
uuucaaaaauagcaauaauu

SEQ ID NO: 2505268 - RNA, 21 nt, Chlamydia trachomatis
uuucaaaagaaggcuuuucua

SEQ ID NO: 2505269 - RNA, 23 nt, Chlamydia trachomatis
uuucaaagaagcuccuuuaccuu

SEQ ID NO: 2505270 - RNA, 16 nt, Chlamydia trachomatis
uuucaaagagaucugc

SEQ ID NO: 2505271 - RNA, 23 nt, Chlamydia trachomatis
uuucaacgggaacaaaaccaaaa

SEQ ID NO: 2505272 - RNA, 20 nt, Chlamydia trachomatis
uuucaagacguucuuggcua

SEQ ID NO: 2505273 - RNA, 15 nt, Chlamydia trachomatis
uuucaaguucuaacu

SEQ ID NO: 2505274 - RNA, 16 nt, Chlamydia trachomatis
uuucaaugcuucuauu

SEQ ID NO: 2505275 - RNA, 11 nt, Chlamydia trachomatis
uuucacaaccc

SEQ ID NO: 2505276 - RNA, 20 nt, Chlamydia trachomatis
uuucacacauccuucugcua

SEQ ID NO: 2505277 - RNA, 18 nt, Chlamydia trachomatis
uuucaccgacaguuuccc

SEQ ID NO: 2505278 - RNA, 12 nt, Chlamydia trachomatis
uuucagaaaagc

SEQ ID NO: 2505279 - RNA, 22 nt, Chlamydia trachomatis
uuucagagaggcuguaacuaaa

SEQ ID NO: 2505280 - RNA, 23 nt, Chlamydia trachomatis
uuucagagccagcuuuaaagagc

SEQ ID NO: 2505281 - RNA, 14 nt, Chlamydia trachomatis
uuucagcuuuucuu

SEQ ID NO: 2505282 - RNA, 18 nt, Chlamydia trachomatis
uuucagggauagaaacuc

SEQ ID NO: 2505283 - RNA, 21 nt, Chlamydia trachomatis
uuucauaaagagagaggagaa

SEQ ID NO: 2505284 - RNA, 24 nt, Chlamydia trachomatis
uuucauacccuaacgaggcacaaa

SEQ ID NO: 2505285 - RNA, 21 nt, Chlamydia trachomatis
uuucaucaaaauauagacugu

SEQ ID NO: 2505286 - RNA, 23 nt, Chlamydia trachomatis
uuucaucccacaugcuaguuagu

SEQ ID NO: 2505287 - RNA, 22 nt, Chlamydia trachomatis
uuucaucccgguuuugccaucu

SEQ ID NO: 2505288 - RNA, 18 nt, Chlamydia trachomatis
uuucauccuaggggauuu

SEQ ID NO: 2505289 - RNA, 12 nt, Chlamydia trachomatis
uuucaucuccuu

SEQ ID NO: 2505290 - RNA, 14 nt, Chlamydia trachomatis
uuucaucuuccaac

SEQ ID NO: 2505291 - RNA, 13 nt, Chlamydia trachomatis
uuucaugaaaagc

SEQ ID NO: 2505292 - RNA, 14 nt, Chlamydia trachomatis
uuucaugacauuca

SEQ ID NO: 2505293 - RNA, 17 nt, Chlamydia trachomatis
uuucaugcaaguaauuu

SEQ ID NO: 2505294 - RNA, 20 nt, Chlamydia trachomatis
uuucauggcugcaauucuua

SEQ ID NO: 2505295 - RNA, 13 nt, Chlamydia trachomatis
uuucauucuuucg

SEQ ID NO: 2505296 - RNA, 16 nt, Chlamydia trachomatis
uuuccaagaaaaauac

SEQ ID NO: 2505297 - RNA, 16 nt, Chlamydia trachomatis
uuuccaauaucuucag

SEQ ID NO: 2505298 - RNA, 22 nt, Chlamydia trachomatis
uuuccacagguugcaucaacaa

SEQ ID NO: 2505299 - RNA, 20 nt, Chlamydia trachomatis
uuuccagcaggccucuguuu

SEQ ID NO: 2505300 - RNA, 18 nt, Chlamydia trachomatis
uuuccagccucuccagaa

SEQ ID NO: 2505301 - RNA, 21 nt, Chlamydia trachomatis
uuuccagccucuccagaaaaa

SEQ ID NO: 2505302 - RNA, 19 nt, Chlamydia trachomatis
uuuccauaagagaggcuug

SEQ ID NO: 2505303 - RNA, 16 nt, Chlamydia trachomatis
uuuccauauucuugcu

SEQ ID NO: 2505304 - RNA, 18 nt, Chlamydia trachomatis
uuuccauauucuugcuaa

SEQ ID NO: 2505305 - RNA, 15 nt, Chlamydia trachomatis
uuuccauuccuccua

SEQ ID NO: 2505306 - RNA, 17 nt, Chlamydia trachomatis
uuucccccaccuuuucu

SEQ ID NO: 2505307 - RNA, 22 nt, Chlamydia trachomatis
uuucccgcaacuuuucagcaag

SEQ ID NO: 2505308 - RNA, 13 nt, Chlamydia trachomatis
uuucccuauuuuu

SEQ ID NO: 2505309 - RNA, 13 nt, Chlamydia trachomatis
uuucccuucuuuc

SEQ ID NO: 2505310 - RNA, 17 nt, Chlamydia trachomatis
uuucccuucuuucuucu

SEQ ID NO: 2505311 - RNA, 23 nt, Chlamydia trachomatis
uuuccgaagguugaacuagagau

SEQ ID NO: 2505312 - RNA, 18 nt, Chlamydia trachomatis
uuuccgaauaaaaucaaa

SEQ ID NO: 2505313 - RNA, 20 nt, Chlamydia trachomatis
uuuccgaauuaaaucugcuc

SEQ ID NO: 2505314 - RNA, 14 nt, Chlamydia trachomatis
uuuccgagagcgaa

SEQ ID NO: 2505315 - RNA, 19 nt, Chlamydia trachomatis
uuuccuccauaggaauacg

SEQ ID NO: 2505316 - RNA, 23 nt, Chlamydia trachomatis
uuuccuccucccuuuccauacau

SEQ ID NO: 2505317 - RNA, 20 nt, Chlamydia trachomatis
uuuccugaaacgaucagcuc

SEQ ID NO: 2505318 - RNA, 17 nt, Chlamydia trachomatis
uuuccuguucccauuuu

SEQ ID NO: 2505319 - RNA, 22 nt, Chlamydia trachomatis
uuuccuuagaaagaauuugcuu

SEQ ID NO: 2505320 - RNA, 13 nt, Chlamydia trachomatis
uuuccuuauaguu

SEQ ID NO: 2505321 - RNA, 14 nt, Chlamydia trachomatis
uuucgaacaaaacu

SEQ ID NO: 2505322 - RNA, 15 nt, Chlamydia trachomatis
uuucgaacaaaacuu

SEQ ID NO: 2505323 - RNA, 19 nt, Chlamydia trachomatis
uuucgaauuggaucucccu

SEQ ID NO: 2505324 - RNA, 17 nt, Chlamydia trachomatis
uuucgaauuuuuuucuu

SEQ ID NO: 2505325 - RNA, 15 nt, Chlamydia trachomatis
uuucguaguuuucuu

SEQ ID NO: 2505326 - RNA, 15 nt, Chlamydia trachomatis
uuucuaaaaaacuuu

SEQ ID NO: 2505327 - RNA, 11 nt, Chlamydia trachomatis
uuucuaaaauc

SEQ ID NO: 2505328 - RNA, 12 nt, Chlamydia trachomatis
uuucuaaaauuu

SEQ ID NO: 2505329 - RNA, 13 nt, Chlamydia trachomatis
uuucuaauuuccc

SEQ ID NO: 2505330 - RNA, 19 nt, Chlamydia trachomatis
uuucuagccaauccguaug

SEQ ID NO: 2505331 - RNA, 18 nt, Chlamydia trachomatis
uuucuauacagcaucacg

SEQ ID NO: 2505332 - RNA, 18 nt, Chlamydia trachomatis
uuucucgauucucuugca

SEQ ID NO: 2505333 - RNA, 15 nt, Chlamydia trachomatis
uuucucuaacaauga

SEQ ID NO: 2505334 - RNA, 21 nt, Chlamydia trachomatis
uuucucuacccaggcuuuucu

SEQ ID NO: 2505335 - RNA, 22 nt, Chlamydia trachomatis
uuucucuacccaggcuuuucuu

SEQ ID NO: 2505336 - RNA, 14 nt, Chlamydia trachomatis
uuucucuagaauuu

SEQ ID NO: 2505337 - RNA, 20 nt, Chlamydia trachomatis
uuucugaguccucuaaagua

SEQ ID NO: 2505338 - RNA, 14 nt, Chlamydia trachomatis
uuucugcagagagc

SEQ ID NO: 2505339 - RNA, 23 nt, Chlamydia trachomatis
uuucugcagagaucauaccaaua

SEQ ID NO: 2505340 - RNA, 17 nt, Chlamydia trachomatis
uuucugcagagcacaaa

SEQ ID NO: 2505341 - RNA, 13 nt, Chlamydia trachomatis
uuucugcuccaaa

SEQ ID NO: 2505342 - RNA, 19 nt, Chlamydia trachomatis
uuucuggcgaaugcccuuu

SEQ ID NO: 2505343 - RNA, 21 nt, Chlamydia trachomatis
uuucugggucauagaaaaugg

SEQ ID NO: 2505344 - RNA, 16 nt, Chlamydia trachomatis
uuucuguuugucccac

SEQ ID NO: 2505345 - RNA, 14 nt, Chlamydia trachomatis
uuucuguuuucguu

SEQ ID NO: 2505346 - RNA, 23 nt, Chlamydia trachomatis
uuucuguuuucguuuaucuaauu

SEQ ID NO: 2505347 - RNA, 13 nt, Chlamydia trachomatis
uuucuuacuccuu

SEQ ID NO: 2505348 - RNA, 17 nt, Chlamydia trachomatis
uuucuuaggaacucccu

SEQ ID NO: 2505349 - RNA, 19 nt, Chlamydia trachomatis
uuucuuaggaacucccuca

SEQ ID NO: 2505350 - RNA, 17 nt, Chlamydia trachomatis
uuucuuccagacaaaaa

SEQ ID NO: 2505351 - RNA, 15 nt, Chlamydia trachomatis
uuucuuccagagcau

SEQ ID NO: 2505352 - RNA, 22 nt, Chlamydia trachomatis
uuucuuccaucacuccaagaag

SEQ ID NO: 2505353 - RNA, 12 nt, Chlamydia trachomatis
uuucuuccucag

SEQ ID NO: 2505354 - RNA, 20 nt, Chlamydia trachomatis
uuucuuccugcuucaaaaaa

SEQ ID NO: 2505355 - RNA, 16 nt, Chlamydia trachomatis
uuucuucuaagaaguu

SEQ ID NO: 2505356 - RNA, 18 nt, Chlamydia trachomatis
uuucuucuguuuuuucag

SEQ ID NO: 2505357 - RNA, 19 nt, Chlamydia trachomatis
uuucuugaggaagauaagu

SEQ ID NO: 2505358 - RNA, 13 nt, Chlamydia trachomatis
uuucuugaggagg

SEQ ID NO: 2505359 - RNA, 19 nt, Chlamydia trachomatis
uuucuugugauaucuccac

SEQ ID NO: 2505360 - RNA, 19 nt, Chlamydia trachomatis
uuugaaacaucuuuuaaag

SEQ ID NO: 2505361 - RNA, 23 nt, Chlamydia trachomatis
uuugaauacgauccucuggauau

SEQ ID NO: 2505362 - RNA, 22 nt, Chlamydia trachomatis
uuugacuaggauuacagcaaga

SEQ ID NO: 2505363 - RNA, 22 nt, Chlamydia trachomatis
uuugacucucauaagaauacaa

SEQ ID NO: 2505364 - RNA, 19 nt, Chlamydia trachomatis
uuugagaaaguuaaagaau

SEQ ID NO: 2505365 - RNA, 14 nt, Chlamydia trachomatis
uuugaggcucucua

SEQ ID NO: 2505366 - RNA, 18 nt, Chlamydia trachomatis
uuugauaauacucuucua

SEQ ID NO: 2505367 - RNA, 17 nt, Chlamydia trachomatis
uuugauacaauuccugc

SEQ ID NO: 2505368 - RNA, 16 nt, Chlamydia trachomatis
uuugauagauuugccu

SEQ ID NO: 2505369 - RNA, 15 nt, Chlamydia trachomatis
uuugauagcaacagu

SEQ ID NO: 2505370 - RNA, 12 nt, Chlamydia trachomatis
uuugauagcuuc

SEQ ID NO: 2505371 - RNA, 15 nt, Chlamydia trachomatis
uuugauagcuucaua

SEQ ID NO: 2505372 - RNA, 18 nt, Chlamydia trachomatis
uuugauaucccccuucug

SEQ ID NO: 2505373 - RNA, 19 nt, Chlamydia trachomatis
uuugauaucccccuucugg

SEQ ID NO: 2505374 - RNA, 16 nt, Chlamydia trachomatis
uuugaucuguaaaaau

SEQ ID NO: 2505375 - RNA, 19 nt, Chlamydia trachomatis
uuugaucuuuguucucuaa

SEQ ID NO: 2505376 - RNA, 21 nt, Chlamydia trachomatis
uuugaugagcuuuauugaacc

SEQ ID NO: 2505377 - RNA, 19 nt, Chlamydia trachomatis
uuugaugccacugacucuc

SEQ ID NO: 2505378 - RNA, 15 nt, Chlamydia trachomatis
uuugauucugcuuug

SEQ ID NO: 2505379 - RNA, 15 nt, Chlamydia trachomatis
uuugauuucugcaga

SEQ ID NO: 2505380 - RNA, 20 nt, Chlamydia trachomatis
uuugcacaaaaaaaaagagg

SEQ ID NO: 2505381 - RNA, 12 nt, Chlamydia trachomatis
uuugcacaagau

SEQ ID NO: 2505382 - RNA, 16 nt, Chlamydia trachomatis
uuugcacaagauacaa

SEQ ID NO: 2505383 - RNA, 17 nt, Chlamydia trachomatis
uuugcagaagcuccaaa

SEQ ID NO: 2505384 - RNA, 23 nt, Chlamydia trachomatis
uuugcagaagcuccaaagaacag

SEQ ID NO: 2505385 - RNA, 18 nt, Chlamydia trachomatis
uuugcauguaaucccuuu

SEQ ID NO: 2505386 - RNA, 18 nt, Chlamydia trachomatis
uuugcauuuccauagaaa

SEQ ID NO: 2505387 - RNA, 21 nt, Chlamydia trachomatis
uuugcauuuccauagaaagau

SEQ ID NO: 2505388 - RNA, 13 nt, Chlamydia trachomatis
uuugccaaugaaa

SEQ ID NO: 2505389 - RNA, 13 nt, Chlamydia trachomatis
uuuggaagaucuc

SEQ ID NO: 2505390 - RNA, 20 nt, Chlamydia trachomatis
uuuggaucucuuagacccuc

SEQ ID NO: 2505391 - RNA, 21 nt, Chlamydia trachomatis
uuuggcucuuuaauauuuccc

SEQ ID NO: 2505392 - RNA, 18 nt, Chlamydia trachomatis
uuugggaaaaaauuaaca

SEQ ID NO: 2505393 - RNA, 17 nt, Chlamydia trachomatis
uuugggauagauagcuc

SEQ ID NO: 2505394 - RNA, 17 nt, Chlamydia trachomatis
uuugguaagaucucuac

SEQ ID NO: 2505395 - RNA, 19 nt, Chlamydia trachomatis
uuugguaagaucucuacau

SEQ ID NO: 2505396 - RNA, 23 nt, Chlamydia trachomatis
uuuguaguugcgccuucugcuga

SEQ ID NO: 2505397 - RNA, 17 nt, Chlamydia trachomatis
uuugucccgugcuugcu

SEQ ID NO: 2505398 - RNA, 22 nt, Chlamydia trachomatis
uuugucccgugcuugcuuucuu

SEQ ID NO: 2505399 - RNA, 17 nt, Chlamydia trachomatis
uuuguccuggccaaaaa

SEQ ID NO: 2505400 - RNA, 21 nt, Chlamydia trachomatis
uuuguccuggccaaaaaauca

SEQ ID NO: 2505401 - RNA, 22 nt, Chlamydia trachomatis
uuuguccuggccaaaaaaucag

SEQ ID NO: 2505402 - RNA, 15 nt, Chlamydia trachomatis
uuuguguagcuuuuc

SEQ ID NO: 2505403 - RNA, 22 nt, Chlamydia trachomatis
uuuguuaagaauuaacccaaaa

SEQ ID NO: 2505404 - RNA, 15 nt, Chlamydia trachomatis
uuuguuccagaaaaa

SEQ ID NO: 2505405 - RNA, 16 nt, Chlamydia trachomatis
uuuguuccagaaaaaa

SEQ ID NO: 2505406 - RNA, 23 nt, Chlamydia trachomatis
uuuguuccauguauucuccuuuu

SEQ ID NO: 2505407 - RNA, 13 nt, Chlamydia trachomatis
uuuguucguaaug

SEQ ID NO: 2505408 - RNA, 17 nt, Chlamydia trachomatis
uuuguucucuaaagauu

SEQ ID NO: 2505409 - RNA, 13 nt, Chlamydia trachomatis
uuuuaaaaggcuu

SEQ ID NO: 2505410 - RNA, 14 nt, Chlamydia trachomatis
uuuuaaaaucuccu

SEQ ID NO: 2505411 - RNA, 20 nt, Chlamydia trachomatis
uuuuaaagggggacaaaaau

SEQ ID NO: 2505412 - RNA, 23 nt, Chlamydia trachomatis
uuuuaaagggggacaaaaauacu

SEQ ID NO: 2505413 - RNA, 22 nt, Chlamydia trachomatis
uuuuaacuucccacucauccua

SEQ ID NO: 2505414 - RNA, 22 nt, Chlamydia trachomatis
uuuuaagaccuaguaagugcau

SEQ ID NO: 2505415 - RNA, 19 nt, Chlamydia trachomatis
uuuuaagaguuuuuugaau

SEQ ID NO: 2505416 - RNA, 15 nt, Chlamydia trachomatis
uuuuaauaagaccuc

SEQ ID NO: 2505417 - RNA, 17 nt, Chlamydia trachomatis
uuuuaauaggcccguuu

SEQ ID NO: 2505418 - RNA, 15 nt, Chlamydia trachomatis
uuuuacaagggccac

SEQ ID NO: 2505419 - RNA, 23 nt, Chlamydia trachomatis
uuuuacaauguacgcuaaaaacu

SEQ ID NO: 2505420 - RNA, 20 nt, Chlamydia trachomatis
uuuuaccguuccaucuucca

SEQ ID NO: 2505421 - RNA, 16 nt, Chlamydia trachomatis
uuuuacgcucuuucuu

SEQ ID NO: 2505422 - RNA, 16 nt, Chlamydia trachomatis
uuuuagaaugguucuu

SEQ ID NO: 2505423 - RNA, 15 nt, Chlamydia trachomatis
uuuuagagaaaagaa

SEQ ID NO: 2505424 - RNA, 19 nt, Chlamydia trachomatis
uuuuagcaaauaauagcuu

SEQ ID NO: 2505425 - RNA, 12 nt, Chlamydia trachomatis
uuuuagcaucug

SEQ ID NO: 2505426 - RNA, 20 nt, Chlamydia trachomatis
uuuuaggauucauauuccaa

SEQ ID NO: 2505427 - RNA, 20 nt, Chlamydia trachomatis
uuuuaggcguuccugcauac

SEQ ID NO: 2505428 - RNA, 21 nt, Chlamydia trachomatis
uuuuaguaccauaacaucuaa

SEQ ID NO: 2505429 - RNA, 13 nt, Chlamydia trachomatis
uuuuauaaucucc

SEQ ID NO: 2505430 - RNA, 15 nt, Chlamydia trachomatis
uuuuauccaaaaaag

SEQ ID NO: 2505431 - RNA, 19 nt, Chlamydia trachomatis
uuuuaugggugaagaagga

SEQ ID NO: 2505432 - RNA, 17 nt, Chlamydia trachomatis
uuuuauguaaauauuuu

SEQ ID NO: 2505433 - RNA, 17 nt, Chlamydia trachomatis
uuuuauucaaaucuucu

SEQ ID NO: 2505434 - RNA, 13 nt, Chlamydia trachomatis
uuuuauucaccca

SEQ ID NO: 2505435 - RNA, 12 nt, Chlamydia trachomatis
uuuuauucuuca

SEQ ID NO: 2505436 - RNA, 18 nt, Chlamydia trachomatis
uuuucaaaaauagcaaua

SEQ ID NO: 2505437 - RNA, 23 nt, Chlamydia trachomatis
uuuucaccagcaaaagaaaaauc

SEQ ID NO: 2505438 - RNA, 17 nt, Chlamydia trachomatis
uuuucagaaaaaguaag

SEQ ID NO: 2505439 - RNA, 20 nt, Chlamydia trachomatis
uuuucagacaaaaagccuaa

SEQ ID NO: 2505440 - RNA, 14 nt, Chlamydia trachomatis
uuuucagcuuuucu

SEQ ID NO: 2505441 - RNA, 15 nt, Chlamydia trachomatis
uuuucauaaagagag

SEQ ID NO: 2505442 - RNA, 14 nt, Chlamydia trachomatis
uuuucauauaguuu

SEQ ID NO: 2505443 - RNA, 13 nt, Chlamydia trachomatis
uuuucauccacuu

SEQ ID NO: 2505444 - RNA, 16 nt, Chlamydia trachomatis
uuuuccauuccuccua

SEQ ID NO: 2505445 - RNA, 19 nt, Chlamydia trachomatis
uuuucccacaaacaaaaaa

SEQ ID NO: 2505446 - RNA, 17 nt, Chlamydia trachomatis
uuuucccaucuacaaaa

SEQ ID NO: 2505447 - RNA, 10 nt, Chlamydia trachomatis
uuuuccccuu

SEQ ID NO: 2505448 - RNA, 17 nt, Chlamydia trachomatis
uuuucccuagaaaaucu

SEQ ID NO: 2505449 - RNA, 19 nt, Chlamydia trachomatis
uuuuccgaauucuuucauu

SEQ ID NO: 2505450 - RNA, 20 nt, Chlamydia trachomatis
uuuuccgcacccaaucuucu

SEQ ID NO: 2505451 - RNA, 23 nt, Chlamydia trachomatis
uuuuccugaaacgaucagcuccu

SEQ ID NO: 2505452 - RNA, 20 nt, Chlamydia trachomatis
uuuucgcuauccccaucucu

SEQ ID NO: 2505453 - RNA, 21 nt, Chlamydia trachomatis
uuuucgcuaucuucaauccac

SEQ ID NO: 2505454 - RNA, 22 nt, Chlamydia trachomatis
uuuucggaaggcgaauucuuug

SEQ ID NO: 2505455 - RNA, 18 nt, Chlamydia trachomatis
uuuucggugaggaaggcu

SEQ ID NO: 2505456 - RNA, 17 nt, Chlamydia trachomatis
uuuucguagacagagaa

SEQ ID NO: 2505457 - RNA, 13 nt, Chlamydia trachomatis
uuuucguuuugaa

SEQ ID NO: 2505458 - RNA, 12 nt, Chlamydia trachomatis
uuuucuaaaauc

SEQ ID NO: 2505459 - RNA, 18 nt, Chlamydia trachomatis
uuuucuaacguuccuccu

SEQ ID NO: 2505460 - RNA, 20 nt, Chlamydia trachomatis
uuuucuacaacuaucagaag

SEQ ID NO: 2505461 - RNA, 21 nt, Chlamydia trachomatis
uuuucuacaacuaucagaaga

SEQ ID NO: 2505462 - RNA, 15 nt, Chlamydia trachomatis
uuuucucuaauaguu

SEQ ID NO: 2505463 - RNA, 11 nt, Chlamydia trachomatis
uuuucucuuga

SEQ ID NO: 2505464 - RNA, 12 nt, Chlamydia trachomatis
uuuucugagacu

SEQ ID NO: 2505465 - RNA, 12 nt, Chlamydia trachomatis
uuuucugcucca

SEQ ID NO: 2505466 - RNA, 15 nt, Chlamydia trachomatis
uuuucugcuccaaag

SEQ ID NO: 2505467 - RNA, 12 nt, Chlamydia trachomatis
uuuucuuauaaa

SEQ ID NO: 2505468 - RNA, 22 nt, Chlamydia trachomatis
uuuucuuccugcuucaaaaaag

SEQ ID NO: 2505469 - RNA, 15 nt, Chlamydia trachomatis
uuuucuucuuuuucu

SEQ ID NO: 2505470 - RNA, 22 nt, Chlamydia trachomatis
uuuucuucuuuuuuacauaauc

SEQ ID NO: 2505471 - RNA, 19 nt, Chlamydia trachomatis
uuuucuuucaaagagaucu

SEQ ID NO: 2505472 - RNA, 15 nt, Chlamydia trachomatis
uuuugaaauuccguu

SEQ ID NO: 2505473 - RNA, 22 nt, Chlamydia trachomatis
uuuugaagaagaucuguaacua

SEQ ID NO: 2505474 - RNA, 18 nt, Chlamydia trachomatis
uuuugagcaaaauaguca

SEQ ID NO: 2505475 - RNA, 13 nt, Chlamydia trachomatis
uuuugauuauaaa

SEQ ID NO: 2505476 - RNA, 21 nt, Chlamydia trachomatis
uuuugcaaucauuugugugcc

SEQ ID NO: 2505477 - RNA, 14 nt, Chlamydia trachomatis
uuuugcacaaaaaa

SEQ ID NO: 2505478 - RNA, 18 nt, Chlamydia trachomatis
uuuugcacaaaggaacau

SEQ ID NO: 2505479 - RNA, 22 nt, Chlamydia trachomatis
uuuugcuaaccaaacaggagau

SEQ ID NO: 2505480 - RNA, 18 nt, Chlamydia trachomatis
uuuugguguggaguaucu

SEQ ID NO: 2505481 - RNA, 15 nt, Chlamydia trachomatis
uuuuguuauccaaaa

SEQ ID NO: 2505482 - RNA, 18 nt, Chlamydia trachomatis
uuuuuaauaauaaagaua

SEQ ID NO: 2505483 - RNA, 13 nt, Chlamydia trachomatis
uuuuuaauuuucu

SEQ ID NO: 2505484 - RNA, 22 nt, Chlamydia trachomatis
uuuuuacgcauuugcucuucca

SEQ ID NO: 2505485 - RNA, 19 nt, Chlamydia trachomatis
uuuuuagcaaccuuaucuu

SEQ ID NO: 2505486 - RNA, 20 nt, Chlamydia trachomatis
uuuuuagcaucugauacuga

SEQ ID NO: 2505487 - RNA, 22 nt, Chlamydia trachomatis
uuuuuaggauucauauuccaaa

SEQ ID NO: 2505488 - RNA, 19 nt, Chlamydia trachomatis
uuuuuaguaccauaacauc

SEQ ID NO: 2505489 - RNA, 14 nt, Chlamydia trachomatis
uuuuuauaaucucc

SEQ ID NO: 2505490 - RNA, 13 nt, Chlamydia trachomatis
uuuuuauccaaaa

SEQ ID NO: 2505491 - RNA, 12 nt, Chlamydia trachomatis
uuuuucaaaaau

SEQ ID NO: 2505492 - RNA, 22 nt, Chlamydia trachomatis
uuuuucaggagaaaggcuuugu

SEQ ID NO: 2505493 - RNA, 22 nt, Chlamydia trachomatis
uuuuuccuacgcgaaucacaug

SEQ ID NO: 2505494 - RNA, 21 nt, Chlamydia trachomatis
uuuuucggaaggcgaauucuu

SEQ ID NO: 2505495 - RNA, 19 nt, Chlamydia trachomatis
uuuuucguuuugaagaaga

SEQ ID NO: 2505496 - RNA, 13 nt, Chlamydia trachomatis
uuuuucugcuaga

SEQ ID NO: 2505497 - RNA, 12 nt, Chlamydia trachomatis
uuuuucugcucc

SEQ ID NO: 2505498 - RNA, 18 nt, Chlamydia trachomatis
uuuuucuucucuagcaug

SEQ ID NO: 2505499 - RNA, 12 nt, Chlamydia trachomatis
uuuuucuucuuu

SEQ ID NO: 2505500 - RNA, 15 nt, Chlamydia trachomatis
uuuuugacauucugc

SEQ ID NO: 2505501 - RNA, 18 nt, Chlamydia trachomatis
uuuuugggaaaaaauuaa

SEQ ID NO: 2505502 - RNA, 16 nt, Chlamydia trachomatis
uuuuuguuuuuuucaa

SEQ ID NO: 2505503 - RNA, 13 nt, Chlamydia trachomatis
uuuuuuauccaaa

SEQ ID NO: 2505504 - RNA, 13 nt, Chlamydia trachomatis
uuuuuucugcaau

SEQ ID NO: 2505505 - RNA, 21 nt, Chlamydia trachomatis
uuuuuuguuuccauuaaacua

SEQ ID NO: 2505506 - RNA, 11 nt, Chlamydia trachomatis
uuuuuuuauuc

SEQ ID NO: 2505507 - RNA, 19 nt, Chlamydia trachomatis
uuuuuuugugcaaaaagca

SEQ ID NO: 2505508 - RNA, 23 nt, Chlamydia trachomatis
guuguuucuaauggaugaucugu

SEQ ID NO: 2505509 - RNA, 23 nt, Chlamydia trachomatis
guuuaaccuuugcauuuaaauga

SEQ ID NO: 2505510 - RNA, 13 nt, Chlamydia trachomatis
guuuaauauuuuu

SEQ ID NO: 2505511 - RNA, 13 nt, Chlamydia trachomatis
guuuaauuccuug

SEQ ID NO: 2505512 - RNA, 15 nt, Chlamydia trachomatis
guuuacaaaugauuu

SEQ ID NO: 2505513 - RNA, 13 nt, Chlamydia trachomatis
guuuagaggagaa

SEQ ID NO: 2505514 - RNA, 13 nt, Chlamydia trachomatis
guuuagauguugu

SEQ ID NO: 2505515 - RNA, 14 nt, Chlamydia trachomatis
guuuagcaagacau

SEQ ID NO: 2505516 - RNA, 14 nt, Chlamydia trachomatis
guuuagcagccuga

SEQ ID NO: 2505517 - RNA, 20 nt, Chlamydia trachomatis
guuuagccuccaucucugcu

SEQ ID NO: 2505518 - RNA, 17 nt, Chlamydia trachomatis
guuuaggcggcauuuua

SEQ ID NO: 2505519 - RNA, 17 nt, Chlamydia trachomatis
guuuauaaauuucuaaa

SEQ ID NO: 2505520 - RNA, 23 nt, Chlamydia trachomatis
guuuauaaauuucuaaauauuua

SEQ ID NO: 2505521 - RNA, 20 nt, Chlamydia trachomatis
guuuaucauugaaaucagaa

SEQ ID NO: 2505522 - RNA, 22 nt, Chlamydia trachomatis
guuuauuaucuagaaaagagca

SEQ ID NO: 2505523 - RNA, 14 nt, Chlamydia trachomatis
guuuauuccaaccu

SEQ ID NO: 2505524 - RNA, 22 nt, Chlamydia trachomatis
guuuauuuuccgaauaaaauca

SEQ ID NO: 2505525 - RNA, 21 nt, Chlamydia trachomatis
guuucaaacauccaguaauuu

SEQ ID NO: 2505526 - RNA, 22 nt, Chlamydia trachomatis
guuucagagaggcuguaacuaa

SEQ ID NO: 2505527 - RNA, 19 nt, Chlamydia trachomatis
guuucagcgguugccuuac

SEQ ID NO: 2505528 - RNA, 20 nt, Chlamydia trachomatis
guuuccauuaaacuaugcaa

SEQ ID NO: 2505529 - RNA, 23 nt, Chlamydia trachomatis
guuucccaaaauuuuucugcucc

SEQ ID NO: 2505530 - RNA, 16 nt, Chlamydia trachomatis
guuucccuucuuucuu

SEQ ID NO: 2505531 - RNA, 12 nt, Chlamydia trachomatis
guuucuaaaaaa

SEQ ID NO: 2505532 - RNA, 14 nt, Chlamydia trachomatis
guuucuaaaauuuu

SEQ ID NO: 2505533 - RNA, 13 nt, Chlamydia trachomatis
guuucuacuuuuu

SEQ ID NO: 2505534 - RNA, 21 nt, Chlamydia trachomatis
guuucuacuuuuugacauucu

SEQ ID NO: 2505535 - RNA, 17 nt, Chlamydia trachomatis
guuucuaggucugaaga

SEQ ID NO: 2505536 - RNA, 20 nt, Chlamydia trachomatis
guuucugagaaaucuaaaac

SEQ ID NO: 2505537 - RNA, 17 nt, Chlamydia trachomatis
guuucuggaaaaucuuu

SEQ ID NO: 2505538 - RNA, 16 nt, Chlamydia trachomatis
guuucuucccuuuuuu

SEQ ID NO: 2505539 - RNA, 19 nt, Chlamydia trachomatis
guuucuucccuuuuuucug

SEQ ID NO: 2505540 - RNA, 16 nt, Chlamydia trachomatis
guuucuucuuuugaga

SEQ ID NO: 2505541 - RNA, 22 nt, Chlamydia trachomatis
guuucuugcugggagauagcuc

SEQ ID NO: 2505542 - RNA, 23 nt, Chlamydia trachomatis
guuucuugcugggagauagcucg

SEQ ID NO: 2505543 - RNA, 24 nt, Chlamydia trachomatis
guuugaucaccggaccuccucuuc

SEQ ID NO: 2505544 - RNA, 20 nt, Chlamydia trachomatis
guuugcacaagauacaaggc

SEQ ID NO: 2505545 - RNA, 15 nt, Chlamydia trachomatis
guuuggagaauugga

SEQ ID NO: 2505546 - RNA, 18 nt, Chlamydia trachomatis
guuuggauaagaacuucu

SEQ ID NO: 2505547 - RNA, 21 nt, Chlamydia trachomatis
guuugguuuuuuuuguuaucc

SEQ ID NO: 2505548 - RNA, 14 nt, Chlamydia trachomatis
guuuguguuucuaa

SEQ ID NO: 2505549 - RNA, 15 nt, Chlamydia trachomatis
guuuguuuuuuucaa

SEQ ID NO: 2505550 - RNA, 14 nt, Chlamydia trachomatis
guuuucacuagggu

SEQ ID NO: 2505551 - RNA, 23 nt, Chlamydia trachomatis
guuuuccugaaacgaucagcucc

SEQ ID NO: 2505552 - RNA, 12 nt, Chlamydia trachomatis
guuuucgaauuu

SEQ ID NO: 2505553 - RNA, 21 nt, Chlamydia trachomatis
guuuucgaauuuuuuucuuug

SEQ ID NO: 2505554 - RNA, 22 nt, Chlamydia trachomatis
guuuucgacggaacucuuuauu

SEQ ID NO: 2505555 - RNA, 18 nt, Chlamydia trachomatis
guuuucggagaagaagag

SEQ ID NO: 2505556 - RNA, 20 nt, Chlamydia trachomatis
guuuucucuugaaaaaacca

SEQ ID NO: 2505557 - RNA, 21 nt, Chlamydia trachomatis
guuuucuguugcacuuuccgu

SEQ ID NO: 2505558 - RNA, 19 nt, Chlamydia trachomatis
guuuucuugugauaucucc

SEQ ID NO: 2505559 - RNA, 21 nt, Chlamydia trachomatis
guuuucuugugauaucuccac

SEQ ID NO: 2505560 - RNA, 17 nt, Chlamydia trachomatis
guuuucuuguucuuuua

SEQ ID NO: 2505561 - RNA, 15 nt, Chlamydia trachomatis
guuuugaagaagauc

SEQ ID NO: 2505562 - RNA, 19 nt, Chlamydia trachomatis
guuuugaggaagaaauguu

SEQ ID NO: 2505563 - RNA, 19 nt, Chlamydia trachomatis
guuuuguguuuccaaagcu

SEQ ID NO: 2505564 - RNA, 20 nt, Chlamydia trachomatis
guuuuguucguaaugaugua

SEQ ID NO: 2505565 - RNA, 21 nt, Chlamydia trachomatis
guuuuucagauaucugcccgc

SEQ ID NO: 2505566 - RNA, 10 nt, Chlamydia trachomatis
guuuuuguuu

SEQ ID NO: 2505567 - RNA, 18 nt, Chlamydia trachomatis
uaaaaaaagucuguuccu

SEQ ID NO: 2505568 - RNA, 17 nt, Chlamydia trachomatis
uaaaaaaauucuugcca

SEQ ID NO: 2505569 - RNA, 16 nt, Chlamydia trachomatis
uaaaaacgcuccaaau

SEQ ID NO: 2505570 - RNA, 14 nt, Chlamydia trachomatis
uaaaaacuggagaa

SEQ ID NO: 2505571 - RNA, 15 nt, Chlamydia trachomatis
uaaaaagaaacaaaa

SEQ ID NO: 2505572 - RNA, 16 nt, Chlamydia trachomatis
uaaaaagccaagagaa

SEQ ID NO: 2505573 - RNA, 15 nt, Chlamydia trachomatis
uaaaaagccauacaa

SEQ ID NO: 2505574 - RNA, 17 nt, Chlamydia trachomatis
uaaaaagcccagaacaa

SEQ ID NO: 2505575 - RNA, 21 nt, Chlamydia trachomatis
uaaaaagcccuuuccucauaa

SEQ ID NO: 2505576 - RNA, 18 nt, Chlamydia trachomatis
uaaaaagcugggcagcaa

SEQ ID NO: 2505577 - RNA, 22 nt, Chlamydia trachomatis
uaaaaagcugggcagcaagaga

SEQ ID NO: 2505578 - RNA, 21 nt, Chlamydia trachomatis
uaaaaaggcuagagauaucac

SEQ ID NO: 2505579 - RNA, 14 nt, Chlamydia trachomatis
uaaaaauagaaaac

SEQ ID NO: 2505580 - RNA, 15 nt, Chlamydia trachomatis
uaaaaauagaaaacg

SEQ ID NO: 2505581 - RNA, 13 nt, Chlamydia trachomatis
uaaaaaugcuugc

SEQ ID NO: 2505582 - RNA, 20 nt, Chlamydia trachomatis
uaaaaauuccauguugucau

SEQ ID NO: 2505583 - RNA, 14 nt, Chlamydia trachomatis
uaaaacaaccauaa

SEQ ID NO: 2505584 - RNA, 16 nt, Chlamydia trachomatis
uaaaacaaccauaaua

SEQ ID NO: 2505585 - RNA, 13 nt, Chlamydia trachomatis
uaaaacaauuucc

SEQ ID NO: 2505586 - RNA, 16 nt, Chlamydia trachomatis
uaaaacaauuuccuua

SEQ ID NO: 2505587 - RNA, 15 nt, Chlamydia trachomatis
uaaaacgaaaaacag

SEQ ID NO: 2505588 - RNA, 17 nt, Chlamydia trachomatis
uaaaacgaaaaacagaa

SEQ ID NO: 2505589 - RNA, 16 nt, Chlamydia trachomatis
uaaaacuacagaaaga

SEQ ID NO: 2505590 - RNA, 17 nt, Chlamydia trachomatis
uaaaacuacagaaagag

SEQ ID NO: 2505591 - RNA, 18 nt, Chlamydia trachomatis
uaaaacuacagaaagagu

SEQ ID NO: 2505592 - RNA, 19 nt, Chlamydia trachomatis
uaaaacuacagaaagaguc

SEQ ID NO: 2505593 - RNA, 19 nt, Chlamydia trachomatis
uaaaacuaccugauagagu

SEQ ID NO: 2505594 - RNA, 19 nt, Chlamydia trachomatis
uaaaagacagaacaaacga

SEQ ID NO: 2505595 - RNA, 20 nt, Chlamydia trachomatis
uaaaagacagaacaaacgaa

SEQ ID NO: 2505596 - RNA, 22 nt, Chlamydia trachomatis
uaaaagagaagaacccucuuca

SEQ ID NO: 2505597 - RNA, 17 nt, Chlamydia trachomatis
uaaaagagcuucuucua

SEQ ID NO: 2505598 - RNA, 21 nt, Chlamydia trachomatis
uaaaagagcuucuucuaaaga

SEQ ID NO: 2505599 - RNA, 13 nt, Chlamydia trachomatis
uaaaagaguaagu

SEQ ID NO: 2505600 - RNA, 15 nt, Chlamydia trachomatis
uaaaagaguuucuuu

SEQ ID NO: 2505601 - RNA, 23 nt, Chlamydia trachomatis
uaaaagccauagccaucaguccu

SEQ ID NO: 2505602 - RNA, 22 nt, Chlamydia trachomatis
uaaaagcugcuuuauccaaaga

SEQ ID NO: 2505603 - RNA, 23 nt, Chlamydia trachomatis
uaaaagcugcuuuauccaaagau

SEQ ID NO: 2505604 - RNA, 16 nt, Chlamydia trachomatis
uaaaagcuguaugcca

SEQ ID NO: 2505605 - RNA, 18 nt, Chlamydia trachomatis
uaaaagcuguaugccaau

SEQ ID NO: 2505606 - RNA, 17 nt, Chlamydia trachomatis
uaaaagggcucucuccu

SEQ ID NO: 2505607 - RNA, 17 nt, Chlamydia trachomatis
uaaaaggguagaaaaag

SEQ ID NO: 2505608 - RNA, 18 nt, Chlamydia trachomatis
uaaaaguaguccuaucac

SEQ ID NO: 2505609 - RNA, 15 nt, Chlamydia trachomatis
uaaaagucucuaaag

SEQ ID NO: 2505610 - RNA, 14 nt, Chlamydia trachomatis
uaaaaguugcucuu

SEQ ID NO: 2505611 - RNA, 12 nt, Chlamydia trachomatis
uaaaauaaucuu

SEQ ID NO: 2505612 - RNA, 13 nt, Chlamydia trachomatis
uaaaauaaucuug

SEQ ID NO: 2505613 - RNA, 17 nt, Chlamydia trachomatis
uaaaauaucauccgcua

SEQ ID NO: 2505614 - RNA, 15 nt, Chlamydia trachomatis
uaaaaucacuuucug

SEQ ID NO: 2505615 - RNA, 19 nt, Chlamydia trachomatis
uaaaaucagcgaguagagc

SEQ ID NO: 2505616 - RNA, 22 nt, Chlamydia trachomatis
uaaaauccuucugccucuuuua

SEQ ID NO: 2505617 - RNA, 14 nt, Chlamydia trachomatis
uaaaaucuaaaaua

SEQ ID NO: 2505618 - RNA, 14 nt, Chlamydia trachomatis
uaaaaucuccucga

SEQ ID NO: 2505619 - RNA, 17 nt, Chlamydia trachomatis
uaaaaucuccucgagau

SEQ ID NO: 2505620 - RNA, 12 nt, Chlamydia trachomatis
uaaaaugagaaa

SEQ ID NO: 2505621 - RNA, 23 nt, Chlamydia trachomatis
uaaaaugagaaauaaaaaccuug

SEQ ID NO: 2505622 - RNA, 14 nt, Chlamydia trachomatis
uaaaaugcaaagcu

SEQ ID NO: 2505623 - RNA, 13 nt, Chlamydia trachomatis
uaaaauggaaaua

SEQ ID NO: 2505624 - RNA, 17 nt, Chlamydia trachomatis
uaaaauuccuacgcaga

SEQ ID NO: 2505625 - RNA, 19 nt, Chlamydia trachomatis
uaaaauuucauacgcacag

SEQ ID NO: 2505626 - RNA, 14 nt, Chlamydia trachomatis
uaaacaagaucuau

SEQ ID NO: 2505627 - RNA, 17 nt, Chlamydia trachomatis
uaaacaaggauuuucuu

SEQ ID NO: 2505628 - RNA, 18 nt, Chlamydia trachomatis
uaaacaagguucuucaac

SEQ ID NO: 2505629 - RNA, 22 nt, Chlamydia trachomatis
uaaacaagguucuucaacaacu

SEQ ID NO: 2505630 - RNA, 13 nt, Chlamydia trachomatis
uaaacaauauucu

SEQ ID NO: 2505631 - RNA, 19 nt, Chlamydia trachomatis
uaaacaauauucuuuucca

SEQ ID NO: 2505632 - RNA, 21 nt, Chlamydia trachomatis
uaaacaauauucuuuuccaua

SEQ ID NO: 2505633 - RNA, 22 nt, Chlamydia trachomatis
uaaacaauauucuuuuccauau

SEQ ID NO: 2505634 - RNA, 18 nt, Chlamydia trachomatis
uaaacagaucuuuuucau

SEQ ID NO: 2505635 - RNA, 20 nt, Chlamydia trachomatis
uaaacauacacagauacuga

SEQ ID NO: 2505636 - RNA, 20 nt, Chlamydia trachomatis
uaaaccaaaggcaacaaagg

SEQ ID NO: 2505637 - RNA, 13 nt, Chlamydia trachomatis
uaaacccucugca

SEQ ID NO: 2505638 - RNA, 22 nt, Chlamydia trachomatis
uaaacgaggaauauaucggaaa

SEQ ID NO: 2505639 - RNA, 15 nt, Chlamydia trachomatis
uaaacgguugauaaa

SEQ ID NO: 2505640 - RNA, 18 nt, Chlamydia trachomatis
uaaacgguugauaaacuc

SEQ ID NO: 2505641 - RNA, 18 nt, Chlamydia trachomatis
uaaacguuuggaaauccu

SEQ ID NO: 2505642 - RNA, 15 nt, Chlamydia trachomatis
uaaacuaucuaaaau

SEQ ID NO: 2505643 - RNA, 13 nt, Chlamydia trachomatis
uaaacuccauugc

SEQ ID NO: 2505644 - RNA, 23 nt, Chlamydia trachomatis
uaaacucucgggccaaaaagacu

SEQ ID NO: 2505645 - RNA, 19 nt, Chlamydia trachomatis
uaaacuuucuugcaugacu

SEQ ID NO: 2505646 - RNA, 20 nt, Chlamydia trachomatis
uaaagaaagcccuauuuccu

SEQ ID NO: 2505647 - RNA, 22 nt, Chlamydia trachomatis
uaaagaagacuucgaggcuccc

SEQ ID NO: 2505648 - RNA, 14 nt, Chlamydia trachomatis
uaaagaaggaaaau

SEQ ID NO: 2505649 - RNA, 20 nt, Chlamydia trachomatis
uaaagaauccucuagagccu

SEQ ID NO: 2505650 - RNA, 14 nt, Chlamydia trachomatis
uaaagaaucuccug

SEQ ID NO: 2505651 - RNA, 15 nt, Chlamydia trachomatis
uaaagacacuaucac

SEQ ID NO: 2505652 - RNA, 18 nt, Chlamydia trachomatis
uaaagacccucuaaauuc

SEQ ID NO: 2505653 - RNA, 23 nt, Chlamydia trachomatis
uaaagacguucuugcugagaauc

SEQ ID NO: 2505654 - RNA, 15 nt, Chlamydia trachomatis
uaaagacuacaaaac

SEQ ID NO: 2505655 - RNA, 15 nt, Chlamydia trachomatis
uaaagagaucucucc

SEQ ID NO: 2505656 - RNA, 16 nt, Chlamydia trachomatis
uaaagagaucucucca

SEQ ID NO: 2505657 - RNA, 17 nt, Chlamydia trachomatis
uaaagagaucucuccag

SEQ ID NO: 2505658 - RNA, 19 nt, Chlamydia trachomatis
uaaagagaucucuccagag

SEQ ID NO: 2505659 - RNA, 20 nt, Chlamydia trachomatis
uaaagagccguucucucuaa

SEQ ID NO: 2505660 - RNA, 22 nt, Chlamydia trachomatis
uaaagauaacacucucaucuaa

SEQ ID NO: 2505661 - RNA, 19 nt, Chlamydia trachomatis
uaaagauccucuuucgcuu

SEQ ID NO: 2505662 - RNA, 12 nt, Chlamydia trachomatis
uaaagauucugu

SEQ ID NO: 2505663 - RNA, 13 nt, Chlamydia trachomatis
uaaagauuuuccu

SEQ ID NO: 2505664 - RNA, 19 nt, Chlamydia trachomatis
uaaagcagaaacaauuuca

SEQ ID NO: 2505665 - RNA, 16 nt, Chlamydia trachomatis
uaaagcagaaacagcu

SEQ ID NO: 2505666 - RNA, 21 nt, Chlamydia trachomatis
uaaagccuuucucuaaaagaa

SEQ ID NO: 2505667 - RNA, 14 nt, Chlamydia trachomatis
uaaagcggcuaaag

SEQ ID NO: 2505668 - RNA, 17 nt, Chlamydia trachomatis
uaaagcugcuuuacauc

SEQ ID NO: 2505669 - RNA, 14 nt, Chlamydia trachomatis
uaaagcuuuuucca

SEQ ID NO: 2505670 - RNA, 15 nt, Chlamydia trachomatis
uaaagcuuuuuccaa

SEQ ID NO: 2505671 - RNA, 23 nt, Chlamydia trachomatis
uaaagcuuuuucuacuguagcac

SEQ ID NO: 2505672 - RNA, 19 nt, Chlamydia trachomatis
uaaaggaagggagcuuaga

SEQ ID NO: 2505673 - RNA, 21 nt, Chlamydia trachomatis
uaaaggaauaauuuuccacaa

SEQ ID NO: 2505674 - RNA, 16 nt, Chlamydia trachomatis
uaaaggauaaggaaga

SEQ ID NO: 2505675 - RNA, 20 nt, Chlamydia trachomatis
uaaaggauaaggaagaagau

SEQ ID NO: 2505676 - RNA, 12 nt, Chlamydia trachomatis
uaaagggaaaaa

SEQ ID NO: 2505677 - RNA, 13 nt, Chlamydia trachomatis
uaaagggaaaaaa

SEQ ID NO: 2505678 - RNA, 13 nt, Chlamydia trachomatis
uaaagguuuccca

SEQ ID NO: 2505679 - RNA, 19 nt, Chlamydia trachomatis
uaaagucacuacuucaucg

SEQ ID NO: 2505680 - RNA, 15 nt, Chlamydia trachomatis
uaaaguuugcugggu

SEQ ID NO: 2505681 - RNA, 21 nt, Chlamydia trachomatis
uaaauaaguccuuaucuucuu

SEQ ID NO: 2505682 - RNA, 21 nt, Chlamydia trachomatis
uaaauacaaaucuuuuaucuu

SEQ ID NO: 2505683 - RNA, 13 nt, Chlamydia trachomatis
uaaauauuaucag

SEQ ID NO: 2505684 - RNA, 16 nt, Chlamydia trachomatis
uaaauauuaucagacc

SEQ ID NO: 2505685 - RNA, 16 nt, Chlamydia trachomatis
uaaauauucauauguu

SEQ ID NO: 2505686 - RNA, 13 nt, Chlamydia trachomatis
uaaauauuuugcc

SEQ ID NO: 2505687 - RNA, 18 nt, Chlamydia trachomatis
uaaaucaguggaacugcu

SEQ ID NO: 2505688 - RNA, 15 nt, Chlamydia trachomatis
uaaaucauggaugua

SEQ ID NO: 2505689 - RNA, 17 nt, Chlamydia trachomatis
uaaaucuauccauaauu

SEQ ID NO: 2505690 - RNA, 14 nt, Chlamydia trachomatis
uaaaucuccuccua

SEQ ID NO: 2505691 - RNA, 20 nt, Chlamydia trachomatis
uaaaugaaaccccucuuucu

SEQ ID NO: 2505692 - RNA, 14 nt, Chlamydia trachomatis
uaaaugaauguggu

SEQ ID NO: 2505693 - RNA, 15 nt, Chlamydia trachomatis
uaaaugaauguggug

SEQ ID NO: 2505694 - RNA, 14 nt, Chlamydia trachomatis
uaaaugcuguaaaa

SEQ ID NO: 2505695 - RNA, 21 nt, Chlamydia trachomatis
uaaauugcgacaccuaauccu

SEQ ID NO: 2505696 - RNA, 23 nt, Chlamydia trachomatis
uaacaacaaugucaacauaauag

SEQ ID NO: 2505697 - RNA, 13 nt, Chlamydia trachomatis
uaacaaccaucaa

SEQ ID NO: 2505698 - RNA, 16 nt, Chlamydia trachomatis
uaacaacucuccuaau

SEQ ID NO: 2505699 - RNA, 23 nt, Chlamydia trachomatis
uaacaacucuccuaauucaacau

SEQ ID NO: 2505700 - RNA, 16 nt, Chlamydia trachomatis
uaacaaggcuuuucca

SEQ ID NO: 2505701 - RNA, 18 nt, Chlamydia trachomatis
uaacaaggcuuuuccauu

SEQ ID NO: 2505702 - RNA, 13 nt, Chlamydia trachomatis
uaacaauccccaa

SEQ ID NO: 2505703 - RNA, 14 nt, Chlamydia trachomatis
uaacaauccccaaa

SEQ ID NO: 2505704 - RNA, 13 nt, Chlamydia trachomatis
uaacaauccuaga

SEQ ID NO: 2505705 - RNA, 17 nt, Chlamydia trachomatis
uaacaaugacucaaaaa

SEQ ID NO: 2505706 - RNA, 20 nt, Chlamydia trachomatis
uaacaaugcugauaaaaaua

SEQ ID NO: 2505707 - RNA, 22 nt, Chlamydia trachomatis
uaacaaugcugauaaaaauaau

SEQ ID NO: 2505708 - RNA, 17 nt, Chlamydia trachomatis
uaacaauuuuaaaaucu

SEQ ID NO: 2505709 - RNA, 17 nt, Chlamydia trachomatis
uaacacaagcagacaag

SEQ ID NO: 2505710 - RNA, 22 nt, Chlamydia trachomatis
uaacacaagcagacaagcaaua

SEQ ID NO: 2505711 - RNA, 17 nt, Chlamydia trachomatis
uaacacauaucuccaaa

SEQ ID NO: 2505712 - RNA, 21 nt, Chlamydia trachomatis
uaacacauaucuccaaaaaua

SEQ ID NO: 2505713 - RNA, 12 nt, Chlamydia trachomatis
uaacaccaaaaa

SEQ ID NO: 2505714 - RNA, 14 nt, Chlamydia trachomatis
uaacaccaaaaaau

SEQ ID NO: 2505715 - RNA, 17 nt, Chlamydia trachomatis
uaacaccaaaaaaucca

SEQ ID NO: 2505716 - RNA, 14 nt, Chlamydia trachomatis
uaacaccucuucug

SEQ ID NO: 2505717 - RNA, 14 nt, Chlamydia trachomatis
uaacagcaagacaa

SEQ ID NO: 2505718 - RNA, 15 nt, Chlamydia trachomatis
uaacagcaagcuugu

SEQ ID NO: 2505719 - RNA, 15 nt, Chlamydia trachomatis
uaacaggaagaauau

SEQ ID NO: 2505720 - RNA, 13 nt, Chlamydia trachomatis
uaacaggcuuccu

SEQ ID NO: 2505721 - RNA, 15 nt, Chlamydia trachomatis
uaacaucaaagaucu

SEQ ID NO: 2505722 - RNA, 20 nt, Chlamydia trachomatis
uaacaugguugauuuguccc

SEQ ID NO: 2505723 - RNA, 20 nt, Chlamydia trachomatis
uaacauuauuccgcuucuau

SEQ ID NO: 2505724 - RNA, 20 nt, Chlamydia trachomatis
uaacauucugaacauacaau

SEQ ID NO: 2505725 - RNA, 17 nt, Chlamydia trachomatis
uaaccaaaaaaaggcuc

SEQ ID NO: 2505726 - RNA, 11 nt, Chlamydia trachomatis
uaaccaaacag

SEQ ID NO: 2505727 - RNA, 13 nt, Chlamydia trachomatis
uaaccaaacagga

SEQ ID NO: 2505728 - RNA, 15 nt, Chlamydia trachomatis
uaaccaaauagguau

SEQ ID NO: 2505729 - RNA, 16 nt, Chlamydia trachomatis
uaaccagaauccuuuu

SEQ ID NO: 2505730 - RNA, 17 nt, Chlamydia trachomatis
uaaccagaauccuuuuc

SEQ ID NO: 2505731 - RNA, 21 nt, Chlamydia trachomatis
uaaccaugagcuccaaaguaa

SEQ ID NO: 2505732 - RNA, 14 nt, Chlamydia trachomatis
uaacccuccgaccc

SEQ ID NO: 2505733 - RNA, 20 nt, Chlamydia trachomatis
uaaccgccauuuaugaagcc

SEQ ID NO: 2505734 - RNA, 18 nt, Chlamydia trachomatis
uaaccucuacgaaaaagu

SEQ ID NO: 2505735 - RNA, 22 nt, Chlamydia trachomatis
uaaccucuacgaaaaagucaag

SEQ ID NO: 2505736 - RNA, 18 nt, Chlamydia trachomatis
uaaccucugcaagaaaau

SEQ ID NO: 2505737 - RNA, 14 nt, Chlamydia trachomatis
uaaccugaagauuu

SEQ ID NO: 2505738 - RNA, 23 nt, Chlamydia trachomatis
uaacgaguuuaaaggacccgcua

SEQ ID NO: 2505739 - RNA, 14 nt, Chlamydia trachomatis
uaacgauucuugau

SEQ ID NO: 2505740 - RNA, 19 nt, Chlamydia trachomatis
uaacgauucuugauaaaua

SEQ ID NO: 2505741 - RNA, 15 nt, Chlamydia trachomatis
uaacgauuguuucug

SEQ ID NO: 2505742 - RNA, 19 nt, Chlamydia trachomatis
uaacgcauuccaaucauuu

SEQ ID NO: 2505743 - RNA, 20 nt, Chlamydia trachomatis
uaacgcccucuuuucaaaau

SEQ ID NO: 2505744 - RNA, 15 nt, Chlamydia trachomatis
uaacgcuuccucucc

SEQ ID NO: 2505745 - RNA, 13 nt, Chlamydia trachomatis
uaacgguuccauu

SEQ ID NO: 2505746 - RNA, 14 nt, Chlamydia trachomatis
uaacguagauaucu

SEQ ID NO: 2505747 - RNA, 15 nt, Chlamydia trachomatis
uaacguagauaucuu

SEQ ID NO: 2505748 - RNA, 20 nt, Chlamydia trachomatis
uaacguccgcuccuucuuuc

SEQ ID NO: 2505749 - RNA, 14 nt, Chlamydia trachomatis
uaacguuccuccuc

SEQ ID NO: 2505750 - RNA, 18 nt, Chlamydia trachomatis
uaacuaagcuucucaaca

SEQ ID NO: 2505751 - RNA, 19 nt, Chlamydia trachomatis
uaacuacaucuaaaagagu

SEQ ID NO: 2505752 - RNA, 22 nt, Chlamydia trachomatis
uaacuaccauccgggaaugauu

SEQ ID NO: 2505753 - RNA, 15 nt, Chlamydia trachomatis
uaacuacggaaaaag

SEQ ID NO: 2505754 - RNA, 18 nt, Chlamydia trachomatis
uaacuacucccaaaucaa

SEQ ID NO: 2505755 - RNA, 19 nt, Chlamydia trachomatis
uaacuacucccaaaucaaa

SEQ ID NO: 2505756 - RNA, 21 nt, Chlamydia trachomatis
uaacuccaagggaugaagcua

SEQ ID NO: 2505757 - RNA, 17 nt, Chlamydia trachomatis
uaacuccaguccaucuu

SEQ ID NO: 2505758 - RNA, 16 nt, Chlamydia trachomatis
uaacuccaucaggaau

SEQ ID NO: 2505759 - RNA, 13 nt, Chlamydia trachomatis
uaacucuucugga

SEQ ID NO: 2505760 - RNA, 22 nt, Chlamydia trachomatis
uaacugagccaagaacaaagca

SEQ ID NO: 2505761 - RNA, 19 nt, Chlamydia trachomatis
uaacugggauaagaaaucu

SEQ ID NO: 2505762 - RNA, 20 nt, Chlamydia trachomatis
uaacugguguggguaagaau

SEQ ID NO: 2505763 - RNA, 23 nt, Chlamydia trachomatis
uaacuguggguuuuuuuauugau

SEQ ID NO: 2505764 - RNA, 15 nt, Chlamydia trachomatis
uaacuuaugaaaacu

SEQ ID NO: 2505765 - RNA, 14 nt, Chlamydia trachomatis
uaacuuuaauagcc

SEQ ID NO: 2505766 - RNA, 17 nt, Chlamydia trachomatis
uaacuuugaacaaauuu

SEQ ID NO: 2505767 - RNA, 19 nt, Chlamydia trachomatis
uaacuuuuucucuugcuuc

SEQ ID NO: 2505768 - RNA, 22 nt, Chlamydia trachomatis
uaagaaaaaggucucccaagaa

SEQ ID NO: 2505769 - RNA, 23 nt, Chlamydia trachomatis
uaagaaaguuuuuuucaggagaa

SEQ ID NO: 2505770 - RNA, 14 nt, Chlamydia trachomatis
uaagaaauuaacac

SEQ ID NO: 2505771 - RNA, 13 nt, Chlamydia trachomatis
uaagaaccacaac

SEQ ID NO: 2505772 - RNA, 15 nt, Chlamydia trachomatis
uaagaaccgcaagca

SEQ ID NO: 2505773 - RNA, 10 nt, Chlamydia trachomatis
uaagaagaga

SEQ ID NO: 2505774 - RNA, 21 nt, Chlamydia trachomatis
uaagaagguugaauuucagga

SEQ ID NO: 2505775 - RNA, 20 nt, Chlamydia trachomatis
uaagaagucuuguccuuccc

SEQ ID NO: 2505776 - RNA, 15 nt, Chlamydia trachomatis
uaagaauaaacaaca

SEQ ID NO: 2505777 - RNA, 16 nt, Chlamydia trachomatis
uaagaauaaacaacau

SEQ ID NO: 2505778 - RNA, 15 nt, Chlamydia trachomatis
uaagaauaaagauga

SEQ ID NO: 2505779 - RNA, 16 nt, Chlamydia trachomatis
uaagaauaaagaugaa

SEQ ID NO: 2505780 - RNA, 23 nt, Chlamydia trachomatis
uaagaauuaacccaaaagaucca

SEQ ID NO: 2505781 - RNA, 20 nt, Chlamydia trachomatis
uaagaccgaaauuaguaaua

SEQ ID NO: 2505782 - RNA, 18 nt, Chlamydia trachomatis
uaagaccgagauuaucau

SEQ ID NO: 2505783 - RNA, 17 nt, Chlamydia trachomatis
uaagaccuaguaagugc

SEQ ID NO: 2505784 - RNA, 20 nt, Chlamydia trachomatis
uaagaccuaguaagugcaua

SEQ ID NO: 2505785 - RNA, 22 nt, Chlamydia trachomatis
uaagacucaaauuuucaugaaa

SEQ ID NO: 2505786 - RNA, 18 nt, Chlamydia trachomatis
uaagacuuucucuaacaa

SEQ ID NO: 2505787 - RNA, 21 nt, Chlamydia trachomatis
uaagacuuucucuaacaauga

SEQ ID NO: 2505788 - RNA, 18 nt, Chlamydia trachomatis
uaagacuuugugcaaccu

SEQ ID NO: 2505789 - RNA, 18 nt, Chlamydia trachomatis
uaagagcagagcuuuuac

SEQ ID NO: 2505790 - RNA, 15 nt, Chlamydia trachomatis
uaagaggacuuucuu

SEQ ID NO: 2505791 - RNA, 18 nt, Chlamydia trachomatis
uaagauauccauagccuu

SEQ ID NO: 2505792 - RNA, 21 nt, Chlamydia trachomatis
uaagauauugccaaaaagaaa

SEQ ID NO: 2505793 - RNA, 22 nt, Chlamydia trachomatis
uaagauauugccaaaaagaaaa

SEQ ID NO: 2505794 - RNA, 17 nt, Chlamydia trachomatis
uaagaucucuacauaag

SEQ ID NO: 2505795 - RNA, 17 nt, Chlamydia trachomatis
uaagaucucuuccuugu

SEQ ID NO: 2505796 - RNA, 14 nt, Chlamydia trachomatis
uaagaucuguagca

SEQ ID NO: 2505797 - RNA, 18 nt, Chlamydia trachomatis
uaagaucuuuacuuucuu

SEQ ID NO: 2505798 - RNA, 17 nt, Chlamydia trachomatis
uaagauucgaaggaaau

SEQ ID NO: 2505799 - RNA, 15 nt, Chlamydia trachomatis
uaagauugaugacaa

SEQ ID NO: 2505800 - RNA, 19 nt, Chlamydia trachomatis
uaagauuuucaucuuccaa

SEQ ID NO: 2505801 - RNA, 20 nt, Chlamydia trachomatis
uaagauuuuucagccugucu

SEQ ID NO: 2505802 - RNA, 13 nt, Chlamydia trachomatis
uaagcaaauccug

SEQ ID NO: 2505803 - RNA, 11 nt, Chlamydia trachomatis
uaagcaacaac

SEQ ID NO: 2505804 - RNA, 23 nt, Chlamydia trachomatis
uaagcaacaacugcucugccaua

SEQ ID NO: 2505805 - RNA, 14 nt, Chlamydia trachomatis
uaagcaacgacaaa

SEQ ID NO: 2505806 - RNA, 20 nt, Chlamydia trachomatis
uaagcacuauaucuccaaca

SEQ ID NO: 2505807 - RNA, 19 nt, Chlamydia trachomatis
uaagcauagcuucuugcgu

SEQ ID NO: 2505808 - RNA, 20 nt, Chlamydia trachomatis
uaagccgaguagacucuaau

SEQ ID NO: 2505809 - RNA, 16 nt, Chlamydia trachomatis
uaagccuucuccagaa

SEQ ID NO: 2505810 - RNA, 18 nt, Chlamydia trachomatis
uaagcgaaaaaaaaagaa

SEQ ID NO: 2505811 - RNA, 20 nt, Chlamydia trachomatis
uaagcgaaaaaaaaagaaca

SEQ ID NO: 2505812 - RNA, 15 nt, Chlamydia trachomatis
uaagcgagauaagga

SEQ ID NO: 2505813 - RNA, 15 nt, Chlamydia trachomatis
uaagcgaugagcgag

SEQ ID NO: 2505814 - RNA, 22 nt, Chlamydia trachomatis
uaagcguuccuauacaagaaaa

SEQ ID NO: 2505815 - RNA, 16 nt, Chlamydia trachomatis
uaagcuagaaaauagc

SEQ ID NO: 2505816 - RNA, 18 nt, Chlamydia trachomatis
uaagcuguucuuccauau

SEQ ID NO: 2505817 - RNA, 21 nt, Chlamydia trachomatis
uaagcuugaucaaagaaucuu

SEQ ID NO: 2505818 - RNA, 23 nt, Chlamydia trachomatis
uaaggaaagagaggcgucugcau

SEQ ID NO: 2505819 - RNA, 16 nt, Chlamydia trachomatis
uaaggaauguggagcu

SEQ ID NO: 2505820 - RNA, 16 nt, Chlamydia trachomatis
uaaggacuucaacaaa

SEQ ID NO: 2505821 - RNA, 13 nt, Chlamydia trachomatis
uaaggagagaaaa

SEQ ID NO: 2505822 - RNA, 13 nt, Chlamydia trachomatis
uaaggcgagaaua

SEQ ID NO: 2505823 - RNA, 20 nt, Chlamydia trachomatis
uaagguacuucuauccggag

SEQ ID NO: 2505824 - RNA, 17 nt, Chlamydia trachomatis
uaagguggcacacucca

SEQ ID NO: 2505825 - RNA, 18 nt, Chlamydia trachomatis
uaagguggcacacuccau

SEQ ID NO: 2505826 - RNA, 14 nt, Chlamydia trachomatis
uaaguaaaagcacu

SEQ ID NO: 2505827 - RNA, 14 nt, Chlamydia trachomatis
uaaguaaggauguu

SEQ ID NO: 2505828 - RNA, 21 nt, Chlamydia trachomatis
uaaguagcaaauuaacagaua

SEQ ID NO: 2505829 - RNA, 15 nt, Chlamydia trachomatis
uaaguauagaagccu

SEQ ID NO: 2505830 - RNA, 15 nt, Chlamydia trachomatis
uaagucaaaagaauc

SEQ ID NO: 2505831 - RNA, 19 nt, Chlamydia trachomatis
uaagucaccauuuucucga

SEQ ID NO: 2505832 - RNA, 20 nt, Chlamydia trachomatis
uaaguccaucuaaagggaga

SEQ ID NO: 2505833 - RNA, 15 nt, Chlamydia trachomatis
uaagucucuugccuu

SEQ ID NO: 2505834 - RNA, 15 nt, Chlamydia trachomatis
uaagucugccacuac

SEQ ID NO: 2505835 - RNA, 13 nt, Chlamydia trachomatis
uaagucuguugcc

SEQ ID NO: 2505836 - RNA, 18 nt, Chlamydia trachomatis
uaagugcuccugcagaca

SEQ ID NO: 2505837 - RNA, 15 nt, Chlamydia trachomatis
uaaguuaccucuuua

SEQ ID NO: 2505838 - RNA, 12 nt, Chlamydia trachomatis
uaaguuccuuag

SEQ ID NO: 2505839 - RNA, 21 nt, Chlamydia trachomatis
uaaguuggcucguagagaacg

SEQ ID NO: 2505840 - RNA, 17 nt, Chlamydia trachomatis
uaaguuguaaagcauuc

SEQ ID NO: 2505841 - RNA, 16 nt, Chlamydia trachomatis
uaaguuuauuccaacc

SEQ ID NO: 2505842 - RNA, 15 nt, Chlamydia trachomatis
uaaguuuuaagaaga

SEQ ID NO: 2505843 - RNA, 17 nt, Chlamydia trachomatis
uaauaaaagcuccuaaa

SEQ ID NO: 2505844 - RNA, 21 nt, Chlamydia trachomatis
uaauaaaaggcuuauucucuu

SEQ ID NO: 2505845 - RNA, 19 nt, Chlamydia trachomatis
uaauaaaagggcucucucc

SEQ ID NO: 2505846 - RNA, 15 nt, Chlamydia trachomatis
uaauaaacagaucuu

SEQ ID NO: 2505847 - RNA, 18 nt, Chlamydia trachomatis
uaauaaagauagcaucuu

SEQ ID NO: 2505848 - RNA, 21 nt, Chlamydia trachomatis
uaauaaauauuaucagaccuu

SEQ ID NO: 2505849 - RNA, 14 nt, Chlamydia trachomatis
uaauaaauuaggga

SEQ ID NO: 2505850 - RNA, 21 nt, Chlamydia trachomatis
uaauaacugagccaagaacaa

SEQ ID NO: 2505851 - RNA, 16 nt, Chlamydia trachomatis
uaauaagaccucuuuu

SEQ ID NO: 2505852 - RNA, 18 nt, Chlamydia trachomatis
uaauaagaccucuuuuuu

SEQ ID NO: 2505853 - RNA, 12 nt, Chlamydia trachomatis
uaauaagauuga

SEQ ID NO: 2505854 - RNA, 16 nt, Chlamydia trachomatis
uaauaaguuuuucaaa

SEQ ID NO: 2505855 - RNA, 22 nt, Chlamydia trachomatis
uaauaauaagagcuacaggaac

SEQ ID NO: 2505856 - RNA, 15 nt, Chlamydia trachomatis
uaauacgaauaagag

SEQ ID NO: 2505857 - RNA, 14 nt, Chlamydia trachomatis
uaauacuaaacuau

SEQ ID NO: 2505858 - RNA, 22 nt, Chlamydia trachomatis
uaauacuaaacuaucuaaaauc

SEQ ID NO: 2505859 - RNA, 20 nt, Chlamydia trachomatis
uaauacugacccauccaaaa

SEQ ID NO: 2505860 - RNA, 22 nt, Chlamydia trachomatis
uaauacugacccauccaaaaca

SEQ ID NO: 2505861 - RNA, 15 nt, Chlamydia trachomatis
uaauagaaaaacuau

SEQ ID NO: 2505862 - RNA, 15 nt, Chlamydia trachomatis
uaauagcaaagaaga

SEQ ID NO: 2505863 - RNA, 18 nt, Chlamydia trachomatis
uaauagccgcgaguauag

SEQ ID NO: 2505864 - RNA, 22 nt, Chlamydia trachomatis
uaauagcgggaggccauagaau

SEQ ID NO: 2505865 - RNA, 13 nt, Chlamydia trachomatis
uaauaggaagaua

SEQ ID NO: 2505866 - RNA, 21 nt, Chlamydia trachomatis
uaauaggcaggagaccacuca

SEQ ID NO: 2505867 - RNA, 24 nt, Chlamydia trachomatis
uaauaggcaggagaccacucauca

SEQ ID NO: 2505868 - RNA, 20 nt, Chlamydia trachomatis
uaauagugcguccuucuuua

SEQ ID NO: 2505869 - RNA, 17 nt, Chlamydia trachomatis
uaauaguuaaaacacaa

SEQ ID NO: 2505870 - RNA, 22 nt, Chlamydia trachomatis
uaauauaaguucagccccuaaa

SEQ ID NO: 2505871 - RNA, 15 nt, Chlamydia trachomatis
uaauauacucccaua

SEQ ID NO: 2505872 - RNA, 13 nt, Chlamydia trachomatis
uaauauccccauc

SEQ ID NO: 2505873 - RNA, 13 nt, Chlamydia trachomatis
uaauaucugcucu

SEQ ID NO: 2505874 - RNA, 21 nt, Chlamydia trachomatis
uaauauuagauagcuucuuaa

SEQ ID NO: 2505875 - RNA, 14 nt, Chlamydia trachomatis
uaauauuuuuuccc

SEQ ID NO: 2505876 - RNA, 16 nt, Chlamydia trachomatis
uaauauuuuuucccuu

SEQ ID NO: 2505877 - RNA, 21 nt, Chlamydia trachomatis
uaauauuuuuucccuuucaua

SEQ ID NO: 2505878 - RNA, 22 nt, Chlamydia trachomatis
uaauauuuuuucccuuucauaa

SEQ ID NO: 2505879 - RNA, 21 nt, Chlamydia trachomatis
uaaucaaaccuaaguagcaaa

SEQ ID NO: 2505880 - RNA, 17 nt, Chlamydia trachomatis
uaaucaauugaaagucu

SEQ ID NO: 2505881 - RNA, 18 nt, Chlamydia trachomatis
uaaucaguugaaagacuu

SEQ ID NO: 2505882 - RNA, 13 nt, Chlamydia trachomatis
uaaucauagccau

SEQ ID NO: 2505883 - RNA, 13 nt, Chlamydia trachomatis
uaauccaggagac

SEQ ID NO: 2505884 - RNA, 21 nt, Chlamydia trachomatis
uaaucccuuuuucaagaaauc

SEQ ID NO: 2505885 - RNA, 15 nt, Chlamydia trachomatis
uaauccguaguuggc

SEQ ID NO: 2505886 - RNA, 22 nt, Chlamydia trachomatis
uaauccguaguuggccagcuca

SEQ ID NO: 2505887 - RNA, 23 nt, Chlamydia trachomatis
uaauccuucgauaaguucuuuag

SEQ ID NO: 2505888 - RNA, 18 nt, Chlamydia trachomatis
uaaucgaucacagaaacg

SEQ ID NO: 2505889 - RNA, 23 nt, Chlamydia trachomatis
uaaucggauagagaagaauugaa

SEQ ID NO: 2505890 - RNA, 14 nt, Chlamydia trachomatis
uaaucggcaaaaga

SEQ ID NO: 2505891 - RNA, 20 nt, Chlamydia trachomatis
uaaucuaaagacaaaacuuc

SEQ ID NO: 2505892 - RNA, 14 nt, Chlamydia trachomatis
uaaucuaucuggau

SEQ ID NO: 2505893 - RNA, 12 nt, Chlamydia trachomatis
uaaucuauuuua

SEQ ID NO: 2505894 - RNA, 23 nt, Chlamydia trachomatis
uaaucuccuaaccgguaaucaaa

SEQ ID NO: 2505895 - RNA, 14 nt, Chlamydia trachomatis
uaaucucuuaaucc

SEQ ID NO: 2505896 - RNA, 17 nt, Chlamydia trachomatis
uaaucugcuuaucuccg

SEQ ID NO: 2505897 - RNA, 16 nt, Chlamydia trachomatis
uaaucuucuauuuguu

SEQ ID NO: 2505898 - RNA, 20 nt, Chlamydia trachomatis
uaaucuuguaauaucaaaga

SEQ ID NO: 2505899 - RNA, 20 nt, Chlamydia trachomatis
uaaugaaacucuuuuuaaau

SEQ ID NO: 2505900 - RNA, 21 nt, Chlamydia trachomatis
uaaugaagguuucuaaaaaac

SEQ ID NO: 2505901 - RNA, 15 nt, Chlamydia trachomatis
uaaugaauacgggga

SEQ ID NO: 2505902 - RNA, 17 nt, Chlamydia trachomatis
uaaugacaaacuuucuc

SEQ ID NO: 2505903 - RNA, 17 nt, Chlamydia trachomatis
uaaugagcagaauagau

SEQ ID NO: 2505904 - RNA, 19 nt, Chlamydia trachomatis
uaaugaucagcaaaaagag

SEQ ID NO: 2505905 - RNA, 21 nt, Chlamydia trachomatis
uaaugauuuuuuuauuuugag

SEQ ID NO: 2505906 - RNA, 19 nt, Chlamydia trachomatis
uaaugccuuuugcacaaag

SEQ ID NO: 2505907 - RNA, 14 nt, Chlamydia trachomatis
uaaugcuuagaaac

SEQ ID NO: 2505908 - RNA, 21 nt, Chlamydia trachomatis
uaaugggccguuuuucuccau

SEQ ID NO: 2505909 - RNA, 13 nt, Chlamydia trachomatis
uaaugggcuccuu

SEQ ID NO: 2505910 - RNA, 16 nt, Chlamydia trachomatis
uaauguccucuuuauc

SEQ ID NO: 2505911 - RNA, 17 nt, Chlamydia trachomatis
uaaugucucuucacaaa

SEQ ID NO: 2505912 - RNA, 22 nt, Chlamydia trachomatis
uaauuaauaacgcccucuuuuc

SEQ ID NO: 2505913 - RNA, 14 nt, Chlamydia trachomatis
uaauucaacauaau

SEQ ID NO: 2505914 - RNA, 16 nt, Chlamydia trachomatis
uaauucaacauaauaa

SEQ ID NO: 2505915 - RNA, 16 nt, Chlamydia trachomatis
uaauucaggcucuuuc

SEQ ID NO: 2505916 - RNA, 13 nt, Chlamydia trachomatis
uaauucaugaucu

SEQ ID NO: 2505917 - RNA, 19 nt, Chlamydia trachomatis
uaauuccaaugaggaugug

SEQ ID NO: 2505918 - RNA, 12 nt, Chlamydia trachomatis
uaauuccaucuu

SEQ ID NO: 2505919 - RNA, 16 nt, Chlamydia trachomatis
uaauuccaucuuuucg

SEQ ID NO: 2505920 - RNA, 16 nt, Chlamydia trachomatis
uaauuccuucaaauau

SEQ ID NO: 2505921 - RNA, 18 nt, Chlamydia trachomatis
uaauucgaacaucaacca

SEQ ID NO: 2505922 - RNA, 17 nt, Chlamydia trachomatis
uaauucuagcaaccgau

SEQ ID NO: 2505923 - RNA, 14 nt, Chlamydia trachomatis
uaauugcaguauag

SEQ ID NO: 2505924 - RNA, 19 nt, Chlamydia trachomatis
uaauugcuguuaagauaag

SEQ ID NO: 2505925 - RNA, 12 nt, Chlamydia trachomatis
uaauuuccccua

SEQ ID NO: 2505926 - RNA, 22 nt, Chlamydia trachomatis
uaauuucuagauggauaaucuc

SEQ ID NO: 2505927 - RNA, 23 nt, Chlamydia trachomatis
uaauuugacuaggauuacagcaa

SEQ ID NO: 2505928 - RNA, 17 nt, Chlamydia trachomatis
uaauuuggcucuuuaau

SEQ ID NO: 2505929 - RNA, 21 nt, Chlamydia trachomatis
uaauuuggcuucuuuuuucuu

SEQ ID NO: 2505930 - RNA, 13 nt, Chlamydia trachomatis
uaauuuuccacaa

SEQ ID NO: 2505931 - RNA, 18 nt, Chlamydia trachomatis
uaauuuuccuuuuuccca

SEQ ID NO: 2505932 - RNA, 14 nt, Chlamydia trachomatis
uaauuuucugacuc

SEQ ID NO: 2505933 - RNA, 22 nt, Chlamydia trachomatis
uaauuuuugauacaauuccugc

SEQ ID NO: 2505934 - RNA, 17 nt, Chlamydia trachomatis
uacaaaagauuucuucu

SEQ ID NO: 2505935 - RNA, 23 nt, Chlamydia trachomatis
uacaaaccgaagagggaagagaa

SEQ ID NO: 2505936 - RNA, 14 nt, Chlamydia trachomatis
uacaaacugcucaa

SEQ ID NO: 2505937 - RNA, 16 nt, Chlamydia trachomatis
uacaaagauaaucaaa

SEQ ID NO: 2505938 - RNA, 12 nt, Chlamydia trachomatis
uacaaagcacga

SEQ ID NO: 2505939 - RNA, 13 nt, Chlamydia trachomatis
uacaaagcagcca

SEQ ID NO: 2505940 - RNA, 15 nt, Chlamydia trachomatis
uacaaagcagccacu

SEQ ID NO: 2505941 - RNA, 23 nt, Chlamydia trachomatis
uacaaagguaaauggugaaacuu

SEQ ID NO: 2505942 - RNA, 20 nt, Chlamydia trachomatis
uacaaaguggcguuguuucu

SEQ ID NO: 2505943 - RNA, 23 nt, Chlamydia trachomatis
uacaaaguggcguuguuucuaau

SEQ ID NO: 2505944 - RNA, 17 nt, Chlamydia trachomatis
uacaaaucuuuuaucuu

SEQ ID NO: 2505945 - RNA, 19 nt, Chlamydia trachomatis
uacaaccugggcauacacc

SEQ ID NO: 2505946 - RNA, 16 nt, Chlamydia trachomatis
uacaacuaaaggaaac

SEQ ID NO: 2505947 - RNA, 20 nt, Chlamydia trachomatis
uacaacuaaaggaaacaagc

SEQ ID NO: 2505948 - RNA, 13 nt, Chlamydia trachomatis
uacaagaaaacag

SEQ ID NO: 2505949 - RNA, 23 nt, Chlamydia trachomatis
uacaaggcuccuuuucaagagcc

SEQ ID NO: 2505950 - RNA, 19 nt, Chlamydia trachomatis
uacaaggcucuugaaaagg

SEQ ID NO: 2505951 - RNA, 18 nt, Chlamydia trachomatis
uacaaguauuucuuguug

SEQ ID NO: 2505952 - RNA, 18 nt, Chlamydia trachomatis
uacaagugacauuuccaa

SEQ ID NO: 2505953 - RNA, 21 nt, Chlamydia trachomatis
uacaauaauacaaagcacgau

SEQ ID NO: 2505954 - RNA, 18 nt, Chlamydia trachomatis
uacaauagguuuaaauaa

SEQ ID NO: 2505955 - RNA, 22 nt, Chlamydia trachomatis
uacaauaguaccuucaaucugu

SEQ ID NO: 2505956 - RNA, 20 nt, Chlamydia trachomatis
uacaaugaccgaagguucuu

SEQ ID NO: 2505957 - RNA, 22 nt, Chlamydia trachomatis
uacaaugaccgaagguucuucu

SEQ ID NO: 2505958 - RNA, 17 nt, Chlamydia trachomatis
uacaauguacgcuaaaa

SEQ ID NO: 2505959 - RNA, 12 nt, Chlamydia trachomatis
uacaauuccugc

SEQ ID NO: 2505960 - RNA, 15 nt, Chlamydia trachomatis
uacaauuccugcuca

SEQ ID NO: 2505961 - RNA, 18 nt, Chlamydia trachomatis
uacaauugagugugaguc

SEQ ID NO: 2505962 - RNA, 13 nt, Chlamydia trachomatis
uacacaucaaaau

SEQ ID NO: 2505963 - RNA, 12 nt, Chlamydia trachomatis
uacacaucugua

SEQ ID NO: 2505964 - RNA, 15 nt, Chlamydia trachomatis
uacaccucuugugau

SEQ ID NO: 2505965 - RNA, 23 nt, Chlamydia trachomatis
uacaccuguauugggauaauaau

SEQ ID NO: 2505966 - RNA, 18 nt, Chlamydia trachomatis
uacacgcugaguuuccuu

SEQ ID NO: 2505967 - RNA, 22 nt, Chlamydia trachomatis
uacacguuuuagaaugguucuu

SEQ ID NO: 2505968 - RNA, 18 nt, Chlamydia trachomatis
uacagaacauuucucguc

SEQ ID NO: 2505969 - RNA, 17 nt, Chlamydia trachomatis
uacagacgaaaacgcau

SEQ ID NO: 2505970 - RNA, 16 nt, Chlamydia trachomatis
uacagacgcauagaau

SEQ ID NO: 2505971 - RNA, 20 nt, Chlamydia trachomatis
uacagacuguggcaaggcuu

SEQ ID NO: 2505972 - RNA, 16 nt, Chlamydia trachomatis
uacagagagcuuuuuu

SEQ ID NO: 2505973 - RNA, 18 nt, Chlamydia trachomatis
uacagagccuuuuauucu

SEQ ID NO: 2505974 - RNA, 16 nt, Chlamydia trachomatis
uacagauaccaagcca

SEQ ID NO: 2505975 - RNA, 23 nt, Chlamydia trachomatis
uacagaucuugaucugaaaagag

SEQ ID NO: 2505976 - RNA, 18 nt, Chlamydia trachomatis
uacagauuuuucgaaaau

SEQ ID NO: 2505977 - RNA, 23 nt, Chlamydia trachomatis
uacagcaaaaccuuuugaaacau

SEQ ID NO: 2505978 - RNA, 13 nt, Chlamydia trachomatis
uacagcaagaaga

SEQ ID NO: 2505979 - RNA, 12 nt, Chlamydia trachomatis
uacagcaugccu

SEQ ID NO: 2505980 - RNA, 23 nt, Chlamydia trachomatis
uacagcaugccuucuuccuucau

SEQ ID NO: 2505981 - RNA, 16 nt, Chlamydia trachomatis
uacagcggauuagucg

SEQ ID NO: 2505982 - RNA, 17 nt, Chlamydia trachomatis
uacagcuguauuuacag

SEQ ID NO: 2505983 - RNA, 23 nt, Chlamydia trachomatis
uacaggccucccuaucaauuccu

SEQ ID NO: 2505984 - RNA, 15 nt, Chlamydia trachomatis
uacagucuguguuug

SEQ ID NO: 2505985 - RNA, 17 nt, Chlamydia trachomatis
uacagucuuccucugcu

SEQ ID NO: 2505986 - RNA, 23 nt, Chlamydia trachomatis
uacagucuucucgagaagaaaaa

SEQ ID NO: 2505987 - RNA, 13 nt, Chlamydia trachomatis
uacaguuagagau

SEQ ID NO: 2505988 - RNA, 15 nt, Chlamydia trachomatis
uacauaaucuuccug

SEQ ID NO: 2505989 - RNA, 14 nt, Chlamydia trachomatis
uacaucacugcaac

SEQ ID NO: 2505990 - RNA, 19 nt, Chlamydia trachomatis
uacaucacugcaacuaaua

SEQ ID NO: 2505991 - RNA, 15 nt, Chlamydia trachomatis
uacaucaucucucag

SEQ ID NO: 2505992 - RNA, 18 nt, Chlamydia trachomatis
uacaucaucucucagcag

SEQ ID NO: 2505993 - RNA, 21 nt, Chlamydia trachomatis
uacaucuaaaagaguuucuuu

SEQ ID NO: 2505994 - RNA, 23 nt, Chlamydia trachomatis
uacaucuguagagccaugaucaa

SEQ ID NO: 2505995 - RNA, 17 nt, Chlamydia trachomatis
uacaugauagucagaau

SEQ ID NO: 2505996 - RNA, 21 nt, Chlamydia trachomatis
uacaugauagucagaauaaua

SEQ ID NO: 2505997 - RNA, 17 nt, Chlamydia trachomatis
uacauucgccucuucuc

SEQ ID NO: 2505998 - RNA, 23 nt, Chlamydia trachomatis
uacauuguaaauagacuucuucg

SEQ ID NO: 2505999 - RNA, 12 nt, Chlamydia trachomatis
uaccaaaauccu

SEQ ID NO: 2506000 - RNA, 12 nt, Chlamydia trachomatis
uaccaaaccuuu

SEQ ID NO: 2506001 - RNA, 19 nt, Chlamydia trachomatis
uaccaaagaauucuugcua

SEQ ID NO: 2506002 - RNA, 17 nt, Chlamydia trachomatis
uaccaagccauuuccag

SEQ ID NO: 2506003 - RNA, 24 nt, Chlamydia trachomatis
uaccaaucacgcuacaugcaggau

SEQ ID NO: 2506004 - RNA, 21 nt, Chlamydia trachomatis
uaccaauggaccagaucauag

SEQ ID NO: 2506005 - RNA, 19 nt, Chlamydia trachomatis
uaccacaauuuuucuugua

SEQ ID NO: 2506006 - RNA, 14 nt, Chlamydia trachomatis
uaccacauucucuu

SEQ ID NO: 2506007 - RNA, 16 nt, Chlamydia trachomatis
uaccacauucucuuuu

SEQ ID NO: 2506008 - RNA, 19 nt, Chlamydia trachomatis
uaccacgagcauaagaaua

SEQ ID NO: 2506009 - RNA, 16 nt, Chlamydia trachomatis
uaccacgccaagaauu

SEQ ID NO: 2506010 - RNA, 17 nt, Chlamydia trachomatis
uaccagaggagggagau

SEQ ID NO: 2506011 - RNA, 14 nt, Chlamydia trachomatis
uaccagcagaccca

SEQ ID NO: 2506012 - RNA, 18 nt, Chlamydia trachomatis
uaccagcagacccaaaug

SEQ ID NO: 2506013 - RNA, 20 nt, Chlamydia trachomatis
uaccauaauccuaugcagua

SEQ ID NO: 2506014 - RNA, 17 nt, Chlamydia trachomatis
uaccauaucaaaaauag

SEQ ID NO: 2506015 - RNA, 22 nt, Chlamydia trachomatis
uaccaucaauccuggaaucaca

SEQ ID NO: 2506016 - RNA, 16 nt, Chlamydia trachomatis
uaccauccgggaauga

SEQ ID NO: 2506017 - RNA, 12 nt, Chlamydia trachomatis
uacccaaacauc

SEQ ID NO: 2506018 - RNA, 14 nt, Chlamydia trachomatis
uacccaaacaucua

SEQ ID NO: 2506019 - RNA, 16 nt, Chlamydia trachomatis
uacccaggcuuuucuu

SEQ ID NO: 2506020 - RNA, 17 nt, Chlamydia trachomatis
uacccaggcuuuucuuu

SEQ ID NO: 2506021 - RNA, 15 nt, Chlamydia trachomatis
uacccauaauucuug

SEQ ID NO: 2506022 - RNA, 16 nt, Chlamydia trachomatis
uacccccuucuccuuu

SEQ ID NO: 2506023 - RNA, 14 nt, Chlamydia trachomatis
uaccccuaaagucu

SEQ ID NO: 2506024 - RNA, 16 nt, Chlamydia trachomatis
uacccgauucaaaaau

SEQ ID NO: 2506025 - RNA, 20 nt, Chlamydia trachomatis
uacccuaaauuccuuugcuu

SEQ ID NO: 2506026 - RNA, 19 nt, Chlamydia trachomatis
uacccuacugcaauuagua

SEQ ID NO: 2506027 - RNA, 23 nt, Chlamydia trachomatis
uacccucuuuagccaauuuccau

SEQ ID NO: 2506028 - RNA, 20 nt, Chlamydia trachomatis
uacccuuauaagccgcucug

SEQ ID NO: 2506029 - RNA, 15 nt, Chlamydia trachomatis
uaccgacuucaacuu

SEQ ID NO: 2506030 - RNA, 16 nt, Chlamydia trachomatis
uaccguauuaucugca

SEQ ID NO: 2506031 - RNA, 21 nt, Chlamydia trachomatis
uaccgucucuugucagaagag

SEQ ID NO: 2506032 - RNA, 13 nt, Chlamydia trachomatis
uaccguuccaucu

SEQ ID NO: 2506033 - RNA, 22 nt, Chlamydia trachomatis
uaccuaaacaaggauuuucuuc

SEQ ID NO: 2506034 - RNA, 19 nt, Chlamydia trachomatis
uaccuacacgauauaucca

SEQ ID NO: 2506035 - RNA, 18 nt, Chlamydia trachomatis
uaccuagcaauucaucag

SEQ ID NO: 2506036 - RNA, 22 nt, Chlamydia trachomatis
uaccuagugauuuuaaaccaau

SEQ ID NO: 2506037 - RNA, 12 nt, Chlamydia trachomatis
uaccuauuccaa

SEQ ID NO: 2506038 - RNA, 20 nt, Chlamydia trachomatis
uaccucaauagcagcauucu

SEQ ID NO: 2506039 - RNA, 18 nt, Chlamydia trachomatis
uaccucgagcaacgagga

SEQ ID NO: 2506040 - RNA, 19 nt, Chlamydia trachomatis
uaccucuaaagauccucuu

SEQ ID NO: 2506041 - RNA, 20 nt, Chlamydia trachomatis
uaccucuaaagauccucuuu

SEQ ID NO: 2506042 - RNA, 14 nt, Chlamydia trachomatis
uaccucuccauuuu

SEQ ID NO: 2506043 - RNA, 15 nt, Chlamydia trachomatis
uaccugauagagucc

SEQ ID NO: 2506044 - RNA, 14 nt, Chlamydia trachomatis
uaccuggaaaggag

SEQ ID NO: 2506045 - RNA, 15 nt, Chlamydia trachomatis
uaccugggaaaacuu

SEQ ID NO: 2506046 - RNA, 14 nt, Chlamydia trachomatis
uaccugugaagaaa

SEQ ID NO: 2506047 - RNA, 14 nt, Chlamydia trachomatis
uacgaaaugacaca

SEQ ID NO: 2506048 - RNA, 12 nt, Chlamydia trachomatis
uacgaacaagau

SEQ ID NO: 2506049 - RNA, 20 nt, Chlamydia trachomatis
uacgaauaagaguccuaaua

SEQ ID NO: 2506050 - RNA, 20 nt, Chlamydia trachomatis
uacgaauuucugggaaaauu

SEQ ID NO: 2506051 - RNA, 19 nt, Chlamydia trachomatis
uacgagaggguuucuucuu

SEQ ID NO: 2506052 - RNA, 20 nt, Chlamydia trachomatis
uacgagcugaccuuuuacuu

SEQ ID NO: 2506053 - RNA, 15 nt, Chlamydia trachomatis
uacgaguaucuguua

SEQ ID NO: 2506054 - RNA, 20 nt, Chlamydia trachomatis
uacgauauccaucauaaaaa

SEQ ID NO: 2506055 - RNA, 22 nt, Chlamydia trachomatis
uacgauauccaucauaaaaaga

SEQ ID NO: 2506056 - RNA, 13 nt, Chlamydia trachomatis
uacgauggaaaua

SEQ ID NO: 2506057 - RNA, 15 nt, Chlamydia trachomatis
uacgcaaacuguauu

SEQ ID NO: 2506058 - RNA, 15 nt, Chlamydia trachomatis
uacgcauuugcucuu

SEQ ID NO: 2506059 - RNA, 13 nt, Chlamydia trachomatis
uacgcucuuucuu

SEQ ID NO: 2506060 - RNA, 21 nt, Chlamydia trachomatis
uacgcugguauaccaggagcg

SEQ ID NO: 2506061 - RNA, 17 nt, Chlamydia trachomatis
uacgcuuccuacagcua

SEQ ID NO: 2506062 - RNA, 15 nt, Chlamydia trachomatis
uacggaaaaagaaga

SEQ ID NO: 2506063 - RNA, 22 nt, Chlamydia trachomatis
uacggaaaaagaagaucccaua

SEQ ID NO: 2506064 - RNA, 13 nt, Chlamydia trachomatis
uacggaaaccaau

SEQ ID NO: 2506065 - RNA, 16 nt, Chlamydia trachomatis
uacggacggacaaauu

SEQ ID NO: 2506066 - RNA, 21 nt, Chlamydia trachomatis
uacggacggacaaauuucuau

SEQ ID NO: 2506067 - RNA, 17 nt, Chlamydia trachomatis
uacgguuucaagagcau

SEQ ID NO: 2506068 - RNA, 15 nt, Chlamydia trachomatis
uacuaaaaugacuag

SEQ ID NO: 2506069 - RNA, 18 nt, Chlamydia trachomatis
uacuaaacuaucuaaaau

SEQ ID NO: 2506070 - RNA, 13 nt, Chlamydia trachomatis
uacuaacaaauag

SEQ ID NO: 2506071 - RNA, 19 nt, Chlamydia trachomatis
uacuaacaucaaagaucuu

SEQ ID NO: 2506072 - RNA, 21 nt, Chlamydia trachomatis
uacuacaacaggaccagagau

SEQ ID NO: 2506073 - RNA, 18 nt, Chlamydia trachomatis
uacuagauagauggcauu

SEQ ID NO: 2506074 - RNA, 22 nt, Chlamydia trachomatis
uacuaucaggaauaaugauuuu

SEQ ID NO: 2506075 - RNA, 16 nt, Chlamydia trachomatis
uacuauucgagaauga

SEQ ID NO: 2506076 - RNA, 19 nt, Chlamydia trachomatis
uacuauucgagaaugaaua

SEQ ID NO: 2506077 - RNA, 22 nt, Chlamydia trachomatis
uacucaucgaauuaauaauucc

SEQ ID NO: 2506078 - RNA, 14 nt, Chlamydia trachomatis
uacucaucuuuuuu

SEQ ID NO: 2506079 - RNA, 16 nt, Chlamydia trachomatis
uacucaucuuuuuuaa

SEQ ID NO: 2506080 - RNA, 18 nt, Chlamydia trachomatis
uacucaucuuuuuuaaaa

SEQ ID NO: 2506081 - RNA, 20 nt, Chlamydia trachomatis
uacucaucuuuuuuaaaaag

SEQ ID NO: 2506082 - RNA, 20 nt, Chlamydia trachomatis
uacuccucgucgaagaaauc

SEQ ID NO: 2506083 - RNA, 21 nt, Chlamydia trachomatis
uacuccucgucgaagaaaucc

SEQ ID NO: 2506084 - RNA, 16 nt, Chlamydia trachomatis
uacucgauggcaggga

SEQ ID NO: 2506085 - RNA, 14 nt, Chlamydia trachomatis
uacucgucuuuuac

SEQ ID NO: 2506086 - RNA, 18 nt, Chlamydia trachomatis
uacucuaaaaguuuucuu

SEQ ID NO: 2506087 - RNA, 13 nt, Chlamydia trachomatis
uacucugauuaga

SEQ ID NO: 2506088 - RNA, 24 nt, Chlamydia trachomatis
uacucugauuagaagguccgccaa

SEQ ID NO: 2506089 - RNA, 17 nt, Chlamydia trachomatis
uacucugcaaaaucuuc

SEQ ID NO: 2506090 - RNA, 13 nt, Chlamydia trachomatis
uacucuuuucuuu

SEQ ID NO: 2506091 - RNA, 15 nt, Chlamydia trachomatis
uacugacaaggcugc

SEQ ID NO: 2506092 - RNA, 17 nt, Chlamydia trachomatis
uacugacaaggcugcua

SEQ ID NO: 2506093 - RNA, 22 nt, Chlamydia trachomatis
uacugcaauaaggggaagaaau

SEQ ID NO: 2506094 - RNA, 18 nt, Chlamydia trachomatis
uacugucagaccuacaaa

SEQ ID NO: 2506095 - RNA, 18 nt, Chlamydia trachomatis
uacuuacgagaucgccuu

SEQ ID NO: 2506096 - RNA, 11 nt, Chlamydia trachomatis
uacuucauuuu

SEQ ID NO: 2506097 - RNA, 21 nt, Chlamydia trachomatis
uacuucccacauacuuggauc

SEQ ID NO: 2506098 - RNA, 14 nt, Chlamydia trachomatis
uacuuccguuucuu

SEQ ID NO: 2506099 - RNA, 13 nt, Chlamydia trachomatis
uacuucuaaaauu

SEQ ID NO: 2506100 - RNA, 15 nt, Chlamydia trachomatis
uacuucuaaaauuug

SEQ ID NO: 2506101 - RNA, 22 nt, Chlamydia trachomatis
uacuucuaguuauauugcuuca

SEQ ID NO: 2506102 - RNA, 18 nt, Chlamydia trachomatis
uacuucuuacuuaaaaaa

SEQ ID NO: 2506103 - RNA, 14 nt, Chlamydia trachomatis
uacuugagaacaaa

SEQ ID NO: 2506104 - RNA, 15 nt, Chlamydia trachomatis
uacuugagaacaaac

SEQ ID NO: 2506105 - RNA, 20 nt, Chlamydia trachomatis
uacuugcuccguggcaagca

SEQ ID NO: 2506106 - RNA, 17 nt, Chlamydia trachomatis
uacuuuaccgcaaauau

SEQ ID NO: 2506107 - RNA, 13 nt, Chlamydia trachomatis
uacuuuaggagaa

SEQ ID NO: 2506108 - RNA, 18 nt, Chlamydia trachomatis
uacuuuuccgaauucuuu

SEQ ID NO: 2506109 - RNA, 12 nt, Chlamydia trachomatis
uagaaaaagaga

SEQ ID NO: 2506110 - RNA, 13 nt, Chlamydia trachomatis
uagaaaaagagaa

SEQ ID NO: 2506111 - RNA, 15 nt, Chlamydia trachomatis
uagaaaaagagaaau

SEQ ID NO: 2506112 - RNA, 16 nt, Chlamydia trachomatis
uagaaaaagagaaaua

SEQ ID NO: 2506113 - RNA, 13 nt, Chlamydia trachomatis
uagaaaagagcag

SEQ ID NO: 2506114 - RNA, 15 nt, Chlamydia trachomatis
uagaaaagagcagcu

SEQ ID NO: 2506115 - RNA, 15 nt, Chlamydia trachomatis
uagaaaaucauagau

SEQ ID NO: 2506116 - RNA, 13 nt, Chlamydia trachomatis
uagaaaaucuauu

SEQ ID NO: 2506117 - RNA, 17 nt, Chlamydia trachomatis
uagaaacagccugcuuu

SEQ ID NO: 2506118 - RNA, 22 nt, Chlamydia trachomatis
uagaaacuauugaucaaaguau

SEQ ID NO: 2506119 - RNA, 18 nt, Chlamydia trachomatis
uagaaacuuacuuuucuu

SEQ ID NO: 2506120 - RNA, 12 nt, Chlamydia trachomatis
uagaaagaacca

SEQ ID NO: 2506121 - RNA, 13 nt, Chlamydia trachomatis
uagaaagaggcuu

SEQ ID NO: 2506122 - RNA, 21 nt, Chlamydia trachomatis
uagaaagcuacagucugucca

SEQ ID NO: 2506123 - RNA, 22 nt, Chlamydia trachomatis
uagaaagcuacagucuguccag

SEQ ID NO: 2506124 - RNA, 15 nt, Chlamydia trachomatis
uagaaauuacagaag

SEQ ID NO: 2506125 - RNA, 16 nt, Chlamydia trachomatis
uagaaauuacagaaga

SEQ ID NO: 2506126 - RNA, 14 nt, Chlamydia trachomatis
uagaaauucaucau

SEQ ID NO: 2506127 - RNA, 16 nt, Chlamydia trachomatis
uagaaauuuuaaaucc

SEQ ID NO: 2506128 - RNA, 20 nt, Chlamydia trachomatis
uagaacagauuuagagaaua

SEQ ID NO: 2506129 - RNA, 19 nt, Chlamydia trachomatis
uagaaccacuuuucuguau

SEQ ID NO: 2506130 - RNA, 15 nt, Chlamydia trachomatis
uagaacggcauuccc

SEQ ID NO: 2506131 - RNA, 18 nt, Chlamydia trachomatis
uagaacggcauucccauu

SEQ ID NO: 2506132 - RNA, 19 nt, Chlamydia trachomatis
uagaacggcauucccauuu

SEQ ID NO: 2506133 - RNA, 21 nt, Chlamydia trachomatis
uagaagacaaagaucguaaaa

SEQ ID NO: 2506134 - RNA, 23 nt, Chlamydia trachomatis
uagaagauccuucgcaggggaau

SEQ ID NO: 2506135 - RNA, 16 nt, Chlamydia trachomatis
uagaagccaauguucu

SEQ ID NO: 2506136 - RNA, 18 nt, Chlamydia trachomatis
uagaaggucugaacaacu

SEQ ID NO: 2506137 - RNA, 18 nt, Chlamydia trachomatis
uagaaguagucuacucca

SEQ ID NO: 2506138 - RNA, 14 nt, Chlamydia trachomatis
uagaauuucuucuu

SEQ ID NO: 2506139 - RNA, 18 nt, Chlamydia trachomatis
uagacaacguuuaaugaa

SEQ ID NO: 2506140 - RNA, 13 nt, Chlamydia trachomatis
uagacagcucuug

SEQ ID NO: 2506141 - RNA, 18 nt, Chlamydia trachomatis
uagaccuaagcuauguaa

SEQ ID NO: 2506142 - RNA, 16 nt, Chlamydia trachomatis
uagacgauccgcuucc

SEQ ID NO: 2506143 - RNA, 16 nt, Chlamydia trachomatis
uagacuggcauagucu

SEQ ID NO: 2506144 - RNA, 20 nt, Chlamydia trachomatis
uagacuguugaggagacuuu

SEQ ID NO: 2506145 - RNA, 15 nt, Chlamydia trachomatis
uagagaaaagaaaag

SEQ ID NO: 2506146 - RNA, 18 nt, Chlamydia trachomatis
uagagaagaauugaagua

SEQ ID NO: 2506147 - RNA, 11 nt, Chlamydia trachomatis
uagagaauaau

SEQ ID NO: 2506148 - RNA, 19 nt, Chlamydia trachomatis
uagagaauggguaagggga

SEQ ID NO: 2506149 - RNA, 20 nt, Chlamydia trachomatis
uagagaauggguaaggggaa

SEQ ID NO: 2506150 - RNA, 17 nt, Chlamydia trachomatis
uagagaauuagagauaa

SEQ ID NO: 2506151 - RNA, 17 nt, Chlamydia trachomatis
uagagacggucuacaaa

SEQ ID NO: 2506152 - RNA, 22 nt, Chlamydia trachomatis
uagagacggucuacaaauagug

SEQ ID NO: 2506153 - RNA, 20 nt, Chlamydia trachomatis
uagagaguucguuaggauuc

SEQ ID NO: 2506154 - RNA, 22 nt, Chlamydia trachomatis
uagagauaucccuaaagaggca

SEQ ID NO: 2506155 - RNA, 19 nt, Chlamydia trachomatis
uagagccccuauguaaaca

SEQ ID NO: 2506156 - RNA, 15 nt, Chlamydia trachomatis
uagaggaaacacugu

SEQ ID NO: 2506157 - RNA, 17 nt, Chlamydia trachomatis
uagaggaaugugaagaa

SEQ ID NO: 2506158 - RNA, 18 nt, Chlamydia trachomatis
uagaggagaacaagauaa

SEQ ID NO: 2506159 - RNA, 16 nt, Chlamydia trachomatis
uagaggcauggaaugg

SEQ ID NO: 2506160 - RNA, 17 nt, Chlamydia trachomatis
uagagguauuuuauuca

SEQ ID NO: 2506161 - RNA, 14 nt, Chlamydia trachomatis
uagagguuuccuua

SEQ ID NO: 2506162 - RNA, 15 nt, Chlamydia trachomatis
uagaguccugagcca

SEQ ID NO: 2506163 - RNA, 15 nt, Chlamydia trachomatis
uagagucucuaaaau

SEQ ID NO: 2506164 - RNA, 22 nt, Chlamydia trachomatis
uagauaaguccaucuaaaggga

SEQ ID NO: 2506165 - RNA, 14 nt, Chlamydia trachomatis
uagauaaucguauu

SEQ ID NO: 2506166 - RNA, 12 nt, Chlamydia trachomatis
uagauacacaga

SEQ ID NO: 2506167 - RNA, 14 nt, Chlamydia trachomatis
uagauagagauucc

SEQ ID NO: 2506168 - RNA, 19 nt, Chlamydia trachomatis
uagauagagauuccacuac

SEQ ID NO: 2506169 - RNA, 17 nt, Chlamydia trachomatis
uagauaggggaaacuag

SEQ ID NO: 2506170 - RNA, 23 nt, Chlamydia trachomatis
uagauaggggaaacuagcaaauu

SEQ ID NO: 2506171 - RNA, 21 nt, Chlamydia trachomatis
uagaucccuuucauucuuucg

SEQ ID NO: 2506172 - RNA, 16 nt, Chlamydia trachomatis
uagauccgcagccacu

SEQ ID NO: 2506173 - RNA, 19 nt, Chlamydia trachomatis
uagaucgguugcauccaau

SEQ ID NO: 2506174 - RNA, 16 nt, Chlamydia trachomatis
uagaucuuuucgucuu

SEQ ID NO: 2506175 - RNA, 20 nt, Chlamydia trachomatis
uagauggauaaucucugaaa

SEQ ID NO: 2506176 - RNA, 18 nt, Chlamydia trachomatis
uagauuagaagauaacaa

SEQ ID NO: 2506177 - RNA, 19 nt, Chlamydia trachomatis
uagauucagaacaagugca

SEQ ID NO: 2506178 - RNA, 19 nt, Chlamydia trachomatis
uagauuuuagaaggaucau

SEQ ID NO: 2506179 - RNA, 14 nt, Chlamydia trachomatis
uagcaaagaaauag

SEQ ID NO: 2506180 - RNA, 16 nt, Chlamydia trachomatis
uagcaaagacauaaaa

SEQ ID NO: 2506181 - RNA, 17 nt, Chlamydia trachomatis
uagcaaauucgcuacca

SEQ ID NO: 2506182 - RNA, 19 nt, Chlamydia trachomatis
uagcaaauucgcuaccaaa

SEQ ID NO: 2506183 - RNA, 23 nt, Chlamydia trachomatis
uagcaaauucgcuaccaaaaauu

SEQ ID NO: 2506184 - RNA, 13 nt, Chlamydia trachomatis
uagcaagacaucu

SEQ ID NO: 2506185 - RNA, 22 nt, Chlamydia trachomatis
uagcaauaaccugaccuugaac

SEQ ID NO: 2506186 - RNA, 23 nt, Chlamydia trachomatis
uagcaaugccgaaaccaacaaga

SEQ ID NO: 2506187 - RNA, 19 nt, Chlamydia trachomatis
uagcaaugcgaucagaaac

SEQ ID NO: 2506188 - RNA, 20 nt, Chlamydia trachomatis
uagcaaugcgaucagaaacg

SEQ ID NO: 2506189 - RNA, 21 nt, Chlamydia trachomatis
uagcacaaguugguagcagcu

SEQ ID NO: 2506190 - RNA, 16 nt, Chlamydia trachomatis
uagcacgcaaaacauc

SEQ ID NO: 2506191 - RNA, 23 nt, Chlamydia trachomatis
uagcagcaguuuuuauggaugau

SEQ ID NO: 2506192 - RNA, 18 nt, Chlamydia trachomatis
uagcagccaauuucucua

SEQ ID NO: 2506193 - RNA, 15 nt, Chlamydia trachomatis
uagcagcuagaacau

SEQ ID NO: 2506194 - RNA, 16 nt, Chlamydia trachomatis
uagcagcuagaacaua

SEQ ID NO: 2506195 - RNA, 14 nt, Chlamydia trachomatis
uagcagcucuuacu

SEQ ID NO: 2506196 - RNA, 18 nt, Chlamydia trachomatis
uagcaggaacuucuucau

SEQ ID NO: 2506197 - RNA, 16 nt, Chlamydia trachomatis
uagcagggaacacaga

SEQ ID NO: 2506198 - RNA, 17 nt, Chlamydia trachomatis
uagcagggaacacagag

SEQ ID NO: 2506199 - RNA, 16 nt, Chlamydia trachomatis
uagcaucauccccaga

SEQ ID NO: 2506200 - RNA, 13 nt, Chlamydia trachomatis
uagcaucguuuuu

SEQ ID NO: 2506201 - RNA, 13 nt, Chlamydia trachomatis
uagcaucucugua

SEQ ID NO: 2506202 - RNA, 12 nt, Chlamydia trachomatis
uagcaucuucac

SEQ ID NO: 2506203 - RNA, 16 nt, Chlamydia trachomatis
uagcaugaucaugcag

SEQ ID NO: 2506204 - RNA, 16 nt, Chlamydia trachomatis
uagcaugcaaaacagc

SEQ ID NO: 2506205 - RNA, 23 nt, Chlamydia trachomatis
uagcaugggcugcaucagcaaga

SEQ ID NO: 2506206 - RNA, 15 nt, Chlamydia trachomatis
uagcauguucagaau

SEQ ID NO: 2506207 - RNA, 17 nt, Chlamydia trachomatis
uagcauuaauauacuca

SEQ ID NO: 2506208 - RNA, 18 nt, Chlamydia trachomatis
uagcauugcgcagaucuc

SEQ ID NO: 2506209 - RNA, 18 nt, Chlamydia trachomatis
uagcauuugucuucgcaa

SEQ ID NO: 2506210 - RNA, 13 nt, Chlamydia trachomatis
uagccaaggaaga

SEQ ID NO: 2506211 - RNA, 13 nt, Chlamydia trachomatis
uagccaauccgua

SEQ ID NO: 2506212 - RNA, 21 nt, Chlamydia trachomatis
uagccaauccguaugauaaaa

SEQ ID NO: 2506213 - RNA, 20 nt, Chlamydia trachomatis
uagccaauuuccauggagcu

SEQ ID NO: 2506214 - RNA, 16 nt, Chlamydia trachomatis
uagccauaccaaugga

SEQ ID NO: 2506215 - RNA, 12 nt, Chlamydia trachomatis
uagccuccaaac

SEQ ID NO: 2506216 - RNA, 16 nt, Chlamydia trachomatis
uagccuggcugcagaa

SEQ ID NO: 2506217 - RNA, 16 nt, Chlamydia trachomatis
uagcgauuuucugaag

SEQ ID NO: 2506218 - RNA, 20 nt, Chlamydia trachomatis
uagcggaacaagcaaaacau

SEQ ID NO: 2506219 - RNA, 21 nt, Chlamydia trachomatis
uagcggaacaagcaaaacaua

SEQ ID NO: 2506220 - RNA, 18 nt, Chlamydia trachomatis
uagcgucuaacuaaaugu

SEQ ID NO: 2506221 - RNA, 23 nt, Chlamydia trachomatis
uagcuaaucuuuuugauuuuucu

SEQ ID NO: 2506222 - RNA, 12 nt, Chlamydia trachomatis
uagcuacagcaa

SEQ ID NO: 2506223 - RNA, 23 nt, Chlamydia trachomatis
uagcuaccacgagcauaagaaua

SEQ ID NO: 2506224 - RNA, 22 nt, Chlamydia trachomatis
uagcuaucgcggcuaucgucuu

SEQ ID NO: 2506225 - RNA, 23 nt, Chlamydia trachomatis
uagcuaucgcggcuaucgucuuu

SEQ ID NO: 2506226 - RNA, 22 nt, Chlamydia trachomatis
uagcucccugcucuugaagaua

SEQ ID NO: 2506227 - RNA, 15 nt, Chlamydia trachomatis
uagcucguuuuuuug

SEQ ID NO: 2506228 - RNA, 15 nt, Chlamydia trachomatis
uagcugaacccuuca

SEQ ID NO: 2506229 - RNA, 21 nt, Chlamydia trachomatis
uagcugacuuugaagauucua

SEQ ID NO: 2506230 - RNA, 13 nt, Chlamydia trachomatis
uagcugauaagga

SEQ ID NO: 2506231 - RNA, 17 nt, Chlamydia trachomatis
uagcuguaauaaacacu

SEQ ID NO: 2506232 - RNA, 17 nt, Chlamydia trachomatis
uagcuguuaugaaccag

SEQ ID NO: 2506233 - RNA, 22 nt, Chlamydia trachomatis
uagcuguuaugaaccagggaga

SEQ ID NO: 2506234 - RNA, 23 nt, Chlamydia trachomatis
uagcuucagaagaagauguuguu

SEQ ID NO: 2506235 - RNA, 18 nt, Chlamydia trachomatis
uagcuucguagagcaaga

SEQ ID NO: 2506236 - RNA, 17 nt, Chlamydia trachomatis
uagcuucuaauuucuuu

SEQ ID NO: 2506237 - RNA, 13 nt, Chlamydia trachomatis
uagcuucugacuc

SEQ ID NO: 2506238 - RNA, 15 nt, Chlamydia trachomatis
uagcuugcacagcaa

SEQ ID NO: 2506239 - RNA, 15 nt, Chlamydia trachomatis
uagcuuuuuucagaa

SEQ ID NO: 2506240 - RNA, 17 nt, Chlamydia trachomatis
uaggaaaauacacagca

SEQ ID NO: 2506241 - RNA, 15 nt, Chlamydia trachomatis
uaggaacuacauucg

SEQ ID NO: 2506242 - RNA, 23 nt, Chlamydia trachomatis
uaggaacucccucauuaagaaua

SEQ ID NO: 2506243 - RNA, 15 nt, Chlamydia trachomatis
uaggaacucuaaaua

SEQ ID NO: 2506244 - RNA, 21 nt, Chlamydia trachomatis
uaggaaggguuuugaagcuug

SEQ ID NO: 2506245 - RNA, 21 nt, Chlamydia trachomatis
uaggacaauuaucuccuaaga

SEQ ID NO: 2506246 - RNA, 19 nt, Chlamydia trachomatis
uaggacucuaagagaacca

SEQ ID NO: 2506247 - RNA, 15 nt, Chlamydia trachomatis
uaggagagaaucuuu

SEQ ID NO: 2506248 - RNA, 15 nt, Chlamydia trachomatis
uaggagagagcccuu

SEQ ID NO: 2506249 - RNA, 12 nt, Chlamydia trachomatis
uaggagcaagaa

SEQ ID NO: 2506250 - RNA, 22 nt, Chlamydia trachomatis
uaggagcuuuuugcaaugcaaa

SEQ ID NO: 2506251 - RNA, 14 nt, Chlamydia trachomatis
uaggaucccaagga

SEQ ID NO: 2506252 - RNA, 17 nt, Chlamydia trachomatis
uaggaucccaaggaaau

SEQ ID NO: 2506253 - RNA, 12 nt, Chlamydia trachomatis
uaggaucuggaa

SEQ ID NO: 2506254 - RNA, 13 nt, Chlamydia trachomatis
uaggaucuggaac

SEQ ID NO: 2506255 - RNA, 16 nt, Chlamydia trachomatis
uaggauuaaaauccau

SEQ ID NO: 2506256 - RNA, 16 nt, Chlamydia trachomatis
uaggauucguugcucc

SEQ ID NO: 2506257 - RNA, 20 nt, Chlamydia trachomatis
uaggcauaguuggugucuuu

SEQ ID NO: 2506258 - RNA, 18 nt, Chlamydia trachomatis
uaggcauuaaagggaaaa

SEQ ID NO: 2506259 - RNA, 20 nt, Chlamydia trachomatis
uaggccauuucaugacagcu

SEQ ID NO: 2506260 - RNA, 16 nt, Chlamydia trachomatis
uaggcgaauuucucua

SEQ ID NO: 2506261 - RNA, 21 nt, Chlamydia trachomatis
uaggcgacacgcuucuucaaa

SEQ ID NO: 2506262 - RNA, 12 nt, Chlamydia trachomatis
uaggcucgccau

SEQ ID NO: 2506263 - RNA, 21 nt, Chlamydia trachomatis
uaggcugcucccucuggagug

SEQ ID NO: 2506264 - RNA, 11 nt, Chlamydia trachomatis
uagggaaaaac

SEQ ID NO: 2506265 - RNA, 14 nt, Chlamydia trachomatis
uagggaagauagga

SEQ ID NO: 2506266 - RNA, 21 nt, Chlamydia trachomatis
uagggaauaaaaguacuucua

SEQ ID NO: 2506267 - RNA, 16 nt, Chlamydia trachomatis
uagggaucucagcugg

SEQ ID NO: 2506268 - RNA, 15 nt, Chlamydia trachomatis
uaggggaagaaucaa

SEQ ID NO: 2506269 - RNA, 16 nt, Chlamydia trachomatis
uaggggaagaaucaau

SEQ ID NO: 2506270 - RNA, 12 nt, Chlamydia trachomatis
uaggguuguuuu

SEQ ID NO: 2506271 - RNA, 15 nt, Chlamydia trachomatis
uaggguuguuuuaga

SEQ ID NO: 2506272 - RNA, 16 nt, Chlamydia trachomatis
uaggguuguuuuagaa

SEQ ID NO: 2506273 - RNA, 15 nt, Chlamydia trachomatis
uagguaccacgccaa

SEQ ID NO: 2506274 - RNA, 14 nt, Chlamydia trachomatis
uagguagaaaagga

SEQ ID NO: 2506275 - RNA, 19 nt, Chlamydia trachomatis
uagguccucuaaucuugau

SEQ ID NO: 2506276 - RNA, 14 nt, Chlamydia trachomatis
uagguuccaucuaa

SEQ ID NO: 2506277 - RNA, 21 nt, Chlamydia trachomatis
uagguucuuugaucaaauccu

SEQ ID NO: 2506278 - RNA, 16 nt, Chlamydia trachomatis
uagguugaagaggcaa

SEQ ID NO: 2506279 - RNA, 13 nt, Chlamydia trachomatis
uagguuucugcua

SEQ ID NO: 2506280 - RNA, 23 nt, Chlamydia trachomatis
uagguuuuaaagaggcgacagcu

SEQ ID NO: 2506281 - RNA, 15 nt, Chlamydia trachomatis
uaguaaaaacuauaa

SEQ ID NO: 2506282 - RNA, 23 nt, Chlamydia trachomatis
uaguaaugugucuaaagaucggc

SEQ ID NO: 2506283 - RNA, 13 nt, Chlamydia trachomatis
uaguaauuuugac

SEQ ID NO: 2506284 - RNA, 24 nt, Chlamydia trachomatis
uaguaauuuugacagaauugagca

SEQ ID NO: 2506285 - RNA, 13 nt, Chlamydia trachomatis
uaguacaaaaaua

SEQ ID NO: 2506286 - RNA, 14 nt, Chlamydia trachomatis
uaguacaaaaauac

SEQ ID NO: 2506287 - RNA, 17 nt, Chlamydia trachomatis
uaguacaaaaauacuug

SEQ ID NO: 2506288 - RNA, 16 nt, Chlamydia trachomatis
uaguacguguuaucaa

SEQ ID NO: 2506289 - RNA, 15 nt, Chlamydia trachomatis
uaguauaugcucuuu

SEQ ID NO: 2506290 - RNA, 22 nt, Chlamydia trachomatis
uaguaucuauaaucuauuuuau

SEQ ID NO: 2506291 - RNA, 20 nt, Chlamydia trachomatis
uaguauuacggaaaagcuuu

SEQ ID NO: 2506292 - RNA, 21 nt, Chlamydia trachomatis
uagucaucugcagccuacaua

SEQ ID NO: 2506293 - RNA, 16 nt, Chlamydia trachomatis
uagucaugaauggaaa

SEQ ID NO: 2506294 - RNA, 22 nt, Chlamydia trachomatis
uagucaugaauggaaaguacuc

SEQ ID NO: 2506295 - RNA, 18 nt, Chlamydia trachomatis
uaguccacauucacuuca

SEQ ID NO: 2506296 - RNA, 14 nt, Chlamydia trachomatis
uaguccaugugaga

SEQ ID NO: 2506297 - RNA, 23 nt, Chlamydia trachomatis
uagucucccaaauuucugucacu

SEQ ID NO: 2506298 - RNA, 18 nt, Chlamydia trachomatis
uagucugggcgaucuccu

SEQ ID NO: 2506299 - RNA, 20 nt, Chlamydia trachomatis
uagucuuuguugcuauaugg

SEQ ID NO: 2506300 - RNA, 14 nt, Chlamydia trachomatis
uagugaagagcaga

SEQ ID NO: 2506301 - RNA, 15 nt, Chlamydia trachomatis
uagugauaaacagga

SEQ ID NO: 2506302 - RNA, 17 nt, Chlamydia trachomatis
uaguggugaguagcaaa

SEQ ID NO: 2506303 - RNA, 16 nt, Chlamydia trachomatis
uaguguaaggagagaa

SEQ ID NO: 2506304 - RNA, 17 nt, Chlamydia trachomatis
uagugucuucgaauccu

SEQ ID NO: 2506305 - RNA, 18 nt, Chlamydia trachomatis
uaguuaaaacuccagaaa

SEQ ID NO: 2506306 - RNA, 13 nt, Chlamydia trachomatis
uaguuaaauguug

SEQ ID NO: 2506307 - RNA, 15 nt, Chlamydia trachomatis
uaguuaaauguugau

SEQ ID NO: 2506308 - RNA, 14 nt, Chlamydia trachomatis
uaguuacauacuuu

SEQ ID NO: 2506309 - RNA, 16 nt, Chlamydia trachomatis
uaguuaccaaaaagga

SEQ ID NO: 2506310 - RNA, 13 nt, Chlamydia trachomatis
uaguuagugaagu

SEQ ID NO: 2506311 - RNA, 16 nt, Chlamydia trachomatis
uaguuagugaagucug

SEQ ID NO: 2506312 - RNA, 16 nt, Chlamydia trachomatis
uaguuccacuuaauac

SEQ ID NO: 2506313 - RNA, 22 nt, Chlamydia trachomatis
uaguucguuacgcguaaagauu

SEQ ID NO: 2506314 - RNA, 23 nt, Chlamydia trachomatis
uaguucuaacacuuuuuuuucuu

SEQ ID NO: 2506315 - RNA, 19 nt, Chlamydia trachomatis
uaguuggccagcucaaaga

SEQ ID NO: 2506316 - RNA, 14 nt, Chlamydia trachomatis
uaguuguuuuugau

SEQ ID NO: 2506317 - RNA, 17 nt, Chlamydia trachomatis
uaguuuuguaaacgaga

SEQ ID NO: 2506318 - RNA, 21 nt, Chlamydia trachomatis
uauaaaugaaaccccucuuuc

SEQ ID NO: 2506319 - RNA, 22 nt, Chlamydia trachomatis
uauaacuaagaucuccaugauc

SEQ ID NO: 2506320 - RNA, 12 nt, Chlamydia trachomatis
uauaagaaaaag

SEQ ID NO: 2506321 - RNA, 16 nt, Chlamydia trachomatis
uauaagaccuaaucca

SEQ ID NO: 2506322 - RNA, 14 nt, Chlamydia trachomatis
uauaagagaacccu

SEQ ID NO: 2506323 - RNA, 18 nt, Chlamydia trachomatis
uauaagucaaaagaaucc

SEQ ID NO: 2506324 - RNA, 21 nt, Chlamydia trachomatis
uauaaguucagccccuaaagc

SEQ ID NO: 2506325 - RNA, 16 nt, Chlamydia trachomatis
uauaaguuuuaagaag

SEQ ID NO: 2506326 - RNA, 12 nt, Chlamydia trachomatis
uauaauccagga

SEQ ID NO: 2506327 - RNA, 19 nt, Chlamydia trachomatis
uauaaucccaaaaacaauc

SEQ ID NO: 2506328 - RNA, 20 nt, Chlamydia trachomatis
uauaauccgagcauuuucca

SEQ ID NO: 2506329 - RNA, 16 nt, Chlamydia trachomatis
uauaaucuauuuuaua

SEQ ID NO: 2506330 - RNA, 13 nt, Chlamydia trachomatis
uauacacuaucag

SEQ ID NO: 2506331 - RNA, 11 nt, Chlamydia trachomatis
uauacagaaca

SEQ ID NO: 2506332 - RNA, 13 nt, Chlamydia trachomatis
uauacagagcaag

SEQ ID NO: 2506333 - RNA, 22 nt, Chlamydia trachomatis
uauacagcaugccuucuuccuu

SEQ ID NO: 2506334 - RNA, 19 nt, Chlamydia trachomatis
uauacaucagagcaauaga

SEQ ID NO: 2506335 - RNA, 19 nt, Chlamydia trachomatis
uauaccagcagacccaaau

SEQ ID NO: 2506336 - RNA, 18 nt, Chlamydia trachomatis
uauacccgacuaaaaaau

SEQ ID NO: 2506337 - RNA, 19 nt, Chlamydia trachomatis
uauaccgccucaaacaauc

SEQ ID NO: 2506338 - RNA, 15 nt, Chlamydia trachomatis
uauaccggaacguga

SEQ ID NO: 2506339 - RNA, 21 nt, Chlamydia trachomatis
uauacguuuaccgcucuucca

SEQ ID NO: 2506340 - RNA, 19 nt, Chlamydia trachomatis
uauacuagggaauaaaagu

SEQ ID NO: 2506341 - RNA, 20 nt, Chlamydia trachomatis
uauacuucuuacuuaaaaaa

SEQ ID NO: 2506342 - RNA, 17 nt, Chlamydia trachomatis
uauacuuuagauuuguu

SEQ ID NO: 2506343 - RNA, 15 nt, Chlamydia trachomatis
uauagaagacuaauc

SEQ ID NO: 2506344 - RNA, 21 nt, Chlamydia trachomatis
uauagagaauugccgaaucaa

SEQ ID NO: 2506345 - RNA, 23 nt, Chlamydia trachomatis
uauagccacgauaagaucuugag

SEQ ID NO: 2506346 - RNA, 11 nt, Chlamydia trachomatis
uauaggauuug

SEQ ID NO: 2506347 - RNA, 15 nt, Chlamydia trachomatis
uauaggcugaaacuu

SEQ ID NO: 2506348 - RNA, 15 nt, Chlamydia trachomatis
uauaggcuuccaaau

SEQ ID NO: 2506349 - RNA, 20 nt, Chlamydia trachomatis
uauaggggugagcuccuaag

SEQ ID NO: 2506350 - RNA, 22 nt, Chlamydia trachomatis
uauaggguccaaacauaagagg

SEQ ID NO: 2506351 - RNA, 19 nt, Chlamydia trachomatis
uauagguuccaucuaaagg

SEQ ID NO: 2506352 - RNA, 17 nt, Chlamydia trachomatis
uauaguuguuuuugaug

SEQ ID NO: 2506353 - RNA, 19 nt, Chlamydia trachomatis
uauauagaccagagucucc

SEQ ID NO: 2506354 - RNA, 16 nt, Chlamydia trachomatis
uauauauuuaagaagc

SEQ ID NO: 2506355 - RNA, 19 nt, Chlamydia trachomatis
uauaucuuaauugaaauau

SEQ ID NO: 2506356 - RNA, 14 nt, Chlamydia trachomatis
uauauguaagaagc

SEQ ID NO: 2506357 - RNA, 21 nt, Chlamydia trachomatis
uauauucggagauuucggaua

SEQ ID NO: 2506358 - RNA, 18 nt, Chlamydia trachomatis
uaucaaaaauagcaucug

SEQ ID NO: 2506359 - RNA, 19 nt, Chlamydia trachomatis
uaucaaauuuuucagaaaa

SEQ ID NO: 2506360 - RNA, 12 nt, Chlamydia trachomatis
uaucaacaucug

SEQ ID NO: 2506361 - RNA, 17 nt, Chlamydia trachomatis
uaucaagaauuucuuga

SEQ ID NO: 2506362 - RNA, 13 nt, Chlamydia trachomatis
uaucaauaaaaac

SEQ ID NO: 2506363 - RNA, 14 nt, Chlamydia trachomatis
uaucaauaaagaag

SEQ ID NO: 2506364 - RNA, 17 nt, Chlamydia trachomatis
uaucaauaaagaagccu

SEQ ID NO: 2506365 - RNA, 21 nt, Chlamydia trachomatis
uaucacaaaccagcucaucaa

SEQ ID NO: 2506366 - RNA, 18 nt, Chlamydia trachomatis
uaucacuguugagaaaaa

SEQ ID NO: 2506367 - RNA, 14 nt, Chlamydia trachomatis
uaucagaagauagu

SEQ ID NO: 2506368 - RNA, 21 nt, Chlamydia trachomatis
uaucagcaaaagugcuccuaa

SEQ ID NO: 2506369 - RNA, 19 nt, Chlamydia trachomatis
uaucagcaaccauauauuu

SEQ ID NO: 2506370 - RNA, 15 nt, Chlamydia trachomatis
uaucagcacagcgga

SEQ ID NO: 2506371 - RNA, 11 nt, Chlamydia trachomatis
uaucagcaucc

SEQ ID NO: 2506372 - RNA, 24 nt, Chlamydia trachomatis
uaucagcgucaucuuugagaagca

SEQ ID NO: 2506373 - RNA, 13 nt, Chlamydia trachomatis
uaucauguagccc

SEQ ID NO: 2506374 - RNA, 21 nt, Chlamydia trachomatis
uaucauuaucguucucuaaag

SEQ ID NO: 2506375 - RNA, 19 nt, Chlamydia trachomatis
uaucauugaaaucagaaac

SEQ ID NO: 2506376 - RNA, 11 nt, Chlamydia trachomatis
uaucauuucca

SEQ ID NO: 2506377 - RNA, 13 nt, Chlamydia trachomatis
uauccaaaaggau

SEQ ID NO: 2506378 - RNA, 18 nt, Chlamydia trachomatis
uauccacuuuuaggauag

SEQ ID NO: 2506379 - RNA, 21 nt, Chlamydia trachomatis
uauccagaaguuuuaacauga

SEQ ID NO: 2506380 - RNA, 15 nt, Chlamydia trachomatis
uauccaucauaaaaa

SEQ ID NO: 2506381 - RNA, 19 nt, Chlamydia trachomatis
uauccaucauaaaaagaua

SEQ ID NO: 2506382 - RNA, 18 nt, Chlamydia trachomatis
uauccaugaucucugcag

SEQ ID NO: 2506383 - RNA, 19 nt, Chlamydia trachomatis
uauccaugaucucugcaga

SEQ ID NO: 2506384 - RNA, 17 nt, Chlamydia trachomatis
uaucccgcgguagaaag

SEQ ID NO: 2506385 - RNA, 18 nt, Chlamydia trachomatis
uauccuagagacggucua

SEQ ID NO: 2506386 - RNA, 24 nt, Chlamydia trachomatis
uauccuagagacggucuacaaaua

SEQ ID NO: 2506387 - RNA, 16 nt, Chlamydia trachomatis
uauccugcucaacaua

SEQ ID NO: 2506388 - RNA, 15 nt, Chlamydia trachomatis
uauccuguucuccaa

SEQ ID NO: 2506389 - RNA, 14 nt, Chlamydia trachomatis
uauccuuuuuacua

SEQ ID NO: 2506390 - RNA, 13 nt, Chlamydia trachomatis
uaucguaaacaaa

SEQ ID NO: 2506391 - RNA, 13 nt, Chlamydia trachomatis
uaucuaaaaaaau

SEQ ID NO: 2506392 - RNA, 11 nt, Chlamydia trachomatis
uaucuaaaauc

SEQ ID NO: 2506393 - RNA, 13 nt, Chlamydia trachomatis
uaucuaaaauccc

SEQ ID NO: 2506394 - RNA, 15 nt, Chlamydia trachomatis
uaucuaaaaucccua

SEQ ID NO: 2506395 - RNA, 21 nt, Chlamydia trachomatis
uaucuaacaauacuacuaagg

SEQ ID NO: 2506396 - RNA, 20 nt, Chlamydia trachomatis
uaucuaagcgacuacccuaa

SEQ ID NO: 2506397 - RNA, 15 nt, Chlamydia trachomatis
uaucuaccuuuuucc

SEQ ID NO: 2506398 - RNA, 20 nt, Chlamydia trachomatis
uaucuagacauagcuuguuc

SEQ ID NO: 2506399 - RNA, 15 nt, Chlamydia trachomatis
uaucuauaaucuauu

SEQ ID NO: 2506400 - RNA, 20 nt, Chlamydia trachomatis
uaucucaggauaaaacccua

SEQ ID NO: 2506401 - RNA, 20 nt, Chlamydia trachomatis
uaucuccgcuaggcaaauau

SEQ ID NO: 2506402 - RNA, 12 nt, Chlamydia trachomatis
uaucuccuaaaa

SEQ ID NO: 2506403 - RNA, 16 nt, Chlamydia trachomatis
uaucugcccaucaucg

SEQ ID NO: 2506404 - RNA, 15 nt, Chlamydia trachomatis
uaucugcuauagaaa

SEQ ID NO: 2506405 - RNA, 17 nt, Chlamydia trachomatis
uaucugcucuaaagcac

SEQ ID NO: 2506406 - RNA, 21 nt, Chlamydia trachomatis
uaucugcuuccguaacaauau

SEQ ID NO: 2506407 - RNA, 23 nt, Chlamydia trachomatis
uaucugggauggaaauaauuucu

SEQ ID NO: 2506408 - RNA, 18 nt, Chlamydia trachomatis
uaucugucagucuucuuu

SEQ ID NO: 2506409 - RNA, 14 nt, Chlamydia trachomatis
uaucuguucugcuc

SEQ ID NO: 2506410 - RNA, 15 nt, Chlamydia trachomatis
uaucuucaaagaaca

SEQ ID NO: 2506411 - RNA, 19 nt, Chlamydia trachomatis
uaucuucaacccuuuuaau

SEQ ID NO: 2506412 - RNA, 21 nt, Chlamydia trachomatis
uaucuucagguuuauaagaga

SEQ ID NO: 2506413 - RNA, 14 nt, Chlamydia trachomatis
uaucuucuuaauug

SEQ ID NO: 2506414 - RNA, 21 nt, Chlamydia trachomatis
uaucuugagagaccugcuuca

SEQ ID NO: 2506415 - RNA, 18 nt, Chlamydia trachomatis
uaugaaaaaaaaagccuc

SEQ ID NO: 2506416 - RNA, 22 nt, Chlamydia trachomatis
uaugaaaguagaccauuuagac

SEQ ID NO: 2506417 - RNA, 17 nt, Chlamydia trachomatis
uaugaacggcucuucuu

SEQ ID NO: 2506418 - RNA, 20 nt, Chlamydia trachomatis
uaugaauauuuaagggaagc

SEQ ID NO: 2506419 - RNA, 20 nt, Chlamydia trachomatis
uaugacagagcccuucuuuu

SEQ ID NO: 2506420 - RNA, 16 nt, Chlamydia trachomatis
uaugacccagaaucau

SEQ ID NO: 2506421 - RNA, 19 nt, Chlamydia trachomatis
uaugagccuugccuacaga

SEQ ID NO: 2506422 - RNA, 16 nt, Chlamydia trachomatis
uaugauucuucuagcu

SEQ ID NO: 2506423 - RNA, 22 nt, Chlamydia trachomatis
uaugcagacucaaagcuucccu

SEQ ID NO: 2506424 - RNA, 22 nt, Chlamydia trachomatis
uaugcgcaaagauguuucuuau

SEQ ID NO: 2506425 - RNA, 14 nt, Chlamydia trachomatis
uaugcggcaauacc

SEQ ID NO: 2506426 - RNA, 14 nt, Chlamydia trachomatis
uaugcuacuccuaa

SEQ ID NO: 2506427 - RNA, 19 nt, Chlamydia trachomatis
uaugcucgccucuaucucu

SEQ ID NO: 2506428 - RNA, 20 nt, Chlamydia trachomatis
uaugcucgccucuaucucuu

SEQ ID NO: 2506429 - RNA, 13 nt, Chlamydia trachomatis
uaugcugaagcua

SEQ ID NO: 2506430 - RNA, 17 nt, Chlamydia trachomatis
uaugcugaagcuacuaa

SEQ ID NO: 2506431 - RNA, 19 nt, Chlamydia trachomatis
uaugcugguugguuuucuu

SEQ ID NO: 2506432 - RNA, 18 nt, Chlamydia trachomatis
uaugcuuuuuaauauccu

SEQ ID NO: 2506433 - RNA, 15 nt, Chlamydia trachomatis
uauggaaguagcaua

SEQ ID NO: 2506434 - RNA, 14 nt, Chlamydia trachomatis
uauggacaagcaau

SEQ ID NO: 2506435 - RNA, 18 nt, Chlamydia trachomatis
uauggucgucucagcuuc

SEQ ID NO: 2506436 - RNA, 15 nt, Chlamydia trachomatis
uauggucucucauac

SEQ ID NO: 2506437 - RNA, 21 nt, Chlamydia trachomatis
uaugguuuuuucgauaguacc

SEQ ID NO: 2506438 - RNA, 18 nt, Chlamydia trachomatis
uauguaaacaagaauaau

SEQ ID NO: 2506439 - RNA, 13 nt, Chlamydia trachomatis
uauguaaggaaau

SEQ ID NO: 2506440 - RNA, 17 nt, Chlamydia trachomatis
uauguucagcauccuga

SEQ ID NO: 2506441 - RNA, 14 nt, Chlamydia trachomatis
uauuaaccaacucu

SEQ ID NO: 2506442 - RNA, 15 nt, Chlamydia trachomatis
uauuaagauccauuu

SEQ ID NO: 2506443 - RNA, 18 nt, Chlamydia trachomatis
uauuaucuagaaaagagc

SEQ ID NO: 2506444 - RNA, 19 nt, Chlamydia trachomatis
uauuauuacgaacagcaau

SEQ ID NO: 2506445 - RNA, 18 nt, Chlamydia trachomatis
uauuauugaaaaagcuuu

SEQ ID NO: 2506446 - RNA, 15 nt, Chlamydia trachomatis
uauuauuuaaaacaa

SEQ ID NO: 2506447 - RNA, 16 nt, Chlamydia trachomatis
uauucaaaucuucuuc

SEQ ID NO: 2506448 - RNA, 18 nt, Chlamydia trachomatis
uauucacacuuaaaaaga

SEQ ID NO: 2506449 - RNA, 22 nt, Chlamydia trachomatis
uauucacgcaucccaaaauagc

SEQ ID NO: 2506450 - RNA, 15 nt, Chlamydia trachomatis
uauucagaagaagag

SEQ ID NO: 2506451 - RNA, 20 nt, Chlamydia trachomatis
uauucagaagaagagcugcu

SEQ ID NO: 2506452 - RNA, 15 nt, Chlamydia trachomatis
uauuccaaagaaaug

SEQ ID NO: 2506453 - RNA, 23 nt, Chlamydia trachomatis
uauuccauaauaguuaaaacaca

SEQ ID NO: 2506454 - RNA, 23 nt, Chlamydia trachomatis
uauucccgaacuuuauuauugaa

SEQ ID NO: 2506455 - RNA, 19 nt, Chlamydia trachomatis
uauucgcaauauagagcau

SEQ ID NO: 2506456 - RNA, 16 nt, Chlamydia trachomatis
uauucgcuauuucgau

SEQ ID NO: 2506457 - RNA, 17 nt, Chlamydia trachomatis
uauucguguccucuauu

SEQ ID NO: 2506458 - RNA, 13 nt, Chlamydia trachomatis
uauucuaaagucu

SEQ ID NO: 2506459 - RNA, 16 nt, Chlamydia trachomatis
uauucuccgauaauuu

SEQ ID NO: 2506460 - RNA, 17 nt, Chlamydia trachomatis
uauucuccgauaauuuu

SEQ ID NO: 2506461 - RNA, 20 nt, Chlamydia trachomatis
uauucuguaaaaggaauucu

SEQ ID NO: 2506462 - RNA, 17 nt, Chlamydia trachomatis
uauucuugcuaagaaca

SEQ ID NO: 2506463 - RNA, 18 nt, Chlamydia trachomatis
uauucuuucuuaucuguc

SEQ ID NO: 2506464 - RNA, 14 nt, Chlamydia trachomatis
uauucuuuuccaua

SEQ ID NO: 2506465 - RNA, 12 nt, Chlamydia trachomatis
uauugaaagcau

SEQ ID NO: 2506466 - RNA, 11 nt, Chlamydia trachomatis
uauugauuuuu

SEQ ID NO: 2506467 - RNA, 20 nt, Chlamydia trachomatis
uauuguuuauaaauuucuaa

SEQ ID NO: 2506468 - RNA, 14 nt, Chlamydia trachomatis
uauuuaaaacaaug

SEQ ID NO: 2506469 - RNA, 13 nt, Chlamydia trachomatis
uauuuacgagagg

SEQ ID NO: 2506470 - RNA, 23 nt, Chlamydia trachomatis
uauuuacgagaggguuucuucuu

SEQ ID NO: 2506471 - RNA, 17 nt, Chlamydia trachomatis
uauuucaccacuuuucc

SEQ ID NO: 2506472 - RNA, 19 nt, Chlamydia trachomatis
uauuucaccacuuuuccga

SEQ ID NO: 2506473 - RNA, 18 nt, Chlamydia trachomatis
uauuucauuuaauaaguu

SEQ ID NO: 2506474 - RNA, 15 nt, Chlamydia trachomatis
uauuuccauaagaga

SEQ ID NO: 2506475 - RNA, 14 nt, Chlamydia trachomatis
uauuucccagugau

SEQ ID NO: 2506476 - RNA, 17 nt, Chlamydia trachomatis
uauuuccccuacaaaca

SEQ ID NO: 2506477 - RNA, 23 nt, Chlamydia trachomatis
uauuucucuuccugaauacucaa

SEQ ID NO: 2506478 - RNA, 16 nt, Chlamydia trachomatis
uauuucuuguguugaa

SEQ ID NO: 2506479 - RNA, 16 nt, Chlamydia trachomatis
uauuuguucucuuaga

SEQ ID NO: 2506480 - RNA, 12 nt, Chlamydia trachomatis
uauuuuagagaa

SEQ ID NO: 2506481 - RNA, 14 nt, Chlamydia trachomatis
uauuuuagagaaaa

SEQ ID NO: 2506482 - RNA, 13 nt, Chlamydia trachomatis
uauuuucaaaaau

SEQ ID NO: 2506483 - RNA, 14 nt, Chlamydia trachomatis
uauuuucaaaaccu

SEQ ID NO: 2506484 - RNA, 20 nt, Chlamydia trachomatis
uauuuucagcaaaagaagaa

SEQ ID NO: 2506485 - RNA, 16 nt, Chlamydia trachomatis
uauuuuuuaagaaguc

SEQ ID NO: 2506486 - RNA, 11 nt, Chlamydia trachomatis
ucaaaaaagau

SEQ ID NO: 2506487 - RNA, 15 nt, Chlamydia trachomatis
ucaaaaaaggaaucu

SEQ ID NO: 2506488 - RNA, 18 nt, Chlamydia trachomatis
ucaaaaaaggcauaaaag

SEQ ID NO: 2506489 - RNA, 23 nt, Chlamydia trachomatis
ucaaaaacacuacgcuacagagu

SEQ ID NO: 2506490 - RNA, 17 nt, Chlamydia trachomatis
ucaaaaagagcuaaacu

SEQ ID NO: 2506491 - RNA, 19 nt, Chlamydia trachomatis
ucaaaaagcuguaaacgua

SEQ ID NO: 2506492 - RNA, 13 nt, Chlamydia trachomatis
ucaaaaauagcaa

SEQ ID NO: 2506493 - RNA, 19 nt, Chlamydia trachomatis
ucaaaaauagcaucuggaa

SEQ ID NO: 2506494 - RNA, 19 nt, Chlamydia trachomatis
ucaaaaccuugaugaauuu

SEQ ID NO: 2506495 - RNA, 16 nt, Chlamydia trachomatis
ucaaaacgcucagaaa

SEQ ID NO: 2506496 - RNA, 18 nt, Chlamydia trachomatis
ucaaaacgcucagaaaac

SEQ ID NO: 2506497 - RNA, 20 nt, Chlamydia trachomatis
ucaaaacuaaaaguugcucu

SEQ ID NO: 2506498 - RNA, 21 nt, Chlamydia trachomatis
ucaaaaggccaacgcauguaa

SEQ ID NO: 2506499 - RNA, 15 nt, Chlamydia trachomatis
ucaaaauauuuugcu

SEQ ID NO: 2506500 - RNA, 16 nt, Chlamydia trachomatis
ucaaaaucaauaaugu

SEQ ID NO: 2506501 - RNA, 18 nt, Chlamydia trachomatis
ucaaaaugaucgccucua

SEQ ID NO: 2506502 - RNA, 19 nt, Chlamydia trachomatis
ucaaaaugaucgccucuaa

SEQ ID NO: 2506503 - RNA, 23 nt, Chlamydia trachomatis
ucaaaaugaucuaaaggaaaaau

SEQ ID NO: 2506504 - RNA, 16 nt, Chlamydia trachomatis
ucaaaauguuugagua

SEQ ID NO: 2506505 - RNA, 17 nt, Chlamydia trachomatis
ucaaaauuaucuaaaaa

SEQ ID NO: 2506506 - RNA, 16 nt, Chlamydia trachomatis
ucaaaauucuaugaau

SEQ ID NO: 2506507 - RNA, 13 nt, Chlamydia trachomatis
ucaaacaaucuaa

SEQ ID NO: 2506508 - RNA, 17 nt, Chlamydia trachomatis
ucaaacaaucuaaaaaa

SEQ ID NO: 2506509 - RNA, 19 nt, Chlamydia trachomatis
ucaaacaaucuaaaaaauu

SEQ ID NO: 2506510 - RNA, 24 nt, Chlamydia trachomatis
ucaaacauagaaggaaugcagauc

SEQ ID NO: 2506511 - RNA, 13 nt, Chlamydia trachomatis
ucaaaccaaaaau

SEQ ID NO: 2506512 - RNA, 14 nt, Chlamydia trachomatis
ucaaaccaaaaaua

SEQ ID NO: 2506513 - RNA, 18 nt, Chlamydia trachomatis
ucaaaccuaaguagcaaa

SEQ ID NO: 2506514 - RNA, 15 nt, Chlamydia trachomatis
ucaaagaaagcuuau

SEQ ID NO: 2506515 - RNA, 21 nt, Chlamydia trachomatis
ucaaagaagcuccuuuaccuu

SEQ ID NO: 2506516 - RNA, 12 nt, Chlamydia trachomatis
ucaaagaaguaa

SEQ ID NO: 2506517 - RNA, 20 nt, Chlamydia trachomatis
ucaaagaucuuucuacauuu

SEQ ID NO: 2506518 - RNA, 23 nt, Chlamydia trachomatis
ucaaagaucuuucuacauuuugc

SEQ ID NO: 2506519 - RNA, 14 nt, Chlamydia trachomatis
ucaaagaugcgauc

SEQ ID NO: 2506520 - RNA, 21 nt, Chlamydia trachomatis
ucaaagcgaucuuugaacauu

SEQ ID NO: 2506521 - RNA, 22 nt, Chlamydia trachomatis
ucaaagcgaucuuugaacauuu

SEQ ID NO: 2506522 - RNA, 17 nt, Chlamydia trachomatis
ucaaagcuaacucaccu

SEQ ID NO: 2506523 - RNA, 14 nt, Chlamydia trachomatis
ucaaaguagcaauc

SEQ ID NO: 2506524 - RNA, 18 nt, Chlamydia trachomatis
ucaaauaaagcggcuaaa

SEQ ID NO: 2506525 - RNA, 13 nt, Chlamydia trachomatis
ucaaauccugcuu

SEQ ID NO: 2506526 - RNA, 15 nt, Chlamydia trachomatis
ucaaauccugcuucc

SEQ ID NO: 2506527 - RNA, 14 nt, Chlamydia trachomatis
ucaaaucgaaacug

SEQ ID NO: 2506528 - RNA, 13 nt, Chlamydia trachomatis
ucaaaucuucuuc

SEQ ID NO: 2506529 - RNA, 18 nt, Chlamydia trachomatis
ucaaaucuucuucuaagc

SEQ ID NO: 2506530 - RNA, 14 nt, Chlamydia trachomatis
ucaaauuucucuag

SEQ ID NO: 2506531 - RNA, 20 nt, Chlamydia trachomatis
ucaaauuucucuaggaacau

SEQ ID NO: 2506532 - RNA, 15 nt, Chlamydia trachomatis
ucaaauuuucaugaa

SEQ ID NO: 2506533 - RNA, 16 nt, Chlamydia trachomatis
ucaaauuuuucagaaa

SEQ ID NO: 2506534 - RNA, 14 nt, Chlamydia trachomatis
ucaacaacuucaau

SEQ ID NO: 2506535 - RNA, 23 nt, Chlamydia trachomatis
ucaacaagauuuuuuacaaugua

SEQ ID NO: 2506536 - RNA, 20 nt, Chlamydia trachomatis
ucaacagaaggaguuuuucu

SEQ ID NO: 2506537 - RNA, 13 nt, Chlamydia trachomatis
ucaacagaugacu

SEQ ID NO: 2506538 - RNA, 15 nt, Chlamydia trachomatis
ucaacauaauaaaua

SEQ ID NO: 2506539 - RNA, 14 nt, Chlamydia trachomatis
ucaacauaauagcg

SEQ ID NO: 2506540 - RNA, 13 nt, Chlamydia trachomatis
ucaacauuagaau

SEQ ID NO: 2506541 - RNA, 15 nt, Chlamydia trachomatis
ucaaccucucaucag

SEQ ID NO: 2506542 - RNA, 19 nt, Chlamydia trachomatis
ucaacgaaagcauccccaa

SEQ ID NO: 2506543 - RNA, 22 nt, Chlamydia trachomatis
ucaacgaaagcauccccaaaag

SEQ ID NO: 2506544 - RNA, 22 nt, Chlamydia trachomatis
ucaacggcguugggaucgguaa

SEQ ID NO: 2506545 - RNA, 15 nt, Chlamydia trachomatis
ucaacgggaacaaaa

SEQ ID NO: 2506546 - RNA, 14 nt, Chlamydia trachomatis
ucaacguuuucacu

SEQ ID NO: 2506547 - RNA, 20 nt, Chlamydia trachomatis
ucaacucgcuccagaacgaa

SEQ ID NO: 2506548 - RNA, 21 nt, Chlamydia trachomatis
ucaacugauucguuugugcua

SEQ ID NO: 2506549 - RNA, 23 nt, Chlamydia trachomatis
ucaacuucuccaguuaauccuuc

SEQ ID NO: 2506550 - RNA, 23 nt, Chlamydia trachomatis
ucaagagagaucuaugaaaaaag

SEQ ID NO: 2506551 - RNA, 21 nt, Chlamydia trachomatis
ucaagaggcuuaaagauaaca

SEQ ID NO: 2506552 - RNA, 14 nt, Chlamydia trachomatis
ucaagaucaaaguc

SEQ ID NO: 2506553 - RNA, 17 nt, Chlamydia trachomatis
ucaagaucaaagucagg

SEQ ID NO: 2506554 - RNA, 16 nt, Chlamydia trachomatis
ucaagcgauuaugaaa

SEQ ID NO: 2506555 - RNA, 13 nt, Chlamydia trachomatis
ucaagucuccacu

SEQ ID NO: 2506556 - RNA, 14 nt, Chlamydia trachomatis
ucaaguucauuggu

SEQ ID NO: 2506557 - RNA, 18 nt, Chlamydia trachomatis
ucaauaaacgaggaauau

SEQ ID NO: 2506558 - RNA, 20 nt, Chlamydia trachomatis
ucaauaaccugaagauuuuu

SEQ ID NO: 2506559 - RNA, 17 nt, Chlamydia trachomatis
ucaauaacgauaguaca

SEQ ID NO: 2506560 - RNA, 17 nt, Chlamydia trachomatis
ucaauaagccuccugcg

SEQ ID NO: 2506561 - RNA, 23 nt, Chlamydia trachomatis
ucaauaagccuccugcguuagca

SEQ ID NO: 2506562 - RNA, 17 nt, Chlamydia trachomatis
ucaauaauuucuacguu

SEQ ID NO: 2506563 - RNA, 19 nt, Chlamydia trachomatis
ucaauagcaggaacuucuu

SEQ ID NO: 2506564 - RNA, 14 nt, Chlamydia trachomatis
ucaauagcauuucu

SEQ ID NO: 2506565 - RNA, 12 nt, Chlamydia trachomatis
ucaauauaagcu

SEQ ID NO: 2506566 - RNA, 21 nt, Chlamydia trachomatis
ucaauaucaacguuuucacua

SEQ ID NO: 2506567 - RNA, 14 nt, Chlamydia trachomatis
ucaaucauaggaau

SEQ ID NO: 2506568 - RNA, 13 nt, Chlamydia trachomatis
ucaaugagauucc

SEQ ID NO: 2506569 - RNA, 18 nt, Chlamydia trachomatis
ucaaugcggucaugcaaa

SEQ ID NO: 2506570 - RNA, 13 nt, Chlamydia trachomatis
ucaaugcuucuau

SEQ ID NO: 2506571 - RNA, 20 nt, Chlamydia trachomatis
ucaauguggcugauuaauaa

SEQ ID NO: 2506572 - RNA, 16 nt, Chlamydia trachomatis
ucaauuaaagaaguug

SEQ ID NO: 2506573 - RNA, 13 nt, Chlamydia trachomatis
ucaauuccuggag

SEQ ID NO: 2506574 - RNA, 15 nt, Chlamydia trachomatis
ucaauucuugcuuca

SEQ ID NO: 2506575 - RNA, 16 nt, Chlamydia trachomatis
ucacaaaccaaaacca

SEQ ID NO: 2506576 - RNA, 19 nt, Chlamydia trachomatis
ucacaaaccaaaaccacac

SEQ ID NO: 2506577 - RNA, 20 nt, Chlamydia trachomatis
ucacaaauuaccccaaauua

SEQ ID NO: 2506578 - RNA, 12 nt, Chlamydia trachomatis
ucacaacuaguu

SEQ ID NO: 2506579 - RNA, 12 nt, Chlamydia trachomatis
ucacaagaacau

SEQ ID NO: 2506580 - RNA, 13 nt, Chlamydia trachomatis
ucacaauuuuucu

SEQ ID NO: 2506581 - RNA, 12 nt, Chlamydia trachomatis
ucacacaagcug

SEQ ID NO: 2506582 - RNA, 21 nt, Chlamydia trachomatis
ucacacaagcugacaaagcuu

SEQ ID NO: 2506583 - RNA, 18 nt, Chlamydia trachomatis
ucacacacaaaaaaaaga

SEQ ID NO: 2506584 - RNA, 15 nt, Chlamydia trachomatis
ucacagagcuucucu

SEQ ID NO: 2506585 - RNA, 16 nt, Chlamydia trachomatis
ucacagcaauagccau

SEQ ID NO: 2506586 - RNA, 22 nt, Chlamydia trachomatis
ucacaggcugugauggaaaugu

SEQ ID NO: 2506587 - RNA, 19 nt, Chlamydia trachomatis
ucacauacaggccgucaau

SEQ ID NO: 2506588 - RNA, 17 nt, Chlamydia trachomatis
ucacaucgaauaaaaau

SEQ ID NO: 2506589 - RNA, 18 nt, Chlamydia trachomatis
ucacaugcucaucaaacu

SEQ ID NO: 2506590 - RNA, 19 nt, Chlamydia trachomatis
ucaccacuaaucccaccuu

SEQ ID NO: 2506591 - RNA, 14 nt, Chlamydia trachomatis
ucaccacuuuuccg

SEQ ID NO: 2506592 - RNA, 19 nt, Chlamydia trachomatis
ucaccagcaaaagaaaaau

SEQ ID NO: 2506593 - RNA, 17 nt, Chlamydia trachomatis
ucaccccaucccuugca

SEQ ID NO: 2506594 - RNA, 15 nt, Chlamydia trachomatis
ucaccuauuaagaau

SEQ ID NO: 2506595 - RNA, 17 nt, Chlamydia trachomatis
ucacgccuccauccagu

SEQ ID NO: 2506596 - RNA, 14 nt, Chlamydia trachomatis
ucacggagagaaag

SEQ ID NO: 2506597 - RNA, 15 nt, Chlamydia trachomatis
ucacggagagaaaga

SEQ ID NO: 2506598 - RNA, 17 nt, Chlamydia trachomatis
ucacuaaaaguaguccu

SEQ ID NO: 2506599 - RNA, 21 nt, Chlamydia trachomatis
ucacuaaaaguaguccuauca

SEQ ID NO: 2506600 - RNA, 15 nt, Chlamydia trachomatis
ucacuacuucaucga

SEQ ID NO: 2506601 - RNA, 15 nt, Chlamydia trachomatis
ucacuaggcucauga

SEQ ID NO: 2506602 - RNA, 18 nt, Chlamydia trachomatis
ucacuaucauugagcaaa

SEQ ID NO: 2506603 - RNA, 14 nt, Chlamydia trachomatis
ucacuaucugcaaa

SEQ ID NO: 2506604 - RNA, 20 nt, Chlamydia trachomatis
ucacuccaagaagagucucu

SEQ ID NO: 2506605 - RNA, 22 nt, Chlamydia trachomatis
ucacuccaagaagagucucuaa

SEQ ID NO: 2506606 - RNA, 15 nt, Chlamydia trachomatis
ucacuccuccuccua

SEQ ID NO: 2506607 - RNA, 20 nt, Chlamydia trachomatis
ucacuccuccuccuaaacaa

SEQ ID NO: 2506608 - RNA, 21 nt, Chlamydia trachomatis
ucacugaccgaagaacucaaa

SEQ ID NO: 2506609 - RNA, 16 nt, Chlamydia trachomatis
ucacugcaacuaauau

SEQ ID NO: 2506610 - RNA, 16 nt, Chlamydia trachomatis
ucacuguugagaaaaa

SEQ ID NO: 2506611 - RNA, 13 nt, Chlamydia trachomatis
ucacuguuuuugc

SEQ ID NO: 2506612 - RNA, 14 nt, Chlamydia trachomatis
ucacuugaaucaca

SEQ ID NO: 2506613 - RNA, 19 nt, Chlamydia trachomatis
ucagaaaagccuucuuuca

SEQ ID NO: 2506614 - RNA, 21 nt, Chlamydia trachomatis
ucagaaacuucccacggaaga

SEQ ID NO: 2506615 - RNA, 17 nt, Chlamydia trachomatis
ucagaacaagugcagcg

SEQ ID NO: 2506616 - RNA, 18 nt, Chlamydia trachomatis
ucagaacucaaaauaaag

SEQ ID NO: 2506617 - RNA, 20 nt, Chlamydia trachomatis
ucagaacucaaaauaaagaa

SEQ ID NO: 2506618 - RNA, 13 nt, Chlamydia trachomatis
ucagaagaggcaa

SEQ ID NO: 2506619 - RNA, 16 nt, Chlamydia trachomatis
ucagaagcuauuccau

SEQ ID NO: 2506620 - RNA, 13 nt, Chlamydia trachomatis
ucagaaucugugc

SEQ ID NO: 2506621 - RNA, 16 nt, Chlamydia trachomatis
ucagacacaaugaauu

SEQ ID NO: 2506622 - RNA, 18 nt, Chlamydia trachomatis
ucagagauauugucuacu

SEQ ID NO: 2506623 - RNA, 16 nt, Chlamydia trachomatis
ucagagccagcuuuaa

SEQ ID NO: 2506624 - RNA, 15 nt, Chlamydia trachomatis
ucagagguagccaaa

SEQ ID NO: 2506625 - RNA, 18 nt, Chlamydia trachomatis
ucagagguagccaaagaa

SEQ ID NO: 2506626 - RNA, 19 nt, Chlamydia trachomatis
ucagagguagccaaagaau

SEQ ID NO: 2506627 - RNA, 13 nt, Chlamydia trachomatis
ucagcaaaaagag

SEQ ID NO: 2506628 - RNA, 16 nt, Chlamydia trachomatis
ucagcaaaagaagaau

SEQ ID NO: 2506629 - RNA, 23 nt, Chlamydia trachomatis
ucagcaaaagaagaaucuucuuc

SEQ ID NO: 2506630 - RNA, 20 nt, Chlamydia trachomatis
ucagcaagauucuccuuaga

SEQ ID NO: 2506631 - RNA, 21 nt, Chlamydia trachomatis
ucagcaauaauaccuuaauaa

SEQ ID NO: 2506632 - RNA, 18 nt, Chlamydia trachomatis
ucagcacccacauuacca

SEQ ID NO: 2506633 - RNA, 18 nt, Chlamydia trachomatis
ucagcacguaguuucccg

SEQ ID NO: 2506634 - RNA, 16 nt, Chlamydia trachomatis
ucagcagaucauccau

SEQ ID NO: 2506635 - RNA, 19 nt, Chlamydia trachomatis
ucagcagaucauccauaaa

SEQ ID NO: 2506636 - RNA, 18 nt, Chlamydia trachomatis
ucagcagcauaaauccuu

SEQ ID NO: 2506637 - RNA, 20 nt, Chlamydia trachomatis
ucagcagcauaaauccuuga

SEQ ID NO: 2506638 - RNA, 21 nt, Chlamydia trachomatis
ucagcaggcgaacagugacag

SEQ ID NO: 2506639 - RNA, 13 nt, Chlamydia trachomatis
ucagcauccugaa

SEQ ID NO: 2506640 - RNA, 23 nt, Chlamydia trachomatis
ucagcauccugaacccgcugcug

SEQ ID NO: 2506641 - RNA, 18 nt, Chlamydia trachomatis
ucagccaguccucccaaa

SEQ ID NO: 2506642 - RNA, 19 nt, Chlamydia trachomatis
ucagccaugggaucuagaa

SEQ ID NO: 2506643 - RNA, 20 nt, Chlamydia trachomatis
ucagcgguugccuuacucuu

SEQ ID NO: 2506644 - RNA, 16 nt, Chlamydia trachomatis
ucagcguugggauaga

SEQ ID NO: 2506645 - RNA, 17 nt, Chlamydia trachomatis
ucagcuaacgacgagaa

SEQ ID NO: 2506646 - RNA, 20 nt, Chlamydia trachomatis
ucagcuaacgacgagaacgu

SEQ ID NO: 2506647 - RNA, 17 nt, Chlamydia trachomatis
ucagcuccuaucacucc

SEQ ID NO: 2506648 - RNA, 11 nt, Chlamydia trachomatis
ucagcucuccu

SEQ ID NO: 2506649 - RNA, 14 nt, Chlamydia trachomatis
ucagcucuccucgu

SEQ ID NO: 2506650 - RNA, 16 nt, Chlamydia trachomatis
ucagcuucacguuuuu

SEQ ID NO: 2506651 - RNA, 22 nt, Chlamydia trachomatis
ucagcuuccuuggcuuuuacaa

SEQ ID NO: 2506652 - RNA, 16 nt, Chlamydia trachomatis
ucagcuuuucuuuccu

SEQ ID NO: 2506653 - RNA, 14 nt, Chlamydia trachomatis
ucaggaauagcuac

SEQ ID NO: 2506654 - RNA, 19 nt, Chlamydia trachomatis
ucaggaauauuaagaucca

SEQ ID NO: 2506655 - RNA, 21 nt, Chlamydia trachomatis
ucaggaauauuaagauccauu

SEQ ID NO: 2506656 - RNA, 20 nt, Chlamydia trachomatis
ucaggaaucacuaagucugu

SEQ ID NO: 2506657 - RNA, 17 nt, Chlamydia trachomatis
ucaggaucuaauucuag

SEQ ID NO: 2506658 - RNA, 23 nt, Chlamydia trachomatis
ucaggcuaucacaaaagcgaaua

SEQ ID NO: 2506659 - RNA, 15 nt, Chlamydia trachomatis
ucagggauagaaacu

SEQ ID NO: 2506660 - RNA, 19 nt, Chlamydia trachomatis
ucagggaucgagucccuuc

SEQ ID NO: 2506661 - RNA, 21 nt, Chlamydia trachomatis
ucagggcugacuaaauacaaa

SEQ ID NO: 2506662 - RNA, 13 nt, Chlamydia trachomatis
ucaggggagaaaa

SEQ ID NO: 2506663 - RNA, 14 nt, Chlamydia trachomatis
ucagguaauuguga

SEQ ID NO: 2506664 - RNA, 17 nt, Chlamydia trachomatis
ucagguaauugugaaug

SEQ ID NO: 2506665 - RNA, 17 nt, Chlamydia trachomatis
ucaguaagucaccauuu

SEQ ID NO: 2506666 - RNA, 17 nt, Chlamydia trachomatis
ucagucuucuuuucuga

SEQ ID NO: 2506667 - RNA, 15 nt, Chlamydia trachomatis
ucaguucgaaguucc

SEQ ID NO: 2506668 - RNA, 16 nt, Chlamydia trachomatis
ucaguugaaagacuug

SEQ ID NO: 2506669 - RNA, 14 nt, Chlamydia trachomatis
ucaguuugaaucac

SEQ ID NO: 2506670 - RNA, 15 nt, Chlamydia trachomatis
ucaguuugaaucaca

SEQ ID NO: 2506671 - RNA, 19 nt, Chlamydia trachomatis
ucaguuugaaucacagaaa

SEQ ID NO: 2506672 - RNA, 16 nt, Chlamydia trachomatis
ucaguuuguucagaaa

SEQ ID NO: 2506673 - RNA, 11 nt, Chlamydia trachomatis
ucauaaaaaag

SEQ ID NO: 2506674 - RNA, 22 nt, Chlamydia trachomatis
ucauaaaaagauagugcagaag

SEQ ID NO: 2506675 - RNA, 15 nt, Chlamydia trachomatis
ucauaaaauuucaua

SEQ ID NO: 2506676 - RNA, 23 nt, Chlamydia trachomatis
ucauaaagagccguucucucuaa

SEQ ID NO: 2506677 - RNA, 19 nt, Chlamydia trachomatis
ucauaaaggaaagggcuuu

SEQ ID NO: 2506678 - RNA, 19 nt, Chlamydia trachomatis
ucauaagccucauccccuu

SEQ ID NO: 2506679 - RNA, 18 nt, Chlamydia trachomatis
ucauaagcucuaacucuu

SEQ ID NO: 2506680 - RNA, 17 nt, Chlamydia trachomatis
ucauaauuacauugcag

SEQ ID NO: 2506681 - RNA, 17 nt, Chlamydia trachomatis
ucauacauaacuauccc

SEQ ID NO: 2506682 - RNA, 22 nt, Chlamydia trachomatis
ucauacgagccuguuucuuauc

SEQ ID NO: 2506683 - RNA, 24 nt, Chlamydia trachomatis
ucauacgagccuguuucuuaucag

SEQ ID NO: 2506684 - RNA, 20 nt, Chlamydia trachomatis
ucauacuggcagggauagua

SEQ ID NO: 2506685 - RNA, 22 nt, Chlamydia trachomatis
ucauagaaaauggcugcuuggc

SEQ ID NO: 2506686 - RNA, 13 nt, Chlamydia trachomatis
ucauagauaauga

SEQ ID NO: 2506687 - RNA, 23 nt, Chlamydia trachomatis
ucauagauugugguuagaaauuc

SEQ ID NO: 2506688 - RNA, 23 nt, Chlamydia trachomatis
ucauaggcuccugcaagggaaca

SEQ ID NO: 2506689 - RNA, 18 nt, Chlamydia trachomatis
ucauaguuaacggaaaua

SEQ ID NO: 2506690 - RNA, 13 nt, Chlamydia trachomatis
ucauaucugcagc

SEQ ID NO: 2506691 - RNA, 22 nt, Chlamydia trachomatis
ucauauguuacaggugauucaa

SEQ ID NO: 2506692 - RNA, 14 nt, Chlamydia trachomatis
ucaucaaaauauuu

SEQ ID NO: 2506693 - RNA, 18 nt, Chlamydia trachomatis
ucaucaaaauauuuugcu

SEQ ID NO: 2506694 - RNA, 13 nt, Chlamydia trachomatis
ucaucaaacucuu

SEQ ID NO: 2506695 - RNA, 23 nt, Chlamydia trachomatis
ucaucaaauagcaaagcgaucag

SEQ ID NO: 2506696 - RNA, 19 nt, Chlamydia trachomatis
ucaucaaccgcgacagcca

SEQ ID NO: 2506697 - RNA, 16 nt, Chlamydia trachomatis
ucaucagcuguuccuu

SEQ ID NO: 2506698 - RNA, 23 nt, Chlamydia trachomatis
ucaucaguaaacacuuuauuaga

SEQ ID NO: 2506699 - RNA, 14 nt, Chlamydia trachomatis
ucaucaucauggaa

SEQ ID NO: 2506700 - RNA, 17 nt, Chlamydia trachomatis
ucaucaucauggaaaau

SEQ ID NO: 2506701 - RNA, 16 nt, Chlamydia trachomatis
ucaucaugagaacgau

SEQ ID NO: 2506702 - RNA, 19 nt, Chlamydia trachomatis
ucaucaugagaacgauuuu

SEQ ID NO: 2506703 - RNA, 21 nt, Chlamydia trachomatis
ucauccccagaagccauaaua

SEQ ID NO: 2506704 - RNA, 21 nt, Chlamydia trachomatis
ucauccuagcagcuaauacuu

SEQ ID NO: 2506705 - RNA, 16 nt, Chlamydia trachomatis
ucaucgaaaacaaaga

SEQ ID NO: 2506706 - RNA, 19 nt, Chlamydia trachomatis
ucaucgaaaacaaagaguu

SEQ ID NO: 2506707 - RNA, 20 nt, Chlamydia trachomatis
ucaucgagaacggcaauaaa

SEQ ID NO: 2506708 - RNA, 22 nt, Chlamydia trachomatis
ucaucgagaacggcaauaaaga

SEQ ID NO: 2506709 - RNA, 19 nt, Chlamydia trachomatis
ucaucggcuugcccaaacu

SEQ ID NO: 2506710 - RNA, 22 nt, Chlamydia trachomatis
ucaucggcuugcccaaacucca

SEQ ID NO: 2506711 - RNA, 23 nt, Chlamydia trachomatis
ucaucggcuugcccaaacuccau

SEQ ID NO: 2506712 - RNA, 16 nt, Chlamydia trachomatis
ucaucuccuuugcuaa

SEQ ID NO: 2506713 - RNA, 22 nt, Chlamydia trachomatis
ucaucuccuuugcuaacaaaga

SEQ ID NO: 2506714 - RNA, 21 nt, Chlamydia trachomatis
ucaucucuaccagggauaaau

SEQ ID NO: 2506715 - RNA, 16 nt, Chlamydia trachomatis
ucaucucucagcagau

SEQ ID NO: 2506716 - RNA, 17 nt, Chlamydia trachomatis
ucaugaaaagcuuucaa

SEQ ID NO: 2506717 - RNA, 16 nt, Chlamydia trachomatis
ucaugaacagcaagag

SEQ ID NO: 2506718 - RNA, 19 nt, Chlamydia trachomatis
ucaugcagaugaagaaucu

SEQ ID NO: 2506719 - RNA, 20 nt, Chlamydia trachomatis
ucaugcggauuaaagaagga

SEQ ID NO: 2506720 - RNA, 21 nt, Chlamydia trachomatis
ucaugguuaccugugaagaaa

SEQ ID NO: 2506721 - RNA, 18 nt, Chlamydia trachomatis
ucaugucuucuuucucuu

SEQ ID NO: 2506722 - RNA, 18 nt, Chlamydia trachomatis
ucauuaaagacuacaaaa

SEQ ID NO: 2506723 - RNA, 13 nt, Chlamydia trachomatis
ucauuaaaggaau

SEQ ID NO: 2506724 - RNA, 17 nt, Chlamydia trachomatis
ucauuaaaggaauaauu

SEQ ID NO: 2506725 - RNA, 15 nt, Chlamydia trachomatis
ucauucaagugacuu

SEQ ID NO: 2506726 - RNA, 16 nt, Chlamydia trachomatis
ucauucgucaaagaag

SEQ ID NO: 2506727 - RNA, 11 nt, Chlamydia trachomatis
ucauugaucac

SEQ ID NO: 2506728 - RNA, 15 nt, Chlamydia trachomatis
ucauuuaauaaguuu

SEQ ID NO: 2506729 - RNA, 19 nt, Chlamydia trachomatis
ucauuuaauaaguuuuuca

SEQ ID NO: 2506730 - RNA, 14 nt, Chlamydia trachomatis
ucauuuuaauaaga

SEQ ID NO: 2506731 - RNA, 15 nt, Chlamydia trachomatis
ucauuuuauguaaau

SEQ ID NO: 2506732 - RNA, 21 nt, Chlamydia trachomatis
ucauuuuuucuuggaccucuu

SEQ ID NO: 2506733 - RNA, 15 nt, Chlamydia trachomatis
uccaaaaaagaaucu

SEQ ID NO: 2506734 - RNA, 12 nt, Chlamydia trachomatis
uccaaaaaagag

SEQ ID NO: 2506735 - RNA, 20 nt, Chlamydia trachomatis
uccaaaaagcgugucaauga

SEQ ID NO: 2506736 - RNA, 18 nt, Chlamydia trachomatis
uccaaaaauugaaagaga

SEQ ID NO: 2506737 - RNA, 22 nt, Chlamydia trachomatis
uccaaaaguguuuagaagugcu

SEQ ID NO: 2506738 - RNA, 14 nt, Chlamydia trachomatis
uccaaaaucaucaa

SEQ ID NO: 2506739 - RNA, 17 nt, Chlamydia trachomatis
uccaaaaucaucaaccg

SEQ ID NO: 2506740 - RNA, 22 nt, Chlamydia trachomatis
uccaaaauuucagggaaacgua

SEQ ID NO: 2506741 - RNA, 15 nt, Chlamydia trachomatis
uccaaaccaguucug

SEQ ID NO: 2506742 - RNA, 17 nt, Chlamydia trachomatis
uccaaagagauuguaau

SEQ ID NO: 2506743 - RNA, 18 nt, Chlamydia trachomatis
uccaaagauauagguucc

SEQ ID NO: 2506744 - RNA, 19 nt, Chlamydia trachomatis
uccaaaggauauacagaac

SEQ ID NO: 2506745 - RNA, 14 nt, Chlamydia trachomatis
uccaaaguaaucuc

SEQ ID NO: 2506746 - RNA, 18 nt, Chlamydia trachomatis
uccaaaguacucagucaa

SEQ ID NO: 2506747 - RNA, 15 nt, Chlamydia trachomatis
uccaaauaaaacgaa

SEQ ID NO: 2506748 - RNA, 20 nt, Chlamydia trachomatis
uccaaauuuuguuuaaucag

SEQ ID NO: 2506749 - RNA, 15 nt, Chlamydia trachomatis
uccaacaauuuucgu

SEQ ID NO: 2506750 - RNA, 16 nt, Chlamydia trachomatis
uccaacacgaaugccu

SEQ ID NO: 2506751 - RNA, 16 nt, Chlamydia trachomatis
uccaagaaaaauacag

SEQ ID NO: 2506752 - RNA, 21 nt, Chlamydia trachomatis
uccaagauuaucacauucuua

SEQ ID NO: 2506753 - RNA, 20 nt, Chlamydia trachomatis
uccaagggaugaagcuaaaa

SEQ ID NO: 2506754 - RNA, 23 nt, Chlamydia trachomatis
uccaagggaugaagcuaaaaaau

SEQ ID NO: 2506755 - RNA, 21 nt, Chlamydia trachomatis
uccaaguuuuguaaaguaacu

SEQ ID NO: 2506756 - RNA, 23 nt, Chlamydia trachomatis
uccaaguuuuguaaaguaacuac

SEQ ID NO: 2506757 - RNA, 22 nt, Chlamydia trachomatis
uccaauaggggcaugacgaucu

SEQ ID NO: 2506758 - RNA, 13 nt, Chlamydia trachomatis
uccaauaucuuca

SEQ ID NO: 2506759 - RNA, 14 nt, Chlamydia trachomatis
uccaaucacagcaa

SEQ ID NO: 2506760 - RNA, 23 nt, Chlamydia trachomatis
uccaauccuguggucacaagaac

SEQ ID NO: 2506761 - RNA, 13 nt, Chlamydia trachomatis
uccaauccuuggc

SEQ ID NO: 2506762 - RNA, 23 nt, Chlamydia trachomatis
uccaauccuuggcaagaagcugc

SEQ ID NO: 2506763 - RNA, 15 nt, Chlamydia trachomatis
uccaaucguauaaua

SEQ ID NO: 2506764 - RNA, 18 nt, Chlamydia trachomatis
uccaaucguauaauaaug

SEQ ID NO: 2506765 - RNA, 19 nt, Chlamydia trachomatis
uccaaucguauaauaaugg

SEQ ID NO: 2506766 - RNA, 17 nt, Chlamydia trachomatis
uccacaacggcccuucc

SEQ ID NO: 2506767 - RNA, 20 nt, Chlamydia trachomatis
uccacaagauuuugaauacg

SEQ ID NO: 2506768 - RNA, 16 nt, Chlamydia trachomatis
uccacacaacauaacu

SEQ ID NO: 2506769 - RNA, 11 nt, Chlamydia trachomatis
uccacagaucu

SEQ ID NO: 2506770 - RNA, 20 nt, Chlamydia trachomatis
uccacagaucugguccucca

SEQ ID NO: 2506771 - RNA, 21 nt, Chlamydia trachomatis
uccacagaucugguccuccag

SEQ ID NO: 2506772 - RNA, 15 nt, Chlamydia trachomatis
uccacagcagugagc

SEQ ID NO: 2506773 - RNA, 15 nt, Chlamydia trachomatis
uccacauuauucaca

SEQ ID NO: 2506774 - RNA, 18 nt, Chlamydia trachomatis
uccacauucacuucaacu

SEQ ID NO: 2506775 - RNA, 21 nt, Chlamydia trachomatis
uccaccagcagucgcgcagcu

SEQ ID NO: 2506776 - RNA, 14 nt, Chlamydia trachomatis
uccaccguagaaca

SEQ ID NO: 2506777 - RNA, 17 nt, Chlamydia trachomatis
uccaccuaauuccccaa

SEQ ID NO: 2506778 - RNA, 17 nt, Chlamydia trachomatis
uccaccuucauuucaag

SEQ ID NO: 2506779 - RNA, 18 nt, Chlamydia trachomatis
uccacgaagagcaaaauc

SEQ ID NO: 2506780 - RNA, 17 nt, Chlamydia trachomatis
uccacgagaagagguuu

SEQ ID NO: 2506781 - RNA, 16 nt, Chlamydia trachomatis
uccacuaccccaccua

SEQ ID NO: 2506782 - RNA, 17 nt, Chlamydia trachomatis
uccagaaaaaauaaugg

SEQ ID NO: 2506783 - RNA, 20 nt, Chlamydia trachomatis
uccagaaaaaauaauggacu

SEQ ID NO: 2506784 - RNA, 20 nt, Chlamydia trachomatis
uccagaaaauucuacaacag

SEQ ID NO: 2506785 - RNA, 13 nt, Chlamydia trachomatis
uccagaaauaagg

SEQ ID NO: 2506786 - RNA, 12 nt, Chlamydia trachomatis
uccagaacgaag

SEQ ID NO: 2506787 - RNA, 21 nt, Chlamydia trachomatis
uccagacaaaaagaaagccuu

SEQ ID NO: 2506788 - RNA, 18 nt, Chlamydia trachomatis
uccagacgcccuccuccu

SEQ ID NO: 2506789 - RNA, 13 nt, Chlamydia trachomatis
uccagagcaaaua

SEQ ID NO: 2506790 - RNA, 16 nt, Chlamydia trachomatis
uccagagcaaauagaa

SEQ ID NO: 2506791 - RNA, 20 nt, Chlamydia trachomatis
uccagaguucauuuuuucuu

SEQ ID NO: 2506792 - RNA, 17 nt, Chlamydia trachomatis
uccagcaggccucuguu

SEQ ID NO: 2506793 - RNA, 22 nt, Chlamydia trachomatis
uccagcauuuuaaaaucacuuu

SEQ ID NO: 2506794 - RNA, 16 nt, Chlamydia trachomatis
uccagccucuccagaa

SEQ ID NO: 2506795 - RNA, 17 nt, Chlamydia trachomatis
uccagcgcacacuuuuc

SEQ ID NO: 2506796 - RNA, 17 nt, Chlamydia trachomatis
uccagcucgaucaauaa

SEQ ID NO: 2506797 - RNA, 22 nt, Chlamydia trachomatis
uccagcuucugaacgagaaaaa

SEQ ID NO: 2506798 - RNA, 22 nt, Chlamydia trachomatis
uccaggagagucugcuacaaac

SEQ ID NO: 2506799 - RNA, 23 nt, Chlamydia trachomatis
uccaggagauguaggauucagag

SEQ ID NO: 2506800 - RNA, 21 nt, Chlamydia trachomatis
uccaggggugacagcuuucac

SEQ ID NO: 2506801 - RNA, 15 nt, Chlamydia trachomatis
uccaguuaauccuuc

SEQ ID NO: 2506802 - RNA, 21 nt, Chlamydia trachomatis
uccauaagaauguuuccuaau

SEQ ID NO: 2506803 - RNA, 21 nt, Chlamydia trachomatis
uccauaauuuucuucacuucc

SEQ ID NO: 2506804 - RNA, 16 nt, Chlamydia trachomatis
uccauacaaagguaaa

SEQ ID NO: 2506805 - RNA, 20 nt, Chlamydia trachomatis
uccauagcaugggcugcauc

SEQ ID NO: 2506806 - RNA, 18 nt, Chlamydia trachomatis
uccauauauucagaagaa

SEQ ID NO: 2506807 - RNA, 19 nt, Chlamydia trachomatis
uccauauauucagaagaag

SEQ ID NO: 2506808 - RNA, 21 nt, Chlamydia trachomatis
uccauauauucagaagaagag

SEQ ID NO: 2506809 - RNA, 22 nt, Chlamydia trachomatis
uccauauauucagaagaagagc

SEQ ID NO: 2506810 - RNA, 15 nt, Chlamydia trachomatis
uccauauccaugaag

SEQ ID NO: 2506811 - RNA, 19 nt, Chlamydia trachomatis
uccaucacuccaagaagag

SEQ ID NO: 2506812 - RNA, 16 nt, Chlamydia trachomatis
uccaucauaaaaagau

SEQ ID NO: 2506813 - RNA, 20 nt, Chlamydia trachomatis
uccaucguaagcaacaauau

SEQ ID NO: 2506814 - RNA, 16 nt, Chlamydia trachomatis
uccaucguuuaugaag

SEQ ID NO: 2506815 - RNA, 17 nt, Chlamydia trachomatis
uccaucguuuaugaagc

SEQ ID NO: 2506816 - RNA, 13 nt, Chlamydia trachomatis
uccaucuaaaggc

SEQ ID NO: 2506817 - RNA, 14 nt, Chlamydia trachomatis
uccaucucuccgga

SEQ ID NO: 2506818 - RNA, 13 nt, Chlamydia trachomatis
uccaucucugcuu

SEQ ID NO: 2506819 - RNA, 14 nt, Chlamydia trachomatis
uccaucuuuaaaga

SEQ ID NO: 2506820 - RNA, 17 nt, Chlamydia trachomatis
uccaucuuuaaagagga

SEQ ID NO: 2506821 - RNA, 16 nt, Chlamydia trachomatis
uccaugaccaagguug

SEQ ID NO: 2506822 - RNA, 21 nt, Chlamydia trachomatis
uccaugauccccuacgcuacg

SEQ ID NO: 2506823 - RNA, 13 nt, Chlamydia trachomatis
uccaugauuucuu

SEQ ID NO: 2506824 - RNA, 14 nt, Chlamydia trachomatis
uccaugauuucuuu

SEQ ID NO: 2506825 - RNA, 16 nt, Chlamydia trachomatis
uccaugauuucuuuaa

SEQ ID NO: 2506826 - RNA, 13 nt, Chlamydia trachomatis
uccaugcauguua

SEQ ID NO: 2506827 - RNA, 16 nt, Chlamydia trachomatis
uccaugcauguuagua

SEQ ID NO: 2506828 - RNA, 21 nt, Chlamydia trachomatis
uccauggcguuagaauaccaa

SEQ ID NO: 2506829 - RNA, 17 nt, Chlamydia trachomatis
uccaugugagaacgaag

SEQ ID NO: 2506830 - RNA, 14 nt, Chlamydia trachomatis
uccauucgcauuaa

SEQ ID NO: 2506831 - RNA, 21 nt, Chlamydia trachomatis
uccauucgcauuaaauaauac

SEQ ID NO: 2506832 - RNA, 21 nt, Chlamydia trachomatis
uccauuuacgucaauuuuucc

SEQ ID NO: 2506833 - RNA, 17 nt, Chlamydia trachomatis
uccauuuucguaagcau

SEQ ID NO: 2506834 - RNA, 22 nt, Chlamydia trachomatis
uccauuuucguaagcauagcuu

SEQ ID NO: 2506835 - RNA, 13 nt, Chlamydia trachomatis
ucccaaaaacaau

SEQ ID NO: 2506836 - RNA, 20 nt, Chlamydia trachomatis
ucccaaaaacaaucaaagca

SEQ ID NO: 2506837 - RNA, 14 nt, Chlamydia trachomatis
ucccaaaagaauga

SEQ ID NO: 2506838 - RNA, 22 nt, Chlamydia trachomatis
ucccaaaagauuuucaacggga

SEQ ID NO: 2506839 - RNA, 15 nt, Chlamydia trachomatis
ucccaaaauagcagg

SEQ ID NO: 2506840 - RNA, 16 nt, Chlamydia trachomatis
ucccaaaccuccuaaa

SEQ ID NO: 2506841 - RNA, 20 nt, Chlamydia trachomatis
ucccaaauuucugucacucg

SEQ ID NO: 2506842 - RNA, 23 nt, Chlamydia trachomatis
ucccaacaggagaucccaaaaga

SEQ ID NO: 2506843 - RNA, 16 nt, Chlamydia trachomatis
ucccaagaaacuuuuc

SEQ ID NO: 2506844 - RNA, 15 nt, Chlamydia trachomatis
ucccaauauauuccu

SEQ ID NO: 2506845 - RNA, 23 nt, Chlamydia trachomatis
ucccacaacuugcguuuucuugu

SEQ ID NO: 2506846 - RNA, 18 nt, Chlamydia trachomatis
ucccacuacauucuuuuu

SEQ ID NO: 2506847 - RNA, 12 nt, Chlamydia trachomatis
ucccacucuucu

SEQ ID NO: 2506848 - RNA, 13 nt, Chlamydia trachomatis
ucccacucuucuu

SEQ ID NO: 2506849 - RNA, 13 nt, Chlamydia trachomatis
ucccagaauaaag

SEQ ID NO: 2506850 - RNA, 18 nt, Chlamydia trachomatis
ucccagaauaaaggauuc

SEQ ID NO: 2506851 - RNA, 14 nt, Chlamydia trachomatis
ucccagugaugaaa

SEQ ID NO: 2506852 - RNA, 19 nt, Chlamydia trachomatis
ucccaguuaggcauuccuu

SEQ ID NO: 2506853 - RNA, 23 nt, Chlamydia trachomatis
ucccaguuaggcauuccuuucuu

SEQ ID NO: 2506854 - RNA, 13 nt, Chlamydia trachomatis
ucccauaaucuca

SEQ ID NO: 2506855 - RNA, 14 nt, Chlamydia trachomatis
ucccauaaucucau

SEQ ID NO: 2506856 - RNA, 17 nt, Chlamydia trachomatis
ucccauagcuucuuagu

SEQ ID NO: 2506857 - RNA, 23 nt, Chlamydia trachomatis
ucccauaguaccucgagcaacga

SEQ ID NO: 2506858 - RNA, 13 nt, Chlamydia trachomatis
ucccaucaaaagc

SEQ ID NO: 2506859 - RNA, 19 nt, Chlamydia trachomatis
ucccaucuacaaaaccaaa

SEQ ID NO: 2506860 - RNA, 21 nt, Chlamydia trachomatis
ucccaucuugcacauuuucuu

SEQ ID NO: 2506861 - RNA, 22 nt, Chlamydia trachomatis
ucccauuuuuaccaaaccuuuc

SEQ ID NO: 2506862 - RNA, 23 nt, Chlamydia trachomatis
uccccaaaaggauugacagcugu

SEQ ID NO: 2506863 - RNA, 17 nt, Chlamydia trachomatis
uccccaaaccaguuucu

SEQ ID NO: 2506864 - RNA, 19 nt, Chlamydia trachomatis
uccccaaaccaguuucuuc

SEQ ID NO: 2506865 - RNA, 13 nt, Chlamydia trachomatis
uccccaaagcagu

SEQ ID NO: 2506866 - RNA, 22 nt, Chlamydia trachomatis
uccccaagggggguuaagaaaa

SEQ ID NO: 2506867 - RNA, 19 nt, Chlamydia trachomatis
uccccagaacgcaauguuu

SEQ ID NO: 2506868 - RNA, 14 nt, Chlamydia trachomatis
uccccauaaagcua

SEQ ID NO: 2506869 - RNA, 16 nt, Chlamydia trachomatis
uccccauaaagcuagu

SEQ ID NO: 2506870 - RNA, 18 nt, Chlamydia trachomatis
uccccgccagaaacuuca

SEQ ID NO: 2506871 - RNA, 15 nt, Chlamydia trachomatis
uccccuacaaacauc

SEQ ID NO: 2506872 - RNA, 21 nt, Chlamydia trachomatis
uccccuacgcuacgagcaaca

SEQ ID NO: 2506873 - RNA, 23 nt, Chlamydia trachomatis
uccccuuacccaaacaucuacac

SEQ ID NO: 2506874 - RNA, 22 nt, Chlamydia trachomatis
ucccgcuauuuuccucuucaca

SEQ ID NO: 2506875 - RNA, 17 nt, Chlamydia trachomatis
ucccggaggaauugauc

SEQ ID NO: 2506876 - RNA, 15 nt, Chlamydia trachomatis
ucccgguaauagaag

SEQ ID NO: 2506877 - RNA, 19 nt, Chlamydia trachomatis
ucccguuaaugggucaaga

SEQ ID NO: 2506878 - RNA, 15 nt, Chlamydia trachomatis
ucccuaaagcagcua

SEQ ID NO: 2506879 - RNA, 19 nt, Chlamydia trachomatis
ucccuaagaucucuuccuu

SEQ ID NO: 2506880 - RNA, 22 nt, Chlamydia trachomatis
ucccuacggaauagccuccaaa

SEQ ID NO: 2506881 - RNA, 15 nt, Chlamydia trachomatis
ucccuacugaaguag

SEQ ID NO: 2506882 - RNA, 13 nt, Chlamydia trachomatis
ucccuagaaaauc

SEQ ID NO: 2506883 - RNA, 16 nt, Chlamydia trachomatis
ucccuaguacaaaaau

SEQ ID NO: 2506884 - RNA, 15 nt, Chlamydia trachomatis
ucccucauuuaaaag

SEQ ID NO: 2506885 - RNA, 16 nt, Chlamydia trachomatis
ucccucuagcaaccaa

SEQ ID NO: 2506886 - RNA, 22 nt, Chlamydia trachomatis
ucccucuguccauucuaaggag

SEQ ID NO: 2506887 - RNA, 12 nt, Chlamydia trachomatis
ucccucuuguaa

SEQ ID NO: 2506888 - RNA, 19 nt, Chlamydia trachomatis
ucccugcaacauuuccuaa

SEQ ID NO: 2506889 - RNA, 21 nt, Chlamydia trachomatis
ucccugcaacauuuccuaagg

SEQ ID NO: 2506890 - RNA, 20 nt, Chlamydia trachomatis
ucccugcaauuuacuaucag

SEQ ID NO: 2506891 - RNA, 18 nt, Chlamydia trachomatis
ucccugcaccucuuucag

SEQ ID NO: 2506892 - RNA, 20 nt, Chlamydia trachomatis
ucccugcauaauagcuugca

SEQ ID NO: 2506893 - RNA, 18 nt, Chlamydia trachomatis
ucccugcucuugaagaua

SEQ ID NO: 2506894 - RNA, 19 nt, Chlamydia trachomatis
ucccuguaguuagguaauc

SEQ ID NO: 2506895 - RNA, 13 nt, Chlamydia trachomatis
ucccuucuuucuu

SEQ ID NO: 2506896 - RNA, 17 nt, Chlamydia trachomatis
ucccuucuuucuucuaa

SEQ ID NO: 2506897 - RNA, 22 nt, Chlamydia trachomatis
ucccuugaacuagaaauaaaau

SEQ ID NO: 2506898 - RNA, 17 nt, Chlamydia trachomatis
ucccuugcaaaaaucuc

SEQ ID NO: 2506899 - RNA, 18 nt, Chlamydia trachomatis
ucccuugcaaaaaucucu

SEQ ID NO: 2506900 - RNA, 19 nt, Chlamydia trachomatis
ucccuugcguguucuaaac

SEQ ID NO: 2506901 - RNA, 16 nt, Chlamydia trachomatis
ucccuuucauaauagu

SEQ ID NO: 2506902 - RNA, 18 nt, Chlamydia trachomatis
ucccuuuccauacaucau

SEQ ID NO: 2506903 - RNA, 16 nt, Chlamydia trachomatis
ucccuuuuuucuguuu

SEQ ID NO: 2506904 - RNA, 22 nt, Chlamydia trachomatis
uccgaagauuauaccagcagac

SEQ ID NO: 2506905 - RNA, 17 nt, Chlamydia trachomatis
uccgaauaaguccacaa

SEQ ID NO: 2506906 - RNA, 16 nt, Chlamydia trachomatis
uccgacaccaggcaau

SEQ ID NO: 2506907 - RNA, 20 nt, Chlamydia trachomatis
uccgagagaagcuccucuuc

SEQ ID NO: 2506908 - RNA, 19 nt, Chlamydia trachomatis
uccgauaauuuuccuuuuu

SEQ ID NO: 2506909 - RNA, 21 nt, Chlamydia trachomatis
uccgauaauuuuccuuuuucc

SEQ ID NO: 2506910 - RNA, 13 nt, Chlamydia trachomatis
uccgauaggaaaa

SEQ ID NO: 2506911 - RNA, 16 nt, Chlamydia trachomatis
uccgaucauaauuaaa

SEQ ID NO: 2506912 - RNA, 18 nt, Chlamydia trachomatis
uccgcaaacaaaauaauc

SEQ ID NO: 2506913 - RNA, 22 nt, Chlamydia trachomatis
uccgcacccaaucuucuaaaug

SEQ ID NO: 2506914 - RNA, 22 nt, Chlamydia trachomatis
uccgcagagaugauauuuucau

SEQ ID NO: 2506915 - RNA, 20 nt, Chlamydia trachomatis
uccgcaguaaaaucuaaaau

SEQ ID NO: 2506916 - RNA, 22 nt, Chlamydia trachomatis
uccgcaguaaaaucuaaaauau

SEQ ID NO: 2506917 - RNA, 17 nt, Chlamydia trachomatis
uccgcuagauccguuuu

SEQ ID NO: 2506918 - RNA, 17 nt, Chlamydia trachomatis
uccgcuaggcaaauauc

SEQ ID NO: 2506919 - RNA, 16 nt, Chlamydia trachomatis
uccgcucgauauccug

SEQ ID NO: 2506920 - RNA, 20 nt, Chlamydia trachomatis
uccgcugcaaucucuuguuu

SEQ ID NO: 2506921 - RNA, 22 nt, Chlamydia trachomatis
uccgcuuagaaugggaagcucg

SEQ ID NO: 2506922 - RNA, 12 nt, Chlamydia trachomatis
uccgcuucuuca

SEQ ID NO: 2506923 - RNA, 19 nt, Chlamydia trachomatis
uccggacacacucucccug

SEQ ID NO: 2506924 - RNA, 17 nt, Chlamydia trachomatis
uccggcucucuucacaa

SEQ ID NO: 2506925 - RNA, 17 nt, Chlamydia trachomatis
uccgguauauucuucac

SEQ ID NO: 2506926 - RNA, 17 nt, Chlamydia trachomatis
uccgguguauccucguc

SEQ ID NO: 2506927 - RNA, 12 nt, Chlamydia trachomatis
uccgguucucuu

SEQ ID NO: 2506928 - RNA, 21 nt, Chlamydia trachomatis
uccgguuuccaaauaggaucc

SEQ ID NO: 2506929 - RNA, 23 nt, Chlamydia trachomatis
uccguaaugaucagcaaaaagag

SEQ ID NO: 2506930 - RNA, 19 nt, Chlamydia trachomatis
uccguacucugauuagaag

SEQ ID NO: 2506931 - RNA, 22 nt, Chlamydia trachomatis
uccgugacgaauaaucaauccg

SEQ ID NO: 2506932 - RNA, 20 nt, Chlamydia trachomatis
uccgugauuuccguaaugau

SEQ ID NO: 2506933 - RNA, 20 nt, Chlamydia trachomatis
uccguuaaagagucuucauc

SEQ ID NO: 2506934 - RNA, 17 nt, Chlamydia trachomatis
uccuaaaccuccagaag

SEQ ID NO: 2506935 - RNA, 21 nt, Chlamydia trachomatis
uccuaaccaaguuuuuuucau

SEQ ID NO: 2506936 - RNA, 13 nt, Chlamydia trachomatis
uccuaacccuaaa

SEQ ID NO: 2506937 - RNA, 23 nt, Chlamydia trachomatis
uccuaagcagugaauaacguaga

SEQ ID NO: 2506938 - RNA, 16 nt, Chlamydia trachomatis
uccuaaucuuucuaau

SEQ ID NO: 2506939 - RNA, 21 nt, Chlamydia trachomatis
uccuaauuuucuaggagaaga

SEQ ID NO: 2506940 - RNA, 14 nt, Chlamydia trachomatis
uccuacaaaauagu

SEQ ID NO: 2506941 - RNA, 22 nt, Chlamydia trachomatis
uccuacacaagcuuuuuucuga

SEQ ID NO: 2506942 - RNA, 15 nt, Chlamydia trachomatis
uccuaccaucaaucc

SEQ ID NO: 2506943 - RNA, 15 nt, Chlamydia trachomatis
uccuagaaagaacca

SEQ ID NO: 2506944 - RNA, 14 nt, Chlamydia trachomatis
uccuagcgaagucu

SEQ ID NO: 2506945 - RNA, 15 nt, Chlamydia trachomatis
uccuagcgaagucuu

SEQ ID NO: 2506946 - RNA, 16 nt, Chlamydia trachomatis
uccuauacaagaaaac

SEQ ID NO: 2506947 - RNA, 20 nt, Chlamydia trachomatis
uccuauacccgacuaaaaaa

SEQ ID NO: 2506948 - RNA, 19 nt, Chlamydia trachomatis
uccuaucacucccugcaau

SEQ ID NO: 2506949 - RNA, 22 nt, Chlamydia trachomatis
uccuaucuucaacccuuuuaau

SEQ ID NO: 2506950 - RNA, 18 nt, Chlamydia trachomatis
uccuaugcaguaaagaaa

SEQ ID NO: 2506951 - RNA, 21 nt, Chlamydia trachomatis
uccuauugagcgcaaagcgga

SEQ ID NO: 2506952 - RNA, 13 nt, Chlamydia trachomatis
uccucaaaaaagg

SEQ ID NO: 2506953 - RNA, 14 nt, Chlamydia trachomatis
uccucaaaaaaggc

SEQ ID NO: 2506954 - RNA, 20 nt, Chlamydia trachomatis
uccucaaaagaacuuccuau

SEQ ID NO: 2506955 - RNA, 15 nt, Chlamydia trachomatis
uccucaagcgauuau

SEQ ID NO: 2506956 - RNA, 18 nt, Chlamydia trachomatis
uccucagggcugacuaaa

SEQ ID NO: 2506957 - RNA, 14 nt, Chlamydia trachomatis
uccucauccuuuug

SEQ ID NO: 2506958 - RNA, 18 nt, Chlamydia trachomatis
uccuccaaagaugcuccu

SEQ ID NO: 2506959 - RNA, 17 nt, Chlamydia trachomatis
uccuccagauacugcuc

SEQ ID NO: 2506960 - RNA, 19 nt, Chlamydia trachomatis
uccuccagauacugcucca

SEQ ID NO: 2506961 - RNA, 20 nt, Chlamydia trachomatis
uccuccauaacgauccucuu

SEQ ID NO: 2506962 - RNA, 13 nt, Chlamydia trachomatis
uccuccuccuaaa

SEQ ID NO: 2506963 - RNA, 20 nt, Chlamydia trachomatis
uccuccugauuccugcugau

SEQ ID NO: 2506964 - RNA, 19 nt, Chlamydia trachomatis
uccuccugcaggaggcauu

SEQ ID NO: 2506965 - RNA, 17 nt, Chlamydia trachomatis
uccucgaagcuacugau

SEQ ID NO: 2506966 - RNA, 13 nt, Chlamydia trachomatis
uccucgcaaucca

SEQ ID NO: 2506967 - RNA, 17 nt, Chlamydia trachomatis
uccucggacaaacgucc

SEQ ID NO: 2506968 - RNA, 22 nt, Chlamydia trachomatis
uccucgggaaauucagguaauu

SEQ ID NO: 2506969 - RNA, 17 nt, Chlamydia trachomatis
uccucguccaugagcaa

SEQ ID NO: 2506970 - RNA, 15 nt, Chlamydia trachomatis
uccucgugaggcaug

SEQ ID NO: 2506971 - RNA, 17 nt, Chlamydia trachomatis
uccucguuuuuuuagau

SEQ ID NO: 2506972 - RNA, 22 nt, Chlamydia trachomatis
uccucuaaacaagguucuucaa

SEQ ID NO: 2506973 - RNA, 13 nt, Chlamydia trachomatis
uccucuacaccau

SEQ ID NO: 2506974 - RNA, 16 nt, Chlamydia trachomatis
uccucucucugcagag

SEQ ID NO: 2506975 - RNA, 16 nt, Chlamydia trachomatis
uccucucucuuuauga

SEQ ID NO: 2506976 - RNA, 16 nt, Chlamydia trachomatis
uccucugaauccauuc

SEQ ID NO: 2506977 - RNA, 17 nt, Chlamydia trachomatis
uccucugaauccauucu

SEQ ID NO: 2506978 - RNA, 23 nt, Chlamydia trachomatis
uccucuggauauaccacggaaca

SEQ ID NO: 2506979 - RNA, 21 nt, Chlamydia trachomatis
uccucuggcuuaucaacaaga

SEQ ID NO: 2506980 - RNA, 23 nt, Chlamydia trachomatis
uccucuggcuuaucaacaagauu

SEQ ID NO: 2506981 - RNA, 13 nt, Chlamydia trachomatis
uccucuucuagaa

SEQ ID NO: 2506982 - RNA, 14 nt, Chlamydia trachomatis
uccucuucuagaag

SEQ ID NO: 2506983 - RNA, 15 nt, Chlamydia trachomatis
uccucuucuagaaga

SEQ ID NO: 2506984 - RNA, 11 nt, Chlamydia trachomatis
uccucuucuuc

SEQ ID NO: 2506985 - RNA, 16 nt, Chlamydia trachomatis
uccucuuuuuccuacg

SEQ ID NO: 2506986 - RNA, 23 nt, Chlamydia trachomatis
uccugaaaguuccgguauauucu

SEQ ID NO: 2506987 - RNA, 18 nt, Chlamydia trachomatis
uccugaauggucaauaau

SEQ ID NO: 2506988 - RNA, 20 nt, Chlamydia trachomatis
uccugagcccaaggagaaua

SEQ ID NO: 2506989 - RNA, 15 nt, Chlamydia trachomatis
uccugagggccuucu

SEQ ID NO: 2506990 - RNA, 21 nt, Chlamydia trachomatis
uccugagggccuucuuuuucc

SEQ ID NO: 2506991 - RNA, 13 nt, Chlamydia trachomatis
uccugcaagcaca

SEQ ID NO: 2506992 - RNA, 18 nt, Chlamydia trachomatis
uccugcagcuaaagaauc

SEQ ID NO: 2506993 - RNA, 20 nt, Chlamydia trachomatis
uccugcaggaggcauuccuu

SEQ ID NO: 2506994 - RNA, 17 nt, Chlamydia trachomatis
uccugcauacuuuucaa

SEQ ID NO: 2506995 - RNA, 14 nt, Chlamydia trachomatis
uccugcuucuuuuu

SEQ ID NO: 2506996 - RNA, 23 nt, Chlamydia trachomatis
uccuguagaaagacuuaccauag

SEQ ID NO: 2506997 - RNA, 11 nt, Chlamydia trachomatis
uccuguucucc

SEQ ID NO: 2506998 - RNA, 20 nt, Chlamydia trachomatis
uccuguucuucaaauucuac

SEQ ID NO: 2506999 - RNA, 18 nt, Chlamydia trachomatis
uccuuaagguuuguuaau

SEQ ID NO: 2507000 - RNA, 22 nt, Chlamydia trachomatis
uccuuagaaggagugugaucga

SEQ ID NO: 2507001 - RNA, 15 nt, Chlamydia trachomatis
uccuuagcuaaaagc

SEQ ID NO: 2507002 - RNA, 21 nt, Chlamydia trachomatis
uccuuaguuaaaacuccagaa

SEQ ID NO: 2507003 - RNA, 22 nt, Chlamydia trachomatis
uccuuaguuaaaacuccagaaa

SEQ ID NO: 2507004 - RNA, 21 nt, Chlamydia trachomatis
uccuuaguuagcugaaauguc

SEQ ID NO: 2507005 - RNA, 20 nt, Chlamydia trachomatis
uccuuauacaucagagcaau

SEQ ID NO: 2507006 - RNA, 20 nt, Chlamydia trachomatis
uccuuauaguuguuuuugau

SEQ ID NO: 2507007 - RNA, 14 nt, Chlamydia trachomatis
uccuuaucuaauuc

SEQ ID NO: 2507008 - RNA, 13 nt, Chlamydia trachomatis
uccuuaucuucuu

SEQ ID NO: 2507009 - RNA, 15 nt, Chlamydia trachomatis
uccuucaaauauuuu

SEQ ID NO: 2507010 - RNA, 23 nt, Chlamydia trachomatis
uccuucgaagcggagcaucuucu

SEQ ID NO: 2507011 - RNA, 15 nt, Chlamydia trachomatis
uccuucgauauggca

SEQ ID NO: 2507012 - RNA, 16 nt, Chlamydia trachomatis
uccuucgauauggcaa

SEQ ID NO: 2507013 - RNA, 19 nt, Chlamydia trachomatis
uccuucucccgcuaauuuu

SEQ ID NO: 2507014 - RNA, 16 nt, Chlamydia trachomatis
uccuucucgcaaaaga

SEQ ID NO: 2507015 - RNA, 12 nt, Chlamydia trachomatis
uccuucugcuau

SEQ ID NO: 2507016 - RNA, 22 nt, Chlamydia trachomatis
uccuucuguguuugauaacgcu

SEQ ID NO: 2507017 - RNA, 14 nt, Chlamydia trachomatis
uccuucuugugaga

SEQ ID NO: 2507018 - RNA, 22 nt, Chlamydia trachomatis
uccuucuuuaauaaaagcuccu

SEQ ID NO: 2507019 - RNA, 20 nt, Chlamydia trachomatis
uccuucuuucuggaaucauu

SEQ ID NO: 2507020 - RNA, 13 nt, Chlamydia trachomatis
uccuugaaccaaa

SEQ ID NO: 2507021 - RNA, 14 nt, Chlamydia trachomatis
uccuugacucuaaa

SEQ ID NO: 2507022 - RNA, 16 nt, Chlamydia trachomatis
uccuuggcuuuuacaa

SEQ ID NO: 2507023 - RNA, 20 nt, Chlamydia trachomatis
uccuuuuaagauauccauag

SEQ ID NO: 2507024 - RNA, 13 nt, Chlamydia trachomatis
uccuuuucagaau

SEQ ID NO: 2507025 - RNA, 21 nt, Chlamydia trachomatis
uccuuuucagaauuacccuga

SEQ ID NO: 2507026 - RNA, 16 nt, Chlamydia trachomatis
uccuuuugauucugcu

SEQ ID NO: 2507027 - RNA, 13 nt, Chlamydia trachomatis
uccuuuuuacuaa

SEQ ID NO: 2507028 - RNA, 14 nt, Chlamydia trachomatis
ucgaaaacaaagag

SEQ ID NO: 2507029 - RNA, 16 nt, Chlamydia trachomatis
ucgaaaacaaagaguu

SEQ ID NO: 2507030 - RNA, 12 nt, Chlamydia trachomatis
ucgaaaagagcu

SEQ ID NO: 2507031 - RNA, 16 nt, Chlamydia trachomatis
ucgaacgcuucuuccc

SEQ ID NO: 2507032 - RNA, 22 nt, Chlamydia trachomatis
ucgaacucagcuuccuuggcuu

SEQ ID NO: 2507033 - RNA, 12 nt, Chlamydia trachomatis
ucgaagcuacug

SEQ ID NO: 2507034 - RNA, 20 nt, Chlamydia trachomatis
ucgaaggaauacccagaagu

SEQ ID NO: 2507035 - RNA, 22 nt, Chlamydia trachomatis
ucgaaggaauacccagaaguau

SEQ ID NO: 2507036 - RNA, 22 nt, Chlamydia trachomatis
ucgaaggagcuaagaaccacaa

SEQ ID NO: 2507037 - RNA, 19 nt, Chlamydia trachomatis
ucgaauagcucccaacaag

SEQ ID NO: 2507038 - RNA, 20 nt, Chlamydia trachomatis
ucgaaugccccagaaacacu

SEQ ID NO: 2507039 - RNA, 14 nt, Chlamydia trachomatis
ucgaauucuaucaa

SEQ ID NO: 2507040 - RNA, 15 nt, Chlamydia trachomatis
ucgaauuuuucugcu

SEQ ID NO: 2507041 - RNA, 19 nt, Chlamydia trachomatis
ucgaauuuuuuucuuugcu

SEQ ID NO: 2507042 - RNA, 17 nt, Chlamydia trachomatis
ucgacaacgauauaaag

SEQ ID NO: 2507043 - RNA, 23 nt, Chlamydia trachomatis
ucgacuugcuacggaaaccaaua

SEQ ID NO: 2507044 - RNA, 14 nt, Chlamydia trachomatis
ucgagaaaugaauu

SEQ ID NO: 2507045 - RNA, 17 nt, Chlamydia trachomatis
ucgagaagagccaucaa

SEQ ID NO: 2507046 - RNA, 18 nt, Chlamydia trachomatis
ucgagagaugauuguuuu

SEQ ID NO: 2507047 - RNA, 21 nt, Chlamydia trachomatis
ucgagagaugauuguuuugau

SEQ ID NO: 2507048 - RNA, 21 nt, Chlamydia trachomatis
ucgagauaauauugagaaaua

SEQ ID NO: 2507049 - RNA, 16 nt, Chlamydia trachomatis
ucgagcuaagaaaaua

SEQ ID NO: 2507050 - RNA, 23 nt, Chlamydia trachomatis
ucgagcuguuuuugcaacaaagc

SEQ ID NO: 2507051 - RNA, 11 nt, Chlamydia trachomatis
ucgaggcuccc

SEQ ID NO: 2507052 - RNA, 18 nt, Chlamydia trachomatis
ucgaguuuuuuuguuucc

SEQ ID NO: 2507053 - RNA, 12 nt, Chlamydia trachomatis
ucgauaagaagg

SEQ ID NO: 2507054 - RNA, 20 nt, Chlamydia trachomatis
ucgauaaugcuuagaaacug

SEQ ID NO: 2507055 - RNA, 20 nt, Chlamydia trachomatis
ucgauaccuauuccaaaucc

SEQ ID NO: 2507056 - RNA, 14 nt, Chlamydia trachomatis
ucgauacucaucga

SEQ ID NO: 2507057 - RNA, 15 nt, Chlamydia trachomatis
ucgauagaaaaaaac

SEQ ID NO: 2507058 - RNA, 23 nt, Chlamydia trachomatis
ucgauaguuuucccaucuacaaa

SEQ ID NO: 2507059 - RNA, 18 nt, Chlamydia trachomatis
ucgauaucgcguccaaaa

SEQ ID NO: 2507060 - RNA, 13 nt, Chlamydia trachomatis
ucgauccaaagcc

SEQ ID NO: 2507061 - RNA, 14 nt, Chlamydia trachomatis
ucgauccagcaucu

SEQ ID NO: 2507062 - RNA, 16 nt, Chlamydia trachomatis
ucgaucccuuuuucag

SEQ ID NO: 2507063 - RNA, 17 nt, Chlamydia trachomatis
ucgaucggaaagaggag

SEQ ID NO: 2507064 - RNA, 18 nt, Chlamydia trachomatis
ucgaucgucaucaguguc

SEQ ID NO: 2507065 - RNA, 21 nt, Chlamydia trachomatis
ucgaucuuaccaaaaucuaaa

SEQ ID NO: 2507066 - RNA, 17 nt, Chlamydia trachomatis
ucgaugauaucuucuga

SEQ ID NO: 2507067 - RNA, 17 nt, Chlamydia trachomatis
ucgcagagaaagagcca

SEQ ID NO: 2507068 - RNA, 19 nt, Chlamydia trachomatis
ucgcaguacuuuaccugua

SEQ ID NO: 2507069 - RNA, 22 nt, Chlamydia trachomatis
ucgcauaguguugaucuuauua

SEQ ID NO: 2507070 - RNA, 21 nt, Chlamydia trachomatis
ucgcaugagccgauccaucaa

SEQ ID NO: 2507071 - RNA, 22 nt, Chlamydia trachomatis
ucgcauuugaaagaaacguuuu

SEQ ID NO: 2507072 - RNA, 17 nt, Chlamydia trachomatis
ucgcauuuguaguucua

SEQ ID NO: 2507073 - RNA, 20 nt, Chlamydia trachomatis
ucgccaaacacugcaacagu

SEQ ID NO: 2507074 - RNA, 15 nt, Chlamydia trachomatis
ucgccaaucagugua

SEQ ID NO: 2507075 - RNA, 16 nt, Chlamydia trachomatis
ucgcccuacggaacca

SEQ ID NO: 2507076 - RNA, 22 nt, Chlamydia trachomatis
ucgcccuuauugguauagaaac

SEQ ID NO: 2507077 - RNA, 23 nt, Chlamydia trachomatis
ucgccgggggagccaaaaagucc

SEQ ID NO: 2507078 - RNA, 15 nt, Chlamydia trachomatis
ucgccucuaucucuu

SEQ ID NO: 2507079 - RNA, 14 nt, Chlamydia trachomatis
ucgcuacaaauccu

SEQ ID NO: 2507080 - RNA, 22 nt, Chlamydia trachomatis
ucgcuauagcaugaucaugcag

SEQ ID NO: 2507081 - RNA, 14 nt, Chlamydia trachomatis
ucgcuaucaauaaa

SEQ ID NO: 2507082 - RNA, 19 nt, Chlamydia trachomatis
ucgcuauuuccccuacaaa

SEQ ID NO: 2507083 - RNA, 18 nt, Chlamydia trachomatis
ucgcugucaggauuuaaa

SEQ ID NO: 2507084 - RNA, 18 nt, Chlamydia trachomatis
ucgcuucaaaacuaaaag

SEQ ID NO: 2507085 - RNA, 12 nt, Chlamydia trachomatis
ucgcuucugcug

SEQ ID NO: 2507086 - RNA, 20 nt, Chlamydia trachomatis
ucggaauaagcgaaaaaaaa

SEQ ID NO: 2507087 - RNA, 11 nt, Chlamydia trachomatis
ucggagaagaa

SEQ ID NO: 2507088 - RNA, 16 nt, Chlamydia trachomatis
ucggagaagaagaggg

SEQ ID NO: 2507089 - RNA, 14 nt, Chlamydia trachomatis
ucggauagagaaga

SEQ ID NO: 2507090 - RNA, 15 nt, Chlamydia trachomatis
ucggauagagaagaa

SEQ ID NO: 2507091 - RNA, 13 nt, Chlamydia trachomatis
ucggauaggcuga

SEQ ID NO: 2507092 - RNA, 16 nt, Chlamydia trachomatis
ucggauaggcugagga

SEQ ID NO: 2507093 - RNA, 20 nt, Chlamydia trachomatis
ucggcaggccuuccaccuug

SEQ ID NO: 2507094 - RNA, 13 nt, Chlamydia trachomatis
ucggccuuuucua

SEQ ID NO: 2507095 - RNA, 22 nt, Chlamydia trachomatis
ucggccuuuucuagagaagaga

SEQ ID NO: 2507096 - RNA, 23 nt, Chlamydia trachomatis
ucggucacgaaguuuuuuuaaaa

SEQ ID NO: 2507097 - RNA, 13 nt, Chlamydia trachomatis
ucgguuguauaaa

SEQ ID NO: 2507098 - RNA, 18 nt, Chlamydia trachomatis
ucgguuugauuuccucuu

SEQ ID NO: 2507099 - RNA, 15 nt, Chlamydia trachomatis
ucguaaccaagcuua

SEQ ID NO: 2507100 - RNA, 20 nt, Chlamydia trachomatis
ucguaaccaagcuuagcaga

SEQ ID NO: 2507101 - RNA, 14 nt, Chlamydia trachomatis
ucguaagcaaacag

SEQ ID NO: 2507102 - RNA, 24 nt, Chlamydia trachomatis
ucguaagcaacaauauccuccaua

SEQ ID NO: 2507103 - RNA, 19 nt, Chlamydia trachomatis
ucguaagcauagcuucuug

SEQ ID NO: 2507104 - RNA, 17 nt, Chlamydia trachomatis
ucguaaguguugaggaa

SEQ ID NO: 2507105 - RNA, 20 nt, Chlamydia trachomatis
ucguaaguguugaggaacau

SEQ ID NO: 2507106 - RNA, 16 nt, Chlamydia trachomatis
ucguaaugaaggaaau

SEQ ID NO: 2507107 - RNA, 23 nt, Chlamydia trachomatis
ucguagacagagaauagcugcca

SEQ ID NO: 2507108 - RNA, 21 nt, Chlamydia trachomatis
ucguauaaguuuuaagaagag

SEQ ID NO: 2507109 - RNA, 23 nt, Chlamydia trachomatis
ucguaucccugcauaauagcuug

SEQ ID NO: 2507110 - RNA, 17 nt, Chlamydia trachomatis
ucgucagggagaaaacg

SEQ ID NO: 2507111 - RNA, 19 nt, Chlamydia trachomatis
ucgucaggggaucuguacc

SEQ ID NO: 2507112 - RNA, 12 nt, Chlamydia trachomatis
ucgucagugcag

SEQ ID NO: 2507113 - RNA, 13 nt, Chlamydia trachomatis
ucgucccaucuug

SEQ ID NO: 2507114 - RNA, 19 nt, Chlamydia trachomatis
ucgucucagcuucaaccuu

SEQ ID NO: 2507115 - RNA, 23 nt, Chlamydia trachomatis
ucgucugcgaaaaagaaauaacc

SEQ ID NO: 2507116 - RNA, 17 nt, Chlamydia trachomatis
ucgucuuuaacccuuca

SEQ ID NO: 2507117 - RNA, 22 nt, Chlamydia trachomatis
ucgugagacagcacuucuucuu

SEQ ID NO: 2507118 - RNA, 17 nt, Chlamydia trachomatis
ucgugcagggagaaggg

SEQ ID NO: 2507119 - RNA, 22 nt, Chlamydia trachomatis
ucgugccagcacaucacuauaa

SEQ ID NO: 2507120 - RNA, 15 nt, Chlamydia trachomatis
ucguggaggggaaua

SEQ ID NO: 2507121 - RNA, 19 nt, Chlamydia trachomatis
ucgugucaggcgauaugcu

SEQ ID NO: 2507122 - RNA, 17 nt, Chlamydia trachomatis
ucgugugacuguaaguu

SEQ ID NO: 2507123 - RNA, 19 nt, Chlamydia trachomatis
ucgugugggugaugccuau

SEQ ID NO: 2507124 - RNA, 15 nt, Chlamydia trachomatis
ucguguguaggaaug

SEQ ID NO: 2507125 - RNA, 19 nt, Chlamydia trachomatis
ucguuacgcguaaagauuu

SEQ ID NO: 2507126 - RNA, 20 nt, Chlamydia trachomatis
ucguuacgcguaaagauuuu

SEQ ID NO: 2507127 - RNA, 21 nt, Chlamydia trachomatis
ucguugcucccaucaacucuc

SEQ ID NO: 2507128 - RNA, 20 nt, Chlamydia trachomatis
ucguuucuaugauucuucua

SEQ ID NO: 2507129 - RNA, 18 nt, Chlamydia trachomatis
ucguuugugcuaaaucuc

SEQ ID NO: 2507130 - RNA, 18 nt, Chlamydia trachomatis
ucguuuucggagaagaag

SEQ ID NO: 2507131 - RNA, 23 nt, Chlamydia trachomatis
ucguuuugaagaagaucuguaac

SEQ ID NO: 2507132 - RNA, 18 nt, Chlamydia trachomatis
ucuaaaaaggcacuuugu

SEQ ID NO: 2507133 - RNA, 20 nt, Chlamydia trachomatis
ucuaaaacaauuuccuuaga

SEQ ID NO: 2507134 - RNA, 12 nt, Chlamydia trachomatis
ucuaaaagaaua

SEQ ID NO: 2507135 - RNA, 12 nt, Chlamydia trachomatis
ucuaaaagaguu

SEQ ID NO: 2507136 - RNA, 15 nt, Chlamydia trachomatis
ucuaaaauuuuacgu

SEQ ID NO: 2507137 - RNA, 21 nt, Chlamydia trachomatis
ucuaaacaagguucuucaaca

SEQ ID NO: 2507138 - RNA, 21 nt, Chlamydia trachomatis
ucuaaagacaaaacuucuucg

SEQ ID NO: 2507139 - RNA, 16 nt, Chlamydia trachomatis
ucuaaagauccucuuu

SEQ ID NO: 2507140 - RNA, 12 nt, Chlamydia trachomatis
ucuaaagccaua

SEQ ID NO: 2507141 - RNA, 20 nt, Chlamydia trachomatis
ucuaaaugcuguaaaacauu

SEQ ID NO: 2507142 - RNA, 21 nt, Chlamydia trachomatis
ucuaaaugcuguaaaacauuu

SEQ ID NO: 2507143 - RNA, 14 nt, Chlamydia trachomatis
ucuaacacuuuauc

SEQ ID NO: 2507144 - RNA, 17 nt, Chlamydia trachomatis
ucuaacgcuuccucucc

SEQ ID NO: 2507145 - RNA, 19 nt, Chlamydia trachomatis
ucuaacgcuuccucuccuu

SEQ ID NO: 2507146 - RNA, 16 nt, Chlamydia trachomatis
ucuaacucuucuggag

SEQ ID NO: 2507147 - RNA, 12 nt, Chlamydia trachomatis
ucuaagaacaac

SEQ ID NO: 2507148 - RNA, 17 nt, Chlamydia trachomatis
ucuaagcaccuuuacaa

SEQ ID NO: 2507149 - RNA, 20 nt, Chlamydia trachomatis
ucuaagcgaaacaguucuuu

SEQ ID NO: 2507150 - RNA, 18 nt, Chlamydia trachomatis
ucuaagcuagaaaauagc

SEQ ID NO: 2507151 - RNA, 23 nt, Chlamydia trachomatis
ucuaagcuagaaaauagcaucuc

SEQ ID NO: 2507152 - RNA, 16 nt, Chlamydia trachomatis
ucuaauaaacagaucu

SEQ ID NO: 2507153 - RNA, 22 nt, Chlamydia trachomatis
ucuaauaggguuaggaaagcac

SEQ ID NO: 2507154 - RNA, 13 nt, Chlamydia trachomatis
ucuaaugcuuugu

SEQ ID NO: 2507155 - RNA, 21 nt, Chlamydia trachomatis
ucuaauuggacgagaggcgaa

SEQ ID NO: 2507156 - RNA, 20 nt, Chlamydia trachomatis
ucuaauuuuagauaaaagaa

SEQ ID NO: 2507157 - RNA, 23 nt, Chlamydia trachomatis
ucuacacgcucaggcuaucacaa

SEQ ID NO: 2507158 - RNA, 13 nt, Chlamydia trachomatis
ucuacagcaaaac

SEQ ID NO: 2507159 - RNA, 22 nt, Chlamydia trachomatis
ucuacaggccucccuaucaauu

SEQ ID NO: 2507160 - RNA, 16 nt, Chlamydia trachomatis
ucuacauccaaaaauu

SEQ ID NO: 2507161 - RNA, 20 nt, Chlamydia trachomatis
ucuacauccaaaaauugaaa

SEQ ID NO: 2507162 - RNA, 19 nt, Chlamydia trachomatis
ucuacgcuuccuacagcua

SEQ ID NO: 2507163 - RNA, 13 nt, Chlamydia trachomatis
ucuacuuucccua

SEQ ID NO: 2507164 - RNA, 20 nt, Chlamydia trachomatis
ucuacuuuuuguuuagacaa

SEQ ID NO: 2507165 - RNA, 15 nt, Chlamydia trachomatis
ucuagaaaagagcag

SEQ ID NO: 2507166 - RNA, 17 nt, Chlamydia trachomatis
ucuagaagaacuccccc

SEQ ID NO: 2507167 - RNA, 15 nt, Chlamydia trachomatis
ucuagacauagcuug

SEQ ID NO: 2507168 - RNA, 13 nt, Chlamydia trachomatis
ucuagagauaucc

SEQ ID NO: 2507169 - RNA, 23 nt, Chlamydia trachomatis
ucuagagauaucccuaaagaggc

SEQ ID NO: 2507170 - RNA, 19 nt, Chlamydia trachomatis
ucuagagccugcaagagau

SEQ ID NO: 2507171 - RNA, 16 nt, Chlamydia trachomatis
ucuagagguauuuuau

SEQ ID NO: 2507172 - RNA, 17 nt, Chlamydia trachomatis
ucuagcgcacuauuagg

SEQ ID NO: 2507173 - RNA, 15 nt, Chlamydia trachomatis
ucuagcuuuuuucag

SEQ ID NO: 2507174 - RNA, 22 nt, Chlamydia trachomatis
ucuaggagauaagcaagcauaa

SEQ ID NO: 2507175 - RNA, 19 nt, Chlamydia trachomatis
ucuagggaaaaaaagaggu

SEQ ID NO: 2507176 - RNA, 21 nt, Chlamydia trachomatis
ucuagugccucaauuuguagc

SEQ ID NO: 2507177 - RNA, 22 nt, Chlamydia trachomatis
ucuaguuauauugcuucauaaa

SEQ ID NO: 2507178 - RNA, 16 nt, Chlamydia trachomatis
ucuauaaauuauacaa

SEQ ID NO: 2507179 - RNA, 17 nt, Chlamydia trachomatis
ucuauagccaaaugcac

SEQ ID NO: 2507180 - RNA, 22 nt, Chlamydia trachomatis
ucuauaggauaaauuaauguaa

SEQ ID NO: 2507181 - RNA, 22 nt, Chlamydia trachomatis
ucuauaggaugguauucgcugu

SEQ ID NO: 2507182 - RNA, 14 nt, Chlamydia trachomatis
ucuauccauaauuu

SEQ ID NO: 2507183 - RNA, 18 nt, Chlamydia trachomatis
ucuauccggaguaccaaa

SEQ ID NO: 2507184 - RNA, 19 nt, Chlamydia trachomatis
ucuauccggaguaccaaaa

SEQ ID NO: 2507185 - RNA, 13 nt, Chlamydia trachomatis
ucuaugagaagaa

SEQ ID NO: 2507186 - RNA, 20 nt, Chlamydia trachomatis
ucuauguaaaaauucuaaag

SEQ ID NO: 2507187 - RNA, 19 nt, Chlamydia trachomatis
ucuauuaagaaucuuugaa

SEQ ID NO: 2507188 - RNA, 21 nt, Chlamydia trachomatis
ucuauuggacucagaaucuuu

SEQ ID NO: 2507189 - RNA, 15 nt, Chlamydia trachomatis
ucuauuuucucuuua

SEQ ID NO: 2507190 - RNA, 15 nt, Chlamydia trachomatis
ucucaccgaaaaauu

SEQ ID NO: 2507191 - RNA, 18 nt, Chlamydia trachomatis
ucucagauucgaauaauc

SEQ ID NO: 2507192 - RNA, 13 nt, Chlamydia trachomatis
ucucauaagaaua

SEQ ID NO: 2507193 - RNA, 17 nt, Chlamydia trachomatis
ucucauaagaauacaaa

SEQ ID NO: 2507194 - RNA, 15 nt, Chlamydia trachomatis
ucucauaaggaguuu

SEQ ID NO: 2507195 - RNA, 22 nt, Chlamydia trachomatis
ucucauggaucaccgaacaacc

SEQ ID NO: 2507196 - RNA, 21 nt, Chlamydia trachomatis
ucucauuauauaaagccccuc

SEQ ID NO: 2507197 - RNA, 14 nt, Chlamydia trachomatis
ucuccaaacucuau

SEQ ID NO: 2507198 - RNA, 14 nt, Chlamydia trachomatis
ucuccaaauaaucc

SEQ ID NO: 2507199 - RNA, 16 nt, Chlamydia trachomatis
ucuccaaauaauccca

SEQ ID NO: 2507200 - RNA, 13 nt, Chlamydia trachomatis
ucuccaacaguga

SEQ ID NO: 2507201 - RNA, 22 nt, Chlamydia trachomatis
ucuccagaaaaacguuucuguu

SEQ ID NO: 2507202 - RNA, 13 nt, Chlamydia trachomatis
ucuccagcaucuu

SEQ ID NO: 2507203 - RNA, 15 nt, Chlamydia trachomatis
ucuccagcaucuuuu

SEQ ID NO: 2507204 - RNA, 14 nt, Chlamydia trachomatis
ucuccaucugacuu

SEQ ID NO: 2507205 - RNA, 17 nt, Chlamydia trachomatis
ucuccaucugacuuuuu

SEQ ID NO: 2507206 - RNA, 20 nt, Chlamydia trachomatis
ucuccaugauccccuacgcu

SEQ ID NO: 2507207 - RNA, 20 nt, Chlamydia trachomatis
ucucccaagaaacuuuucug

SEQ ID NO: 2507208 - RNA, 20 nt, Chlamydia trachomatis
ucucccgaugaucuuuccaa

SEQ ID NO: 2507209 - RNA, 20 nt, Chlamydia trachomatis
ucuccgaugccgcagaaaaa

SEQ ID NO: 2507210 - RNA, 17 nt, Chlamydia trachomatis
ucuccgcuuaaaacuac

SEQ ID NO: 2507211 - RNA, 22 nt, Chlamydia trachomatis
ucuccgcuuaaaacuacagaaa

SEQ ID NO: 2507212 - RNA, 13 nt, Chlamydia trachomatis
ucuccuaaaagcc

SEQ ID NO: 2507213 - RNA, 13 nt, Chlamydia trachomatis
ucuccuaaauccu

SEQ ID NO: 2507214 - RNA, 16 nt, Chlamydia trachomatis
ucuccuaacccuaaaa

SEQ ID NO: 2507215 - RNA, 15 nt, Chlamydia trachomatis
ucuccuaauucaaca

SEQ ID NO: 2507216 - RNA, 14 nt, Chlamydia trachomatis
ucuccuagagaaac

SEQ ID NO: 2507217 - RNA, 20 nt, Chlamydia trachomatis
ucuccuauugagcgcaaagc

SEQ ID NO: 2507218 - RNA, 15 nt, Chlamydia trachomatis
ucuccucauccuuuu

SEQ ID NO: 2507219 - RNA, 13 nt, Chlamydia trachomatis
ucuccucucucuu

SEQ ID NO: 2507220 - RNA, 14 nt, Chlamydia trachomatis
ucuccuuccucuuu

SEQ ID NO: 2507221 - RNA, 17 nt, Chlamydia trachomatis
ucuccuucuuuaauaaa

SEQ ID NO: 2507222 - RNA, 22 nt, Chlamydia trachomatis
ucuccuucuuugacaaagucag

SEQ ID NO: 2507223 - RNA, 22 nt, Chlamydia trachomatis
ucucgaacucagcuuccuuggc

SEQ ID NO: 2507224 - RNA, 13 nt, Chlamydia trachomatis
ucucgaaugcugu

SEQ ID NO: 2507225 - RNA, 15 nt, Chlamydia trachomatis
ucucgaauucuauca

SEQ ID NO: 2507226 - RNA, 16 nt, Chlamydia trachomatis
ucucgaauucuaucaa

SEQ ID NO: 2507227 - RNA, 18 nt, Chlamydia trachomatis
ucucgagcuaagaaaaua

SEQ ID NO: 2507228 - RNA, 15 nt, Chlamydia trachomatis
ucucgagucaagaag

SEQ ID NO: 2507229 - RNA, 15 nt, Chlamydia trachomatis
ucucgcaaagaauca

SEQ ID NO: 2507230 - RNA, 15 nt, Chlamydia trachomatis
ucucggauaggaaaa

SEQ ID NO: 2507231 - RNA, 20 nt, Chlamydia trachomatis
ucucggaucgagaagagcca

SEQ ID NO: 2507232 - RNA, 13 nt, Chlamydia trachomatis
ucucgguuuucuu

SEQ ID NO: 2507233 - RNA, 14 nt, Chlamydia trachomatis
ucucgguuuucuuu

SEQ ID NO: 2507234 - RNA, 16 nt, Chlamydia trachomatis
ucucuaaaagaagagc

SEQ ID NO: 2507235 - RNA, 16 nt, Chlamydia trachomatis
ucucuaaaaucacaca

SEQ ID NO: 2507236 - RNA, 20 nt, Chlamydia trachomatis
ucucuaaaaucacacaagcu

SEQ ID NO: 2507237 - RNA, 15 nt, Chlamydia trachomatis
ucucuaaagacagca

SEQ ID NO: 2507238 - RNA, 20 nt, Chlamydia trachomatis
ucucuaaagcuuuuguuaac

SEQ ID NO: 2507239 - RNA, 15 nt, Chlamydia trachomatis
ucucuaacaaugacu

SEQ ID NO: 2507240 - RNA, 16 nt, Chlamydia trachomatis
ucucuaacuuaauaag

SEQ ID NO: 2507241 - RNA, 17 nt, Chlamydia trachomatis
ucucuaacuuaauaagg

SEQ ID NO: 2507242 - RNA, 13 nt, Chlamydia trachomatis
ucucuaaguaagg

SEQ ID NO: 2507243 - RNA, 18 nt, Chlamydia trachomatis
ucucuaauaguugcaaaa

SEQ ID NO: 2507244 - RNA, 20 nt, Chlamydia trachomatis
ucucuaauaguugcaaaaag

SEQ ID NO: 2507245 - RNA, 14 nt, Chlamydia trachomatis
ucucuagcaugccg

SEQ ID NO: 2507246 - RNA, 21 nt, Chlamydia trachomatis
ucucuagguauuuagguagca

SEQ ID NO: 2507247 - RNA, 17 nt, Chlamydia trachomatis
ucucucagauucgaaua

SEQ ID NO: 2507248 - RNA, 11 nt, Chlamydia trachomatis
ucucucagcag

SEQ ID NO: 2507249 - RNA, 12 nt, Chlamydia trachomatis
ucucucagcagc

SEQ ID NO: 2507250 - RNA, 16 nt, Chlamydia trachomatis
ucucucagcagcuucc

SEQ ID NO: 2507251 - RNA, 22 nt, Chlamydia trachomatis
ucucuccggagaacaguguccu

SEQ ID NO: 2507252 - RNA, 20 nt, Chlamydia trachomatis
ucucucgcgaacaauaucug

SEQ ID NO: 2507253 - RNA, 19 nt, Chlamydia trachomatis
ucucucuggcaauaaucuu

SEQ ID NO: 2507254 - RNA, 23 nt, Chlamydia trachomatis
ucucugauggaaaugcugugacu

SEQ ID NO: 2507255 - RNA, 19 nt, Chlamydia trachomatis
ucucugguaaaaauagaaa

SEQ ID NO: 2507256 - RNA, 20 nt, Chlamydia trachomatis
ucucugugcacaaucucuuu

SEQ ID NO: 2507257 - RNA, 16 nt, Chlamydia trachomatis
ucucuuagaagcucuc

SEQ ID NO: 2507258 - RNA, 14 nt, Chlamydia trachomatis
ucucuucacaaauu

SEQ ID NO: 2507259 - RNA, 22 nt, Chlamydia trachomatis
ucucuucacaaauuuaucugcu

SEQ ID NO: 2507260 - RNA, 15 nt, Chlamydia trachomatis
ucucuucacuuugau

SEQ ID NO: 2507261 - RNA, 17 nt, Chlamydia trachomatis
ucucuuccacgaugaga

SEQ ID NO: 2507262 - RNA, 12 nt, Chlamydia trachomatis
ucucuugauuga

SEQ ID NO: 2507263 - RNA, 17 nt, Chlamydia trachomatis
ucucuugcauguauagu

SEQ ID NO: 2507264 - RNA, 11 nt, Chlamydia trachomatis
ucucuugcuuc

SEQ ID NO: 2507265 - RNA, 21 nt, Chlamydia trachomatis
ucucuuguagagaggcaaaca

SEQ ID NO: 2507266 - RNA, 12 nt, Chlamydia trachomatis
ucucuugucaga

SEQ ID NO: 2507267 - RNA, 14 nt, Chlamydia trachomatis
ucucuuguuucaaa

SEQ ID NO: 2507268 - RNA, 23 nt, Chlamydia trachomatis
ucucuuuauagaaggucugaaca

SEQ ID NO: 2507269 - RNA, 15 nt, Chlamydia trachomatis
ucucuuucucuagaa

SEQ ID NO: 2507270 - RNA, 17 nt, Chlamydia trachomatis
ucucuuuuuaaaaggcu

SEQ ID NO: 2507271 - RNA, 20 nt, Chlamydia trachomatis
ucugaaaagagaagaaggcu

SEQ ID NO: 2507272 - RNA, 17 nt, Chlamydia trachomatis
ucugaaacuagucucuu

SEQ ID NO: 2507273 - RNA, 22 nt, Chlamydia trachomatis
ucugaaacuagucucuucugug

SEQ ID NO: 2507274 - RNA, 13 nt, Chlamydia trachomatis
ucugaaaggccag

SEQ ID NO: 2507275 - RNA, 13 nt, Chlamydia trachomatis
ucugaacaacugc

SEQ ID NO: 2507276 - RNA, 16 nt, Chlamydia trachomatis
ucugaacgagaaaaag

SEQ ID NO: 2507277 - RNA, 12 nt, Chlamydia trachomatis
ucugaaguucuu

SEQ ID NO: 2507278 - RNA, 14 nt, Chlamydia trachomatis
ucugaaucuguguu

SEQ ID NO: 2507279 - RNA, 22 nt, Chlamydia trachomatis
ucugaaucuguguugcaaagag

SEQ ID NO: 2507280 - RNA, 22 nt, Chlamydia trachomatis
ucugacggaauuuuucucacuu

SEQ ID NO: 2507281 - RNA, 16 nt, Chlamydia trachomatis
ucugacuuuuuagcau

SEQ ID NO: 2507282 - RNA, 16 nt, Chlamydia trachomatis
ucugagaugaaaauau

SEQ ID NO: 2507283 - RNA, 14 nt, Chlamydia trachomatis
ucugagcuuugagg

SEQ ID NO: 2507284 - RNA, 19 nt, Chlamydia trachomatis
ucugaguauuaaggaaaug

SEQ ID NO: 2507285 - RNA, 21 nt, Chlamydia trachomatis
ucugauaaaugucccugaaca

SEQ ID NO: 2507286 - RNA, 21 nt, Chlamydia trachomatis
ucugauagagauaaagaaucc

SEQ ID NO: 2507287 - RNA, 18 nt, Chlamydia trachomatis
ucugauguuccaucuuuu

SEQ ID NO: 2507288 - RNA, 16 nt, Chlamydia trachomatis
ucugcaaaaucuucca

SEQ ID NO: 2507289 - RNA, 15 nt, Chlamydia trachomatis
ucugcaacaaauacc

SEQ ID NO: 2507290 - RNA, 22 nt, Chlamydia trachomatis
ucugcaagaaaauagguaaaga

SEQ ID NO: 2507291 - RNA, 13 nt, Chlamydia trachomatis
ucugcagaagaag

SEQ ID NO: 2507292 - RNA, 15 nt, Chlamydia trachomatis
ucugcagaagaagcc

SEQ ID NO: 2507293 - RNA, 17 nt, Chlamydia trachomatis
ucugcagaagaagcccc

SEQ ID NO: 2507294 - RNA, 14 nt, Chlamydia trachomatis
ucugcagagagcca

SEQ ID NO: 2507295 - RNA, 17 nt, Chlamydia trachomatis
ucugcagagcacaaauc

SEQ ID NO: 2507296 - RNA, 23 nt, Chlamydia trachomatis
ucugcagauuuuguagcacagcu

SEQ ID NO: 2507297 - RNA, 16 nt, Chlamydia trachomatis
ucugcagccuacauac

SEQ ID NO: 2507298 - RNA, 19 nt, Chlamydia trachomatis
ucugcaggucuaggggaag

SEQ ID NO: 2507299 - RNA, 21 nt, Chlamydia trachomatis
ucugcauaacagcaagacaac

SEQ ID NO: 2507300 - RNA, 12 nt, Chlamydia trachomatis
ucugcauauuua

SEQ ID NO: 2507301 - RNA, 13 nt, Chlamydia trachomatis
ucugcauauuuaa

SEQ ID NO: 2507302 - RNA, 15 nt, Chlamydia trachomatis
ucugcauauuuaauu

SEQ ID NO: 2507303 - RNA, 16 nt, Chlamydia trachomatis
ucugcauauuuaauug

SEQ ID NO: 2507304 - RNA, 16 nt, Chlamydia trachomatis
ucugccauuucuaaag

SEQ ID NO: 2507305 - RNA, 19 nt, Chlamydia trachomatis
ucugcccuuuguacaugau

SEQ ID NO: 2507306 - RNA, 13 nt, Chlamydia trachomatis
ucugccgagcauu

SEQ ID NO: 2507307 - RNA, 15 nt, Chlamydia trachomatis
ucugcgaaagaaacu

SEQ ID NO: 2507308 - RNA, 15 nt, Chlamydia trachomatis
ucugcuaaagaaaaa

SEQ ID NO: 2507309 - RNA, 18 nt, Chlamydia trachomatis
ucugcuaauaguucucug

SEQ ID NO: 2507310 - RNA, 19 nt, Chlamydia trachomatis
ucugcuacaaacugcucaa

SEQ ID NO: 2507311 - RNA, 21 nt, Chlamydia trachomatis
ucugcuagauacaauaguacc

SEQ ID NO: 2507312 - RNA, 15 nt, Chlamydia trachomatis
ucugcugcucgaaaa

SEQ ID NO: 2507313 - RNA, 18 nt, Chlamydia trachomatis
ucugcuuccguaacaaua

SEQ ID NO: 2507314 - RNA, 19 nt, Chlamydia trachomatis
ucugcuugcgaauaacuaa

SEQ ID NO: 2507315 - RNA, 17 nt, Chlamydia trachomatis
ucuggaacauacuucug

SEQ ID NO: 2507316 - RNA, 11 nt, Chlamydia trachomatis
ucuggaaucau

SEQ ID NO: 2507317 - RNA, 16 nt, Chlamydia trachomatis
ucuggagcaacaacca

SEQ ID NO: 2507318 - RNA, 12 nt, Chlamydia trachomatis
ucuggaggagga

SEQ ID NO: 2507319 - RNA, 17 nt, Chlamydia trachomatis
ucuggauugugaagaac

SEQ ID NO: 2507320 - RNA, 14 nt, Chlamydia trachomatis
ucuggcugaagaag

SEQ ID NO: 2507321 - RNA, 18 nt, Chlamydia trachomatis
ucugggaaaauuaaaagg

SEQ ID NO: 2507322 - RNA, 20 nt, Chlamydia trachomatis
ucugggaaaauuaaaaggcg

SEQ ID NO: 2507323 - RNA, 22 nt, Chlamydia trachomatis
ucugggaggagaacucuuuccu

SEQ ID NO: 2507324 - RNA, 21 nt, Chlamydia trachomatis
ucugguacucaucuuuuuuaa

SEQ ID NO: 2507325 - RNA, 11 nt, Chlamydia trachomatis
ucugguuuaau

SEQ ID NO: 2507326 - RNA, 17 nt, Chlamydia trachomatis
ucugguuucuuaaacaa

SEQ ID NO: 2507327 - RNA, 20 nt, Chlamydia trachomatis
ucuguaacuacaucuaaaag

SEQ ID NO: 2507328 - RNA, 21 nt, Chlamydia trachomatis
ucuguaacuacaucuaaaaga

SEQ ID NO: 2507329 - RNA, 22 nt, Chlamydia trachomatis
ucuguaacuacaucuaaaagag

SEQ ID NO: 2507330 - RNA, 14 nt, Chlamydia trachomatis
ucuguaaggcagga

SEQ ID NO: 2507331 - RNA, 20 nt, Chlamydia trachomatis
ucuguaauuuuaaauccugu

SEQ ID NO: 2507332 - RNA, 21 nt, Chlamydia trachomatis
ucuguacgucugcaagaaaau

SEQ ID NO: 2507333 - RNA, 18 nt, Chlamydia trachomatis
ucuguagauucagcaaga

SEQ ID NO: 2507334 - RNA, 23 nt, Chlamydia trachomatis
ucuguagauucagcaagauucuc

SEQ ID NO: 2507335 - RNA, 15 nt, Chlamydia trachomatis
ucuguauccuaacua

SEQ ID NO: 2507336 - RNA, 17 nt, Chlamydia trachomatis
ucugucagucuucuuuu

SEQ ID NO: 2507337 - RNA, 20 nt, Chlamydia trachomatis
ucuguccauucuaaggagca

SEQ ID NO: 2507338 - RNA, 17 nt, Chlamydia trachomatis
ucugucguuaaagaauu

SEQ ID NO: 2507339 - RNA, 18 nt, Chlamydia trachomatis
ucugucuggauaccagua

SEQ ID NO: 2507340 - RNA, 21 nt, Chlamydia trachomatis
ucugucuuagcaaagaaauag

SEQ ID NO: 2507341 - RNA, 20 nt, Chlamydia trachomatis
ucuguuaguagcuucucuuc

SEQ ID NO: 2507342 - RNA, 19 nt, Chlamydia trachomatis
ucuguuagugaagagcaga

SEQ ID NO: 2507343 - RNA, 20 nt, Chlamydia trachomatis
ucuuaaaaggguagaaaaag

SEQ ID NO: 2507344 - RNA, 22 nt, Chlamydia trachomatis
ucuuaaaaggguagaaaaagag

SEQ ID NO: 2507345 - RNA, 15 nt, Chlamydia trachomatis
ucuuaaacaaaaaua

SEQ ID NO: 2507346 - RNA, 22 nt, Chlamydia trachomatis
ucuuaaaggucgagcucccauu

SEQ ID NO: 2507347 - RNA, 14 nt, Chlamydia trachomatis
ucuuaauaaucugu

SEQ ID NO: 2507348 - RNA, 14 nt, Chlamydia trachomatis
ucuuaauccuugca

SEQ ID NO: 2507349 - RNA, 19 nt, Chlamydia trachomatis
ucuuacaagggcacucgcg

SEQ ID NO: 2507350 - RNA, 19 nt, Chlamydia trachomatis
ucuuacauaagauccaucu

SEQ ID NO: 2507351 - RNA, 20 nt, Chlamydia trachomatis
ucuuacgaccguauuuuuua

SEQ ID NO: 2507352 - RNA, 17 nt, Chlamydia trachomatis
ucuuacuccuucucuga

SEQ ID NO: 2507353 - RNA, 15 nt, Chlamydia trachomatis
ucuuagaaggaucua

SEQ ID NO: 2507354 - RNA, 18 nt, Chlamydia trachomatis
ucuuagauuuucaugcaa

SEQ ID NO: 2507355 - RNA, 13 nt, Chlamydia trachomatis
ucuuagcgcuugu

SEQ ID NO: 2507356 - RNA, 23 nt, Chlamydia trachomatis
ucuuagugaaugcuccauacgcu

SEQ ID NO: 2507357 - RNA, 18 nt, Chlamydia trachomatis
ucuuaguuugugaugagg

SEQ ID NO: 2507358 - RNA, 16 nt, Chlamydia trachomatis
ucuuaucagcauccca

SEQ ID NO: 2507359 - RNA, 18 nt, Chlamydia trachomatis
ucuuaucguagagaucuu

SEQ ID NO: 2507360 - RNA, 20 nt, Chlamydia trachomatis
ucuuaucguagagaucuucu

SEQ ID NO: 2507361 - RNA, 13 nt, Chlamydia trachomatis
ucuucaaagaaca

SEQ ID NO: 2507362 - RNA, 20 nt, Chlamydia trachomatis
ucuucaaagaacaagauccu

SEQ ID NO: 2507363 - RNA, 12 nt, Chlamydia trachomatis
ucuucaacaaga

SEQ ID NO: 2507364 - RNA, 18 nt, Chlamydia trachomatis
ucuucaacccuuuuaauc

SEQ ID NO: 2507365 - RNA, 11 nt, Chlamydia trachomatis
ucuucaagaag

SEQ ID NO: 2507366 - RNA, 16 nt, Chlamydia trachomatis
ucuucaauggcaaaac

SEQ ID NO: 2507367 - RNA, 18 nt, Chlamydia trachomatis
ucuucaauggcaaaacuu

SEQ ID NO: 2507368 - RNA, 20 nt, Chlamydia trachomatis
ucuucaauggcaaaacuucg

SEQ ID NO: 2507369 - RNA, 20 nt, Chlamydia trachomatis
ucuucacagagcuucucuaa

SEQ ID NO: 2507370 - RNA, 23 nt, Chlamydia trachomatis
ucuucacagagcuucucuaaaug

SEQ ID NO: 2507371 - RNA, 22 nt, Chlamydia trachomatis
ucuucaccaacuccaagcauua

SEQ ID NO: 2507372 - RNA, 16 nt, Chlamydia trachomatis
ucuucaccccuuacaa

SEQ ID NO: 2507373 - RNA, 21 nt, Chlamydia trachomatis
ucuucacggagagaaagaggg

SEQ ID NO: 2507374 - RNA, 15 nt, Chlamydia trachomatis
ucuucagaaaucuuc

SEQ ID NO: 2507375 - RNA, 16 nt, Chlamydia trachomatis
ucuucaggauuggaaa

SEQ ID NO: 2507376 - RNA, 21 nt, Chlamydia trachomatis
ucuucaggauuggaaaaucca

SEQ ID NO: 2507377 - RNA, 18 nt, Chlamydia trachomatis
ucuucagguugcuugaau

SEQ ID NO: 2507378 - RNA, 20 nt, Chlamydia trachomatis
ucuucagguugcuugaauaa

SEQ ID NO: 2507379 - RNA, 20 nt, Chlamydia trachomatis
ucuucagguuuauaagagaa

SEQ ID NO: 2507380 - RNA, 22 nt, Chlamydia trachomatis
ucuucaguuugaaucacagaaa

SEQ ID NO: 2507381 - RNA, 21 nt, Chlamydia trachomatis
ucuucauaaaacuauggagag

SEQ ID NO: 2507382 - RNA, 22 nt, Chlamydia trachomatis
ucuucauaaaacuauggagagg

SEQ ID NO: 2507383 - RNA, 19 nt, Chlamydia trachomatis
ucuucauaagaaaauucuu

SEQ ID NO: 2507384 - RNA, 16 nt, Chlamydia trachomatis
ucuucauagcuucuaa

SEQ ID NO: 2507385 - RNA, 18 nt, Chlamydia trachomatis
ucuucauagcuucuaauu

SEQ ID NO: 2507386 - RNA, 19 nt, Chlamydia trachomatis
ucuucaucuauaggauggu

SEQ ID NO: 2507387 - RNA, 15 nt, Chlamydia trachomatis
ucuuccacagaaguu

SEQ ID NO: 2507388 - RNA, 16 nt, Chlamydia trachomatis
ucuuccacagaaguug

SEQ ID NO: 2507389 - RNA, 19 nt, Chlamydia trachomatis
ucuuccagccuacaaauaa

SEQ ID NO: 2507390 - RNA, 21 nt, Chlamydia trachomatis
ucuuccaucacuccaagaaga

SEQ ID NO: 2507391 - RNA, 22 nt, Chlamydia trachomatis
ucuuccaucacuccaagaagag

SEQ ID NO: 2507392 - RNA, 21 nt, Chlamydia trachomatis
ucuucccaauauauuccuguc

SEQ ID NO: 2507393 - RNA, 22 nt, Chlamydia trachomatis
ucuucccaauauauuccugucu

SEQ ID NO: 2507394 - RNA, 18 nt, Chlamydia trachomatis
ucuuccccuucuuuauaa

SEQ ID NO: 2507395 - RNA, 17 nt, Chlamydia trachomatis
ucuucccuuuuuucugu

SEQ ID NO: 2507396 - RNA, 23 nt, Chlamydia trachomatis
ucuuccgaagauucgcugcuguc

SEQ ID NO: 2507397 - RNA, 13 nt, Chlamydia trachomatis
ucuuccgauuagu

SEQ ID NO: 2507398 - RNA, 20 nt, Chlamydia trachomatis
ucuuccguauggguuuuugu

SEQ ID NO: 2507399 - RNA, 19 nt, Chlamydia trachomatis
ucuuccucaguauaaaaaa

SEQ ID NO: 2507400 - RNA, 17 nt, Chlamydia trachomatis
ucuuccucuaauuuuac

SEQ ID NO: 2507401 - RNA, 13 nt, Chlamydia trachomatis
ucuuccuguaaga

SEQ ID NO: 2507402 - RNA, 15 nt, Chlamydia trachomatis
ucuuccuucccuucc

SEQ ID NO: 2507403 - RNA, 15 nt, Chlamydia trachomatis
ucuucgaauccuaaa

SEQ ID NO: 2507404 - RNA, 22 nt, Chlamydia trachomatis
ucuucgaauccuaaaaucacca

SEQ ID NO: 2507405 - RNA, 16 nt, Chlamydia trachomatis
ucuucgagucuucccu

SEQ ID NO: 2507406 - RNA, 15 nt, Chlamydia trachomatis
ucuucggacauugaa

SEQ ID NO: 2507407 - RNA, 20 nt, Chlamydia trachomatis
ucuucuaaagaaucuaccac

SEQ ID NO: 2507408 - RNA, 16 nt, Chlamydia trachomatis
ucuucuaaaugcugua

SEQ ID NO: 2507409 - RNA, 23 nt, Chlamydia trachomatis
ucuucuaaaugcuguaaaacauu

SEQ ID NO: 2507410 - RNA, 13 nt, Chlamydia trachomatis
ucuucuaagaagu

SEQ ID NO: 2507411 - RNA, 16 nt, Chlamydia trachomatis
ucuucuaaguauucuu

SEQ ID NO: 2507412 - RNA, 19 nt, Chlamydia trachomatis
ucuucuaaguauucuucug

SEQ ID NO: 2507413 - RNA, 23 nt, Chlamydia trachomatis
ucuucuaauugaaacaguagaaa

SEQ ID NO: 2507414 - RNA, 15 nt, Chlamydia trachomatis
ucuucuagagauauc

SEQ ID NO: 2507415 - RNA, 22 nt, Chlamydia trachomatis
ucuucuagauagagauuccacu

SEQ ID NO: 2507416 - RNA, 22 nt, Chlamydia trachomatis
ucuucuauaggcgauucguuga

SEQ ID NO: 2507417 - RNA, 13 nt, Chlamydia trachomatis
ucuucuauuuguu

SEQ ID NO: 2507418 - RNA, 13 nt, Chlamydia trachomatis
ucuucucucagau

SEQ ID NO: 2507419 - RNA, 20 nt, Chlamydia trachomatis
ucuucucuuuuagcgaucuc

SEQ ID NO: 2507420 - RNA, 15 nt, Chlamydia trachomatis
ucuucugaacaacau

SEQ ID NO: 2507421 - RNA, 16 nt, Chlamydia trachomatis
ucuucugaagagaaaa

SEQ ID NO: 2507422 - RNA, 18 nt, Chlamydia trachomatis
ucuucugaagagaaaaau

SEQ ID NO: 2507423 - RNA, 18 nt, Chlamydia trachomatis
ucuucugauaaauguccc

SEQ ID NO: 2507424 - RNA, 11 nt, Chlamydia trachomatis
ucuucuggaau

SEQ ID NO: 2507425 - RNA, 15 nt, Chlamydia trachomatis
ucuucuggagcaacu

SEQ ID NO: 2507426 - RNA, 18 nt, Chlamydia trachomatis
ucuucuguagccccaguc

SEQ ID NO: 2507427 - RNA, 13 nt, Chlamydia trachomatis
ucuucuucgaaau

SEQ ID NO: 2507428 - RNA, 19 nt, Chlamydia trachomatis
ucuucuugaauggcaagga

SEQ ID NO: 2507429 - RNA, 22 nt, Chlamydia trachomatis
ucuucuugaauggcaaggacaa

SEQ ID NO: 2507430 - RNA, 13 nt, Chlamydia trachomatis
ucuucuuucucuu

SEQ ID NO: 2507431 - RNA, 14 nt, Chlamydia trachomatis
ucuucuuuuucucu

SEQ ID NO: 2507432 - RNA, 23 nt, Chlamydia trachomatis
ucuugaaaaggagccuuguaucu

SEQ ID NO: 2507433 - RNA, 16 nt, Chlamydia trachomatis
ucuugaaucagaaguu

SEQ ID NO: 2507434 - RNA, 18 nt, Chlamydia trachomatis
ucuugaauggcaaggaca

SEQ ID NO: 2507435 - RNA, 17 nt, Chlamydia trachomatis
ucuugaggaagagagaa

SEQ ID NO: 2507436 - RNA, 17 nt, Chlamydia trachomatis
ucuugaucugaaaagag

SEQ ID NO: 2507437 - RNA, 21 nt, Chlamydia trachomatis
ucuugccuuuaccgcacuuug

SEQ ID NO: 2507438 - RNA, 14 nt, Chlamydia trachomatis
ucuugcugggagau

SEQ ID NO: 2507439 - RNA, 18 nt, Chlamydia trachomatis
ucuugcugguccauggaa

SEQ ID NO: 2507440 - RNA, 22 nt, Chlamydia trachomatis
ucuugcuucaugucuucuuucu

SEQ ID NO: 2507441 - RNA, 23 nt, Chlamydia trachomatis
ucuugcuucaugucuucuuucuc

SEQ ID NO: 2507442 - RNA, 21 nt, Chlamydia trachomatis
ucuugggauaugccucuaagc

SEQ ID NO: 2507443 - RNA, 23 nt, Chlamydia trachomatis
ucuuggggaucgaucccuuuuuc

SEQ ID NO: 2507444 - RNA, 14 nt, Chlamydia trachomatis
ucuuguagaaaaag

SEQ ID NO: 2507445 - RNA, 16 nt, Chlamydia trachomatis
ucuuguagaaaaagau

SEQ ID NO: 2507446 - RNA, 14 nt, Chlamydia trachomatis
ucuugucucucgaa

SEQ ID NO: 2507447 - RNA, 16 nt, Chlamydia trachomatis
ucuugucuuugcucuu

SEQ ID NO: 2507448 - RNA, 19 nt, Chlamydia trachomatis
ucuuguuaaugacaaacuu

SEQ ID NO: 2507449 - RNA, 13 nt, Chlamydia trachomatis
ucuuguugaauau

SEQ ID NO: 2507450 - RNA, 17 nt, Chlamydia trachomatis
ucuuguuuagaaaauac

SEQ ID NO: 2507451 - RNA, 15 nt, Chlamydia trachomatis
ucuuguuucaaagau

SEQ ID NO: 2507452 - RNA, 22 nt, Chlamydia trachomatis
ucuuuaaccagaauauaagcac

SEQ ID NO: 2507453 - RNA, 14 nt, Chlamydia trachomatis
ucuuuaagcaacaa

SEQ ID NO: 2507454 - RNA, 15 nt, Chlamydia trachomatis
ucuuuaauaacugca

SEQ ID NO: 2507455 - RNA, 16 nt, Chlamydia trachomatis
ucuuuaauaccuucuu

SEQ ID NO: 2507456 - RNA, 15 nt, Chlamydia trachomatis
ucuuuaauauuuccc

SEQ ID NO: 2507457 - RNA, 15 nt, Chlamydia trachomatis
ucuuuaccauuucca

SEQ ID NO: 2507458 - RNA, 21 nt, Chlamydia trachomatis
ucuuuaccgucuuuaacaaga

SEQ ID NO: 2507459 - RNA, 16 nt, Chlamydia trachomatis
ucuuuacgcacaaaga

SEQ ID NO: 2507460 - RNA, 22 nt, Chlamydia trachomatis
ucuuuacuaggagcaaaaagug

SEQ ID NO: 2507461 - RNA, 15 nt, Chlamydia trachomatis
ucuuuacucuuuucu

SEQ ID NO: 2507462 - RNA, 16 nt, Chlamydia trachomatis
ucuuuacucuuuucuu

SEQ ID NO: 2507463 - RNA, 17 nt, Chlamydia trachomatis
ucuuuacuuucuuugcu

SEQ ID NO: 2507464 - RNA, 14 nt, Chlamydia trachomatis
ucuuuagaaacuaa

SEQ ID NO: 2507465 - RNA, 15 nt, Chlamydia trachomatis
ucuuuagaagaaaag

SEQ ID NO: 2507466 - RNA, 19 nt, Chlamydia trachomatis
ucuuuagaagaaaagagcu

SEQ ID NO: 2507467 - RNA, 17 nt, Chlamydia trachomatis
ucuuuauguaaggaaau

SEQ ID NO: 2507468 - RNA, 14 nt, Chlamydia trachomatis
ucuuuauuuuuucc

SEQ ID NO: 2507469 - RNA, 12 nt, Chlamydia trachomatis
ucuuucaaagag

SEQ ID NO: 2507470 - RNA, 19 nt, Chlamydia trachomatis
ucuuucaauagcauuucug

SEQ ID NO: 2507471 - RNA, 16 nt, Chlamydia trachomatis
ucuuucacaacccaag

SEQ ID NO: 2507472 - RNA, 22 nt, Chlamydia trachomatis
ucuuucagagaaaauuucucuu

SEQ ID NO: 2507473 - RNA, 22 nt, Chlamydia trachomatis
ucuuuccuccucccuuuccaua

SEQ ID NO: 2507474 - RNA, 21 nt, Chlamydia trachomatis
ucuuucgauaucgcguccaaa

SEQ ID NO: 2507475 - RNA, 20 nt, Chlamydia trachomatis
ucuuucgugagccgcuuaag

SEQ ID NO: 2507476 - RNA, 22 nt, Chlamydia trachomatis
ucuuucucaugcguuaauuaau

SEQ ID NO: 2507477 - RNA, 11 nt, Chlamydia trachomatis
ucuuucucuag

SEQ ID NO: 2507478 - RNA, 21 nt, Chlamydia trachomatis
ucuuucuuaucugucagucuu

SEQ ID NO: 2507479 - RNA, 15 nt, Chlamydia trachomatis
ucuuucuucuaagaa

SEQ ID NO: 2507480 - RNA, 16 nt, Chlamydia trachomatis
ucuuucuucuaagaag

SEQ ID NO: 2507481 - RNA, 12 nt, Chlamydia trachomatis
ucuuucuuucua

SEQ ID NO: 2507482 - RNA, 17 nt, Chlamydia trachomatis
ucuuugagaaaguuaaa

SEQ ID NO: 2507483 - RNA, 18 nt, Chlamydia trachomatis
ucuuugauaugcagcauc

SEQ ID NO: 2507484 - RNA, 20 nt, Chlamydia trachomatis
ucuuugauaugcagcaucca

SEQ ID NO: 2507485 - RNA, 20 nt, Chlamydia trachomatis
ucuuugcuccacaagaagua

SEQ ID NO: 2507486 - RNA, 21 nt, Chlamydia trachomatis
ucuuugcuccacaagaaguaa

SEQ ID NO: 2507487 - RNA, 15 nt, Chlamydia trachomatis
ucuuuggaaaaaaaa

SEQ ID NO: 2507488 - RNA, 18 nt, Chlamydia trachomatis
ucuuugggauagauagcu

SEQ ID NO: 2507489 - RNA, 16 nt, Chlamydia trachomatis
ucuuugguaauagcaa

SEQ ID NO: 2507490 - RNA, 13 nt, Chlamydia trachomatis
ucuuugucacaaa

SEQ ID NO: 2507491 - RNA, 15 nt, Chlamydia trachomatis
ucuuuguucacagaa

SEQ ID NO: 2507492 - RNA, 17 nt, Chlamydia trachomatis
ucuuuuacuuugaaaug

SEQ ID NO: 2507493 - RNA, 19 nt, Chlamydia trachomatis
ucuuuuaggugcgcauaca

SEQ ID NO: 2507494 - RNA, 15 nt, Chlamydia trachomatis
ucuuuuaucuucuua

SEQ ID NO: 2507495 - RNA, 11 nt, Chlamydia trachomatis
ucuuuuccaua

SEQ ID NO: 2507496 - RNA, 23 nt, Chlamydia trachomatis
ucuuuucuuauaaaguccggacu

SEQ ID NO: 2507497 - RNA, 17 nt, Chlamydia trachomatis
ucuuuugcaaaaauuuu

SEQ ID NO: 2507498 - RNA, 23 nt, Chlamydia trachomatis
ucuuuugcaaaaauuuucacaca

SEQ ID NO: 2507499 - RNA, 13 nt, Chlamydia trachomatis
ucuuuuguuugca

SEQ ID NO: 2507500 - RNA, 14 nt, Chlamydia trachomatis
ucuuuuguuugcac

SEQ ID NO: 2507501 - RNA, 20 nt, Chlamydia trachomatis
ucuuuuuaaaucaauuucuc

SEQ ID NO: 2507502 - RNA, 19 nt, Chlamydia trachomatis
ucuuuuugcuaccaagcuu

SEQ ID NO: 2507503 - RNA, 17 nt, Chlamydia trachomatis
ucuuuuuguugcucuau

SEQ ID NO: 2507504 - RNA, 22 nt, Chlamydia trachomatis
ucuuuuuguugcucuauaacau

SEQ ID NO: 2507505 - RNA, 17 nt, Chlamydia trachomatis
ucuuuuuuaaaaagcug

SEQ ID NO: 2507506 - RNA, 14 nt, Chlamydia trachomatis
ucuuuuuuuuugcu

SEQ ID NO: 2507507 - RNA, 16 nt, Chlamydia trachomatis
ugaaaaagccugugcc

SEQ ID NO: 2507508 - RNA, 17 nt, Chlamydia trachomatis
ugaaaacuuuguauuaa

SEQ ID NO: 2507509 - RNA, 21 nt, Chlamydia trachomatis
ugaaaacuuuguauuaacgau

SEQ ID NO: 2507510 - RNA, 19 nt, Chlamydia trachomatis
ugaaaagaacccuaucccc

SEQ ID NO: 2507511 - RNA, 13 nt, Chlamydia trachomatis
ugaaaagagaaga

SEQ ID NO: 2507512 - RNA, 23 nt, Chlamydia trachomatis
ugaaaauaaguccauugauaggu

SEQ ID NO: 2507513 - RNA, 20 nt, Chlamydia trachomatis
ugaaaauaucuaagcgacua

SEQ ID NO: 2507514 - RNA, 17 nt, Chlamydia trachomatis
ugaaaaugcucuaaagg

SEQ ID NO: 2507515 - RNA, 19 nt, Chlamydia trachomatis
ugaaaaugcucuaaaggau

SEQ ID NO: 2507516 - RNA, 19 nt, Chlamydia trachomatis
ugaaacaccucuccuugaa

SEQ ID NO: 2507517 - RNA, 18 nt, Chlamydia trachomatis
ugaaacacgcucauagau

SEQ ID NO: 2507518 - RNA, 14 nt, Chlamydia trachomatis
ugaaacaucuuuua

SEQ ID NO: 2507519 - RNA, 18 nt, Chlamydia trachomatis
ugaaacaucuuuuaaagu

SEQ ID NO: 2507520 - RNA, 17 nt, Chlamydia trachomatis
ugaaaccgcaagucucu

SEQ ID NO: 2507521 - RNA, 12 nt, Chlamydia trachomatis
ugaaagaaaaau

SEQ ID NO: 2507522 - RNA, 14 nt, Chlamydia trachomatis
ugaaagagcuucuu

SEQ ID NO: 2507523 - RNA, 20 nt, Chlamydia trachomatis
ugaaagagcuucuuuuucaa

SEQ ID NO: 2507524 - RNA, 15 nt, Chlamydia trachomatis
ugaaagcauguaaau

SEQ ID NO: 2507525 - RNA, 18 nt, Chlamydia trachomatis
ugaaagcuauuuucuucc

SEQ ID NO: 2507526 - RNA, 21 nt, Chlamydia trachomatis
ugaaagcuauuuucuuccugc

SEQ ID NO: 2507527 - RNA, 23 nt, Chlamydia trachomatis
ugaaagcuauuuucuuccugcuu

SEQ ID NO: 2507528 - RNA, 12 nt, Chlamydia trachomatis
ugaaaguagcua

SEQ ID NO: 2507529 - RNA, 15 nt, Chlamydia trachomatis
ugaaaguagcuacuu

SEQ ID NO: 2507530 - RNA, 21 nt, Chlamydia trachomatis
ugaaaguagcuacuuucgcuu

SEQ ID NO: 2507531 - RNA, 14 nt, Chlamydia trachomatis
ugaaagucuuuaua

SEQ ID NO: 2507532 - RNA, 13 nt, Chlamydia trachomatis
ugaaauaagucuu

SEQ ID NO: 2507533 - RNA, 23 nt, Chlamydia trachomatis
ugaaauaugcauagucuucagga

SEQ ID NO: 2507534 - RNA, 19 nt, Chlamydia trachomatis
ugaaaucacucgcacacga

SEQ ID NO: 2507535 - RNA, 12 nt, Chlamydia trachomatis
ugaaaucagaaa

SEQ ID NO: 2507536 - RNA, 17 nt, Chlamydia trachomatis
ugaaauguccacaagga

SEQ ID NO: 2507537 - RNA, 12 nt, Chlamydia trachomatis
ugaacagcaaga

SEQ ID NO: 2507538 - RNA, 16 nt, Chlamydia trachomatis
ugaacagcaagaggcc

SEQ ID NO: 2507539 - RNA, 17 nt, Chlamydia trachomatis
ugaacauacaauuuaga

SEQ ID NO: 2507540 - RNA, 22 nt, Chlamydia trachomatis
ugaacauacguuuucucuggaa

SEQ ID NO: 2507541 - RNA, 16 nt, Chlamydia trachomatis
ugaacauccaccagca

SEQ ID NO: 2507542 - RNA, 22 nt, Chlamydia trachomatis
ugaacauuuucugguuucuuaa

SEQ ID NO: 2507543 - RNA, 16 nt, Chlamydia trachomatis
ugaaccgcagcaacau

SEQ ID NO: 2507544 - RNA, 13 nt, Chlamydia trachomatis
ugaacgagaaaaa

SEQ ID NO: 2507545 - RNA, 17 nt, Chlamydia trachomatis
ugaacuguucauucuca

SEQ ID NO: 2507546 - RNA, 18 nt, Chlamydia trachomatis
ugaacuguucauucucag

SEQ ID NO: 2507547 - RNA, 19 nt, Chlamydia trachomatis
ugaacuguucauucucagg

SEQ ID NO: 2507548 - RNA, 19 nt, Chlamydia trachomatis
ugaagaaacuucuggagau

SEQ ID NO: 2507549 - RNA, 21 nt, Chlamydia trachomatis
ugaagaacugucuucuuucaa

SEQ ID NO: 2507550 - RNA, 22 nt, Chlamydia trachomatis
ugaagaacugucuucuuucaaa

SEQ ID NO: 2507551 - RNA, 14 nt, Chlamydia trachomatis
ugaagaacuuuaga

SEQ ID NO: 2507552 - RNA, 21 nt, Chlamydia trachomatis
ugaagaaggaggggauuuuca

SEQ ID NO: 2507553 - RNA, 16 nt, Chlamydia trachomatis
ugaagaaguuuacgaa

SEQ ID NO: 2507554 - RNA, 16 nt, Chlamydia trachomatis
ugaagaaugaaacuug

SEQ ID NO: 2507555 - RNA, 23 nt, Chlamydia trachomatis
ugaagacccguuuucucuugaaa

SEQ ID NO: 2507556 - RNA, 14 nt, Chlamydia trachomatis
ugaagagaaaaauu

SEQ ID NO: 2507557 - RNA, 13 nt, Chlamydia trachomatis
ugaagagcagagg

SEQ ID NO: 2507558 - RNA, 23 nt, Chlamydia trachomatis
ugaagagcagagguaugcagacu

SEQ ID NO: 2507559 - RNA, 22 nt, Chlamydia trachomatis
ugaagauauucaugugaacaga

SEQ ID NO: 2507560 - RNA, 22 nt, Chlamydia trachomatis
ugaagauuaccguggagaauca

SEQ ID NO: 2507561 - RNA, 17 nt, Chlamydia trachomatis
ugaagauucuaaaaugc

SEQ ID NO: 2507562 - RNA, 12 nt, Chlamydia trachomatis
ugaagcaaauag

SEQ ID NO: 2507563 - RNA, 20 nt, Chlamydia trachomatis
ugaagcgcuuguagugaagu

SEQ ID NO: 2507564 - RNA, 17 nt, Chlamydia trachomatis
ugaagcuaaaaaaucca

SEQ ID NO: 2507565 - RNA, 21 nt, Chlamydia trachomatis
ugaaggccaaagaaauagcua

SEQ ID NO: 2507566 - RNA, 22 nt, Chlamydia trachomatis
ugaaguaugcucgagccuguuu

SEQ ID NO: 2507567 - RNA, 15 nt, Chlamydia trachomatis
ugaauaacguuuuaa

SEQ ID NO: 2507568 - RNA, 20 nt, Chlamydia trachomatis
ugaauacaaaccgaagaggg

SEQ ID NO: 2507569 - RNA, 22 nt, Chlamydia trachomatis
ugaauacgauccucuggauaua

SEQ ID NO: 2507570 - RNA, 17 nt, Chlamydia trachomatis
ugaauaggaagaauaau

SEQ ID NO: 2507571 - RNA, 18 nt, Chlamydia trachomatis
ugaauaggaagaauaaua

SEQ ID NO: 2507572 - RNA, 19 nt, Chlamydia trachomatis
ugaauaggaagaauaauac

SEQ ID NO: 2507573 - RNA, 17 nt, Chlamydia trachomatis
ugaauagguucuaucca

SEQ ID NO: 2507574 - RNA, 19 nt, Chlamydia trachomatis
ugaauagguucuauccaua

SEQ ID NO: 2507575 - RNA, 12 nt, Chlamydia trachomatis
ugaauauucccg

SEQ ID NO: 2507576 - RNA, 20 nt, Chlamydia trachomatis
ugaauauucccgaacuuuau

SEQ ID NO: 2507577 - RNA, 22 nt, Chlamydia trachomatis
ugaauauucccgaacuuuauua

SEQ ID NO: 2507578 - RNA, 16 nt, Chlamydia trachomatis
ugaaucacagaaacuu

SEQ ID NO: 2507579 - RNA, 19 nt, Chlamydia trachomatis
ugaauccagaauuaauuuc

SEQ ID NO: 2507580 - RNA, 13 nt, Chlamydia trachomatis
ugaauccauucua

SEQ ID NO: 2507581 - RNA, 19 nt, Chlamydia trachomatis
ugaauccuugaaccaaacg

SEQ ID NO: 2507582 - RNA, 12 nt, Chlamydia trachomatis
ugaaugaauuca

SEQ ID NO: 2507583 - RNA, 15 nt, Chlamydia trachomatis
ugaaugagcuuagau

SEQ ID NO: 2507584 - RNA, 13 nt, Chlamydia trachomatis
ugaauggcaagga

SEQ ID NO: 2507585 - RNA, 14 nt, Chlamydia trachomatis
ugaaugucuuuuuc

SEQ ID NO: 2507586 - RNA, 16 nt, Chlamydia trachomatis
ugaauguuaacaucuu

SEQ ID NO: 2507587 - RNA, 11 nt, Chlamydia trachomatis
ugaauuacuug

SEQ ID NO: 2507588 - RNA, 17 nt, Chlamydia trachomatis
ugaauuccaaguugcuu

SEQ ID NO: 2507589 - RNA, 14 nt, Chlamydia trachomatis
ugaauucuccagga

SEQ ID NO: 2507590 - RNA, 18 nt, Chlamydia trachomatis
ugaauuggcguuccauua

SEQ ID NO: 2507591 - RNA, 22 nt, Chlamydia trachomatis
ugaauuugaacagcgacauucu

SEQ ID NO: 2507592 - RNA, 18 nt, Chlamydia trachomatis
ugaauuuuaucuaaaaag

SEQ ID NO: 2507593 - RNA, 19 nt, Chlamydia trachomatis
ugaauuuuaucuaaaaagg

SEQ ID NO: 2507594 - RNA, 12 nt, Chlamydia trachomatis
ugacaaacuuuc

SEQ ID NO: 2507595 - RNA, 18 nt, Chlamydia trachomatis
ugacaauccgaagauuau

SEQ ID NO: 2507596 - RNA, 18 nt, Chlamydia trachomatis
ugacagcaccaagcucca

SEQ ID NO: 2507597 - RNA, 15 nt, Chlamydia trachomatis
ugacagcauagauau

SEQ ID NO: 2507598 - RNA, 23 nt, Chlamydia trachomatis
ugacagcauagauauugccuaca

SEQ ID NO: 2507599 - RNA, 20 nt, Chlamydia trachomatis
ugacagcuuucacagggaca

SEQ ID NO: 2507600 - RNA, 15 nt, Chlamydia trachomatis
ugacaggcagcagag

SEQ ID NO: 2507601 - RNA, 21 nt, Chlamydia trachomatis
ugacaucaccgagcauucuga

SEQ ID NO: 2507602 - RNA, 12 nt, Chlamydia trachomatis
ugaccaauaccu

SEQ ID NO: 2507603 - RNA, 19 nt, Chlamydia trachomatis
ugaccaucuucaccaacuc

SEQ ID NO: 2507604 - RNA, 18 nt, Chlamydia trachomatis
ugacccauaagauauugc

SEQ ID NO: 2507605 - RNA, 22 nt, Chlamydia trachomatis
ugaccgaagaacucaaaagcuu

SEQ ID NO: 2507606 - RNA, 20 nt, Chlamydia trachomatis
ugaccgaagguucuucuucg

SEQ ID NO: 2507607 - RNA, 14 nt, Chlamydia trachomatis
ugaccgaaucucaa

SEQ ID NO: 2507608 - RNA, 16 nt, Chlamydia trachomatis
ugaccguuaauauccc

SEQ ID NO: 2507609 - RNA, 21 nt, Chlamydia trachomatis
ugaccguuaauaucccacucu

SEQ ID NO: 2507610 - RNA, 13 nt, Chlamydia trachomatis
ugacgacaacaug

SEQ ID NO: 2507611 - RNA, 20 nt, Chlamydia trachomatis
ugacgagaagucgugucuuu

SEQ ID NO: 2507612 - RNA, 12 nt, Chlamydia trachomatis
ugacuaucugcu

SEQ ID NO: 2507613 - RNA, 13 nt, Chlamydia trachomatis
ugacuauuccuga

SEQ ID NO: 2507614 - RNA, 14 nt, Chlamydia trachomatis
ugacucccauaauc

SEQ ID NO: 2507615 - RNA, 15 nt, Chlamydia trachomatis
ugacucucauaagaa

SEQ ID NO: 2507616 - RNA, 18 nt, Chlamydia trachomatis
ugacugcggcagcugcuu

SEQ ID NO: 2507617 - RNA, 21 nt, Chlamydia trachomatis
ugacugcggcagcugcuugga

SEQ ID NO: 2507618 - RNA, 20 nt, Chlamydia trachomatis
ugacuggcgagaagcaugca

SEQ ID NO: 2507619 - RNA, 18 nt, Chlamydia trachomatis
ugacuguaaguuuauucc

SEQ ID NO: 2507620 - RNA, 23 nt, Chlamydia trachomatis
ugacuuaacgugucgaaaauggu

SEQ ID NO: 2507621 - RNA, 17 nt, Chlamydia trachomatis
ugacuugaguaaucagu

SEQ ID NO: 2507622 - RNA, 19 nt, Chlamydia trachomatis
ugagaaaaagaagaacgcc

SEQ ID NO: 2507623 - RNA, 15 nt, Chlamydia trachomatis
ugagaaaucuaaaac

SEQ ID NO: 2507624 - RNA, 19 nt, Chlamydia trachomatis
ugagaaaucuaaaacaauu

SEQ ID NO: 2507625 - RNA, 13 nt, Chlamydia trachomatis
ugagaacaaacca

SEQ ID NO: 2507626 - RNA, 19 nt, Chlamydia trachomatis
ugagaacaaaccaucugua

SEQ ID NO: 2507627 - RNA, 13 nt, Chlamydia trachomatis
ugagaagaaaggu

SEQ ID NO: 2507628 - RNA, 14 nt, Chlamydia trachomatis
ugagaagcaucuca

SEQ ID NO: 2507629 - RNA, 16 nt, Chlamydia trachomatis
ugagaagcaucucaau

SEQ ID NO: 2507630 - RNA, 12 nt, Chlamydia trachomatis
ugagaagcuuag

SEQ ID NO: 2507631 - RNA, 15 nt, Chlamydia trachomatis
ugagaauuuccagca

SEQ ID NO: 2507632 - RNA, 21 nt, Chlamydia trachomatis
ugagaccauuggaauuuucau

SEQ ID NO: 2507633 - RNA, 22 nt, Chlamydia trachomatis
ugagaccauuggaauuuucauc

SEQ ID NO: 2507634 - RNA, 18 nt, Chlamydia trachomatis
ugagaccgucaaaaagau

SEQ ID NO: 2507635 - RNA, 18 nt, Chlamydia trachomatis
ugagacuccagcuucucc

SEQ ID NO: 2507636 - RNA, 14 nt, Chlamydia trachomatis
ugagaugaaaauau

SEQ ID NO: 2507637 - RNA, 15 nt, Chlamydia trachomatis
ugagauguuuacgag

SEQ ID NO: 2507638 - RNA, 21 nt, Chlamydia trachomatis
ugagauguuuacgaggagguu

SEQ ID NO: 2507639 - RNA, 21 nt, Chlamydia trachomatis
ugagcaagccccgaaacccaa

SEQ ID NO: 2507640 - RNA, 21 nt, Chlamydia trachomatis
ugagcacaagcuguuccuaau

SEQ ID NO: 2507641 - RNA, 21 nt, Chlamydia trachomatis
ugagcagaauagauucccuuu

SEQ ID NO: 2507642 - RNA, 15 nt, Chlamydia trachomatis
ugagcagcaaagauc

SEQ ID NO: 2507643 - RNA, 17 nt, Chlamydia trachomatis
ugagcauuugccaauga

SEQ ID NO: 2507644 - RNA, 22 nt, Chlamydia trachomatis
ugagccgcuauucacuaccaga

SEQ ID NO: 2507645 - RNA, 21 nt, Chlamydia trachomatis
ugagccucuaacucuucugga

SEQ ID NO: 2507646 - RNA, 17 nt, Chlamydia trachomatis
ugagccuucaauucuug

SEQ ID NO: 2507647 - RNA, 21 nt, Chlamydia trachomatis
ugagccuucaauucuugcuuc

SEQ ID NO: 2507648 - RNA, 17 nt, Chlamydia trachomatis
ugagcgucuuuucacaa

SEQ ID NO: 2507649 - RNA, 17 nt, Chlamydia trachomatis
ugagcucuuuccucuag

SEQ ID NO: 2507650 - RNA, 19 nt, Chlamydia trachomatis
ugagcugucucugauguaa

SEQ ID NO: 2507651 - RNA, 22 nt, Chlamydia trachomatis
ugagcuucucgcuacaaauccu

SEQ ID NO: 2507652 - RNA, 17 nt, Chlamydia trachomatis
ugagcuuuauuuucaua

SEQ ID NO: 2507653 - RNA, 13 nt, Chlamydia trachomatis
ugagcuuugagga

SEQ ID NO: 2507654 - RNA, 16 nt, Chlamydia trachomatis
ugaggaagaaauguuu

SEQ ID NO: 2507655 - RNA, 20 nt, Chlamydia trachomatis
ugaggaagagagaacaaacg

SEQ ID NO: 2507656 - RNA, 14 nt, Chlamydia trachomatis
ugaggaagauaagu

SEQ ID NO: 2507657 - RNA, 21 nt, Chlamydia trachomatis
ugaggaagauaaguccuccua

SEQ ID NO: 2507658 - RNA, 16 nt, Chlamydia trachomatis
ugaggaaggcugagca

SEQ ID NO: 2507659 - RNA, 14 nt, Chlamydia trachomatis
ugaggauccuuagu

SEQ ID NO: 2507660 - RNA, 15 nt, Chlamydia trachomatis
ugaggcuccgccuuc

SEQ ID NO: 2507661 - RNA, 15 nt, Chlamydia trachomatis
ugaggcuuguugcca

SEQ ID NO: 2507662 - RNA, 23 nt, Chlamydia trachomatis
ugaggcuuuguccuggccaaaaa

SEQ ID NO: 2507663 - RNA, 24 nt, Chlamydia trachomatis
ugagggacgcgucucccuagugcu

SEQ ID NO: 2507664 - RNA, 19 nt, Chlamydia trachomatis
ugagggagcaguuuaggac

SEQ ID NO: 2507665 - RNA, 24 nt, Chlamydia trachomatis
ugagggagcaguuuaggacgcuuc

SEQ ID NO: 2507666 - RNA, 16 nt, Chlamydia trachomatis
ugagguccaaaauuuc

SEQ ID NO: 2507667 - RNA, 22 nt, Chlamydia trachomatis
ugagguccaaaauuucagggaa

SEQ ID NO: 2507668 - RNA, 19 nt, Chlamydia trachomatis
ugaguaaucacucucucga

SEQ ID NO: 2507669 - RNA, 15 nt, Chlamydia trachomatis
ugagugaaaaauaga

SEQ ID NO: 2507670 - RNA, 17 nt, Chlamydia trachomatis
ugagugaaaaauagaau

SEQ ID NO: 2507671 - RNA, 19 nt, Chlamydia trachomatis
ugagugaaaaauagaaucu

SEQ ID NO: 2507672 - RNA, 14 nt, Chlamydia trachomatis
ugaguggggcucga

SEQ ID NO: 2507673 - RNA, 12 nt, Chlamydia trachomatis
ugaguguaccau

SEQ ID NO: 2507674 - RNA, 14 nt, Chlamydia trachomatis
ugaguguagucuuu

SEQ ID NO: 2507675 - RNA, 15 nt, Chlamydia trachomatis
ugaguguagucuuug

SEQ ID NO: 2507676 - RNA, 16 nt, Chlamydia trachomatis
ugaguguagucuuugu

SEQ ID NO: 2507677 - RNA, 16 nt, Chlamydia trachomatis
ugaguuccgaacaaaa

SEQ ID NO: 2507678 - RNA, 16 nt, Chlamydia trachomatis
ugaguugcucaauugu

SEQ ID NO: 2507679 - RNA, 22 nt, Chlamydia trachomatis
ugaguuguuugggcugcugcuu

SEQ ID NO: 2507680 - RNA, 12 nt, Chlamydia trachomatis
ugauaaaacucc

SEQ ID NO: 2507681 - RNA, 14 nt, Chlamydia trachomatis
ugauaaaacucccc

SEQ ID NO: 2507682 - RNA, 14 nt, Chlamydia trachomatis
ugauaaauaaucuc

SEQ ID NO: 2507683 - RNA, 15 nt, Chlamydia trachomatis
ugauaaauucuaaac

SEQ ID NO: 2507684 - RNA, 13 nt, Chlamydia trachomatis
ugauacaauuccu

SEQ ID NO: 2507685 - RNA, 20 nt, Chlamydia trachomatis
ugauaggagaggauuaagga

SEQ ID NO: 2507686 - RNA, 18 nt, Chlamydia trachomatis
ugauagucagaauaauau

SEQ ID NO: 2507687 - RNA, 15 nt, Chlamydia trachomatis
ugauagugaaauaag

SEQ ID NO: 2507688 - RNA, 16 nt, Chlamydia trachomatis
ugauaucccuuuccaa

SEQ ID NO: 2507689 - RNA, 23 nt, Chlamydia trachomatis
ugauaucccuuuccaagaaucaa

SEQ ID NO: 2507690 - RNA, 11 nt, Chlamydia trachomatis
ugauaucucca

SEQ ID NO: 2507691 - RNA, 14 nt, Chlamydia trachomatis
ugauauuaguuagu

SEQ ID NO: 2507692 - RNA, 21 nt, Chlamydia trachomatis
ugauauuaguuagugaagucu

SEQ ID NO: 2507693 - RNA, 15 nt, Chlamydia trachomatis
ugaucaaauccugcu

SEQ ID NO: 2507694 - RNA, 18 nt, Chlamydia trachomatis
ugaucacuaauauagaau

SEQ ID NO: 2507695 - RNA, 17 nt, Chlamydia trachomatis
ugaucacugugagagca

SEQ ID NO: 2507696 - RNA, 19 nt, Chlamydia trachomatis
ugaucauugauaaauucua

SEQ ID NO: 2507697 - RNA, 22 nt, Chlamydia trachomatis
ugauccaguucuggagcaacaa

SEQ ID NO: 2507698 - RNA, 22 nt, Chlamydia trachomatis
ugaucccuaauaugaagaacuu

SEQ ID NO: 2507699 - RNA, 21 nt, Chlamydia trachomatis
ugaucgcaaaugcguuaaacu

SEQ ID NO: 2507700 - RNA, 17 nt, Chlamydia trachomatis
ugaucuaaaggaaaaau

SEQ ID NO: 2507701 - RNA, 14 nt, Chlamydia trachomatis
ugaucucugcagaa

SEQ ID NO: 2507702 - RNA, 23 nt, Chlamydia trachomatis
ugaucucugcagaagaagcccca

SEQ ID NO: 2507703 - RNA, 13 nt, Chlamydia trachomatis
ugaucucuuuuua

SEQ ID NO: 2507704 - RNA, 20 nt, Chlamydia trachomatis
ugaucucuuuuuacaacucu

SEQ ID NO: 2507705 - RNA, 22 nt, Chlamydia trachomatis
ugaucucuuuuuacaacucuga

SEQ ID NO: 2507706 - RNA, 14 nt, Chlamydia trachomatis
ugaucugaaaagag

SEQ ID NO: 2507707 - RNA, 15 nt, Chlamydia trachomatis
ugaucugaaaagaga

SEQ ID NO: 2507708 - RNA, 16 nt, Chlamydia trachomatis
ugaucugaaaagagaa

SEQ ID NO: 2507709 - RNA, 19 nt, Chlamydia trachomatis
ugaucugaaaagagaagaa

SEQ ID NO: 2507710 - RNA, 20 nt, Chlamydia trachomatis
ugaucuuauuaaccaacucu

SEQ ID NO: 2507711 - RNA, 22 nt, Chlamydia trachomatis
ugaucuuauuaaccaacucucu

SEQ ID NO: 2507712 - RNA, 17 nt, Chlamydia trachomatis
ugaucuuuaagcucuuc

SEQ ID NO: 2507713 - RNA, 15 nt, Chlamydia trachomatis
ugaucuuuguucucu

SEQ ID NO: 2507714 - RNA, 22 nt, Chlamydia trachomatis
ugaucuuuguucucuaaagauu

SEQ ID NO: 2507715 - RNA, 13 nt, Chlamydia trachomatis
ugaugaaaaagaa

SEQ ID NO: 2507716 - RNA, 14 nt, Chlamydia trachomatis
ugaugaaaaagaag

SEQ ID NO: 2507717 - RNA, 22 nt, Chlamydia trachomatis
ugaugauagucugcaauccaau

SEQ ID NO: 2507718 - RNA, 15 nt, Chlamydia trachomatis
ugaugcaccauaaua

SEQ ID NO: 2507719 - RNA, 18 nt, Chlamydia trachomatis
ugaugccguacaaggaaa

SEQ ID NO: 2507720 - RNA, 14 nt, Chlamydia trachomatis
ugauguuccaucuu

SEQ ID NO: 2507721 - RNA, 15 nt, Chlamydia trachomatis
ugauguuccaucuuu

SEQ ID NO: 2507722 - RNA, 18 nt, Chlamydia trachomatis
ugauuaaaguuucuaaua

SEQ ID NO: 2507723 - RNA, 16 nt, Chlamydia trachomatis
ugauuaaccaaaagag

SEQ ID NO: 2507724 - RNA, 17 nt, Chlamydia trachomatis
ugauuaaccaaaagagc

SEQ ID NO: 2507725 - RNA, 16 nt, Chlamydia trachomatis
ugauuagaaagggcuu

SEQ ID NO: 2507726 - RNA, 15 nt, Chlamydia trachomatis
ugauuagaaauugau

SEQ ID NO: 2507727 - RNA, 14 nt, Chlamydia trachomatis
ugauucccagggag

SEQ ID NO: 2507728 - RNA, 16 nt, Chlamydia trachomatis
ugauucuugaagauuu

SEQ ID NO: 2507729 - RNA, 19 nt, Chlamydia trachomatis
ugauugaaccguuuuucua

SEQ ID NO: 2507730 - RNA, 18 nt, Chlamydia trachomatis
ugauuguugguugcucca

SEQ ID NO: 2507731 - RNA, 14 nt, Chlamydia trachomatis
ugauuguuuugauu

SEQ ID NO: 2507732 - RNA, 14 nt, Chlamydia trachomatis
ugauuuagacacau

SEQ ID NO: 2507733 - RNA, 15 nt, Chlamydia trachomatis
ugauuuuaaaccaau

SEQ ID NO: 2507734 - RNA, 16 nt, Chlamydia trachomatis
ugauuuuaaaccaauc

SEQ ID NO: 2507735 - RNA, 13 nt, Chlamydia trachomatis
ugauuuuuucgcu

SEQ ID NO: 2507736 - RNA, 18 nt, Chlamydia trachomatis
ugauuuuuuuauuuugag

SEQ ID NO: 2507737 - RNA, 15 nt, Chlamydia trachomatis
ugcaaaaagagcaua

SEQ ID NO: 2507738 - RNA, 13 nt, Chlamydia trachomatis
ugcaaaaaucucu

SEQ ID NO: 2507739 - RNA, 13 nt, Chlamydia trachomatis
ugcaaaaauuuuc

SEQ ID NO: 2507740 - RNA, 12 nt, Chlamydia trachomatis
ugcaaacaaaag

SEQ ID NO: 2507741 - RNA, 16 nt, Chlamydia trachomatis
ugcaaacaaaagagau

SEQ ID NO: 2507742 - RNA, 17 nt, Chlamydia trachomatis
ugcaaacaaaagagaug

SEQ ID NO: 2507743 - RNA, 15 nt, Chlamydia trachomatis
ugcaaagaguaggga

SEQ ID NO: 2507744 - RNA, 18 nt, Chlamydia trachomatis
ugcaaagcuuuucuccuu

SEQ ID NO: 2507745 - RNA, 18 nt, Chlamydia trachomatis
ugcaaaggaguccgcgau

SEQ ID NO: 2507746 - RNA, 17 nt, Chlamydia trachomatis
ugcaaaggauaaauauu

SEQ ID NO: 2507747 - RNA, 18 nt, Chlamydia trachomatis
ugcaaaggauaaauauuu

SEQ ID NO: 2507748 - RNA, 15 nt, Chlamydia trachomatis
ugcaaauaagaaagu

SEQ ID NO: 2507749 - RNA, 16 nt, Chlamydia trachomatis
ugcaaauaagaaaguu

SEQ ID NO: 2507750 - RNA, 17 nt, Chlamydia trachomatis
ugcaaauaagaaaguuu

SEQ ID NO: 2507751 - RNA, 12 nt, Chlamydia trachomatis
ugcaaauaauaa

SEQ ID NO: 2507752 - RNA, 16 nt, Chlamydia trachomatis
ugcaaauuugcagaag

SEQ ID NO: 2507753 - RNA, 20 nt, Chlamydia trachomatis
ugcaacaaauaccaaaauau

SEQ ID NO: 2507754 - RNA, 18 nt, Chlamydia trachomatis
ugcaacaguaaauuucau

SEQ ID NO: 2507755 - RNA, 14 nt, Chlamydia trachomatis
ugcaaccuucucca

SEQ ID NO: 2507756 - RNA, 16 nt, Chlamydia trachomatis
ugcaaccuucuccaau

SEQ ID NO: 2507757 - RNA, 23 nt, Chlamydia trachomatis
ugcaaccuucuccaauaggggca

SEQ ID NO: 2507758 - RNA, 14 nt, Chlamydia trachomatis
ugcaacucuugcca

SEQ ID NO: 2507759 - RNA, 13 nt, Chlamydia trachomatis
ugcaagaaaauaa

SEQ ID NO: 2507760 - RNA, 14 nt, Chlamydia trachomatis
ugcaagaaaauaag

SEQ ID NO: 2507761 - RNA, 19 nt, Chlamydia trachomatis
ugcaagaaaauagguaaag

SEQ ID NO: 2507762 - RNA, 22 nt, Chlamydia trachomatis
ugcaagaaaauagguaaagaag

SEQ ID NO: 2507763 - RNA, 21 nt, Chlamydia trachomatis
ugcaagauauucccuaaaugc

SEQ ID NO: 2507764 - RNA, 23 nt, Chlamydia trachomatis
ugcaagauauucccuaaaugcuc

SEQ ID NO: 2507765 - RNA, 15 nt, Chlamydia trachomatis
ugcaagggaacaaac

SEQ ID NO: 2507766 - RNA, 11 nt, Chlamydia trachomatis
ugcaauaaacg

SEQ ID NO: 2507767 - RNA, 16 nt, Chlamydia trachomatis
ugcaauccuuuuuccu

SEQ ID NO: 2507768 - RNA, 17 nt, Chlamydia trachomatis
ugcaauccuuuuuccuu

SEQ ID NO: 2507769 - RNA, 19 nt, Chlamydia trachomatis
ugcaaucuagcgccuacac

SEQ ID NO: 2507770 - RNA, 16 nt, Chlamydia trachomatis
ugcacaaaaaaaaaga

SEQ ID NO: 2507771 - RNA, 17 nt, Chlamydia trachomatis
ugcacaaaaaaaaagag

SEQ ID NO: 2507772 - RNA, 15 nt, Chlamydia trachomatis
ugcacaaaggaacau

SEQ ID NO: 2507773 - RNA, 22 nt, Chlamydia trachomatis
ugcacaaaggaacaucgagaaa

SEQ ID NO: 2507774 - RNA, 18 nt, Chlamydia trachomatis
ugcacaaguuuauggaaa

SEQ ID NO: 2507775 - RNA, 13 nt, Chlamydia trachomatis
ugcacaaucucuu

SEQ ID NO: 2507776 - RNA, 15 nt, Chlamydia trachomatis
ugcaccggcaaagaa

SEQ ID NO: 2507777 - RNA, 18 nt, Chlamydia trachomatis
ugcaccgugcagaggggg

SEQ ID NO: 2507778 - RNA, 23 nt, Chlamydia trachomatis
ugcacuaaagagcuucggcuaua

SEQ ID NO: 2507779 - RNA, 16 nt, Chlamydia trachomatis
ugcacuuuccguagcc

SEQ ID NO: 2507780 - RNA, 12 nt, Chlamydia trachomatis
ugcagaaaaauu

SEQ ID NO: 2507781 - RNA, 12 nt, Chlamydia trachomatis
ugcagaaauccc

SEQ ID NO: 2507782 - RNA, 13 nt, Chlamydia trachomatis
ugcagaagaagcc

SEQ ID NO: 2507783 - RNA, 21 nt, Chlamydia trachomatis
ugcagaagaagccccaauagc

SEQ ID NO: 2507784 - RNA, 19 nt, Chlamydia trachomatis
ugcagaagaauaggaaucc

SEQ ID NO: 2507785 - RNA, 22 nt, Chlamydia trachomatis
ugcagaagauaagcaaggaaua

SEQ ID NO: 2507786 - RNA, 19 nt, Chlamydia trachomatis
ugcagaagcuccaaagaac

SEQ ID NO: 2507787 - RNA, 23 nt, Chlamydia trachomatis
ugcagacucaaagcuucccuucu

SEQ ID NO: 2507788 - RNA, 17 nt, Chlamydia trachomatis
ugcagagggccucccau

SEQ ID NO: 2507789 - RNA, 21 nt, Chlamydia trachomatis
ugcagaggggggcuugcacaa

SEQ ID NO: 2507790 - RNA, 20 nt, Chlamydia trachomatis
ugcagagggggguguuuuuu

SEQ ID NO: 2507791 - RNA, 20 nt, Chlamydia trachomatis
ugcagauuuuguagcacagc

SEQ ID NO: 2507792 - RNA, 12 nt, Chlamydia trachomatis
ugcagcaucuau

SEQ ID NO: 2507793 - RNA, 22 nt, Chlamydia trachomatis
ugcagcaucuauuuucucuuua

SEQ ID NO: 2507794 - RNA, 20 nt, Chlamydia trachomatis
ugcagccuacauacaugcuu

SEQ ID NO: 2507795 - RNA, 14 nt, Chlamydia trachomatis
ugcagccuuucccu

SEQ ID NO: 2507796 - RNA, 18 nt, Chlamydia trachomatis
ugcagcggcgaaaauuug

SEQ ID NO: 2507797 - RNA, 13 nt, Chlamydia trachomatis
ugcagcuaaagaa

SEQ ID NO: 2507798 - RNA, 15 nt, Chlamydia trachomatis
ugcagcuaaagaauc

SEQ ID NO: 2507799 - RNA, 19 nt, Chlamydia trachomatis
ugcagguuuagauguugug

SEQ ID NO: 2507800 - RNA, 15 nt, Chlamydia trachomatis
ugcaguaaagaaaag

SEQ ID NO: 2507801 - RNA, 18 nt, Chlamydia trachomatis
ugcaguggaagauagaag

SEQ ID NO: 2507802 - RNA, 22 nt, Chlamydia trachomatis
ugcauaauagcuugcacagcaa

SEQ ID NO: 2507803 - RNA, 19 nt, Chlamydia trachomatis
ugcauacuucccacauacu

SEQ ID NO: 2507804 - RNA, 23 nt, Chlamydia trachomatis
ugcauagagaacucgugaauguu

SEQ ID NO: 2507805 - RNA, 19 nt, Chlamydia trachomatis
ugcauagcuuguugcagcc

SEQ ID NO: 2507806 - RNA, 13 nt, Chlamydia trachomatis
ugcaucauuuugu

SEQ ID NO: 2507807 - RNA, 14 nt, Chlamydia trachomatis
ugcauggaaucaua

SEQ ID NO: 2507808 - RNA, 18 nt, Chlamydia trachomatis
ugcauggaaucauauccu

SEQ ID NO: 2507809 - RNA, 14 nt, Chlamydia trachomatis
ugcaugguaaaugu

SEQ ID NO: 2507810 - RNA, 19 nt, Chlamydia trachomatis
ugcauguuaguauccauau

SEQ ID NO: 2507811 - RNA, 16 nt, Chlamydia trachomatis
ugcauuuauccacagg

SEQ ID NO: 2507812 - RNA, 23 nt, Chlamydia trachomatis
ugccaagaccucuucaaagaucg

SEQ ID NO: 2507813 - RNA, 23 nt, Chlamydia trachomatis
ugccaauaguaacggaacucuac

SEQ ID NO: 2507814 - RNA, 22 nt, Chlamydia trachomatis
ugccaaucuguaauaaacccug

SEQ ID NO: 2507815 - RNA, 16 nt, Chlamydia trachomatis
ugccaaugaaauauca

SEQ ID NO: 2507816 - RNA, 22 nt, Chlamydia trachomatis
ugccaaugaaauaucauucccu

SEQ ID NO: 2507817 - RNA, 18 nt, Chlamydia trachomatis
ugccacacuuccccauuc

SEQ ID NO: 2507818 - RNA, 18 nt, Chlamydia trachomatis
ugccaucauuaucuucuu

SEQ ID NO: 2507819 - RNA, 20 nt, Chlamydia trachomatis
ugccaucauuaucuucuucu

SEQ ID NO: 2507820 - RNA, 22 nt, Chlamydia trachomatis
ugccaucauuaucuucuucuaa

SEQ ID NO: 2507821 - RNA, 23 nt, Chlamydia trachomatis
ugccaucauuaucuucuucuaau

SEQ ID NO: 2507822 - RNA, 13 nt, Chlamydia trachomatis
ugccauccagagc

SEQ ID NO: 2507823 - RNA, 18 nt, Chlamydia trachomatis
ugcccaugagaaaccaau

SEQ ID NO: 2507824 - RNA, 21 nt, Chlamydia trachomatis
ugcccgacaguauauccucuc

SEQ ID NO: 2507825 - RNA, 21 nt, Chlamydia trachomatis
ugcccuaaagagaucucucca

SEQ ID NO: 2507826 - RNA, 18 nt, Chlamydia trachomatis
ugccgaaacuucucggau

SEQ ID NO: 2507827 - RNA, 16 nt, Chlamydia trachomatis
ugccgaaucaaagacu

SEQ ID NO: 2507828 - RNA, 14 nt, Chlamydia trachomatis
ugccguuacuaaca

SEQ ID NO: 2507829 - RNA, 19 nt, Chlamydia trachomatis
ugccuauagagcaaucucu

SEQ ID NO: 2507830 - RNA, 21 nt, Chlamydia trachomatis
ugccuccagcgcacacuuuuc

SEQ ID NO: 2507831 - RNA, 15 nt, Chlamydia trachomatis
ugccucuauguucuu

SEQ ID NO: 2507832 - RNA, 14 nt, Chlamydia trachomatis
ugccuggagcacuc

SEQ ID NO: 2507833 - RNA, 14 nt, Chlamydia trachomatis
ugccuguugcaaca

SEQ ID NO: 2507834 - RNA, 16 nt, Chlamydia trachomatis
ugccuguugcaacaga

SEQ ID NO: 2507835 - RNA, 20 nt, Chlamydia trachomatis
ugccuguugcaacagacucu

SEQ ID NO: 2507836 - RNA, 12 nt, Chlamydia trachomatis
ugccuuacucuu

SEQ ID NO: 2507837 - RNA, 17 nt, Chlamydia trachomatis
ugccuuucguuagaaag

SEQ ID NO: 2507838 - RNA, 16 nt, Chlamydia trachomatis
ugcgaaaaagaaauaa

SEQ ID NO: 2507839 - RNA, 18 nt, Chlamydia trachomatis
ugcgaggaauucuucuuc

SEQ ID NO: 2507840 - RNA, 20 nt, Chlamydia trachomatis
ugcgaggcuuuuuuuuucau

SEQ ID NO: 2507841 - RNA, 23 nt, Chlamydia trachomatis
ugcgaggcuuuuuuuuucauaaa

SEQ ID NO: 2507842 - RNA, 14 nt, Chlamydia trachomatis
ugcgaucuccucau

SEQ ID NO: 2507843 - RNA, 15 nt, Chlamydia trachomatis
ugcgaugccucuaac

SEQ ID NO: 2507844 - RNA, 22 nt, Chlamydia trachomatis
ugcgauuugauaucccccuucu

SEQ ID NO: 2507845 - RNA, 14 nt, Chlamydia trachomatis
ugcgauuuuuuuua

SEQ ID NO: 2507846 - RNA, 21 nt, Chlamydia trachomatis
ugcgcaaucauaucaagaauu

SEQ ID NO: 2507847 - RNA, 18 nt, Chlamydia trachomatis
ugcgcuccacuucuuuuc

SEQ ID NO: 2507848 - RNA, 22 nt, Chlamydia trachomatis
ugcggagccgauucaaaagcua

SEQ ID NO: 2507849 - RNA, 20 nt, Chlamydia trachomatis
ugcggagcgaugagcuuauc

SEQ ID NO: 2507850 - RNA, 17 nt, Chlamydia trachomatis
ugcggauuaaagaagga

SEQ ID NO: 2507851 - RNA, 18 nt, Chlamydia trachomatis
ugcggcuccuucuugaug

SEQ ID NO: 2507852 - RNA, 18 nt, Chlamydia trachomatis
ugcguauagagcauauca

SEQ ID NO: 2507853 - RNA, 20 nt, Chlamydia trachomatis
ugcgugaacuguucauucuc

SEQ ID NO: 2507854 - RNA, 15 nt, Chlamydia trachomatis
ugcgugucacagacu

SEQ ID NO: 2507855 - RNA, 21 nt, Chlamydia trachomatis
ugcguucugcaaucucuucac

SEQ ID NO: 2507856 - RNA, 22 nt, Chlamydia trachomatis
ugcguuucagaaaagccuucuu

SEQ ID NO: 2507857 - RNA, 19 nt, Chlamydia trachomatis
ugcuaaccguucuugacaa

SEQ ID NO: 2507858 - RNA, 16 nt, Chlamydia trachomatis
ugcuaacgcuucuucu

SEQ ID NO: 2507859 - RNA, 18 nt, Chlamydia trachomatis
ugcuaagaacauaacaag

SEQ ID NO: 2507860 - RNA, 16 nt, Chlamydia trachomatis
ugcuaaggagaauucu

SEQ ID NO: 2507861 - RNA, 22 nt, Chlamydia trachomatis
ugcuacaagggugcuaacuuuc

SEQ ID NO: 2507862 - RNA, 16 nt, Chlamydia trachomatis
ugcuacaguaucugcu

SEQ ID NO: 2507863 - RNA, 15 nt, Chlamydia trachomatis
ugcuacggaaaccaa

SEQ ID NO: 2507864 - RNA, 16 nt, Chlamydia trachomatis
ugcuaggguucuaaag

SEQ ID NO: 2507865 - RNA, 18 nt, Chlamydia trachomatis
ugcuaggucucccuagca

SEQ ID NO: 2507866 - RNA, 17 nt, Chlamydia trachomatis
ugcuaguauuaaacuuc

SEQ ID NO: 2507867 - RNA, 18 nt, Chlamydia trachomatis
ugcuaguauuaaacuuca

SEQ ID NO: 2507868 - RNA, 20 nt, Chlamydia trachomatis
ugcuauauggccuuacucau

SEQ ID NO: 2507869 - RNA, 19 nt, Chlamydia trachomatis
ugcuauccugcucaacaua

SEQ ID NO: 2507870 - RNA, 20 nt, Chlamydia trachomatis
ugcucaaggaaacucuuaaa

SEQ ID NO: 2507871 - RNA, 19 nt, Chlamydia trachomatis
ugcuccaaaguaaaaugcc

SEQ ID NO: 2507872 - RNA, 15 nt, Chlamydia trachomatis
ugcuccaacaauagc

SEQ ID NO: 2507873 - RNA, 14 nt, Chlamydia trachomatis
ugcuccacaagaag

SEQ ID NO: 2507874 - RNA, 22 nt, Chlamydia trachomatis
ugcucccaauauacaaguauuu

SEQ ID NO: 2507875 - RNA, 19 nt, Chlamydia trachomatis
ugcuccuacaaaauaguuc

SEQ ID NO: 2507876 - RNA, 15 nt, Chlamydia trachomatis
ugcucgagaaaugaa

SEQ ID NO: 2507877 - RNA, 13 nt, Chlamydia trachomatis
ugcucuaaaggau

SEQ ID NO: 2507878 - RNA, 19 nt, Chlamydia trachomatis
ugcucuaccaacugagcua

SEQ ID NO: 2507879 - RNA, 16 nt, Chlamydia trachomatis
ugcucuauaacauucu

SEQ ID NO: 2507880 - RNA, 17 nt, Chlamydia trachomatis
ugcucuugaagauauuc

SEQ ID NO: 2507881 - RNA, 18 nt, Chlamydia trachomatis
ugcucuugagcuaagaag

SEQ ID NO: 2507882 - RNA, 15 nt, Chlamydia trachomatis
ugcucuuucccgaua

SEQ ID NO: 2507883 - RNA, 21 nt, Chlamydia trachomatis
ugcugacaauccgaagauuau

SEQ ID NO: 2507884 - RNA, 18 nt, Chlamydia trachomatis
ugcugagcuuuuuuucac

SEQ ID NO: 2507885 - RNA, 13 nt, Chlamydia trachomatis
ugcugauaaaaau

SEQ ID NO: 2507886 - RNA, 18 nt, Chlamydia trachomatis
ugcugauaaccagaaucc

SEQ ID NO: 2507887 - RNA, 13 nt, Chlamydia trachomatis
ugcugaucagagg

SEQ ID NO: 2507888 - RNA, 18 nt, Chlamydia trachomatis
ugcugcguuacccuucca

SEQ ID NO: 2507889 - RNA, 22 nt, Chlamydia trachomatis
ugcugcguuacccuuccaauaa

SEQ ID NO: 2507890 - RNA, 14 nt, Chlamydia trachomatis
ugcuguuucaggca

SEQ ID NO: 2507891 - RNA, 15 nt, Chlamydia trachomatis
ugcuuagaaacuguc

SEQ ID NO: 2507892 - RNA, 13 nt, Chlamydia trachomatis
ugcuuauuuacaa

SEQ ID NO: 2507893 - RNA, 16 nt, Chlamydia trachomatis
ugcuucaaaaaagauu

SEQ ID NO: 2507894 - RNA, 21 nt, Chlamydia trachomatis
ugcuucaaaaaagauuucccc

SEQ ID NO: 2507895 - RNA, 21 nt, Chlamydia trachomatis
ugcuucacuaggcucaugagc

SEQ ID NO: 2507896 - RNA, 21 nt, Chlamydia trachomatis
ugcuucagaugggguuuacaa

SEQ ID NO: 2507897 - RNA, 15 nt, Chlamydia trachomatis
ugcuucauaaaaaag

SEQ ID NO: 2507898 - RNA, 17 nt, Chlamydia trachomatis
ugcuucaugucuucuuu

SEQ ID NO: 2507899 - RNA, 23 nt, Chlamydia trachomatis
ugcuucccuccuagaaagaacca

SEQ ID NO: 2507900 - RNA, 22 nt, Chlamydia trachomatis
ugcuucuggacuauuuucaaaa

SEQ ID NO: 2507901 - RNA, 12 nt, Chlamydia trachomatis
ugcuugaacaac

SEQ ID NO: 2507902 - RNA, 17 nt, Chlamydia trachomatis
ugcuugaacaacuccuc

SEQ ID NO: 2507903 - RNA, 17 nt, Chlamydia trachomatis
ugcuugaugacgcagca

SEQ ID NO: 2507904 - RNA, 16 nt, Chlamydia trachomatis
ugcuuggcaaucugca

SEQ ID NO: 2507905 - RNA, 22 nt, Chlamydia trachomatis
ugcuuggcaaucugcaugguaa

SEQ ID NO: 2507906 - RNA, 20 nt, Chlamydia trachomatis
ugcuuguccauauauuggag

SEQ ID NO: 2507907 - RNA, 23 nt, Chlamydia trachomatis
ugcuuuaacugggauaagaaauc

SEQ ID NO: 2507908 - RNA, 18 nt, Chlamydia trachomatis
ugcuuuccuuaguuuuaa

SEQ ID NO: 2507909 - RNA, 20 nt, Chlamydia trachomatis
ugcuuuccuuaguuuuaauu

SEQ ID NO: 2507910 - RNA, 16 nt, Chlamydia trachomatis
ugcuuucuuuguuccu

SEQ ID NO: 2507911 - RNA, 14 nt, Chlamydia trachomatis
uggaaaaaaaacca

SEQ ID NO: 2507912 - RNA, 16 nt, Chlamydia trachomatis
uggaaaaaaaaccaaa

SEQ ID NO: 2507913 - RNA, 13 nt, Chlamydia trachomatis
uggaaaagaucuu

SEQ ID NO: 2507914 - RNA, 21 nt, Chlamydia trachomatis
uggaaaguacucgauggcagg

SEQ ID NO: 2507915 - RNA, 14 nt, Chlamydia trachomatis
uggaaauaaaaagc

SEQ ID NO: 2507916 - RNA, 14 nt, Chlamydia trachomatis
uggaagaacagcag

SEQ ID NO: 2507917 - RNA, 17 nt, Chlamydia trachomatis
uggaagauaacaauccu

SEQ ID NO: 2507918 - RNA, 19 nt, Chlamydia trachomatis
uggaagaucucuuucucua

SEQ ID NO: 2507919 - RNA, 14 nt, Chlamydia trachomatis
uggaagaucuucag

SEQ ID NO: 2507920 - RNA, 22 nt, Chlamydia trachomatis
uggaagaucuucagaaaucuuc

SEQ ID NO: 2507921 - RNA, 15 nt, Chlamydia trachomatis
uggaaguagcauaag

SEQ ID NO: 2507922 - RNA, 17 nt, Chlamydia trachomatis
uggaaguagcauaagcu

SEQ ID NO: 2507923 - RNA, 19 nt, Chlamydia trachomatis
uggaauagcuucugacucu

SEQ ID NO: 2507924 - RNA, 17 nt, Chlamydia trachomatis
uggaaugcgcaauccuu

SEQ ID NO: 2507925 - RNA, 21 nt, Chlamydia trachomatis
uggaccagcgcuuucuaaagc

SEQ ID NO: 2507926 - RNA, 23 nt, Chlamydia trachomatis
uggagaacgcauaagcacuauau

SEQ ID NO: 2507927 - RNA, 11 nt, Chlamydia trachomatis
uggagaaucca

SEQ ID NO: 2507928 - RNA, 18 nt, Chlamydia trachomatis
uggagaauuggaaacucu

SEQ ID NO: 2507929 - RNA, 17 nt, Chlamydia trachomatis
uggagaggguucucuuu

SEQ ID NO: 2507930 - RNA, 20 nt, Chlamydia trachomatis
uggagaggguucucuuuuua

SEQ ID NO: 2507931 - RNA, 18 nt, Chlamydia trachomatis
uggagauggaguagggga

SEQ ID NO: 2507932 - RNA, 14 nt, Chlamydia trachomatis
uggagcaacaacca

SEQ ID NO: 2507933 - RNA, 16 nt, Chlamydia trachomatis
uggagcaacaaccaac

SEQ ID NO: 2507934 - RNA, 18 nt, Chlamydia trachomatis
uggagcacucucaacgaa

SEQ ID NO: 2507935 - RNA, 20 nt, Chlamydia trachomatis
uggagcauguagccaaggaa

SEQ ID NO: 2507936 - RNA, 21 nt, Chlamydia trachomatis
uggaggaguauccagaaguuu

SEQ ID NO: 2507937 - RNA, 15 nt, Chlamydia trachomatis
uggauacuuuuccga

SEQ ID NO: 2507938 - RNA, 22 nt, Chlamydia trachomatis
uggauacuuuuccgaauucuuu

SEQ ID NO: 2507939 - RNA, 19 nt, Chlamydia trachomatis
uggauaguuucuuucuuag

SEQ ID NO: 2507940 - RNA, 20 nt, Chlamydia trachomatis
uggaucaccgaacaaccuuc

SEQ ID NO: 2507941 - RNA, 22 nt, Chlamydia trachomatis
uggaucaccgaacaaccuucug

SEQ ID NO: 2507942 - RNA, 23 nt, Chlamydia trachomatis
uggaucaccgaacaaccuucuga

SEQ ID NO: 2507943 - RNA, 20 nt, Chlamydia trachomatis
uggaucgcaugaaugagcuu

SEQ ID NO: 2507944 - RNA, 14 nt, Chlamydia trachomatis
uggaucucuuagac

SEQ ID NO: 2507945 - RNA, 22 nt, Chlamydia trachomatis
uggauuagaaaaagggagagga

SEQ ID NO: 2507946 - RNA, 20 nt, Chlamydia trachomatis
uggauuugugugcaaaucac

SEQ ID NO: 2507947 - RNA, 14 nt, Chlamydia trachomatis
uggcaauaaucuuu

SEQ ID NO: 2507948 - RNA, 15 nt, Chlamydia trachomatis
uggcaauggcaaaau

SEQ ID NO: 2507949 - RNA, 16 nt, Chlamydia trachomatis
uggcaauggcaaaauc

SEQ ID NO: 2507950 - RNA, 17 nt, Chlamydia trachomatis
uggcaauggcaaaaucu

SEQ ID NO: 2507951 - RNA, 16 nt, Chlamydia trachomatis
uggcacacuccaucuc

SEQ ID NO: 2507952 - RNA, 13 nt, Chlamydia trachomatis
uggcagaacucgc

SEQ ID NO: 2507953 - RNA, 14 nt, Chlamydia trachomatis
uggcagaugcaucu

SEQ ID NO: 2507954 - RNA, 17 nt, Chlamydia trachomatis
uggcagaugcaucuauu

SEQ ID NO: 2507955 - RNA, 16 nt, Chlamydia trachomatis
uggcagggauaguaaa

SEQ ID NO: 2507956 - RNA, 22 nt, Chlamydia trachomatis
uggcagggauaguaaaaacuau

SEQ ID NO: 2507957 - RNA, 21 nt, Chlamydia trachomatis
uggcaguuaagccuucuccag

SEQ ID NO: 2507958 - RNA, 21 nt, Chlamydia trachomatis
uggcauagggaucucagcugg

SEQ ID NO: 2507959 - RNA, 13 nt, Chlamydia trachomatis
uggcauagucuug

SEQ ID NO: 2507960 - RNA, 14 nt, Chlamydia trachomatis
uggcggagaagcug

SEQ ID NO: 2507961 - RNA, 22 nt, Chlamydia trachomatis
uggcucgcaguacuuuaccugu

SEQ ID NO: 2507962 - RNA, 20 nt, Chlamydia trachomatis
uggcucuuuaauauuuccca

SEQ ID NO: 2507963 - RNA, 17 nt, Chlamydia trachomatis
uggcugcagaagacuuu

SEQ ID NO: 2507964 - RNA, 16 nt, Chlamydia trachomatis
uggcuguaauguuaau

SEQ ID NO: 2507965 - RNA, 19 nt, Chlamydia trachomatis
uggcuguagcacaaguugg

SEQ ID NO: 2507966 - RNA, 23 nt, Chlamydia trachomatis
uggcuucgggacgcccuacagga

SEQ ID NO: 2507967 - RNA, 18 nt, Chlamydia trachomatis
uggcuuuuacaauagcau

SEQ ID NO: 2507968 - RNA, 13 nt, Chlamydia trachomatis
uggcuuuuggaug

SEQ ID NO: 2507969 - RNA, 15 nt, Chlamydia trachomatis
ugggaaaaaauuaac

SEQ ID NO: 2507970 - RNA, 13 nt, Chlamydia trachomatis
ugggauagauagc

SEQ ID NO: 2507971 - RNA, 18 nt, Chlamydia trachomatis
ugggauagauagcuccaa

SEQ ID NO: 2507972 - RNA, 18 nt, Chlamydia trachomatis
ugggauggaaauaauuuc

SEQ ID NO: 2507973 - RNA, 17 nt, Chlamydia trachomatis
ugggcaaucaagcuaau

SEQ ID NO: 2507974 - RNA, 12 nt, Chlamydia trachomatis
ugggcagcaaga

SEQ ID NO: 2507975 - RNA, 18 nt, Chlamydia trachomatis
ugggccguuuuucuccau

SEQ ID NO: 2507976 - RNA, 16 nt, Chlamydia trachomatis
ugggccugauuucucu

SEQ ID NO: 2507977 - RNA, 17 nt, Chlamydia trachomatis
ugggcucguggagggga

SEQ ID NO: 2507978 - RNA, 19 nt, Chlamydia trachomatis
ugggcucguggaggggaau

SEQ ID NO: 2507979 - RNA, 18 nt, Chlamydia trachomatis
ugggcugcaucagcaaga

SEQ ID NO: 2507980 - RNA, 17 nt, Chlamydia trachomatis
ugggcugcugcuuggaa

SEQ ID NO: 2507981 - RNA, 12 nt, Chlamydia trachomatis
uggggaggaaua

SEQ ID NO: 2507982 - RNA, 16 nt, Chlamydia trachomatis
uggggaggaauacuag

SEQ ID NO: 2507983 - RNA, 22 nt, Chlamydia trachomatis
uggggaucgaucccuuuuucag

SEQ ID NO: 2507984 - RNA, 18 nt, Chlamydia trachomatis
uggguaagagcagagcuu

SEQ ID NO: 2507985 - RNA, 20 nt, Chlamydia trachomatis
uggguagcgauacaagacuc

SEQ ID NO: 2507986 - RNA, 12 nt, Chlamydia trachomatis
uggguaggauua

SEQ ID NO: 2507987 - RNA, 15 nt, Chlamydia trachomatis
ugguaacaccaaaaa

SEQ ID NO: 2507988 - RNA, 20 nt, Chlamydia trachomatis
ugguaacaccaaaaaaucca

SEQ ID NO: 2507989 - RNA, 23 nt, Chlamydia trachomatis
ugguaagggguuuucuuggcagg

SEQ ID NO: 2507990 - RNA, 16 nt, Chlamydia trachomatis
ugguaauagcaaagaa

SEQ ID NO: 2507991 - RNA, 16 nt, Chlamydia trachomatis
ugguagaggagaacaa

SEQ ID NO: 2507992 - RNA, 16 nt, Chlamydia trachomatis
ugguauagaagaccuu

SEQ ID NO: 2507993 - RNA, 18 nt, Chlamydia trachomatis
ugguauuccguacucuga

SEQ ID NO: 2507994 - RNA, 13 nt, Chlamydia trachomatis
ugguauucuaaau

SEQ ID NO: 2507995 - RNA, 16 nt, Chlamydia trachomatis
ccagugcucaaagauu

SEQ ID NO: 2507996 - RNA, 14 nt, Chlamydia trachomatis
ccaguucuggagca

SEQ ID NO: 2507997 - RNA, 19 nt, Chlamydia trachomatis
ccaguucuucacuuuucua

SEQ ID NO: 2507998 - RNA, 23 nt, Chlamydia trachomatis
ccauaaaaacugcugcuaucauc

SEQ ID NO: 2507999 - RNA, 16 nt, Chlamydia trachomatis
ccauaaaauccaaugu

SEQ ID NO: 2508000 - RNA, 16 nt, Chlamydia trachomatis
ccauaacgaagauuaa

SEQ ID NO: 2508001 - RNA, 17 nt, Chlamydia trachomatis
ccauaauacgaauaaga

SEQ ID NO: 2508002 - RNA, 13 nt, Chlamydia trachomatis
ccauaauccuaug

SEQ ID NO: 2508003 - RNA, 22 nt, Chlamydia trachomatis
ccauaauuuucuucacuuccuc

SEQ ID NO: 2508004 - RNA, 12 nt, Chlamydia trachomatis
ccauacaucauc

SEQ ID NO: 2508005 - RNA, 16 nt, Chlamydia trachomatis
ccauacaucaucucuc

SEQ ID NO: 2508006 - RNA, 15 nt, Chlamydia trachomatis
ccauacuuacuucua

SEQ ID NO: 2508007 - RNA, 14 nt, Chlamydia trachomatis
ccauaucaaagcua

SEQ ID NO: 2508008 - RNA, 14 nt, Chlamydia trachomatis
ccauaucaggaccu

SEQ ID NO: 2508009 - RNA, 17 nt, Chlamydia trachomatis
ccauauccaugaagacc

SEQ ID NO: 2508010 - RNA, 20 nt, Chlamydia trachomatis
ccauaucuacaggccucccu

SEQ ID NO: 2508011 - RNA, 15 nt, Chlamydia trachomatis
ccaucaacuguucug

SEQ ID NO: 2508012 - RNA, 15 nt, Chlamydia trachomatis
ccaucaauaagagca

SEQ ID NO: 2508013 - RNA, 19 nt, Chlamydia trachomatis
ccaucacuccaagaagagu

SEQ ID NO: 2508014 - RNA, 20 nt, Chlamydia trachomatis
ccaucaggaauagcuacagc

SEQ ID NO: 2508015 - RNA, 18 nt, Chlamydia trachomatis
ccaucauaaaaagauagu

SEQ ID NO: 2508016 - RNA, 15 nt, Chlamydia trachomatis
ccaucauagaagcaa

SEQ ID NO: 2508017 - RNA, 15 nt, Chlamydia trachomatis
ccaucauuaucuucu

SEQ ID NO: 2508018 - RNA, 15 nt, Chlamydia trachomatis
ccaucccuugcaaaa

SEQ ID NO: 2508019 - RNA, 15 nt, Chlamydia trachomatis
ccauccuuuaucuug

SEQ ID NO: 2508020 - RNA, 18 nt, Chlamydia trachomatis
ccaucuacaaaaccaaaa

SEQ ID NO: 2508021 - RNA, 14 nt, Chlamydia trachomatis
ccaucuccaaucac

SEQ ID NO: 2508022 - RNA, 19 nt, Chlamydia trachomatis
ccaucuccaaucacagcaa

SEQ ID NO: 2508023 - RNA, 23 nt, Chlamydia trachomatis
ccaucucggaucgagaagagcca

SEQ ID NO: 2508024 - RNA, 19 nt, Chlamydia trachomatis
ccaucugcccuuugugcau

SEQ ID NO: 2508025 - RNA, 23 nt, Chlamydia trachomatis
ccaucuucaccaacuccaagcau

SEQ ID NO: 2508026 - RNA, 17 nt, Chlamydia trachomatis
ccaugaacagcauuuac

SEQ ID NO: 2508027 - RNA, 19 nt, Chlamydia trachomatis
ccaugagcaaccuuuccug

SEQ ID NO: 2508028 - RNA, 14 nt, Chlamydia trachomatis
ccaugcuccuuuca

SEQ ID NO: 2508029 - RNA, 19 nt, Chlamydia trachomatis
ccauggaauagcuucugac

SEQ ID NO: 2508030 - RNA, 13 nt, Chlamydia trachomatis
ccauucccagauu

SEQ ID NO: 2508031 - RNA, 13 nt, Chlamydia trachomatis
ccauuccuccuau

SEQ ID NO: 2508032 - RNA, 17 nt, Chlamydia trachomatis
ccauucgcauuaaauaa

SEQ ID NO: 2508033 - RNA, 23 nt, Chlamydia trachomatis
ccauucuacguaguaauuuugac

SEQ ID NO: 2508034 - RNA, 18 nt, Chlamydia trachomatis
ccauucuucucgaacuca

SEQ ID NO: 2508035 - RNA, 20 nt, Chlamydia trachomatis
ccauugauuccauuugcuac

SEQ ID NO: 2508036 - RNA, 21 nt, Chlamydia trachomatis
ccauugauuccauuugcuaca

SEQ ID NO: 2508037 - RNA, 14 nt, Chlamydia trachomatis
ccauugcugaugca

SEQ ID NO: 2508038 - RNA, 15 nt, Chlamydia trachomatis
ccauuggaauuuuca

SEQ ID NO: 2508039 - RNA, 14 nt, Chlamydia trachomatis
ccauuguagaugcu

SEQ ID NO: 2508040 - RNA, 16 nt, Chlamydia trachomatis
ccauuguagaugcugu

SEQ ID NO: 2508041 - RNA, 23 nt, Chlamydia trachomatis
ccauuuaauauggacuucccuaa

SEQ ID NO: 2508042 - RNA, 19 nt, Chlamydia trachomatis
ccauuuagaccaggauucc

SEQ ID NO: 2508043 - RNA, 15 nt, Chlamydia trachomatis
ccauuuccacagguu

SEQ ID NO: 2508044 - RNA, 21 nt, Chlamydia trachomatis
cccaaaaacaaucaaagcacc

SEQ ID NO: 2508045 - RNA, 20 nt, Chlamydia trachomatis
cccaaaauuuuucugcucca

SEQ ID NO: 2508046 - RNA, 19 nt, Chlamydia trachomatis
cccaaaccaguuucuucua

SEQ ID NO: 2508047 - RNA, 21 nt, Chlamydia trachomatis
cccaaauacugggaaaucauu

SEQ ID NO: 2508048 - RNA, 19 nt, Chlamydia trachomatis
cccaaaucaaaccaaaaau

SEQ ID NO: 2508049 - RNA, 23 nt, Chlamydia trachomatis
cccaacaagggaaugaaaucacu

SEQ ID NO: 2508050 - RNA, 17 nt, Chlamydia trachomatis
cccaagaaacuuuucug

SEQ ID NO: 2508051 - RNA, 23 nt, Chlamydia trachomatis
cccaagacgauucucaugcacug

SEQ ID NO: 2508052 - RNA, 22 nt, Chlamydia trachomatis
cccaagagugugguaugcugaa

SEQ ID NO: 2508053 - RNA, 18 nt, Chlamydia trachomatis
cccaagcguauuugcauu

SEQ ID NO: 2508054 - RNA, 12 nt, Chlamydia trachomatis
cccaagcuuuca

SEQ ID NO: 2508055 - RNA, 19 nt, Chlamydia trachomatis
cccaagcuuucaucuccuu

SEQ ID NO: 2508056 - RNA, 19 nt, Chlamydia trachomatis
cccaaggaaaagaugaaga

SEQ ID NO: 2508057 - RNA, 23 nt, Chlamydia trachomatis
cccaauauacaaguauuucuugu

SEQ ID NO: 2508058 - RNA, 14 nt, Chlamydia trachomatis
cccaauauauuccu

SEQ ID NO: 2508059 - RNA, 12 nt, Chlamydia trachomatis
cccaaucuucua

SEQ ID NO: 2508060 - RNA, 15 nt, Chlamydia trachomatis
cccaaucuucuaaau

SEQ ID NO: 2508061 - RNA, 20 nt, Chlamydia trachomatis
cccacaagugccaacaucaa

SEQ ID NO: 2508062 - RNA, 18 nt, Chlamydia trachomatis
cccacaguucccauccaa

SEQ ID NO: 2508063 - RNA, 20 nt, Chlamydia trachomatis
cccacauuaccauucacacc

SEQ ID NO: 2508064 - RNA, 18 nt, Chlamydia trachomatis
cccacgaaaagacucucc

SEQ ID NO: 2508065 - RNA, 16 nt, Chlamydia trachomatis
cccacgccauaucaaa

SEQ ID NO: 2508066 - RNA, 20 nt, Chlamydia trachomatis
cccagaaguaucuaacaaua

SEQ ID NO: 2508067 - RNA, 15 nt, Chlamydia trachomatis
cccagaaucaucugg

SEQ ID NO: 2508068 - RNA, 20 nt, Chlamydia trachomatis
cccagauuacauugagauga

SEQ ID NO: 2508069 - RNA, 16 nt, Chlamydia trachomatis
cccaggauaacaaaca

SEQ ID NO: 2508070 - RNA, 17 nt, Chlamydia trachomatis
cccaggauaacaaacaa

SEQ ID NO: 2508071 - RNA, 22 nt, Chlamydia trachomatis
cccagguugucauugaucacau

SEQ ID NO: 2508072 - RNA, 17 nt, Chlamydia trachomatis
cccauagauucaugaga

SEQ ID NO: 2508073 - RNA, 14 nt, Chlamydia trachomatis
cccaucaacucucu

SEQ ID NO: 2508074 - RNA, 20 nt, Chlamydia trachomatis
cccaucuacaaaaccaaaau

SEQ ID NO: 2508075 - RNA, 20 nt, Chlamydia trachomatis
cccaucuugcacauuuucuu

SEQ ID NO: 2508076 - RNA, 17 nt, Chlamydia trachomatis
ccccaccuauggcauuc

SEQ ID NO: 2508077 - RNA, 19 nt, Chlamydia trachomatis
ccccacgaccacaaacaau

SEQ ID NO: 2508078 - RNA, 22 nt, Chlamydia trachomatis
ccccagaaacacuaucuccuau

SEQ ID NO: 2508079 - RNA, 14 nt, Chlamydia trachomatis
ccccaucucuuuug

SEQ ID NO: 2508080 - RNA, 12 nt, Chlamydia trachomatis
ccccauucuucu

SEQ ID NO: 2508081 - RNA, 15 nt, Chlamydia trachomatis
ccccauucuucucga

SEQ ID NO: 2508082 - RNA, 22 nt, Chlamydia trachomatis
ccccccuuuuuuuauucuuucu

SEQ ID NO: 2508083 - RNA, 23 nt, Chlamydia trachomatis
ccccgaacaaucuacaccauuac

SEQ ID NO: 2508084 - RNA, 10 nt, Chlamydia trachomatis
ccccuccgcu

SEQ ID NO: 2508085 - RNA, 15 nt, Chlamydia trachomatis
ccccuccuucuucac

SEQ ID NO: 2508086 - RNA, 10 nt, Chlamydia trachomatis
ccccucugca

SEQ ID NO: 2508087 - RNA, 13 nt, Chlamydia trachomatis
ccccucuuuuuca

SEQ ID NO: 2508088 - RNA, 21 nt, Chlamydia trachomatis
ccccuuagggaaaccccaaug

SEQ ID NO: 2508089 - RNA, 15 nt, Chlamydia trachomatis
ccccuuauuuaccuu

SEQ ID NO: 2508090 - RNA, 19 nt, Chlamydia trachomatis
ccccuuauuuaccuugagu

SEQ ID NO: 2508091 - RNA, 11 nt, Chlamydia trachomatis
ccccuucugga

SEQ ID NO: 2508092 - RNA, 14 nt, Chlamydia trachomatis
cccgauucaaaaau

SEQ ID NO: 2508093 - RNA, 18 nt, Chlamydia trachomatis
cccgcauaccaaagcauu

SEQ ID NO: 2508094 - RNA, 22 nt, Chlamydia trachomatis
cccguaauagagccugggcgag

SEQ ID NO: 2508095 - RNA, 22 nt, Chlamydia trachomatis
cccuaaagagaucucuccagag

SEQ ID NO: 2508096 - RNA, 16 nt, Chlamydia trachomatis
cccuaaaucuccuccu

SEQ ID NO: 2508097 - RNA, 11 nt, Chlamydia trachomatis
cccuagaaaau

SEQ ID NO: 2508098 - RNA, 17 nt, Chlamydia trachomatis
cccuagcagcucuuacu

SEQ ID NO: 2508099 - RNA, 14 nt, Chlamydia trachomatis
cccuagucgagaag

SEQ ID NO: 2508100 - RNA, 16 nt, Chlamydia trachomatis
cccucaccucuugccu

SEQ ID NO: 2508101 - RNA, 21 nt, Chlamydia trachomatis
cccucaccucuugccugcaaa

SEQ ID NO: 2508102 - RNA, 18 nt, Chlamydia trachomatis
cccucguguaauugcugu

SEQ ID NO: 2508103 - RNA, 16 nt, Chlamydia trachomatis
cccucuuccuucccuu

SEQ ID NO: 2508104 - RNA, 13 nt, Chlamydia trachomatis
cccugaaagacuu

SEQ ID NO: 2508105 - RNA, 23 nt, Chlamydia trachomatis
cccugagaaauugcucaggaauc

SEQ ID NO: 2508106 - RNA, 14 nt, Chlamydia trachomatis
cccugcucuugaag

SEQ ID NO: 2508107 - RNA, 20 nt, Chlamydia trachomatis
cccugcuucacagcuaauca

SEQ ID NO: 2508108 - RNA, 23 nt, Chlamydia trachomatis
cccuguaguuagguaaucuucua

SEQ ID NO: 2508109 - RNA, 13 nt, Chlamydia trachomatis
cccuguauucuga

SEQ ID NO: 2508110 - RNA, 21 nt, Chlamydia trachomatis
cccugucauaccaagauuaga

SEQ ID NO: 2508111 - RNA, 19 nt, Chlamydia trachomatis
cccuuacaauguaaacaau

SEQ ID NO: 2508112 - RNA, 18 nt, Chlamydia trachomatis
cccuuagggaaaccccaa

SEQ ID NO: 2508113 - RNA, 14 nt, Chlamydia trachomatis
cccuucaauuucuu

SEQ ID NO: 2508114 - RNA, 18 nt, Chlamydia trachomatis
cccuuccaaauuucccuc

SEQ ID NO: 2508115 - RNA, 16 nt, Chlamydia trachomatis
cccuucuuucuucuaa

SEQ ID NO: 2508116 - RNA, 22 nt, Chlamydia trachomatis
cccuuuagaaauuguccaagcu

SEQ ID NO: 2508117 - RNA, 16 nt, Chlamydia trachomatis
cccuuuaguuaccaaa

SEQ ID NO: 2508118 - RNA, 18 nt, Chlamydia trachomatis
cccuuucuuacuccuucu

SEQ ID NO: 2508119 - RNA, 11 nt, Chlamydia trachomatis
cccuuuguagu

SEQ ID NO: 2508120 - RNA, 22 nt, Chlamydia trachomatis
cccuuuguaguuagacaaaaaa

SEQ ID NO: 2508121 - RNA, 22 nt, Chlamydia trachomatis
cccuuuuaaagggggacaaaaa

SEQ ID NO: 2508122 - RNA, 23 nt, Chlamydia trachomatis
cccuuuuaaagggggacaaaaau

SEQ ID NO: 2508123 - RNA, 18 nt, Chlamydia trachomatis
cccuuuuuuuauucuuuc

SEQ ID NO: 2508124 - RNA, 13 nt, Chlamydia trachomatis
ccgaaaaaaagau

SEQ ID NO: 2508125 - RNA, 17 nt, Chlamydia trachomatis
ccgaagauuauaccagc

SEQ ID NO: 2508126 - RNA, 19 nt, Chlamydia trachomatis
ccgaagauucgcugcuguc

SEQ ID NO: 2508127 - RNA, 18 nt, Chlamydia trachomatis
ccgaagguucuucuucga

SEQ ID NO: 2508128 - RNA, 14 nt, Chlamydia trachomatis
ccgaaucccaucuc

SEQ ID NO: 2508129 - RNA, 19 nt, Chlamydia trachomatis
ccgaauuaaaucugcuccu

SEQ ID NO: 2508130 - RNA, 23 nt, Chlamydia trachomatis
ccgaauucuucuccuauagcagg

SEQ ID NO: 2508131 - RNA, 18 nt, Chlamydia trachomatis
ccgaauuuguagaucuuu

SEQ ID NO: 2508132 - RNA, 21 nt, Chlamydia trachomatis
ccgacaccaggcaaugcuaag

SEQ ID NO: 2508133 - RNA, 14 nt, Chlamydia trachomatis
ccgacuaaaaaauu

SEQ ID NO: 2508134 - RNA, 18 nt, Chlamydia trachomatis
ccgacuaaaaaauuuuga

SEQ ID NO: 2508135 - RNA, 12 nt, Chlamydia trachomatis
ccgacuucaacu

SEQ ID NO: 2508136 - RNA, 19 nt, Chlamydia trachomatis
ccgagauuaucauucaaaa

SEQ ID NO: 2508137 - RNA, 22 nt, Chlamydia trachomatis
ccgaguaaucaaaaaaggaauc

SEQ ID NO: 2508138 - RNA, 18 nt, Chlamydia trachomatis
ccgaugcccaagaaacug

SEQ ID NO: 2508139 - RNA, 17 nt, Chlamydia trachomatis
ccgauucaaaagcuauc

SEQ ID NO: 2508140 - RNA, 19 nt, Chlamydia trachomatis
ccgcacauccgcuucuuca

SEQ ID NO: 2508141 - RNA, 20 nt, Chlamydia trachomatis
ccgcagagaugauauuuuca

SEQ ID NO: 2508142 - RNA, 14 nt, Chlamydia trachomatis
ccgcagcuucuuua

SEQ ID NO: 2508143 - RNA, 16 nt, Chlamydia trachomatis
ccgcauaccaaagcau

SEQ ID NO: 2508144 - RNA, 17 nt, Chlamydia trachomatis
ccgcaucagccccaaaa

SEQ ID NO: 2508145 - RNA, 15 nt, Chlamydia trachomatis
ccgcaugaaaguagc

SEQ ID NO: 2508146 - RNA, 17 nt, Chlamydia trachomatis
ccgccauuuaugaagcc

SEQ ID NO: 2508147 - RNA, 21 nt, Chlamydia trachomatis
ccgccccguguugaauuacuu

SEQ ID NO: 2508148 - RNA, 13 nt, Chlamydia trachomatis
ccgcuagauccgu

SEQ ID NO: 2508149 - RNA, 21 nt, Chlamydia trachomatis
ccgcuauuuuccucuucacag

SEQ ID NO: 2508150 - RNA, 20 nt, Chlamydia trachomatis
ccgcucuuccauaauuucua

SEQ ID NO: 2508151 - RNA, 13 nt, Chlamydia trachomatis
ccgcuuggaauac

SEQ ID NO: 2508152 - RNA, 13 nt, Chlamydia trachomatis
ccggaaaugcaca

SEQ ID NO: 2508153 - RNA, 19 nt, Chlamydia trachomatis
ccggacacacucucccugu

SEQ ID NO: 2508154 - RNA, 18 nt, Chlamydia trachomatis
ccggacauuccaaaccca

SEQ ID NO: 2508155 - RNA, 21 nt, Chlamydia trachomatis
ccggagauacggcuaacucca

SEQ ID NO: 2508156 - RNA, 11 nt, Chlamydia trachomatis
ccggauucugu

SEQ ID NO: 2508157 - RNA, 19 nt, Chlamydia trachomatis
ccggcuuuuuggcagaacu

SEQ ID NO: 2508158 - RNA, 21 nt, Chlamydia trachomatis
ccggcuuuuuggcagaacucg

SEQ ID NO: 2508159 - RNA, 13 nt, Chlamydia trachomatis
ccgguaauagaag

SEQ ID NO: 2508160 - RNA, 13 nt, Chlamydia trachomatis
ccgguaaucaaag

SEQ ID NO: 2508161 - RNA, 17 nt, Chlamydia trachomatis
ccguaaaagucucuaaa

SEQ ID NO: 2508162 - RNA, 19 nt, Chlamydia trachomatis
ccguaacgcauuccaauca

SEQ ID NO: 2508163 - RNA, 20 nt, Chlamydia trachomatis
ccguaaggaagccagccccu

SEQ ID NO: 2508164 - RNA, 15 nt, Chlamydia trachomatis
ccguacucugauuag

SEQ ID NO: 2508165 - RNA, 20 nt, Chlamydia trachomatis
ccguaugauaaaacuccccu

SEQ ID NO: 2508166 - RNA, 15 nt, Chlamydia trachomatis
ccgucacucuugaua

SEQ ID NO: 2508167 - RNA, 15 nt, Chlamydia trachomatis
ccgucaguugcuccu

SEQ ID NO: 2508168 - RNA, 18 nt, Chlamydia trachomatis
ccgucaguugcuccuccg

SEQ ID NO: 2508169 - RNA, 16 nt, Chlamydia trachomatis
ccgugaacugcucccu

SEQ ID NO: 2508170 - RNA, 12 nt, Chlamydia trachomatis
ccgugauuuccg

SEQ ID NO: 2508171 - RNA, 13 nt, Chlamydia trachomatis
ccguucaaagcaa

SEQ ID NO: 2508172 - RNA, 17 nt, Chlamydia trachomatis
ccguucucucuaaaauc

SEQ ID NO: 2508173 - RNA, 10 nt, Chlamydia trachomatis
ccuaaacaaa

SEQ ID NO: 2508174 - RNA, 17 nt, Chlamydia trachomatis
ccuaaaccuccagaagg

SEQ ID NO: 2508175 - RNA, 12 nt, Chlamydia trachomatis
ccuaaagaagcc

SEQ ID NO: 2508176 - RNA, 22 nt, Chlamydia trachomatis
ccuaaagaagccauaguagaaa

SEQ ID NO: 2508177 - RNA, 15 nt, Chlamydia trachomatis
ccuaaaucuccuccu

SEQ ID NO: 2508178 - RNA, 13 nt, Chlamydia trachomatis
ccuaaccaaguuu

SEQ ID NO: 2508179 - RNA, 22 nt, Chlamydia trachomatis
ccuaaccaaguuuuuuucaucc

SEQ ID NO: 2508180 - RNA, 16 nt, Chlamydia trachomatis
ccuaacgauuccccga

SEQ ID NO: 2508181 - RNA, 18 nt, Chlamydia trachomatis
ccuaagaaccgcaagcaa

SEQ ID NO: 2508182 - RNA, 15 nt, Chlamydia trachomatis
ccuaagcuauguaaa

SEQ ID NO: 2508183 - RNA, 18 nt, Chlamydia trachomatis
ccuaagcuauguaaaaaa

SEQ ID NO: 2508184 - RNA, 20 nt, Chlamydia trachomatis
ccuaagggccgaacuaauau

SEQ ID NO: 2508185 - RNA, 14 nt, Chlamydia trachomatis
ccuaaucuuucuaa

SEQ ID NO: 2508186 - RNA, 21 nt, Chlamydia trachomatis
ccuaauguagaaauuuuaaau

SEQ ID NO: 2508187 - RNA, 20 nt, Chlamydia trachomatis
ccuacaaaauaguucacucc

SEQ ID NO: 2508188 - RNA, 18 nt, Chlamydia trachomatis
ccuacaaacauccuuacu

SEQ ID NO: 2508189 - RNA, 12 nt, Chlamydia trachomatis
ccuacaagaccu

SEQ ID NO: 2508190 - RNA, 19 nt, Chlamydia trachomatis
ccuacauuguaaauagacu

SEQ ID NO: 2508191 - RNA, 18 nt, Chlamydia trachomatis
ccuaccaucaauccugga

SEQ ID NO: 2508192 - RNA, 19 nt, Chlamydia trachomatis
ccuacuagcgcauagcgua

SEQ ID NO: 2508193 - RNA, 20 nt, Chlamydia trachomatis
ccuagaaagaaccacaaaau

SEQ ID NO: 2508194 - RNA, 17 nt, Chlamydia trachomatis
ccuagacgauuaauagg

SEQ ID NO: 2508195 - RNA, 15 nt, Chlamydia trachomatis
ccuagagagggagau

SEQ ID NO: 2508196 - RNA, 23 nt, Chlamydia trachomatis
ccuagcgaagucuucuaucacag

SEQ ID NO: 2508197 - RNA, 17 nt, Chlamydia trachomatis
ccuaguacaaaaauacu

SEQ ID NO: 2508198 - RNA, 18 nt, Chlamydia trachomatis
ccuauagcaggauuuucu

SEQ ID NO: 2508199 - RNA, 20 nt, Chlamydia trachomatis
ccuaucaccacuaaucccac

SEQ ID NO: 2508200 - RNA, 21 nt, Chlamydia trachomatis
ccuaucaccacuaaucccacc

SEQ ID NO: 2508201 - RNA, 20 nt, Chlamydia trachomatis
ccuaucgcacacaauaaauc

SEQ ID NO: 2508202 - RNA, 15 nt, Chlamydia trachomatis
ccuauggcauucaac

SEQ ID NO: 2508203 - RNA, 20 nt, Chlamydia trachomatis
ccucaaaaaauguuuuugau

SEQ ID NO: 2508204 - RNA, 17 nt, Chlamydia trachomatis
ccucaauagcagcauuc

SEQ ID NO: 2508205 - RNA, 21 nt, Chlamydia trachomatis
ccucaauagcugacuuugaag

SEQ ID NO: 2508206 - RNA, 16 nt, Chlamydia trachomatis
ccucacacacaaaaaa

SEQ ID NO: 2508207 - RNA, 16 nt, Chlamydia trachomatis
ccucagauuuaucugc

SEQ ID NO: 2508208 - RNA, 19 nt, Chlamydia trachomatis
ccucagauuuaucugcuau

SEQ ID NO: 2508209 - RNA, 14 nt, Chlamydia trachomatis
ccucaguauaaaaa

SEQ ID NO: 2508210 - RNA, 20 nt, Chlamydia trachomatis
ccucauccuuuuggaagauc

SEQ ID NO: 2508211 - RNA, 20 nt, Chlamydia trachomatis
ccuccagcuucuucuauaag

SEQ ID NO: 2508212 - RNA, 13 nt, Chlamydia trachomatis
ccuccauaggaau

SEQ ID NO: 2508213 - RNA, 16 nt, Chlamydia trachomatis
ccuccaucucugcuuc

SEQ ID NO: 2508214 - RNA, 13 nt, Chlamydia trachomatis
ccuccggcuccca

SEQ ID NO: 2508215 - RNA, 13 nt, Chlamydia trachomatis
ccuccuacuccaa

SEQ ID NO: 2508216 - RNA, 15 nt, Chlamydia trachomatis
ccuccuagaaagaac

SEQ ID NO: 2508217 - RNA, 14 nt, Chlamydia trachomatis
ccuccucuucuauc

SEQ ID NO: 2508218 - RNA, 18 nt, Chlamydia trachomatis
ccuccugcguuagcaaga

SEQ ID NO: 2508219 - RNA, 13 nt, Chlamydia trachomatis
ccucguaauaacu

SEQ ID NO: 2508220 - RNA, 15 nt, Chlamydia trachomatis
ccucguuuuuuuaga

SEQ ID NO: 2508221 - RNA, 21 nt, Chlamydia trachomatis
ccucuaaacaagguucuucaa

SEQ ID NO: 2508222 - RNA, 14 nt, Chlamydia trachomatis
ccucuaacucuucu

SEQ ID NO: 2508223 - RNA, 16 nt, Chlamydia trachomatis
ccucuaacucuucugg

SEQ ID NO: 2508224 - RNA, 18 nt, Chlamydia trachomatis
ccucuaagcaccuuuaca

SEQ ID NO: 2508225 - RNA, 18 nt, Chlamydia trachomatis
ccucuaauaaacagaucu

SEQ ID NO: 2508226 - RNA, 22 nt, Chlamydia trachomatis
ccucuaauaaacagaucuuuuu

SEQ ID NO: 2508227 - RNA, 11 nt, Chlamydia trachomatis
ccucuaaucuu

SEQ ID NO: 2508228 - RNA, 14 nt, Chlamydia trachomatis
ccucuaaucuugau

SEQ ID NO: 2508229 - RNA, 18 nt, Chlamydia trachomatis
ccucuacaccauaaaacu

SEQ ID NO: 2508230 - RNA, 14 nt, Chlamydia trachomatis
ccucuaucucuucu

SEQ ID NO: 2508231 - RNA, 12 nt, Chlamydia trachomatis
ccucuccagaaa

SEQ ID NO: 2508232 - RNA, 16 nt, Chlamydia trachomatis
ccucuccauccugcgu

SEQ ID NO: 2508233 - RNA, 15 nt, Chlamydia trachomatis
ccucucucugcagag

SEQ ID NO: 2508234 - RNA, 16 nt, Chlamydia trachomatis
ccucugguacucaucu

SEQ ID NO: 2508235 - RNA, 20 nt, Chlamydia trachomatis
ccucuucucuuuuagcgauc

SEQ ID NO: 2508236 - RNA, 21 nt, Chlamydia trachomatis
ccucuugccugcaaauaauaa

SEQ ID NO: 2508237 - RNA, 21 nt, Chlamydia trachomatis
ccucuuucagaugcacuuccu

SEQ ID NO: 2508238 - RNA, 15 nt, Chlamydia trachomatis
ccucuuucgcuuucc

SEQ ID NO: 2508239 - RNA, 16 nt, Chlamydia trachomatis
ccucuuugaauauccg

SEQ ID NO: 2508240 - RNA, 12 nt, Chlamydia trachomatis
ccucuuuuucac

SEQ ID NO: 2508241 - RNA, 17 nt, Chlamydia trachomatis
ccugaacauccaccagc

SEQ ID NO: 2508242 - RNA, 15 nt, Chlamydia trachomatis
ccugaagauuuuuua

SEQ ID NO: 2508243 - RNA, 21 nt, Chlamydia trachomatis
ccugaauagggauuuuaaaga

SEQ ID NO: 2508244 - RNA, 15 nt, Chlamydia trachomatis
ccugaauaguuguag

SEQ ID NO: 2508245 - RNA, 17 nt, Chlamydia trachomatis
ccugagggccuucuuuu

SEQ ID NO: 2508246 - RNA, 13 nt, Chlamydia trachomatis
ccugauggauagu

SEQ ID NO: 2508247 - RNA, 14 nt, Chlamydia trachomatis
ccugcaaaaaggcu

SEQ ID NO: 2508248 - RNA, 24 nt, Chlamydia trachomatis
ccugcaaaaaggcuuacagagagc

SEQ ID NO: 2508249 - RNA, 15 nt, Chlamydia trachomatis
ccugcaccucuuuca

SEQ ID NO: 2508250 - RNA, 15 nt, Chlamydia trachomatis
ccugcauaauagcuu

SEQ ID NO: 2508251 - RNA, 22 nt, Chlamydia trachomatis
ccugcauagcugaacccuucaa

SEQ ID NO: 2508252 - RNA, 19 nt, Chlamydia trachomatis
ccugcuccggcaaauccug

SEQ ID NO: 2508253 - RNA, 16 nt, Chlamydia trachomatis
ccugcuucacagcuaa

SEQ ID NO: 2508254 - RNA, 16 nt, Chlamydia trachomatis
ccugcuucuauagaaa

SEQ ID NO: 2508255 - RNA, 19 nt, Chlamydia trachomatis
ccugcuucuauagaaacac

SEQ ID NO: 2508256 - RNA, 19 nt, Chlamydia trachomatis
ccugcuugaaguagcauug

SEQ ID NO: 2508257 - RNA, 16 nt, Chlamydia trachomatis
ccuggaaucacaugcu

SEQ ID NO: 2508258 - RNA, 13 nt, Chlamydia trachomatis
ccuggauccaaaa

SEQ ID NO: 2508259 - RNA, 22 nt, Chlamydia trachomatis
ccuggauccaaaaaagaaucua

SEQ ID NO: 2508260 - RNA, 14 nt, Chlamydia trachomatis
ccuggaugcacauc

SEQ ID NO: 2508261 - RNA, 14 nt, Chlamydia trachomatis
ccuggcugcagaag

SEQ ID NO: 2508262 - RNA, 20 nt, Chlamydia trachomatis
ccugggccaaacaguucuug

SEQ ID NO: 2508263 - RNA, 22 nt, Chlamydia trachomatis
ccuguaguuagguaaucuucua

SEQ ID NO: 2508264 - RNA, 22 nt, Chlamydia trachomatis
ccugugaagaaacuucuggaga

SEQ ID NO: 2508265 - RNA, 17 nt, Chlamydia trachomatis
ccuguucuucaaauucu

SEQ ID NO: 2508266 - RNA, 17 nt, Chlamydia trachomatis
ccuguuguguaucaaaa

SEQ ID NO: 2508267 - RNA, 13 nt, Chlamydia trachomatis
ccuguuuagaaag

SEQ ID NO: 2508268 - RNA, 22 nt, Chlamydia trachomatis
ccuguuuguuuguuuuuuucaa

SEQ ID NO: 2508269 - RNA, 19 nt, Chlamydia trachomatis
ccuguuuucuuguagaaaa

SEQ ID NO: 2508270 - RNA, 16 nt, Chlamydia trachomatis
ccuuaaacauacacag

SEQ ID NO: 2508271 - RNA, 18 nt, Chlamydia trachomatis
ccuuaaaugcaguggaag

SEQ ID NO: 2508272 - RNA, 16 nt, Chlamydia trachomatis
ccuuaauaagcuuuuu

SEQ ID NO: 2508273 - RNA, 20 nt, Chlamydia trachomatis
ccuuaauuggggauccuaca

SEQ ID NO: 2508274 - RNA, 17 nt, Chlamydia trachomatis
ccuuacccaaacaucua

SEQ ID NO: 2508275 - RNA, 13 nt, Chlamydia trachomatis
ccuuacucuuccg

SEQ ID NO: 2508276 - RNA, 19 nt, Chlamydia trachomatis
ccuuagauccggcuuuuug

SEQ ID NO: 2508277 - RNA, 22 nt, Chlamydia trachomatis
ccuuagggaaaccccaauguuu

SEQ ID NO: 2508278 - RNA, 22 nt, Chlamydia trachomatis
ccuuaguuuuaauuccaucuuu

SEQ ID NO: 2508279 - RNA, 18 nt, Chlamydia trachomatis
ccuuauacaucagagcaa

SEQ ID NO: 2508280 - RNA, 12 nt, Chlamydia trachomatis
ccuuauggcuca

SEQ ID NO: 2508281 - RNA, 20 nt, Chlamydia trachomatis
ccuucauuucaagagagauc

SEQ ID NO: 2508282 - RNA, 13 nt, Chlamydia trachomatis
ccuucgaagcgga

SEQ ID NO: 2508283 - RNA, 18 nt, Chlamydia trachomatis
ccuucgauaaguucuuua

SEQ ID NO: 2508284 - RNA, 22 nt, Chlamydia trachomatis
ccuucgauauggcaaucgcgga

SEQ ID NO: 2508285 - RNA, 13 nt, Chlamydia trachomatis
ccuucugccucuu

SEQ ID NO: 2508286 - RNA, 12 nt, Chlamydia trachomatis
ccuucuugaugc

SEQ ID NO: 2508287 - RNA, 21 nt, Chlamydia trachomatis
ccuucuuuaccgauaauuuua

SEQ ID NO: 2508288 - RNA, 18 nt, Chlamydia trachomatis
ccuucuuuauaaucgauc

SEQ ID NO: 2508289 - RNA, 20 nt, Chlamydia trachomatis
ccuucuuucuggaaucauuc

SEQ ID NO: 2508290 - RNA, 21 nt, Chlamydia trachomatis
ccuucuuucuggaaucauuca

SEQ ID NO: 2508291 - RNA, 14 nt, Chlamydia trachomatis
ccuucuuucuucua

SEQ ID NO: 2508292 - RNA, 21 nt, Chlamydia trachomatis
ccuucuuucuucuaagaaguu

SEQ ID NO: 2508293 - RNA, 19 nt, Chlamydia trachomatis
ccuucuuuuuccucagcau

SEQ ID NO: 2508294 - RNA, 14 nt, Chlamydia trachomatis
ccuugaacuagaaa

SEQ ID NO: 2508295 - RNA, 13 nt, Chlamydia trachomatis
ccuugauauccuu

SEQ ID NO: 2508296 - RNA, 23 nt, Chlamydia trachomatis
ccuugaugaauuuuaucuaaaaa

SEQ ID NO: 2508297 - RNA, 23 nt, Chlamydia trachomatis
ccuugccaucauuaucuucuucu

SEQ ID NO: 2508298 - RNA, 16 nt, Chlamydia trachomatis
ccuugccuacagaauc

SEQ ID NO: 2508299 - RNA, 17 nt, Chlamydia trachomatis
ccuuggauuucuucugu

SEQ ID NO: 2508300 - RNA, 23 nt, Chlamydia trachomatis
ccuuguaucuugugcaaacaaaa

SEQ ID NO: 2508301 - RNA, 24 nt, Chlamydia trachomatis
ccuugucuauaggaauagccuccu

SEQ ID NO: 2508302 - RNA, 19 nt, Chlamydia trachomatis
ccuuguuagaaaugcaaau

SEQ ID NO: 2508303 - RNA, 15 nt, Chlamydia trachomatis
ccuuuaaaguauaau

SEQ ID NO: 2508304 - RNA, 17 nt, Chlamydia trachomatis
ccuuuaagguacuucua

SEQ ID NO: 2508305 - RNA, 19 nt, Chlamydia trachomatis
ccuuuaauguuugggaaga

SEQ ID NO: 2508306 - RNA, 18 nt, Chlamydia trachomatis
ccuuuaauuaugcaaaaa

SEQ ID NO: 2508307 - RNA, 15 nt, Chlamydia trachomatis
ccuuuaguuaccaaa

SEQ ID NO: 2508308 - RNA, 21 nt, Chlamydia trachomatis
ccuuuaguuaccaaaaaggaa

SEQ ID NO: 2508309 - RNA, 13 nt, Chlamydia trachomatis
ccuuucaaauacc

SEQ ID NO: 2508310 - RNA, 17 nt, Chlamydia trachomatis
ccuuucauaauaguccu

SEQ ID NO: 2508311 - RNA, 17 nt, Chlamydia trachomatis
ccuuuccauacaucauc

SEQ ID NO: 2508312 - RNA, 18 nt, Chlamydia trachomatis
ccuuucgucacagauuug

SEQ ID NO: 2508313 - RNA, 15 nt, Chlamydia trachomatis
ccuuucucuaaaaga

SEQ ID NO: 2508314 - RNA, 17 nt, Chlamydia trachomatis
ccuuucuuacuccuucu

SEQ ID NO: 2508315 - RNA, 20 nt, Chlamydia trachomatis
ccuuucuuacuccuucucug

SEQ ID NO: 2508316 - RNA, 22 nt, Chlamydia trachomatis
ccuuuuaaagggggacaaaaau

SEQ ID NO: 2508317 - RNA, 18 nt, Chlamydia trachomatis
ccuuuuaagauauccaua

SEQ ID NO: 2508318 - RNA, 22 nt, Chlamydia trachomatis
ccuuuuaagauauccauagccu

SEQ ID NO: 2508319 - RNA, 14 nt, Chlamydia trachomatis
ccuuuuagcccucc

SEQ ID NO: 2508320 - RNA, 18 nt, Chlamydia trachomatis
ccuuuuauucuucaguuu

SEQ ID NO: 2508321 - RNA, 19 nt, Chlamydia trachomatis
ccuuuugauucugcuccaa

SEQ ID NO: 2508322 - RNA, 16 nt, Chlamydia trachomatis
ccuuuuguuuucaaaa

SEQ ID NO: 2508323 - RNA, 17 nt, Chlamydia trachomatis
ccuuuuguuuuuuuaua

SEQ ID NO: 2508324 - RNA, 12 nt, Chlamydia trachomatis
ccuuuuuaaaau

SEQ ID NO: 2508325 - RNA, 15 nt, Chlamydia trachomatis
ccuuuuuucuguuug

SEQ ID NO: 2508326 - RNA, 19 nt, Chlamydia trachomatis
ccuuuuuugcuaaaagaaa

SEQ ID NO: 2508327 - RNA, 22 nt, Chlamydia trachomatis
ccuuuuuuuauucuuucuuauc

SEQ ID NO: 2508328 - RNA, 15 nt, Chlamydia trachomatis
cgaaaaaaaaagaac

SEQ ID NO: 2508329 - RNA, 17 nt, Chlamydia trachomatis
cgaaaaaaugccuccau

SEQ ID NO: 2508330 - RNA, 14 nt, Chlamydia trachomatis
cgaaaaacagaaag

SEQ ID NO: 2508331 - RNA, 21 nt, Chlamydia trachomatis
cgaaaaucacuuuuaccguuc

SEQ ID NO: 2508332 - RNA, 23 nt, Chlamydia trachomatis
cgaaacuacccgauucaaaaauc

SEQ ID NO: 2508333 - RNA, 22 nt, Chlamydia trachomatis
cgaaagcauguuucggaauuca

SEQ ID NO: 2508334 - RNA, 20 nt, Chlamydia trachomatis
cgaaaguuuccuuaaaguuu

SEQ ID NO: 2508335 - RNA, 12 nt, Chlamydia trachomatis
cgaaauauugua

SEQ ID NO: 2508336 - RNA, 17 nt, Chlamydia trachomatis
cgaaaucgaaagguuuc

SEQ ID NO: 2508337 - RNA, 14 nt, Chlamydia trachomatis
cgaacaagaugacu

SEQ ID NO: 2508338 - RNA, 13 nt, Chlamydia trachomatis
cgaacaaucggaa

SEQ ID NO: 2508339 - RNA, 14 nt, Chlamydia trachomatis
cgaacucagcuucc

SEQ ID NO: 2508340 - RNA, 13 nt, Chlamydia trachomatis
cgaacucuccucu

SEQ ID NO: 2508341 - RNA, 13 nt, Chlamydia trachomatis
cgaacuuuauuau

SEQ ID NO: 2508342 - RNA, 18 nt, Chlamydia trachomatis
cgaagaacucaaaagcuu

SEQ ID NO: 2508343 - RNA, 20 nt, Chlamydia trachomatis
cgaagacgaacgcuagaaac

SEQ ID NO: 2508344 - RNA, 17 nt, Chlamydia trachomatis
cgaaggcaauuccucua

SEQ ID NO: 2508345 - RNA, 13 nt, Chlamydia trachomatis
cgaagucuucuau

SEQ ID NO: 2508346 - RNA, 21 nt, Chlamydia trachomatis
cgaauaagaguccuaauaguc

SEQ ID NO: 2508347 - RNA, 22 nt, Chlamydia trachomatis
cgaauaagcauuacacaacucu

SEQ ID NO: 2508348 - RNA, 17 nt, Chlamydia trachomatis
cgaauaaucagucgcuc

SEQ ID NO: 2508349 - RNA, 23 nt, Chlamydia trachomatis
cgaauaccccaaauguugcgaua

SEQ ID NO: 2508350 - RNA, 22 nt, Chlamydia trachomatis
cgaaucacaugucauccuuaga

SEQ ID NO: 2508351 - RNA, 23 nt, Chlamydia trachomatis
cgaaucauugggaaaacgauaaa

SEQ ID NO: 2508352 - RNA, 15 nt, Chlamydia trachomatis
cgaauuacucugccu

SEQ ID NO: 2508353 - RNA, 19 nt, Chlamydia trachomatis
cgaauucuuugaucuguaa

SEQ ID NO: 2508354 - RNA, 14 nt, Chlamydia trachomatis
cgaauuucuugaac

SEQ ID NO: 2508355 - RNA, 15 nt, Chlamydia trachomatis
cgaauuuguagaucu

SEQ ID NO: 2508356 - RNA, 20 nt, Chlamydia trachomatis
cgaauuuguagaucuuuucg

SEQ ID NO: 2508357 - RNA, 18 nt, Chlamydia trachomatis
cgacagcguuuuccccuu

SEQ ID NO: 2508358 - RNA, 15 nt, Chlamydia trachomatis
cgacguuagaacuau

SEQ ID NO: 2508359 - RNA, 18 nt, Chlamydia trachomatis
cgacuaaaaaauuuugag

SEQ ID NO: 2508360 - RNA, 21 nt, Chlamydia trachomatis
cgacuuagcacucaaacacuc

SEQ ID NO: 2508361 - RNA, 15 nt, Chlamydia trachomatis
cgacuucaacuucuc

SEQ ID NO: 2508362 - RNA, 22 nt, Chlamydia trachomatis
cgagaaaucuuuuacuggagaa

SEQ ID NO: 2508363 - RNA, 23 nt, Chlamydia trachomatis
cgagaaccaaucgagagguccag

SEQ ID NO: 2508364 - RNA, 12 nt, Chlamydia trachomatis
cgagaagagguu

SEQ ID NO: 2508365 - RNA, 14 nt, Chlamydia trachomatis
cgagauaaaaaccu

SEQ ID NO: 2508366 - RNA, 19 nt, Chlamydia trachomatis
cgagauuaucauucaaaau

SEQ ID NO: 2508367 - RNA, 22 nt, Chlamydia trachomatis
cgagauuaucauucaaaaucca

SEQ ID NO: 2508368 - RNA, 12 nt, Chlamydia trachomatis
cgagcuaagaaa

SEQ ID NO: 2508369 - RNA, 18 nt, Chlamydia trachomatis
cgagcucccauuucuggc

SEQ ID NO: 2508370 - RNA, 14 nt, Chlamydia trachomatis
cgagcuuucuuacg

SEQ ID NO: 2508371 - RNA, 17 nt, Chlamydia trachomatis
cgaggaauucuucuucu

SEQ ID NO: 2508372 - RNA, 21 nt, Chlamydia trachomatis
cgaggcuucuucuucuuuagc

SEQ ID NO: 2508373 - RNA, 18 nt, Chlamydia trachomatis
cgaguagacucuaauaaa

SEQ ID NO: 2508374 - RNA, 23 nt, Chlamydia trachomatis
cgagucccuucaaucauaggaau

SEQ ID NO: 2508375 - RNA, 20 nt, Chlamydia trachomatis
cgagugaucuacagcuguau

SEQ ID NO: 2508376 - RNA, 19 nt, Chlamydia trachomatis
cgagugaugauagacaaga

SEQ ID NO: 2508377 - RNA, 16 nt, Chlamydia trachomatis
cgagugccgaauaaug

SEQ ID NO: 2508378 - RNA, 18 nt, Chlamydia trachomatis
cgaguucgggaauaauuc

SEQ ID NO: 2508379 - RNA, 14 nt, Chlamydia trachomatis
cgauaaaaagcugg

SEQ ID NO: 2508380 - RNA, 16 nt, Chlamydia trachomatis
cgauaaacagaucuag

SEQ ID NO: 2508381 - RNA, 15 nt, Chlamydia trachomatis
cgauaaaguaaagga

SEQ ID NO: 2508382 - RNA, 15 nt, Chlamydia trachomatis
cgauaacuccaucag

SEQ ID NO: 2508383 - RNA, 21 nt, Chlamydia trachomatis
cgauaaugcuuagaaacuguc

SEQ ID NO: 2508384 - RNA, 18 nt, Chlamydia trachomatis
cgauaccaauaaugacac

SEQ ID NO: 2508385 - RNA, 16 nt, Chlamydia trachomatis
cgauaccuauuccaaa

SEQ ID NO: 2508386 - RNA, 21 nt, Chlamydia trachomatis
cgauaccuauuccaaauccuc

SEQ ID NO: 2508387 - RNA, 18 nt, Chlamydia trachomatis
cgauaguacaaguauaua

SEQ ID NO: 2508388 - RNA, 20 nt, Chlamydia trachomatis
cgauauccaucauaaaaaga

SEQ ID NO: 2508389 - RNA, 11 nt, Chlamydia trachomatis
cgauauuucuu

SEQ ID NO: 2508390 - RNA, 15 nt, Chlamydia trachomatis
cgaucacagaaacgg

SEQ ID NO: 2508391 - RNA, 13 nt, Chlamydia trachomatis
cgaucagcuccug

SEQ ID NO: 2508392 - RNA, 22 nt, Chlamydia trachomatis
cgaucauuaggauuaaaaucca

SEQ ID NO: 2508393 - RNA, 20 nt, Chlamydia trachomatis
cgauccaaagccucuuguug

SEQ ID NO: 2508394 - RNA, 11 nt, Chlamydia trachomatis
cgauccaagga

SEQ ID NO: 2508395 - RNA, 18 nt, Chlamydia trachomatis
cgauccucuugagcauug

SEQ ID NO: 2508396 - RNA, 12 nt, Chlamydia trachomatis
cgaucuccucau

SEQ ID NO: 2508397 - RNA, 22 nt, Chlamydia trachomatis
cgaucuccuuccucuuuaacca

SEQ ID NO: 2508398 - RNA, 22 nt, Chlamydia trachomatis
cgaugagcuuaucacaaaccag

SEQ ID NO: 2508399 - RNA, 21 nt, Chlamydia trachomatis
cgaugauauuaguuagugaag

SEQ ID NO: 2508400 - RNA, 23 nt, Chlamydia trachomatis
cgaugauauuaguuagugaaguc

SEQ ID NO: 2508401 - RNA, 17 nt, Chlamydia trachomatis
cgaugcccaagaaacug

SEQ ID NO: 2508402 - RNA, 12 nt, Chlamydia trachomatis
cgaugccucuaa

SEQ ID NO: 2508403 - RNA, 15 nt, Chlamydia trachomatis
cgaugguucuuguga

SEQ ID NO: 2508404 - RNA, 14 nt, Chlamydia trachomatis
cgauguaaaugaug

SEQ ID NO: 2508405 - RNA, 12 nt, Chlamydia trachomatis
cgauguucacac

SEQ ID NO: 2508406 - RNA, 18 nt, Chlamydia trachomatis
cgauuaggguagucgcuu

SEQ ID NO: 2508407 - RNA, 12 nt, Chlamydia trachomatis
cgauucaaaaau

SEQ ID NO: 2508408 - RNA, 17 nt, Chlamydia trachomatis
cgauuccccgagacgca

SEQ ID NO: 2508409 - RNA, 12 nt, Chlamydia trachomatis
cgauucuccgaa

SEQ ID NO: 2508410 - RNA, 12 nt, Chlamydia trachomatis
cgauucuugaua

SEQ ID NO: 2508411 - RNA, 14 nt, Chlamydia trachomatis
cgauucuugauaaa

SEQ ID NO: 2508412 - RNA, 23 nt, Chlamydia trachomatis
cgauuguucguacugcauuggca

SEQ ID NO: 2508413 - RNA, 21 nt, Chlamydia trachomatis
cgauuguuucuguaggagaga

SEQ ID NO: 2508414 - RNA, 12 nt, Chlamydia trachomatis
cgauuuuuaaaa

SEQ ID NO: 2508415 - RNA, 15 nt, Chlamydia trachomatis
cgauuuuuaaaagac

SEQ ID NO: 2508416 - RNA, 16 nt, Chlamydia trachomatis
cgauuuuuaaaagacc

SEQ ID NO: 2508417 - RNA, 13 nt, Chlamydia trachomatis
cgcaaaacaucua

SEQ ID NO: 2508418 - RNA, 18 nt, Chlamydia trachomatis
cgcaaccccgcauaccaa

SEQ ID NO: 2508419 - RNA, 15 nt, Chlamydia trachomatis
cgcaagcaugucgag

SEQ ID NO: 2508420 - RNA, 13 nt, Chlamydia trachomatis
cgcaagucucugc

SEQ ID NO: 2508421 - RNA, 16 nt, Chlamydia trachomatis
cgcaauauagagcaua

SEQ ID NO: 2508422 - RNA, 17 nt, Chlamydia trachomatis
cgcaaucauaucaagaa

SEQ ID NO: 2508423 - RNA, 19 nt, Chlamydia trachomatis
cgcaaucauaucaagaauu

SEQ ID NO: 2508424 - RNA, 23 nt, Chlamydia trachomatis
cgcaaucauaucaagaauuucuu

SEQ ID NO: 2508425 - RNA, 16 nt, Chlamydia trachomatis
cgcacauccgcuucuu

SEQ ID NO: 2508426 - RNA, 12 nt, Chlamydia trachomatis
cgcaccaaucac

SEQ ID NO: 2508427 - RNA, 21 nt, Chlamydia trachomatis
cgcacuauuagggagcccagc

SEQ ID NO: 2508428 - RNA, 15 nt, Chlamydia trachomatis
cgcagaucuccuucu

SEQ ID NO: 2508429 - RNA, 16 nt, Chlamydia trachomatis
cgcagcaugaaugaau

SEQ ID NO: 2508430 - RNA, 14 nt, Chlamydia trachomatis
cgcagcucaccagc

SEQ ID NO: 2508431 - RNA, 18 nt, Chlamydia trachomatis
cgcagcucaccagcuucc

SEQ ID NO: 2508432 - RNA, 23 nt, Chlamydia trachomatis
cgcagcuuucguugaucacggaa

SEQ ID NO: 2508433 - RNA, 16 nt, Chlamydia trachomatis
cgcagcuuucuuuucc

SEQ ID NO: 2508434 - RNA, 21 nt, Chlamydia trachomatis
cgcaguucgcuauaaucccaa

SEQ ID NO: 2508435 - RNA, 12 nt, Chlamydia trachomatis
cgcauaccaaag

SEQ ID NO: 2508436 - RNA, 15 nt, Chlamydia trachomatis
cgcauacucgguaac

SEQ ID NO: 2508437 - RNA, 20 nt, Chlamydia trachomatis
cgcauaugcagaagaccagu

SEQ ID NO: 2508438 - RNA, 19 nt, Chlamydia trachomatis
cgcaucuccaaagacacac

SEQ ID NO: 2508439 - RNA, 20 nt, Chlamydia trachomatis
cgcauuugcucuuccaacaa

SEQ ID NO: 2508440 - RNA, 12 nt, Chlamydia trachomatis
cgccaacuauug

SEQ ID NO: 2508441 - RNA, 14 nt, Chlamydia trachomatis
cgccccucuuuuuc

SEQ ID NO: 2508442 - RNA, 23 nt, Chlamydia trachomatis
cgccccucuuuuucaccagcaaa

SEQ ID NO: 2508443 - RNA, 13 nt, Chlamydia trachomatis
cgcccuccuccuc

SEQ ID NO: 2508444 - RNA, 16 nt, Chlamydia trachomatis
cgccgggggagccaaa

SEQ ID NO: 2508445 - RNA, 23 nt, Chlamydia trachomatis
cgccucaaacaaucuaaaaaauu

SEQ ID NO: 2508446 - RNA, 19 nt, Chlamydia trachomatis
cgccucuuuugcauuucca

SEQ ID NO: 2508447 - RNA, 14 nt, Chlamydia trachomatis
cgccuucuauagcu

SEQ ID NO: 2508448 - RNA, 15 nt, Chlamydia trachomatis
cgccuugcgcaucaa

SEQ ID NO: 2508449 - RNA, 19 nt, Chlamydia trachomatis
cgccuugucuauaggaaua

SEQ ID NO: 2508450 - RNA, 15 nt, Chlamydia trachomatis
cgcgauauccuuuuu

SEQ ID NO: 2508451 - RNA, 17 nt, Chlamydia trachomatis
cgcgcaaaucaggaauc

SEQ ID NO: 2508452 - RNA, 18 nt, Chlamydia trachomatis
cgcguaauuuucuagcuu

SEQ ID NO: 2508453 - RNA, 22 nt, Chlamydia trachomatis
cgcguaauuuucuagcuucuug

SEQ ID NO: 2508454 - RNA, 12 nt, Chlamydia trachomatis
cgcgucucccua

SEQ ID NO: 2508455 - RNA, 14 nt, Chlamydia trachomatis
cgcguuuccgcggc

SEQ ID NO: 2508456 - RNA, 15 nt, Chlamydia trachomatis
cgcuaaauugaaauu

SEQ ID NO: 2508457 - RNA, 18 nt, Chlamydia trachomatis
cgcuaauccaugcaucuc

SEQ ID NO: 2508458 - RNA, 19 nt, Chlamydia trachomatis
cgcuacagaguuaacuauu

SEQ ID NO: 2508459 - RNA, 20 nt, Chlamydia trachomatis
cgcuacccauguuuuggcuc

SEQ ID NO: 2508460 - RNA, 16 nt, Chlamydia trachomatis
cgcuagggucuucucu

SEQ ID NO: 2508461 - RNA, 19 nt, Chlamydia trachomatis
cgcuagggucuucucugug

SEQ ID NO: 2508462 - RNA, 21 nt, Chlamydia trachomatis
cgcuauaaucccaaaaacaau

SEQ ID NO: 2508463 - RNA, 14 nt, Chlamydia trachomatis
cgcuauagcaugau

SEQ ID NO: 2508464 - RNA, 13 nt, Chlamydia trachomatis
cgcuaucaauaaa

SEQ ID NO: 2508465 - RNA, 20 nt, Chlamydia trachomatis
cgcucaggcuaucacaaaag

SEQ ID NO: 2508466 - RNA, 15 nt, Chlamydia trachomatis
cgcuccagcucuucc

SEQ ID NO: 2508467 - RNA, 22 nt, Chlamydia trachomatis
cgcucccauuuuuaccaaaccu

SEQ ID NO: 2508468 - RNA, 16 nt, Chlamydia trachomatis
cgcuccuagugauaaa

SEQ ID NO: 2508469 - RNA, 16 nt, Chlamydia trachomatis
cgcucguuccucagcu

SEQ ID NO: 2508470 - RNA, 14 nt, Chlamydia trachomatis
cgcucuuucuuacg

SEQ ID NO: 2508471 - RNA, 13 nt, Chlamydia trachomatis
cgcucuuuuucuu

SEQ ID NO: 2508472 - RNA, 15 nt, Chlamydia trachomatis
cgcugaguuuccuuu

SEQ ID NO: 2508473 - RNA, 12 nt, Chlamydia trachomatis
cgcugcgagaga

SEQ ID NO: 2508474 - RNA, 19 nt, Chlamydia trachomatis
cgcugcuaaagcagcagaa

SEQ ID NO: 2508475 - RNA, 14 nt, Chlamydia trachomatis
cgcuucaaaacuaa

SEQ ID NO: 2508476 - RNA, 21 nt, Chlamydia trachomatis
cgcuuccugccaguucuucac

SEQ ID NO: 2508477 - RNA, 19 nt, Chlamydia trachomatis
cgcuucucgcuaaauugaa

SEQ ID NO: 2508478 - RNA, 13 nt, Chlamydia trachomatis
cgcuugaaaagaa

SEQ ID NO: 2508479 - RNA, 21 nt, Chlamydia trachomatis
cgcuuggaauacaucacugca

SEQ ID NO: 2508480 - RNA, 19 nt, Chlamydia trachomatis
cgcuuguaugguuuguccu

SEQ ID NO: 2508481 - RNA, 23 nt, Chlamydia trachomatis
cgcuuugguagcucguuuuuuug

SEQ ID NO: 2508482 - RNA, 16 nt, Chlamydia trachomatis
cgcuuuugcugcuuca

SEQ ID NO: 2508483 - RNA, 18 nt, Chlamydia trachomatis
cgcuuuuucuucucuagc

SEQ ID NO: 2508484 - RNA, 19 nt, Chlamydia trachomatis
cggaaaccaauaaaguacg

SEQ ID NO: 2508485 - RNA, 17 nt, Chlamydia trachomatis
cggaaagcacuucguua

SEQ ID NO: 2508486 - RNA, 22 nt, Chlamydia trachomatis
cggaaaucuucggugaguugua

SEQ ID NO: 2508487 - RNA, 20 nt, Chlamydia trachomatis
cggaaauguuaaagucauuc

SEQ ID NO: 2508488 - RNA, 21 nt, Chlamydia trachomatis
cggaaggaaaaagaaaaaaag

SEQ ID NO: 2508489 - RNA, 22 nt, Chlamydia trachomatis
cggaauaagcgaaaaaaaaaga

SEQ ID NO: 2508490 - RNA, 21 nt, Chlamydia trachomatis
cggaauagccuccaaacauuu

SEQ ID NO: 2508491 - RNA, 17 nt, Chlamydia trachomatis
cggaaucuugcuggucc

SEQ ID NO: 2508492 - RNA, 14 nt, Chlamydia trachomatis
cggacaaauuucua

SEQ ID NO: 2508493 - RNA, 18 nt, Chlamydia trachomatis
cggacauuucacuaucca

SEQ ID NO: 2508494 - RNA, 19 nt, Chlamydia trachomatis
cggacugcaucauguugcg

SEQ ID NO: 2508495 - RNA, 23 nt, Chlamydia trachomatis
cggacuucuuuauguaaggaaau

SEQ ID NO: 2508496 - RNA, 11 nt, Chlamydia trachomatis
cggagaagaag

SEQ ID NO: 2508497 - RNA, 14 nt, Chlamydia trachomatis
cggagagaaagagg

SEQ ID NO: 2508498 - RNA, 21 nt, Chlamydia trachomatis
cggagauacggcuaacuccag

SEQ ID NO: 2508499 - RNA, 15 nt, Chlamydia trachomatis
cggaguaccaaaaaa

SEQ ID NO: 2508500 - RNA, 15 nt, Chlamydia trachomatis
cggagucugcuccac

SEQ ID NO: 2508501 - RNA, 17 nt, Chlamydia trachomatis
cggauaggaaaaagcua

SEQ ID NO: 2508502 - RNA, 19 nt, Chlamydia trachomatis
cggauaggaaaaagcuauc

SEQ ID NO: 2508503 - RNA, 17 nt, Chlamydia trachomatis
cggauaggcugaggauu

SEQ ID NO: 2508504 - RNA, 19 nt, Chlamydia trachomatis
cggauaggcugaggauucc

SEQ ID NO: 2508505 - RNA, 15 nt, Chlamydia trachomatis
cggaucaauccccaa

SEQ ID NO: 2508506 - RNA, 20 nt, Chlamydia trachomatis
cggaucgagaagagccauca

SEQ ID NO: 2508507 - RNA, 20 nt, Chlamydia trachomatis
cggaugaggaauccucuucc

SEQ ID NO: 2508508 - RNA, 13 nt, Chlamydia trachomatis
cggauucaucaaa

SEQ ID NO: 2508509 - RNA, 18 nt, Chlamydia trachomatis
cggcaaaagaucucauag

SEQ ID NO: 2508510 - RNA, 16 nt, Chlamydia trachomatis
cggcaagacucuuuca

SEQ ID NO: 2508511 - RNA, 19 nt, Chlamydia trachomatis
cggcacucaaauuucucua

SEQ ID NO: 2508512 - RNA, 16 nt, Chlamydia trachomatis
cggccauccacgcaaa

SEQ ID NO: 2508513 - RNA, 22 nt, Chlamydia trachomatis
cggcuacccccuucuccuuuuu

SEQ ID NO: 2508514 - RNA, 21 nt, Chlamydia trachomatis
cggcuuuucuauuucauuuaa

SEQ ID NO: 2508515 - RNA, 19 nt, Chlamydia trachomatis
cgggauauguuaaagccca

SEQ ID NO: 2508516 - RNA, 23 nt, Chlamydia trachomatis
cgggggagcugauguaagcgaga

SEQ ID NO: 2508517 - RNA, 13 nt, Chlamydia trachomatis
cgguaaacaaugc

SEQ ID NO: 2508518 - RNA, 22 nt, Chlamydia trachomatis
cgguaauagaaguuacuuuucu

SEQ ID NO: 2508519 - RNA, 14 nt, Chlamydia trachomatis
cgguacaggcauuu

SEQ ID NO: 2508520 - RNA, 14 nt, Chlamydia trachomatis
cgguaccugcuucu

SEQ ID NO: 2508521 - RNA, 18 nt, Chlamydia trachomatis
cgguagcgauuuucugaa

SEQ ID NO: 2508522 - RNA, 20 nt, Chlamydia trachomatis
cgguauauguauaccgcgua

SEQ ID NO: 2508523 - RNA, 22 nt, Chlamydia trachomatis
cgguauauucuucaccuuuucc

SEQ ID NO: 2508524 - RNA, 12 nt, Chlamydia trachomatis
cgguauuaauaa

SEQ ID NO: 2508525 - RNA, 20 nt, Chlamydia trachomatis
cggucgacagcguuuucccc

SEQ ID NO: 2508526 - RNA, 22 nt, Chlamydia trachomatis
cggucgacagcguuuuccccuu

SEQ ID NO: 2508527 - RNA, 12 nt, Chlamydia trachomatis
cggucuacaaau

SEQ ID NO: 2508528 - RNA, 14 nt, Chlamydia trachomatis
cggucuauggcaaa

SEQ ID NO: 2508529 - RNA, 18 nt, Chlamydia trachomatis
cggucuauggcaaaaggu

SEQ ID NO: 2508530 - RNA, 15 nt, Chlamydia trachomatis
cggugaggaaggcug

SEQ ID NO: 2508531 - RNA, 20 nt, Chlamydia trachomatis
cgguuugauuuccucuucuu

SEQ ID NO: 2508532 - RNA, 16 nt, Chlamydia trachomatis
cguaaaccuucuugaa

SEQ ID NO: 2508533 - RNA, 21 nt, Chlamydia trachomatis
cguaaccagcggcaaaaauau

SEQ ID NO: 2508534 - RNA, 14 nt, Chlamydia trachomatis
cguaaugaucagca

SEQ ID NO: 2508535 - RNA, 16 nt, Chlamydia trachomatis
cguacuuuaggagaaa

SEQ ID NO: 2508536 - RNA, 16 nt, Chlamydia trachomatis
cguagaauuucuucuu

SEQ ID NO: 2508537 - RNA, 17 nt, Chlamydia trachomatis
cguagagaucuucugaa

SEQ ID NO: 2508538 - RNA, 16 nt, Chlamydia trachomatis
cguaucccugcauaau

SEQ ID NO: 2508539 - RNA, 16 nt, Chlamydia trachomatis
cguaugcgcccaucaa

SEQ ID NO: 2508540 - RNA, 18 nt, Chlamydia trachomatis
cguauuaucugcaaccca

SEQ ID NO: 2508541 - RNA, 21 nt, Chlamydia trachomatis
cguauuuuuuacgcucuuucu

SEQ ID NO: 2508542 - RNA, 16 nt, Chlamydia trachomatis
cgucaaaaagaucuuc

SEQ ID NO: 2508543 - RNA, 13 nt, Chlamydia trachomatis
cgucaaagaagua

SEQ ID NO: 2508544 - RNA, 21 nt, Chlamydia trachomatis
cgucacgaguucgccccucuu

SEQ ID NO: 2508545 - RNA, 13 nt, Chlamydia trachomatis
cguccaaaaagcg

SEQ ID NO: 2508546 - RNA, 16 nt, Chlamydia trachomatis
cguccaaaaucaucaa

SEQ ID NO: 2508547 - RNA, 15 nt, Chlamydia trachomatis
cgucguacuccucgu

SEQ ID NO: 2508548 - RNA, 16 nt, Chlamydia trachomatis
cgucgucguacuccuc

SEQ ID NO: 2508549 - RNA, 19 nt, Chlamydia trachomatis
cgucuagcgcauaaguaaa

SEQ ID NO: 2508550 - RNA, 19 nt, Chlamydia trachomatis
cgucuccaaaaguguuuag

SEQ ID NO: 2508551 - RNA, 19 nt, Chlamydia trachomatis
cgucucuugucagaagagg

SEQ ID NO: 2508552 - RNA, 12 nt, Chlamydia trachomatis
cgucugcauaaa

SEQ ID NO: 2508553 - RNA, 22 nt, Chlamydia trachomatis
cgucuguauaacaauuuuaaaa

SEQ ID NO: 2508554 - RNA, 16 nt, Chlamydia trachomatis
cgucuguggagauaau

SEQ ID NO: 2508555 - RNA, 17 nt, Chlamydia trachomatis
cgugacgaauaaucaau

SEQ ID NO: 2508556 - RNA, 16 nt, Chlamydia trachomatis
cgugagcgucuuuuca

SEQ ID NO: 2508557 - RNA, 17 nt, Chlamydia trachomatis
cgugaggaaguucugcu

SEQ ID NO: 2508558 - RNA, 20 nt, Chlamydia trachomatis
cgugaggaaguucugcugcc

SEQ ID NO: 2508559 - RNA, 16 nt, Chlamydia trachomatis
cguggaauuugacucu

SEQ ID NO: 2508560 - RNA, 22 nt, Chlamydia trachomatis
cgugugaccaucuucaccaacu

SEQ ID NO: 2508561 - RNA, 16 nt, Chlamydia trachomatis
cguuaaugcuaaggag

SEQ ID NO: 2508562 - RNA, 22 nt, Chlamydia trachomatis
cguuaauuaauaagccuuugcu

SEQ ID NO: 2508563 - RNA, 11 nt, Chlamydia trachomatis
cguuacagaug

SEQ ID NO: 2508564 - RNA, 22 nt, Chlamydia trachomatis
cguuacuucuugcgaugccucu

SEQ ID NO: 2508565 - RNA, 22 nt, Chlamydia trachomatis
cguuagaacuauucuugcggaa

SEQ ID NO: 2508566 - RNA, 17 nt, Chlamydia trachomatis
cguuagcaucaucccca

SEQ ID NO: 2508567 - RNA, 15 nt, Chlamydia trachomatis
cguuaggccauuuca

SEQ ID NO: 2508568 - RNA, 20 nt, Chlamydia trachomatis
cguuaugagcauuugccaau

SEQ ID NO: 2508569 - RNA, 21 nt, Chlamydia trachomatis
cguucgguaaguccgcagaga

SEQ ID NO: 2508570 - RNA, 15 nt, Chlamydia trachomatis
cguucuugacaaaac

SEQ ID NO: 2508571 - RNA, 19 nt, Chlamydia trachomatis
cguuguagagauaaaauca

SEQ ID NO: 2508572 - RNA, 15 nt, Chlamydia trachomatis
cguuuagcagccuga

SEQ ID NO: 2508573 - RNA, 16 nt, Chlamydia trachomatis
cguuuagccuccaucu

SEQ ID NO: 2508574 - RNA, 21 nt, Chlamydia trachomatis
cguuuaucuaauuuuagauaa

SEQ ID NO: 2508575 - RNA, 20 nt, Chlamydia trachomatis
cguuucguaguuuucuucgg

SEQ ID NO: 2508576 - RNA, 11 nt, Chlamydia trachomatis
cguuucuuagg

SEQ ID NO: 2508577 - RNA, 12 nt, Chlamydia trachomatis
cguuuuccccuu

SEQ ID NO: 2508578 - RNA, 11 nt, Chlamydia trachomatis
cguuuucuagu

SEQ ID NO: 2508579 - RNA, 14 nt, Chlamydia trachomatis
cguuuucucuugaa

SEQ ID NO: 2508580 - RNA, 14 nt, Chlamydia trachomatis
cuaaaaaauuuuga

SEQ ID NO: 2508581 - RNA, 13 nt, Chlamydia trachomatis
cuaaaaacucuuu

SEQ ID NO: 2508582 - RNA, 18 nt, Chlamydia trachomatis
cuaaaaacucuuuuucua

SEQ ID NO: 2508583 - RNA, 12 nt, Chlamydia trachomatis
cuaaaaagccau

SEQ ID NO: 2508584 - RNA, 18 nt, Chlamydia trachomatis
cuaaaaagccauacaaag

SEQ ID NO: 2508585 - RNA, 12 nt, Chlamydia trachomatis
cuaaaagagcuu

SEQ ID NO: 2508586 - RNA, 21 nt, Chlamydia trachomatis
cuaaaagagcuucuucuaaag

SEQ ID NO: 2508587 - RNA, 21 nt, Chlamydia trachomatis
cuaaaaguuuucgaauuuuuu

SEQ ID NO: 2508588 - RNA, 22 nt, Chlamydia trachomatis
cuaaaaucaccauauccauaac

SEQ ID NO: 2508589 - RNA, 23 nt, Chlamydia trachomatis
cuaaaaucccuaacucuugggca

SEQ ID NO: 2508590 - RNA, 15 nt, Chlamydia trachomatis
cuaaacaaaaacucu

SEQ ID NO: 2508591 - RNA, 19 nt, Chlamydia trachomatis
cuaaacaaaaacucucaaa

SEQ ID NO: 2508592 - RNA, 23 nt, Chlamydia trachomatis
cuaaacaaggauuuucuucuuuu

SEQ ID NO: 2508593 - RNA, 21 nt, Chlamydia trachomatis
cuaaacaagguucuucaacaa

SEQ ID NO: 2508594 - RNA, 14 nt, Chlamydia trachomatis
cuaaacaagucucu

SEQ ID NO: 2508595 - RNA, 16 nt, Chlamydia trachomatis
cuaaacaagucucuga

SEQ ID NO: 2508596 - RNA, 15 nt, Chlamydia trachomatis
cuaaacccucugcau

SEQ ID NO: 2508597 - RNA, 15 nt, Chlamydia trachomatis
cuaaacuaucuaaaa

SEQ ID NO: 2508598 - RNA, 17 nt, Chlamydia trachomatis
cuaaacuaucuaaaauc

SEQ ID NO: 2508599 - RNA, 13 nt, Chlamydia trachomatis
cuaaacuucuugu

SEQ ID NO: 2508600 - RNA, 14 nt, Chlamydia trachomatis
cuaaagaaaagcuu

SEQ ID NO: 2508601 - RNA, 15 nt, Chlamydia trachomatis
cuaaagaaaagcuuu

SEQ ID NO: 2508602 - RNA, 12 nt, Chlamydia trachomatis
cuaaagaagcca

SEQ ID NO: 2508603 - RNA, 19 nt, Chlamydia trachomatis
cuaaagaagccauaguaga

SEQ ID NO: 2508604 - RNA, 20 nt, Chlamydia trachomatis
cuaaagaaucuccuguacac

SEQ ID NO: 2508605 - RNA, 20 nt, Chlamydia trachomatis
cuaaagacaaaacuucuucg

SEQ ID NO: 2508606 - RNA, 13 nt, Chlamydia trachomatis
cuaaagacagcau

SEQ ID NO: 2508607 - RNA, 22 nt, Chlamydia trachomatis
cuaaagagaucucuccagaguu

SEQ ID NO: 2508608 - RNA, 18 nt, Chlamydia trachomatis
cuaaagagccaaaauaua

SEQ ID NO: 2508609 - RNA, 17 nt, Chlamydia trachomatis
cuaaagcacguuuaacu

SEQ ID NO: 2508610 - RNA, 19 nt, Chlamydia trachomatis
cuaaagcacguuuaacuuc

SEQ ID NO: 2508611 - RNA, 23 nt, Chlamydia trachomatis
cuaaagcagaaacagcuucuucu

SEQ ID NO: 2508612 - RNA, 16 nt, Chlamydia trachomatis
cuaaaggaaacaagca

SEQ ID NO: 2508613 - RNA, 16 nt, Chlamydia trachomatis
cuaaaggaaguagaga

SEQ ID NO: 2508614 - RNA, 14 nt, Chlamydia trachomatis
cuaaaggauaagga

SEQ ID NO: 2508615 - RNA, 16 nt, Chlamydia trachomatis
cuaaaggcaacucucu

SEQ ID NO: 2508616 - RNA, 18 nt, Chlamydia trachomatis
cuaaaggcaacucucucu

SEQ ID NO: 2508617 - RNA, 19 nt, Chlamydia trachomatis
cuaaaggugcgauuacuuc

SEQ ID NO: 2508618 - RNA, 14 nt, Chlamydia trachomatis
cuaaagucuccaua

SEQ ID NO: 2508619 - RNA, 16 nt, Chlamydia trachomatis
cuaaagucuccauaag

SEQ ID NO: 2508620 - RNA, 18 nt, Chlamydia trachomatis
cuaaagucuuaaaagggu

SEQ ID NO: 2508621 - RNA, 14 nt, Chlamydia trachomatis
cuaaagucuuucca

SEQ ID NO: 2508622 - RNA, 16 nt, Chlamydia trachomatis
cuaaagucuuuuccuc

SEQ ID NO: 2508623 - RNA, 15 nt, Chlamydia trachomatis
cuaaagugagcccuc

SEQ ID NO: 2508624 - RNA, 14 nt, Chlamydia trachomatis
cuaaaguugguaga

SEQ ID NO: 2508625 - RNA, 15 nt, Chlamydia trachomatis
cuaaauaccucuuuu

SEQ ID NO: 2508626 - RNA, 23 nt, Chlamydia trachomatis
cuaaauaccucuuuuuuucccua

SEQ ID NO: 2508627 - RNA, 22 nt, Chlamydia trachomatis
cuaaauauagguagguuucugc

SEQ ID NO: 2508628 - RNA, 15 nt, Chlamydia trachomatis
cuaaaucuccuccua

SEQ ID NO: 2508629 - RNA, 17 nt, Chlamydia trachomatis
cuaaaucucuuggagag

SEQ ID NO: 2508630 - RNA, 19 nt, Chlamydia trachomatis
cuaaaucucuuggagagaa

SEQ ID NO: 2508631 - RNA, 19 nt, Chlamydia trachomatis
cuaaaugcuguaaaacauu

SEQ ID NO: 2508632 - RNA, 12 nt, Chlamydia trachomatis
cuaaauuuuuaa

SEQ ID NO: 2508633 - RNA, 23 nt, Chlamydia trachomatis
cuaaauuuuuaacgauguacucu

SEQ ID NO: 2508634 - RNA, 18 nt, Chlamydia trachomatis
cuaacaaagcucuagcaa

SEQ ID NO: 2508635 - RNA, 19 nt, Chlamydia trachomatis
cuaacaacaguucuucaua

SEQ ID NO: 2508636 - RNA, 15 nt, Chlamydia trachomatis
cuaacacaagcagac

SEQ ID NO: 2508637 - RNA, 22 nt, Chlamydia trachomatis
cuaacagcucuucuucugaaga

SEQ ID NO: 2508638 - RNA, 22 nt, Chlamydia trachomatis
cuaacaugcucaacauuagaau

SEQ ID NO: 2508639 - RNA, 16 nt, Chlamydia trachomatis
cuaaccaaaaaaaggc

SEQ ID NO: 2508640 - RNA, 17 nt, Chlamydia trachomatis
cuaaccaaguuuuuuuc

SEQ ID NO: 2508641 - RNA, 14 nt, Chlamydia trachomatis
cuaacccuaaaaaa

SEQ ID NO: 2508642 - RNA, 20 nt, Chlamydia trachomatis
cuaacccuuguacagcgaca

SEQ ID NO: 2508643 - RNA, 17 nt, Chlamydia trachomatis
cuaaccgguaaucaaag

SEQ ID NO: 2508644 - RNA, 20 nt, Chlamydia trachomatis
cuaacgaacgggaaaugcug

SEQ ID NO: 2508645 - RNA, 17 nt, Chlamydia trachomatis
cuaacgaggcacaaaau

SEQ ID NO: 2508646 - RNA, 15 nt, Chlamydia trachomatis
cuaacgauuccccga

SEQ ID NO: 2508647 - RNA, 13 nt, Chlamydia trachomatis
cuaacgcuucuuc

SEQ ID NO: 2508648 - RNA, 15 nt, Chlamydia trachomatis
cuaacgcuucuucug

SEQ ID NO: 2508649 - RNA, 17 nt, Chlamydia trachomatis
cuaacguuccuccucca

SEQ ID NO: 2508650 - RNA, 15 nt, Chlamydia trachomatis
cuaacuaccauccgg

SEQ ID NO: 2508651 - RNA, 15 nt, Chlamydia trachomatis
cuaacucaccuaaau

SEQ ID NO: 2508652 - RNA, 13 nt, Chlamydia trachomatis
cuaacucuugaaa

SEQ ID NO: 2508653 - RNA, 15 nt, Chlamydia trachomatis
cuaacuuaauaaggg

SEQ ID NO: 2508654 - RNA, 13 nt, Chlamydia trachomatis
cuaacuugcagga

SEQ ID NO: 2508655 - RNA, 14 nt, Chlamydia trachomatis
cuaacuuucuucca

SEQ ID NO: 2508656 - RNA, 12 nt, Chlamydia trachomatis
cuaagaaaauaa

SEQ ID NO: 2508657 - RNA, 19 nt, Chlamydia trachomatis
cuaagaaagguuuuucuua

SEQ ID NO: 2508658 - RNA, 14 nt, Chlamydia trachomatis
cuaagaaccacaac

SEQ ID NO: 2508659 - RNA, 20 nt, Chlamydia trachomatis
cuaagacuaucccggaggca

SEQ ID NO: 2508660 - RNA, 14 nt, Chlamydia trachomatis
cuaagacuuucucu

SEQ ID NO: 2508661 - RNA, 16 nt, Chlamydia trachomatis
cuaagacuuucucuaa

SEQ ID NO: 2508662 - RNA, 17 nt, Chlamydia trachomatis
cuaagaugguugcucuu

SEQ ID NO: 2508663 - RNA, 16 nt, Chlamydia trachomatis
cuaagcgcaagaaacu

SEQ ID NO: 2508664 - RNA, 18 nt, Chlamydia trachomatis
cuaagcuagaaaauagca

SEQ ID NO: 2508665 - RNA, 15 nt, Chlamydia trachomatis
cuaagcuucucaaca

SEQ ID NO: 2508666 - RNA, 23 nt, Chlamydia trachomatis
cuaaggagcaugguauucuaaag

SEQ ID NO: 2508667 - RNA, 21 nt, Chlamydia trachomatis
cuaaggcaugagauauagucg

SEQ ID NO: 2508668 - RNA, 21 nt, Chlamydia trachomatis
cuaagucuguugccugcaaag

SEQ ID NO: 2508669 - RNA, 15 nt, Chlamydia trachomatis
cuaagugcaucauuu

SEQ ID NO: 2508670 - RNA, 19 nt, Chlamydia trachomatis
cuaagugcaucauuuugua

SEQ ID NO: 2508671 - RNA, 23 nt, Chlamydia trachomatis
cuaauaaaagggcucucuccuaa

SEQ ID NO: 2508672 - RNA, 18 nt, Chlamydia trachomatis
cuaauaaacagaucuuuu

SEQ ID NO: 2508673 - RNA, 22 nt, Chlamydia trachomatis
cuaauaaacagaucuuuuucau

SEQ ID NO: 2508674 - RNA, 17 nt, Chlamydia trachomatis
cuaauaacccgcuuuga

SEQ ID NO: 2508675 - RNA, 14 nt, Chlamydia trachomatis
cuaauaaguucacu

SEQ ID NO: 2508676 - RNA, 15 nt, Chlamydia trachomatis
cuaauaauacagauu

SEQ ID NO: 2508677 - RNA, 18 nt, Chlamydia trachomatis
cuaauaauacagauuuuu

SEQ ID NO: 2508678 - RNA, 21 nt, Chlamydia trachomatis
cuaauaauacagauuuuucga

SEQ ID NO: 2508679 - RNA, 23 nt, Chlamydia trachomatis
cuaauacuaaacuaucuaaaauc

SEQ ID NO: 2508680 - RNA, 11 nt, Chlamydia trachomatis
cuaauagcuug

SEQ ID NO: 2508681 - RNA, 15 nt, Chlamydia trachomatis
cuaauaguucucugc

SEQ ID NO: 2508682 - RNA, 19 nt, Chlamydia trachomatis
cuaauaguucucugcauag

SEQ ID NO: 2508683 - RNA, 18 nt, Chlamydia trachomatis
cuaauaucucaggauaaa

SEQ ID NO: 2508684 - RNA, 23 nt, Chlamydia trachomatis
cuaauaucucaggauaaaacccu

SEQ ID NO: 2508685 - RNA, 16 nt, Chlamydia trachomatis
cuaauaucugcucuaa

SEQ ID NO: 2508686 - RNA, 14 nt, Chlamydia trachomatis
cuaauaugcagggc

SEQ ID NO: 2508687 - RNA, 21 nt, Chlamydia trachomatis
cuaauauuagauagcuucuua

SEQ ID NO: 2508688 - RNA, 20 nt, Chlamydia trachomatis
cuaaucaugaugaugagagc

SEQ ID NO: 2508689 - RNA, 20 nt, Chlamydia trachomatis
cuaauccaugcaucuccucu

SEQ ID NO: 2508690 - RNA, 18 nt, Chlamydia trachomatis
cuaaucgaauuacucugc

SEQ ID NO: 2508691 - RNA, 20 nt, Chlamydia trachomatis
cuaaucuuuuugauuuuucu

SEQ ID NO: 2508692 - RNA, 14 nt, Chlamydia trachomatis
cuaaugagcagaau

SEQ ID NO: 2508693 - RNA, 19 nt, Chlamydia trachomatis
cuaaugcuuuguagauacu

SEQ ID NO: 2508694 - RNA, 14 nt, Chlamydia trachomatis
cuaauguagaaauu

SEQ ID NO: 2508695 - RNA, 15 nt, Chlamydia trachomatis
cuaauuccccaauga

SEQ ID NO: 2508696 - RNA, 14 nt, Chlamydia trachomatis
cuaauucuagcaac

SEQ ID NO: 2508697 - RNA, 14 nt, Chlamydia trachomatis
cuaauugaaacagu

SEQ ID NO: 2508698 - RNA, 17 nt, Chlamydia trachomatis
cuaauuucuuucucaug

SEQ ID NO: 2508699 - RNA, 19 nt, Chlamydia trachomatis
cuaauuuuagauaaaagaa

SEQ ID NO: 2508700 - RNA, 13 nt, Chlamydia trachomatis
cuaauuuuugaga

SEQ ID NO: 2508701 - RNA, 20 nt, Chlamydia trachomatis
cuaauuuuugagagagcuua

SEQ ID NO: 2508702 - RNA, 15 nt, Chlamydia trachomatis
cuacaaaaccaaaau

SEQ ID NO: 2508703 - RNA, 20 nt, Chlamydia trachomatis
cuacaaaacgcucuuuuucu

SEQ ID NO: 2508704 - RNA, 15 nt, Chlamydia trachomatis
cuacaaacauccuua

SEQ ID NO: 2508705 - RNA, 22 nt, Chlamydia trachomatis
cuacaagggugcuaacuuucuu

SEQ ID NO: 2508706 - RNA, 16 nt, Chlamydia trachomatis
cuacacaucuguaucc

SEQ ID NO: 2508707 - RNA, 13 nt, Chlamydia trachomatis
cuacaccagaucc

SEQ ID NO: 2508708 - RNA, 14 nt, Chlamydia trachomatis
cuacaccauaaaac

SEQ ID NO: 2508709 - RNA, 16 nt, Chlamydia trachomatis
cuacacgauauaucca

SEQ ID NO: 2508710 - RNA, 12 nt, Chlamydia trachomatis
cuacagaaucag

SEQ ID NO: 2508711 - RNA, 21 nt, Chlamydia trachomatis
cuacagaguuaacuauuucug

SEQ ID NO: 2508712 - RNA, 17 nt, Chlamydia trachomatis
cuacagccuccucuaca

SEQ ID NO: 2508713 - RNA, 16 nt, Chlamydia trachomatis
cuacagcuagcucucc

SEQ ID NO: 2508714 - RNA, 19 nt, Chlamydia trachomatis
cuacagcuguauuuacagc

SEQ ID NO: 2508715 - RNA, 23 nt, Chlamydia trachomatis
cuacaggauccgcaccaaucacc

SEQ ID NO: 2508716 - RNA, 15 nt, Chlamydia trachomatis
cuacagguuguuccu

SEQ ID NO: 2508717 - RNA, 22 nt, Chlamydia trachomatis
cuacauaagucucuugccuuua

SEQ ID NO: 2508718 - RNA, 16 nt, Chlamydia trachomatis
cuacauuguaaauaga

SEQ ID NO: 2508719 - RNA, 19 nt, Chlamydia trachomatis
cuaccacgagcauaagaau

SEQ ID NO: 2508720 - RNA, 17 nt, Chlamydia trachomatis
cuaccauccgggaauga

SEQ ID NO: 2508721 - RNA, 21 nt, Chlamydia trachomatis
cuaccuagugauuuuaaacca

SEQ ID NO: 2508722 - RNA, 22 nt, Chlamydia trachomatis
cuaccucuaaagauccucuuuc

SEQ ID NO: 2508723 - RNA, 22 nt, Chlamydia trachomatis
cuaccuguuguguaucaaaauc

SEQ ID NO: 2508724 - RNA, 13 nt, Chlamydia trachomatis
cuaccuuuuuccc

SEQ ID NO: 2508725 - RNA, 21 nt, Chlamydia trachomatis
cuacgagcugaccuuuuacuu

SEQ ID NO: 2508726 - RNA, 23 nt, Chlamydia trachomatis
cuacuauccgaagcugcaauaga

SEQ ID NO: 2508727 - RNA, 14 nt, Chlamydia trachomatis
cuacucaacaaauu

SEQ ID NO: 2508728 - RNA, 14 nt, Chlamydia trachomatis
cuacucaauccuuu

SEQ ID NO: 2508729 - RNA, 19 nt, Chlamydia trachomatis
cuacuccaauggaaauaag

SEQ ID NO: 2508730 - RNA, 16 nt, Chlamydia trachomatis
cuacucccaaaucaaa

SEQ ID NO: 2508731 - RNA, 21 nt, Chlamydia trachomatis
cuacucguucuauaggaaagg

SEQ ID NO: 2508732 - RNA, 15 nt, Chlamydia trachomatis
cuacucuuccuugau

SEQ ID NO: 2508733 - RNA, 17 nt, Chlamydia trachomatis
cuacugucgaacgcuuc

SEQ ID NO: 2508734 - RNA, 18 nt, Chlamydia trachomatis
cuacuucuggaggaguau

SEQ ID NO: 2508735 - RNA, 19 nt, Chlamydia trachomatis
cuacuuucccuauuuuuuc

SEQ ID NO: 2508736 - RNA, 18 nt, Chlamydia trachomatis
cuacuuucgcuuuugcug

SEQ ID NO: 2508737 - RNA, 15 nt, Chlamydia trachomatis
cuagaaaagagcagc

SEQ ID NO: 2508738 - RNA, 21 nt, Chlamydia trachomatis
cuagaaagaaccacaaaauca

SEQ ID NO: 2508739 - RNA, 10 nt, Chlamydia trachomatis
cuagaagaag

SEQ ID NO: 2508740 - RNA, 12 nt, Chlamydia trachomatis
cuagaagaagag

SEQ ID NO: 2508741 - RNA, 15 nt, Chlamydia trachomatis
cuagaagaccaaaaa

SEQ ID NO: 2508742 - RNA, 16 nt, Chlamydia trachomatis
cuagaagaccaaaaau

SEQ ID NO: 2508743 - RNA, 13 nt, Chlamydia trachomatis
cuagaauagcagc

SEQ ID NO: 2508744 - RNA, 19 nt, Chlamydia trachomatis
cuagacaaacaccuauggg

SEQ ID NO: 2508745 - RNA, 19 nt, Chlamydia trachomatis
cuagacguuuagccuccau

SEQ ID NO: 2508746 - RNA, 21 nt, Chlamydia trachomatis
cuagacguuuagccuccaucu

SEQ ID NO: 2508747 - RNA, 20 nt, Chlamydia trachomatis
cuagagauaucacuaccagc

SEQ ID NO: 2508748 - RNA, 21 nt, Chlamydia trachomatis
cuagagauaucacuaccagcc

SEQ ID NO: 2508749 - RNA, 21 nt, Chlamydia trachomatis
cuagauacaauaguaccuuca

SEQ ID NO: 2508750 - RNA, 22 nt, Chlamydia trachomatis
cuagauacaauaguaccuucaa

SEQ ID NO: 2508751 - RNA, 15 nt, Chlamydia trachomatis
cuagauauaaauuug

SEQ ID NO: 2508752 - RNA, 17 nt, Chlamydia trachomatis
cuagauccguuuuucua

SEQ ID NO: 2508753 - RNA, 13 nt, Chlamydia trachomatis
cuagcaaacgaag

SEQ ID NO: 2508754 - RNA, 21 nt, Chlamydia trachomatis
cuagcaaauucgcuaccaaaa

SEQ ID NO: 2508755 - RNA, 14 nt, Chlamydia trachomatis
cuagcaauagagau

SEQ ID NO: 2508756 - RNA, 19 nt, Chlamydia trachomatis
cuagcagcucuuacuccua

SEQ ID NO: 2508757 - RNA, 20 nt, Chlamydia trachomatis
cuagccuggcugcagaagac

SEQ ID NO: 2508758 - RNA, 19 nt, Chlamydia trachomatis
cuagcgacugcugcagaaa

SEQ ID NO: 2508759 - RNA, 18 nt, Chlamydia trachomatis
cuagcuguaaauguucau

SEQ ID NO: 2508760 - RNA, 12 nt, Chlamydia trachomatis
cuagcuuuccuc

SEQ ID NO: 2508761 - RNA, 14 nt, Chlamydia trachomatis
cuaggaauaucaaa

SEQ ID NO: 2508762 - RNA, 19 nt, Chlamydia trachomatis
cuaggagcauuccuucuau

SEQ ID NO: 2508763 - RNA, 21 nt, Chlamydia trachomatis
cuaggaucccaaggaaauaaa

SEQ ID NO: 2508764 - RNA, 22 nt, Chlamydia trachomatis
cuaggauuacagcaagaagaag

SEQ ID NO: 2508765 - RNA, 21 nt, Chlamydia trachomatis
cuaggcaaauauccuaaauua

SEQ ID NO: 2508766 - RNA, 20 nt, Chlamydia trachomatis
cuaggcgacacgcuucuuca

SEQ ID NO: 2508767 - RNA, 17 nt, Chlamydia trachomatis
cuaggcucaugagccuc

SEQ ID NO: 2508768 - RNA, 23 nt, Chlamydia trachomatis
cuaggggaagaaucaauauccac

SEQ ID NO: 2508769 - RNA, 18 nt, Chlamydia trachomatis
cuaggguguauugguuau

SEQ ID NO: 2508770 - RNA, 17 nt, Chlamydia trachomatis
cuaggguucuaaagaaa

SEQ ID NO: 2508771 - RNA, 18 nt, Chlamydia trachomatis
cuaggguugugaaaaaaa

SEQ ID NO: 2508772 - RNA, 19 nt, Chlamydia trachomatis
cuagguaucgaaaguaaaa

SEQ ID NO: 2508773 - RNA, 13 nt, Chlamydia trachomatis
cuaggucucccag

SEQ ID NO: 2508774 - RNA, 15 nt, Chlamydia trachomatis
cuaggucucccuagc

SEQ ID NO: 2508775 - RNA, 14 nt, Chlamydia trachomatis
cuaguaaugugucu

SEQ ID NO: 2508776 - RNA, 17 nt, Chlamydia trachomatis
cuaguacaaaaauacuu

SEQ ID NO: 2508777 - RNA, 17 nt, Chlamydia trachomatis
cuaguauuaaacuucaa

SEQ ID NO: 2508778 - RNA, 19 nt, Chlamydia trachomatis
cuagugauuuuaaaccaau

SEQ ID NO: 2508779 - RNA, 18 nt, Chlamydia trachomatis
cuaguguuuguacacagg

SEQ ID NO: 2508780 - RNA, 17 nt, Chlamydia trachomatis
cuaguuauauugcuuca

SEQ ID NO: 2508781 - RNA, 17 nt, Chlamydia trachomatis
cuaguuuacgcacuucu

SEQ ID NO: 2508782 - RNA, 18 nt, Chlamydia trachomatis
cuaguuugguuuuuuuug

SEQ ID NO: 2508783 - RNA, 21 nt, Chlamydia trachomatis
cuauaaaugaaaccccucuuu

SEQ ID NO: 2508784 - RNA, 11 nt, Chlamydia trachomatis
cuauaacauuc

SEQ ID NO: 2508785 - RNA, 22 nt, Chlamydia trachomatis
cuauacaagugacauuuccaac

SEQ ID NO: 2508786 - RNA, 12 nt, Chlamydia trachomatis
cuauacagcauc

SEQ ID NO: 2508787 - RNA, 20 nt, Chlamydia trachomatis
cuauacccgacuaaaaaauu

SEQ ID NO: 2508788 - RNA, 16 nt, Chlamydia trachomatis
cuauaccuaaaaguuu

SEQ ID NO: 2508789 - RNA, 14 nt, Chlamydia trachomatis
cuauaccuuccaua

SEQ ID NO: 2508790 - RNA, 20 nt, Chlamydia trachomatis
cuauacggagaucugacuga

SEQ ID NO: 2508791 - RNA, 16 nt, Chlamydia trachomatis
cuauaggaauagccuc

SEQ ID NO: 2508792 - RNA, 16 nt, Chlamydia trachomatis
cuauauguaagaagcu

SEQ ID NO: 2508793 - RNA, 19 nt, Chlamydia trachomatis
cuauauuuguguacuuuug

SEQ ID NO: 2508794 - RNA, 11 nt, Chlamydia trachomatis
cuaucaauaaa

SEQ ID NO: 2508795 - RNA, 21 nt, Chlamydia trachomatis
cuaucagcgcucauaggacaa

SEQ ID NO: 2508796 - RNA, 19 nt, Chlamydia trachomatis
cuaucaggaauaaugauuu

SEQ ID NO: 2508797 - RNA, 15 nt, Chlamydia trachomatis
cuaucaucgcacagc

SEQ ID NO: 2508798 - RNA, 20 nt, Chlamydia trachomatis
cuaucauugagcaaaaaaag

SEQ ID NO: 2508799 - RNA, 15 nt, Chlamydia trachomatis
cuaucauuuccaaaa

SEQ ID NO: 2508800 - RNA, 16 nt, Chlamydia trachomatis
cuaucauuuccaaaau

SEQ ID NO: 2508801 - RNA, 23 nt, Chlamydia trachomatis
cuaucccggaggcaacaaauaac

SEQ ID NO: 2508802 - RNA, 20 nt, Chlamydia trachomatis
cuauccggaguaccaaaaaa

SEQ ID NO: 2508803 - RNA, 20 nt, Chlamydia trachomatis
cuaucgcggcuaucgucuuu

SEQ ID NO: 2508804 - RNA, 17 nt, Chlamydia trachomatis
cuaucucgccaaccaua

SEQ ID NO: 2508805 - RNA, 14 nt, Chlamydia trachomatis
cuaucuuucuuagu

SEQ ID NO: 2508806 - RNA, 15 nt, Chlamydia trachomatis
cuaugaaaaauccuu

SEQ ID NO: 2508807 - RNA, 21 nt, Chlamydia trachomatis
cuaugaaaaauccuuccauau

SEQ ID NO: 2508808 - RNA, 17 nt, Chlamydia trachomatis
cuaugaacaaacagcug

SEQ ID NO: 2508809 - RNA, 14 nt, Chlamydia trachomatis
cuaugagaagaaag

SEQ ID NO: 2508810 - RNA, 21 nt, Chlamydia trachomatis
cuaugaucacaugaucauagu

SEQ ID NO: 2508811 - RNA, 15 nt, Chlamydia trachomatis
cuaugcaaaguuucu

SEQ ID NO: 2508812 - RNA, 20 nt, Chlamydia trachomatis
cuaugcgcggaaggaaaaag

SEQ ID NO: 2508813 - RNA, 16 nt, Chlamydia trachomatis
cuaugcgugucacaga

SEQ ID NO: 2508814 - RNA, 20 nt, Chlamydia trachomatis
cuaugcucacaaaccaaaac

SEQ ID NO: 2508815 - RNA, 17 nt, Chlamydia trachomatis
cuauggguaugugggcu

SEQ ID NO: 2508816 - RNA, 21 nt, Chlamydia trachomatis
cuauguaaaaaaucuugucgu

SEQ ID NO: 2508817 - RNA, 19 nt, Chlamydia trachomatis
cuauguaaaaauucuaaag

SEQ ID NO: 2508818 - RNA, 19 nt, Chlamydia trachomatis
cuauguuuacugacaaggc

SEQ ID NO: 2508819 - RNA, 14 nt, Chlamydia trachomatis
cuauuagauugcga

SEQ ID NO: 2508820 - RNA, 13 nt, Chlamydia trachomatis
cuauucgcaguau

SEQ ID NO: 2508821 - RNA, 19 nt, Chlamydia trachomatis
cuauucguguccucuauuu

SEQ ID NO: 2508822 - RNA, 14 nt, Chlamydia trachomatis
cuauugauuuuuuc

SEQ ID NO: 2508823 - RNA, 15 nt, Chlamydia trachomatis
cuauugauuuuuucg

SEQ ID NO: 2508824 - RNA, 15 nt, Chlamydia trachomatis
cuauuuaggcuaacu

SEQ ID NO: 2508825 - RNA, 19 nt, Chlamydia trachomatis
cuauuuaggcuaacuccau

SEQ ID NO: 2508826 - RNA, 21 nt, Chlamydia trachomatis
cuauuucgaucuuaccaaaau

SEQ ID NO: 2508827 - RNA, 15 nt, Chlamydia trachomatis
cuauuucuucgcaua

SEQ ID NO: 2508828 - RNA, 21 nt, Chlamydia trachomatis
cuauuucuucuagauagagau

SEQ ID NO: 2508829 - RNA, 22 nt, Chlamydia trachomatis
cuauuucuucuagauagagauu

SEQ ID NO: 2508830 - RNA, 17 nt, Chlamydia trachomatis
cuauuuucaaaaccuug

SEQ ID NO: 2508831 - RNA, 19 nt, Chlamydia trachomatis
cuauuuucaaaaccuugau

SEQ ID NO: 2508832 - RNA, 14 nt, Chlamydia trachomatis
cuauuuuccucuuc

SEQ ID NO: 2508833 - RNA, 17 nt, Chlamydia trachomatis
cuauuuucuuccugcuu

SEQ ID NO: 2508834 - RNA, 18 nt, Chlamydia trachomatis
cuauuuucuuccugcuuc

SEQ ID NO: 2508835 - RNA, 22 nt, Chlamydia trachomatis
cucaaaaacacuacgcuacaga

SEQ ID NO: 2508836 - RNA, 18 nt, Chlamydia trachomatis
cucaaaacgcucuccaaa

SEQ ID NO: 2508837 - RNA, 18 nt, Chlamydia trachomatis
cucaaaagaacuuccuau

SEQ ID NO: 2508838 - RNA, 14 nt, Chlamydia trachomatis
cucaaaagcuuuuc

SEQ ID NO: 2508839 - RNA, 15 nt, Chlamydia trachomatis
cucaaacaaucuaaa

SEQ ID NO: 2508840 - RNA, 17 nt, Chlamydia trachomatis
cucaaacaaucuaaaaa

SEQ ID NO: 2508841 - RNA, 19 nt, Chlamydia trachomatis
cucaaacaaucuaaaaaau

SEQ ID NO: 2508842 - RNA, 16 nt, Chlamydia trachomatis
cucaaacugugaagaa

SEQ ID NO: 2508843 - RNA, 19 nt, Chlamydia trachomatis
cucaaacugugaagaauga

SEQ ID NO: 2508844 - RNA, 23 nt, Chlamydia trachomatis
cucaaaguuuuuguuuuuuucaa

SEQ ID NO: 2508845 - RNA, 16 nt, Chlamydia trachomatis
cucaaaucacugagag

SEQ ID NO: 2508846 - RNA, 13 nt, Chlamydia trachomatis
cucaaauuucucu

SEQ ID NO: 2508847 - RNA, 16 nt, Chlamydia trachomatis
cucaaauuuucaugaa

SEQ ID NO: 2508848 - RNA, 17 nt, Chlamydia trachomatis
cucaacgccuguuagua

SEQ ID NO: 2508849 - RNA, 16 nt, Chlamydia trachomatis
cucaacgcucaacucg

SEQ ID NO: 2508850 - RNA, 20 nt, Chlamydia trachomatis
cucaacgucuugucucucga

SEQ ID NO: 2508851 - RNA, 22 nt, Chlamydia trachomatis
cucaacuccagagcaaauagaa

SEQ ID NO: 2508852 - RNA, 18 nt, Chlamydia trachomatis
cucaacucgcuccagaac

SEQ ID NO: 2508853 - RNA, 22 nt, Chlamydia trachomatis
cucaaguucauugguaagauuc

SEQ ID NO: 2508854 - RNA, 21 nt, Chlamydia trachomatis
cucaaguugagugcagaggau

SEQ ID NO: 2508855 - RNA, 12 nt, Chlamydia trachomatis
cucaauagcagc

SEQ ID NO: 2508856 - RNA, 15 nt, Chlamydia trachomatis
cucaauagcagcauu

SEQ ID NO: 2508857 - RNA, 19 nt, Chlamydia trachomatis
cucaaucaccacgagaucu

SEQ ID NO: 2508858 - RNA, 16 nt, Chlamydia trachomatis
cucaaugagcgcuuuu

SEQ ID NO: 2508859 - RNA, 15 nt, Chlamydia trachomatis
cucacaaauaacaga

SEQ ID NO: 2508860 - RNA, 13 nt, Chlamydia trachomatis
cucaccagcuucc

SEQ ID NO: 2508861 - RNA, 19 nt, Chlamydia trachomatis
cucaccuaaauucagaucc

SEQ ID NO: 2508862 - RNA, 14 nt, Chlamydia trachomatis
cucaccucuugccu

SEQ ID NO: 2508863 - RNA, 14 nt, Chlamydia trachomatis
cucagaaucugucu

SEQ ID NO: 2508864 - RNA, 15 nt, Chlamydia trachomatis
cucagaaucugucua

SEQ ID NO: 2508865 - RNA, 17 nt, Chlamydia trachomatis
cucagauucgaauaauc

SEQ ID NO: 2508866 - RNA, 18 nt, Chlamydia trachomatis
cucagauuuaucugcuau

SEQ ID NO: 2508867 - RNA, 14 nt, Chlamydia trachomatis
cucagcagaucauc

SEQ ID NO: 2508868 - RNA, 22 nt, Chlamydia trachomatis
cucagcauagcgcuucccgcua

SEQ ID NO: 2508869 - RNA, 15 nt, Chlamydia trachomatis
cucagcuucaacugg

SEQ ID NO: 2508870 - RNA, 22 nt, Chlamydia trachomatis
cucagcuuccuuggcuuuuaca

SEQ ID NO: 2508871 - RNA, 23 nt, Chlamydia trachomatis
cucagggcuauauguaagaagcu

SEQ ID NO: 2508872 - RNA, 14 nt, Chlamydia trachomatis
cucagguucccuug

SEQ ID NO: 2508873 - RNA, 18 nt, Chlamydia trachomatis
cucaguugguagagcaac

SEQ ID NO: 2508874 - RNA, 17 nt, Chlamydia trachomatis
cucauaagaauacaaag

SEQ ID NO: 2508875 - RNA, 22 nt, Chlamydia trachomatis
cucauaagaauacaaagcagcc

SEQ ID NO: 2508876 - RNA, 22 nt, Chlamydia trachomatis
cucauaagaucuuuacuuucuu

SEQ ID NO: 2508877 - RNA, 19 nt, Chlamydia trachomatis
cucauaagcagggcuguau

SEQ ID NO: 2508878 - RNA, 19 nt, Chlamydia trachomatis
cucauaaggaguuuuaggc

SEQ ID NO: 2508879 - RNA, 20 nt, Chlamydia trachomatis
cucauaccuaaacaaggauu

SEQ ID NO: 2508880 - RNA, 16 nt, Chlamydia trachomatis
cucaucaaauagcaaa

SEQ ID NO: 2508881 - RNA, 17 nt, Chlamydia trachomatis
cucaucaggaucagcau

SEQ ID NO: 2508882 - RNA, 21 nt, Chlamydia trachomatis
cucauccuuuuggaagaucuc

SEQ ID NO: 2508883 - RNA, 20 nt, Chlamydia trachomatis
cucaucgaagcauagggcua

SEQ ID NO: 2508884 - RNA, 16 nt, Chlamydia trachomatis
cucaucuuuuuuaaaa

SEQ ID NO: 2508885 - RNA, 17 nt, Chlamydia trachomatis
cucaucuuuuuuaaaaa

SEQ ID NO: 2508886 - RNA, 18 nt, Chlamydia trachomatis
cucaugaacagcaagagg

SEQ ID NO: 2508887 - RNA, 20 nt, Chlamydia trachomatis
cucaugagccucuaacucuu

SEQ ID NO: 2508888 - RNA, 16 nt, Chlamydia trachomatis
cucaugcacugucuca

SEQ ID NO: 2508889 - RNA, 21 nt, Chlamydia trachomatis
cucaugucuagcuagaagcca

SEQ ID NO: 2508890 - RNA, 16 nt, Chlamydia trachomatis
cucauuaaugacuccc

SEQ ID NO: 2508891 - RNA, 21 nt, Chlamydia trachomatis
cucauuaccauacagacgcau

SEQ ID NO: 2508892 - RNA, 15 nt, Chlamydia trachomatis
cuccaaagaugcucc

SEQ ID NO: 2508893 - RNA, 22 nt, Chlamydia trachomatis
cuccaaagaugcuccuacaaaa

SEQ ID NO: 2508894 - RNA, 21 nt, Chlamydia trachomatis
cuccaaauuguguaagauauu

SEQ ID NO: 2508895 - RNA, 19 nt, Chlamydia trachomatis
cuccaacaauagcgcgaca

SEQ ID NO: 2508896 - RNA, 19 nt, Chlamydia trachomatis
cuccaacacgaaugccugu

SEQ ID NO: 2508897 - RNA, 21 nt, Chlamydia trachomatis
cuccaagaagagucucuaaca

SEQ ID NO: 2508898 - RNA, 18 nt, Chlamydia trachomatis
cuccaagcauuaccauau

SEQ ID NO: 2508899 - RNA, 24 nt, Chlamydia trachomatis
cuccaagcauuaccauaucaaaaa

SEQ ID NO: 2508900 - RNA, 15 nt, Chlamydia trachomatis
cuccaaucacagcaa

SEQ ID NO: 2508901 - RNA, 19 nt, Chlamydia trachomatis
cuccaaucacagcaauagc

SEQ ID NO: 2508902 - RNA, 14 nt, Chlamydia trachomatis
cuccacaagaagua

SEQ ID NO: 2508903 - RNA, 14 nt, Chlamydia trachomatis
cuccaccuucuuug

SEQ ID NO: 2508904 - RNA, 12 nt, Chlamydia trachomatis
cuccagaaaauu

SEQ ID NO: 2508905 - RNA, 18 nt, Chlamydia trachomatis
cuccagaagggaaguuau

SEQ ID NO: 2508906 - RNA, 18 nt, Chlamydia trachomatis
cuccagaguucauuuuuu

SEQ ID NO: 2508907 - RNA, 20 nt, Chlamydia trachomatis
cuccagaguucauuuuuucu

SEQ ID NO: 2508908 - RNA, 14 nt, Chlamydia trachomatis
cuccagauacugcu

SEQ ID NO: 2508909 - RNA, 12 nt, Chlamydia trachomatis
cuccagcuucuc

SEQ ID NO: 2508910 - RNA, 13 nt, Chlamydia trachomatis
cuccagcuucucc

SEQ ID NO: 2508911 - RNA, 17 nt, Chlamydia trachomatis
cuccagcuucuucuaua

SEQ ID NO: 2508912 - RNA, 15 nt, Chlamydia trachomatis
cuccaggagagucug

SEQ ID NO: 2508913 - RNA, 14 nt, Chlamydia trachomatis
cuccauaagaaugu

SEQ ID NO: 2508914 - RNA, 12 nt, Chlamydia trachomatis
cuccauacgcug

SEQ ID NO: 2508915 - RNA, 21 nt, Chlamydia trachomatis
cuccaucaggaauagcuacag

SEQ ID NO: 2508916 - RNA, 19 nt, Chlamydia trachomatis
cuccauccaguugguacac

SEQ ID NO: 2508917 - RNA, 20 nt, Chlamydia trachomatis
cuccaucccggaggaauuga

SEQ ID NO: 2508918 - RNA, 10 nt, Chlamydia trachomatis
cuccaucucg

SEQ ID NO: 2508919 - RNA, 13 nt, Chlamydia trachomatis
cuccaucucugcu

SEQ ID NO: 2508920 - RNA, 15 nt, Chlamydia trachomatis
cuccaucucugcuuc

SEQ ID NO: 2508921 - RNA, 13 nt, Chlamydia trachomatis
cuccaucugacuu

SEQ ID NO: 2508922 - RNA, 12 nt, Chlamydia trachomatis
cuccauuuccau

SEQ ID NO: 2508923 - RNA, 16 nt, Chlamydia trachomatis
cuccauuuccaugaau

SEQ ID NO: 2508924 - RNA, 21 nt, Chlamydia trachomatis
cucccaagaaacuuuucugca

SEQ ID NO: 2508925 - RNA, 18 nt, Chlamydia trachomatis
cucccaauauacaaguau

SEQ ID NO: 2508926 - RNA, 23 nt, Chlamydia trachomatis
cucccauaggcucgccauuauua

SEQ ID NO: 2508927 - RNA, 20 nt, Chlamydia trachomatis
cucccauuuuuaccaaaccu

SEQ ID NO: 2508928 - RNA, 17 nt, Chlamydia trachomatis
cuccccucgaggacagu

SEQ ID NO: 2508929 - RNA, 22 nt, Chlamydia trachomatis
cucccucaccucuugccugcaa

SEQ ID NO: 2508930 - RNA, 18 nt, Chlamydia trachomatis
cucccucauuuaaaaguc

SEQ ID NO: 2508931 - RNA, 11 nt, Chlamydia trachomatis
cucccuccucu

SEQ ID NO: 2508932 - RNA, 16 nt, Chlamydia trachomatis
cucccuccucuuuuuc

SEQ ID NO: 2508933 - RNA, 23 nt, Chlamydia trachomatis
cucccuuuccauacaucaucucu

SEQ ID NO: 2508934 - RNA, 14 nt, Chlamydia trachomatis
cuccgaaaauaccc

SEQ ID NO: 2508935 - RNA, 13 nt, Chlamydia trachomatis
cuccgccuucugc

SEQ ID NO: 2508936 - RNA, 18 nt, Chlamydia trachomatis
cuccgcuaggcaaauauc

SEQ ID NO: 2508937 - RNA, 13 nt, Chlamydia trachomatis
cuccgcuuagaau

SEQ ID NO: 2508938 - RNA, 22 nt, Chlamydia trachomatis
cuccggagaacaguguccuucc

SEQ ID NO: 2508939 - RNA, 20 nt, Chlamydia trachomatis
cuccguggcaagcaacgaaa

SEQ ID NO: 2508940 - RNA, 19 nt, Chlamydia trachomatis
cuccguucaaagcaaacuu

SEQ ID NO: 2508941 - RNA, 15 nt, Chlamydia trachomatis
cuccuaaacaaaugu

SEQ ID NO: 2508942 - RNA, 21 nt, Chlamydia trachomatis
cuccuaaaguaagauuuuuca

SEQ ID NO: 2508943 - RNA, 20 nt, Chlamydia trachomatis
cuccuaaauaccacaauuuu

SEQ ID NO: 2508944 - RNA, 15 nt, Chlamydia trachomatis
cuccuaagcagugaa

SEQ ID NO: 2508945 - RNA, 15 nt, Chlamydia trachomatis
cuccuagaaagaacc

SEQ ID NO: 2508946 - RNA, 21 nt, Chlamydia trachomatis
cuccuagagaaacaaccaucu

SEQ ID NO: 2508947 - RNA, 20 nt, Chlamydia trachomatis
cuccucagcauagcgcuucc

SEQ ID NO: 2508948 - RNA, 12 nt, Chlamydia trachomatis
cuccucgcaagu

SEQ ID NO: 2508949 - RNA, 21 nt, Chlamydia trachomatis
cuccucggacaaacguccucc

SEQ ID NO: 2508950 - RNA, 12 nt, Chlamydia trachomatis
cuccucucucuu

SEQ ID NO: 2508951 - RNA, 22 nt, Chlamydia trachomatis
cuccugaaaguuuuuuccccug

SEQ ID NO: 2508952 - RNA, 15 nt, Chlamydia trachomatis
cuccugcaacaagaa

SEQ ID NO: 2508953 - RNA, 13 nt, Chlamydia trachomatis
cuccugcaaggga

SEQ ID NO: 2508954 - RNA, 13 nt, Chlamydia trachomatis
cuccuggaaggug

SEQ ID NO: 2508955 - RNA, 14 nt, Chlamydia trachomatis
cuccuggagaaaau

SEQ ID NO: 2508956 - RNA, 22 nt, Chlamydia trachomatis
cuccuguacaccaccgcaugaa

SEQ ID NO: 2508957 - RNA, 23 nt, Chlamydia trachomatis
cuccuuagauccggcuuuuuggc

SEQ ID NO: 2508958 - RNA, 20 nt, Chlamydia trachomatis
cuccuucuacaaaaaaugau

SEQ ID NO: 2508959 - RNA, 13 nt, Chlamydia trachomatis
cuccuucuugaug

SEQ ID NO: 2508960 - RNA, 18 nt, Chlamydia trachomatis
cuccuugaacaauuugug

SEQ ID NO: 2508961 - RNA, 19 nt, Chlamydia trachomatis
cucgaacucagcuuccuug

SEQ ID NO: 2508962 - RNA, 14 nt, Chlamydia trachomatis
cucgagaaaugaau

SEQ ID NO: 2508963 - RNA, 14 nt, Chlamydia trachomatis
cucgagaagaaaaa

SEQ ID NO: 2508964 - RNA, 21 nt, Chlamydia trachomatis
cucgagccuguuuagaaagag

SEQ ID NO: 2508965 - RNA, 16 nt, Chlamydia trachomatis
cucgagcuaagaaaau

SEQ ID NO: 2508966 - RNA, 14 nt, Chlamydia trachomatis
cucgauccaaagcc

SEQ ID NO: 2508967 - RNA, 17 nt, Chlamydia trachomatis
cucgauccgguucuuuu

SEQ ID NO: 2508968 - RNA, 23 nt, Chlamydia trachomatis
cucgcaaagaaucaaaacgcuca

SEQ ID NO: 2508969 - RNA, 21 nt, Chlamydia trachomatis
cucgcaaguucuccuucuugu

SEQ ID NO: 2508970 - RNA, 16 nt, Chlamydia trachomatis
cucgcuucaaaacuaa

SEQ ID NO: 2508971 - RNA, 16 nt, Chlamydia trachomatis
cucggauccagaagca

SEQ ID NO: 2508972 - RNA, 20 nt, Chlamydia trachomatis
cucggccuuuucuagagaag

SEQ ID NO: 2508973 - RNA, 15 nt, Chlamydia trachomatis
cucgucgaagaaauc

SEQ ID NO: 2508974 - RNA, 14 nt, Chlamydia trachomatis
cucgucuacaccug

SEQ ID NO: 2508975 - RNA, 20 nt, Chlamydia trachomatis
cucguuccucagcuaauaac

SEQ ID NO: 2508976 - RNA, 15 nt, Chlamydia trachomatis
cucuaaagacagcau

SEQ ID NO: 2508977 - RNA, 18 nt, Chlamydia trachomatis
cucuaaaggauaaggaag

SEQ ID NO: 2508978 - RNA, 16 nt, Chlamydia trachomatis
cucuaaaguauucugu

SEQ ID NO: 2508979 - RNA, 15 nt, Chlamydia trachomatis
cucuaacucuucuuu

SEQ ID NO: 2508980 - RNA, 19 nt, Chlamydia trachomatis
cucuaauuaauaacgcccu

SEQ ID NO: 2508981 - RNA, 18 nt, Chlamydia trachomatis
cucuacaaaauaaaaaaa

SEQ ID NO: 2508982 - RNA, 17 nt, Chlamydia trachomatis
cucuaccagggauaaau

SEQ ID NO: 2508983 - RNA, 19 nt, Chlamydia trachomatis
cucuaccagggauaaauga

SEQ ID NO: 2508984 - RNA, 19 nt, Chlamydia trachomatis
cucuaccauugugaacaau

SEQ ID NO: 2508985 - RNA, 18 nt, Chlamydia trachomatis
cucuacgcuuccuacagc

SEQ ID NO: 2508986 - RNA, 21 nt, Chlamydia trachomatis
cucuacgcuuccuacagcuag

SEQ ID NO: 2508987 - RNA, 22 nt, Chlamydia trachomatis
cucuagagggagcgauagaauu

SEQ ID NO: 2508988 - RNA, 21 nt, Chlamydia trachomatis
cucuagcaaccaauucucugc

SEQ ID NO: 2508989 - RNA, 23 nt, Chlamydia trachomatis
cucuagcaaccaauucucugccu

SEQ ID NO: 2508990 - RNA, 15 nt, Chlamydia trachomatis
cucuagcauugcgag

SEQ ID NO: 2508991 - RNA, 16 nt, Chlamydia trachomatis
cucuauuaagaaucuu

SEQ ID NO: 2508992 - RNA, 16 nt, Chlamydia trachomatis
cucucaccgaaaaauu

SEQ ID NO: 2508993 - RNA, 15 nt, Chlamydia trachomatis
cucucagcagcuucc

SEQ ID NO: 2508994 - RNA, 14 nt, Chlamydia trachomatis
cucucaucuaaacg

SEQ ID NO: 2508995 - RNA, 17 nt, Chlamydia trachomatis
cucuccagaaacaggag

SEQ ID NO: 2508996 - RNA, 20 nt, Chlamydia trachomatis
cucuccauuuaagacuacag

SEQ ID NO: 2508997 - RNA, 18 nt, Chlamydia trachomatis
cucuccauuuuccuguuc

SEQ ID NO: 2508998 - RNA, 20 nt, Chlamydia trachomatis
cucucccucuuguaaguccu

SEQ ID NO: 2508999 - RNA, 15 nt, Chlamydia trachomatis
cucuccgugaagauu

SEQ ID NO: 2509000 - RNA, 13 nt, Chlamydia trachomatis
cucuccuaacccu

SEQ ID NO: 2509001 - RNA, 15 nt, Chlamydia trachomatis
cucucgaauagcucc

SEQ ID NO: 2509002 - RNA, 14 nt, Chlamydia trachomatis
cucucgaucucauc

SEQ ID NO: 2509003 - RNA, 19 nt, Chlamydia trachomatis
cucucgggccaaaaagacu

SEQ ID NO: 2509004 - RNA, 13 nt, Chlamydia trachomatis
cucucuaaaauca

SEQ ID NO: 2509005 - RNA, 12 nt, Chlamydia trachomatis
cucucucagcag

SEQ ID NO: 2509006 - RNA, 13 nt, Chlamydia trachomatis
cucucucagcagc

SEQ ID NO: 2509007 - RNA, 15 nt, Chlamydia trachomatis
cucucuugguaacaa

SEQ ID NO: 2509008 - RNA, 11 nt, Chlamydia trachomatis
cucucuuuuuu

SEQ ID NO: 2509009 - RNA, 14 nt, Chlamydia trachomatis
cucucuuuuuuuug

SEQ ID NO: 2509010 - RNA, 17 nt, Chlamydia trachomatis
cucugaauccauucuac

SEQ ID NO: 2509011 - RNA, 15 nt, Chlamydia trachomatis
cucugcaaaaucuuc

SEQ ID NO: 2509012 - RNA, 20 nt, Chlamydia trachomatis
cucugcaaggagcuucuuua

SEQ ID NO: 2509013 - RNA, 19 nt, Chlamydia trachomatis
cucugcacaauauuaucua

SEQ ID NO: 2509014 - RNA, 20 nt, Chlamydia trachomatis
cucugcacaauauuaucuac

SEQ ID NO: 2509015 - RNA, 23 nt, Chlamydia trachomatis
cucugcacaauauuaucuacagu

SEQ ID NO: 2509016 - RNA, 16 nt, Chlamydia trachomatis
cucugcacggugcaga

SEQ ID NO: 2509017 - RNA, 21 nt, Chlamydia trachomatis
cucugccugggguuuuguugc

SEQ ID NO: 2509018 - RNA, 22 nt, Chlamydia trachomatis
cucugguacucaucuuuuuuaa

SEQ ID NO: 2509019 - RNA, 22 nt, Chlamydia trachomatis
cucuggucgugaucacugugag

SEQ ID NO: 2509020 - RNA, 13 nt, Chlamydia trachomatis
cucugucaauaaa

SEQ ID NO: 2509021 - RNA, 24 nt, Chlamydia trachomatis
cucugugcacaaucucuuuaagcu

SEQ ID NO: 2509022 - RNA, 23 nt, Chlamydia trachomatis
cucuuaauccuugcacuaagaau

SEQ ID NO: 2509023 - RNA, 15 nt, Chlamydia trachomatis
cucuuagaagcucuc

SEQ ID NO: 2509024 - RNA, 22 nt, Chlamydia trachomatis
cucuuaucguagagaucuucug

SEQ ID NO: 2509025 - RNA, 19 nt, Chlamydia trachomatis
cucuucaagaucaaaguca

SEQ ID NO: 2509026 - RNA, 14 nt, Chlamydia trachomatis
cucuucacaaauuu

SEQ ID NO: 2509027 - RNA, 14 nt, Chlamydia trachomatis
cucuucagacacaa

SEQ ID NO: 2509028 - RNA, 16 nt, Chlamydia trachomatis
cucuuccaacaauuuu

SEQ ID NO: 2509029 - RNA, 21 nt, Chlamydia trachomatis
cucuuccacgaugagauacag

SEQ ID NO: 2509030 - RNA, 12 nt, Chlamydia trachomatis
cucuuccauaau

SEQ ID NO: 2509031 - RNA, 16 nt, Chlamydia trachomatis
cucuuccccuucuuua

SEQ ID NO: 2509032 - RNA, 21 nt, Chlamydia trachomatis
cucuucccgccguuuguucuc

SEQ ID NO: 2509033 - RNA, 21 nt, Chlamydia trachomatis
cucuuccgaguaaucaaaaaa

SEQ ID NO: 2509034 - RNA, 18 nt, Chlamydia trachomatis
cucuucgagucuucccuu

SEQ ID NO: 2509035 - RNA, 20 nt, Chlamydia trachomatis
cucuucguaguaacuuauga

SEQ ID NO: 2509036 - RNA, 21 nt, Chlamydia trachomatis
cucuucguaguaacuuaugaa

SEQ ID NO: 2509037 - RNA, 22 nt, Chlamydia trachomatis
cucuucuagagcgugcauggca

SEQ ID NO: 2509038 - RNA, 22 nt, Chlamydia trachomatis
cucuucuaucgaucgaagcauu

SEQ ID NO: 2509039 - RNA, 19 nt, Chlamydia trachomatis
cucuucuucugaagagaaa

SEQ ID NO: 2509040 - RNA, 13 nt, Chlamydia trachomatis
cucuugaaaacuc

SEQ ID NO: 2509041 - RNA, 14 nt, Chlamydia trachomatis
cucuugagcauuga

SEQ ID NO: 2509042 - RNA, 21 nt, Chlamydia trachomatis
cucuugccugcaaauaauaaa

SEQ ID NO: 2509043 - RNA, 20 nt, Chlamydia trachomatis
cucuuguaucauauucuuug

SEQ ID NO: 2509044 - RNA, 20 nt, Chlamydia trachomatis
cucuuguucugggcugacag

SEQ ID NO: 2509045 - RNA, 15 nt, Chlamydia trachomatis
cucuuguuucaaaga

SEQ ID NO: 2509046 - RNA, 15 nt, Chlamydia trachomatis
cucuuuacgcacaaa

SEQ ID NO: 2509047 - RNA, 19 nt, Chlamydia trachomatis
cucuuuacgcacaaagauu

SEQ ID NO: 2509048 - RNA, 18 nt, Chlamydia trachomatis
cucuuuaucuaaagaaau

SEQ ID NO: 2509049 - RNA, 19 nt, Chlamydia trachomatis
cucuuuauuaaacucccaa

SEQ ID NO: 2509050 - RNA, 18 nt, Chlamydia trachomatis
cucuuucagaugcacuuc

SEQ ID NO: 2509051 - RNA, 17 nt, Chlamydia trachomatis
cucuuuccgacugcagu

SEQ ID NO: 2509052 - RNA, 15 nt, Chlamydia trachomatis
cucuuucgaaaacaa

SEQ ID NO: 2509053 - RNA, 18 nt, Chlamydia trachomatis
cucuuugcuccacaagaa

SEQ ID NO: 2509054 - RNA, 15 nt, Chlamydia trachomatis
cucuuuucaaaauga

SEQ ID NO: 2509055 - RNA, 15 nt, Chlamydia trachomatis
cucuuuuuaaaaggc

SEQ ID NO: 2509056 - RNA, 21 nt, Chlamydia trachomatis
cucuuuuuaaaaggcuuuauc

SEQ ID NO: 2509057 - RNA, 22 nt, Chlamydia trachomatis
cucuuuuuuaugggugaagaag

SEQ ID NO: 2509058 - RNA, 14 nt, Chlamydia trachomatis
cucuuuuuuuuugu

SEQ ID NO: 2509059 - RNA, 15 nt, Chlamydia trachomatis
cugaaaaaucaagga

SEQ ID NO: 2509060 - RNA, 18 nt, Chlamydia trachomatis
cugaaaaaucaaggauau

SEQ ID NO: 2509061 - RNA, 21 nt, Chlamydia trachomatis
cugaaacacgcucauagauuu

SEQ ID NO: 2509062 - RNA, 17 nt, Chlamydia trachomatis
cugaaagacuuuccaag

SEQ ID NO: 2509063 - RNA, 17 nt, Chlamydia trachomatis
cugaaagagcuucuuuu

SEQ ID NO: 2509064 - RNA, 19 nt, Chlamydia trachomatis
cugaaagagcuucuuuuuc

SEQ ID NO: 2509065 - RNA, 19 nt, Chlamydia trachomatis
cugaaaguuuuuuccccug

SEQ ID NO: 2509066 - RNA, 16 nt, Chlamydia trachomatis
cugaacauccaccagc

SEQ ID NO: 2509067 - RNA, 15 nt, Chlamydia trachomatis
cugaagaaaaaucua

SEQ ID NO: 2509068 - RNA, 19 nt, Chlamydia trachomatis
cugaagaaaaaucuagaca

SEQ ID NO: 2509069 - RNA, 13 nt, Chlamydia trachomatis
cugaagauuuuuu

SEQ ID NO: 2509070 - RNA, 18 nt, Chlamydia trachomatis
cugaaggugugaaagaaa

SEQ ID NO: 2509071 - RNA, 20 nt, Chlamydia trachomatis
cugaagucuuuaauaccuuc

SEQ ID NO: 2509072 - RNA, 19 nt, Chlamydia trachomatis
cugaauacucaaaaauucc

SEQ ID NO: 2509073 - RNA, 14 nt, Chlamydia trachomatis
cugaaucaaacaga

SEQ ID NO: 2509074 - RNA, 16 nt, Chlamydia trachomatis
cugaauggucaauaau

SEQ ID NO: 2509075 - RNA, 16 nt, Chlamydia trachomatis
cugacagaaguuagaa

SEQ ID NO: 2509076 - RNA, 22 nt, Chlamydia trachomatis
cugacagaaguuagaaucugcu

SEQ ID NO: 2509077 - RNA, 19 nt, Chlamydia trachomatis
cugacuacagucuuccucu

SEQ ID NO: 2509078 - RNA, 11 nt, Chlamydia trachomatis
cugacuauucc

SEQ ID NO: 2509079 - RNA, 21 nt, Chlamydia trachomatis
cugacugguuccccaaggggg

SEQ ID NO: 2509080 - RNA, 17 nt, Chlamydia trachomatis
cugagacuccagcuucu

SEQ ID NO: 2509081 - RNA, 13 nt, Chlamydia trachomatis
cugagagaugaug

SEQ ID NO: 2509082 - RNA, 21 nt, Chlamydia trachomatis
cugagcagugacuaagaucca

SEQ ID NO: 2509083 - RNA, 19 nt, Chlamydia trachomatis
cugagccaagaacaaagca

SEQ ID NO: 2509084 - RNA, 23 nt, Chlamydia trachomatis
cugagcuauuuaggcuaacucca

SEQ ID NO: 2509085 - RNA, 15 nt, Chlamydia trachomatis
cugaggcaauaaaag

SEQ ID NO: 2509086 - RNA, 18 nt, Chlamydia trachomatis
cugaggcaauaaaagcug

SEQ ID NO: 2509087 - RNA, 18 nt, Chlamydia trachomatis
cugagggccuucuuuuuc

SEQ ID NO: 2509088 - RNA, 15 nt, Chlamydia trachomatis
cugagggugaggucc

SEQ ID NO: 2509089 - RNA, 16 nt, Chlamydia trachomatis
cugaguauuaaggaaa

SEQ ID NO: 2509090 - RNA, 21 nt, Chlamydia trachomatis
cugauaaccagaauccuuuuc

SEQ ID NO: 2509091 - RNA, 15 nt, Chlamydia trachomatis
cugauaaggaggcuu

SEQ ID NO: 2509092 - RNA, 17 nt, Chlamydia trachomatis
cugauaaggaggcuuca

SEQ ID NO: 2509093 - RNA, 15 nt, Chlamydia trachomatis
cugauaggcaacuug

SEQ ID NO: 2509094 - RNA, 16 nt, Chlamydia trachomatis
cugaugcaccauaaua

SEQ ID NO: 2509095 - RNA, 15 nt, Chlamydia trachomatis
cugauguuccaucuu

SEQ ID NO: 2509096 - RNA, 19 nt, Chlamydia trachomatis
cugauguuccaucuuuucg

SEQ ID NO: 2509097 - RNA, 23 nt, Chlamydia trachomatis
cugauuagaaagggcuuuauacu

SEQ ID NO: 2509098 - RNA, 24 nt, Chlamydia trachomatis
cugauuccgagggaaucauuugcc

SEQ ID NO: 2509099 - RNA, 12 nt, Chlamydia trachomatis
cugauuucucuu

SEQ ID NO: 2509100 - RNA, 15 nt, Chlamydia trachomatis
cugcaaaaucuucca

SEQ ID NO: 2509101 - RNA, 13 nt, Chlamydia trachomatis
cugcaaaggaguc

SEQ ID NO: 2509102 - RNA, 17 nt, Chlamydia trachomatis
cugcaacaaauaccaaa

SEQ ID NO: 2509103 - RNA, 18 nt, Chlamydia trachomatis
cugcaacaguaaauuuca

SEQ ID NO: 2509104 - RNA, 21 nt, Chlamydia trachomatis
cugcaacucucuugguaacaa

SEQ ID NO: 2509105 - RNA, 17 nt, Chlamydia trachomatis
cugcaagaacaaagaau

SEQ ID NO: 2509106 - RNA, 18 nt, Chlamydia trachomatis
cugcaaggagcuucuuua

SEQ ID NO: 2509107 - RNA, 21 nt, Chlamydia trachomatis
cugcaauaaggggaagaaaua

SEQ ID NO: 2509108 - RNA, 21 nt, Chlamydia trachomatis
cugcaaugagugcggccauga

SEQ ID NO: 2509109 - RNA, 16 nt, Chlamydia trachomatis
cugcaccggcaaagaa

SEQ ID NO: 2509110 - RNA, 19 nt, Chlamydia trachomatis
cugcaccgugcagaggggg

SEQ ID NO: 2509111 - RNA, 14 nt, Chlamydia trachomatis
cugcaccucuuuca

SEQ ID NO: 2509112 - RNA, 15 nt, Chlamydia trachomatis
cugcagaaaaauuua

SEQ ID NO: 2509113 - RNA, 13 nt, Chlamydia trachomatis
cugcagagauaua

SEQ ID NO: 2509114 - RNA, 15 nt, Chlamydia trachomatis
cugcagagcacaaau

SEQ ID NO: 2509115 - RNA, 19 nt, Chlamydia trachomatis
cugcagcaucuauuuucuc

SEQ ID NO: 2509116 - RNA, 16 nt, Chlamydia trachomatis
cugcagcuaaagaauc

SEQ ID NO: 2509117 - RNA, 22 nt, Chlamydia trachomatis
cugcagcuaaagaaucuccugu

SEQ ID NO: 2509118 - RNA, 13 nt, Chlamydia trachomatis
cugcagugacauu

SEQ ID NO: 2509119 - RNA, 14 nt, Chlamydia trachomatis
cugcauaacagcaa

SEQ ID NO: 2509120 - RNA, 18 nt, Chlamydia trachomatis
cugcauagcuauaaaaua

SEQ ID NO: 2509121 - RNA, 11 nt, Chlamydia trachomatis
cugcauagcug

SEQ ID NO: 2509122 - RNA, 14 nt, Chlamydia trachomatis
cugcauauuuaauu

SEQ ID NO: 2509123 - RNA, 16 nt, Chlamydia trachomatis
cugcauauuuaauugc

SEQ ID NO: 2509124 - RNA, 22 nt, Chlamydia trachomatis
cugcaucuuaggaucuaacgca

SEQ ID NO: 2509125 - RNA, 18 nt, Chlamydia trachomatis
cugcaucuuuauagaauu

SEQ ID NO: 2509126 - RNA, 13 nt, Chlamydia trachomatis
cugcauuaaacac

SEQ ID NO: 2509127 - RNA, 18 nt, Chlamydia trachomatis
cugcccuuuguacaugau

SEQ ID NO: 2509128 - RNA, 21 nt, Chlamydia trachomatis
cugcccuuuguacaugauaau

SEQ ID NO: 2509129 - RNA, 19 nt, Chlamydia trachomatis
cugccgaacugcuuuccuu

SEQ ID NO: 2509130 - RNA, 15 nt, Chlamydia trachomatis
cugccgagcauugua

SEQ ID NO: 2509131 - RNA, 20 nt, Chlamydia trachomatis
cugccucuuuuaccgagaga

SEQ ID NO: 2509132 - RNA, 15 nt, Chlamydia trachomatis
cugccuuuaggaaga

SEQ ID NO: 2509133 - RNA, 20 nt, Chlamydia trachomatis
cugcgaaaaagaaauaaccu

SEQ ID NO: 2509134 - RNA, 17 nt, Chlamydia trachomatis
cugcgaugccaaagaaa

SEQ ID NO: 2509135 - RNA, 22 nt, Chlamydia trachomatis
cugcgcauccacuacugucaga

SEQ ID NO: 2509136 - RNA, 15 nt, Chlamydia trachomatis
cugcgcggaauaagu

SEQ ID NO: 2509137 - RNA, 17 nt, Chlamydia trachomatis
cugcggauuacaaaaga

SEQ ID NO: 2509138 - RNA, 19 nt, Chlamydia trachomatis
cugcggauucagaagggga

SEQ ID NO: 2509139 - RNA, 21 nt, Chlamydia trachomatis
cugcggcagcugcuuggaaua

SEQ ID NO: 2509140 - RNA, 14 nt, Chlamydia trachomatis
cugcgguauccaua

SEQ ID NO: 2509141 - RNA, 21 nt, Chlamydia trachomatis
cugcgguauccauacgaaaga

SEQ ID NO: 2509142 - RNA, 18 nt, Chlamydia trachomatis
cugcguauuugaaaucaa

SEQ ID NO: 2509143 - RNA, 14 nt, Chlamydia trachomatis
cugcguuuaauucc

SEQ ID NO: 2509144 - RNA, 15 nt, Chlamydia trachomatis
cugcguuuaauuccu

SEQ ID NO: 2509145 - RNA, 19 nt, Chlamydia trachomatis
cugcguuuaauuccuugga

SEQ ID NO: 2509146 - RNA, 21 nt, Chlamydia trachomatis
cugcuaauaguucucugcaua

SEQ ID NO: 2509147 - RNA, 21 nt, Chlamydia trachomatis
cugcugacaauccgaagauua

SEQ ID NO: 2509148 - RNA, 17 nt, Chlamydia trachomatis
cugcugauaaauuucuu

SEQ ID NO: 2509149 - RNA, 15 nt, Chlamydia trachomatis
cugcugauaaccaga

SEQ ID NO: 2509150 - RNA, 17 nt, Chlamydia trachomatis
cugcugccaaagcuucg

SEQ ID NO: 2509151 - RNA, 15 nt, Chlamydia trachomatis
cugcugcuuggaaua

SEQ ID NO: 2509152 - RNA, 17 nt, Chlamydia trachomatis
cugcuguugcgauuuga

SEQ ID NO: 2509153 - RNA, 15 nt, Chlamydia trachomatis
cugcuucacagcuaa

SEQ ID NO: 2509154 - RNA, 18 nt, Chlamydia trachomatis
cugcuucacagcuaauca

SEQ ID NO: 2509155 - RNA, 17 nt, Chlamydia trachomatis
cugcuucccuccuagaa

SEQ ID NO: 2509156 - RNA, 17 nt, Chlamydia trachomatis
cugcuucuauagaaaca

SEQ ID NO: 2509157 - RNA, 14 nt, Chlamydia trachomatis
cugcuucuuuuucc

SEQ ID NO: 2509158 - RNA, 20 nt, Chlamydia trachomatis
cugcuugaaguagcauugcg

SEQ ID NO: 2509159 - RNA, 21 nt, Chlamydia trachomatis
cugcuuggaauaaaucucuuc

SEQ ID NO: 2509160 - RNA, 13 nt, Chlamydia trachomatis
cugcuuggaauag

SEQ ID NO: 2509161 - RNA, 16 nt, Chlamydia trachomatis
cugcuuuaaaugcugc

SEQ ID NO: 2509162 - RNA, 18 nt, Chlamydia trachomatis
cugcuuuauccaaagaua

SEQ ID NO: 2509163 - RNA, 15 nt, Chlamydia trachomatis
cugcuuucuuuguuc

SEQ ID NO: 2509164 - RNA, 15 nt, Chlamydia trachomatis
cuggagccgucugua

SEQ ID NO: 2509165 - RNA, 16 nt, Chlamydia trachomatis
cuggauagacagccau

SEQ ID NO: 2509166 - RNA, 18 nt, Chlamydia trachomatis
cuggcaauaaucuuuuua

SEQ ID NO: 2509167 - RNA, 21 nt, Chlamydia trachomatis
cuggcagggauaguaaaaacu

SEQ ID NO: 2509168 - RNA, 22 nt, Chlamydia trachomatis
cuggcauagcagccaauuucuc

SEQ ID NO: 2509169 - RNA, 19 nt, Chlamydia trachomatis
cuggcgagaagcaugcaau

SEQ ID NO: 2509170 - RNA, 14 nt, Chlamydia trachomatis
cugggaaaauuaaa

SEQ ID NO: 2509171 - RNA, 14 nt, Chlamydia trachomatis
cugggauggaaaua

SEQ ID NO: 2509172 - RNA, 17 nt, Chlamydia trachomatis
cugggcacaacgcccag

SEQ ID NO: 2509173 - RNA, 17 nt, Chlamydia trachomatis
cugggcagcaagagaga

SEQ ID NO: 2509174 - RNA, 20 nt, Chlamydia trachomatis
cugggcauacaccugcaaga

SEQ ID NO: 2509175 - RNA, 17 nt, Chlamydia trachomatis
cugggcgaucuccuucc

SEQ ID NO: 2509176 - RNA, 19 nt, Chlamydia trachomatis
cugggcgaucuccuuccuc

SEQ ID NO: 2509177 - RNA, 13 nt, Chlamydia trachomatis
cugggcugacaga

SEQ ID NO: 2509178 - RNA, 14 nt, Chlamydia trachomatis
cugggucauagaaa

SEQ ID NO: 2509179 - RNA, 18 nt, Chlamydia trachomatis
cugggucuuuuuuaugaa

SEQ ID NO: 2509180 - RNA, 17 nt, Chlamydia trachomatis
cuggguuuuaucaagag

SEQ ID NO: 2509181 - RNA, 16 nt, Chlamydia trachomatis
cugguaaaaauagaaa

SEQ ID NO: 2509182 - RNA, 20 nt, Chlamydia trachomatis
cugguacucaucuuuuuuaa

SEQ ID NO: 2509183 - RNA, 17 nt, Chlamydia trachomatis
cugguagaaagcuacag

SEQ ID NO: 2509184 - RNA, 17 nt, Chlamydia trachomatis
cugguauucugcagaaa

SEQ ID NO: 2509185 - RNA, 22 nt, Chlamydia trachomatis
cugguauucugcagaaaaauuu

SEQ ID NO: 2509186 - RNA, 20 nt, Chlamydia trachomatis
cugguguaggaaaauacaca

SEQ ID NO: 2509187 - RNA, 14 nt, Chlamydia trachomatis
cugguugguuuucu

SEQ ID NO: 2509188 - RNA, 16 nt, Chlamydia trachomatis
cugguugguuuucuug

SEQ ID NO: 2509189 - RNA, 19 nt, Chlamydia trachomatis
cugguuucuuaaacaaaaa

SEQ ID NO: 2509190 - RNA, 20 nt, Chlamydia trachomatis
cugguuuuuuuugaaaaggg

SEQ ID NO: 2509191 - RNA, 19 nt, Chlamydia trachomatis
cuguaacgauagcuaaucu

SEQ ID NO: 2509192 - RNA, 16 nt, Chlamydia trachomatis
cuguaacuaaacucca

SEQ ID NO: 2509193 - RNA, 18 nt, Chlamydia trachomatis
cuguaacuaaacuccauu

SEQ ID NO: 2509194 - RNA, 19 nt, Chlamydia trachomatis
cuguaagaggaucuccaga

SEQ ID NO: 2509195 - RNA, 13 nt, Chlamydia trachomatis
cuguaaguuuauu

SEQ ID NO: 2509196 - RNA, 13 nt, Chlamydia trachomatis
cuguaauaaacac

SEQ ID NO: 2509197 - RNA, 11 nt, Chlamydia trachomatis
cuguaauaagu

SEQ ID NO: 2509198 - RNA, 19 nt, Chlamydia trachomatis
cuguaauagcauuaauaua

SEQ ID NO: 2509199 - RNA, 14 nt, Chlamydia trachomatis
cuguaauguccucu

SEQ ID NO: 2509200 - RNA, 16 nt, Chlamydia trachomatis
cuguaauguccucuuu

SEQ ID NO: 2509201 - RNA, 23 nt, Chlamydia trachomatis
cuguaauguuaauggaaucuaga

SEQ ID NO: 2509202 - RNA, 14 nt, Chlamydia trachomatis
cuguacaccaccgc

SEQ ID NO: 2509203 - RNA, 16 nt, Chlamydia trachomatis
cuguagaaaaucauag

SEQ ID NO: 2509204 - RNA, 14 nt, Chlamydia trachomatis
cuguagagagcccc

SEQ ID NO: 2509205 - RNA, 17 nt, Chlamydia trachomatis
cuguagagccaugauca

SEQ ID NO: 2509206 - RNA, 20 nt, Chlamydia trachomatis
cuguagccccagucucuacg

SEQ ID NO: 2509207 - RNA, 17 nt, Chlamydia trachomatis
cuguaggagagaaucuu

SEQ ID NO: 2509208 - RNA, 23 nt, Chlamydia trachomatis
cuguaggggagggacuucuucua

SEQ ID NO: 2509209 - RNA, 18 nt, Chlamydia trachomatis
cuguagugaaauaagaaa

SEQ ID NO: 2509210 - RNA, 21 nt, Chlamydia trachomatis
cuguaguuagguaaucuucua

SEQ ID NO: 2509211 - RNA, 19 nt, Chlamydia trachomatis
cuguaguugccccuuauuu

SEQ ID NO: 2509212 - RNA, 20 nt, Chlamydia trachomatis
cuguaguugccccuuauuua

SEQ ID NO: 2509213 - RNA, 12 nt, Chlamydia trachomatis
cuguauaacaau

SEQ ID NO: 2509214 - RNA, 22 nt, Chlamydia trachomatis
cuguauaacaauuuuaaaaucu

SEQ ID NO: 2509215 - RNA, 17 nt, Chlamydia trachomatis
cuguauucgcuauuucg

SEQ ID NO: 2509216 - RNA, 15 nt, Chlamydia trachomatis
cuguauugcucugca

SEQ ID NO: 2509217 - RNA, 16 nt, Chlamydia trachomatis
cugucagaccuacaaa

SEQ ID NO: 2509218 - RNA, 18 nt, Chlamydia trachomatis
cugucagaccuacaaaga

SEQ ID NO: 2509219 - RNA, 19 nt, Chlamydia trachomatis
cugucagaccuacaaagau

SEQ ID NO: 2509220 - RNA, 22 nt, Chlamydia trachomatis
cugucagaucauuuuaauaaga

SEQ ID NO: 2509221 - RNA, 15 nt, Chlamydia trachomatis
cugucagucuucuuu

SEQ ID NO: 2509222 - RNA, 18 nt, Chlamydia trachomatis
cugucgaacgcuucuucc

SEQ ID NO: 2509223 - RNA, 17 nt, Chlamydia trachomatis
cugucguuaaagaauua

SEQ ID NO: 2509224 - RNA, 23 nt, Chlamydia trachomatis
cugucuaagauuuucaucuucca

SEQ ID NO: 2509225 - RNA, 11 nt, Chlamydia trachomatis
cugucuucuuu

SEQ ID NO: 2509226 - RNA, 21 nt, Chlamydia trachomatis
cugucuucuuucaaagaagcu

SEQ ID NO: 2509227 - RNA, 17 nt, Chlamydia trachomatis
cugucuuggucgcauuu

SEQ ID NO: 2509228 - RNA, 17 nt, Chlamydia trachomatis
cugugaagaaacuucug

SEQ ID NO: 2509229 - RNA, 18 nt, Chlamydia trachomatis
cugugauaucccuuucca

SEQ ID NO: 2509230 - RNA, 17 nt, Chlamydia trachomatis
cugugauggaaauguuu

SEQ ID NO: 2509231 - RNA, 15 nt, Chlamydia trachomatis
cugugcaaucagcuc

SEQ ID NO: 2509232 - RNA, 17 nt, Chlamydia trachomatis
cugugcaaucagcucuc

SEQ ID NO: 2509233 - RNA, 17 nt, Chlamydia trachomatis
cugugcccaagaagcga

SEQ ID NO: 2509234 - RNA, 17 nt, Chlamydia trachomatis
cugugcuugcauagaua

SEQ ID NO: 2509235 - RNA, 20 nt, Chlamydia trachomatis
cugugcuugcauagauagau

SEQ ID NO: 2509236 - RNA, 18 nt, Chlamydia trachomatis
cuguguacaaacacuaga

SEQ ID NO: 2509237 - RNA, 17 nt, Chlamydia trachomatis
cugugucauaagcucua

SEQ ID NO: 2509238 - RNA, 15 nt, Chlamydia trachomatis
cuguguuugcacaau

SEQ ID NO: 2509239 - RNA, 23 nt, Chlamydia trachomatis
cuguuaacugacaauccaguacu

SEQ ID NO: 2509240 - RNA, 17 nt, Chlamydia trachomatis
cuguuaccugggaaaac

SEQ ID NO: 2509241 - RNA, 12 nt, Chlamydia trachomatis
cuguuagugaag

SEQ ID NO: 2509242 - RNA, 18 nt, Chlamydia trachomatis
cuguuagugaagagcaga

SEQ ID NO: 2509243 - RNA, 23 nt, Chlamydia trachomatis
cuguuaugaaccagggagagcuu

SEQ ID NO: 2509244 - RNA, 22 nt, Chlamydia trachomatis
cuguuauuuguucucuuagaag

SEQ ID NO: 2509245 - RNA, 15 nt, Chlamydia trachomatis
cuguucaagagaggc

SEQ ID NO: 2509246 - RNA, 19 nt, Chlamydia trachomatis
cuguucaauuguuggacaa

SEQ ID NO: 2509247 - RNA, 21 nt, Chlamydia trachomatis
cuguucagcuucuacauccaa

SEQ ID NO: 2509248 - RNA, 18 nt, Chlamydia trachomatis
cuguucagguuugcaugu

SEQ ID NO: 2509249 - RNA, 15 nt, Chlamydia trachomatis
cuguucccauuuuua

SEQ ID NO: 2509250 - RNA, 19 nt, Chlamydia trachomatis
cuguuccuaauacuaaacu

SEQ ID NO: 2509251 - RNA, 11 nt, Chlamydia trachomatis
cuguucuccaa

SEQ ID NO: 2509252 - RNA, 17 nt, Chlamydia trachomatis
cuguugagaaaaacucu

SEQ ID NO: 2509253 - RNA, 17 nt, Chlamydia trachomatis
cuguugaggagacuuua

SEQ ID NO: 2509254 - RNA, 22 nt, Chlamydia trachomatis
cuguugaugauguccaaagcuc

SEQ ID NO: 2509255 - RNA, 17 nt, Chlamydia trachomatis
cuguugcaacagacucu

SEQ ID NO: 2509256 - RNA, 15 nt, Chlamydia trachomatis
cuguugcacuuuccg

SEQ ID NO: 2509257 - RNA, 22 nt, Chlamydia trachomatis
cuguugucgauuuuuaaaagac

SEQ ID NO: 2509258 - RNA, 21 nt, Chlamydia trachomatis
cuguuguguaucaaaaucaau

SEQ ID NO: 2509259 - RNA, 22 nt, Chlamydia trachomatis
cuguuuaucacuaucugcaaaa

SEQ ID NO: 2509260 - RNA, 19 nt, Chlamydia trachomatis
cuguuucagaaacuuccca

SEQ ID NO: 2509261 - RNA, 21 nt, Chlamydia trachomatis
cuguuuucuuguagaaaaaga

SEQ ID NO: 2509262 - RNA, 14 nt, Chlamydia trachomatis
cuuaaaaaacaaaa

SEQ ID NO: 2509263 - RNA, 14 nt, Chlamydia trachomatis
cuuaaagauaacac

SEQ ID NO: 2509264 - RNA, 18 nt, Chlamydia trachomatis
cuuaacacccucuuccuu

SEQ ID NO: 2509265 - RNA, 19 nt, Chlamydia trachomatis
cuuaacacccucuuccuuc

SEQ ID NO: 2509266 - RNA, 21 nt, Chlamydia trachomatis
cuuaacacccucuuccuuccc

SEQ ID NO: 2509267 - RNA, 20 nt, Chlamydia trachomatis
cuuaacaugauucaaaauaa

SEQ ID NO: 2509268 - RNA, 14 nt, Chlamydia trachomatis
cuuaaccgugaacu

SEQ ID NO: 2509269 - RNA, 22 nt, Chlamydia trachomatis
cuuaacugcagcaucuauuuuc

SEQ ID NO: 2509270 - RNA, 15 nt, Chlamydia trachomatis
cuuaacuuuguuauu

SEQ ID NO: 2509271 - RNA, 12 nt, Chlamydia trachomatis
cuuaaugcuuga

SEQ ID NO: 2509272 - RNA, 16 nt, Chlamydia trachomatis
cuuaauugccucguga

SEQ ID NO: 2509273 - RNA, 17 nt, Chlamydia trachomatis
cuuacagagagcuuuuu

SEQ ID NO: 2509274 - RNA, 17 nt, Chlamydia trachomatis
cuuacauaagauccauc

SEQ ID NO: 2509275 - RNA, 18 nt, Chlamydia trachomatis
cuuacgagcuuucuuacg

SEQ ID NO: 2509276 - RNA, 12 nt, Chlamydia trachomatis
cuuacucuuccg

SEQ ID NO: 2509277 - RNA, 23 nt, Chlamydia trachomatis
cuuagaaacuguccuuuauucaa

SEQ ID NO: 2509278 - RNA, 19 nt, Chlamydia trachomatis
cuuagaaggaucuaugaau

SEQ ID NO: 2509279 - RNA, 15 nt, Chlamydia trachomatis
cuuagcaaagaaaua

SEQ ID NO: 2509280 - RNA, 23 nt, Chlamydia trachomatis
cuuagcagauaauucucgcaaag

SEQ ID NO: 2509281 - RNA, 16 nt, Chlamydia trachomatis
cuuagcaguuacauuu

SEQ ID NO: 2509282 - RNA, 15 nt, Chlamydia trachomatis
cuuagccacugcaca

SEQ ID NO: 2509283 - RNA, 14 nt, Chlamydia trachomatis
cuuagccuuguuua

SEQ ID NO: 2509284 - RNA, 15 nt, Chlamydia trachomatis
cuuagccuuguuuau

SEQ ID NO: 2509285 - RNA, 21 nt, Chlamydia trachomatis
cuuagccuuguuucucaacga

SEQ ID NO: 2509286 - RNA, 19 nt, Chlamydia trachomatis
cuuagcucccugcucuuga

SEQ ID NO: 2509287 - RNA, 23 nt, Chlamydia trachomatis
cuuagcucccugcucuugaagau

SEQ ID NO: 2509288 - RNA, 22 nt, Chlamydia trachomatis
cuuaggaccuaauaucugcucu

SEQ ID NO: 2509289 - RNA, 22 nt, Chlamydia trachomatis
cuuagugucuucgaauccuaaa

SEQ ID NO: 2509290 - RNA, 13 nt, Chlamydia trachomatis
cuuaguuaaaacu

SEQ ID NO: 2509291 - RNA, 19 nt, Chlamydia trachomatis
cuuaguuaaaacuccagaa

SEQ ID NO: 2509292 - RNA, 22 nt, Chlamydia trachomatis
cuuauaaaguccggacuuuccu

SEQ ID NO: 2509293 - RNA, 21 nt, Chlamydia trachomatis
cuuauacaucagagcaauaga

SEQ ID NO: 2509294 - RNA, 22 nt, Chlamydia trachomatis
cuuaucugucagucuucuuuuc

SEQ ID NO: 2509295 - RNA, 15 nt, Chlamydia trachomatis
cuuaucuucuugaga

SEQ ID NO: 2509296 - RNA, 16 nt, Chlamydia trachomatis
cuuaucuucuugagaa

SEQ ID NO: 2509297 - RNA, 19 nt, Chlamydia trachomatis
cuuaugaacggcucuucuu

SEQ ID NO: 2509298 - RNA, 22 nt, Chlamydia trachomatis
cuuauuaaaagaccucuuuuuu

SEQ ID NO: 2509299 - RNA, 18 nt, Chlamydia trachomatis
cuuauuuaccuugagucc

SEQ ID NO: 2509300 - RNA, 22 nt, Chlamydia trachomatis
cuucaaaaaagauuuccccuuu

SEQ ID NO: 2509301 - RNA, 13 nt, Chlamydia trachomatis
cuucaaagaacaa

SEQ ID NO: 2509302 - RNA, 14 nt, Chlamydia trachomatis
cuucaaagaacaua

SEQ ID NO: 2509303 - RNA, 18 nt, Chlamydia trachomatis
cuucaaauucuacuccug

SEQ ID NO: 2509304 - RNA, 22 nt, Chlamydia trachomatis
cuucaacuggccuuuuucguua

SEQ ID NO: 2509305 - RNA, 21 nt, Chlamydia trachomatis
cuucaaguucuucuuccacag

SEQ ID NO: 2509306 - RNA, 20 nt, Chlamydia trachomatis
cuucaauaacgauaguacaa

SEQ ID NO: 2509307 - RNA, 19 nt, Chlamydia trachomatis
cuucaauaauguugaaguc

SEQ ID NO: 2509308 - RNA, 19 nt, Chlamydia trachomatis
cuucaauagcaggaacuuc

SEQ ID NO: 2509309 - RNA, 21 nt, Chlamydia trachomatis
cuucaauagcaggaacuucuu

SEQ ID NO: 2509310 - RNA, 17 nt, Chlamydia trachomatis
cuucaauggcaaaacuu

SEQ ID NO: 2509311 - RNA, 20 nt, Chlamydia trachomatis
cuucaauucuugcuucaugu

SEQ ID NO: 2509312 - RNA, 12 nt, Chlamydia trachomatis
cuucaauuucuu

SEQ ID NO: 2509313 - RNA, 19 nt, Chlamydia trachomatis
cuucacaaauauacucuuu

SEQ ID NO: 2509314 - RNA, 21 nt, Chlamydia trachomatis
cuucacaccagcggacaaguc

SEQ ID NO: 2509315 - RNA, 23 nt, Chlamydia trachomatis
cuucacaccagcggacaaguccu

SEQ ID NO: 2509316 - RNA, 16 nt, Chlamydia trachomatis
cuucacagcuaaucau

SEQ ID NO: 2509317 - RNA, 20 nt, Chlamydia trachomatis
cuucacagcuaaucauagcc

SEQ ID NO: 2509318 - RNA, 18 nt, Chlamydia trachomatis
cuucacccauaaaaaaga

SEQ ID NO: 2509319 - RNA, 13 nt, Chlamydia trachomatis
cuucacugccuuu

SEQ ID NO: 2509320 - RNA, 14 nt, Chlamydia trachomatis
cuucagcaacauuc

SEQ ID NO: 2509321 - RNA, 16 nt, Chlamydia trachomatis
cuucagcacguaguuu

SEQ ID NO: 2509322 - RNA, 17 nt, Chlamydia trachomatis
cuucaguuugaaucaca

SEQ ID NO: 2509323 - RNA, 18 nt, Chlamydia trachomatis
cuucauaaaaaagaccca

SEQ ID NO: 2509324 - RNA, 16 nt, Chlamydia trachomatis
cuucauaagaaaauuc

SEQ ID NO: 2509325 - RNA, 21 nt, Chlamydia trachomatis
cuucauacgagccuguuucuu

SEQ ID NO: 2509326 - RNA, 20 nt, Chlamydia trachomatis
cuucaucagcuguuccuuuu

SEQ ID NO: 2509327 - RNA, 18 nt, Chlamydia trachomatis
cuucaugucuucuuucuc

SEQ ID NO: 2509328 - RNA, 20 nt, Chlamydia trachomatis
cuucaugucuucuuucucuu

SEQ ID NO: 2509329 - RNA, 14 nt, Chlamydia trachomatis
cuucauuuuugcua

SEQ ID NO: 2509330 - RNA, 15 nt, Chlamydia trachomatis
cuuccaaaucugcaa

SEQ ID NO: 2509331 - RNA, 22 nt, Chlamydia trachomatis
cuuccaaauuucccucuucccg

SEQ ID NO: 2509332 - RNA, 18 nt, Chlamydia trachomatis
cuucccacauacuuggau

SEQ ID NO: 2509333 - RNA, 21 nt, Chlamydia trachomatis
cuucccgcuauuuuccucuuc

SEQ ID NO: 2509334 - RNA, 22 nt, Chlamydia trachomatis
cuucccuaagaaccgcaagcaa

SEQ ID NO: 2509335 - RNA, 21 nt, Chlamydia trachomatis
cuucccuccuagaaagaacca

SEQ ID NO: 2509336 - RNA, 15 nt, Chlamydia trachomatis
cuucccuuuuuucug

SEQ ID NO: 2509337 - RNA, 21 nt, Chlamydia trachomatis
cuuccguccccuuacccaaac

SEQ ID NO: 2509338 - RNA, 21 nt, Chlamydia trachomatis
cuuccucaguauaaaaaaagu

SEQ ID NO: 2509339 - RNA, 13 nt, Chlamydia trachomatis
cuuccucuccuuc

SEQ ID NO: 2509340 - RNA, 16 nt, Chlamydia trachomatis
cuuccucuccuucuac

SEQ ID NO: 2509341 - RNA, 14 nt, Chlamydia trachomatis
cuuccucucucuca

SEQ ID NO: 2509342 - RNA, 21 nt, Chlamydia trachomatis
cuuccucucucucaccgaaaa

SEQ ID NO: 2509343 - RNA, 14 nt, Chlamydia trachomatis
cuuccucugcuucu

SEQ ID NO: 2509344 - RNA, 18 nt, Chlamydia trachomatis
cuuccugaacgauaacag

SEQ ID NO: 2509345 - RNA, 11 nt, Chlamydia trachomatis
cuuccugcuuc

SEQ ID NO: 2509346 - RNA, 16 nt, Chlamydia trachomatis
cuuccugcuucaaaaa

SEQ ID NO: 2509347 - RNA, 19 nt, Chlamydia trachomatis
cuuccuuaucuaauuccuu

SEQ ID NO: 2509348 - RNA, 13 nt, Chlamydia trachomatis
cuuccuucccuuc

SEQ ID NO: 2509349 - RNA, 12 nt, Chlamydia trachomatis
cuuccuugacuc

SEQ ID NO: 2509350 - RNA, 18 nt, Chlamydia trachomatis
cuuccuugacucuaaaga

SEQ ID NO: 2509351 - RNA, 13 nt, Chlamydia trachomatis
cuucgaaauauug

SEQ ID NO: 2509352 - RNA, 19 nt, Chlamydia trachomatis
cuucgagcuguuuuugcaa

SEQ ID NO: 2509353 - RNA, 14 nt, Chlamydia trachomatis
cuucgaggcucccc

SEQ ID NO: 2509354 - RNA, 19 nt, Chlamydia trachomatis
cuucgaguacuggggucag

SEQ ID NO: 2509355 - RNA, 17 nt, Chlamydia trachomatis
cuucggcagaagcugca

SEQ ID NO: 2509356 - RNA, 18 nt, Chlamydia trachomatis
cuucggcagaagcugcag

SEQ ID NO: 2509357 - RNA, 21 nt, Chlamydia trachomatis
cuucggcagaagcugcagaga

SEQ ID NO: 2509358 - RNA, 23 nt, Chlamydia trachomatis
cuucgugagacagcacuucuucu

SEQ ID NO: 2509359 - RNA, 20 nt, Chlamydia trachomatis
cuucuaaagaaucuaccacg

SEQ ID NO: 2509360 - RNA, 20 nt, Chlamydia trachomatis
cuucuaaaugcuguaaaaca

SEQ ID NO: 2509361 - RNA, 19 nt, Chlamydia trachomatis
cuucuaacuacucccaaau

SEQ ID NO: 2509362 - RNA, 13 nt, Chlamydia trachomatis
cuucuaacuuuuc

SEQ ID NO: 2509363 - RNA, 14 nt, Chlamydia trachomatis
cuucuaacuuuuca

SEQ ID NO: 2509364 - RNA, 15 nt, Chlamydia trachomatis
cuucuaagcuagaaa

SEQ ID NO: 2509365 - RNA, 12 nt, Chlamydia trachomatis
cuucuacaaaaa

SEQ ID NO: 2509366 - RNA, 18 nt, Chlamydia trachomatis
cuucuacauccaaaaauu

SEQ ID NO: 2509367 - RNA, 18 nt, Chlamydia trachomatis
cuucuagaagaccaaaaa

SEQ ID NO: 2509368 - RNA, 19 nt, Chlamydia trachomatis
cuucuagaagaccaaaaau

SEQ ID NO: 2509369 - RNA, 13 nt, Chlamydia trachomatis
cuucuagaggagu

SEQ ID NO: 2509370 - RNA, 14 nt, Chlamydia trachomatis
cuucuagauagaag

SEQ ID NO: 2509371 - RNA, 22 nt, Chlamydia trachomatis
cuucuauccggaguaccaaaaa

SEQ ID NO: 2509372 - RNA, 18 nt, Chlamydia trachomatis
cuucuauguaaaaauucu

SEQ ID NO: 2509373 - RNA, 12 nt, Chlamydia trachomatis
cuucuauuucca

SEQ ID NO: 2509374 - RNA, 16 nt, Chlamydia trachomatis
cuucuauuucucuucc

SEQ ID NO: 2509375 - RNA, 17 nt, Chlamydia trachomatis
cuucucaacacugaaaa

SEQ ID NO: 2509376 - RNA, 14 nt, Chlamydia trachomatis
cuucucauaaggag

SEQ ID NO: 2509377 - RNA, 13 nt, Chlamydia trachomatis
cuucucgcuacaa

SEQ ID NO: 2509378 - RNA, 14 nt, Chlamydia trachomatis
cuucucgcuacaaa

SEQ ID NO: 2509379 - RNA, 15 nt, Chlamydia trachomatis
cuucucgcuacaaau

SEQ ID NO: 2509380 - RNA, 17 nt, Chlamydia trachomatis
cuucucuaaaugagcga

SEQ ID NO: 2509381 - RNA, 16 nt, Chlamydia trachomatis
cuucucuagaaaaggc

SEQ ID NO: 2509382 - RNA, 17 nt, Chlamydia trachomatis
cuucucuagaaaaggcc

SEQ ID NO: 2509383 - RNA, 23 nt, Chlamydia trachomatis
cuucucugugcacaaucucuuua

SEQ ID NO: 2509384 - RNA, 13 nt, Chlamydia trachomatis
cuucucuucacuu

SEQ ID NO: 2509385 - RNA, 21 nt, Chlamydia trachomatis
cuucucuugaaucaaaaaguu

SEQ ID NO: 2509386 - RNA, 14 nt, Chlamydia trachomatis
cuucucuuguucug

SEQ ID NO: 2509387 - RNA, 20 nt, Chlamydia trachomatis
cuucugaacaacauccuuua

SEQ ID NO: 2509388 - RNA, 22 nt, Chlamydia trachomatis
cuucugacucuaguguuuguac

SEQ ID NO: 2509389 - RNA, 13 nt, Chlamydia trachomatis
cuucugauucugu

SEQ ID NO: 2509390 - RNA, 15 nt, Chlamydia trachomatis
cuucugcauugguau

SEQ ID NO: 2509391 - RNA, 21 nt, Chlamydia trachomatis
cuucugccucuuuuaccgaga

SEQ ID NO: 2509392 - RNA, 15 nt, Chlamydia trachomatis
cuucugcuaaaaaug

SEQ ID NO: 2509393 - RNA, 23 nt, Chlamydia trachomatis
cuucugcuaaaaaugcuugcgua

SEQ ID NO: 2509394 - RNA, 16 nt, Chlamydia trachomatis
cuucugcugaauauuc

SEQ ID NO: 2509395 - RNA, 19 nt, Chlamydia trachomatis
cuucuggacuauuuucaaa

SEQ ID NO: 2509396 - RNA, 17 nt, Chlamydia trachomatis
cuucuggcgaaucaauu

SEQ ID NO: 2509397 - RNA, 21 nt, Chlamydia trachomatis
cuucuggcgaaucaauuucua

SEQ ID NO: 2509398 - RNA, 14 nt, Chlamydia trachomatis
cuucuguagcccca

SEQ ID NO: 2509399 - RNA, 19 nt, Chlamydia trachomatis
cuucugugcaaucagcucu

SEQ ID NO: 2509400 - RNA, 18 nt, Chlamydia trachomatis
cuucuucacccauaaaaa

SEQ ID NO: 2509401 - RNA, 22 nt, Chlamydia trachomatis
cuucuucacccauaaaaaagag

SEQ ID NO: 2509402 - RNA, 15 nt, Chlamydia trachomatis
cuucuucauguucug

SEQ ID NO: 2509403 - RNA, 16 nt, Chlamydia trachomatis
cuucuuccacagaagu

SEQ ID NO: 2509404 - RNA, 14 nt, Chlamydia trachomatis
cuucuuccuucaua

SEQ ID NO: 2509405 - RNA, 15 nt, Chlamydia trachomatis
cuucuucggaaagca

SEQ ID NO: 2509406 - RNA, 21 nt, Chlamydia trachomatis
cuucuucgucugugagagagc

SEQ ID NO: 2509407 - RNA, 14 nt, Chlamydia trachomatis
cuucuucuaaagaa

SEQ ID NO: 2509408 - RNA, 15 nt, Chlamydia trachomatis
cuucuucuaaagaau

SEQ ID NO: 2509409 - RNA, 22 nt, Chlamydia trachomatis
cuucuucuaaguauucuucugc

SEQ ID NO: 2509410 - RNA, 19 nt, Chlamydia trachomatis
cuucuucuagugccucaau

SEQ ID NO: 2509411 - RNA, 13 nt, Chlamydia trachomatis
cuucuucuucuuu

SEQ ID NO: 2509412 - RNA, 23 nt, Chlamydia trachomatis
cuucuucuuuagcucgcuucaaa

SEQ ID NO: 2509413 - RNA, 16 nt, Chlamydia trachomatis
cuucuugagaaaacuu

SEQ ID NO: 2509414 - RNA, 18 nt, Chlamydia trachomatis
cuucuugcgaugccucua

SEQ ID NO: 2509415 - RNA, 23 nt, Chlamydia trachomatis
cuucuugcgaugccucuaacacu

SEQ ID NO: 2509416 - RNA, 23 nt, Chlamydia trachomatis
cuucuuguauaaguucuuuuugu

SEQ ID NO: 2509417 - RNA, 18 nt, Chlamydia trachomatis
cuucuuguuuagaggaga

SEQ ID NO: 2509418 - RNA, 19 nt, Chlamydia trachomatis
cuucuuuaggcgaauaagc

SEQ ID NO: 2509419 - RNA, 15 nt, Chlamydia trachomatis
cuucuuucaaaagaa

SEQ ID NO: 2509420 - RNA, 14 nt, Chlamydia trachomatis
cuucuuucaaagaa

SEQ ID NO: 2509421 - RNA, 17 nt, Chlamydia trachomatis
cuucuuuggaaaaaaaa

SEQ ID NO: 2509422 - RNA, 20 nt, Chlamydia trachomatis
cuucuuuuucucuggaacag

SEQ ID NO: 2509423 - RNA, 17 nt, Chlamydia trachomatis
cuugaaccccuccucca

SEQ ID NO: 2509424 - RNA, 20 nt, Chlamydia trachomatis
cuugaacguaggccacaaga

SEQ ID NO: 2509425 - RNA, 21 nt, Chlamydia trachomatis
cuugaacguaggccacaagau

SEQ ID NO: 2509426 - RNA, 16 nt, Chlamydia trachomatis
cuugaaucaaaaaguu

SEQ ID NO: 2509427 - RNA, 17 nt, Chlamydia trachomatis
cuugaauuguuggauuu

SEQ ID NO: 2509428 - RNA, 17 nt, Chlamydia trachomatis
cuugagccuucaauucu

SEQ ID NO: 2509429 - RNA, 20 nt, Chlamydia trachomatis
cuugaggauaguauucuuug

SEQ ID NO: 2509430 - RNA, 13 nt, Chlamydia trachomatis
cuugauaagaguc

SEQ ID NO: 2509431 - RNA, 20 nt, Chlamydia trachomatis
cuugaucggagucugcucca

SEQ ID NO: 2509432 - RNA, 19 nt, Chlamydia trachomatis
cuugaucuacagcaaaacc

SEQ ID NO: 2509433 - RNA, 15 nt, Chlamydia trachomatis
cuugaucugaaaaga

SEQ ID NO: 2509434 - RNA, 21 nt, Chlamydia trachomatis
cuugaucugaaaagagaagaa

SEQ ID NO: 2509435 - RNA, 18 nt, Chlamydia trachomatis
cuugaucuguggagugcc

SEQ ID NO: 2509436 - RNA, 17 nt, Chlamydia trachomatis
cuugaugaauuuuaucu

SEQ ID NO: 2509437 - RNA, 21 nt, Chlamydia trachomatis
cuugaugaauuuuaucuaaaa

SEQ ID NO: 2509438 - RNA, 19 nt, Chlamydia trachomatis
cuugaugcccaggauaaca

SEQ ID NO: 2509439 - RNA, 16 nt, Chlamydia trachomatis
cuugauucuugaauca

SEQ ID NO: 2509440 - RNA, 18 nt, Chlamydia trachomatis
cuugauucuugaaucaga

SEQ ID NO: 2509441 - RNA, 13 nt, Chlamydia trachomatis
cuugauuggauaa

SEQ ID NO: 2509442 - RNA, 21 nt, Chlamydia trachomatis
cuugcaaaaaucucuuuagca

SEQ ID NO: 2509443 - RNA, 14 nt, Chlamydia trachomatis
cuugcaacucuuau

SEQ ID NO: 2509444 - RNA, 12 nt, Chlamydia trachomatis
cuugcagaacag

SEQ ID NO: 2509445 - RNA, 14 nt, Chlamydia trachomatis
cuugcauggaauca

SEQ ID NO: 2509446 - RNA, 15 nt, Chlamydia trachomatis
cuugcauggaaucau

SEQ ID NO: 2509447 - RNA, 21 nt, Chlamydia trachomatis
cuugcauuugggagauacaga

SEQ ID NO: 2509448 - RNA, 17 nt, Chlamydia trachomatis
cuugccaucauuaucuu

SEQ ID NO: 2509449 - RNA, 21 nt, Chlamydia trachomatis
cuugccaucauuaucuucuuc

SEQ ID NO: 2509450 - RNA, 15 nt, Chlamydia trachomatis
cuugcccaaacucca

SEQ ID NO: 2509451 - RNA, 16 nt, Chlamydia trachomatis
cuugcccgacaguaua

SEQ ID NO: 2509452 - RNA, 13 nt, Chlamydia trachomatis
cuugcgaugccuc

SEQ ID NO: 2509453 - RNA, 14 nt, Chlamydia trachomatis
cuugcgaugccucu

SEQ ID NO: 2509454 - RNA, 13 nt, Chlamydia trachomatis
cuugcgcaucaaa

SEQ ID NO: 2509455 - RNA, 15 nt, Chlamydia trachomatis
cuugcggagccgauu

SEQ ID NO: 2509456 - RNA, 16 nt, Chlamydia trachomatis
cuugcgggcaaccauu

SEQ ID NO: 2509457 - RNA, 18 nt, Chlamydia trachomatis
cuugcuaagaacauaaca

SEQ ID NO: 2509458 - RNA, 17 nt, Chlamydia trachomatis
cuugcuccacacaacau

SEQ ID NO: 2509459 - RNA, 22 nt, Chlamydia trachomatis
cuugcuccacacaacauaacuc

SEQ ID NO: 2509460 - RNA, 13 nt, Chlamydia trachomatis
cuugcuuaacacu

SEQ ID NO: 2509461 - RNA, 21 nt, Chlamydia trachomatis
cuugcuuucuugaggaagaua

SEQ ID NO: 2509462 - RNA, 19 nt, Chlamydia trachomatis
cuuggaccauaaaacuugu

SEQ ID NO: 2509463 - RNA, 19 nt, Chlamydia trachomatis
cuuggacguuggagaaaca

SEQ ID NO: 2509464 - RNA, 18 nt, Chlamydia trachomatis
cuuggagagaaugaagaa

SEQ ID NO: 2509465 - RNA, 15 nt, Chlamydia trachomatis
cuuggaucgcuucga

SEQ ID NO: 2509466 - RNA, 18 nt, Chlamydia trachomatis
cuuggccuuuuagcccuc

SEQ ID NO: 2509467 - RNA, 20 nt, Chlamydia trachomatis
cuuggccuuuuagcccuccu

SEQ ID NO: 2509468 - RNA, 18 nt, Chlamydia trachomatis
cuuggcggauaucuucuu

SEQ ID NO: 2509469 - RNA, 20 nt, Chlamydia trachomatis
cuuggcggauaucuucuuga

SEQ ID NO: 2509470 - RNA, 16 nt, Chlamydia trachomatis
cuugggaaucuucuuc

SEQ ID NO: 2509471 - RNA, 16 nt, Chlamydia trachomatis
cuuggguaagaccaaa

SEQ ID NO: 2509472 - RNA, 19 nt, Chlamydia trachomatis
cuuggucgcauuugaaaga

SEQ ID NO: 2509473 - RNA, 13 nt, Chlamydia trachomatis
cuuggugcagaag

SEQ ID NO: 2509474 - RNA, 20 nt, Chlamydia trachomatis
cuuggugcagaagaauagga

SEQ ID NO: 2509475 - RNA, 20 nt, Chlamydia trachomatis
cuugguuauacagagcaagg

SEQ ID NO: 2509476 - RNA, 22 nt, Chlamydia trachomatis
cuugguuuugucucgcagcacc

SEQ ID NO: 2509477 - RNA, 19 nt, Chlamydia trachomatis
cuuguaacuaagcuucuca

SEQ ID NO: 2509478 - RNA, 14 nt, Chlamydia trachomatis
cuuguaauaucaaa

SEQ ID NO: 2509479 - RNA, 15 nt, Chlamydia trachomatis
cuuguaauugcagua

SEQ ID NO: 2509480 - RNA, 17 nt, Chlamydia trachomatis
cuuguagagaggcaaac

SEQ ID NO: 2509481 - RNA, 20 nt, Chlamydia trachomatis
cuuguagugaaguucccuuu

SEQ ID NO: 2509482 - RNA, 17 nt, Chlamydia trachomatis
cuuguaucauauucuuu

SEQ ID NO: 2509483 - RNA, 18 nt, Chlamydia trachomatis
cuuguaucauauucuuug

SEQ ID NO: 2509484 - RNA, 18 nt, Chlamydia trachomatis
cuuguaugguuuguccuu

SEQ ID NO: 2509485 - RNA, 14 nt, Chlamydia trachomatis
cuugucuaaaagaa

SEQ ID NO: 2509486 - RNA, 15 nt, Chlamydia trachomatis
cuugugagagaaauu

SEQ ID NO: 2509487 - RNA, 15 nt, Chlamydia trachomatis
cuugugaggagcucu

SEQ ID NO: 2509488 - RNA, 14 nt, Chlamydia trachomatis
cuugugauaucucc

SEQ ID NO: 2509489 - RNA, 14 nt, Chlamydia trachomatis
cuugugcaaacaaa

SEQ ID NO: 2509490 - RNA, 18 nt, Chlamydia trachomatis
cuuguuagaaaugcaaau

SEQ ID NO: 2509491 - RNA, 18 nt, Chlamydia trachomatis
cuuguucccacaccaucu

SEQ ID NO: 2509492 - RNA, 21 nt, Chlamydia trachomatis
cuuguuuugcucgagaaauga

SEQ ID NO: 2509493 - RNA, 16 nt, Chlamydia trachomatis
cuuguuuuuuaagagu

SEQ ID NO: 2509494 - RNA, 14 nt, Chlamydia trachomatis
cuuuaacaucuuua

SEQ ID NO: 2509495 - RNA, 15 nt, Chlamydia trachomatis
cuuuaaccucugcaa

SEQ ID NO: 2509496 - RNA, 17 nt, Chlamydia trachomatis
cuuuaagaaaaaugcca

SEQ ID NO: 2509497 - RNA, 15 nt, Chlamydia trachomatis
cuuuaauaaaagcuc

SEQ ID NO: 2509498 - RNA, 16 nt, Chlamydia trachomatis
cuuuaauaauaagagc

SEQ ID NO: 2509499 - RNA, 13 nt, Chlamydia trachomatis
cuuuaauauuucc

SEQ ID NO: 2509500 - RNA, 22 nt, Chlamydia trachomatis
cuuuaccaaagaauucuugcua

SEQ ID NO: 2509501 - RNA, 17 nt, Chlamydia trachomatis
cuuuaccauuuccacag

SEQ ID NO: 2509502 - RNA, 15 nt, Chlamydia trachomatis
cuuuaccgacuucaa

SEQ ID NO: 2509503 - RNA, 20 nt, Chlamydia trachomatis
cuuuaccgacuucaacuucu

SEQ ID NO: 2509504 - RNA, 16 nt, Chlamydia trachomatis
cuuuaccgauaauuuu

SEQ ID NO: 2509505 - RNA, 16 nt, Chlamydia trachomatis
cuuuaccguuacagga

SEQ ID NO: 2509506 - RNA, 17 nt, Chlamydia trachomatis
cuuuaccguuacaggau

SEQ ID NO: 2509507 - RNA, 19 nt, Chlamydia trachomatis
cuuuaccguuacaggauag

SEQ ID NO: 2509508 - RNA, 20 nt, Chlamydia trachomatis
cuuuacuaggagcaaaaagu

SEQ ID NO: 2509509 - RNA, 18 nt, Chlamydia trachomatis
cuuuacucuuuucuuuau

SEQ ID NO: 2509510 - RNA, 19 nt, Chlamydia trachomatis
cuuuagauagucuucuacc

SEQ ID NO: 2509511 - RNA, 21 nt, Chlamydia trachomatis
cuuuagauagucuucuaccgc

SEQ ID NO: 2509512 - RNA, 22 nt, Chlamydia trachomatis
cuuuagcaaacuuuuuguaggu

SEQ ID NO: 2509513 - RNA, 14 nt, Chlamydia trachomatis
cuuuagcacuacag

SEQ ID NO: 2509514 - RNA, 21 nt, Chlamydia trachomatis
cuuuagcagccccccuuuuuu

SEQ ID NO: 2509515 - RNA, 21 nt, Chlamydia trachomatis
cuuuagcucgcuucaaaacua

SEQ ID NO: 2509516 - RNA, 17 nt, Chlamydia trachomatis
cuuuagcugcuuuaaau

SEQ ID NO: 2509517 - RNA, 17 nt, Chlamydia trachomatis
cuuuaggcgaauaagcu

SEQ ID NO: 2509518 - RNA, 22 nt, Chlamydia trachomatis
cuuuauaaucgaucacagaaac

SEQ ID NO: 2509519 - RNA, 22 nt, Chlamydia trachomatis
cuuuauagaaggucugaacaac

SEQ ID NO: 2509520 - RNA, 23 nt, Chlamydia trachomatis
cuuuaucagcgucaucuuugaga

SEQ ID NO: 2509521 - RNA, 23 nt, Chlamydia trachomatis
cuuuauccggagcuuuagaaaua

SEQ ID NO: 2509522 - RNA, 22 nt, Chlamydia trachomatis
cuuuaucucccccuguacccgu

SEQ ID NO: 2509523 - RNA, 16 nt, Chlamydia trachomatis
cuuuaugacuguugau

SEQ ID NO: 2509524 - RNA, 19 nt, Chlamydia trachomatis
cuuuaugacuguugaugau

SEQ ID NO: 2509525 - RNA, 20 nt, Chlamydia trachomatis
cuuuaugacuguugaugaug

SEQ ID NO: 2509526 - RNA, 22 nt, Chlamydia trachomatis
cuuuauggguagcgauacaaga

SEQ ID NO: 2509527 - RNA, 14 nt, Chlamydia trachomatis
cuuuauguaaggaa

SEQ ID NO: 2509528 - RNA, 15 nt, Chlamydia trachomatis
cuuuauguaaggaaa

SEQ ID NO: 2509529 - RNA, 13 nt, Chlamydia trachomatis
cuuuauuagaguu

SEQ ID NO: 2509530 - RNA, 12 nt, Chlamydia trachomatis
cuuuauuauuga

SEQ ID NO: 2509531 - RNA, 21 nt, Chlamydia trachomatis
cuuuauuauugaaaaagcuuu

SEQ ID NO: 2509532 - RNA, 12 nt, Chlamydia trachomatis
cuuuauucaaua

SEQ ID NO: 2509533 - RNA, 16 nt, Chlamydia trachomatis
cuuuauugaacccaua

SEQ ID NO: 2509534 - RNA, 20 nt, Chlamydia trachomatis
cuuuauugaacccauagauu

SEQ ID NO: 2509535 - RNA, 22 nt, Chlamydia trachomatis
cuuuauugaacccauagauuca

SEQ ID NO: 2509536 - RNA, 11 nt, Chlamydia trachomatis
cuuucaaagag

SEQ ID NO: 2509537 - RNA, 23 nt, Chlamydia trachomatis
cuuucaauagcauuucugccaaa

SEQ ID NO: 2509538 - RNA, 20 nt, Chlamydia trachomatis
cuuucagagaaaauuucucu

SEQ ID NO: 2509539 - RNA, 18 nt, Chlamydia trachomatis
cuuucagaugcacuuccu

SEQ ID NO: 2509540 - RNA, 13 nt, Chlamydia trachomatis
cuuucauaaaacc

SEQ ID NO: 2509541 - RNA, 9 nt, Chlamydia trachomatis
cuuuccaua

SEQ ID NO: 2509542 - RNA, 19 nt, Chlamydia trachomatis
cuuucccaguuauaacgau

SEQ ID NO: 2509543 - RNA, 14 nt, Chlamydia trachomatis
cuuucccuauuuuu

SEQ ID NO: 2509544 - RNA, 21 nt, Chlamydia trachomatis
cuuuccgacugcaguugauca

SEQ ID NO: 2509545 - RNA, 13 nt, Chlamydia trachomatis
cuuucguugauca

SEQ ID NO: 2509546 - RNA, 15 nt, Chlamydia trachomatis
cuuucuaauuucccu

SEQ ID NO: 2509547 - RNA, 23 nt, Chlamydia trachomatis
cuuucuacauggccaaacaucau

SEQ ID NO: 2509548 - RNA, 13 nt, Chlamydia trachomatis
cuuucuacauuuu

SEQ ID NO: 2509549 - RNA, 15 nt, Chlamydia trachomatis
cuuucucaugcguua

SEQ ID NO: 2509550 - RNA, 21 nt, Chlamydia trachomatis
cuuucuggaaucauucaucuu

SEQ ID NO: 2509551 - RNA, 14 nt, Chlamydia trachomatis
cuuucuuacuccuu

SEQ ID NO: 2509552 - RNA, 15 nt, Chlamydia trachomatis
cuuucuuccaucacu

SEQ ID NO: 2509553 - RNA, 17 nt, Chlamydia trachomatis
cuuucuucuaagaaguu

SEQ ID NO: 2509554 - RNA, 16 nt, Chlamydia trachomatis
cuuucuuucuaagaaa

SEQ ID NO: 2509555 - RNA, 17 nt, Chlamydia trachomatis
cuuugaacaaauuuauc

SEQ ID NO: 2509556 - RNA, 16 nt, Chlamydia trachomatis
cuuugaacauuuaucg

SEQ ID NO: 2509557 - RNA, 13 nt, Chlamydia trachomatis
cuuugaacuucaa

SEQ ID NO: 2509558 - RNA, 17 nt, Chlamydia trachomatis
cuuugaagccucgcuuu

SEQ ID NO: 2509559 - RNA, 19 nt, Chlamydia trachomatis
cuuugaagguaagaaaguc

SEQ ID NO: 2509560 - RNA, 20 nt, Chlamydia trachomatis
cuuugaauauccgaaugaau

SEQ ID NO: 2509561 - RNA, 22 nt, Chlamydia trachomatis
cuuugacgauagagaacaucuc

SEQ ID NO: 2509562 - RNA, 21 nt, Chlamydia trachomatis
cuuugaguccaacgcugcgcu

SEQ ID NO: 2509563 - RNA, 19 nt, Chlamydia trachomatis
cuuugauaauacucuucua

SEQ ID NO: 2509564 - RNA, 14 nt, Chlamydia trachomatis
cuuugaucuuuguu

SEQ ID NO: 2509565 - RNA, 18 nt, Chlamydia trachomatis
cuuugauuucugcagaga

SEQ ID NO: 2509566 - RNA, 15 nt, Chlamydia trachomatis
cuuugcuaacaaaga

SEQ ID NO: 2509567 - RNA, 13 nt, Chlamydia trachomatis
cuuuggaagaggc

SEQ ID NO: 2509568 - RNA, 14 nt, Chlamydia trachomatis
cuuuggaagaggcg

SEQ ID NO: 2509569 - RNA, 18 nt, Chlamydia trachomatis
cuuuggcagaaccuucca

SEQ ID NO: 2509570 - RNA, 19 nt, Chlamydia trachomatis
cuuuggcagaaccuuccac

SEQ ID NO: 2509571 - RNA, 17 nt, Chlamydia trachomatis
cuuuggcaugcccuaaa

SEQ ID NO: 2509572 - RNA, 21 nt, Chlamydia trachomatis
cuuugggauagauagcuccaa

SEQ ID NO: 2509573 - RNA, 13 nt, Chlamydia trachomatis
cuuugguaagauc

SEQ ID NO: 2509574 - RNA, 17 nt, Chlamydia trachomatis
cuuugguagcucguuuu

SEQ ID NO: 2509575 - RNA, 21 nt, Chlamydia trachomatis
cuuuguaguuagacaaaaaau

SEQ ID NO: 2509576 - RNA, 21 nt, Chlamydia trachomatis
cuuuguauaaugcaaccccca

SEQ ID NO: 2509577 - RNA, 16 nt, Chlamydia trachomatis
cuuuguauuaacgauu

SEQ ID NO: 2509578 - RNA, 21 nt, Chlamydia trachomatis
cuuugucacaaauuaccccaa

SEQ ID NO: 2509579 - RNA, 15 nt, Chlamydia trachomatis
cuuugucauuaaagg

SEQ ID NO: 2509580 - RNA, 18 nt, Chlamydia trachomatis
cuuugucuauaagguuca

SEQ ID NO: 2509581 - RNA, 20 nt, Chlamydia trachomatis
cuuugugcaaccucuauagc

SEQ ID NO: 2509582 - RNA, 22 nt, Chlamydia trachomatis
cuuugugcaaccucuauagcca

SEQ ID NO: 2509583 - RNA, 16 nt, Chlamydia trachomatis
cuuugugcauaaaagc

SEQ ID NO: 2509584 - RNA, 13 nt, Chlamydia trachomatis
cuuuguguaaagc

SEQ ID NO: 2509585 - RNA, 21 nt, Chlamydia trachomatis
cuuuguuauuuuuuaagaagu

SEQ ID NO: 2509586 - RNA, 18 nt, Chlamydia trachomatis
cuuuguugcaaacgguag

SEQ ID NO: 2509587 - RNA, 19 nt, Chlamydia trachomatis
cuuuuaaagggggacaaaa

SEQ ID NO: 2509588 - RNA, 20 nt, Chlamydia trachomatis
cuuuuaaagggggacaaaaa

SEQ ID NO: 2509589 - RNA, 13 nt, Chlamydia trachomatis
cuuuuaagggaau

SEQ ID NO: 2509590 - RNA, 14 nt, Chlamydia trachomatis
cuuuuaaguagagc

SEQ ID NO: 2509591 - RNA, 22 nt, Chlamydia trachomatis
cuuuuacaauagcauuugucuu

SEQ ID NO: 2509592 - RNA, 23 nt, Chlamydia trachomatis
cuuuuagcgaucucccguacuuu

SEQ ID NO: 2509593 - RNA, 15 nt, Chlamydia trachomatis
cuuuuaucuucuuaa

SEQ ID NO: 2509594 - RNA, 20 nt, Chlamydia trachomatis
cuuuuaucuucuuaauugcc

SEQ ID NO: 2509595 - RNA, 22 nt, Chlamydia trachomatis
cuuuuauuagggcucucuuuuu

SEQ ID NO: 2509596 - RNA, 15 nt, Chlamydia trachomatis
cuuuucaacaaucca

SEQ ID NO: 2509597 - RNA, 16 nt, Chlamydia trachomatis
cuuuucaacaauccac

SEQ ID NO: 2509598 - RNA, 23 nt, Chlamydia trachomatis
cuuuucaaguucuaacuuuugau

SEQ ID NO: 2509599 - RNA, 16 nt, Chlamydia trachomatis
cuuuucacaaagagaa

SEQ ID NO: 2509600 - RNA, 16 nt, Chlamydia trachomatis
cuuuucacaagguguc

SEQ ID NO: 2509601 - RNA, 15 nt, Chlamydia trachomatis
cuuuuccuaaacaaa

SEQ ID NO: 2509602 - RNA, 22 nt, Chlamydia trachomatis
cuuuuccuccauaggaauacga

SEQ ID NO: 2509603 - RNA, 21 nt, Chlamydia trachomatis
cuuuuccugggaggacuucua

SEQ ID NO: 2509604 - RNA, 15 nt, Chlamydia trachomatis
cuuuucgaacaaaac

SEQ ID NO: 2509605 - RNA, 17 nt, Chlamydia trachomatis
cuuuucgaacaaaacuu

SEQ ID NO: 2509606 - RNA, 15 nt, Chlamydia trachomatis
cuuuucuauuuagag

SEQ ID NO: 2509607 - RNA, 15 nt, Chlamydia trachomatis
cuuuucuauuuuuag

SEQ ID NO: 2509608 - RNA, 14 nt, Chlamydia trachomatis
cuuuucuccuucuu

SEQ ID NO: 2509609 - RNA, 21 nt, Chlamydia trachomatis
cuuuucugaaacgcacuccaa

SEQ ID NO: 2509610 - RNA, 22 nt, Chlamydia trachomatis
cuuuucugaaacgcacuccaau

SEQ ID NO: 2509611 - RNA, 17 nt, Chlamydia trachomatis
cuuuucugagacuccag

SEQ ID NO: 2509612 - RNA, 23 nt, Chlamydia trachomatis
cuuuucuuccucaguauaaaaaa

SEQ ID NO: 2509613 - RNA, 21 nt, Chlamydia trachomatis
cuuuugaaacaucuuuuaaag

SEQ ID NO: 2509614 - RNA, 15 nt, Chlamydia trachomatis
cuuuugaucuuucca

SEQ ID NO: 2509615 - RNA, 18 nt, Chlamydia trachomatis
cuuuugcaaaaauuuuca

SEQ ID NO: 2509616 - RNA, 22 nt, Chlamydia trachomatis
cuuuugccuauagagcaaucuc

SEQ ID NO: 2509617 - RNA, 19 nt, Chlamydia trachomatis
cuuuugcuguggaaaaauu

SEQ ID NO: 2509618 - RNA, 19 nt, Chlamydia trachomatis
cuuuuggaagaucucuuuc

SEQ ID NO: 2509619 - RNA, 18 nt, Chlamydia trachomatis
cuuuuguuccagaaaaaa

SEQ ID NO: 2509620 - RNA, 13 nt, Chlamydia trachomatis
cuuuuguuuucaa

SEQ ID NO: 2509621 - RNA, 14 nt, Chlamydia trachomatis
cuuuuguuuucaaa

SEQ ID NO: 2509622 - RNA, 17 nt, Chlamydia trachomatis
cuuuuguuuucaaaagc

SEQ ID NO: 2509623 - RNA, 10 nt, Chlamydia trachomatis
cuuuuuagcg

SEQ ID NO: 2509624 - RNA, 16 nt, Chlamydia trachomatis
cuuuuucagacaaaaa

SEQ ID NO: 2509625 - RNA, 15 nt, Chlamydia trachomatis
cuuuuucauuuuaug

SEQ ID NO: 2509626 - RNA, 12 nt, Chlamydia trachomatis
cuuuuuccucuu

SEQ ID NO: 2509627 - RNA, 16 nt, Chlamydia trachomatis
cuuuuugauuuuucuu

SEQ ID NO: 2509628 - RNA, 20 nt, Chlamydia trachomatis
cuuuuuguuagcggaacaag

SEQ ID NO: 2509629 - RNA, 15 nt, Chlamydia trachomatis
cuuuuuuacauaauc

SEQ ID NO: 2509630 - RNA, 14 nt, Chlamydia trachomatis
cuuuuuuuauucuu

SEQ ID NO: 2509631 - RNA, 23 nt, Chlamydia trachomatis
cuuuuuuugcucaaugauaguga

SEQ ID NO: 2509632 - RNA, 12 nt, Chlamydia trachomatis
gaaaaaaaacca

SEQ ID NO: 2509633 - RNA, 14 nt, Chlamydia trachomatis
gaaaaaaccacaga

SEQ ID NO: 2509634 - RNA, 20 nt, Chlamydia trachomatis
gaaaaaaggucucucuuuau

SEQ ID NO: 2509635 - RNA, 12 nt, Chlamydia trachomatis
gaaaaaaugccu

SEQ ID NO: 2509636 - RNA, 15 nt, Chlamydia trachomatis
gaaaaagaagauccc

SEQ ID NO: 2509637 - RNA, 17 nt, Chlamydia trachomatis
gaaaaagaagaucccau

SEQ ID NO: 2509638 - RNA, 19 nt, Chlamydia trachomatis
gaaaaagaagcuaauagcu

SEQ ID NO: 2509639 - RNA, 19 nt, Chlamydia trachomatis
gaaaaagggagaggauucc

SEQ ID NO: 2509640 - RNA, 15 nt, Chlamydia trachomatis
gaaaaauaaaaauag

SEQ ID NO: 2509641 - RNA, 13 nt, Chlamydia trachomatis
gaaaaaucacaau

SEQ ID NO: 2509642 - RNA, 14 nt, Chlamydia trachomatis
gaaaaauccuucca

SEQ ID NO: 2509643 - RNA, 14 nt, Chlamydia trachomatis
gaaaacgauaaaaa

SEQ ID NO: 2509644 - RNA, 16 nt, Chlamydia trachomatis
gaaaacgucucccccu

SEQ ID NO: 2509645 - RNA, 14 nt, Chlamydia trachomatis
gaaaacuuucucgc

SEQ ID NO: 2509646 - RNA, 13 nt, Chlamydia trachomatis
gaaaagaaaaggg

SEQ ID NO: 2509647 - RNA, 14 nt, Chlamydia trachomatis
gaaaagaaaagggg

SEQ ID NO: 2509648 - RNA, 21 nt, Chlamydia trachomatis
gaaaagaacccuauccccccu

SEQ ID NO: 2509649 - RNA, 17 nt, Chlamydia trachomatis
gaaaagacucucccucu

SEQ ID NO: 2509650 - RNA, 21 nt, Chlamydia trachomatis
gaaaagacucucccucuugua

SEQ ID NO: 2509651 - RNA, 11 nt, Chlamydia trachomatis
gaaaagagaag

SEQ ID NO: 2509652 - RNA, 14 nt, Chlamydia trachomatis
gaaaagagaagaag

SEQ ID NO: 2509653 - RNA, 15 nt, Chlamydia trachomatis
gaaaagauuucagag

SEQ ID NO: 2509654 - RNA, 12 nt, Chlamydia trachomatis
gaaaagcuucug

SEQ ID NO: 2509655 - RNA, 16 nt, Chlamydia trachomatis
gaaaagcuuucaaagc

SEQ ID NO: 2509656 - RNA, 17 nt, Chlamydia trachomatis
gaaaagucgcccauauu

SEQ ID NO: 2509657 - RNA, 14 nt, Chlamydia trachomatis
gaaaauacacagca

SEQ ID NO: 2509658 - RNA, 18 nt, Chlamydia trachomatis
gaaaauacacagcaucaa

SEQ ID NO: 2509659 - RNA, 22 nt, Chlamydia trachomatis
gaaaauacgcgcgcuaagacuu

SEQ ID NO: 2509660 - RNA, 23 nt, Chlamydia trachomatis
gaaaauacggaagagucuguuuc

SEQ ID NO: 2509661 - RNA, 14 nt, Chlamydia trachomatis
gaaaauagauuuuc

SEQ ID NO: 2509662 - RNA, 16 nt, Chlamydia trachomatis
gaaaaucauacauccu

SEQ ID NO: 2509663 - RNA, 18 nt, Chlamydia trachomatis
gaaaaucgcuauuucccc

SEQ ID NO: 2509664 - RNA, 21 nt, Chlamydia trachomatis
gaaaaucugggauauauagac

SEQ ID NO: 2509665 - RNA, 15 nt, Chlamydia trachomatis
gaaaaugaugaaaaa

SEQ ID NO: 2509666 - RNA, 17 nt, Chlamydia trachomatis
gaaaaugaugaaaaaga

SEQ ID NO: 2509667 - RNA, 16 nt, Chlamydia trachomatis
gaaaaugcucuaaagg

SEQ ID NO: 2509668 - RNA, 13 nt, Chlamydia trachomatis
gaaaauuucucuu

SEQ ID NO: 2509669 - RNA, 20 nt, Chlamydia trachomatis
gaaacaaauaacuuuuucuc

SEQ ID NO: 2509670 - RNA, 22 nt, Chlamydia trachomatis
gaaacaaauaacuuuuucucuu

SEQ ID NO: 2509671 - RNA, 15 nt, Chlamydia trachomatis
gaaacaacaaagaac

SEQ ID NO: 2509672 - RNA, 15 nt, Chlamydia trachomatis
gaaacaccucuccuu

SEQ ID NO: 2509673 - RNA, 17 nt, Chlamydia trachomatis
gaaacagccugcuuucu

SEQ ID NO: 2509674 - RNA, 19 nt, Chlamydia trachomatis
gaaacagccugcuuucuuc

SEQ ID NO: 2509675 - RNA, 20 nt, Chlamydia trachomatis
gaaacagcuucuucuucucu

SEQ ID NO: 2509676 - RNA, 15 nt, Chlamydia trachomatis
gaaacaguagaaacu

SEQ ID NO: 2509677 - RNA, 15 nt, Chlamydia trachomatis
gaaacauuccaaaua

SEQ ID NO: 2509678 - RNA, 16 nt, Chlamydia trachomatis
gaaacauuccaaauau

SEQ ID NO: 2509679 - RNA, 20 nt, Chlamydia trachomatis
gaaacauuugcgugauaaaa

SEQ ID NO: 2509680 - RNA, 21 nt, Chlamydia trachomatis
gaaacauuugcgugauaaaaa

SEQ ID NO: 2509681 - RNA, 14 nt, Chlamydia trachomatis
gaaaccaaaauauc

SEQ ID NO: 2509682 - RNA, 20 nt, Chlamydia trachomatis
gaaaccccaauguuucccau

SEQ ID NO: 2509683 - RNA, 21 nt, Chlamydia trachomatis
gaaaccuguuucugaaucaaa

SEQ ID NO: 2509684 - RNA, 16 nt, Chlamydia trachomatis
gaaacguguaauuucc

SEQ ID NO: 2509685 - RNA, 18 nt, Chlamydia trachomatis
gaaacuauugaucaaagu

SEQ ID NO: 2509686 - RNA, 18 nt, Chlamydia trachomatis
gaaacucaucuucggaca

SEQ ID NO: 2509687 - RNA, 15 nt, Chlamydia trachomatis
gaaacuguaaugucc

SEQ ID NO: 2509688 - RNA, 13 nt, Chlamydia trachomatis
gaaacuucuucua

SEQ ID NO: 2509689 - RNA, 21 nt, Chlamydia trachomatis
gaaacuugguugcccuuccga

SEQ ID NO: 2509690 - RNA, 14 nt, Chlamydia trachomatis
gaaacuuuccuacu

SEQ ID NO: 2509691 - RNA, 15 nt, Chlamydia trachomatis
gaaagaaugagguaa

SEQ ID NO: 2509692 - RNA, 16 nt, Chlamydia trachomatis
gaaagaaugcuugaug

SEQ ID NO: 2509693 - RNA, 13 nt, Chlamydia trachomatis
gaaagaauuugcu

SEQ ID NO: 2509694 - RNA, 14 nt, Chlamydia trachomatis
gaaagagaaucauc

SEQ ID NO: 2509695 - RNA, 12 nt, Chlamydia trachomatis
gaaagagcuucu

SEQ ID NO: 2509696 - RNA, 16 nt, Chlamydia trachomatis
gaaagagugauucggu

SEQ ID NO: 2509697 - RNA, 20 nt, Chlamydia trachomatis
gaaagaguucuccucccaga

SEQ ID NO: 2509698 - RNA, 21 nt, Chlamydia trachomatis
gaaagauuugaucuucuggaa

SEQ ID NO: 2509699 - RNA, 14 nt, Chlamydia trachomatis
gaaagcacuuugug

SEQ ID NO: 2509700 - RNA, 18 nt, Chlamydia trachomatis
gaaagcauccccaaaagg

SEQ ID NO: 2509701 - RNA, 20 nt, Chlamydia trachomatis
gaaagcauccccaaaaggau

SEQ ID NO: 2509702 - RNA, 14 nt, Chlamydia trachomatis
gaaagccuucucuu

SEQ ID NO: 2509703 - RNA, 17 nt, Chlamydia trachomatis
gaaagcgugcauuugag

SEQ ID NO: 2509704 - RNA, 17 nt, Chlamydia trachomatis
gaaagcuagaagaauca

SEQ ID NO: 2509705 - RNA, 17 nt, Chlamydia trachomatis
gaaagcuauuuucuucc

SEQ ID NO: 2509706 - RNA, 21 nt, Chlamydia trachomatis
gaaagcuauuuucuuccugcu

SEQ ID NO: 2509707 - RNA, 22 nt, Chlamydia trachomatis
gaaagcuauuuucuuccugcuu

SEQ ID NO: 2509708 - RNA, 22 nt, Chlamydia trachomatis
gaaagcuucuaagaacaacgcu

SEQ ID NO: 2509709 - RNA, 14 nt, Chlamydia trachomatis
gaaagggaggagga

SEQ ID NO: 2509710 - RNA, 15 nt, Chlamydia trachomatis
gaaagguuuuucuua

SEQ ID NO: 2509711 - RNA, 22 nt, Chlamydia trachomatis
gaaaguacucgauggcagggaa

SEQ ID NO: 2509712 - RNA, 12 nt, Chlamydia trachomatis
gaaaguccugcu

SEQ ID NO: 2509713 - RNA, 22 nt, Chlamydia trachomatis
gaaaguccugcuucuuuuuccc

SEQ ID NO: 2509714 - RNA, 22 nt, Chlamydia trachomatis
gaaaguuccgguauauucuuca

SEQ ID NO: 2509715 - RNA, 15 nt, Chlamydia trachomatis
gaaaguugcucccaa

SEQ ID NO: 2509716 - RNA, 13 nt, Chlamydia trachomatis
gaaauaaaaaccu

SEQ ID NO: 2509717 - RNA, 16 nt, Chlamydia trachomatis
gaaauaaaaaccuuga

SEQ ID NO: 2509718 - RNA, 12 nt, Chlamydia trachomatis
gaaauaaaaagc

SEQ ID NO: 2509719 - RNA, 14 nt, Chlamydia trachomatis
gaaauaaaaagccc

SEQ ID NO: 2509720 - RNA, 15 nt, Chlamydia trachomatis
gaaauaaaaagccca

SEQ ID NO: 2509721 - RNA, 22 nt, Chlamydia trachomatis
gaaauaaaaagcccagaacaac

SEQ ID NO: 2509722 - RNA, 15 nt, Chlamydia trachomatis
gaaauaaaauggaaa

SEQ ID NO: 2509723 - RNA, 23 nt, Chlamydia trachomatis
gaaauaaaauggaaauaaaaagc

SEQ ID NO: 2509724 - RNA, 14 nt, Chlamydia trachomatis
gaaauaaagaucuu

SEQ ID NO: 2509725 - RNA, 14 nt, Chlamydia trachomatis
gaaauaacaaagca

SEQ ID NO: 2509726 - RNA, 21 nt, Chlamydia trachomatis
gaaauaaccuaggagcauucc

SEQ ID NO: 2509727 - RNA, 15 nt, Chlamydia trachomatis
gaaauaagagaggcu

SEQ ID NO: 2509728 - RNA, 20 nt, Chlamydia trachomatis
gaaauaagucuuuuacuuug

SEQ ID NO: 2509729 - RNA, 18 nt, Chlamydia trachomatis
gaaauagccauucccuaa

SEQ ID NO: 2509730 - RNA, 20 nt, Chlamydia trachomatis
gaaauagcuaucaauaaaga

SEQ ID NO: 2509731 - RNA, 18 nt, Chlamydia trachomatis
gaaauagcuuaccucaau

SEQ ID NO: 2509732 - RNA, 23 nt, Chlamydia trachomatis
gaaauagcuuaccucaauagcag

SEQ ID NO: 2509733 - RNA, 22 nt, Chlamydia trachomatis
gaaauaggaccgacauuaguau

SEQ ID NO: 2509734 - RNA, 19 nt, Chlamydia trachomatis
gaaauaggauuuaaaccau

SEQ ID NO: 2509735 - RNA, 15 nt, Chlamydia trachomatis
gaaauaucaauuccu

SEQ ID NO: 2509736 - RNA, 19 nt, Chlamydia trachomatis
gaaauaugacagagcccuu

SEQ ID NO: 2509737 - RNA, 20 nt, Chlamydia trachomatis
gaaaucaaaaggccaacgca

SEQ ID NO: 2509738 - RNA, 19 nt, Chlamydia trachomatis
gaaauccccagucucucca

SEQ ID NO: 2509739 - RNA, 13 nt, Chlamydia trachomatis
gaaaucgcaugag

SEQ ID NO: 2509740 - RNA, 21 nt, Chlamydia trachomatis
gaaaucuucucuugaaucaaa

SEQ ID NO: 2509741 - RNA, 14 nt, Chlamydia trachomatis
gaaaucuucuuaua

SEQ ID NO: 2509742 - RNA, 18 nt, Chlamydia trachomatis
gaaaucuucuuauacagc

SEQ ID NO: 2509743 - RNA, 16 nt, Chlamydia trachomatis
gaaaucuugugcuaag

SEQ ID NO: 2509744 - RNA, 16 nt, Chlamydia trachomatis
gaaaugagagcuagca

SEQ ID NO: 2509745 - RNA, 16 nt, Chlamydia trachomatis
gaaaugcaaauuugca

SEQ ID NO: 2509746 - RNA, 23 nt, Chlamydia trachomatis
gaaaugcgugaacuguucauucu

SEQ ID NO: 2509747 - RNA, 13 nt, Chlamydia trachomatis
gaaauggucucuu

SEQ ID NO: 2509748 - RNA, 18 nt, Chlamydia trachomatis
gaaauguugugugaugaa

SEQ ID NO: 2509749 - RNA, 23 nt, Chlamydia trachomatis
gaaauguuugaucugagaaagcu

SEQ ID NO: 2509750 - RNA, 12 nt, Chlamydia trachomatis
gaaauuacagaa

SEQ ID NO: 2509751 - RNA, 20 nt, Chlamydia trachomatis
gaaauuaucgccaaaaauca

SEQ ID NO: 2509752 - RNA, 18 nt, Chlamydia trachomatis
gaaauucaauuaaagcca

SEQ ID NO: 2509753 - RNA, 17 nt, Chlamydia trachomatis
gaaauucaucaugagaa

SEQ ID NO: 2509754 - RNA, 18 nt, Chlamydia trachomatis
gaaauucaucaugagaac

SEQ ID NO: 2509755 - RNA, 23 nt, Chlamydia trachomatis
gaaauugauagugaaauaagucu

SEQ ID NO: 2509756 - RNA, 15 nt, Chlamydia trachomatis
gaaauuuuaaauccc

SEQ ID NO: 2509757 - RNA, 19 nt, Chlamydia trachomatis
gaacaaaacuugucuaaaa

SEQ ID NO: 2509758 - RNA, 23 nt, Chlamydia trachomatis
gaacaaacgaaggagcuuugauu

SEQ ID NO: 2509759 - RNA, 19 nt, Chlamydia trachomatis
gaacaacagucguaauugc

SEQ ID NO: 2509760 - RNA, 11 nt, Chlamydia trachomatis
gaacaacugcu

SEQ ID NO: 2509761 - RNA, 13 nt, Chlamydia trachomatis
gaacaacugcuga

SEQ ID NO: 2509762 - RNA, 20 nt, Chlamydia trachomatis
gaacaacuugaucuacagca

SEQ ID NO: 2509763 - RNA, 15 nt, Chlamydia trachomatis
gaacaagcaaaacau

SEQ ID NO: 2509764 - RNA, 22 nt, Chlamydia trachomatis
gaacaagugcagcguucugaga

SEQ ID NO: 2509765 - RNA, 13 nt, Chlamydia trachomatis
gaacaaucggaaa

SEQ ID NO: 2509766 - RNA, 17 nt, Chlamydia trachomatis
gaacaaucuggagcuaa

SEQ ID NO: 2509767 - RNA, 17 nt, Chlamydia trachomatis
gaacacacuuuccccau

SEQ ID NO: 2509768 - RNA, 19 nt, Chlamydia trachomatis
gaacagauuuagagaauaa

SEQ ID NO: 2509769 - RNA, 15 nt, Chlamydia trachomatis
gaacagcagcagugc

SEQ ID NO: 2509770 - RNA, 15 nt, Chlamydia trachomatis
gaacagcucuaaaga

SEQ ID NO: 2509771 - RNA, 18 nt, Chlamydia trachomatis
gaacaggggaccaaaaaa

SEQ ID NO: 2509772 - RNA, 14 nt, Chlamydia trachomatis
gaacagguuucuua

SEQ ID NO: 2509773 - RNA, 23 nt, Chlamydia trachomatis
gaacagugacagcauagauauug

SEQ ID NO: 2509774 - RNA, 18 nt, Chlamydia trachomatis
gaacaguguccuuccaug

SEQ ID NO: 2509775 - RNA, 18 nt, Chlamydia trachomatis
gaacauaccguagauccu

SEQ ID NO: 2509776 - RNA, 16 nt, Chlamydia trachomatis
gaacaucgagaaaaug

SEQ ID NO: 2509777 - RNA, 22 nt, Chlamydia trachomatis
gaacaucucggucuuagaagga

SEQ ID NO: 2509778 - RNA, 16 nt, Chlamydia trachomatis
gaacauggcugcagga

SEQ ID NO: 2509779 - RNA, 14 nt, Chlamydia trachomatis
gaacauuuaucgua

SEQ ID NO: 2509780 - RNA, 22 nt, Chlamydia trachomatis
gaaccaaacgauuauguucugu

SEQ ID NO: 2509781 - RNA, 12 nt, Chlamydia trachomatis
gaaccacaaaau

SEQ ID NO: 2509782 - RNA, 16 nt, Chlamydia trachomatis
gaaccacaaaaucagc

SEQ ID NO: 2509783 - RNA, 15 nt, Chlamydia trachomatis
gaaccacaaccucuc

SEQ ID NO: 2509784 - RNA, 23 nt, Chlamydia trachomatis
gaacccuauccccccuacauugu

SEQ ID NO: 2509785 - RNA, 15 nt, Chlamydia trachomatis
gaacccucuucauaa

SEQ ID NO: 2509786 - RNA, 13 nt, Chlamydia trachomatis
gaaccgcaagcaa

SEQ ID NO: 2509787 - RNA, 15 nt, Chlamydia trachomatis
gaaccgcaagcaaac

SEQ ID NO: 2509788 - RNA, 18 nt, Chlamydia trachomatis
gaaccgcagcaacaugca

SEQ ID NO: 2509789 - RNA, 15 nt, Chlamydia trachomatis
gaaccgggauugcug

SEQ ID NO: 2509790 - RNA, 17 nt, Chlamydia trachomatis
gaaccuagaucuaagga

SEQ ID NO: 2509791 - RNA, 16 nt, Chlamydia trachomatis
gaaccucaauagcuga

SEQ ID NO: 2509792 - RNA, 21 nt, Chlamydia trachomatis
gaacgagaaaaagguauuaga

SEQ ID NO: 2509793 - RNA, 19 nt, Chlamydia trachomatis
gaacgcaauguuuuacaaa

SEQ ID NO: 2509794 - RNA, 14 nt, Chlamydia trachomatis
gaacgcuagaaaca

SEQ ID NO: 2509795 - RNA, 20 nt, Chlamydia trachomatis
gaacgcuuccugaacgauaa

SEQ ID NO: 2509796 - RNA, 19 nt, Chlamydia trachomatis
gaacgcuuuccgaagguug

SEQ ID NO: 2509797 - RNA, 19 nt, Chlamydia trachomatis
gaacguacuuuaggagaaa

SEQ ID NO: 2509798 - RNA, 19 nt, Chlamydia trachomatis
gaacucaaaauaaagaaau

SEQ ID NO: 2509799 - RNA, 14 nt, Chlamydia trachomatis
gaacucccccuuuc

SEQ ID NO: 2509800 - RNA, 16 nt, Chlamydia trachomatis
gaacucgcguauuuuu

SEQ ID NO: 2509801 - RNA, 14 nt, Chlamydia trachomatis
gaacucuccucucc

SEQ ID NO: 2509802 - RNA, 21 nt, Chlamydia trachomatis
gaacucuuuauuaaacuccca

SEQ ID NO: 2509803 - RNA, 13 nt, Chlamydia trachomatis
gaacugcuucccu

SEQ ID NO: 2509804 - RNA, 20 nt, Chlamydia trachomatis
gaacugucuucuuucaaaga

SEQ ID NO: 2509805 - RNA, 16 nt, Chlamydia trachomatis
gaacuuauuggugagu

SEQ ID NO: 2509806 - RNA, 19 nt, Chlamydia trachomatis
gaacuuauuggugagugca

SEQ ID NO: 2509807 - RNA, 18 nt, Chlamydia trachomatis
gaacuucuccuggaaggu

SEQ ID NO: 2509808 - RNA, 20 nt, Chlamydia trachomatis
gaacuuuauuauugaaaaag

SEQ ID NO: 2509809 - RNA, 23 nt, Chlamydia trachomatis
gaagaaauauucccaaagcuagg

SEQ ID NO: 2509810 - RNA, 23 nt, Chlamydia trachomatis
gaagaaauccccagucucuccau

SEQ ID NO: 2509811 - RNA, 18 nt, Chlamydia trachomatis
gaagaacacacuuucccc

SEQ ID NO: 2509812 - RNA, 14 nt, Chlamydia trachomatis
gaagaacagcagca

SEQ ID NO: 2509813 - RNA, 17 nt, Chlamydia trachomatis
gaagaacccucuucaua

SEQ ID NO: 2509814 - RNA, 17 nt, Chlamydia trachomatis
gaagaaccgaauuugua

SEQ ID NO: 2509815 - RNA, 19 nt, Chlamydia trachomatis
gaagaacgccugaucaaau

SEQ ID NO: 2509816 - RNA, 17 nt, Chlamydia trachomatis
gaagaacugcagugaca

SEQ ID NO: 2509817 - RNA, 15 nt, Chlamydia trachomatis
gaagaagaagaacug

SEQ ID NO: 2509818 - RNA, 15 nt, Chlamydia trachomatis
gaagaagaggaggau

SEQ ID NO: 2509819 - RNA, 14 nt, Chlamydia trachomatis
gaagaagaggguuu

SEQ ID NO: 2509820 - RNA, 17 nt, Chlamydia trachomatis
gaagaagauaguagaga

SEQ ID NO: 2509821 - RNA, 18 nt, Chlamydia trachomatis
gaagaaguuuacgaacaa

SEQ ID NO: 2509822 - RNA, 16 nt, Chlamydia trachomatis
gaagaaguuuuuuguc

SEQ ID NO: 2509823 - RNA, 18 nt, Chlamydia trachomatis
gaagaauucgcacuaucu

SEQ ID NO: 2509824 - RNA, 13 nt, Chlamydia trachomatis
gaagaccaaaaau

SEQ ID NO: 2509825 - RNA, 17 nt, Chlamydia trachomatis
gaagacuaaucuuccag

SEQ ID NO: 2509826 - RNA, 19 nt, Chlamydia trachomatis
gaagacuucgaggcucccc

SEQ ID NO: 2509827 - RNA, 17 nt, Chlamydia trachomatis
gaagacuuuggaagagg

SEQ ID NO: 2509828 - RNA, 15 nt, Chlamydia trachomatis
gaagagccaucaaau

SEQ ID NO: 2509829 - RNA, 23 nt, Chlamydia trachomatis
gaagagcuuugcacaccugcuuu

SEQ ID NO: 2509830 - RNA, 14 nt, Chlamydia trachomatis
gaagagggaagaga

SEQ ID NO: 2509831 - RNA, 16 nt, Chlamydia trachomatis
gaagagggaagagaaa

SEQ ID NO: 2509832 - RNA, 15 nt, Chlamydia trachomatis
gaagagguauguuug

SEQ ID NO: 2509833 - RNA, 13 nt, Chlamydia trachomatis
gaagagucucuaa

SEQ ID NO: 2509834 - RNA, 20 nt, Chlamydia trachomatis
gaagagucuguuucugucug

SEQ ID NO: 2509835 - RNA, 15 nt, Chlamydia trachomatis
gaagauaaccaagcu

SEQ ID NO: 2509836 - RNA, 16 nt, Chlamydia trachomatis
gaagauaaguccuccu

SEQ ID NO: 2509837 - RNA, 18 nt, Chlamydia trachomatis
gaagauaauggcaaaaau

SEQ ID NO: 2509838 - RNA, 15 nt, Chlamydia trachomatis
gaagauacagccugc

SEQ ID NO: 2509839 - RNA, 21 nt, Chlamydia trachomatis
gaagauaguagagaauuagag

SEQ ID NO: 2509840 - RNA, 19 nt, Chlamydia trachomatis
gaagaucccaacaggagau

SEQ ID NO: 2509841 - RNA, 21 nt, Chlamydia trachomatis
gaagauccuucgcaggggaau

SEQ ID NO: 2509842 - RNA, 17 nt, Chlamydia trachomatis
gaagaucuuuccuugug

SEQ ID NO: 2509843 - RNA, 13 nt, Chlamydia trachomatis
gaagauggagaug

SEQ ID NO: 2509844 - RNA, 21 nt, Chlamydia trachomatis
gaagauuauaccagcagaccc

SEQ ID NO: 2509845 - RNA, 15 nt, Chlamydia trachomatis
gaagauucgcugcug

SEQ ID NO: 2509846 - RNA, 23 nt, Chlamydia trachomatis
gaagcaauacgauugguuuaaua

SEQ ID NO: 2509847 - RNA, 18 nt, Chlamydia trachomatis
gaagcauagggcuaagaa

SEQ ID NO: 2509848 - RNA, 16 nt, Chlamydia trachomatis
gaagcauucucucaua

SEQ ID NO: 2509849 - RNA, 17 nt, Chlamydia trachomatis
gaagcauucucucauaa

SEQ ID NO: 2509850 - RNA, 23 nt, Chlamydia trachomatis
gaagcauucucucauaagaucuu

SEQ ID NO: 2509851 - RNA, 16 nt, Chlamydia trachomatis
gaagccaaaagaucuu

SEQ ID NO: 2509852 - RNA, 15 nt, Chlamydia trachomatis
gaagccacaaccacu

SEQ ID NO: 2509853 - RNA, 23 nt, Chlamydia trachomatis
gaagcgacagcccaagaucuucc

SEQ ID NO: 2509854 - RNA, 22 nt, Chlamydia trachomatis
gaagcguucgcgucuagcuuuu

SEQ ID NO: 2509855 - RNA, 20 nt, Chlamydia trachomatis
gaagcuaauagcuugaagaa

SEQ ID NO: 2509856 - RNA, 14 nt, Chlamydia trachomatis
gaagcuaugagaau

SEQ ID NO: 2509857 - RNA, 15 nt, Chlamydia trachomatis
gaagcuccaaagaac

SEQ ID NO: 2509858 - RNA, 16 nt, Chlamydia trachomatis
gaagcuccucuucuuc

SEQ ID NO: 2509859 - RNA, 18 nt, Chlamydia trachomatis
gaagcuccucuucuucug

SEQ ID NO: 2509860 - RNA, 16 nt, Chlamydia trachomatis
gaagcucggucucauu

SEQ ID NO: 2509861 - RNA, 19 nt, Chlamydia trachomatis
gaagcucggucucauuaua

SEQ ID NO: 2509862 - RNA, 19 nt, Chlamydia trachomatis
gaagcugcaguuucugaga

SEQ ID NO: 2509863 - RNA, 16 nt, Chlamydia trachomatis
gaaggaaaaagaaaaa

SEQ ID NO: 2509864 - RNA, 17 nt, Chlamydia trachomatis
gaaggaaaaagaaaaaa

SEQ ID NO: 2509865 - RNA, 19 nt, Chlamydia trachomatis
gaaggaaagcuaugcccag

SEQ ID NO: 2509866 - RNA, 22 nt, Chlamydia trachomatis
gaaggaaagcuaugcccaggau

SEQ ID NO: 2509867 - RNA, 22 nt, Chlamydia trachomatis
gaaggaauggguaggauuacaa

SEQ ID NO: 2509868 - RNA, 22 nt, Chlamydia trachomatis
gaaggaaugguuacuugccucu

SEQ ID NO: 2509869 - RNA, 16 nt, Chlamydia trachomatis
gaaggagauguuaucu

SEQ ID NO: 2509870 - RNA, 14 nt, Chlamydia trachomatis
gaaggagcuaagaa

SEQ ID NO: 2509871 - RNA, 15 nt, Chlamydia trachomatis
gaaggagugugaucg

SEQ ID NO: 2509872 - RNA, 14 nt, Chlamydia trachomatis
gaaggaucuaugaa

SEQ ID NO: 2509873 - RNA, 14 nt, Chlamydia trachomatis
gaaggaucuuccag

SEQ ID NO: 2509874 - RNA, 19 nt, Chlamydia trachomatis
gaaggcuuuucuauuuuua

SEQ ID NO: 2509875 - RNA, 17 nt, Chlamydia trachomatis
gaagggaacagucucuu

SEQ ID NO: 2509876 - RNA, 12 nt, Chlamydia trachomatis
gaagguauuuua

SEQ ID NO: 2509877 - RNA, 19 nt, Chlamydia trachomatis
gaagguauuuuagagaaaa

SEQ ID NO: 2509878 - RNA, 15 nt, Chlamydia trachomatis
gaaguaaaacagaag

SEQ ID NO: 2509879 - RNA, 16 nt, Chlamydia trachomatis
gaaguaacaccucuuc

SEQ ID NO: 2509880 - RNA, 17 nt, Chlamydia trachomatis
gaaguagucuacuccau

SEQ ID NO: 2509881 - RNA, 14 nt, Chlamydia trachomatis
gaaguaucuaugau

SEQ ID NO: 2509882 - RNA, 22 nt, Chlamydia trachomatis
gaagucaugcggauuaaagaag

SEQ ID NO: 2509883 - RNA, 19 nt, Chlamydia trachomatis
gaagucuaccguauuaucu

SEQ ID NO: 2509884 - RNA, 17 nt, Chlamydia trachomatis
gaagucuuguccuuccc

SEQ ID NO: 2509885 - RNA, 19 nt, Chlamydia trachomatis
gaagugguuaaugucucuu

SEQ ID NO: 2509886 - RNA, 15 nt, Chlamydia trachomatis
gaaguguuagugagc

SEQ ID NO: 2509887 - RNA, 18 nt, Chlamydia trachomatis
gaaguuacuuuucucaaa

SEQ ID NO: 2509888 - RNA, 14 nt, Chlamydia trachomatis
gaaguucuugcuug

SEQ ID NO: 2509889 - RNA, 14 nt, Chlamydia trachomatis
gaaguugagaagcg

SEQ ID NO: 2509890 - RNA, 13 nt, Chlamydia trachomatis
gaaguuuucccag

SEQ ID NO: 2509891 - RNA, 18 nt, Chlamydia trachomatis
gaauaaaaggcuacuaaa

SEQ ID NO: 2509892 - RNA, 15 nt, Chlamydia trachomatis
gaauaaaaucaaaua

SEQ ID NO: 2509893 - RNA, 17 nt, Chlamydia trachomatis
gaauaaaaucaaauaaa

SEQ ID NO: 2509894 - RNA, 14 nt, Chlamydia trachomatis
gaauaaacaacaug

SEQ ID NO: 2509895 - RNA, 20 nt, Chlamydia trachomatis
gaauaacguagauaucuuua

SEQ ID NO: 2509896 - RNA, 21 nt, Chlamydia trachomatis
gaauaagaggacuuucuuuaa

SEQ ID NO: 2509897 - RNA, 16 nt, Chlamydia trachomatis
gaauaagcauuacaca

SEQ ID NO: 2509898 - RNA, 15 nt, Chlamydia trachomatis
gaauaagcgaaaaaa

SEQ ID NO: 2509899 - RNA, 20 nt, Chlamydia trachomatis
gaauaagcgaaaaaaaaaga

SEQ ID NO: 2509900 - RNA, 21 nt, Chlamydia trachomatis
gaauaagguauccaacaauau

SEQ ID NO: 2509901 - RNA, 20 nt, Chlamydia trachomatis
gaauaaguccacaauggccg

SEQ ID NO: 2509902 - RNA, 18 nt, Chlamydia trachomatis
gaauaaguuguaaagcau

SEQ ID NO: 2509903 - RNA, 18 nt, Chlamydia trachomatis
gaauaauagaaaaacuau

SEQ ID NO: 2509904 - RNA, 13 nt, Chlamydia trachomatis
gaauaauagagac

SEQ ID NO: 2509905 - RNA, 11 nt, Chlamydia trachomatis
gaauaaucuua

SEQ ID NO: 2509906 - RNA, 14 nt, Chlamydia trachomatis
gaauaaugauuuuu

SEQ ID NO: 2509907 - RNA, 14 nt, Chlamydia trachomatis
gaauaauuuuccac

SEQ ID NO: 2509908 - RNA, 17 nt, Chlamydia trachomatis
gaauaauuuuccacaaa

SEQ ID NO: 2509909 - RNA, 23 nt, Chlamydia trachomatis
gaauacaagaaaggccuauccaa

SEQ ID NO: 2509910 - RNA, 15 nt, Chlamydia trachomatis
gaauacgaaaugaca

SEQ ID NO: 2509911 - RNA, 16 nt, Chlamydia trachomatis
gaauacgaaaugacac

SEQ ID NO: 2509912 - RNA, 17 nt, Chlamydia trachomatis
gaauacgaaaugacaca

SEQ ID NO: 2509913 - RNA, 14 nt, Chlamydia trachomatis
gaauacgggaugcg

SEQ ID NO: 2509914 - RNA, 23 nt, Chlamydia trachomatis
gaauagccuccaaacauuuugag

SEQ ID NO: 2509915 - RNA, 18 nt, Chlamydia trachomatis
gaauagcuacuagauaga

SEQ ID NO: 2509916 - RNA, 22 nt, Chlamydia trachomatis
gaauagggagguuuuguucgua

SEQ ID NO: 2509917 - RNA, 20 nt, Chlamydia trachomatis
gaauagguucuauccauaca

SEQ ID NO: 2509918 - RNA, 23 nt, Chlamydia trachomatis
gaauaguaugucguaucccugca

SEQ ID NO: 2509919 - RNA, 13 nt, Chlamydia trachomatis
gaauaguugcagc

SEQ ID NO: 2509920 - RNA, 17 nt, Chlamydia trachomatis
gaauauacccauuugcc

SEQ ID NO: 2509921 - RNA, 16 nt, Chlamydia trachomatis
gaauauaccccgaaca

SEQ ID NO: 2509922 - RNA, 16 nt, Chlamydia trachomatis
gaauaucguaaacaac

SEQ ID NO: 2509923 - RNA, 18 nt, Chlamydia trachomatis
gaauaucguaaacaacca

SEQ ID NO: 2509924 - RNA, 15 nt, Chlamydia trachomatis
gaauaucuucugggc

SEQ ID NO: 2509925 - RNA, 19 nt, Chlamydia trachomatis
gaauauuuaagggaagcuc

SEQ ID NO: 2509926 - RNA, 13 nt, Chlamydia trachomatis
gaaucaaaaaguu

SEQ ID NO: 2509927 - RNA, 22 nt, Chlamydia trachomatis
gaaucaaaacgcucagaaaacu

SEQ ID NO: 2509928 - RNA, 18 nt, Chlamydia trachomatis
gaaucaaacagaaccuuu

SEQ ID NO: 2509929 - RNA, 19 nt, Chlamydia trachomatis
gaaucaaaggaugucuauc

SEQ ID NO: 2509930 - RNA, 19 nt, Chlamydia trachomatis
gaaucaauauccacuuuua

SEQ ID NO: 2509931 - RNA, 15 nt, Chlamydia trachomatis
gaaucauugggaaaa

SEQ ID NO: 2509932 - RNA, 23 nt, Chlamydia trachomatis
gaauccuggaguauuuucaaaaa

SEQ ID NO: 2509933 - RNA, 16 nt, Chlamydia trachomatis
gaauccuugaaccaaa

SEQ ID NO: 2509934 - RNA, 18 nt, Chlamydia trachomatis
gaaucgcccuuauuggua

SEQ ID NO: 2509935 - RNA, 18 nt, Chlamydia trachomatis
gaaucgguacgaauccuc

SEQ ID NO: 2509936 - RNA, 15 nt, Chlamydia trachomatis
gaaucuaaaaagcca

SEQ ID NO: 2509937 - RNA, 21 nt, Chlamydia trachomatis
gaaucuaaaaagccauacaaa

SEQ ID NO: 2509938 - RNA, 21 nt, Chlamydia trachomatis
gaaucucgagcuaagaaaaua

SEQ ID NO: 2509939 - RNA, 15 nt, Chlamydia trachomatis
gaaucuguccaaaga

SEQ ID NO: 2509940 - RNA, 19 nt, Chlamydia trachomatis
gaaucuucuucggaaagca

SEQ ID NO: 2509941 - RNA, 21 nt, Chlamydia trachomatis
gaaucuucuucggaaagcacu

SEQ ID NO: 2509942 - RNA, 12 nt, Chlamydia trachomatis
gaaugaauuucc

SEQ ID NO: 2509943 - RNA, 18 nt, Chlamydia trachomatis
gaaugacugcgcuaugag

SEQ ID NO: 2509944 - RNA, 13 nt, Chlamydia trachomatis
gaaugagcuuaga

SEQ ID NO: 2509945 - RNA, 23 nt, Chlamydia trachomatis
gaaugcaccggccaccccaaacg

SEQ ID NO: 2509946 - RNA, 22 nt, Chlamydia trachomatis
gaaugcagaucauaucugcagc

SEQ ID NO: 2509947 - RNA, 15 nt, Chlamydia trachomatis
gaaugccuguggcaa

SEQ ID NO: 2509948 - RNA, 18 nt, Chlamydia trachomatis
gaauggccuguuucauaa

SEQ ID NO: 2509949 - RNA, 21 nt, Chlamydia trachomatis
gaauggguaaggggaagauug

SEQ ID NO: 2509950 - RNA, 20 nt, Chlamydia trachomatis
gaaugguucuuagcgcuugu

SEQ ID NO: 2509951 - RNA, 21 nt, Chlamydia trachomatis
gaaugugacacaucgaugcuc

SEQ ID NO: 2509952 - RNA, 22 nt, Chlamydia trachomatis
gaaugugugguuguagaggaga

SEQ ID NO: 2509953 - RNA, 10 nt, Chlamydia trachomatis
gaauuacuug

SEQ ID NO: 2509954 - RNA, 11 nt, Chlamydia trachomatis
gaauuagguaa

SEQ ID NO: 2509955 - RNA, 15 nt, Chlamydia trachomatis
gaauucuaucaacau

SEQ ID NO: 2509956 - RNA, 18 nt, Chlamydia trachomatis
gaauucuaucaacaucug

SEQ ID NO: 2509957 - RNA, 12 nt, Chlamydia trachomatis
gaauucuucuuc

SEQ ID NO: 2509958 - RNA, 18 nt, Chlamydia trachomatis
gaauucuugcuauccugc

SEQ ID NO: 2509959 - RNA, 18 nt, Chlamydia trachomatis
gaauugccgaaucaaaga

SEQ ID NO: 2509960 - RNA, 20 nt, Chlamydia trachomatis
gaauuuauaauccaggagac

SEQ ID NO: 2509961 - RNA, 13 nt, Chlamydia trachomatis
gaauuucuuccuc

SEQ ID NO: 2509962 - RNA, 20 nt, Chlamydia trachomatis
gaauuugacucucauaagaa

SEQ ID NO: 2509963 - RNA, 17 nt, Chlamydia trachomatis
gaauuuguguuaaauca

SEQ ID NO: 2509964 - RNA, 18 nt, Chlamydia trachomatis
gaauuuguguuaaaucau

SEQ ID NO: 2509965 - RNA, 19 nt, Chlamydia trachomatis
gaauuuuaucuaaaaaggc

SEQ ID NO: 2509966 - RNA, 13 nt, Chlamydia trachomatis
gaauuuucaucaa

SEQ ID NO: 2509967 - RNA, 13 nt, Chlamydia trachomatis
gaauuuucucucu

SEQ ID NO: 2509968 - RNA, 14 nt, Chlamydia trachomatis
gaauuuuucuaaaa

SEQ ID NO: 2509969 - RNA, 23 nt, Chlamydia trachomatis
gaauuuuucucacuuagcuauug

SEQ ID NO: 2509970 - RNA, 13 nt, Chlamydia trachomatis
gacaaaaaaugcg

SEQ ID NO: 2509971 - RNA, 13 nt, Chlamydia trachomatis
gacaaaaagaaag

SEQ ID NO: 2509972 - RNA, 18 nt, Chlamydia trachomatis
gacaaaacuucuucgucu

SEQ ID NO: 2509973 - RNA, 23 nt, Chlamydia trachomatis
gacaaacuuucucgauucucuug

SEQ ID NO: 2509974 - RNA, 21 nt, Chlamydia trachomatis
gacaaagaucguaaaauagca

SEQ ID NO: 2509975 - RNA, 17 nt, Chlamydia trachomatis
gacaaagguguuuucua

SEQ ID NO: 2509976 - RNA, 12 nt, Chlamydia trachomatis
gacaaaugcagg

SEQ ID NO: 2509977 - RNA, 12 nt, Chlamydia trachomatis
gacaaauuucua

SEQ ID NO: 2509978 - RNA, 17 nt, Chlamydia trachomatis
gacaaauuucuauagaa

SEQ ID NO: 2509979 - RNA, 17 nt, Chlamydia trachomatis
gacaacaaguugauaca

SEQ ID NO: 2509980 - RNA, 21 nt, Chlamydia trachomatis
gacaacagggucacugggauu

SEQ ID NO: 2509981 - RNA, 18 nt, Chlamydia trachomatis
gacaacgauauaaagaag

SEQ ID NO: 2509982 - RNA, 21 nt, Chlamydia trachomatis
gacaacgauauaaagaagacu

SEQ ID NO: 2509983 - RNA, 12 nt, Chlamydia trachomatis
gacaagcacgua

SEQ ID NO: 2509984 - RNA, 18 nt, Chlamydia trachomatis
gacaauauuccauaauag

SEQ ID NO: 2509985 - RNA, 21 nt, Chlamydia trachomatis
gacaauggucuccuaaauccu

SEQ ID NO: 2509986 - RNA, 20 nt, Chlamydia trachomatis
gacacgcggauuaugauucc

SEQ ID NO: 2509987 - RNA, 12 nt, Chlamydia trachomatis
gacacguuuucc

SEQ ID NO: 2509988 - RNA, 23 nt, Chlamydia trachomatis
gacacuaucacuguugagaaaaa

SEQ ID NO: 2509989 - RNA, 19 nt, Chlamydia trachomatis
gacacugcgugaccguuaa

SEQ ID NO: 2509990 - RNA, 23 nt, Chlamydia trachomatis
gacacuggcaccuuuuuugcuaa

SEQ ID NO: 2509991 - RNA, 20 nt, Chlamydia trachomatis
gacagagcccuucuuuuccu

SEQ ID NO: 2509992 - RNA, 18 nt, Chlamydia trachomatis
gacagcaccaagcuccac

SEQ ID NO: 2509993 - RNA, 19 nt, Chlamydia trachomatis
gacagcaccaagcuccaca

SEQ ID NO: 2509994 - RNA, 22 nt, Chlamydia trachomatis
gacagcacuucuucuuuggaaa

SEQ ID NO: 2509995 - RNA, 15 nt, Chlamydia trachomatis
gacagcccaagaucu

SEQ ID NO: 2509996 - RNA, 17 nt, Chlamydia trachomatis
gacagcccaagaucuuc

SEQ ID NO: 2509997 - RNA, 13 nt, Chlamydia trachomatis
gacaggcuauuga

SEQ ID NO: 2509998 - RNA, 14 nt, Chlamydia trachomatis
gacauacauaagaa

SEQ ID NO: 2509999 - RNA, 21 nt, Chlamydia trachomatis
gacauagggguuauccagauc

SEQ ID NO: 2510000 - RNA, 16 nt, Chlamydia trachomatis
gacaucgaaaaucacu

SEQ ID NO: 2510001 - RNA, 22 nt, Chlamydia trachomatis
gacaucgcuguauuuccuucga

SEQ ID NO: 2510002 - RNA, 18 nt, Chlamydia trachomatis
gacaucuauugagaagac

SEQ ID NO: 2510003 - RNA, 16 nt, Chlamydia trachomatis
gacaucuccugcagcu

SEQ ID NO: 2510004 - RNA, 14 nt, Chlamydia trachomatis
gacauucugccgac

SEQ ID NO: 2510005 - RNA, 13 nt, Chlamydia trachomatis
gacauugaacauu

SEQ ID NO: 2510006 - RNA, 20 nt, Chlamydia trachomatis
gaccaagguuguuauguaga

SEQ ID NO: 2510007 - RNA, 22 nt, Chlamydia trachomatis
gaccaauaccuacacgauauau

SEQ ID NO: 2510008 - RNA, 21 nt, Chlamydia trachomatis
gaccagcgcuuucuaaagcag

SEQ ID NO: 2510009 - RNA, 16 nt, Chlamydia trachomatis
gaccaugaaugacugc

SEQ ID NO: 2510010 - RNA, 14 nt, Chlamydia trachomatis
gacccgcuauugua

SEQ ID NO: 2510011 - RNA, 15 nt, Chlamydia trachomatis
gacccuuccaaauuu

SEQ ID NO: 2510012 - RNA, 19 nt, Chlamydia trachomatis
gaccgaagaacucaaaagc

SEQ ID NO: 2510013 - RNA, 20 nt, Chlamydia trachomatis
gaccgagauuaucauucaaa

SEQ ID NO: 2510014 - RNA, 17 nt, Chlamydia trachomatis
gaccuaauaucugcucu

SEQ ID NO: 2510015 - RNA, 14 nt, Chlamydia trachomatis
gaccuacaaagaua

SEQ ID NO: 2510016 - RNA, 20 nt, Chlamydia trachomatis
gaccuacaaagauaaucaaa

SEQ ID NO: 2510017 - RNA, 21 nt, Chlamydia trachomatis
gaccugcuucagcagcauaaa

SEQ ID NO: 2510018 - RNA, 13 nt, Chlamydia trachomatis
gaccuuaggaaua

SEQ ID NO: 2510019 - RNA, 13 nt, Chlamydia trachomatis
gaccuugaacccc

SEQ ID NO: 2510020 - RNA, 16 nt, Chlamydia trachomatis
gacgaauaaucaaucc

SEQ ID NO: 2510021 - RNA, 14 nt, Chlamydia trachomatis
gacgacaacaugaa

SEQ ID NO: 2510022 - RNA, 22 nt, Chlamydia trachomatis
gacgaccuacgcguuacgaaug

SEQ ID NO: 2510023 - RNA, 18 nt, Chlamydia trachomatis
gacgauauuguccaaacg

SEQ ID NO: 2510024 - RNA, 16 nt, Chlamydia trachomatis
gacgauucucaugcac

SEQ ID NO: 2510025 - RNA, 18 nt, Chlamydia trachomatis
gacgauucucaugcacug

SEQ ID NO: 2510026 - RNA, 17 nt, Chlamydia trachomatis
gacggaauuuuucucac

SEQ ID NO: 2510027 - RNA, 23 nt, Chlamydia trachomatis
gacggaauuuuucucacuuagcu

SEQ ID NO: 2510028 - RNA, 16 nt, Chlamydia trachomatis
gacguucuugcugaga

SEQ ID NO: 2510029 - RNA, 12 nt, Chlamydia trachomatis
gacuauuuccua

SEQ ID NO: 2510030 - RNA, 13 nt, Chlamydia trachomatis
gacuauuucuucu

SEQ ID NO: 2510031 - RNA, 15 nt, Chlamydia trachomatis
gacuauuucuucuag

SEQ ID NO: 2510032 - RNA, 20 nt, Chlamydia trachomatis
gacuauuucuucuagauaga

SEQ ID NO: 2510033 - RNA, 17 nt, Chlamydia trachomatis
gacuauuuucaaaaccu

SEQ ID NO: 2510034 - RNA, 21 nt, Chlamydia trachomatis
gacucaucaaaaugaucuaaa

SEQ ID NO: 2510035 - RNA, 15 nt, Chlamydia trachomatis
gacuccuucucgcaa

SEQ ID NO: 2510036 - RNA, 17 nt, Chlamydia trachomatis
gacucucauaagaauac

SEQ ID NO: 2510037 - RNA, 20 nt, Chlamydia trachomatis
gacucucauaagaauacaaa

SEQ ID NO: 2510038 - RNA, 14 nt, Chlamydia trachomatis
gacugcaagaucau

SEQ ID NO: 2510039 - RNA, 12 nt, Chlamydia trachomatis
gacugccgaacu

SEQ ID NO: 2510040 - RNA, 14 nt, Chlamydia trachomatis
gacugcgcuaugag

SEQ ID NO: 2510041 - RNA, 17 nt, Chlamydia trachomatis
gacugcggcagcugcuu

SEQ ID NO: 2510042 - RNA, 23 nt, Chlamydia trachomatis
gacugguuguucccgauuacuug

SEQ ID NO: 2510043 - RNA, 18 nt, Chlamydia trachomatis
gacuuagcacucaaacac

SEQ ID NO: 2510044 - RNA, 14 nt, Chlamydia trachomatis
gacuucuucgucca

SEQ ID NO: 2510045 - RNA, 15 nt, Chlamydia trachomatis
gacuucuucuagaga

SEQ ID NO: 2510046 - RNA, 16 nt, Chlamydia trachomatis
gacuugagcgucuuua

SEQ ID NO: 2510047 - RNA, 20 nt, Chlamydia trachomatis
gacuugcuacggaaaccaau

SEQ ID NO: 2510048 - RNA, 21 nt, Chlamydia trachomatis
gacuuggguaagagcagagcu

SEQ ID NO: 2510049 - RNA, 14 nt, Chlamydia trachomatis
gacuuuagauaguc

SEQ ID NO: 2510050 - RNA, 18 nt, Chlamydia trachomatis
gacuuuccucugguacuc

SEQ ID NO: 2510051 - RNA, 16 nt, Chlamydia trachomatis
gacuuucuuuaagcaa

SEQ ID NO: 2510052 - RNA, 17 nt, Chlamydia trachomatis
gacuuuuauucacccaa

SEQ ID NO: 2510053 - RNA, 15 nt, Chlamydia trachomatis
gacuuuuuagcaucu

SEQ ID NO: 2510054 - RNA, 16 nt, Chlamydia trachomatis
gacuuuuuagcaucug

SEQ ID NO: 2510055 - RNA, 13 nt, Chlamydia trachomatis
gagaaaagaaaag

SEQ ID NO: 2510056 - RNA, 19 nt, Chlamydia trachomatis
gagaaaagaggaguugguu

SEQ ID NO: 2510057 - RNA, 20 nt, Chlamydia trachomatis
gagaaaaugaugaaaaagaa

SEQ ID NO: 2510058 - RNA, 12 nt, Chlamydia trachomatis
gagaaagagcca

SEQ ID NO: 2510059 - RNA, 17 nt, Chlamydia trachomatis
gagaaagcuucuaagaa

SEQ ID NO: 2510060 - RNA, 23 nt, Chlamydia trachomatis
gagaaaguucguucaauuaaaga

SEQ ID NO: 2510061 - RNA, 14 nt, Chlamydia trachomatis
gagaaauaaucauc

SEQ ID NO: 2510062 - RNA, 13 nt, Chlamydia trachomatis
gagaacagucucu

SEQ ID NO: 2510063 - RNA, 21 nt, Chlamydia trachomatis
gagaacaucucggucuuagaa

SEQ ID NO: 2510064 - RNA, 23 nt, Chlamydia trachomatis
gagaacggcaauaaagaaauaac

SEQ ID NO: 2510065 - RNA, 12 nt, Chlamydia trachomatis
gagaagaaaaac

SEQ ID NO: 2510066 - RNA, 12 nt, Chlamydia trachomatis
gagaagaagagg

SEQ ID NO: 2510067 - RNA, 11 nt, Chlamydia trachomatis
gagaagagcca

SEQ ID NO: 2510068 - RNA, 16 nt, Chlamydia trachomatis
gagaagagccaucaaa

SEQ ID NO: 2510069 - RNA, 19 nt, Chlamydia trachomatis
gagaaggucgucagugcag

SEQ ID NO: 2510070 - RNA, 17 nt, Chlamydia trachomatis
gagaaguaaaacagaag

SEQ ID NO: 2510071 - RNA, 23 nt, Chlamydia trachomatis
gagaagucagaugaguuuaucuc

SEQ ID NO: 2510072 - RNA, 21 nt, Chlamydia trachomatis
gagaauaccaaaauccuucgc

SEQ ID NO: 2510073 - RNA, 11 nt, Chlamydia trachomatis
gagaauaccac

SEQ ID NO: 2510074 - RNA, 17 nt, Chlamydia trachomatis
gagaauggguaagggga

SEQ ID NO: 2510075 - RNA, 22 nt, Chlamydia trachomatis
gagacaacaaguugauacaaga

SEQ ID NO: 2510076 - RNA, 13 nt, Chlamydia trachomatis
gagacaucuccug

SEQ ID NO: 2510077 - RNA, 17 nt, Chlamydia trachomatis
gagaccgagccuccgcu

SEQ ID NO: 2510078 - RNA, 22 nt, Chlamydia trachomatis
gagaccgucaaaaagaucuuca

SEQ ID NO: 2510079 - RNA, 18 nt, Chlamydia trachomatis
gagacgagaaaucuuuua

SEQ ID NO: 2510080 - RNA, 19 nt, Chlamydia trachomatis
gagacgcuuggugagggac

SEQ ID NO: 2510081 - RNA, 12 nt, Chlamydia trachomatis
gagagaaucuuu

SEQ ID NO: 2510082 - RNA, 13 nt, Chlamydia trachomatis
gagagagccuuga

SEQ ID NO: 2510083 - RNA, 16 nt, Chlamydia trachomatis
gagagaggagaaaaac

SEQ ID NO: 2510084 - RNA, 18 nt, Chlamydia trachomatis
gagagaucuaugaaaaaa

SEQ ID NO: 2510085 - RNA, 19 nt, Chlamydia trachomatis
gagagaucuaugaaaaaag

SEQ ID NO: 2510086 - RNA, 17 nt, Chlamydia trachomatis
gagagcaaaaucuucug

SEQ ID NO: 2510087 - RNA, 15 nt, Chlamydia trachomatis
gagagcaacgagcaa

SEQ ID NO: 2510088 - RNA, 14 nt, Chlamydia trachomatis
gagagcaagccugg

SEQ ID NO: 2510089 - RNA, 14 nt, Chlamydia trachomatis
gagagcagcuacaa

SEQ ID NO: 2510090 - RNA, 18 nt, Chlamydia trachomatis
gagagcauucuucugaac

SEQ ID NO: 2510091 - RNA, 12 nt, Chlamydia trachomatis
gagagccccacc

SEQ ID NO: 2510092 - RNA, 20 nt, Chlamydia trachomatis
gagagccuugagugaaaaau

SEQ ID NO: 2510093 - RNA, 23 nt, Chlamydia trachomatis
gagagcuuugaucuuuguucucu

SEQ ID NO: 2510094 - RNA, 13 nt, Chlamydia trachomatis
gagaggauuaagg

SEQ ID NO: 2510095 - RNA, 20 nt, Chlamydia trachomatis
gagaggauuaaggaaugaua

SEQ ID NO: 2510096 - RNA, 11 nt, Chlamydia trachomatis
gagaggauucc

SEQ ID NO: 2510097 - RNA, 18 nt, Chlamydia trachomatis
gagauacggcuaacucca

SEQ ID NO: 2510098 - RNA, 14 nt, Chlamydia trachomatis
gagaucauaaaguc

SEQ ID NO: 2510099 - RNA, 13 nt, Chlamydia trachomatis
gagaucuaauugg

SEQ ID NO: 2510100 - RNA, 15 nt, Chlamydia trachomatis
gagaucuaugaaaaa

SEQ ID NO: 2510101 - RNA, 12 nt, Chlamydia trachomatis
gagaucugcauc

SEQ ID NO: 2510102 - RNA, 13 nt, Chlamydia trachomatis
gagaucuucugaa

SEQ ID NO: 2510103 - RNA, 15 nt, Chlamydia trachomatis
gagaugaucgaguuc

SEQ ID NO: 2510104 - RNA, 15 nt, Chlamydia trachomatis
gagauguaggauuca

SEQ ID NO: 2510105 - RNA, 17 nt, Chlamydia trachomatis
gagauguuuguguuucu

SEQ ID NO: 2510106 - RNA, 17 nt, Chlamydia trachomatis
gagauugcaacucuugc

SEQ ID NO: 2510107 - RNA, 19 nt, Chlamydia trachomatis
gagauuuccagcuucugaa

SEQ ID NO: 2510108 - RNA, 14 nt, Chlamydia trachomatis
gagcaaaaaaagag

SEQ ID NO: 2510109 - RNA, 17 nt, Chlamydia trachomatis
gagcaaauagaauaaaa

SEQ ID NO: 2510110 - RNA, 23 nt, Chlamydia trachomatis
gagcaaccuuuccuguauaagaa

SEQ ID NO: 2510111 - RNA, 15 nt, Chlamydia trachomatis
gagcaacuucuaaga

SEQ ID NO: 2510112 - RNA, 19 nt, Chlamydia trachomatis
gagcaacuucuaagagccc

SEQ ID NO: 2510113 - RNA, 17 nt, Chlamydia trachomatis
gagcaagcugaggaagc

SEQ ID NO: 2510114 - RNA, 16 nt, Chlamydia trachomatis
gagcaaggugaccucu

SEQ ID NO: 2510115 - RNA, 19 nt, Chlamydia trachomatis
gagcaauauguuauacgca

SEQ ID NO: 2510116 - RNA, 21 nt, Chlamydia trachomatis
gagcacaaaucuuucuuucua

SEQ ID NO: 2510117 - RNA, 14 nt, Chlamydia trachomatis
gagcacaagcuguu

SEQ ID NO: 2510118 - RNA, 23 nt, Chlamydia trachomatis
gagcauaaagaaucccucuagca

SEQ ID NO: 2510119 - RNA, 24 nt, Chlamydia trachomatis
gagcauccauauauucagaagaag

SEQ ID NO: 2510120 - RNA, 22 nt, Chlamydia trachomatis
gagcaugaaucagcuuuuccac

SEQ ID NO: 2510121 - RNA, 15 nt, Chlamydia trachomatis
gagcaugaccucaga

SEQ ID NO: 2510122 - RNA, 15 nt, Chlamydia trachomatis
gagcaugguauucua

SEQ ID NO: 2510123 - RNA, 18 nt, Chlamydia trachomatis
gagcauggucucuguagu

SEQ ID NO: 2510124 - RNA, 14 nt, Chlamydia trachomatis
gagcauuccuucua

SEQ ID NO: 2510125 - RNA, 13 nt, Chlamydia trachomatis
gagcauucugagc

SEQ ID NO: 2510126 - RNA, 19 nt, Chlamydia trachomatis
gagccaacgaaucgcccuu

SEQ ID NO: 2510127 - RNA, 13 nt, Chlamydia trachomatis
gagccaucgccuu

SEQ ID NO: 2510128 - RNA, 18 nt, Chlamydia trachomatis
gagccaugaucaaagaaa

SEQ ID NO: 2510129 - RNA, 14 nt, Chlamydia trachomatis
gagcccaaggagaa

SEQ ID NO: 2510130 - RNA, 20 nt, Chlamydia trachomatis
gagcccaaggagaauaccac

SEQ ID NO: 2510131 - RNA, 21 nt, Chlamydia trachomatis
gagcccaaggagaauaccacc

SEQ ID NO: 2510132 - RNA, 22 nt, Chlamydia trachomatis
gagcccaaggagaauaccacca

SEQ ID NO: 2510133 - RNA, 17 nt, Chlamydia trachomatis
gagccgcuuaagcuguu

SEQ ID NO: 2510134 - RNA, 18 nt, Chlamydia trachomatis
gagccguucguacugaua

SEQ ID NO: 2510135 - RNA, 13 nt, Chlamydia trachomatis
gagccuacguccu

SEQ ID NO: 2510136 - RNA, 22 nt, Chlamydia trachomatis
gagccuaugcaaccuucuccaa

SEQ ID NO: 2510137 - RNA, 22 nt, Chlamydia trachomatis
gagccuccgcuuagaaugggaa

SEQ ID NO: 2510138 - RNA, 13 nt, Chlamydia trachomatis
gagccucuaacuc

SEQ ID NO: 2510139 - RNA, 23 nt, Chlamydia trachomatis
gagccuguuuagaaagaggacga

SEQ ID NO: 2510140 - RNA, 17 nt, Chlamydia trachomatis
gagccuuuuauucuuca

SEQ ID NO: 2510141 - RNA, 16 nt, Chlamydia trachomatis
gagcgaguuuguggaa

SEQ ID NO: 2510142 - RNA, 20 nt, Chlamydia trachomatis
gagcgauaccugucccugcu

SEQ ID NO: 2510143 - RNA, 22 nt, Chlamydia trachomatis
gagcgucuuuucacaagguguc

SEQ ID NO: 2510144 - RNA, 14 nt, Chlamydia trachomatis
gagcuaagaaaaua

SEQ ID NO: 2510145 - RNA, 21 nt, Chlamydia trachomatis
gagcuauaccgccucaaacaa

SEQ ID NO: 2510146 - RNA, 19 nt, Chlamydia trachomatis
gagcuaucauuuccaaaau

SEQ ID NO: 2510147 - RNA, 21 nt, Chlamydia trachomatis
gagcuauuuaggcuaacucca

SEQ ID NO: 2510148 - RNA, 18 nt, Chlamydia trachomatis
gagcucauuuucuauuuc

SEQ ID NO: 2510149 - RNA, 13 nt, Chlamydia trachomatis
gagcucccauuuc

SEQ ID NO: 2510150 - RNA, 12 nt, Chlamydia trachomatis
gagcugagucuu

SEQ ID NO: 2510151 - RNA, 13 nt, Chlamydia trachomatis
gagcugagucuug

SEQ ID NO: 2510152 - RNA, 18 nt, Chlamydia trachomatis
gagcuuagguaagggaca

SEQ ID NO: 2510153 - RNA, 12 nt, Chlamydia trachomatis
gagcuucucuaa

SEQ ID NO: 2510154 - RNA, 18 nt, Chlamydia trachomatis
gagcuucuucuaaagaau

SEQ ID NO: 2510155 - RNA, 21 nt, Chlamydia trachomatis
gagcuucuuguuuagaggaga

SEQ ID NO: 2510156 - RNA, 21 nt, Chlamydia trachomatis
gagcuugagagcauucuucug

SEQ ID NO: 2510157 - RNA, 15 nt, Chlamydia trachomatis
gagcuuguucuucga

SEQ ID NO: 2510158 - RNA, 22 nt, Chlamydia trachomatis
gagcuuguucuucgaaauauug

SEQ ID NO: 2510159 - RNA, 11 nt, Chlamydia trachomatis
gagcuuugagg

SEQ ID NO: 2510160 - RNA, 23 nt, Chlamydia trachomatis
gagcuuugaggacugacagaagu

SEQ ID NO: 2510161 - RNA, 23 nt, Chlamydia trachomatis
gagcuuugaucuuuguucucuaa

SEQ ID NO: 2510162 - RNA, 14 nt, Chlamydia trachomatis
gagcuuugcagauc

SEQ ID NO: 2510163 - RNA, 23 nt, Chlamydia trachomatis
gagcuuuuuuucacuguuuuugc

SEQ ID NO: 2510164 - RNA, 19 nt, Chlamydia trachomatis
gaggaagaaauguuuggau

SEQ ID NO: 2510165 - RNA, 22 nt, Chlamydia trachomatis
gaggaauugaucuuguguagua

SEQ ID NO: 2510166 - RNA, 13 nt, Chlamydia trachomatis
gaggagaacucuu

SEQ ID NO: 2510167 - RNA, 15 nt, Chlamydia trachomatis
gaggagacuuuagcu

SEQ ID NO: 2510168 - RNA, 15 nt, Chlamydia trachomatis
gaggagauauucagg

SEQ ID NO: 2510169 - RNA, 14 nt, Chlamydia trachomatis
gaggagucucugca

SEQ ID NO: 2510170 - RNA, 23 nt, Chlamydia trachomatis
gaggauaaaucaguggaacugcu

SEQ ID NO: 2510171 - RNA, 15 nt, Chlamydia trachomatis
gaggaucuccagaaa

SEQ ID NO: 2510172 - RNA, 15 nt, Chlamydia trachomatis
gaggaugauucccug

SEQ ID NO: 2510173 - RNA, 21 nt, Chlamydia trachomatis
gaggauguugcgaguuuugau

SEQ ID NO: 2510174 - RNA, 22 nt, Chlamydia trachomatis
gaggccauagaauggcgcucuc

SEQ ID NO: 2510175 - RNA, 20 nt, Chlamydia trachomatis
gaggccuccagcuucuucua

SEQ ID NO: 2510176 - RNA, 19 nt, Chlamydia trachomatis
gaggcggcaaguccuucua

SEQ ID NO: 2510177 - RNA, 20 nt, Chlamydia trachomatis
gaggcucuagguagucucua

SEQ ID NO: 2510178 - RNA, 13 nt, Chlamydia trachomatis
gaggcuguaacua

SEQ ID NO: 2510179 - RNA, 12 nt, Chlamydia trachomatis
gaggcuuaaaga

SEQ ID NO: 2510180 - RNA, 14 nt, Chlamydia trachomatis
gaggcuucaaagaa

SEQ ID NO: 2510181 - RNA, 14 nt, Chlamydia trachomatis
gaggcuugagaauc

SEQ ID NO: 2510182 - RNA, 19 nt, Chlamydia trachomatis
gaggcuuuaccguuacagg

SEQ ID NO: 2510183 - RNA, 20 nt, Chlamydia trachomatis
gagggaaauauugcucuaaa

SEQ ID NO: 2510184 - RNA, 12 nt, Chlamydia trachomatis
gagggaagagaa

SEQ ID NO: 2510185 - RNA, 14 nt, Chlamydia trachomatis
gagggacuucuucu

SEQ ID NO: 2510186 - RNA, 16 nt, Chlamydia trachomatis
gagggagauauagcca

SEQ ID NO: 2510187 - RNA, 21 nt, Chlamydia trachomatis
gaggguuucuucuuuugagau

SEQ ID NO: 2510188 - RNA, 12 nt, Chlamydia trachomatis
gaggguuuggau

SEQ ID NO: 2510189 - RNA, 19 nt, Chlamydia trachomatis
gagguagccagguaaacuc

SEQ ID NO: 2510190 - RNA, 14 nt, Chlamydia trachomatis
gagguauuccugua

SEQ ID NO: 2510191 - RNA, 18 nt, Chlamydia trachomatis
gagguauuccuguagaaa

SEQ ID NO: 2510192 - RNA, 17 nt, Chlamydia trachomatis
gagguauuuagaguucc

SEQ ID NO: 2510193 - RNA, 15 nt, Chlamydia trachomatis
gaggucuuauuaaaa

SEQ ID NO: 2510194 - RNA, 24 nt, Chlamydia trachomatis
gaggugugaauaggaagaauaaua

SEQ ID NO: 2510195 - RNA, 20 nt, Chlamydia trachomatis
gagguuuaagucguacauua

SEQ ID NO: 2510196 - RNA, 21 nt, Chlamydia trachomatis
gagguuuaggagagagcccuu

SEQ ID NO: 2510197 - RNA, 20 nt, Chlamydia trachomatis
gaguaagccggauucugucg

SEQ ID NO: 2510198 - RNA, 20 nt, Chlamydia trachomatis
gaguaaucggauagagaaga

SEQ ID NO: 2510199 - RNA, 24 nt, Chlamydia trachomatis
gaguaaucggauagagaagaauug

SEQ ID NO: 2510200 - RNA, 13 nt, Chlamydia trachomatis
gaguacuucuaaa

SEQ ID NO: 2510201 - RNA, 14 nt, Chlamydia trachomatis
gaguagagcucuuc

SEQ ID NO: 2510202 - RNA, 17 nt, Chlamydia trachomatis
gaguaggcucuccuaau

SEQ ID NO: 2510203 - RNA, 14 nt, Chlamydia trachomatis
gaguaggucccugu

SEQ ID NO: 2510204 - RNA, 20 nt, Chlamydia trachomatis
gaguaucuaucaauuguucu

SEQ ID NO: 2510205 - RNA, 24 nt, Chlamydia trachomatis
gaguccaacgcugcgcuccacuuc

SEQ ID NO: 2510206 - RNA, 19 nt, Chlamydia trachomatis
gagucccuuaacacccucu

SEQ ID NO: 2510207 - RNA, 13 nt, Chlamydia trachomatis
gaguccugagcca

SEQ ID NO: 2510208 - RNA, 17 nt, Chlamydia trachomatis
gagucucuaaaaucgug

SEQ ID NO: 2510209 - RNA, 22 nt, Chlamydia trachomatis
gagugacuagccaauacgaaca

SEQ ID NO: 2510210 - RNA, 16 nt, Chlamydia trachomatis
gagugaugauagacaa

SEQ ID NO: 2510211 - RNA, 15 nt, Chlamydia trachomatis
gaguggcaaggggga

SEQ ID NO: 2510212 - RNA, 20 nt, Chlamydia trachomatis
gaguguaggguagaacaggu

SEQ ID NO: 2510213 - RNA, 20 nt, Chlamydia trachomatis
gaguuagccuaaauagcuca

SEQ ID NO: 2510214 - RNA, 15 nt, Chlamydia trachomatis
gaguuaggcugcucc

SEQ ID NO: 2510215 - RNA, 17 nt, Chlamydia trachomatis
gaguuccgaauaagcau

SEQ ID NO: 2510216 - RNA, 16 nt, Chlamydia trachomatis
gaguucguuaggauuc

SEQ ID NO: 2510217 - RNA, 12 nt, Chlamydia trachomatis
gaguuuaugaua

SEQ ID NO: 2510218 - RNA, 12 nt, Chlamydia trachomatis
gaguuuguggaa

SEQ ID NO: 2510219 - RNA, 20 nt, Chlamydia trachomatis
gaguuuuaggcguuccugca

SEQ ID NO: 2510220 - RNA, 19 nt, Chlamydia trachomatis
gaguuuuuuuguuuccauu

SEQ ID NO: 2510221 - RNA, 20 nt, Chlamydia trachomatis
gaguuuuuuuguuuccauua

SEQ ID NO: 2510222 - RNA, 18 nt, Chlamydia trachomatis
gauaaaacccuaagacua

SEQ ID NO: 2510223 - RNA, 20 nt, Chlamydia trachomatis
gauaaacguuuggaaauccu

SEQ ID NO: 2510224 - RNA, 16 nt, Chlamydia trachomatis
gauaaagcuaucccaa

SEQ ID NO: 2510225 - RNA, 13 nt, Chlamydia trachomatis
gauaaauauuuua

SEQ ID NO: 2510226 - RNA, 14 nt, Chlamydia trachomatis
gauaaauauuuuag

SEQ ID NO: 2510227 - RNA, 13 nt, Chlamydia trachomatis
gauaacaaacaac

SEQ ID NO: 2510228 - RNA, 15 nt, Chlamydia trachomatis
gauaacaaacaacac

SEQ ID NO: 2510229 - RNA, 18 nt, Chlamydia trachomatis
gauaacaaccaucaaagc

SEQ ID NO: 2510230 - RNA, 17 nt, Chlamydia trachomatis
gauaacaacucuccuaa

SEQ ID NO: 2510231 - RNA, 18 nt, Chlamydia trachomatis
gauaaccagaauccuuuu

SEQ ID NO: 2510232 - RNA, 15 nt, Chlamydia trachomatis
gauaacgaagcaaaa

SEQ ID NO: 2510233 - RNA, 18 nt, Chlamydia trachomatis
gauaacuuugaacaaauu

SEQ ID NO: 2510234 - RNA, 14 nt, Chlamydia trachomatis
gauaagaaaucuuc

SEQ ID NO: 2510235 - RNA, 17 nt, Chlamydia trachomatis
gauaagaagguugaauu

SEQ ID NO: 2510236 - RNA, 17 nt, Chlamydia trachomatis
gauaagaugcuugauuu

SEQ ID NO: 2510237 - RNA, 20 nt, Chlamydia trachomatis
gauaagcaagcauaauuccu

SEQ ID NO: 2510238 - RNA, 14 nt, Chlamydia trachomatis
gauaaggaagaaga

SEQ ID NO: 2510239 - RNA, 21 nt, Chlamydia trachomatis
gauaaggacguuuggagcaug

SEQ ID NO: 2510240 - RNA, 18 nt, Chlamydia trachomatis
gauaaguccaucuaaagg

SEQ ID NO: 2510241 - RNA, 13 nt, Chlamydia trachomatis
gauaaucucugaa

SEQ ID NO: 2510242 - RNA, 23 nt, Chlamydia trachomatis
gauaaucucugaaagagcuucuu

SEQ ID NO: 2510243 - RNA, 18 nt, Chlamydia trachomatis
gauaaugccuuuugcaca

SEQ ID NO: 2510244 - RNA, 17 nt, Chlamydia trachomatis
gauaauugauagaguuu

SEQ ID NO: 2510245 - RNA, 19 nt, Chlamydia trachomatis
gauaauuuuccuuuuuccc

SEQ ID NO: 2510246 - RNA, 20 nt, Chlamydia trachomatis
gauaauuuuccuuuuuccca

SEQ ID NO: 2510247 - RNA, 14 nt, Chlamydia trachomatis
gauaauuuucugac

SEQ ID NO: 2510248 - RNA, 12 nt, Chlamydia trachomatis
gauacaauuccu

SEQ ID NO: 2510249 - RNA, 17 nt, Chlamydia trachomatis
gauaccugucccugcuc

SEQ ID NO: 2510250 - RNA, 18 nt, Chlamydia trachomatis
gauaccugucccugcucc

SEQ ID NO: 2510251 - RNA, 18 nt, Chlamydia trachomatis
gauacgaaggaucuucca

SEQ ID NO: 2510252 - RNA, 20 nt, Chlamydia trachomatis
gauacucaacgucuugucuc

SEQ ID NO: 2510253 - RNA, 17 nt, Chlamydia trachomatis
gauacugauuaugccac

SEQ ID NO: 2510254 - RNA, 12 nt, Chlamydia trachomatis
gauagacuggca

SEQ ID NO: 2510255 - RNA, 12 nt, Chlamydia trachomatis
gauagagaacau

SEQ ID NO: 2510256 - RNA, 14 nt, Chlamydia trachomatis
gauagagauaaaga

SEQ ID NO: 2510257 - RNA, 16 nt, Chlamydia trachomatis
gauagaguagggaaug

SEQ ID NO: 2510258 - RNA, 18 nt, Chlamydia trachomatis
gauagaguuuguuccaug

SEQ ID NO: 2510259 - RNA, 22 nt, Chlamydia trachomatis
gauagaucuaaagcagaaacaa

SEQ ID NO: 2510260 - RNA, 15 nt, Chlamydia trachomatis
gauagcaacaguuuu

SEQ ID NO: 2510261 - RNA, 13 nt, Chlamydia trachomatis
gauagccuuaaua

SEQ ID NO: 2510262 - RNA, 14 nt, Chlamydia trachomatis
gauagcuaaucuuu

SEQ ID NO: 2510263 - RNA, 21 nt, Chlamydia trachomatis
gauaggaaaaaagaagcuuuu

SEQ ID NO: 2510264 - RNA, 16 nt, Chlamydia trachomatis
gauaggaaaugagagc

SEQ ID NO: 2510265 - RNA, 19 nt, Chlamydia trachomatis
gauaggcugaggauuccaa

SEQ ID NO: 2510266 - RNA, 15 nt, Chlamydia trachomatis
gauaguaaaaacuau

SEQ ID NO: 2510267 - RNA, 23 nt, Chlamydia trachomatis
gauaguacccacugcacaggauu

SEQ ID NO: 2510268 - RNA, 22 nt, Chlamydia trachomatis
gauagucaguuaggaaaugagg

SEQ ID NO: 2510269 - RNA, 22 nt, Chlamydia trachomatis
gauagugacgugaggaaguucu

SEQ ID NO: 2510270 - RNA, 15 nt, Chlamydia trachomatis
gauaguuucuuucuu

SEQ ID NO: 2510271 - RNA, 20 nt, Chlamydia trachomatis
gauauaaucuaaagacaaaa

SEQ ID NO: 2510272 - RNA, 15 nt, Chlamydia trachomatis
gauauacagaacauu

SEQ ID NO: 2510273 - RNA, 21 nt, Chlamydia trachomatis
gauauagguuccaucuaaagg

SEQ ID NO: 2510274 - RNA, 20 nt, Chlamydia trachomatis
gauauauagaccagagucuc

SEQ ID NO: 2510275 - RNA, 20 nt, Chlamydia trachomatis
gauauccaucauaaaaagau

SEQ ID NO: 2510276 - RNA, 23 nt, Chlamydia trachomatis
gauaucccuuuccaagaaucaaa

SEQ ID NO: 2510277 - RNA, 17 nt, Chlamydia trachomatis
gauaucguuagcaucau

SEQ ID NO: 2510278 - RNA, 19 nt, Chlamydia trachomatis
gauaucguuagcaucaucc

SEQ ID NO: 2510279 - RNA, 14 nt, Chlamydia trachomatis
gauaucuccaccau

SEQ ID NO: 2510280 - RNA, 15 nt, Chlamydia trachomatis
gauaucuugcggagc

SEQ ID NO: 2510281 - RNA, 23 nt, Chlamydia trachomatis
gauaugcagcauccaauagaguu

SEQ ID NO: 2510282 - RNA, 16 nt, Chlamydia trachomatis
gauaugcuacuccuaa

SEQ ID NO: 2510283 - RNA, 18 nt, Chlamydia trachomatis
gauauggaagaacagcag

SEQ ID NO: 2510284 - RNA, 14 nt, Chlamydia trachomatis
gauauucuaauccu

SEQ ID NO: 2510285 - RNA, 18 nt, Chlamydia trachomatis
gauauucuuuuaauacuu

SEQ ID NO: 2510286 - RNA, 17 nt, Chlamydia trachomatis
gauauugccaaaaagaa

SEQ ID NO: 2510287 - RNA, 19 nt, Chlamydia trachomatis
gauauuuucacauacaggc

SEQ ID NO: 2510288 - RNA, 13 nt, Chlamydia trachomatis
gaucaaagaaucu

SEQ ID NO: 2510289 - RNA, 22 nt, Chlamydia trachomatis
gaucaauaagugcuccugcaga

SEQ ID NO: 2510290 - RNA, 17 nt, Chlamydia trachomatis
gaucaccggaccuccuc

SEQ ID NO: 2510291 - RNA, 20 nt, Chlamydia trachomatis
gaucagagggacgagcagcc

SEQ ID NO: 2510292 - RNA, 19 nt, Chlamydia trachomatis
gaucagcaaaaagaggaga

SEQ ID NO: 2510293 - RNA, 19 nt, Chlamydia trachomatis
gaucagcuccuggagaaaa

SEQ ID NO: 2510294 - RNA, 21 nt, Chlamydia trachomatis
gaucauagacuguugaggaga

SEQ ID NO: 2510295 - RNA, 22 nt, Chlamydia trachomatis
gaucauaguuaacggaaauagg

SEQ ID NO: 2510296 - RNA, 21 nt, Chlamydia trachomatis
gaucaugcagaugaagaaucu

SEQ ID NO: 2510297 - RNA, 15 nt, Chlamydia trachomatis
gaucaugggaaauaa

SEQ ID NO: 2510298 - RNA, 16 nt, Chlamydia trachomatis
gauccaaaaaagaauc

SEQ ID NO: 2510299 - RNA, 15 nt, Chlamydia trachomatis
gauccagaagcacac

SEQ ID NO: 2510300 - RNA, 21 nt, Chlamydia trachomatis
gauccaguucuggagcaacaa

SEQ ID NO: 2510301 - RNA, 22 nt, Chlamydia trachomatis
gauccaucauagaagcaagcuu

SEQ ID NO: 2510302 - RNA, 14 nt, Chlamydia trachomatis
gauccaucucuccg

SEQ ID NO: 2510303 - RNA, 23 nt, Chlamydia trachomatis
gaucccaggaucccucuguccau

SEQ ID NO: 2510304 - RNA, 16 nt, Chlamydia trachomatis
gaucccagggagagag

SEQ ID NO: 2510305 - RNA, 17 nt, Chlamydia trachomatis
gauccccacgaccacaa

SEQ ID NO: 2510306 - RNA, 18 nt, Chlamydia trachomatis
gaucccucuguccauucu

SEQ ID NO: 2510307 - RNA, 19 nt, Chlamydia trachomatis
gaucccuuucauucuuucg

SEQ ID NO: 2510308 - RNA, 16 nt, Chlamydia trachomatis
gauccgcuuccugcca

SEQ ID NO: 2510309 - RNA, 17 nt, Chlamydia trachomatis
gauccguuuuucuacaa

SEQ ID NO: 2510310 - RNA, 20 nt, Chlamydia trachomatis
gauccuccagauacugcucc

SEQ ID NO: 2510311 - RNA, 19 nt, Chlamydia trachomatis
gaucgaaaauagauuuucu

SEQ ID NO: 2510312 - RNA, 16 nt, Chlamydia trachomatis
gaucgagaagagccau

SEQ ID NO: 2510313 - RNA, 21 nt, Chlamydia trachomatis
gaucgagcuucugcauuggua

SEQ ID NO: 2510314 - RNA, 21 nt, Chlamydia trachomatis
gaucgagucccuucaaucaua

SEQ ID NO: 2510315 - RNA, 15 nt, Chlamydia trachomatis
gaucgccucuaaagc

SEQ ID NO: 2510316 - RNA, 15 nt, Chlamydia trachomatis
gaucggagucugcuc

SEQ ID NO: 2510317 - RNA, 18 nt, Chlamydia trachomatis
gaucgguucauaaaauuu

SEQ ID NO: 2510318 - RNA, 17 nt, Chlamydia trachomatis
gaucuaaaggaaaaauu

SEQ ID NO: 2510319 - RNA, 21 nt, Chlamydia trachomatis
gaucuaaaggaaaaauuucuu

SEQ ID NO: 2510320 - RNA, 19 nt, Chlamydia trachomatis
gaucuacagcaaaaccuuu

SEQ ID NO: 2510321 - RNA, 18 nt, Chlamydia trachomatis
gaucuagaaguuuuccca

SEQ ID NO: 2510322 - RNA, 20 nt, Chlamydia trachomatis
gaucuagauccgcagccacu

SEQ ID NO: 2510323 - RNA, 14 nt, Chlamydia trachomatis
gaucuaugaaaaaa

SEQ ID NO: 2510324 - RNA, 14 nt, Chlamydia trachomatis
gaucucagcuggcc

SEQ ID NO: 2510325 - RNA, 22 nt, Chlamydia trachomatis
gaucucagcuggccaagcaauu

SEQ ID NO: 2510326 - RNA, 14 nt, Chlamydia trachomatis
gaucuccaugaucc

SEQ ID NO: 2510327 - RNA, 21 nt, Chlamydia trachomatis
gaucucccucaccucuugccu

SEQ ID NO: 2510328 - RNA, 20 nt, Chlamydia trachomatis
gaucucccucauuuaaaagu

SEQ ID NO: 2510329 - RNA, 17 nt, Chlamydia trachomatis
gaucuccucauccuuuu

SEQ ID NO: 2510330 - RNA, 13 nt, Chlamydia trachomatis
gaucuccuuccuc

SEQ ID NO: 2510331 - RNA, 14 nt, Chlamydia trachomatis
gaucuccuuccucu

SEQ ID NO: 2510332 - RNA, 21 nt, Chlamydia trachomatis
gaucucuuagacccucuaaua

SEQ ID NO: 2510333 - RNA, 20 nt, Chlamydia trachomatis
gaucuguaacuacaucuaaa

SEQ ID NO: 2510334 - RNA, 23 nt, Chlamydia trachomatis
gaucuguaacuacaucuaaaaga

SEQ ID NO: 2510335 - RNA, 18 nt, Chlamydia trachomatis
gaucuuauguucagcauc

SEQ ID NO: 2510336 - RNA, 12 nt, Chlamydia trachomatis
gaucuucaacaa

SEQ ID NO: 2510337 - RNA, 14 nt, Chlamydia trachomatis
gaucuucaacaaga

SEQ ID NO: 2510338 - RNA, 18 nt, Chlamydia trachomatis
gaucuuccagccuacaaa

SEQ ID NO: 2510339 - RNA, 18 nt, Chlamydia trachomatis
gaucuuccucuugaaaga

SEQ ID NO: 2510340 - RNA, 20 nt, Chlamydia trachomatis
gaucuucgucagggagaaaa

SEQ ID NO: 2510341 - RNA, 18 nt, Chlamydia trachomatis
gaucuugaucugaaaaga

SEQ ID NO: 2510342 - RNA, 15 nt, Chlamydia trachomatis
gaucuuuacuuucuu

SEQ ID NO: 2510343 - RNA, 20 nt, Chlamydia trachomatis
gaucuuuccaauaucuucag

SEQ ID NO: 2510344 - RNA, 19 nt, Chlamydia trachomatis
gaucuuuguucucuaaaga

SEQ ID NO: 2510345 - RNA, 15 nt, Chlamydia trachomatis
gaucuuuugaagaug

SEQ ID NO: 2510346 - RNA, 23 nt, Chlamydia trachomatis
gaugaaaccuaauagaaauagcu

SEQ ID NO: 2510347 - RNA, 13 nt, Chlamydia trachomatis
gaugaagcuaaaa

SEQ ID NO: 2510348 - RNA, 21 nt, Chlamydia trachomatis
gaugaagcuaaaaaauccagg

SEQ ID NO: 2510349 - RNA, 16 nt, Chlamydia trachomatis
gaugacgcagcaacaa

SEQ ID NO: 2510350 - RNA, 15 nt, Chlamydia trachomatis
gaugagagaaaaggc

SEQ ID NO: 2510351 - RNA, 23 nt, Chlamydia trachomatis
gaugagagcagcuacaaccuggg

SEQ ID NO: 2510352 - RNA, 14 nt, Chlamydia trachomatis
gaugaggaauccuc

SEQ ID NO: 2510353 - RNA, 18 nt, Chlamydia trachomatis
gaugaguuuaucucaucu

SEQ ID NO: 2510354 - RNA, 17 nt, Chlamydia trachomatis
gaugcaauaaacgcuuc

SEQ ID NO: 2510355 - RNA, 21 nt, Chlamydia trachomatis
gaugcacauccguuucuagaa

SEQ ID NO: 2510356 - RNA, 22 nt, Chlamydia trachomatis
gaugcauagcucgcauuuguag

SEQ ID NO: 2510357 - RNA, 22 nt, Chlamydia trachomatis
gaugccccaauuccucguccau

SEQ ID NO: 2510358 - RNA, 15 nt, Chlamydia trachomatis
gaugccugggcuuca

SEQ ID NO: 2510359 - RNA, 13 nt, Chlamydia trachomatis
gaugcgaaugaag

SEQ ID NO: 2510360 - RNA, 20 nt, Chlamydia trachomatis
gaugcgaaugaagaagucua

SEQ ID NO: 2510361 - RNA, 15 nt, Chlamydia trachomatis
gaugcuccuacaaaa

SEQ ID NO: 2510362 - RNA, 14 nt, Chlamydia trachomatis
gaugcugagcauuu

SEQ ID NO: 2510363 - RNA, 12 nt, Chlamydia trachomatis
gaugcugcgaug

SEQ ID NO: 2510364 - RNA, 20 nt, Chlamydia trachomatis
gaugcuguacgaacgccugu

SEQ ID NO: 2510365 - RNA, 18 nt, Chlamydia trachomatis
gauggggguuacuucaag

SEQ ID NO: 2510366 - RNA, 16 nt, Chlamydia trachomatis
gaugguuggaagggcu

SEQ ID NO: 2510367 - RNA, 16 nt, Chlamydia trachomatis
gauguaaguaagcgcu

SEQ ID NO: 2510368 - RNA, 14 nt, Chlamydia trachomatis
gauguaauuuggau

SEQ ID NO: 2510369 - RNA, 14 nt, Chlamydia trachomatis
gauguacucugcaa

SEQ ID NO: 2510370 - RNA, 21 nt, Chlamydia trachomatis
gauguacucugcaaaaucuuc

SEQ ID NO: 2510371 - RNA, 13 nt, Chlamydia trachomatis
gauguccaaagcu

SEQ ID NO: 2510372 - RNA, 16 nt, Chlamydia trachomatis
gauguuccaucuuuuc

SEQ ID NO: 2510373 - RNA, 18 nt, Chlamydia trachomatis
gauuaaaguuucuaauaa

SEQ ID NO: 2510374 - RNA, 15 nt, Chlamydia trachomatis
gauuaagauuauaau

SEQ ID NO: 2510375 - RNA, 23 nt, Chlamydia trachomatis
gauuacagcaagaagaagagaga

SEQ ID NO: 2510376 - RNA, 16 nt, Chlamydia trachomatis
gauuaucuaaagccau

SEQ ID NO: 2510377 - RNA, 15 nt, Chlamydia trachomatis
gauucaaaauagcag

SEQ ID NO: 2510378 - RNA, 21 nt, Chlamydia trachomatis
gauucagcaagauucuccuua

SEQ ID NO: 2510379 - RNA, 23 nt, Chlamydia trachomatis
gauucauauguucuuugaagccu

SEQ ID NO: 2510380 - RNA, 21 nt, Chlamydia trachomatis
gauucauauuccaaagaaaug

SEQ ID NO: 2510381 - RNA, 17 nt, Chlamydia trachomatis
gauucaucaaaauauuu

SEQ ID NO: 2510382 - RNA, 21 nt, Chlamydia trachomatis
gauucaugagaccgucaaaaa

SEQ ID NO: 2510383 - RNA, 19 nt, Chlamydia trachomatis
gauuccacuaccccaccua

SEQ ID NO: 2510384 - RNA, 20 nt, Chlamydia trachomatis
gauucccgccuaauaaugaa

SEQ ID NO: 2510385 - RNA, 17 nt, Chlamydia trachomatis
gauucccuuuaaagaaa

SEQ ID NO: 2510386 - RNA, 15 nt, Chlamydia trachomatis
gauucgaaggaaaug

SEQ ID NO: 2510387 - RNA, 15 nt, Chlamydia trachomatis
gauucgcugcugucu

SEQ ID NO: 2510388 - RNA, 22 nt, Chlamydia trachomatis
gauucgcugcugucuugucuuu

SEQ ID NO: 2510389 - RNA, 14 nt, Chlamydia trachomatis
gauucugcuccaaa

SEQ ID NO: 2510390 - RNA, 20 nt, Chlamydia trachomatis
gauucuugaagauuugcaaa

SEQ ID NO: 2510391 - RNA, 23 nt, Chlamydia trachomatis
gauucuuugguaauagcaaagaa

SEQ ID NO: 2510392 - RNA, 20 nt, Chlamydia trachomatis
gauugaauaaaucuauccau

SEQ ID NO: 2510393 - RNA, 17 nt, Chlamydia trachomatis
gauugagaauaaauaua

SEQ ID NO: 2510394 - RNA, 20 nt, Chlamydia trachomatis
gauugauaaagcuaucccaa

SEQ ID NO: 2510395 - RNA, 23 nt, Chlamydia trachomatis
gauugcuuuuugcacaaaaaaaa

SEQ ID NO: 2510396 - RNA, 17 nt, Chlamydia trachomatis
gauuggaaaauccaaag

SEQ ID NO: 2510397 - RNA, 20 nt, Chlamydia trachomatis
gauuggauaucuugcggagc

SEQ ID NO: 2510398 - RNA, 17 nt, Chlamydia trachomatis
gauuggaucagcuccua

SEQ ID NO: 2510399 - RNA, 22 nt, Chlamydia trachomatis
gauuguuucuguaggagagaau

SEQ ID NO: 2510400 - RNA, 13 nt, Chlamydia trachomatis
gauuuaaaccauc

SEQ ID NO: 2510401 - RNA, 13 nt, Chlamydia trachomatis
gauuuauaaagag

SEQ ID NO: 2510402 - RNA, 18 nt, Chlamydia trachomatis
gauuucauaaauuuccgu

SEQ ID NO: 2510403 - RNA, 23 nt, Chlamydia trachomatis
gauuucauggggugugagguuuu

SEQ ID NO: 2510404 - RNA, 16 nt, Chlamydia trachomatis
gauuuccccuuuucaa

SEQ ID NO: 2510405 - RNA, 12 nt, Chlamydia trachomatis
gauuuccucuuc

SEQ ID NO: 2510406 - RNA, 16 nt, Chlamydia trachomatis
gauuuccucuucuucg

SEQ ID NO: 2510407 - RNA, 11 nt, Chlamydia trachomatis
gauuucugcag

SEQ ID NO: 2510408 - RNA, 20 nt, Chlamydia trachomatis
gauuucuucuguuuuuucag

SEQ ID NO: 2510409 - RNA, 11 nt, Chlamydia trachomatis
gauuucuucuu

SEQ ID NO: 2510410 - RNA, 17 nt, Chlamydia trachomatis
gauuucuuuaacaucuu

SEQ ID NO: 2510411 - RNA, 15 nt, Chlamydia trachomatis
gauuugcaaauucuu

SEQ ID NO: 2510412 - RNA, 20 nt, Chlamydia trachomatis
gauuugccccuuuuguacag

SEQ ID NO: 2510413 - RNA, 22 nt, Chlamydia trachomatis
gauuugccuccagcgcacacuu

SEQ ID NO: 2510414 - RNA, 23 nt, Chlamydia trachomatis
gauuugucccgugcuugcuuucu

SEQ ID NO: 2510415 - RNA, 16 nt, Chlamydia trachomatis
gauuuucaucuuccaa

SEQ ID NO: 2510416 - RNA, 18 nt, Chlamydia trachomatis
gauuuucugaaguucuuu

SEQ ID NO: 2510417 - RNA, 21 nt, Chlamydia trachomatis
gauuuugaauacgauccucug

SEQ ID NO: 2510418 - RNA, 18 nt, Chlamydia trachomatis
gauuuuucuuucaaagag

SEQ ID NO: 2510419 - RNA, 14 nt, Chlamydia trachomatis
gcaaaaagcaaucc

SEQ ID NO: 2510420 - RNA, 20 nt, Chlamydia trachomatis
gcaaaaaucugcaacaaaua

SEQ ID NO: 2510421 - RNA, 21 nt, Chlamydia trachomatis
gcaaaaauuuucacacauccu

SEQ ID NO: 2510422 - RNA, 22 nt, Chlamydia trachomatis
gcaaaacauccaugucuaagga

SEQ ID NO: 2510423 - RNA, 22 nt, Chlamydia trachomatis
gcaaaaccuuuugaaacaucuu

SEQ ID NO: 2510424 - RNA, 19 nt, Chlamydia trachomatis
gcaaaacuucgggauaaga

SEQ ID NO: 2510425 - RNA, 23 nt, Chlamydia trachomatis
gcaaaacuucgggauaagaucuc

SEQ ID NO: 2510426 - RNA, 15 nt, Chlamydia trachomatis
gcaaaagaaaaaucu

SEQ ID NO: 2510427 - RNA, 16 nt, Chlamydia trachomatis
gcaaaagauuuugaau

SEQ ID NO: 2510428 - RNA, 22 nt, Chlamydia trachomatis
gcaaaagguucgaaaucaugaa

SEQ ID NO: 2510429 - RNA, 20 nt, Chlamydia trachomatis
gcaaacgguagcgauuuucu

SEQ ID NO: 2510430 - RNA, 17 nt, Chlamydia trachomatis
gcaaacugcucuucuaa

SEQ ID NO: 2510431 - RNA, 18 nt, Chlamydia trachomatis
gcaaacugcucuucuaac

SEQ ID NO: 2510432 - RNA, 14 nt, Chlamydia trachomatis
gcaaagauguuucu

SEQ ID NO: 2510433 - RNA, 16 nt, Chlamydia trachomatis
gcaaagauguuucuua

SEQ ID NO: 2510434 - RNA, 22 nt, Chlamydia trachomatis
gcaaaggcgcagcuuucguuga

SEQ ID NO: 2510435 - RNA, 23 nt, Chlamydia trachomatis
gcaaagguagauccgauaucagc

SEQ ID NO: 2510436 - RNA, 15 nt, Chlamydia trachomatis
gcaaagugcuaauaa

SEQ ID NO: 2510437 - RNA, 14 nt, Chlamydia trachomatis
gcaaauaauaaacc

SEQ ID NO: 2510438 - RNA, 14 nt, Chlamydia trachomatis
gcaaauagaauaaa

SEQ ID NO: 2510439 - RNA, 19 nt, Chlamydia trachomatis
gcaaauagaauaaaaggcu

SEQ ID NO: 2510440 - RNA, 15 nt, Chlamydia trachomatis
gcaaauuguaacagc

SEQ ID NO: 2510441 - RNA, 15 nt, Chlamydia trachomatis
gcaacaaauaccaaa

SEQ ID NO: 2510442 - RNA, 18 nt, Chlamydia trachomatis
gcaacaaauaccaaaaua

SEQ ID NO: 2510443 - RNA, 15 nt, Chlamydia trachomatis
gcaacaagaacgcuu

SEQ ID NO: 2510444 - RNA, 15 nt, Chlamydia trachomatis
gcaacaguuuugaug

SEQ ID NO: 2510445 - RNA, 23 nt, Chlamydia trachomatis
gcaaccaauucucugccuauagc

SEQ ID NO: 2510446 - RNA, 20 nt, Chlamydia trachomatis
gcaacccuaaaucuccuccu

SEQ ID NO: 2510447 - RNA, 20 nt, Chlamydia trachomatis
gcaacccucgcagagaaaga

SEQ ID NO: 2510448 - RNA, 16 nt, Chlamydia trachomatis
gcaaccucuauagcca

SEQ ID NO: 2510449 - RNA, 15 nt, Chlamydia trachomatis
gcaaccuuaucuugg

SEQ ID NO: 2510450 - RNA, 21 nt, Chlamydia trachomatis
gcaaccuuuccuguauaagaa

SEQ ID NO: 2510451 - RNA, 19 nt, Chlamydia trachomatis
gcaacgaacuuuccauagc

SEQ ID NO: 2510452 - RNA, 14 nt, Chlamydia trachomatis
gcaacucucucucc

SEQ ID NO: 2510453 - RNA, 15 nt, Chlamydia trachomatis
gcaacuugagcaucu

SEQ ID NO: 2510454 - RNA, 17 nt, Chlamydia trachomatis
gcaacuugagcaucugg

SEQ ID NO: 2510455 - RNA, 12 nt, Chlamydia trachomatis
gcaacuuuucag

SEQ ID NO: 2510456 - RNA, 18 nt, Chlamydia trachomatis
gcaacuuuucagcaagaa

SEQ ID NO: 2510457 - RNA, 21 nt, Chlamydia trachomatis
gcaagaacaaagaauggaucu

SEQ ID NO: 2510458 - RNA, 12 nt, Chlamydia trachomatis
gcaagaagaaga

SEQ ID NO: 2510459 - RNA, 14 nt, Chlamydia trachomatis
gcaagaagaagaga

SEQ ID NO: 2510460 - RNA, 21 nt, Chlamydia trachomatis
gcaagaagacgcucauaaaga

SEQ ID NO: 2510461 - RNA, 12 nt, Chlamydia trachomatis
gcaagaauaaaa

SEQ ID NO: 2510462 - RNA, 22 nt, Chlamydia trachomatis
gcaagacaucuauugagaagac

SEQ ID NO: 2510463 - RNA, 23 nt, Chlamydia trachomatis
gcaagacaucuauugagaagacu

SEQ ID NO: 2510464 - RNA, 16 nt, Chlamydia trachomatis
gcaagauauucccuaa

SEQ ID NO: 2510465 - RNA, 17 nt, Chlamydia trachomatis
gcaagaucaugggaaau

SEQ ID NO: 2510466 - RNA, 22 nt, Chlamydia trachomatis
gcaagaucaugggaaauaaaua

SEQ ID NO: 2510467 - RNA, 18 nt, Chlamydia trachomatis
gcaagcaacgaaaccaaa

SEQ ID NO: 2510468 - RNA, 21 nt, Chlamydia trachomatis
gcaagcccuugagagcaagcc

SEQ ID NO: 2510469 - RNA, 18 nt, Chlamydia trachomatis
gcaagcucaacaaggauu

SEQ ID NO: 2510470 - RNA, 20 nt, Chlamydia trachomatis
gcaaggcuuucaaaaagagc

SEQ ID NO: 2510471 - RNA, 13 nt, Chlamydia trachomatis
gcaaguaaugaca

SEQ ID NO: 2510472 - RNA, 15 nt, Chlamydia trachomatis
gcaaguaaugacacu

SEQ ID NO: 2510473 - RNA, 15 nt, Chlamydia trachomatis
gcaagucuaggagau

SEQ ID NO: 2510474 - RNA, 17 nt, Chlamydia trachomatis
gcaagucucugccaccu

SEQ ID NO: 2510475 - RNA, 12 nt, Chlamydia trachomatis
gcaauaaagaaa

SEQ ID NO: 2510476 - RNA, 22 nt, Chlamydia trachomatis
gcaauaaggggaagaaauauuc

SEQ ID NO: 2510477 - RNA, 16 nt, Chlamydia trachomatis
gcaauaauaccuuaau

SEQ ID NO: 2510478 - RNA, 16 nt, Chlamydia trachomatis
gcaauaauuuccccua

SEQ ID NO: 2510479 - RNA, 19 nt, Chlamydia trachomatis
gcaauaauuuccccuauau

SEQ ID NO: 2510480 - RNA, 22 nt, Chlamydia trachomatis
gcaauacgauugguuuaauauu

SEQ ID NO: 2510481 - RNA, 14 nt, Chlamydia trachomatis
gcaauagacaccau

SEQ ID NO: 2510482 - RNA, 20 nt, Chlamydia trachomatis
gcaauagccauuaacaacaa

SEQ ID NO: 2510483 - RNA, 16 nt, Chlamydia trachomatis
gcaaucauaucaagaa

SEQ ID NO: 2510484 - RNA, 17 nt, Chlamydia trachomatis
gcaaucauaucaagaau

SEQ ID NO: 2510485 - RNA, 17 nt, Chlamydia trachomatis
gcaauccaauuaccagu

SEQ ID NO: 2510486 - RNA, 22 nt, Chlamydia trachomatis
gcaauccaguagacagcucuug

SEQ ID NO: 2510487 - RNA, 23 nt, Chlamydia trachomatis
gcaauccuuuugauucugcucca

SEQ ID NO: 2510488 - RNA, 17 nt, Chlamydia trachomatis
gcaaugcaaaacauaac

SEQ ID NO: 2510489 - RNA, 17 nt, Chlamydia trachomatis
gcaaugccgaaaccaac

SEQ ID NO: 2510490 - RNA, 21 nt, Chlamydia trachomatis
gcaauggcaaaaucuucauaa

SEQ ID NO: 2510491 - RNA, 17 nt, Chlamydia trachomatis
gcaauucaucagcaccc

SEQ ID NO: 2510492 - RNA, 17 nt, Chlamydia trachomatis
gcaauuuacuaucagga

SEQ ID NO: 2510493 - RNA, 21 nt, Chlamydia trachomatis
gcaauuucuacgagcugaccu

SEQ ID NO: 2510494 - RNA, 15 nt, Chlamydia trachomatis
gcacaaaaaaaaaga

SEQ ID NO: 2510495 - RNA, 22 nt, Chlamydia trachomatis
gcacaaaaucccuucccagcgu

SEQ ID NO: 2510496 - RNA, 17 nt, Chlamydia trachomatis
gcacaaagauuucuucu

SEQ ID NO: 2510497 - RNA, 16 nt, Chlamydia trachomatis
gcacaaauccagcugc

SEQ ID NO: 2510498 - RNA, 18 nt, Chlamydia trachomatis
gcacaaaucuuucuuucu

SEQ ID NO: 2510499 - RNA, 15 nt, Chlamydia trachomatis
gcacaagauacaagg

SEQ ID NO: 2510500 - RNA, 15 nt, Chlamydia trachomatis
gcacaagcuguuccu

SEQ ID NO: 2510501 - RNA, 16 nt, Chlamydia trachomatis
gcacaagcuguuccua

SEQ ID NO: 2510502 - RNA, 15 nt, Chlamydia trachomatis
gcacaauaacagcac

SEQ ID NO: 2510503 - RNA, 16 nt, Chlamydia trachomatis
gcacaauaacagcaca

SEQ ID NO: 2510504 - RNA, 22 nt, Chlamydia trachomatis
gcacaauaacagcacaaacaaa

SEQ ID NO: 2510505 - RNA, 15 nt, Chlamydia trachomatis
gcacacuugauaaau

SEQ ID NO: 2510506 - RNA, 18 nt, Chlamydia trachomatis
gcacauccgcuucuucau

SEQ ID NO: 2510507 - RNA, 22 nt, Chlamydia trachomatis
gcacauccguuucuagaagaac

SEQ ID NO: 2510508 - RNA, 16 nt, Chlamydia trachomatis
gcacauuacuguacuc

SEQ ID NO: 2510509 - RNA, 19 nt, Chlamydia trachomatis
gcacauuacuguacuccuc

SEQ ID NO: 2510510 - RNA, 15 nt, Chlamydia trachomatis
gcaccaaguucuucu

SEQ ID NO: 2510511 - RNA, 18 nt, Chlamydia trachomatis
gcaccacgugcaacacaa

SEQ ID NO: 2510512 - RNA, 19 nt, Chlamydia trachomatis
gcaccagcuaauaaguuca

SEQ ID NO: 2510513 - RNA, 13 nt, Chlamydia trachomatis
gcacccacauuac

SEQ ID NO: 2510514 - RNA, 19 nt, Chlamydia trachomatis
gcacccgcggaucccaaag

SEQ ID NO: 2510515 - RNA, 17 nt, Chlamydia trachomatis
gcacccuuucuuacucc

SEQ ID NO: 2510516 - RNA, 20 nt, Chlamydia trachomatis
gcaccucggauccagaagca

SEQ ID NO: 2510517 - RNA, 15 nt, Chlamydia trachomatis
gcaccugacucaaug

SEQ ID NO: 2510518 - RNA, 15 nt, Chlamydia trachomatis
gcacgauaaaagaca

SEQ ID NO: 2510519 - RNA, 23 nt, Chlamydia trachomatis
gcacuaacgaacgggaaaugcug

SEQ ID NO: 2510520 - RNA, 14 nt, Chlamydia trachomatis
gcacuagcuugaug

SEQ ID NO: 2510521 - RNA, 16 nt, Chlamydia trachomatis
gcacucaaauuucucu

SEQ ID NO: 2510522 - RNA, 20 nt, Chlamydia trachomatis
gcacugguauucugcagaaa

SEQ ID NO: 2510523 - RNA, 16 nt, Chlamydia trachomatis
gcacuguccacauuau

SEQ ID NO: 2510524 - RNA, 14 nt, Chlamydia trachomatis
gcacugucucaugg

SEQ ID NO: 2510525 - RNA, 16 nt, Chlamydia trachomatis
gcacuuagcaguuaca

SEQ ID NO: 2510526 - RNA, 24 nt, Chlamydia trachomatis
gcacuuccucuggcuuaucaacaa

SEQ ID NO: 2510527 - RNA, 10 nt, Chlamydia trachomatis
gcacuuuccg

SEQ ID NO: 2510528 - RNA, 19 nt, Chlamydia trachomatis
gcacuuuguauaaugcaac

SEQ ID NO: 2510529 - RNA, 22 nt, Chlamydia trachomatis
gcagaaacaaauaacuuuuucu

SEQ ID NO: 2510530 - RNA, 15 nt, Chlamydia trachomatis
gcagaaacaauuuca

SEQ ID NO: 2510531 - RNA, 21 nt, Chlamydia trachomatis
gcagaaacagcuucuucuucu

SEQ ID NO: 2510532 - RNA, 22 nt, Chlamydia trachomatis
gcagaaacagcuucuucuucuc

SEQ ID NO: 2510533 - RNA, 16 nt, Chlamydia trachomatis
gcagaacagcucuagc

SEQ ID NO: 2510534 - RNA, 14 nt, Chlamydia trachomatis
gcagaaccuuccac

SEQ ID NO: 2510535 - RNA, 20 nt, Chlamydia trachomatis
gcagaagcaagaaucaaagg

SEQ ID NO: 2510536 - RNA, 24 nt, Chlamydia trachomatis
gcagacccaaaugcggcccacacu

SEQ ID NO: 2510537 - RNA, 17 nt, Chlamydia trachomatis
gcagacucaaagcuucc

SEQ ID NO: 2510538 - RNA, 12 nt, Chlamydia trachomatis
gcagagaaagcu

SEQ ID NO: 2510539 - RNA, 18 nt, Chlamydia trachomatis
gcagagauaugaguggca

SEQ ID NO: 2510540 - RNA, 19 nt, Chlamydia trachomatis
gcagagccaaaacaaacaa

SEQ ID NO: 2510541 - RNA, 17 nt, Chlamydia trachomatis
gcagaggggggcuugca

SEQ ID NO: 2510542 - RNA, 20 nt, Chlamydia trachomatis
gcagaggggggcuugcacaa

SEQ ID NO: 2510543 - RNA, 18 nt, Chlamydia trachomatis
gcagagguaugcagacuc

SEQ ID NO: 2510544 - RNA, 22 nt, Chlamydia trachomatis
gcagauaauucucgcaaagaau

SEQ ID NO: 2510545 - RNA, 19 nt, Chlamydia trachomatis
gcagauauggaagaacagc

SEQ ID NO: 2510546 - RNA, 15 nt, Chlamydia trachomatis
gcagaucauaucugc

SEQ ID NO: 2510547 - RNA, 15 nt, Chlamydia trachomatis
gcagaucccagccug

SEQ ID NO: 2510548 - RNA, 18 nt, Chlamydia trachomatis
gcagaucccggcuugccu

SEQ ID NO: 2510549 - RNA, 19 nt, Chlamydia trachomatis
gcagaugcuucugccuuuu

SEQ ID NO: 2510550 - RNA, 21 nt, Chlamydia trachomatis
gcagccacuccugcagcuaaa

SEQ ID NO: 2510551 - RNA, 19 nt, Chlamydia trachomatis
gcagccacuugcuccacac

SEQ ID NO: 2510552 - RNA, 13 nt, Chlamydia trachomatis
gcagccccccuuu

SEQ ID NO: 2510553 - RNA, 16 nt, Chlamydia trachomatis
gcagccuacauacaug

SEQ ID NO: 2510554 - RNA, 13 nt, Chlamydia trachomatis
gcagcuaacagcu

SEQ ID NO: 2510555 - RNA, 14 nt, Chlamydia trachomatis
gcagcuaacagcuc

SEQ ID NO: 2510556 - RNA, 18 nt, Chlamydia trachomatis
gcagcuagaacauacccu

SEQ ID NO: 2510557 - RNA, 21 nt, Chlamydia trachomatis
gcagcuccuauaauugcuaag

SEQ ID NO: 2510558 - RNA, 23 nt, Chlamydia trachomatis
gcagcuccuauaauugcuaagga

SEQ ID NO: 2510559 - RNA, 15 nt, Chlamydia trachomatis
gcagcucuuacuccu

SEQ ID NO: 2510560 - RNA, 17 nt, Chlamydia trachomatis
gcaggcgaacagugaca

SEQ ID NO: 2510561 - RNA, 18 nt, Chlamydia trachomatis
gcaggcgaacagugacag

SEQ ID NO: 2510562 - RNA, 19 nt, Chlamydia trachomatis
gcaguauguaggagcgaaa

SEQ ID NO: 2510563 - RNA, 23 nt, Chlamydia trachomatis
gcaguauguaggagcgaaaucga

SEQ ID NO: 2510564 - RNA, 23 nt, Chlamydia trachomatis
gcagucauauucggcuguaguga

SEQ ID NO: 2510565 - RNA, 17 nt, Chlamydia trachomatis
gcagucgcgcagcuucu

SEQ ID NO: 2510566 - RNA, 22 nt, Chlamydia trachomatis
gcagugacauuauuuuuucgag

SEQ ID NO: 2510567 - RNA, 21 nt, Chlamydia trachomatis
gcagugguuaacaggcuuccu

SEQ ID NO: 2510568 - RNA, 17 nt, Chlamydia trachomatis
gcaguuacauuuuucgc

SEQ ID NO: 2510569 - RNA, 18 nt, Chlamydia trachomatis
gcaguugaucauugauaa

SEQ ID NO: 2510570 - RNA, 14 nt, Chlamydia trachomatis
gcaguuguuuucuu

SEQ ID NO: 2510571 - RNA, 20 nt, Chlamydia trachomatis
gcaguuguuuucuugcuacu

SEQ ID NO: 2510572 - RNA, 15 nt, Chlamydia trachomatis
gcauaaaagagaaga

SEQ ID NO: 2510573 - RNA, 13 nt, Chlamydia trachomatis
gcauaaauuugcu

SEQ ID NO: 2510574 - RNA, 16 nt, Chlamydia trachomatis
gcauaacagcaagaca

SEQ ID NO: 2510575 - RNA, 17 nt, Chlamydia trachomatis
gcauaagaauaaacaac

SEQ ID NO: 2510576 - RNA, 19 nt, Chlamydia trachomatis
gcauaagaauaaacaacau

SEQ ID NO: 2510577 - RNA, 18 nt, Chlamydia trachomatis
gcauaaggaagcaaaaac

SEQ ID NO: 2510578 - RNA, 23 nt, Chlamydia trachomatis
gcauaauagcuugcacagcaagc

SEQ ID NO: 2510579 - RNA, 20 nt, Chlamydia trachomatis
gcauaccaagcuuucugcca

SEQ ID NO: 2510580 - RNA, 21 nt, Chlamydia trachomatis
gcauacucgguaacugaggga

SEQ ID NO: 2510581 - RNA, 13 nt, Chlamydia trachomatis
gcauacuuuucaa

SEQ ID NO: 2510582 - RNA, 17 nt, Chlamydia trachomatis
gcauaugcgucuucccu

SEQ ID NO: 2510583 - RNA, 15 nt, Chlamydia trachomatis
gcaucagccccaaaa

SEQ ID NO: 2510584 - RNA, 15 nt, Chlamydia trachomatis
gcaucaguaaaaaua

SEQ ID NO: 2510585 - RNA, 18 nt, Chlamydia trachomatis
gcaucauccccagaagcc

SEQ ID NO: 2510586 - RNA, 20 nt, Chlamydia trachomatis
gcaucauccccagaagccau

SEQ ID NO: 2510587 - RNA, 16 nt, Chlamydia trachomatis
gcaucccaaaauagca

SEQ ID NO: 2510588 - RNA, 16 nt, Chlamydia trachomatis
gcaucccgaaucccau

SEQ ID NO: 2510589 - RNA, 18 nt, Chlamydia trachomatis
gcaucgaagcguuuacaa

SEQ ID NO: 2510590 - RNA, 14 nt, Chlamydia trachomatis
gcaucucaaugagc

SEQ ID NO: 2510591 - RNA, 18 nt, Chlamydia trachomatis
gcaucuucucgaaagaga

SEQ ID NO: 2510592 - RNA, 14 nt, Chlamydia trachomatis
gcaucuuuucuuau

SEQ ID NO: 2510593 - RNA, 16 nt, Chlamydia trachomatis
gcaucuuuucuuauaa

SEQ ID NO: 2510594 - RNA, 17 nt, Chlamydia trachomatis
gcaugaaugagcuuaga

SEQ ID NO: 2510595 - RNA, 12 nt, Chlamydia trachomatis
gcaugagauaua

SEQ ID NO: 2510596 - RNA, 15 nt, Chlamydia trachomatis
gcaugguaaaugugu

SEQ ID NO: 2510597 - RNA, 21 nt, Chlamydia trachomatis
gcauggucucuguagugggcu

SEQ ID NO: 2510598 - RNA, 18 nt, Chlamydia trachomatis
gcauguaaucccuuuuuc

SEQ ID NO: 2510599 - RNA, 16 nt, Chlamydia trachomatis
gcauuaauauacucaa

SEQ ID NO: 2510600 - RNA, 22 nt, Chlamydia trachomatis
gcauuacacaacucuuuuccua

SEQ ID NO: 2510601 - RNA, 15 nt, Chlamydia trachomatis
gcauuacgccccuuc

SEQ ID NO: 2510602 - RNA, 17 nt, Chlamydia trachomatis
gcauuccaagaagaacu

SEQ ID NO: 2510603 - RNA, 18 nt, Chlamydia trachomatis
gcauuccuaggcagagua

SEQ ID NO: 2510604 - RNA, 13 nt, Chlamydia trachomatis
gcauuccuuucuu

SEQ ID NO: 2510605 - RNA, 23 nt, Chlamydia trachomatis
gcauucguuaucaauaaccugaa

SEQ ID NO: 2510606 - RNA, 18 nt, Chlamydia trachomatis
gcauucucucauaagauc

SEQ ID NO: 2510607 - RNA, 19 nt, Chlamydia trachomatis
gcauucucucauaagaucu

SEQ ID NO: 2510608 - RNA, 17 nt, Chlamydia trachomatis
gcauugguauugccaug

SEQ ID NO: 2510609 - RNA, 22 nt, Chlamydia trachomatis
gcauuuccgguauuaauaauga

SEQ ID NO: 2510610 - RNA, 14 nt, Chlamydia trachomatis
gcauuucucuccaa

SEQ ID NO: 2510611 - RNA, 22 nt, Chlamydia trachomatis
gcauuugcucuuccaacaauuu

SEQ ID NO: 2510612 - RNA, 19 nt, Chlamydia trachomatis
gcauuugucuucgcaaacu

SEQ ID NO: 2510613 - RNA, 12 nt, Chlamydia trachomatis
gcauuuguggac

SEQ ID NO: 2510614 - RNA, 15 nt, Chlamydia trachomatis
gccaaaaagaaaauc

SEQ ID NO: 2510615 - RNA, 14 nt, Chlamydia trachomatis
gccaaaaagacuac

SEQ ID NO: 2510616 - RNA, 15 nt, Chlamydia trachomatis
gccaaagaaaaacgg

SEQ ID NO: 2510617 - RNA, 14 nt, Chlamydia trachomatis
gccaaagaaauagc

SEQ ID NO: 2510618 - RNA, 12 nt, Chlamydia trachomatis
gccaagcaagau

SEQ ID NO: 2510619 - RNA, 17 nt, Chlamydia trachomatis
gccaagcaagauauaaa

SEQ ID NO: 2510620 - RNA, 18 nt, Chlamydia trachomatis
gccaaggaagaucaagga

SEQ ID NO: 2510621 - RNA, 18 nt, Chlamydia trachomatis
gccaauacgaacaugucc

SEQ ID NO: 2510622 - RNA, 20 nt, Chlamydia trachomatis
gccaaucuguaauaaacccu

SEQ ID NO: 2510623 - RNA, 12 nt, Chlamydia trachomatis
gccaauguucua

SEQ ID NO: 2510624 - RNA, 17 nt, Chlamydia trachomatis
gccacacauguccuacc

SEQ ID NO: 2510625 - RNA, 16 nt, Chlamydia trachomatis
gccacacuuccccauu

SEQ ID NO: 2510626 - RNA, 15 nt, Chlamydia trachomatis
gccacgauaagaucu

SEQ ID NO: 2510627 - RNA, 19 nt, Chlamydia trachomatis
gccacugcacaucacagau

SEQ ID NO: 2510628 - RNA, 13 nt, Chlamydia trachomatis
gccagaaacuuca

SEQ ID NO: 2510629 - RNA, 18 nt, Chlamydia trachomatis
gccagaagcuaugagaau

SEQ ID NO: 2510630 - RNA, 17 nt, Chlamydia trachomatis
gccagcauauuacugac

SEQ ID NO: 2510631 - RNA, 13 nt, Chlamydia trachomatis
gccaguaaucaaa

SEQ ID NO: 2510632 - RNA, 22 nt, Chlamydia trachomatis
gccagugcucaaagauuuuaug

SEQ ID NO: 2510633 - RNA, 16 nt, Chlamydia trachomatis
gccauaagcuguaggu

SEQ ID NO: 2510634 - RNA, 16 nt, Chlamydia trachomatis
gccauaauaaaaggcu

SEQ ID NO: 2510635 - RNA, 18 nt, Chlamydia trachomatis
gccauacuuacuucuaug

SEQ ID NO: 2510636 - RNA, 18 nt, Chlamydia trachomatis
gccaucauuaucuucuuc

SEQ ID NO: 2510637 - RNA, 21 nt, Chlamydia trachomatis
gccaugacauaagcaaauccu

SEQ ID NO: 2510638 - RNA, 12 nt, Chlamydia trachomatis
gccauucuuacu

SEQ ID NO: 2510639 - RNA, 19 nt, Chlamydia trachomatis
gcccaaaucucaacguguu

SEQ ID NO: 2510640 - RNA, 13 nt, Chlamydia trachomatis
gcccacagaacau

SEQ ID NO: 2510641 - RNA, 23 nt, Chlamydia trachomatis
gcccagauuuuucaaaaauagca

SEQ ID NO: 2510642 - RNA, 15 nt, Chlamydia trachomatis
gcccaggauaacaaa

SEQ ID NO: 2510643 - RNA, 13 nt, Chlamydia trachomatis
gcccagucaagag

SEQ ID NO: 2510644 - RNA, 16 nt, Chlamydia trachomatis
gcccagucaagagcuu

SEQ ID NO: 2510645 - RNA, 14 nt, Chlamydia trachomatis
gcccaugagaaacc

SEQ ID NO: 2510646 - RNA, 20 nt, Chlamydia trachomatis
gcccaugguauagaagaccu

SEQ ID NO: 2510647 - RNA, 16 nt, Chlamydia trachomatis
gccccaaaaacagcag

SEQ ID NO: 2510648 - RNA, 17 nt, Chlamydia trachomatis
gccccaaaaacagcaga

SEQ ID NO: 2510649 - RNA, 22 nt, Chlamydia trachomatis
gccccagaaacacuaucuccua

SEQ ID NO: 2510650 - RNA, 20 nt, Chlamydia trachomatis
gcccuacggaaccagcgaca

SEQ ID NO: 2510651 - RNA, 13 nt, Chlamydia trachomatis
gcccuccugcaga

SEQ ID NO: 2510652 - RNA, 18 nt, Chlamydia trachomatis
gccgaacuaauauaaguu

SEQ ID NO: 2510653 - RNA, 21 nt, Chlamydia trachomatis
gccgaacucuccucuccuaac

SEQ ID NO: 2510654 - RNA, 18 nt, Chlamydia trachomatis
gccgaacugcuuuccuua

SEQ ID NO: 2510655 - RNA, 11 nt, Chlamydia trachomatis
gccgagcauug

SEQ ID NO: 2510656 - RNA, 17 nt, Chlamydia trachomatis
gccgaugcccaagaaac

SEQ ID NO: 2510657 - RNA, 23 nt, Chlamydia trachomatis
gccgaugguucuugugaggagcu

SEQ ID NO: 2510658 - RNA, 20 nt, Chlamydia trachomatis
gccgguuaacacaauuuuug

SEQ ID NO: 2510659 - RNA, 14 nt, Chlamydia trachomatis
gccguuuguucucu

SEQ ID NO: 2510660 - RNA, 19 nt, Chlamydia trachomatis
gccguuuguucucuggucg

SEQ ID NO: 2510661 - RNA, 13 nt, Chlamydia trachomatis
gccuacaagaccu

SEQ ID NO: 2510662 - RNA, 14 nt, Chlamydia trachomatis
gccuacaagaccuc

SEQ ID NO: 2510663 - RNA, 14 nt, Chlamydia trachomatis
gccuauagaagacu

SEQ ID NO: 2510664 - RNA, 16 nt, Chlamydia trachomatis
gccuauagaagacuaa

SEQ ID NO: 2510665 - RNA, 18 nt, Chlamydia trachomatis
gccuauagagcaaucucu

SEQ ID NO: 2510666 - RNA, 20 nt, Chlamydia trachomatis
gccuauccaaggaaaccaag

SEQ ID NO: 2510667 - RNA, 17 nt, Chlamydia trachomatis
gccuccaucucugcuuc

SEQ ID NO: 2510668 - RNA, 14 nt, Chlamydia trachomatis
gccuccauuuccau

SEQ ID NO: 2510669 - RNA, 16 nt, Chlamydia trachomatis
gccuccgcuaauuuuu

SEQ ID NO: 2510670 - RNA, 17 nt, Chlamydia trachomatis
gccuccggcucccaaca

SEQ ID NO: 2510671 - RNA, 17 nt, Chlamydia trachomatis
gccuccgguuuccaaau

SEQ ID NO: 2510672 - RNA, 15 nt, Chlamydia trachomatis
gccucuaagcaccuu

SEQ ID NO: 2510673 - RNA, 11 nt, Chlamydia trachomatis
gccucuaucuc

SEQ ID NO: 2510674 - RNA, 13 nt, Chlamydia trachomatis
gccuguggcaacu

SEQ ID NO: 2510675 - RNA, 16 nt, Chlamydia trachomatis
gccuguggcaacuaau

SEQ ID NO: 2510676 - RNA, 21 nt, Chlamydia trachomatis
gccuguggcaacuaauuuuug

SEQ ID NO: 2510677 - RNA, 13 nt, Chlamydia trachomatis
gccuguuucuuau

SEQ ID NO: 2510678 - RNA, 21 nt, Chlamydia trachomatis
gccuguuuucuuguagaaaaa

SEQ ID NO: 2510679 - RNA, 23 nt, Chlamydia trachomatis
gccuguuuucuuguagaaaaaga

SEQ ID NO: 2510680 - RNA, 17 nt, Chlamydia trachomatis
gccuuaacaugauucaa

SEQ ID NO: 2510681 - RNA, 16 nt, Chlamydia trachomatis
gccuuacucaugacga

SEQ ID NO: 2510682 - RNA, 13 nt, Chlamydia trachomatis
gccuucuuguuuu

SEQ ID NO: 2510683 - RNA, 17 nt, Chlamydia trachomatis
gccuucuuuuuccucag

SEQ ID NO: 2510684 - RNA, 17 nt, Chlamydia trachomatis
gccuugagugaaaaaua

SEQ ID NO: 2510685 - RNA, 16 nt, Chlamydia trachomatis
gccuuuuauucuucag

SEQ ID NO: 2510686 - RNA, 20 nt, Chlamydia trachomatis
gccuuuuguuuucaaaagcu

SEQ ID NO: 2510687 - RNA, 11 nt, Chlamydia trachomatis
gcgaaagaaac

SEQ ID NO: 2510688 - RNA, 23 nt, Chlamydia trachomatis
gcgaagacagaaucguuuaagug

SEQ ID NO: 2510689 - RNA, 14 nt, Chlamydia trachomatis
gcgaagcacuggau

SEQ ID NO: 2510690 - RNA, 20 nt, Chlamydia trachomatis
gcgaaucacaugucauccuu

SEQ ID NO: 2510691 - RNA, 17 nt, Chlamydia trachomatis
gcgaauuucucuaucug

SEQ ID NO: 2510692 - RNA, 17 nt, Chlamydia trachomatis
gcgacaugcuuguucuc

SEQ ID NO: 2510693 - RNA, 16 nt, Chlamydia trachomatis
gcgacuaauucuaaug

SEQ ID NO: 2510694 - RNA, 16 nt, Chlamydia trachomatis
gcgacuccaacacgaa

SEQ ID NO: 2510695 - RNA, 15 nt, Chlamydia trachomatis
gcgacugaucauggg

SEQ ID NO: 2510696 - RNA, 14 nt, Chlamydia trachomatis
gcgagagagcuuua

SEQ ID NO: 2510697 - RNA, 21 nt, Chlamydia trachomatis
gcgaggcuuuuuuuuucauaa

SEQ ID NO: 2510698 - RNA, 17 nt, Chlamydia trachomatis
gcgaguuuugauuagaa

SEQ ID NO: 2510699 - RNA, 18 nt, Chlamydia trachomatis
gcgauagaauuucuuccu

SEQ ID NO: 2510700 - RNA, 20 nt, Chlamydia trachomatis
gcgauaugcuuuuuaauauc

SEQ ID NO: 2510701 - RNA, 19 nt, Chlamydia trachomatis
gcgaucuccucauccuuuu

SEQ ID NO: 2510702 - RNA, 13 nt, Chlamydia trachomatis
gcgaucuccuucc

SEQ ID NO: 2510703 - RNA, 15 nt, Chlamydia trachomatis
gcgaugccaaagaaa

SEQ ID NO: 2510704 - RNA, 23 nt, Chlamydia trachomatis
gcgauguaagguuugucuucaga

SEQ ID NO: 2510705 - RNA, 16 nt, Chlamydia trachomatis
gcgauuacuucagcaa

SEQ ID NO: 2510706 - RNA, 20 nt, Chlamydia trachomatis
gcgcaaccccgcauaccaaa

SEQ ID NO: 2510707 - RNA, 16 nt, Chlamydia trachomatis
gcgcauccacuacugu

SEQ ID NO: 2510708 - RNA, 23 nt, Chlamydia trachomatis
gcgcauccacuacugucagaccu

SEQ ID NO: 2510709 - RNA, 13 nt, Chlamydia trachomatis
gcgccuucugcug

SEQ ID NO: 2510710 - RNA, 18 nt, Chlamydia trachomatis
gcgcuagggucuucucug

SEQ ID NO: 2510711 - RNA, 17 nt, Chlamydia trachomatis
gcgcuccagcucuucca

SEQ ID NO: 2510712 - RNA, 15 nt, Chlamydia trachomatis
gcgcuuucuaaagca

SEQ ID NO: 2510713 - RNA, 17 nt, Chlamydia trachomatis
gcgcuuuuucuucucua

SEQ ID NO: 2510714 - RNA, 21 nt, Chlamydia trachomatis
gcgcuuuuuuuuuagaacaga

SEQ ID NO: 2510715 - RNA, 16 nt, Chlamydia trachomatis
gcggaaggaaaaagaa

SEQ ID NO: 2510716 - RNA, 22 nt, Chlamydia trachomatis
gcggcaguuguugggagagggu

SEQ ID NO: 2510717 - RNA, 13 nt, Chlamydia trachomatis
gcggcuaaagaag

SEQ ID NO: 2510718 - RNA, 14 nt, Chlamydia trachomatis
gcgguagaaagucc

SEQ ID NO: 2510719 - RNA, 17 nt, Chlamydia trachomatis
gcguaauuuucuagcuu

SEQ ID NO: 2510720 - RNA, 22 nt, Chlamydia trachomatis
gcguacgcaaagugcuaauaac

SEQ ID NO: 2510721 - RNA, 19 nt, Chlamydia trachomatis
gcguaguguagucagaaga

SEQ ID NO: 2510722 - RNA, 20 nt, Chlamydia trachomatis
gcguauuugaaaucaaaagg

SEQ ID NO: 2510723 - RNA, 19 nt, Chlamydia trachomatis
gcguauuuuuguuucuacu

SEQ ID NO: 2510724 - RNA, 17 nt, Chlamydia trachomatis
gcgucaucuuugagaag

SEQ ID NO: 2510725 - RNA, 12 nt, Chlamydia trachomatis
gcguccaaaaag

SEQ ID NO: 2510726 - RNA, 20 nt, Chlamydia trachomatis
gcgucuaucuaccuuuuucc

SEQ ID NO: 2510727 - RNA, 17 nt, Chlamydia trachomatis
gcgucugcauaaaacuc

SEQ ID NO: 2510728 - RNA, 20 nt, Chlamydia trachomatis
gcgugugaccaucuucacca

SEQ ID NO: 2510729 - RNA, 15 nt, Chlamydia trachomatis
gcguuacagaugccu

SEQ ID NO: 2510730 - RNA, 21 nt, Chlamydia trachomatis
gcguuacagaugccuugagga

SEQ ID NO: 2510731 - RNA, 19 nt, Chlamydia trachomatis
gcguucgcgucuagcuuuu

SEQ ID NO: 2510732 - RNA, 22 nt, Chlamydia trachomatis
gcguuguagcugucccccagau

SEQ ID NO: 2510733 - RNA, 15 nt, Chlamydia trachomatis
gcuaaaaaauccagg

SEQ ID NO: 2510734 - RNA, 17 nt, Chlamydia trachomatis
gcuaaaaacucuuucau

SEQ ID NO: 2510735 - RNA, 12 nt, Chlamydia trachomatis
gcuaaaaccuua

SEQ ID NO: 2510736 - RNA, 20 nt, Chlamydia trachomatis
gcuaaacuucuuguuaauga

SEQ ID NO: 2510737 - RNA, 13 nt, Chlamydia trachomatis
gcuaaagaaaaac

SEQ ID NO: 2510738 - RNA, 16 nt, Chlamydia trachomatis
gcuaaagcagaaacag

SEQ ID NO: 2510739 - RNA, 17 nt, Chlamydia trachomatis
gcuaaagcagaaacagc

SEQ ID NO: 2510740 - RNA, 21 nt, Chlamydia trachomatis
gcuaaagcagaaacagcuucu

SEQ ID NO: 2510741 - RNA, 22 nt, Chlamydia trachomatis
gcuaaagcagaaacagcuucuu

SEQ ID NO: 2510742 - RNA, 13 nt, Chlamydia trachomatis
gcuaacaaagaau

SEQ ID NO: 2510743 - RNA, 19 nt, Chlamydia trachomatis
gcuaacucuugaaauucaa

SEQ ID NO: 2510744 - RNA, 23 nt, Chlamydia trachomatis
gcuaacuugcaggagauaauuuu

SEQ ID NO: 2510745 - RNA, 12 nt, Chlamydia trachomatis
gcuaagaacaua

SEQ ID NO: 2510746 - RNA, 14 nt, Chlamydia trachomatis
gcuaagaaccacaa

SEQ ID NO: 2510747 - RNA, 22 nt, Chlamydia trachomatis
gcuaaggccuuauccaagcacu

SEQ ID NO: 2510748 - RNA, 15 nt, Chlamydia trachomatis
gcuaaguauagaagc

SEQ ID NO: 2510749 - RNA, 21 nt, Chlamydia trachomatis
gcuaaguuggcucguagagaa

SEQ ID NO: 2510750 - RNA, 22 nt, Chlamydia trachomatis
gcuaauaacccgcuuugaaagu

SEQ ID NO: 2510751 - RNA, 16 nt, Chlamydia trachomatis
gcuaauccaugcaucu

SEQ ID NO: 2510752 - RNA, 22 nt, Chlamydia trachomatis
gcuaaucuuuuugauuuuucuu

SEQ ID NO: 2510753 - RNA, 19 nt, Chlamydia trachomatis
gcuacagaguuaacuauuu

SEQ ID NO: 2510754 - RNA, 14 nt, Chlamydia trachomatis
gcuacagucugucc

SEQ ID NO: 2510755 - RNA, 16 nt, Chlamydia trachomatis
gcuaccaaaaauuuuu

SEQ ID NO: 2510756 - RNA, 19 nt, Chlamydia trachomatis
gcuacugucgaacgcuucu

SEQ ID NO: 2510757 - RNA, 19 nt, Chlamydia trachomatis
gcuagaaaauagcaucucu

SEQ ID NO: 2510758 - RNA, 21 nt, Chlamydia trachomatis
gcuagaaacagccugcuuucu

SEQ ID NO: 2510759 - RNA, 14 nt, Chlamydia trachomatis
gcuagaagaagagg

SEQ ID NO: 2510760 - RNA, 17 nt, Chlamydia trachomatis
gcuagaagaaucauaga

SEQ ID NO: 2510761 - RNA, 14 nt, Chlamydia trachomatis
gcuagagcaugcaa

SEQ ID NO: 2510762 - RNA, 23 nt, Chlamydia trachomatis
gcuagauacaauaguaccuucaa

SEQ ID NO: 2510763 - RNA, 18 nt, Chlamydia trachomatis
gcuagauccguuuuucua

SEQ ID NO: 2510764 - RNA, 18 nt, Chlamydia trachomatis
gcuagccuggcugcagaa

SEQ ID NO: 2510765 - RNA, 19 nt, Chlamydia trachomatis
gcuauaccgccucaaacaa

SEQ ID NO: 2510766 - RNA, 18 nt, Chlamydia trachomatis
gcuauagcgucuugcuaa

SEQ ID NO: 2510767 - RNA, 16 nt, Chlamydia trachomatis
gcuauauguaagaagc

SEQ ID NO: 2510768 - RNA, 14 nt, Chlamydia trachomatis
gcuaucaauaaaaa

SEQ ID NO: 2510769 - RNA, 14 nt, Chlamydia trachomatis
gcuaucaauaaaga

SEQ ID NO: 2510770 - RNA, 15 nt, Chlamydia trachomatis
gcuaucaauaaagaa

SEQ ID NO: 2510771 - RNA, 16 nt, Chlamydia trachomatis
gcuaucaauaaagaag

SEQ ID NO: 2510772 - RNA, 22 nt, Chlamydia trachomatis
gcuaucaauaaagaagccuucu

SEQ ID NO: 2510773 - RNA, 20 nt, Chlamydia trachomatis
gcuaucaguggcuauauucg

SEQ ID NO: 2510774 - RNA, 19 nt, Chlamydia trachomatis
gcuaucgguaaugccuuuu

SEQ ID NO: 2510775 - RNA, 13 nt, Chlamydia trachomatis
gcuaucuaauauu

SEQ ID NO: 2510776 - RNA, 20 nt, Chlamydia trachomatis
gcuaugaaaaauccuuccau

SEQ ID NO: 2510777 - RNA, 22 nt, Chlamydia trachomatis
gcuaugcgcggaaggaaaaaga

SEQ ID NO: 2510778 - RNA, 23 nt, Chlamydia trachomatis
gcuaugcgcggaaggaaaaagaa

SEQ ID NO: 2510779 - RNA, 20 nt, Chlamydia trachomatis
gcuauucacuaccagaggag

SEQ ID NO: 2510780 - RNA, 13 nt, Chlamydia trachomatis
gcuauugauuuuu

SEQ ID NO: 2510781 - RNA, 23 nt, Chlamydia trachomatis
gcuauugauuuuuucgcuuuugg

SEQ ID NO: 2510782 - RNA, 17 nt, Chlamydia trachomatis
gcuauuguauagcuuuu

SEQ ID NO: 2510783 - RNA, 13 nt, Chlamydia trachomatis
gcuauuuggaucu

SEQ ID NO: 2510784 - RNA, 17 nt, Chlamydia trachomatis
gcuauuuggaucucuua

SEQ ID NO: 2510785 - RNA, 14 nt, Chlamydia trachomatis
gcuauuuucagcaa

SEQ ID NO: 2510786 - RNA, 14 nt, Chlamydia trachomatis
gcucaaagaugagu

SEQ ID NO: 2510787 - RNA, 21 nt, Chlamydia trachomatis
gcucaacaaggauuuuuuucu

SEQ ID NO: 2510788 - RNA, 15 nt, Chlamydia trachomatis
gcucaaggaaacucu

SEQ ID NO: 2510789 - RNA, 19 nt, Chlamydia trachomatis
gcucaggaaucacaguaau

SEQ ID NO: 2510790 - RNA, 18 nt, Chlamydia trachomatis
gcucaucaaacucuuuuu

SEQ ID NO: 2510791 - RNA, 15 nt, Chlamydia trachomatis
gcucaucaaauagca

SEQ ID NO: 2510792 - RNA, 22 nt, Chlamydia trachomatis
gcucaucuugcauaaggaagca

SEQ ID NO: 2510793 - RNA, 15 nt, Chlamydia trachomatis
gcucaugagccucua

SEQ ID NO: 2510794 - RNA, 17 nt, Chlamydia trachomatis
gcucaugagccucuaac

SEQ ID NO: 2510795 - RNA, 12 nt, Chlamydia trachomatis
gcucauuagaau

SEQ ID NO: 2510796 - RNA, 11 nt, Chlamydia trachomatis
gcuccaaagau

SEQ ID NO: 2510797 - RNA, 14 nt, Chlamydia trachomatis
gcuccaaagauaua

SEQ ID NO: 2510798 - RNA, 13 nt, Chlamydia trachomatis
gcuccaaauaaaa

SEQ ID NO: 2510799 - RNA, 13 nt, Chlamydia trachomatis
gcuccacaagaag

SEQ ID NO: 2510800 - RNA, 22 nt, Chlamydia trachomatis
gcuccacacaacauaacucugc

SEQ ID NO: 2510801 - RNA, 16 nt, Chlamydia trachomatis
gcuccacuucuuuucc

SEQ ID NO: 2510802 - RNA, 20 nt, Chlamydia trachomatis
gcuccagaacgaaggacacu

SEQ ID NO: 2510803 - RNA, 15 nt, Chlamydia trachomatis
gcuccagcucuucca

SEQ ID NO: 2510804 - RNA, 16 nt, Chlamydia trachomatis
gcuccagcucuuccau

SEQ ID NO: 2510805 - RNA, 22 nt, Chlamydia trachomatis
gcucccaacaagggaaugaaau

SEQ ID NO: 2510806 - RNA, 13 nt, Chlamydia trachomatis
gcuccccucuuuu

SEQ ID NO: 2510807 - RNA, 17 nt, Chlamydia trachomatis
gcuccgagauuuucauc

SEQ ID NO: 2510808 - RNA, 14 nt, Chlamydia trachomatis
gcuccgccuucugc

SEQ ID NO: 2510809 - RNA, 15 nt, Chlamydia trachomatis
gcuccggacauucca

SEQ ID NO: 2510810 - RNA, 16 nt, Chlamydia trachomatis
gcuccggcaaauccug

SEQ ID NO: 2510811 - RNA, 13 nt, Chlamydia trachomatis
gcuccuaaagaag

SEQ ID NO: 2510812 - RNA, 17 nt, Chlamydia trachomatis
gcuccuaacaaagcucu

SEQ ID NO: 2510813 - RNA, 16 nt, Chlamydia trachomatis
gcuccuaaucuuucua

SEQ ID NO: 2510814 - RNA, 19 nt, Chlamydia trachomatis
gcuccuagugauaaacagg

SEQ ID NO: 2510815 - RNA, 17 nt, Chlamydia trachomatis
gcuccugcaagggaaca

SEQ ID NO: 2510816 - RNA, 17 nt, Chlamydia trachomatis
gcuccuggagaaaaucc

SEQ ID NO: 2510817 - RNA, 15 nt, Chlamydia trachomatis
gcuccuuucacuuca

SEQ ID NO: 2510818 - RNA, 13 nt, Chlamydia trachomatis
gcucgagaaauga

SEQ ID NO: 2510819 - RNA, 18 nt, Chlamydia trachomatis
gcucgagagaugauuguu

SEQ ID NO: 2510820 - RNA, 16 nt, Chlamydia trachomatis
gcucgcaauagauagu

SEQ ID NO: 2510821 - RNA, 22 nt, Chlamydia trachomatis
gcucgcauuuguaguucuaaca

SEQ ID NO: 2510822 - RNA, 15 nt, Chlamydia trachomatis
gcucgucuguucucc

SEQ ID NO: 2510823 - RNA, 13 nt, Chlamydia trachomatis
gcucguucacuau

SEQ ID NO: 2510824 - RNA, 22 nt, Chlamydia trachomatis
gcucguuccucagcuaauaacc

SEQ ID NO: 2510825 - RNA, 15 nt, Chlamydia trachomatis
gcucuaaagagccaa

SEQ ID NO: 2510826 - RNA, 19 nt, Chlamydia trachomatis
gcucuaaagucuuuccauu

SEQ ID NO: 2510827 - RNA, 15 nt, Chlamydia trachomatis
gcucuaacucuucuu

SEQ ID NO: 2510828 - RNA, 19 nt, Chlamydia trachomatis
gcucuccuaaugaugagaa

SEQ ID NO: 2510829 - RNA, 15 nt, Chlamydia trachomatis
gcucucuucacaaau

SEQ ID NO: 2510830 - RNA, 16 nt, Chlamydia trachomatis
gcucucuucacaaauu

SEQ ID NO: 2510831 - RNA, 22 nt, Chlamydia trachomatis
gcucucuucucuagaaaaggcc

SEQ ID NO: 2510832 - RNA, 10 nt, Chlamydia trachomatis
gcucucuuuu

SEQ ID NO: 2510833 - RNA, 13 nt, Chlamydia trachomatis
gcucucuuuucug

SEQ ID NO: 2510834 - RNA, 22 nt, Chlamydia trachomatis
gcucugcccccuacagagcccu

SEQ ID NO: 2510835 - RNA, 18 nt, Chlamydia trachomatis
gcucugucguuaaagaau

SEQ ID NO: 2510836 - RNA, 13 nt, Chlamydia trachomatis
gcucuuacuccua

SEQ ID NO: 2510837 - RNA, 22 nt, Chlamydia trachomatis
gcucuucaguacuuacgagauc

SEQ ID NO: 2510838 - RNA, 13 nt, Chlamydia trachomatis
gcucuuucuuacg

SEQ ID NO: 2510839 - RNA, 13 nt, Chlamydia trachomatis
gcugaaacacgcu

SEQ ID NO: 2510840 - RNA, 18 nt, Chlamydia trachomatis
gcugaaauucuugguauu

SEQ ID NO: 2510841 - RNA, 16 nt, Chlamydia trachomatis
gcugacuaaauacaaa

SEQ ID NO: 2510842 - RNA, 15 nt, Chlamydia trachomatis
gcugagcucuuuccu

SEQ ID NO: 2510843 - RNA, 18 nt, Chlamydia trachomatis
gcugagcuuuuuuucacu

SEQ ID NO: 2510844 - RNA, 15 nt, Chlamydia trachomatis
gcugaggaagcauuu

SEQ ID NO: 2510845 - RNA, 16 nt, Chlamydia trachomatis
gcugaggauuccaagg

SEQ ID NO: 2510846 - RNA, 14 nt, Chlamydia trachomatis
gcugauaaggaggc

SEQ ID NO: 2510847 - RNA, 10 nt, Chlamydia trachomatis
gcugauuaga

SEQ ID NO: 2510848 - RNA, 16 nt, Chlamydia trachomatis
gcugcaaucucuuguu

SEQ ID NO: 2510849 - RNA, 17 nt, Chlamydia trachomatis
gcugcagaagacuuugg

SEQ ID NO: 2510850 - RNA, 18 nt, Chlamydia trachomatis
gcugcgauaacaacaaua

SEQ ID NO: 2510851 - RNA, 18 nt, Chlamydia trachomatis
gcugcgauguggucaaaa

SEQ ID NO: 2510852 - RNA, 14 nt, Chlamydia trachomatis
gcugcguuaaacac

SEQ ID NO: 2510853 - RNA, 14 nt, Chlamydia trachomatis
gcugcguuacccuu

SEQ ID NO: 2510854 - RNA, 14 nt, Chlamydia trachomatis
gcugcuaucaucuu

SEQ ID NO: 2510855 - RNA, 21 nt, Chlamydia trachomatis
gcugcuaucuucuagaggagu

SEQ ID NO: 2510856 - RNA, 14 nt, Chlamydia trachomatis
gcugcucccucugg

SEQ ID NO: 2510857 - RNA, 20 nt, Chlamydia trachomatis
gcugcucuaaccaccugagc

SEQ ID NO: 2510858 - RNA, 13 nt, Chlamydia trachomatis
gcugcugcuugga

SEQ ID NO: 2510859 - RNA, 13 nt, Chlamydia trachomatis
gcugcuuggaaua

SEQ ID NO: 2510860 - RNA, 14 nt, Chlamydia trachomatis
gcuggcuuuguccu

SEQ ID NO: 2510861 - RNA, 10 nt, Chlamydia trachomatis
gcugggagau

SEQ ID NO: 2510862 - RNA, 22 nt, Chlamydia trachomatis
gcugguaauuggcggagaagcu

SEQ ID NO: 2510863 - RNA, 16 nt, Chlamydia trachomatis
gcugguugguuuucuu

SEQ ID NO: 2510864 - RNA, 20 nt, Chlamydia trachomatis
gcugguugguuuucuuguuc

SEQ ID NO: 2510865 - RNA, 21 nt, Chlamydia trachomatis
gcugguugguuuucuuguucu

SEQ ID NO: 2510866 - RNA, 16 nt, Chlamydia trachomatis
gcugguuuuuuuugaa

SEQ ID NO: 2510867 - RNA, 16 nt, Chlamydia trachomatis
gcuguacgauggaaau

SEQ ID NO: 2510868 - RNA, 13 nt, Chlamydia trachomatis
gcuguagccccuu

SEQ ID NO: 2510869 - RNA, 21 nt, Chlamydia trachomatis
gcuguagccccuuuagaaauu

SEQ ID NO: 2510870 - RNA, 21 nt, Chlamydia trachomatis
gcuguagugaucuuuuuagga

SEQ ID NO: 2510871 - RNA, 20 nt, Chlamydia trachomatis
gcuguauagaguaaguuucu

SEQ ID NO: 2510872 - RNA, 17 nt, Chlamydia trachomatis
gcuguauucaucucuac

SEQ ID NO: 2510873 - RNA, 14 nt, Chlamydia trachomatis
gcugucagaagaau

SEQ ID NO: 2510874 - RNA, 17 nt, Chlamydia trachomatis
gcugucagaucauuuua

SEQ ID NO: 2510875 - RNA, 22 nt, Chlamydia trachomatis
gcugucagaucauuuuaauaag

SEQ ID NO: 2510876 - RNA, 15 nt, Chlamydia trachomatis
gcugugacuccuucu

SEQ ID NO: 2510877 - RNA, 20 nt, Chlamydia trachomatis
gcuuagauuuagcuguuaug

SEQ ID NO: 2510878 - RNA, 23 nt, Chlamydia trachomatis
gcuuagauuucgauuugaugaga

SEQ ID NO: 2510879 - RNA, 23 nt, Chlamydia trachomatis
gcuuagccacugcacaucacaga

SEQ ID NO: 2510880 - RNA, 16 nt, Chlamydia trachomatis
gcuuaucaacaagauu

SEQ ID NO: 2510881 - RNA, 19 nt, Chlamydia trachomatis
gcuuaucaacaagauuuuu

SEQ ID NO: 2510882 - RNA, 20 nt, Chlamydia trachomatis
gcuuaugaacggcucuucuu

SEQ ID NO: 2510883 - RNA, 22 nt, Chlamydia trachomatis
gcuucaaaacuaaaaguugcuc

SEQ ID NO: 2510884 - RNA, 16 nt, Chlamydia trachomatis
gcuucaacgagcugcc

SEQ ID NO: 2510885 - RNA, 13 nt, Chlamydia trachomatis
gcuucaauaaugu

SEQ ID NO: 2510886 - RNA, 16 nt, Chlamydia trachomatis
gcuucagcagcauaaa

SEQ ID NO: 2510887 - RNA, 17 nt, Chlamydia trachomatis
gcuucaggggagaaaac

SEQ ID NO: 2510888 - RNA, 13 nt, Chlamydia trachomatis
gcuucauaaaaaa

SEQ ID NO: 2510889 - RNA, 23 nt, Chlamydia trachomatis
gcuucaucgauaggcauagccau

SEQ ID NO: 2510890 - RNA, 14 nt, Chlamydia trachomatis
gcuuccgaaagcau

SEQ ID NO: 2510891 - RNA, 19 nt, Chlamydia trachomatis
gcuuccuaucgcgagaaga

SEQ ID NO: 2510892 - RNA, 14 nt, Chlamydia trachomatis
gcuuccucuccuuc

SEQ ID NO: 2510893 - RNA, 18 nt, Chlamydia trachomatis
gcuuccugaacgauaaca

SEQ ID NO: 2510894 - RNA, 21 nt, Chlamydia trachomatis
gcuucgaggagucucugcagu

SEQ ID NO: 2510895 - RNA, 22 nt, Chlamydia trachomatis
gcuucgauaagaaaaaaaacca

SEQ ID NO: 2510896 - RNA, 18 nt, Chlamydia trachomatis
gcuucggaaggagacaag

SEQ ID NO: 2510897 - RNA, 24 nt, Chlamydia trachomatis
gcuucggcuauagcgucuugcuaa

SEQ ID NO: 2510898 - RNA, 16 nt, Chlamydia trachomatis
gcuucuaacgcuuccu

SEQ ID NO: 2510899 - RNA, 16 nt, Chlamydia trachomatis
gcuucuagaaauucuu

SEQ ID NO: 2510900 - RNA, 16 nt, Chlamydia trachomatis
gcuucuccaucugacu

SEQ ID NO: 2510901 - RNA, 14 nt, Chlamydia trachomatis
gcuucugaacgaga

SEQ ID NO: 2510902 - RNA, 20 nt, Chlamydia trachomatis
gcuucugaacgagaaaaagg

SEQ ID NO: 2510903 - RNA, 21 nt, Chlamydia trachomatis
gcuucugaacgagaaaaaggu

SEQ ID NO: 2510904 - RNA, 20 nt, Chlamydia trachomatis
gcuucugccauuucuaaagg

SEQ ID NO: 2510905 - RNA, 16 nt, Chlamydia trachomatis
gcuucugccuuuugau

SEQ ID NO: 2510906 - RNA, 19 nt, Chlamydia trachomatis
gcuucugccuuuugauucu

SEQ ID NO: 2510907 - RNA, 22 nt, Chlamydia trachomatis
gcuucuggacuauuuucaaaac

SEQ ID NO: 2510908 - RNA, 17 nt, Chlamydia trachomatis
gcuucuggcgauaguuc

SEQ ID NO: 2510909 - RNA, 15 nt, Chlamydia trachomatis
gcuucuuaacugcag

SEQ ID NO: 2510910 - RNA, 20 nt, Chlamydia trachomatis
gcuucuuaguggcuucggga

SEQ ID NO: 2510911 - RNA, 16 nt, Chlamydia trachomatis
gcuucuucauguucug

SEQ ID NO: 2510912 - RNA, 14 nt, Chlamydia trachomatis
gcuucuucuaaaga

SEQ ID NO: 2510913 - RNA, 18 nt, Chlamydia trachomatis
gcuucuucuucucuuucg

SEQ ID NO: 2510914 - RNA, 16 nt, Chlamydia trachomatis
gcuucuucuucuuuag

SEQ ID NO: 2510915 - RNA, 21 nt, Chlamydia trachomatis
gcuucuugggauaugccucua

SEQ ID NO: 2510916 - RNA, 16 nt, Chlamydia trachomatis
gcuucuuuaggauucg

SEQ ID NO: 2510917 - RNA, 13 nt, Chlamydia trachomatis
gcuucuuuuucaa

SEQ ID NO: 2510918 - RNA, 17 nt, Chlamydia trachomatis
gcuucuuuuuucuuuuu

SEQ ID NO: 2510919 - RNA, 20 nt, Chlamydia trachomatis
gcuugaaguagcauugcgca

SEQ ID NO: 2510920 - RNA, 16 nt, Chlamydia trachomatis
gcuugagaauccaaau

SEQ ID NO: 2510921 - RNA, 17 nt, Chlamydia trachomatis
gcuugcaacacgguucu

SEQ ID NO: 2510922 - RNA, 15 nt, Chlamydia trachomatis
gcuugcacaaucuca

SEQ ID NO: 2510923 - RNA, 13 nt, Chlamydia trachomatis
gcuugcccaaacu

SEQ ID NO: 2510924 - RNA, 18 nt, Chlamydia trachomatis
gcuuguaugguuuguccu

SEQ ID NO: 2510925 - RNA, 20 nt, Chlamydia trachomatis
gcuugucgaacaaucggaaa

SEQ ID NO: 2510926 - RNA, 15 nt, Chlamydia trachomatis
gcuugucuccuucuu

SEQ ID NO: 2510927 - RNA, 18 nt, Chlamydia trachomatis
gcuuguugcuguaacgaa

SEQ ID NO: 2510928 - RNA, 13 nt, Chlamydia trachomatis
gcuuuacgaaaua

SEQ ID NO: 2510929 - RNA, 22 nt, Chlamydia trachomatis
gcuuuagcagccccccuuuuuu

SEQ ID NO: 2510930 - RNA, 14 nt, Chlamydia trachomatis
gcuuucaaaaagag

SEQ ID NO: 2510931 - RNA, 23 nt, Chlamydia trachomatis
gcuuuccucacacacaaaaaaaa

SEQ ID NO: 2510932 - RNA, 12 nt, Chlamydia trachomatis
gcuuucuaaagc

SEQ ID NO: 2510933 - RNA, 14 nt, Chlamydia trachomatis
gcuuucuaaagcag

SEQ ID NO: 2510934 - RNA, 22 nt, Chlamydia trachomatis
gcuuucuaaagcagcuaaccau

SEQ ID NO: 2510935 - RNA, 21 nt, Chlamydia trachomatis
gcuuucuuuguuccuacuaaa

SEQ ID NO: 2510936 - RNA, 12 nt, Chlamydia trachomatis
gcuuucuuuucc

SEQ ID NO: 2510937 - RNA, 17 nt, Chlamydia trachomatis
gcuuucuuuuccaucgu

SEQ ID NO: 2510938 - RNA, 21 nt, Chlamydia trachomatis
gcuuugaucuuuguucucuaa

SEQ ID NO: 2510939 - RNA, 16 nt, Chlamydia trachomatis
gcuuugcacaccugcu

SEQ ID NO: 2510940 - RNA, 20 nt, Chlamydia trachomatis
gcuuugcacaccugcuuucu

SEQ ID NO: 2510941 - RNA, 15 nt, Chlamydia trachomatis
gcuuugucucugugu

SEQ ID NO: 2510942 - RNA, 15 nt, Chlamydia trachomatis
gcuuuguugcaaacg

SEQ ID NO: 2510943 - RNA, 23 nt, Chlamydia trachomatis
gcuuuuacaauagcauuugucuu

SEQ ID NO: 2510944 - RNA, 15 nt, Chlamydia trachomatis
gcuuuucuauuuuua

SEQ ID NO: 2510945 - RNA, 19 nt, Chlamydia trachomatis
gcuuuucuccuucuuuaau

SEQ ID NO: 2510946 - RNA, 15 nt, Chlamydia trachomatis
gcuuuucuuuccuag

SEQ ID NO: 2510947 - RNA, 15 nt, Chlamydia trachomatis
gcuuuugcaaacaau

SEQ ID NO: 2510948 - RNA, 17 nt, Chlamydia trachomatis
gcuuuugcugcuucacu

SEQ ID NO: 2510949 - RNA, 23 nt, Chlamydia trachomatis
gcuuuuuaggauucauauuccaa

SEQ ID NO: 2510950 - RNA, 18 nt, Chlamydia trachomatis
gcuuuuuccaaagcuucu

SEQ ID NO: 2510951 - RNA, 14 nt, Chlamydia trachomatis
gcuuuuucuucucu

SEQ ID NO: 2510952 - RNA, 15 nt, Chlamydia trachomatis
gcuuuuucuucucua

SEQ ID NO: 2510953 - RNA, 10 nt, Chlamydia trachomatis
ggaaaaaaaa

SEQ ID NO: 2510954 - RNA, 15 nt, Chlamydia trachomatis
ggaaaaaaaaccaaa

SEQ ID NO: 2510955 - RNA, 14 nt, Chlamydia trachomatis
ggaaaaaagaagcu

SEQ ID NO: 2510956 - RNA, 22 nt, Chlamydia trachomatis
ggaaaaaagaagcuuuucccua

SEQ ID NO: 2510957 - RNA, 22 nt, Chlamydia trachomatis
ggaaaaaauuaacaauccccaa

SEQ ID NO: 2510958 - RNA, 17 nt, Chlamydia trachomatis
ggaaaagaugaagaagu

SEQ ID NO: 2510959 - RNA, 14 nt, Chlamydia trachomatis
ggaaaagcuauucc

SEQ ID NO: 2510960 - RNA, 17 nt, Chlamydia trachomatis
ggaaacaaauuccucug

SEQ ID NO: 2510961 - RNA, 18 nt, Chlamydia trachomatis
ggaaacauuccaaauauu

SEQ ID NO: 2510962 - RNA, 21 nt, Chlamydia trachomatis
ggaaacauucccuucuuuaau

SEQ ID NO: 2510963 - RNA, 20 nt, Chlamydia trachomatis
ggaaacugucggugaaagcu

SEQ ID NO: 2510964 - RNA, 19 nt, Chlamydia trachomatis
ggaaagagagaaagcgugu

SEQ ID NO: 2510965 - RNA, 23 nt, Chlamydia trachomatis
ggaaaguacucgauggcagggaa

SEQ ID NO: 2510966 - RNA, 15 nt, Chlamydia trachomatis
ggaaauaaaaagccc

SEQ ID NO: 2510967 - RNA, 23 nt, Chlamydia trachomatis
ggaaauaggaccgacauuaguau

SEQ ID NO: 2510968 - RNA, 17 nt, Chlamydia trachomatis
ggaaaucuucgugcagg

SEQ ID NO: 2510969 - RNA, 22 nt, Chlamydia trachomatis
ggaaaucuucgugcagggagaa

SEQ ID NO: 2510970 - RNA, 21 nt, Chlamydia trachomatis
ggaaaucuugugcuaaggcau

SEQ ID NO: 2510971 - RNA, 15 nt, Chlamydia trachomatis
ggaaaugcacaauaa

SEQ ID NO: 2510972 - RNA, 14 nt, Chlamydia trachomatis
ggaacacagagucu

SEQ ID NO: 2510973 - RNA, 20 nt, Chlamydia trachomatis
ggaacaggggaccaaaaaag

SEQ ID NO: 2510974 - RNA, 17 nt, Chlamydia trachomatis
ggaacauacuucugaau

SEQ ID NO: 2510975 - RNA, 16 nt, Chlamydia trachomatis
ggaacaucgagaaaau

SEQ ID NO: 2510976 - RNA, 14 nt, Chlamydia trachomatis
ggaacgauuaucuu

SEQ ID NO: 2510977 - RNA, 15 nt, Chlamydia trachomatis
ggaagaaagcauuga

SEQ ID NO: 2510978 - RNA, 16 nt, Chlamydia trachomatis
ggaagaauaauacagg

SEQ ID NO: 2510979 - RNA, 18 nt, Chlamydia trachomatis
ggaagaauaauacaggag

SEQ ID NO: 2510980 - RNA, 15 nt, Chlamydia trachomatis
ggaagagagcuuuga

SEQ ID NO: 2510981 - RNA, 12 nt, Chlamydia trachomatis
ggaagaggaggg

SEQ ID NO: 2510982 - RNA, 16 nt, Chlamydia trachomatis
ggaagauacagccugc

SEQ ID NO: 2510983 - RNA, 13 nt, Chlamydia trachomatis
ggaagaucucuuu

SEQ ID NO: 2510984 - RNA, 19 nt, Chlamydia trachomatis
ggaagcauuucucuccaaa

SEQ ID NO: 2510985 - RNA, 16 nt, Chlamydia trachomatis
ggaagcuagaagaaga

SEQ ID NO: 2510986 - RNA, 18 nt, Chlamydia trachomatis
ggaagcuagaagaagagg

SEQ ID NO: 2510987 - RNA, 11 nt, Chlamydia trachomatis
ggaagcugaga

SEQ ID NO: 2510988 - RNA, 17 nt, Chlamydia trachomatis
ggaaggaaaaagaaaaa

SEQ ID NO: 2510989 - RNA, 21 nt, Chlamydia trachomatis
ggaaggaaaaagaaaaaaaga

SEQ ID NO: 2510990 - RNA, 21 nt, Chlamydia trachomatis
ggaagugguuaaugucucuuc

SEQ ID NO: 2510991 - RNA, 15 nt, Chlamydia trachomatis
ggaauaaacagguaa

SEQ ID NO: 2510992 - RNA, 21 nt, Chlamydia trachomatis
ggaauaaugauuuuuuuauuu

SEQ ID NO: 2510993 - RNA, 18 nt, Chlamydia trachomatis
ggaauaauuuuccacaaa

SEQ ID NO: 2510994 - RNA, 22 nt, Chlamydia trachomatis
ggaauaauuuuccacaaauauu

SEQ ID NO: 2510995 - RNA, 19 nt, Chlamydia trachomatis
ggaauacaguuagagaugu

SEQ ID NO: 2510996 - RNA, 16 nt, Chlamydia trachomatis
ggaauacaucacugca

SEQ ID NO: 2510997 - RNA, 18 nt, Chlamydia trachomatis
ggaauacgggaugcgaau

SEQ ID NO: 2510998 - RNA, 22 nt, Chlamydia trachomatis
ggaauauuaagauccauuugau

SEQ ID NO: 2510999 - RNA, 16 nt, Chlamydia trachomatis
ggaaucauaaggaaga

SEQ ID NO: 2511000 - RNA, 15 nt, Chlamydia trachomatis
ggaaucuucuucgga

SEQ ID NO: 2511001 - RNA, 20 nt, Chlamydia trachomatis
ggaauguauaaacacugaga

SEQ ID NO: 2511002 - RNA, 12 nt, Chlamydia trachomatis
ggaauucauaga

SEQ ID NO: 2511003 - RNA, 22 nt, Chlamydia trachomatis
ggaauucgcuaaugauucuuga

SEQ ID NO: 2511004 - RNA, 21 nt, Chlamydia trachomatis
ggaauugaucuuguguaguau

SEQ ID NO: 2511005 - RNA, 19 nt, Chlamydia trachomatis
ggaauuuucaucaaaauau

SEQ ID NO: 2511006 - RNA, 12 nt, Chlamydia trachomatis
ggaauuuuucuc

SEQ ID NO: 2511007 - RNA, 16 nt, Chlamydia trachomatis
ggacaaacguccuccu

SEQ ID NO: 2511008 - RNA, 17 nt, Chlamydia trachomatis
ggacaaacguccuccug

SEQ ID NO: 2511009 - RNA, 23 nt, Chlamydia trachomatis
ggacaagcucgucuuuagaagaa

SEQ ID NO: 2511010 - RNA, 19 nt, Chlamydia trachomatis
ggacaauuaucuccuaaga

SEQ ID NO: 2511011 - RNA, 22 nt, Chlamydia trachomatis
ggaccagaucauagaaaugaug

SEQ ID NO: 2511012 - RNA, 17 nt, Chlamydia trachomatis
ggaccuaauaucugcuc

SEQ ID NO: 2511013 - RNA, 19 nt, Chlamydia trachomatis
ggaccuccucuucuaucgc

SEQ ID NO: 2511014 - RNA, 24 nt, Chlamydia trachomatis
ggaccucuugaggaagagagaaca

SEQ ID NO: 2511015 - RNA, 17 nt, Chlamydia trachomatis
ggacgaucauuaggauu

SEQ ID NO: 2511016 - RNA, 18 nt, Chlamydia trachomatis
ggacuaguccugaagcaa

SEQ ID NO: 2511017 - RNA, 22 nt, Chlamydia trachomatis
ggacuaguccugaagcaaugcu

SEQ ID NO: 2511018 - RNA, 16 nt, Chlamydia trachomatis
ggacuauuuucaaaac

SEQ ID NO: 2511019 - RNA, 14 nt, Chlamydia trachomatis
ggacugguuguucc

SEQ ID NO: 2511020 - RNA, 12 nt, Chlamydia trachomatis
ggagaaagaaug

SEQ ID NO: 2511021 - RNA, 14 nt, Chlamydia trachomatis
ggagaacucuuucc

SEQ ID NO: 2511022 - RNA, 12 nt, Chlamydia trachomatis
ggagaagaagag

SEQ ID NO: 2511023 - RNA, 13 nt, Chlamydia trachomatis
ggagaagaagagg

SEQ ID NO: 2511024 - RNA, 17 nt, Chlamydia trachomatis
ggagaaggggaaggaau

SEQ ID NO: 2511025 - RNA, 21 nt, Chlamydia trachomatis
ggagacaacaaguugauacaa

SEQ ID NO: 2511026 - RNA, 23 nt, Chlamydia trachomatis
ggagaguguuugcauucuuuuaa

SEQ ID NO: 2511027 - RNA, 15 nt, Chlamydia trachomatis
ggagauacagaaucu

SEQ ID NO: 2511028 - RNA, 17 nt, Chlamydia trachomatis
ggagaucccaaaagauu

SEQ ID NO: 2511029 - RNA, 17 nt, Chlamydia trachomatis
ggagauguuuacugaga

SEQ ID NO: 2511030 - RNA, 17 nt, Chlamydia trachomatis
ggagauugccuuuucua

SEQ ID NO: 2511031 - RNA, 15 nt, Chlamydia trachomatis
ggagcaaaaagugug

SEQ ID NO: 2511032 - RNA, 19 nt, Chlamydia trachomatis
ggagcaagaauacaagaaa

SEQ ID NO: 2511033 - RNA, 13 nt, Chlamydia trachomatis
ggagcagcuaaca

SEQ ID NO: 2511034 - RNA, 18 nt, Chlamydia trachomatis
ggagcaugguauucuaaa

SEQ ID NO: 2511035 - RNA, 21 nt, Chlamydia trachomatis
ggagcauguagccaaggaaga

SEQ ID NO: 2511036 - RNA, 12 nt, Chlamydia trachomatis
ggagccaaaaag

SEQ ID NO: 2511037 - RNA, 15 nt, Chlamydia trachomatis
ggaggcaacaaauaa

SEQ ID NO: 2511038 - RNA, 13 nt, Chlamydia trachomatis
ggagggagaugau

SEQ ID NO: 2511039 - RNA, 14 nt, Chlamydia trachomatis
ggaguaagcuaauu

SEQ ID NO: 2511040 - RNA, 12 nt, Chlamydia trachomatis
ggaguaaugauu

SEQ ID NO: 2511041 - RNA, 14 nt, Chlamydia trachomatis
ggaguacuucuaaa

SEQ ID NO: 2511042 - RNA, 14 nt, Chlamydia trachomatis
ggaguaggaaggua

SEQ ID NO: 2511043 - RNA, 16 nt, Chlamydia trachomatis
ggaguauuuucaaaaa

SEQ ID NO: 2511044 - RNA, 15 nt, Chlamydia trachomatis
ggaguguuuucuguu

SEQ ID NO: 2511045 - RNA, 16 nt, Chlamydia trachomatis
ggaguuagccuaaaua

SEQ ID NO: 2511046 - RNA, 23 nt, Chlamydia trachomatis
ggaguugguuuguuaagaaggga

SEQ ID NO: 2511047 - RNA, 16 nt, Chlamydia trachomatis
ggaguuguugcuagau

SEQ ID NO: 2511048 - RNA, 14 nt, Chlamydia trachomatis
ggaguuuuucuccu

SEQ ID NO: 2511049 - RNA, 12 nt, Chlamydia trachomatis
ggauaaagaaag

SEQ ID NO: 2511050 - RNA, 17 nt, Chlamydia trachomatis
ggauaacaaacaacacu

SEQ ID NO: 2511051 - RNA, 15 nt, Chlamydia trachomatis
ggauaagaaaucuuc

SEQ ID NO: 2511052 - RNA, 16 nt, Chlamydia trachomatis
ggauaaggaagaagau

SEQ ID NO: 2511053 - RNA, 18 nt, Chlamydia trachomatis
ggauaaucucugaaagag

SEQ ID NO: 2511054 - RNA, 13 nt, Chlamydia trachomatis
ggauagacuggca

SEQ ID NO: 2511055 - RNA, 15 nt, Chlamydia trachomatis
ggauagauagcucca

SEQ ID NO: 2511056 - RNA, 20 nt, Chlamydia trachomatis
ggauaguaaaaacuauaagg

SEQ ID NO: 2511057 - RNA, 15 nt, Chlamydia trachomatis
ggauaucuucuugaa

SEQ ID NO: 2511058 - RNA, 15 nt, Chlamydia trachomatis
ggauccaaaaaagaa

SEQ ID NO: 2511059 - RNA, 15 nt, Chlamydia trachomatis
ggauccagaagcaca

SEQ ID NO: 2511060 - RNA, 19 nt, Chlamydia trachomatis
ggauccuaaauccagcgug

SEQ ID NO: 2511061 - RNA, 13 nt, Chlamydia trachomatis
ggaucggaggcau

SEQ ID NO: 2511062 - RNA, 17 nt, Chlamydia trachomatis
ggaucucuuagacccuc

SEQ ID NO: 2511063 - RNA, 21 nt, Chlamydia trachomatis
ggaucuuccagccuacaaaua

SEQ ID NO: 2511064 - RNA, 23 nt, Chlamydia trachomatis
ggaucuuccagccuacaaauaaa

SEQ ID NO: 2511065 - RNA, 16 nt, Chlamydia trachomatis
ggauguaagucuauaa

SEQ ID NO: 2511066 - RNA, 15 nt, Chlamydia trachomatis
ggauuacaaaagauu

SEQ ID NO: 2511067 - RNA, 17 nt, Chlamydia trachomatis
ggauuacagcaagaaga

SEQ ID NO: 2511068 - RNA, 18 nt, Chlamydia trachomatis
ggauuacagcaagaagaa

SEQ ID NO: 2511069 - RNA, 13 nt, Chlamydia trachomatis
ggauugccaggcg

SEQ ID NO: 2511070 - RNA, 16 nt, Chlamydia trachomatis
ggauugggggcggcag

SEQ ID NO: 2511071 - RNA, 20 nt, Chlamydia trachomatis
ggauuuuaugaagcaaauag

SEQ ID NO: 2511072 - RNA, 21 nt, Chlamydia trachomatis
ggauuuuaugaagcaaauaga

SEQ ID NO: 2511073 - RNA, 18 nt, Chlamydia trachomatis
ggcaaaaauaccaaaaaa

SEQ ID NO: 2511074 - RNA, 22 nt, Chlamydia trachomatis
ggcaaauccugcauuuauccac

SEQ ID NO: 2511075 - RNA, 18 nt, Chlamydia trachomatis
ggcaacuugagcaucugg

SEQ ID NO: 2511076 - RNA, 14 nt, Chlamydia trachomatis
ggcaagucuaggag

SEQ ID NO: 2511077 - RNA, 15 nt, Chlamydia trachomatis
ggcaagucuaggaga

SEQ ID NO: 2511078 - RNA, 15 nt, Chlamydia trachomatis
ggcaauaaaagcugg

SEQ ID NO: 2511079 - RNA, 19 nt, Chlamydia trachomatis
ggcaauggcaaaaucuuca

SEQ ID NO: 2511080 - RNA, 18 nt, Chlamydia trachomatis
ggcaauuccucuaaacaa

SEQ ID NO: 2511081 - RNA, 15 nt, Chlamydia trachomatis
ggcaccccuaaaaga

SEQ ID NO: 2511082 - RNA, 18 nt, Chlamydia trachomatis
ggcaccccuaaaagagcu

SEQ ID NO: 2511083 - RNA, 14 nt, Chlamydia trachomatis
ggcagcaagagaga

SEQ ID NO: 2511084 - RNA, 16 nt, Chlamydia trachomatis
ggcagcagagccaaaa

SEQ ID NO: 2511085 - RNA, 13 nt, Chlamydia trachomatis
ggcagcugcuugg

SEQ ID NO: 2511086 - RNA, 21 nt, Chlamydia trachomatis
ggcaguucgcgucaguucgga

SEQ ID NO: 2511087 - RNA, 13 nt, Chlamydia trachomatis
ggcauaaaagaga

SEQ ID NO: 2511088 - RNA, 19 nt, Chlamydia trachomatis
ggcauaaaagagaagaacc

SEQ ID NO: 2511089 - RNA, 21 nt, Chlamydia trachomatis
ggcauaauaggauaggaaaug

SEQ ID NO: 2511090 - RNA, 12 nt, Chlamydia trachomatis
ggcauagucuug

SEQ ID NO: 2511091 - RNA, 19 nt, Chlamydia trachomatis
ggcaugagcgauaugcuuu

SEQ ID NO: 2511092 - RNA, 15 nt, Chlamydia trachomatis
ggcccggaucugggc

SEQ ID NO: 2511093 - RNA, 15 nt, Chlamydia trachomatis
ggccuccauuuccau

SEQ ID NO: 2511094 - RNA, 18 nt, Chlamydia trachomatis
ggccucccuaucaauucc

SEQ ID NO: 2511095 - RNA, 21 nt, Chlamydia trachomatis
ggccuuuuagcccuccuacuc

SEQ ID NO: 2511096 - RNA, 14 nt, Chlamydia trachomatis
ggccuuuucuagag

SEQ ID NO: 2511097 - RNA, 13 nt, Chlamydia trachomatis
ggcgaaugcccuu

SEQ ID NO: 2511098 - RNA, 18 nt, Chlamydia trachomatis
ggcgaauuucucuaucug

SEQ ID NO: 2511099 - RNA, 16 nt, Chlamydia trachomatis
ggcgaauuucuugaac

SEQ ID NO: 2511100 - RNA, 20 nt, Chlamydia trachomatis
ggcgacacgcuucuucaaag

SEQ ID NO: 2511101 - RNA, 20 nt, Chlamydia trachomatis
ggcgccuacuucuggaggag

SEQ ID NO: 2511102 - RNA, 24 nt, Chlamydia trachomatis
ggcgcgcgcguaauuuucuagcuu

SEQ ID NO: 2511103 - RNA, 19 nt, Chlamydia trachomatis
ggcggcgguggaagaucuu

SEQ ID NO: 2511104 - RNA, 12 nt, Chlamydia trachomatis
ggcuaaagaaga

SEQ ID NO: 2511105 - RNA, 17 nt, Chlamydia trachomatis
ggcuagccguguucuga

SEQ ID NO: 2511106 - RNA, 18 nt, Chlamydia trachomatis
ggcuagccguguucugaa

SEQ ID NO: 2511107 - RNA, 15 nt, Chlamydia trachomatis
ggcuaucgucuuuaa

SEQ ID NO: 2511108 - RNA, 19 nt, Chlamydia trachomatis
ggcucaugaacagcaagag

SEQ ID NO: 2511109 - RNA, 13 nt, Chlamydia trachomatis
ggcuccauaaaag

SEQ ID NO: 2511110 - RNA, 12 nt, Chlamydia trachomatis
ggcuccccagaa

SEQ ID NO: 2511111 - RNA, 13 nt, Chlamydia trachomatis
ggcuccuuaguua

SEQ ID NO: 2511112 - RNA, 15 nt, Chlamydia trachomatis
ggcucguagagaacg

SEQ ID NO: 2511113 - RNA, 16 nt, Chlamydia trachomatis
ggcucuccuaaugaug

SEQ ID NO: 2511114 - RNA, 21 nt, Chlamydia trachomatis
ggcucucuagcaaacgaaggu

SEQ ID NO: 2511115 - RNA, 18 nt, Chlamydia trachomatis
ggcucuuuaauauuuccc

SEQ ID NO: 2511116 - RNA, 16 nt, Chlamydia trachomatis
ggcugcguuaaacaca

SEQ ID NO: 2511117 - RNA, 19 nt, Chlamydia trachomatis
ggcugcuuggcaaucugca

SEQ ID NO: 2511118 - RNA, 20 nt, Chlamydia trachomatis
ggcuuaugaacggcucuucu

SEQ ID NO: 2511119 - RNA, 16 nt, Chlamydia trachomatis
ggcuucaaagaacaua

SEQ ID NO: 2511120 - RNA, 23 nt, Chlamydia trachomatis
ggcuucgagcuguuuuugcaaca

SEQ ID NO: 2511121 - RNA, 18 nt, Chlamydia trachomatis
ggcuugcacaaucucaaa

SEQ ID NO: 2511122 - RNA, 16 nt, Chlamydia trachomatis
ggcuuuguccuggcca

SEQ ID NO: 2511123 - RNA, 12 nt, Chlamydia trachomatis
ggcuuuugcaaa

SEQ ID NO: 2511124 - RNA, 16 nt, Chlamydia trachomatis
gggaaaaaacuagaag

SEQ ID NO: 2511125 - RNA, 11 nt, Chlamydia trachomatis
gggaaaaaauu

SEQ ID NO: 2511126 - RNA, 15 nt, Chlamydia trachomatis
gggaaaaaguuugga

SEQ ID NO: 2511127 - RNA, 18 nt, Chlamydia trachomatis
gggaaaucuugugcuaag

SEQ ID NO: 2511128 - RNA, 16 nt, Chlamydia trachomatis
gggaaaugcuggauug

SEQ ID NO: 2511129 - RNA, 19 nt, Chlamydia trachomatis
gggaacaaaaccaaaauca

SEQ ID NO: 2511130 - RNA, 21 nt, Chlamydia trachomatis
gggaagacucgaagagcuucc

SEQ ID NO: 2511131 - RNA, 13 nt, Chlamydia trachomatis
gggaauacaguua

SEQ ID NO: 2511132 - RNA, 21 nt, Chlamydia trachomatis
gggaaucauaaggaagauggg

SEQ ID NO: 2511133 - RNA, 18 nt, Chlamydia trachomatis
gggaaucgguacgaaucc

SEQ ID NO: 2511134 - RNA, 20 nt, Chlamydia trachomatis
gggaaucuucuucggaaagc

SEQ ID NO: 2511135 - RNA, 20 nt, Chlamydia trachomatis
gggaauucgcuaaugauucu

SEQ ID NO: 2511136 - RNA, 18 nt, Chlamydia trachomatis
gggacaucgaaaaucacu

SEQ ID NO: 2511137 - RNA, 19 nt, Chlamydia trachomatis
gggacgcccuacaggaucc

SEQ ID NO: 2511138 - RNA, 14 nt, Chlamydia trachomatis
gggagaaggggaag

SEQ ID NO: 2511139 - RNA, 20 nt, Chlamydia trachomatis
gggagauacagacaucuaaa

SEQ ID NO: 2511140 - RNA, 18 nt, Chlamydia trachomatis
gggagcauggucucugua

SEQ ID NO: 2511141 - RNA, 13 nt, Chlamydia trachomatis
gggauagaaacuc

SEQ ID NO: 2511142 - RNA, 22 nt, Chlamydia trachomatis
gggauaucuggauugugaagaa

SEQ ID NO: 2511143 - RNA, 18 nt, Chlamydia trachomatis
gggaucccacaaagaaag

SEQ ID NO: 2511144 - RNA, 10 nt, Chlamydia trachomatis
gggauggaaa

SEQ ID NO: 2511145 - RNA, 11 nt, Chlamydia trachomatis
gggauggaaau

SEQ ID NO: 2511146 - RNA, 16 nt, Chlamydia trachomatis
gggcaaucaagcuaau

SEQ ID NO: 2511147 - RNA, 13 nt, Chlamydia trachomatis
gggcacaacgccc

SEQ ID NO: 2511148 - RNA, 21 nt, Chlamydia trachomatis
gggcauacaccugcaagagau

SEQ ID NO: 2511149 - RNA, 19 nt, Chlamydia trachomatis
gggcuauauguaagaagcu

SEQ ID NO: 2511150 - RNA, 18 nt, Chlamydia trachomatis
gggguagcugaugaagcg

SEQ ID NO: 2511151 - RNA, 18 nt, Chlamydia trachomatis
ggguaucugaacaagaag

SEQ ID NO: 2511152 - RNA, 15 nt, Chlamydia trachomatis
gggucauaaacauau

SEQ ID NO: 2511153 - RNA, 18 nt, Chlamydia trachomatis
ggguucuucugagcuaga

SEQ ID NO: 2511154 - RNA, 17 nt, Chlamydia trachomatis
ggguuuuaaaugcuucu

SEQ ID NO: 2511155 - RNA, 17 nt, Chlamydia trachomatis
ggguuuuuuuauugauc

SEQ ID NO: 2511156 - RNA, 12 nt, Chlamydia trachomatis
gguaaacaaugc

SEQ ID NO: 2511157 - RNA, 21 nt, Chlamydia trachomatis
gguaaagaaguuuaaaagccc

SEQ ID NO: 2511158 - RNA, 19 nt, Chlamydia trachomatis
gguaaaggaaguugagaag

SEQ ID NO: 2511159 - RNA, 23 nt, Chlamydia trachomatis
gguaacaaugcugauaaaaauaa

SEQ ID NO: 2511160 - RNA, 16 nt, Chlamydia trachomatis
gguaaguccgcagaga

SEQ ID NO: 2511161 - RNA, 13 nt, Chlamydia trachomatis
gguaaucuucuau

SEQ ID NO: 2511162 - RNA, 22 nt, Chlamydia trachomatis
gguaaugccuuuuguuuucaaa

SEQ ID NO: 2511163 - RNA, 21 nt, Chlamydia trachomatis
gguacaaggcucuugaaaagg

SEQ ID NO: 2511164 - RNA, 16 nt, Chlamydia trachomatis
gguaccuauaauaaug

SEQ ID NO: 2511165 - RNA, 12 nt, Chlamydia trachomatis
gguagaaaaaga

SEQ ID NO: 2511166 - RNA, 14 nt, Chlamydia trachomatis
gguagaaaguccaa

SEQ ID NO: 2511167 - RNA, 23 nt, Chlamydia trachomatis
gguagcgauuuucugaaguucuu

SEQ ID NO: 2511168 - RNA, 14 nt, Chlamydia trachomatis
gguauauguauacc

SEQ ID NO: 2511169 - RNA, 14 nt, Chlamydia trachomatis
gguauauucuucac

SEQ ID NO: 2511170 - RNA, 15 nt, Chlamydia trachomatis
ggucagcucauuaga

SEQ ID NO: 2511171 - RNA, 20 nt, Chlamydia trachomatis
ggucagcuguacgauggaaa

SEQ ID NO: 2511172 - RNA, 14 nt, Chlamydia trachomatis
gguccauaacgucc

SEQ ID NO: 2511173 - RNA, 13 nt, Chlamydia trachomatis
ggucgacagcguu

SEQ ID NO: 2511174 - RNA, 19 nt, Chlamydia trachomatis
ggucgcuugauucuugaau

SEQ ID NO: 2511175 - RNA, 21 nt, Chlamydia trachomatis
ggucuuuuaauaagaccucuu

SEQ ID NO: 2511176 - RNA, 21 nt, Chlamydia trachomatis
ggucuuuuugcuaccaagcuu

SEQ ID NO: 2511177 - RNA, 21 nt, Chlamydia trachomatis
ggugacagcuuucacagggac

SEQ ID NO: 2511178 - RNA, 15 nt, Chlamydia trachomatis
ggugacccauaagau

SEQ ID NO: 2511179 - RNA, 16 nt, Chlamydia trachomatis
ggugagugcauagaga

SEQ ID NO: 2511180 - RNA, 22 nt, Chlamydia trachomatis
ggugauuuucuuuaggcauuaa

SEQ ID NO: 2511181 - RNA, 20 nt, Chlamydia trachomatis
ggugcacaaguuuauggaaa

SEQ ID NO: 2511182 - RNA, 18 nt, Chlamydia trachomatis
ggugcagaagaauaggaa

SEQ ID NO: 2511183 - RNA, 14 nt, Chlamydia trachomatis
gguguaggaaaaua

SEQ ID NO: 2511184 - RNA, 21 nt, Chlamydia trachomatis
gguguccgcuaccugacuaca

SEQ ID NO: 2511185 - RNA, 23 nt, Chlamydia trachomatis
gguuaccugugaagaaacuucug

SEQ ID NO: 2511186 - RNA, 17 nt, Chlamydia trachomatis
gguuaggaaagcacuuu

SEQ ID NO: 2511187 - RNA, 20 nt, Chlamydia trachomatis
gguucaaacauagaaggaau

SEQ ID NO: 2511188 - RNA, 20 nt, Chlamydia trachomatis
gguucaaggaagucccuccu

SEQ ID NO: 2511189 - RNA, 15 nt, Chlamydia trachomatis
gguuccaucuaaagg

SEQ ID NO: 2511190 - RNA, 20 nt, Chlamydia trachomatis
gguuccauuuaagugaauuu

SEQ ID NO: 2511191 - RNA, 18 nt, Chlamydia trachomatis
gguucuaaagaaaagcuu

SEQ ID NO: 2511192 - RNA, 18 nt, Chlamydia trachomatis
gguucucuuuuuaaaagg

SEQ ID NO: 2511193 - RNA, 11 nt, Chlamydia trachomatis
gguucugccag

SEQ ID NO: 2511194 - RNA, 18 nt, Chlamydia trachomatis
gguucugccaguuaauca

SEQ ID NO: 2511195 - RNA, 21 nt, Chlamydia trachomatis
gguucugccaguuaaucaauu

SEQ ID NO: 2511196 - RNA, 18 nt, Chlamydia trachomatis
gguucuucaacaacuuca

SEQ ID NO: 2511197 - RNA, 21 nt, Chlamydia trachomatis
gguucuucugagcuagaaugu

SEQ ID NO: 2511198 - RNA, 21 nt, Chlamydia trachomatis
gguuggaaaucuucgugcagg

SEQ ID NO: 2511199 - RNA, 20 nt, Chlamydia trachomatis
gguugguuuucuuguucuuu

SEQ ID NO: 2511200 - RNA, 23 nt, Chlamydia trachomatis
gguuuacaauagguuuaaauaag

SEQ ID NO: 2511201 - RNA, 13 nt, Chlamydia trachomatis
gguuucaagagca

SEQ ID NO: 2511202 - RNA, 14 nt, Chlamydia trachomatis
gguuucuauacgca

SEQ ID NO: 2511203 - RNA, 14 nt, Chlamydia trachomatis
guaaaaauucuaaa

SEQ ID NO: 2511204 - RNA, 17 nt, Chlamydia trachomatis
guaaaacaaccauaaua

SEQ ID NO: 2511205 - RNA, 15 nt, Chlamydia trachomatis
guaaaagaguaagug

SEQ ID NO: 2511206 - RNA, 17 nt, Chlamydia trachomatis
guaaaagaguaagugcu

SEQ ID NO: 2511207 - RNA, 19 nt, Chlamydia trachomatis
guaaaauagcacgcaaaac

SEQ ID NO: 2511208 - RNA, 21 nt, Chlamydia trachomatis
guaaaauagcacgcaaaacau

SEQ ID NO: 2511209 - RNA, 13 nt, Chlamydia trachomatis
guaaacaaaagau

SEQ ID NO: 2511210 - RNA, 13 nt, Chlamydia trachomatis
guaaacaaccaaa

SEQ ID NO: 2511211 - RNA, 21 nt, Chlamydia trachomatis
guaaagcugcuuuacaucccu

SEQ ID NO: 2511212 - RNA, 15 nt, Chlamydia trachomatis
guaaagcuucgcuuu

SEQ ID NO: 2511213 - RNA, 15 nt, Chlamydia trachomatis
guaaaggaugaucuu

SEQ ID NO: 2511214 - RNA, 15 nt, Chlamydia trachomatis
guaaauauuuugcca

SEQ ID NO: 2511215 - RNA, 21 nt, Chlamydia trachomatis
guaaauuucaucccacaugcu

SEQ ID NO: 2511216 - RNA, 14 nt, Chlamydia trachomatis
guaacaccaaaaaa

SEQ ID NO: 2511217 - RNA, 19 nt, Chlamydia trachomatis
guaacaccaaauccuccau

SEQ ID NO: 2511218 - RNA, 15 nt, Chlamydia trachomatis
guaaccaagcuuagc

SEQ ID NO: 2511219 - RNA, 20 nt, Chlamydia trachomatis
guaaccagcggcaaaaauau

SEQ ID NO: 2511220 - RNA, 14 nt, Chlamydia trachomatis
guaacgaggccucc

SEQ ID NO: 2511221 - RNA, 15 nt, Chlamydia trachomatis
guaacuacaucuaaa

SEQ ID NO: 2511222 - RNA, 13 nt, Chlamydia trachomatis
guaagaauaaagg

SEQ ID NO: 2511223 - RNA, 16 nt, Chlamydia trachomatis
guaagcaacaauaucc

SEQ ID NO: 2511224 - RNA, 13 nt, Chlamydia trachomatis
guaagcgaagaag

SEQ ID NO: 2511225 - RNA, 14 nt, Chlamydia trachomatis
guaagcgcuuccau

SEQ ID NO: 2511226 - RNA, 20 nt, Chlamydia trachomatis
guaagcuaauuuuucucuaa

SEQ ID NO: 2511227 - RNA, 21 nt, Chlamydia trachomatis
guaaggaagccagccccuccc

SEQ ID NO: 2511228 - RNA, 13 nt, Chlamydia trachomatis
guaagggagguuu

SEQ ID NO: 2511229 - RNA, 17 nt, Chlamydia trachomatis
guaagugcauaccuguu

SEQ ID NO: 2511230 - RNA, 11 nt, Chlamydia trachomatis
guaagugcuaa

SEQ ID NO: 2511231 - RNA, 16 nt, Chlamydia trachomatis
guaaucgcuucugcug

SEQ ID NO: 2511232 - RNA, 22 nt, Chlamydia trachomatis
guaaucguauaaguuuuaagaa

SEQ ID NO: 2511233 - RNA, 21 nt, Chlamydia trachomatis
guaaucuucacggagagaaag

SEQ ID NO: 2511234 - RNA, 22 nt, Chlamydia trachomatis
guaaugaagguuucuaaaaaac

SEQ ID NO: 2511235 - RNA, 21 nt, Chlamydia trachomatis
guaaugacacuggcaccuuuu

SEQ ID NO: 2511236 - RNA, 19 nt, Chlamydia trachomatis
guaaugaucagcaaaaaga

SEQ ID NO: 2511237 - RNA, 15 nt, Chlamydia trachomatis
guaauuccaaauaau

SEQ ID NO: 2511238 - RNA, 17 nt, Chlamydia trachomatis
guaauuccaaauaauac

SEQ ID NO: 2511239 - RNA, 21 nt, Chlamydia trachomatis
guaauuuggcucuuuaauauu

SEQ ID NO: 2511240 - RNA, 19 nt, Chlamydia trachomatis
guaauuuucuagcuucuug

SEQ ID NO: 2511241 - RNA, 15 nt, Chlamydia trachomatis
guacaaaaauacuug

SEQ ID NO: 2511242 - RNA, 18 nt, Chlamydia trachomatis
guacaaaaauacuugauu

SEQ ID NO: 2511243 - RNA, 22 nt, Chlamydia trachomatis
guacaaucauuauccauaaaaa

SEQ ID NO: 2511244 - RNA, 15 nt, Chlamydia trachomatis
guacagagaaaaaga

SEQ ID NO: 2511245 - RNA, 14 nt, Chlamydia trachomatis
guacaggcauuucc

SEQ ID NO: 2511246 - RNA, 18 nt, Chlamydia trachomatis
guaccaaggauuuuuuuc

SEQ ID NO: 2511247 - RNA, 22 nt, Chlamydia trachomatis
guaccaaggauuuuuuucccac

SEQ ID NO: 2511248 - RNA, 16 nt, Chlamydia trachomatis
guacccacugcacagg

SEQ ID NO: 2511249 - RNA, 23 nt, Chlamydia trachomatis
guaccugcuucuauagaaacacg

SEQ ID NO: 2511250 - RNA, 17 nt, Chlamydia trachomatis
guacgauggaaauagga

SEQ ID NO: 2511251 - RNA, 18 nt, Chlamydia trachomatis
guacgccguaagcauucc

SEQ ID NO: 2511252 - RNA, 21 nt, Chlamydia trachomatis
guacgcuaaaaacucuuucau

SEQ ID NO: 2511253 - RNA, 21 nt, Chlamydia trachomatis
guacggcagccgaaacagacu

SEQ ID NO: 2511254 - RNA, 14 nt, Chlamydia trachomatis
guacucaucuuuuu

SEQ ID NO: 2511255 - RNA, 22 nt, Chlamydia trachomatis
guacuccucaagcgauuaugaa

SEQ ID NO: 2511256 - RNA, 13 nt, Chlamydia trachomatis
guacucgauggca

SEQ ID NO: 2511257 - RNA, 16 nt, Chlamydia trachomatis
guacucugauuagaag

SEQ ID NO: 2511258 - RNA, 23 nt, Chlamydia trachomatis
guacugauauucuuuuaauacuu

SEQ ID NO: 2511259 - RNA, 12 nt, Chlamydia trachomatis
guacuuacccuu

SEQ ID NO: 2511260 - RNA, 17 nt, Chlamydia trachomatis
guacuucuaaaauuugu

SEQ ID NO: 2511261 - RNA, 23 nt, Chlamydia trachomatis
guacuuuaccuguaggaggacaa

SEQ ID NO: 2511262 - RNA, 10 nt, Chlamydia trachomatis
guagaaaaag

SEQ ID NO: 2511263 - RNA, 15 nt, Chlamydia trachomatis
guagaaaaggauagu

SEQ ID NO: 2511264 - RNA, 18 nt, Chlamydia trachomatis
guagaaacuuacuuuucu

SEQ ID NO: 2511265 - RNA, 13 nt, Chlamydia trachomatis
guagaaauuacag

SEQ ID NO: 2511266 - RNA, 14 nt, Chlamydia trachomatis
guagagaaacuccu

SEQ ID NO: 2511267 - RNA, 14 nt, Chlamydia trachomatis
guagaggagaacaa

SEQ ID NO: 2511268 - RNA, 15 nt, Chlamydia trachomatis
guagagguuuccuua

SEQ ID NO: 2511269 - RNA, 21 nt, Chlamydia trachomatis
guagauccgauaucagcaaaa

SEQ ID NO: 2511270 - RNA, 17 nt, Chlamydia trachomatis
guagaugcuuuguaaaa

SEQ ID NO: 2511271 - RNA, 18 nt, Chlamydia trachomatis
guagauucuggaggagga

SEQ ID NO: 2511272 - RNA, 19 nt, Chlamydia trachomatis
guagcaaauuaacagauau

SEQ ID NO: 2511273 - RNA, 14 nt, Chlamydia trachomatis
guagcaaucacuaa

SEQ ID NO: 2511274 - RNA, 15 nt, Chlamydia trachomatis
guagcaccaaguucu

SEQ ID NO: 2511275 - RNA, 18 nt, Chlamydia trachomatis
guagcagaauaucuucug

SEQ ID NO: 2511276 - RNA, 13 nt, Chlamydia trachomatis
guagccaaagaau

SEQ ID NO: 2511277 - RNA, 22 nt, Chlamydia trachomatis
guagccccuuuagaaauugucc

SEQ ID NO: 2511278 - RNA, 21 nt, Chlamydia trachomatis
guagcgauuuucugaaguucu

SEQ ID NO: 2511279 - RNA, 16 nt, Chlamydia trachomatis
guagcuaaauucaggg

SEQ ID NO: 2511280 - RNA, 11 nt, Chlamydia trachomatis
guaggaagggu

SEQ ID NO: 2511281 - RNA, 17 nt, Chlamydia trachomatis
guaggauucagagaggu

SEQ ID NO: 2511282 - RNA, 15 nt, Chlamydia trachomatis
guaggccacaagaug

SEQ ID NO: 2511283 - RNA, 15 nt, Chlamydia trachomatis
guaggguagaacagg

SEQ ID NO: 2511284 - RNA, 14 nt, Chlamydia trachomatis
guagguaucugaau

SEQ ID NO: 2511285 - RNA, 12 nt, Chlamydia trachomatis
guaguaagaccc

SEQ ID NO: 2511286 - RNA, 19 nt, Chlamydia trachomatis
guaguauuuaacuuuucaa

SEQ ID NO: 2511287 - RNA, 17 nt, Chlamydia trachomatis
guagucucuagcaucgu

SEQ ID NO: 2511288 - RNA, 12 nt, Chlamydia trachomatis
guaguuagguaa

SEQ ID NO: 2511289 - RNA, 23 nt, Chlamydia trachomatis
guauaauuuacgaaguauuuucg

SEQ ID NO: 2511290 - RNA, 19 nt, Chlamydia trachomatis
guauagauacuaacaaaua

SEQ ID NO: 2511291 - RNA, 17 nt, Chlamydia trachomatis
guauagcuucauacaca

SEQ ID NO: 2511292 - RNA, 13 nt, Chlamydia trachomatis
guauagcuuuuaa

SEQ ID NO: 2511293 - RNA, 16 nt, Chlamydia trachomatis
guauccaaaacauaag

SEQ ID NO: 2511294 - RNA, 21 nt, Chlamydia trachomatis
guaucccuaccuaaagggugc

SEQ ID NO: 2511295 - RNA, 15 nt, Chlamydia trachomatis
guauccgcuucuucu

SEQ ID NO: 2511296 - RNA, 15 nt, Chlamydia trachomatis
guaucgaaaguaaaa

SEQ ID NO: 2511297 - RNA, 20 nt, Chlamydia trachomatis
guaucugaacaagaagauuu

SEQ ID NO: 2511298 - RNA, 15 nt, Chlamydia trachomatis
guaucugggauggaa

SEQ ID NO: 2511299 - RNA, 22 nt, Chlamydia trachomatis
guaucuguuaguagcuucucuu

SEQ ID NO: 2511300 - RNA, 20 nt, Chlamydia trachomatis
guaucuugguuauacagagc

SEQ ID NO: 2511301 - RNA, 17 nt, Chlamydia trachomatis
guaugcaacaacauaau

SEQ ID NO: 2511302 - RNA, 16 nt, Chlamydia trachomatis
guaugcucgagccugu

SEQ ID NO: 2511303 - RNA, 21 nt, Chlamydia trachomatis
guaugcucgccucuaucucuu

SEQ ID NO: 2511304 - RNA, 12 nt, Chlamydia trachomatis
guauggguuuuu

SEQ ID NO: 2511305 - RNA, 17 nt, Chlamydia trachomatis
guauguaagccuaaaac

SEQ ID NO: 2511306 - RNA, 13 nt, Chlamydia trachomatis
guauuaacgauug

SEQ ID NO: 2511307 - RNA, 23 nt, Chlamydia trachomatis
guauucuaaagucuuaaaagggu

SEQ ID NO: 2511308 - RNA, 15 nt, Chlamydia trachomatis
guauugugccaccga

SEQ ID NO: 2511309 - RNA, 17 nt, Chlamydia trachomatis
guauugugcguaauguu

SEQ ID NO: 2511310 - RNA, 12 nt, Chlamydia trachomatis
guauuuagguag

SEQ ID NO: 2511311 - RNA, 21 nt, Chlamydia trachomatis
guauuugcauugacuaucugc

SEQ ID NO: 2511312 - RNA, 18 nt, Chlamydia trachomatis
guauuuuagagaaaagaa

SEQ ID NO: 2511313 - RNA, 20 nt, Chlamydia trachomatis
gucaaaaagaucuucaacaa

SEQ ID NO: 2511314 - RNA, 16 nt, Chlamydia trachomatis
gucaaagaaguaauga

SEQ ID NO: 2511315 - RNA, 13 nt, Chlamydia trachomatis
gucaagagcuucu

SEQ ID NO: 2511316 - RNA, 14 nt, Chlamydia trachomatis
gucaaugagauucc

SEQ ID NO: 2511317 - RNA, 11 nt, Chlamydia trachomatis
gucaauuucug

SEQ ID NO: 2511318 - RNA, 20 nt, Chlamydia trachomatis
gucacgaaguuuuuuuaaaa

SEQ ID NO: 2511319 - RNA, 23 nt, Chlamydia trachomatis
gucacugcuuccgaaagcauguu

SEQ ID NO: 2511320 - RNA, 18 nt, Chlamydia trachomatis
gucagaagauacuuuaau

SEQ ID NO: 2511321 - RNA, 19 nt, Chlamydia trachomatis
gucagaccuacaaagauaa

SEQ ID NO: 2511322 - RNA, 18 nt, Chlamydia trachomatis
gucaggauuuaaagccuu

SEQ ID NO: 2511323 - RNA, 15 nt, Chlamydia trachomatis
gucaggauuuucuag

SEQ ID NO: 2511324 - RNA, 21 nt, Chlamydia trachomatis
gucaucacugaccgaagaacu

SEQ ID NO: 2511325 - RNA, 21 nt, Chlamydia trachomatis
gucaucaggauacgaaggauc

SEQ ID NO: 2511326 - RNA, 17 nt, Chlamydia trachomatis
gucauggugacgaaucc

SEQ ID NO: 2511327 - RNA, 20 nt, Chlamydia trachomatis
gucauucggcggguauguaa

SEQ ID NO: 2511328 - RNA, 15 nt, Chlamydia trachomatis
gucauugcuugcucg

SEQ ID NO: 2511329 - RNA, 13 nt, Chlamydia trachomatis
guccacaugccau

SEQ ID NO: 2511330 - RNA, 14 nt, Chlamydia trachomatis
guccagggaaaaga

SEQ ID NO: 2511331 - RNA, 20 nt, Chlamydia trachomatis
guccauacaaagguaaaugg

SEQ ID NO: 2511332 - RNA, 19 nt, Chlamydia trachomatis
guccaugauuucuuuaaca

SEQ ID NO: 2511333 - RNA, 22 nt, Chlamydia trachomatis
guccaugugagaacgaagccca

SEQ ID NO: 2511334 - RNA, 16 nt, Chlamydia trachomatis
guccauugcaggagau

SEQ ID NO: 2511335 - RNA, 19 nt, Chlamydia trachomatis
gucccacaacuugcguuuu

SEQ ID NO: 2511336 - RNA, 22 nt, Chlamydia trachomatis
gucccugugucucgguuuucuu

SEQ ID NO: 2511337 - RNA, 14 nt, Chlamydia trachomatis
guccgauaggaaaa

SEQ ID NO: 2511338 - RNA, 20 nt, Chlamydia trachomatis
guccuccugauuccugcuga

SEQ ID NO: 2511339 - RNA, 18 nt, Chlamydia trachomatis
guccucggaugaccgaau

SEQ ID NO: 2511340 - RNA, 21 nt, Chlamydia trachomatis
guccugcuucuuuuucccgca

SEQ ID NO: 2511341 - RNA, 12 nt, Chlamydia trachomatis
guccuggccaaa

SEQ ID NO: 2511342 - RNA, 22 nt, Chlamydia trachomatis
guccugucguaaugaaggaaau

SEQ ID NO: 2511343 - RNA, 17 nt, Chlamydia trachomatis
guccuuacauaaaaaag

SEQ ID NO: 2511344 - RNA, 14 nt, Chlamydia trachomatis
guccuuaucuucuu

SEQ ID NO: 2511345 - RNA, 23 nt, Chlamydia trachomatis
guccuuaucuucuugagaaaacu

SEQ ID NO: 2511346 - RNA, 13 nt, Chlamydia trachomatis
guccuuuauucaa

SEQ ID NO: 2511347 - RNA, 17 nt, Chlamydia trachomatis
gucgauuuuuaaaagac

SEQ ID NO: 2511348 - RNA, 14 nt, Chlamydia trachomatis
gucguacuccucgu

SEQ ID NO: 2511349 - RNA, 13 nt, Chlamydia trachomatis
gucguuaaagaau

SEQ ID NO: 2511350 - RNA, 12 nt, Chlamydia trachomatis
gucguuccucua

SEQ ID NO: 2511351 - RNA, 21 nt, Chlamydia trachomatis
gucguuuucggagaagaagag

SEQ ID NO: 2511352 - RNA, 23 nt, Chlamydia trachomatis
gucuacuccgaucaauucaucua

SEQ ID NO: 2511353 - RNA, 17 nt, Chlamydia trachomatis
gucuauaauaugaaagc

SEQ ID NO: 2511354 - RNA, 11 nt, Chlamydia trachomatis
gucucacuucc

SEQ ID NO: 2511355 - RNA, 17 nt, Chlamydia trachomatis
gucucacuuccuuggua

SEQ ID NO: 2511356 - RNA, 18 nt, Chlamydia trachomatis
gucucaugcggagcucca

SEQ ID NO: 2511357 - RNA, 22 nt, Chlamydia trachomatis
gucucaugcggagcuccaggaa

SEQ ID NO: 2511358 - RNA, 21 nt, Chlamydia trachomatis
gucuccaggagagucugcuac

SEQ ID NO: 2511359 - RNA, 23 nt, Chlamydia trachomatis
gucucgaaggaauacccagaagu

SEQ ID NO: 2511360 - RNA, 23 nt, Chlamydia trachomatis
gucucgaauucuaucaacaucug

SEQ ID NO: 2511361 - RNA, 15 nt, Chlamydia trachomatis
gucucgcagcaccug

SEQ ID NO: 2511362 - RNA, 22 nt, Chlamydia trachomatis
gucucuuaagcguuuaagugac

SEQ ID NO: 2511363 - RNA, 22 nt, Chlamydia trachomatis
gucucuucugugcaaucagcuc

SEQ ID NO: 2511364 - RNA, 14 nt, Chlamydia trachomatis
gucucuugucagaa

SEQ ID NO: 2511365 - RNA, 22 nt, Chlamydia trachomatis
gucugcgaaaaagaaauaaccu

SEQ ID NO: 2511366 - RNA, 14 nt, Chlamydia trachomatis
gucugcuacaaacu

SEQ ID NO: 2511367 - RNA, 20 nt, Chlamydia trachomatis
gucugugauaucccuuucca

SEQ ID NO: 2511368 - RNA, 17 nt, Chlamydia trachomatis
gucuguggagauaaugc

SEQ ID NO: 2511369 - RNA, 19 nt, Chlamydia trachomatis
gucuguucuacacaucugu

SEQ ID NO: 2511370 - RNA, 14 nt, Chlamydia trachomatis
gucuguugaaagcu

SEQ ID NO: 2511371 - RNA, 23 nt, Chlamydia trachomatis
gucuuaaaaggguagaaaaagag

SEQ ID NO: 2511372 - RNA, 23 nt, Chlamydia trachomatis
gucuuaaaggucgagcucccauu

SEQ ID NO: 2511373 - RNA, 15 nt, Chlamydia trachomatis
gucuuagaagauccu

SEQ ID NO: 2511374 - RNA, 20 nt, Chlamydia trachomatis
gucuuagcaaagaaauagcu

SEQ ID NO: 2511375 - RNA, 15 nt, Chlamydia trachomatis
gucuuauuaaaagac

SEQ ID NO: 2511376 - RNA, 18 nt, Chlamydia trachomatis
gucuucucugugcacaau

SEQ ID NO: 2511377 - RNA, 13 nt, Chlamydia trachomatis
gucuucuuuucug

SEQ ID NO: 2511378 - RNA, 20 nt, Chlamydia trachomatis
gucuugcuaaacaagucucu

SEQ ID NO: 2511379 - RNA, 23 nt, Chlamydia trachomatis
gucuugcuaaacaagucucugau

SEQ ID NO: 2511380 - RNA, 20 nt, Chlamydia trachomatis
gucuuguaacuaagcuucuc

SEQ ID NO: 2511381 - RNA, 15 nt, Chlamydia trachomatis
gucuuuaacaagaca

SEQ ID NO: 2511382 - RNA, 20 nt, Chlamydia trachomatis
gucuuuaauaccuucuuaca

SEQ ID NO: 2511383 - RNA, 12 nt, Chlamydia trachomatis
gugaaagaaaaa

SEQ ID NO: 2511384 - RNA, 13 nt, Chlamydia trachomatis
gugaaagaaaaau

SEQ ID NO: 2511385 - RNA, 19 nt, Chlamydia trachomatis
gugaacagagcuucaucuc

SEQ ID NO: 2511386 - RNA, 16 nt, Chlamydia trachomatis
gugaacggaggauagu

SEQ ID NO: 2511387 - RNA, 14 nt, Chlamydia trachomatis
gugaagagcagagg

SEQ ID NO: 2511388 - RNA, 13 nt, Chlamydia trachomatis
gugaauaggaaga

SEQ ID NO: 2511389 - RNA, 14 nt, Chlamydia trachomatis
gugaauaggaagaa

SEQ ID NO: 2511390 - RNA, 14 nt, Chlamydia trachomatis
gugacauuauuuuu

SEQ ID NO: 2511391 - RNA, 21 nt, Chlamydia trachomatis
gugacauuuccaacaaaaagc

SEQ ID NO: 2511392 - RNA, 22 nt, Chlamydia trachomatis
gugacuguaaguuuauuccaac

SEQ ID NO: 2511393 - RNA, 16 nt, Chlamydia trachomatis
gugagaacgaagccca

SEQ ID NO: 2511394 - RNA, 17 nt, Chlamydia trachomatis
gugagacagcacuucuu

SEQ ID NO: 2511395 - RNA, 19 nt, Chlamydia trachomatis
gugagacagcacuucuucu

SEQ ID NO: 2511396 - RNA, 15 nt, Chlamydia trachomatis
gugagcccuccugca

SEQ ID NO: 2511397 - RNA, 21 nt, Chlamydia trachomatis
gugagcccuccugcagacaua

SEQ ID NO: 2511398 - RNA, 22 nt, Chlamydia trachomatis
gugagccgcuuaagcuguucuu

SEQ ID NO: 2511399 - RNA, 16 nt, Chlamydia trachomatis
gugagcgucuuuucac

SEQ ID NO: 2511400 - RNA, 15 nt, Chlamydia trachomatis
gugaggaaguucugc

SEQ ID NO: 2511401 - RNA, 14 nt, Chlamydia trachomatis
gugaggagcucucu

SEQ ID NO: 2511402 - RNA, 13 nt, Chlamydia trachomatis
gugauaucuccac

SEQ ID NO: 2511403 - RNA, 13 nt, Chlamydia trachomatis
gugaucuuuugcu

SEQ ID NO: 2511404 - RNA, 17 nt, Chlamydia trachomatis
gugaugcggagcgauga

SEQ ID NO: 2511405 - RNA, 17 nt, Chlamydia trachomatis
gugauuuucuuuaggca

SEQ ID NO: 2511406 - RNA, 16 nt, Chlamydia trachomatis
gugcaaacaaaagaga

SEQ ID NO: 2511407 - RNA, 17 nt, Chlamydia trachomatis
gugcagaggauuuauaa

SEQ ID NO: 2511408 - RNA, 16 nt, Chlamydia trachomatis
gugcaguagccauagc

SEQ ID NO: 2511409 - RNA, 15 nt, Chlamydia trachomatis
gugcauuuguggaca

SEQ ID NO: 2511410 - RNA, 20 nt, Chlamydia trachomatis
gugccaccgaagggacuuuu

SEQ ID NO: 2511411 - RNA, 23 nt, Chlamydia trachomatis
gugccagcauucauaaacacagc

SEQ ID NO: 2511412 - RNA, 16 nt, Chlamydia trachomatis
gugccgaaggggauuu

SEQ ID NO: 2511413 - RNA, 14 nt, Chlamydia trachomatis
gugcuaacuuucuu

SEQ ID NO: 2511414 - RNA, 14 nt, Chlamydia trachomatis
guggaacagcucua

SEQ ID NO: 2511415 - RNA, 17 nt, Chlamydia trachomatis
guggaagcuagaagaag

SEQ ID NO: 2511416 - RNA, 15 nt, Chlamydia trachomatis
guggacgaacaaaaa

SEQ ID NO: 2511417 - RNA, 23 nt, Chlamydia trachomatis
guggauacgcugguauaccagga

SEQ ID NO: 2511418 - RNA, 22 nt, Chlamydia trachomatis
gugggcuaucaguggcuauauu

SEQ ID NO: 2511419 - RNA, 19 nt, Chlamydia trachomatis
gugguauagaggaauaaga

SEQ ID NO: 2511420 - RNA, 17 nt, Chlamydia trachomatis
gugguguugcaccacgu

SEQ ID NO: 2511421 - RNA, 16 nt, Chlamydia trachomatis
gugguuguagaggaga

SEQ ID NO: 2511422 - RNA, 18 nt, Chlamydia trachomatis
guguaagcguuuucuagu

SEQ ID NO: 2511423 - RNA, 14 nt, Chlamydia trachomatis
guguaaggagagaa

SEQ ID NO: 2511424 - RNA, 14 nt, Chlamydia trachomatis
guguaaucauuuuc

SEQ ID NO: 2511425 - RNA, 14 nt, Chlamydia trachomatis
guguacauuagcaa

SEQ ID NO: 2511426 - RNA, 22 nt, Chlamydia trachomatis
guguacgcuuugguagcucguu

SEQ ID NO: 2511427 - RNA, 21 nt, Chlamydia trachomatis
gugucguaaacgauuaacucu

SEQ ID NO: 2511428 - RNA, 19 nt, Chlamydia trachomatis
gugugguuguagaggagaa

SEQ ID NO: 2511429 - RNA, 23 nt, Chlamydia trachomatis
guguucggaauaagcgaaaaaaa

SEQ ID NO: 2511430 - RNA, 17 nt, Chlamydia trachomatis
guguugaaugucuuuuu

SEQ ID NO: 2511431 - RNA, 17 nt, Chlamydia trachomatis
guuaaaacacaaaagca

SEQ ID NO: 2511432 - RNA, 19 nt, Chlamydia trachomatis
guuaaagaauuauuugccu

SEQ ID NO: 2511433 - RNA, 19 nt, Chlamydia trachomatis
guuaacacaauuuuuguuc

SEQ ID NO: 2511434 - RNA, 17 nt, Chlamydia trachomatis
guuaacaucuucccaau

SEQ ID NO: 2511435 - RNA, 19 nt, Chlamydia trachomatis
guuaaccuugggaaucuuc

SEQ ID NO: 2511436 - RNA, 23 nt, Chlamydia trachomatis
guuaacggaguagagguuuccuu

SEQ ID NO: 2511437 - RNA, 13 nt, Chlamydia trachomatis
guuaacucuuucg

SEQ ID NO: 2511438 - RNA, 14 nt, Chlamydia trachomatis
guuaacugacaauc

SEQ ID NO: 2511439 - RNA, 18 nt, Chlamydia trachomatis
guuaagaauuaacccaaa

SEQ ID NO: 2511440 - RNA, 18 nt, Chlamydia trachomatis
guuaauaucccacucuuc

SEQ ID NO: 2511441 - RNA, 14 nt, Chlamydia trachomatis
guuaauucuuuuac

SEQ ID NO: 2511442 - RNA, 14 nt, Chlamydia trachomatis
guuacaagacaaua

SEQ ID NO: 2511443 - RNA, 13 nt, Chlamydia trachomatis
guuacauacuuuu

SEQ ID NO: 2511444 - RNA, 18 nt, Chlamydia trachomatis
guuaccaaaaaggaaauc

SEQ ID NO: 2511445 - RNA, 13 nt, Chlamydia trachomatis
guuacccucuuua

SEQ ID NO: 2511446 - RNA, 17 nt, Chlamydia trachomatis
guuagcaaagacauaaa

SEQ ID NO: 2511447 - RNA, 20 nt, Chlamydia trachomatis
guuagcaaagacauaaaagc

SEQ ID NO: 2511448 - RNA, 19 nt, Chlamydia trachomatis
guuagcauguucagaaucu

SEQ ID NO: 2511449 - RNA, 12 nt, Chlamydia trachomatis
guuagcuaucgc

SEQ ID NO: 2511450 - RNA, 22 nt, Chlamydia trachomatis
guuauagauaaguccaucuaaa

SEQ ID NO: 2511451 - RNA, 17 nt, Chlamydia trachomatis
guuauccacucuaaagu

SEQ ID NO: 2511452 - RNA, 15 nt, Chlamydia trachomatis
guuaugaaccaggga

SEQ ID NO: 2511453 - RNA, 15 nt, Chlamydia trachomatis
guuauucucaaguug

SEQ ID NO: 2511454 - RNA, 16 nt, Chlamydia trachomatis
guuauuuuuuaagaag

SEQ ID NO: 2511455 - RNA, 13 nt, Chlamydia trachomatis
guucaagagaggc

SEQ ID NO: 2511456 - RNA, 13 nt, Chlamydia trachomatis
guucaauuaaaga

SEQ ID NO: 2511457 - RNA, 14 nt, Chlamydia trachomatis
guucacuaugaaca

SEQ ID NO: 2511458 - RNA, 21 nt, Chlamydia trachomatis
guucacugacuguagaaaauc

SEQ ID NO: 2511459 - RNA, 13 nt, Chlamydia trachomatis
guuccagaaaaaa

SEQ ID NO: 2511460 - RNA, 17 nt, Chlamydia trachomatis
guuccagaaaaaauaau

SEQ ID NO: 2511461 - RNA, 16 nt, Chlamydia trachomatis
guuccaucuaaaggca

SEQ ID NO: 2511462 - RNA, 11 nt, Chlamydia trachomatis
guuccaucuuu

SEQ ID NO: 2511463 - RNA, 14 nt, Chlamydia trachomatis
guuccaucuuuucg

SEQ ID NO: 2511464 - RNA, 15 nt, Chlamydia trachomatis
guucccacaccaucu

SEQ ID NO: 2511465 - RNA, 21 nt, Chlamydia trachomatis
guucccuuuacaaugaugaga

SEQ ID NO: 2511466 - RNA, 21 nt, Chlamydia trachomatis
guuccgaauaagcauuacaca

SEQ ID NO: 2511467 - RNA, 18 nt, Chlamydia trachomatis
guuccggaucaaucccca

SEQ ID NO: 2511468 - RNA, 15 nt, Chlamydia trachomatis
guuccuaauagaucu

SEQ ID NO: 2511469 - RNA, 19 nt, Chlamydia trachomatis
guuccugcauacuuuucaa

SEQ ID NO: 2511470 - RNA, 20 nt, Chlamydia trachomatis
guucgacaacgauauaaaga

SEQ ID NO: 2511471 - RNA, 19 nt, Chlamydia trachomatis
guucgcuauaaucccaaaa

SEQ ID NO: 2511472 - RNA, 20 nt, Chlamydia trachomatis
guucgguaaguccgcagaga

SEQ ID NO: 2511473 - RNA, 14 nt, Chlamydia trachomatis
guucguauaauuua

SEQ ID NO: 2511474 - RNA, 12 nt, Chlamydia trachomatis
guucuaaagaaa

SEQ ID NO: 2511475 - RNA, 21 nt, Chlamydia trachomatis
guucucgcaaguucuccuucu

SEQ ID NO: 2511476 - RNA, 12 nt, Chlamydia trachomatis
guucucucccuu

SEQ ID NO: 2511477 - RNA, 17 nt, Chlamydia trachomatis
guucucucccuuccuga

SEQ ID NO: 2511478 - RNA, 19 nt, Chlamydia trachomatis
guucucucucagcagcuuc

SEQ ID NO: 2511479 - RNA, 18 nt, Chlamydia trachomatis
guucucuuagaagcucuc

SEQ ID NO: 2511480 - RNA, 19 nt, Chlamydia trachomatis
guucugagaugaaaauaug

SEQ ID NO: 2511481 - RNA, 21 nt, Chlamydia trachomatis
guucugugggauagaaacuca

SEQ ID NO: 2511482 - RNA, 12 nt, Chlamydia trachomatis
guucuucaaagc

SEQ ID NO: 2511483 - RNA, 16 nt, Chlamydia trachomatis
guucuucauagcuucu

SEQ ID NO: 2511484 - RNA, 15 nt, Chlamydia trachomatis
guucuucuuccacag

SEQ ID NO: 2511485 - RNA, 13 nt, Chlamydia trachomatis
guucuugcugaga

SEQ ID NO: 2511486 - RNA, 15 nt, Chlamydia trachomatis
guucuuuugcaaaaa

SEQ ID NO: 2511487 - RNA, 20 nt, Chlamydia trachomatis
guugaauaacguuuuaaaca

SEQ ID NO: 2511488 - RNA, 23 nt, Chlamydia trachomatis
guugaauauaccccgaacaaucu

SEQ ID NO: 2511489 - RNA, 14 nt, Chlamydia trachomatis
guugaauuucagga

SEQ ID NO: 2511490 - RNA, 23 nt, Chlamydia trachomatis
guugauaaacucggguuuuaaau

SEQ ID NO: 2511491 - RNA, 12 nt, Chlamydia trachomatis
guugaugguuuc

SEQ ID NO: 2511492 - RNA, 22 nt, Chlamydia trachomatis
guugcaaacgguagcgauuuuc

SEQ ID NO: 2511493 - RNA, 13 nt, Chlamydia trachomatis
guugcaggcaaau

SEQ ID NO: 2511494 - RNA, 13 nt, Chlamydia trachomatis
guugcauaaauuu

SEQ ID NO: 2511495 - RNA, 15 nt, Chlamydia trachomatis
guugcaucaacaaua

SEQ ID NO: 2511496 - RNA, 19 nt, Chlamydia trachomatis
guugccuuuaucucccccu

SEQ ID NO: 2511497 - RNA, 15 nt, Chlamydia trachomatis
guugcgccuucugcu

SEQ ID NO: 2511498 - RNA, 19 nt, Chlamydia trachomatis
guugcugagcuuuuuuuca

SEQ ID NO: 2511499 - RNA, 13 nt, Chlamydia trachomatis
guuggagaaacaa

SEQ ID NO: 2511500 - RNA, 14 nt, Chlamydia trachomatis
guugguagaggaga

SEQ ID NO: 2511501 - RNA, 22 nt, Chlamydia trachomatis
guuguaaagcauucguuaucaa

SEQ ID NO: 2511502 - RNA, 22 nt, Chlamydia trachomatis
guuguauaaacccacgaaaaga

SEQ ID NO: 2511503 - RNA, 19 nt, Chlamydia trachomatis
guugugggagauuccacaa

SEQ ID NO: 2511504 - RNA, 18 nt, Chlamydia trachomatis
guuguucggauucaucaa

SEQ ID NO: 2511505 - RNA, 23 nt, Chlamydophila pneumoniae AR39
aaaauucgaauucucagaaagcc

SEQ ID NO: 2511506 - RNA, 16 nt, Chlamydophila pneumoniae AR39
aaacgcucuccuagac

SEQ ID NO: 2511507 - RNA, 23 nt, Chlamydophila pneumoniae AR39
aaagagucucuugcuuuuguaga

SEQ ID NO: 2511508 - RNA, 16 nt, Chlamydophila pneumoniae AR39
aaagccuuugcucacu

SEQ ID NO: 2511509 - RNA, 21 nt, Chlamydophila pneumoniae AR39
aaaucauguccuucaaaaugu

SEQ ID NO: 2511510 - RNA, 18 nt, Chlamydophila pneumoniae AR39
aaauucgaauucucagaa

SEQ ID NO: 2511511 - RNA, 21 nt, Chlamydophila pneumoniae AR39
aagagcaacaguaauuauuuu

SEQ ID NO: 2511512 - RNA, 14 nt, Chlamydophila pneumoniae AR39
aagagucucuugcu

SEQ ID NO: 2511513 - RNA, 13 nt, Chlamydophila pneumoniae AR39
aagauaguauuuu

SEQ ID NO: 2511514 - RNA, 18 nt, Chlamydophila pneumoniae AR39
aagauaguauuuuugaaa

SEQ ID NO: 2511515 - RNA, 19 nt, Chlamydophila pneumoniae AR39
aagauaguauuuuugaaac

SEQ ID NO: 2511516 - RNA, 18 nt, Chlamydophila pneumoniae AR39
aagcugagguagcaucuc

SEQ ID NO: 2511517 - RNA, 22 nt, Chlamydophila pneumoniae AR39
aagcugagguagcaucucucuc

SEQ ID NO: 2511518 - RNA, 24 nt, Chlamydophila pneumoniae AR39
aagcugagguagcaucucucucca

SEQ ID NO: 2511519 - RNA, 22 nt, Chlamydophila pneumoniae AR39
aaguacauuaucacagcaaucu

SEQ ID NO: 2511520 - RNA, 18 nt, Chlamydophila pneumoniae AR39
aauucgaauucucagaaa

SEQ ID NO: 2511521 - RNA, 16 nt, Chlamydophila pneumoniae AR39
aauucucagaaagccu

SEQ ID NO: 2511522 - RNA, 12 nt, Chlamydophila pneumoniae AR39
acaaaaaugccu

SEQ ID NO: 2511523 - RNA, 20 nt, Chlamydophila pneumoniae AR39
acagcaaucugcagguaagg

SEQ ID NO: 2511524 - RNA, 23 nt, Chlamydophila pneumoniae AR39
acucuuccaauuguaaaucauug

SEQ ID NO: 2511525 - RNA, 20 nt, Chlamydophila pneumoniae AR39
acuguuguaauaaaaucaug

SEQ ID NO: 2511526 - RNA, 13 nt, Chlamydophila pneumoniae AR39
acuugggaugcua

SEQ ID NO: 2511527 - RNA, 17 nt, Chlamydophila pneumoniae AR39
agagucucuugcuuuug

SEQ ID NO: 2511528 - RNA, 21 nt, Chlamydophila pneumoniae AR39
agauaguauuuuugaaaccaa

SEQ ID NO: 2511529 - RNA, 15 nt, Chlamydophila pneumoniae AR39
agauguaaagagcaa

SEQ ID NO: 2511530 - RNA, 17 nt, Chlamydophila pneumoniae AR39
agauguaaagagcaaca

SEQ ID NO: 2511531 - RNA, 13 nt, Chlamydophila pneumoniae AR39
agcauagagagaa

SEQ ID NO: 2511532 - RNA, 14 nt, Chlamydophila pneumoniae AR39
aggaauuaaaauau

SEQ ID NO: 2511533 - RNA, 22 nt, Chlamydophila pneumoniae AR39
aggauagguccguuuuuucaga

SEQ ID NO: 2511534 - RNA, 15 nt, Chlamydophila pneumoniae AR39
agggaugcucuagaa

SEQ ID NO: 2511535 - RNA, 18 nt, Chlamydophila pneumoniae AR39
agucgauuucccagaagg

SEQ ID NO: 2511536 - RNA, 15 nt, Chlamydophila pneumoniae AR39
auaaaaucauguccu

SEQ ID NO: 2511537 - RNA, 16 nt, Chlamydophila pneumoniae AR39
aucacagcaaucugca

SEQ ID NO: 2511538 - RNA, 19 nt, Chlamydophila pneumoniae AR39
aucagauguaaagagcaac

SEQ ID NO: 2511539 - RNA, 22 nt, Chlamydophila pneumoniae AR39
aucgacucuuccaauuguaaau

SEQ ID NO: 2511540 - RNA, 20 nt, Chlamydophila pneumoniae AR39
aucggauuuuacucccugaa

SEQ ID NO: 2511541 - RNA, 19 nt, Chlamydophila pneumoniae AR39
aucugcgacaaaaaugccu

SEQ ID NO: 2511542 - RNA, 13 nt, Chlamydophila pneumoniae AR39
augcucuagaaaa

SEQ ID NO: 2511543 - RNA, 16 nt, Chlamydophila pneumoniae AR39
auguccuucaaaaugu

SEQ ID NO: 2511544 - RNA, 15 nt, Chlamydophila pneumoniae AR39
auucucagaaagccu

SEQ ID NO: 2511545 - RNA, 21 nt, Chlamydophila pneumoniae AR39
auuguaaaucauuggaaccau

SEQ ID NO: 2511546 - RNA, 22 nt, Chlamydophila pneumoniae AR39
auuuuaucugcgacaaaaaugc

SEQ ID NO: 2511547 - RNA, 22 nt, Chlamydophila pneumoniae AR39
caaagagucucuugcuuuugua

SEQ ID NO: 2511548 - RNA, 13 nt, Chlamydophila pneumoniae AR39
caacaguaauuau

SEQ ID NO: 2511549 - RNA, 12 nt, Chlamydophila pneumoniae AR39
cagaugauuuua

SEQ ID NO: 2511550 - RNA, 17 nt, Chlamydophila pneumoniae AR39
cagguaagggaugcucu

SEQ ID NO: 2511551 - RNA, 21 nt, Chlamydophila pneumoniae AR39
cagguaagggaugcucuagaa

SEQ ID NO: 2511552 - RNA, 23 nt, Chlamydophila pneumoniae AR39
cauagagagaaggaauuaaaaua

SEQ ID NO: 2511553 - RNA, 11 nt, Chlamydophila pneumoniae AR39
caucucucucc

SEQ ID NO: 2511554 - RNA, 14 nt, Chlamydophila pneumoniae AR39
caucucucuccaaa

SEQ ID NO: 2511555 - RNA, 23 nt, Chlamydophila pneumoniae AR39
cgaauucucagaaagccuuugcu

SEQ ID NO: 2511556 - RNA, 21 nt, Chlamydophila pneumoniae AR39
cguacgagaucagauguaaag

SEQ ID NO: 2511557 - RNA, 19 nt, Chlamydophila pneumoniae AR39
cgugagaggaucgugaagu

SEQ ID NO: 2511558 - RNA, 16 nt, Chlamydophila pneumoniae AR39
cuagaaaacgcucucc

SEQ ID NO: 2511559 - RNA, 20 nt, Chlamydophila pneumoniae AR39
cuagaaaacgcucuccuaga

SEQ ID NO: 2511560 - RNA, 19 nt, Chlamydophila pneumoniae AR39
cuagaacuugggaugcuac

SEQ ID NO: 2511561 - RNA, 15 nt, Chlamydophila pneumoniae AR39
cucacaagcauccua

SEQ ID NO: 2511562 - RNA, 19 nt, Chlamydophila pneumoniae AR39
cucuagaaaacgcucuccu

SEQ ID NO: 2511563 - RNA, 18 nt, Chlamydophila pneumoniae AR39
cuucaaaauguuuaucga

SEQ ID NO: 2511564 - RNA, 14 nt, Chlamydophila pneumoniae AR39
cuuuuguagauuag

SEQ ID NO: 2511565 - RNA, 14 nt, Chlamydophila pneumoniae AR39
gaacuugggaugcu

SEQ ID NO: 2511566 - RNA, 20 nt, Chlamydophila pneumoniae AR39
gaauucucagaaagccuuug

SEQ ID NO: 2511567 - RNA, 13 nt, Chlamydophila pneumoniae AR39
gacaaaaaugccu

SEQ ID NO: 2511568 - RNA, 18 nt, Chlamydophila pneumoniae AR39
gacucuuccaauuguaaa

SEQ ID NO: 2511569 - RNA, 18 nt, Chlamydophila pneumoniae AR39
gagagaaggaauuaaaau

SEQ ID NO: 2511570 - RNA, 14 nt, Chlamydophila pneumoniae AR39
gagcaacaguaauu

SEQ ID NO: 2511571 - RNA, 20 nt, Chlamydophila pneumoniae AR39
gagguagcaucucucuccaa

SEQ ID NO: 2511572 - RNA, 13 nt, Chlamydophila pneumoniae AR39
gagucgauuuccc

SEQ ID NO: 2511573 - RNA, 15 nt, Chlamydophila pneumoniae AR39
gagucgauuucccag

SEQ ID NO: 2511574 - RNA, 20 nt, Chlamydophila pneumoniae AR39
gagucucuugcuuuuguaga

SEQ ID NO: 2511575 - RNA, 22 nt, Chlamydophila pneumoniae AR39
gauaguauuuuugaaaccaagg

SEQ ID NO: 2511576 - RNA, 23 nt, Chlamydophila pneumoniae AR39
gaugcucuagaaaacgcucuccu

SEQ ID NO: 2511577 - RNA, 20 nt, Chlamydophila pneumoniae AR39
gauuuuacucccugaaguug

SEQ ID NO: 2511578 - RNA, 21 nt, Chlamydophila pneumoniae AR39
gcucuccuagacgaucuucag

SEQ ID NO: 2511579 - RNA, 16 nt, Chlamydophila pneumoniae AR39
gcuuuuguagauuagg

SEQ ID NO: 2511580 - RNA, 12 nt, Chlamydophila pneumoniae AR39
guaagggaugcu

SEQ ID NO: 2511581 - RNA, 16 nt, Chlamydophila pneumoniae AR39
guagcaucucucucca

SEQ ID NO: 2511582 - RNA, 23 nt, Chlamydophila pneumoniae AR39
uacacuguuguaauaaaaucaug

SEQ ID NO: 2511583 - RNA, 18 nt, Chlamydophila pneumoniae AR39
uacgagaucagauguaaa

SEQ ID NO: 2511584 - RNA, 19 nt, Chlamydophila pneumoniae AR39
uagaacuugggaugcuacu

SEQ ID NO: 2511585 - RNA, 14 nt, Chlamydophila pneumoniae AR39
uagauuaggaagau

SEQ ID NO: 2511586 - RNA, 14 nt, Chlamydophila pneumoniae AR39
uagcaucucucucc

SEQ ID NO: 2511587 - RNA, 20 nt, Chlamydophila pneumoniae AR39
uauccaaguccgugagagga

SEQ ID NO: 2511588 - RNA, 16 nt, Chlamydophila pneumoniae AR39
ucacagcaaucugcag

SEQ ID NO: 2511589 - RNA, 16 nt, Chlamydophila pneumoniae AR39
ucagaaagccuuugcu

SEQ ID NO: 2511590 - RNA, 15 nt, Chlamydophila pneumoniae AR39
ucagcauagagagaa

SEQ ID NO: 2511591 - RNA, 18 nt, Chlamydophila pneumoniae AR39
ucagcauagagagaagga

SEQ ID NO: 2511592 - RNA, 21 nt, Chlamydophila pneumoniae AR39
ucaucucacaagcauccuaga

SEQ ID NO: 2511593 - RNA, 13 nt, Chlamydophila pneumoniae AR39
ucauguccuucaa

SEQ ID NO: 2511594 - RNA, 20 nt, Chlamydophila pneumoniae AR39
ucccagaaggggaauaauau

SEQ ID NO: 2511595 - RNA, 16 nt, Chlamydophila pneumoniae AR39
uccuagacgaucuuca

SEQ ID NO: 2511596 - RNA, 12 nt, Chlamydophila pneumoniae AR39
ucgacucuucca

SEQ ID NO: 2511597 - RNA, 18 nt, Chlamydophila pneumoniae AR39
ucucagaaagccuuugcu

SEQ ID NO: 2511598 - RNA, 21 nt, Chlamydophila pneumoniae AR39
ucuccaaagagucucuugcuu

SEQ ID NO: 2511599 - RNA, 15 nt, Chlamydophila pneumoniae AR39
ucugcagguaaggga

SEQ ID NO: 2511600 - RNA, 23 nt, Chlamydophila pneumoniae AR39
ucugcagguaagggaugcucuag

SEQ ID NO: 2511601 - RNA, 19 nt, Chlamydophila pneumoniae AR39
ugaaaauucgaauucucag

SEQ ID NO: 2511602 - RNA, 22 nt, Chlamydophila pneumoniae AR39
ugaaaauucgaauucucagaaa

SEQ ID NO: 2511603 - RNA, 16 nt, Chlamydophila pneumoniae AR39
ugaaguacauuaucac

SEQ ID NO: 2511604 - RNA, 19 nt, Chlamydophila pneumoniae AR39
ugaaguugagucgauuucc

SEQ ID NO: 2511605 - RNA, 22 nt, Chlamydophila pneumoniae AR39
ugaaguugagucgauuucccag

SEQ ID NO: 2511606 - RNA, 21 nt, Chlamydophila pneumoniae AR39
ugagaggaucgugaaguacau

SEQ ID NO: 2511607 - RNA, 17 nt, Chlamydophila pneumoniae AR39
ugccugaaaauucgaau

SEQ ID NO: 2511608 - RNA, 23 nt, Chlamydophila pneumoniae AR39
uguaaagagcaacaguaauuauu

SEQ ID NO: 2511609 - RNA, 17 nt, Chlamydophila pneumoniae AR39
uguuuaucgacucuucc

SEQ ID NO: 2511610 - RNA, 15 nt, Chlamydophila pneumoniae AR39
uuauuuucuacacug

SEQ ID NO: 2511611 - RNA, 20 nt, Chlamydophila pneumoniae AR39
uucagaugauuuuaucugcg

SEQ ID NO: 2511612 - RNA, 16 nt, Chlamydophila pneumoniae AR39
uuccaauuguaaauca

SEQ ID NO: 2511613 - RNA, 23 nt, Chlamydophila pneumoniae AR39
uucguaagcugagguagcaucuc

SEQ ID NO: 2511614 - RNA, 16 nt, Chlamydophila pneumoniae AR39
uuuaucgacucuucca

SEQ ID NO: 2511615 - RNA, 20 nt, Chlamydophila pneumoniae AR39
uuuccacguacgagaucaga

SEQ ID NO: 2511616 - RNA, 13 nt, Chlamydophila pneumoniae AR39
uuuguagauuagg

SEQ ID NO: 2511617 - RNA, 22 nt, Chlamydophila pneumoniae AR39
aaaaaugccugaaaauucgaau

SEQ ID NO: 2511618 - RNA, 13 nt, Chlamydophila pneumoniae AR39
aaacgcucuccua

SEQ ID NO: 2511619 - RNA, 21 nt, Chlamydophila pneumoniae AR39
aaaucauuggaaccauaggau

SEQ ID NO: 2511620 - RNA, 13 nt, Chlamydophila pneumoniae AR39
aaaugccugaaaa

SEQ ID NO: 2511621 - RNA, 21 nt, Chlamydophila pneumoniae AR39
aaauguuuaucgacucuucca

SEQ ID NO: 2511622 - RNA, 19 nt, Chlamydophila pneumoniae AR39
aagccuuugcucacuguuu

SEQ ID NO: 2511623 - RNA, 17 nt, Chlamydophila pneumoniae AR39
aagggaugcucuagaaa

SEQ ID NO: 2511624 - RNA, 20 nt, Chlamydophila pneumoniae AR39
aagggaugcucuagaaaacg

SEQ ID NO: 2511625 - RNA, 23 nt, Chlamydophila pneumoniae AR39
aaucauuggaaccauaggauagg

SEQ ID NO: 2511626 - RNA, 20 nt, Chlamydophila pneumoniae AR39
aauguuuaucgacucuucca

SEQ ID NO: 2511627 - RNA, 16 nt, Chlamydophila pneumoniae AR39
aauucgaauucucaga

SEQ ID NO: 2511628 - RNA, 14 nt, Chlamydophila pneumoniae AR39
aauucucagaaagc

SEQ ID NO: 2511629 - RNA, 13 nt, Chlamydophila pneumoniae AR39
acaguaauuauuu

SEQ ID NO: 2511630 - RNA, 22 nt, Chlamydophila pneumoniae AR39
acucuuccaauuguaaaucauu

SEQ ID NO: 2511631 - RNA, 23 nt, Chlamydophila pneumoniae AR39
agaaagccuuugcucacuguuuu

SEQ ID NO: 2511632 - RNA, 21 nt, Chlamydophila pneumoniae AR39
agauguaaagagcaacaguaa

SEQ ID NO: 2511633 - RNA, 19 nt, Chlamydophila pneumoniae AR39
agcaacaguaauuauuuuc

SEQ ID NO: 2511634 - RNA, 14 nt, Chlamydophila pneumoniae AR39
agcauagagagaag

SEQ ID NO: 2511635 - RNA, 14 nt, Chlamydophila pneumoniae AR39
agcaucucucucca

SEQ ID NO: 2511636 - RNA, 23 nt, Chlamydophila pneumoniae AR39
agcugagguagcaucucucucca

SEQ ID NO: 2511637 - RNA, 15 nt, Chlamydophila pneumoniae AR39
aggaagauaguauuu

SEQ ID NO: 2511638 - RNA, 22 nt, Chlamydophila pneumoniae AR39
agguaagggaugcucuagaaaa

SEQ ID NO: 2511639 - RNA, 23 nt, Chlamydophila pneumoniae AR39
aguaauuauuuucuacacuguug

SEQ ID NO: 2511640 - RNA, 18 nt, Chlamydophila pneumoniae AR39
aguacauuaucacagcaa

SEQ ID NO: 2511641 - RNA, 21 nt, Chlamydophila pneumoniae AR39
aguacauuaucacagcaaucu

SEQ ID NO: 2511642 - RNA, 20 nt, Chlamydophila pneumoniae AR39
auaguauuuuugaaaccaag

SEQ ID NO: 2511643 - RNA, 18 nt, Chlamydophila pneumoniae AR39
aucagauguaaagagcaa

SEQ ID NO: 2511644 - RNA, 20 nt, Chlamydophila pneumoniae AR39
aucagauguaaagagcaaca

SEQ ID NO: 2511645 - RNA, 13 nt, Chlamydophila pneumoniae AR39
aucgacucuucca

SEQ ID NO: 2511646 - RNA, 12 nt, Chlamydophila pneumoniae AR39
aucggauuuuac

SEQ ID NO: 2511647 - RNA, 19 nt, Chlamydophila pneumoniae AR39
aucugcagguaagggaugc

SEQ ID NO: 2511648 - RNA, 22 nt, Chlamydophila pneumoniae AR39
aucugcgacaaaaaugccugaa

SEQ ID NO: 2511649 - RNA, 21 nt, Chlamydophila pneumoniae AR39
aucuucagcauagagagaagg

SEQ ID NO: 2511650 - RNA, 19 nt, Chlamydophila pneumoniae AR39
auguccuucaaaauguuua

SEQ ID NO: 2511651 - RNA, 19 nt, Chlamydophila pneumoniae AR39
auucgaauucucagaaagc

SEQ ID NO: 2511652 - RNA, 14 nt, Chlamydophila pneumoniae AR39
caaaauguuuaucg

SEQ ID NO: 2511653 - RNA, 22 nt, Chlamydophila pneumoniae AR39
caaaauguuuaucgacucuucc

SEQ ID NO: 2511654 - RNA, 15 nt, Chlamydophila pneumoniae AR39
caacaguaauuauuu

SEQ ID NO: 2511655 - RNA, 14 nt, Chlamydophila pneumoniae AR39
caagcauccuagaa

SEQ ID NO: 2511656 - RNA, 22 nt, Chlamydophila pneumoniae AR39
caagcauccuagaacuugggau

SEQ ID NO: 2511657 - RNA, 16 nt, Chlamydophila pneumoniae AR39
caaguccgugagagga

SEQ ID NO: 2511658 - RNA, 15 nt, Chlamydophila pneumoniae AR39
cagaugauuuuaucu

SEQ ID NO: 2511659 - RNA, 17 nt, Chlamydophila pneumoniae AR39
caucucacaagcauccu

SEQ ID NO: 2511660 - RNA, 15 nt, Chlamydophila pneumoniae AR39
cauuaucacagcaau

SEQ ID NO: 2511661 - RNA, 13 nt, Chlamydophila pneumoniae AR39
cgaauucucagaa

SEQ ID NO: 2511662 - RNA, 14 nt, Chlamydophila pneumoniae AR39
cgacaaaaaugccu

SEQ ID NO: 2511663 - RNA, 13 nt, Chlamydophila pneumoniae AR39
cgauuucccagaa

SEQ ID NO: 2511664 - RNA, 20 nt, Chlamydophila pneumoniae AR39
cggauuuuacucccugaagu

SEQ ID NO: 2511665 - RNA, 21 nt, Chlamydophila pneumoniae AR39
cuacacuguuguaauaaaauc

SEQ ID NO: 2511666 - RNA, 16 nt, Chlamydophila pneumoniae AR39
cuagaacuugggaugc

SEQ ID NO: 2511667 - RNA, 22 nt, Chlamydophila pneumoniae AR39
cucacuguuuuucguaagcuga

SEQ ID NO: 2511668 - RNA, 20 nt, Chlamydophila pneumoniae AR39
cucuagaaaacgcucuccua

SEQ ID NO: 2511669 - RNA, 17 nt, Chlamydophila pneumoniae AR39
cugcagguaagggaugc

SEQ ID NO: 2511670 - RNA, 17 nt, Chlamydophila pneumoniae AR39
cuguuuuucguaagcug

SEQ ID NO: 2511671 - RNA, 22 nt, Chlamydophila pneumoniae AR39
cuucagcauagagagaaggaau

SEQ ID NO: 2511672 - RNA, 16 nt, Chlamydophila pneumoniae AR39
cuuccaauuguaaauc

SEQ ID NO: 2511673 - RNA, 20 nt, Chlamydophila pneumoniae AR39
cuuuccacguacgagaucag

SEQ ID NO: 2511674 - RNA, 21 nt, Chlamydophila pneumoniae AR39
gaaagccuuugcucacuguuu

SEQ ID NO: 2511675 - RNA, 11 nt, Chlamydophila pneumoniae AR39
gacaaaaaugc

SEQ ID NO: 2511676 - RNA, 15 nt, Chlamydophila pneumoniae AR39
gaugcuacuuuccac

SEQ ID NO: 2511677 - RNA, 22 nt, Chlamydophila pneumoniae AR39
gcaacaguaauuauuuucuaca

SEQ ID NO: 2511678 - RNA, 23 nt, Chlamydophila pneumoniae AR39
gcaaucugcagguaagggaugcu

SEQ ID NO: 2511679 - RNA, 22 nt, Chlamydophila pneumoniae AR39
gcauagagagaaggaauuaaaa

SEQ ID NO: 2511680 - RNA, 13 nt, Chlamydophila pneumoniae AR39
gcaucucucucca

SEQ ID NO: 2511681 - RNA, 21 nt, Chlamydophila pneumoniae AR39
guaaaucauuggaaccauagg

SEQ ID NO: 2511682 - RNA, 22 nt, Chlamydophila pneumoniae AR39
guaauuauuuucuacacuguug

SEQ ID NO: 2511683 - RNA, 18 nt, Chlamydophila pneumoniae AR39
uaaaauaucggauuuuac

SEQ ID NO: 2511684 - RNA, 19 nt, Chlamydophila pneumoniae AR39
uacacuguuguaauaaaau

SEQ ID NO: 2511685 - RNA, 15 nt, Chlamydophila pneumoniae AR39
uagaacuugggaugc

SEQ ID NO: 2511686 - RNA, 19 nt, Chlamydophila pneumoniae AR39
uagagagaaggaauuaaaa

SEQ ID NO: 2511687 - RNA, 22 nt, Chlamydophila pneumoniae AR39
uagguccguuuuuucagaugau

SEQ ID NO: 2511688 - RNA, 16 nt, Chlamydophila pneumoniae AR39
uaucugcgacaaaaau

SEQ ID NO: 2511689 - RNA, 15 nt, Chlamydophila pneumoniae AR39
ucacagcaaucugca

SEQ ID NO: 2511690 - RNA, 18 nt, Chlamydophila pneumoniae AR39
ucacuguuuuucguaagc

SEQ ID NO: 2511691 - RNA, 17 nt, Chlamydophila pneumoniae AR39
ucauguccuucaaaaug

SEQ ID NO: 2511692 - RNA, 16 nt, Chlamydophila pneumoniae AR39
uccaauuguaaaucau

SEQ ID NO: 2511693 - RNA, 17 nt, Chlamydophila pneumoniae AR39
uccaauuguaaaucauu

SEQ ID NO: 2511694 - RNA, 15 nt, Chlamydophila pneumoniae AR39
uccguuuuuucagau

SEQ ID NO: 2511695 - RNA, 20 nt, Chlamydophila pneumoniae AR39
uccuucaaaauguuuaucga

SEQ ID NO: 2511696 - RNA, 20 nt, Chlamydophila pneumoniae AR39
ucuacacuguuguaauaaaa

SEQ ID NO: 2511697 - RNA, 16 nt, Chlamydophila pneumoniae AR39
ucucacaagcauccua

SEQ ID NO: 2511698 - RNA, 13 nt, Chlamydophila pneumoniae AR39
ucucagaaagccu

SEQ ID NO: 2511699 - RNA, 21 nt, Chlamydophila pneumoniae AR39
ucucagaaagccuuugcucac

SEQ ID NO: 2511700 - RNA, 20 nt, Chlamydophila pneumoniae AR39
ucugcagguaagggaugcuc

SEQ ID NO: 2511701 - RNA, 21 nt, Chlamydophila pneumoniae AR39
ugaaguacauuaucacagcaa

SEQ ID NO: 2511702 - RNA, 15 nt, Chlamydophila pneumoniae AR39
ugcgacaaaaaugcc

SEQ ID NO: 2511703 - RNA, 17 nt, Chlamydophila pneumoniae AR39
ugcucacuguuuuucgu

SEQ ID NO: 2511704 - RNA, 16 nt, Chlamydophila pneumoniae AR39
uguuguaauaaaauca

SEQ ID NO: 2511705 - RNA, 15 nt, Chlamydophila pneumoniae AR39
uucagaugauuuuau

SEQ ID NO: 2511706 - RNA, 19 nt, Chlamydophila pneumoniae AR39
uucagaugauuuuaucugc

SEQ ID NO: 2511707 - RNA, 14 nt, Chlamydophila pneumoniae AR39
uucgaauucucaga

SEQ ID NO: 2511708 - RNA, 22 nt, Chlamydophila pneumoniae AR39
uucuacacuguuguaauaaaau

SEQ ID NO: 2511709 - RNA, 14 nt, Chlamydophila pneumoniae AR39
uuguaauaaaauca

SEQ ID NO: 2511710 - RNA, 19 nt, Chlamydophila pneumoniae AR39
uuuaucugcgacaaaaaug

SEQ ID NO: 2511711 - RNA, 12 nt, Chlamydophila pneumoniae AR39
uuuuacucccug

SEQ ID NO: 2511712 - RNA, 14 nt, Chlamydophila pneumoniae CWL029
aaaaaaaaucugcu

SEQ ID NO: 2511713 - RNA, 22 nt, Chlamydophila pneumoniae CWL029
aaaaaaagaccaaauaauuaaa

SEQ ID NO: 2511714 - RNA, 18 nt, Chlamydophila pneumoniae CWL029
aaaaaagaccaaauaauu

SEQ ID NO: 2511715 - RNA, 11 nt, Chlamydophila pneumoniae CWL029
aaaaaagagac

SEQ ID NO: 2511716 - RNA, 20 nt, Chlamydophila pneumoniae CWL029
aaaaaauacaggaaucuccu

SEQ ID NO: 2511717 - RNA, 22 nt, Chlamydophila pneumoniae CWL029
aaaaaaucccagauuacaagag

SEQ ID NO: 2511718 - RNA, 19 nt, Chlamydophila pneumoniae CWL029
aaaaaaucucgagaagacc

SEQ ID NO: 2511719 - RNA, 21 nt, Chlamydophila pneumoniae CWL029
aaaaaaucuucuuagccaaaa

SEQ ID NO: 2511720 - RNA, 23 nt, Chlamydophila pneumoniae CWL029
aaaaaaugcuccugcaaaaaacc

SEQ ID NO: 2511721 - RNA, 12 nt, Chlamydophila pneumoniae CWL029
aaaaaauucuaa

SEQ ID NO: 2511722 - RNA, 14 nt, Chlamydophila pneumoniae CWL029
aaaaaauuuuauag

SEQ ID NO: 2511723 - RNA, 13 nt, Chlamydophila pneumoniae CWL029
aaaaacaaaccuc

SEQ ID NO: 2511724 - RNA, 23 nt, Chlamydophila pneumoniae CWL029
aaaaaccccuagaacuuuacaau

SEQ ID NO: 2511725 - RNA, 13 nt, Chlamydophila pneumoniae CWL029
aaaaaccuucucc

SEQ ID NO: 2511726 - RNA, 17 nt, Chlamydophila pneumoniae CWL029
aaaaacgguaaauaucu

SEQ ID NO: 2511727 - RNA, 21 nt, Chlamydophila pneumoniae CWL029
aaaaacugcaaaaagaucguu

SEQ ID NO: 2511728 - RNA, 19 nt, Chlamydophila pneumoniae CWL029
aaaaacugcgcuagcucca

SEQ ID NO: 2511729 - RNA, 16 nt, Chlamydophila pneumoniae CWL029
aaaaacuguguuuucu

SEQ ID NO: 2511730 - RNA, 21 nt, Chlamydophila pneumoniae CWL029
aaaaacuucccaucuuguucu

SEQ ID NO: 2511731 - RNA, 16 nt, Chlamydophila pneumoniae CWL029
aaaaacuucuaacugu

SEQ ID NO: 2511732 - RNA, 12 nt, Chlamydophila pneumoniae CWL029
aaaaagaaaaga

SEQ ID NO: 2511733 - RNA, 17 nt, Chlamydophila pneumoniae CWL029
aaaaagaacauaagaua

SEQ ID NO: 2511734 - RNA, 14 nt, Chlamydophila pneumoniae CWL029
aaaaagaauaaaaa

SEQ ID NO: 2511735 - RNA, 15 nt, Chlamydophila pneumoniae CWL029
aaaaagaauaaaaau

SEQ ID NO: 2511736 - RNA, 18 nt, Chlamydophila pneumoniae CWL029
aaaaagcccauuccugca

SEQ ID NO: 2511737 - RNA, 21 nt, Chlamydophila pneumoniae CWL029
aaaaagcugacacucagcucc

SEQ ID NO: 2511738 - RNA, 18 nt, Chlamydophila pneumoniae CWL029
aaaaaggacucuuucuau

SEQ ID NO: 2511739 - RNA, 18 nt, Chlamydophila pneumoniae CWL029
aaaaagggaucuccuuca

SEQ ID NO: 2511740 - RNA, 13 nt, Chlamydophila pneumoniae CWL029
aaaaaguaacuau

SEQ ID NO: 2511741 - RNA, 18 nt, Chlamydophila pneumoniae CWL029
aaaaaguaguuuuaagaa

SEQ ID NO: 2511742 - RNA, 21 nt, Chlamydophila pneumoniae CWL029
aaaaaguuccauagaguaucu

SEQ ID NO: 2511743 - RNA, 19 nt, Chlamydophila pneumoniae CWL029
aaaaaguugaggaaaggag

SEQ ID NO: 2511744 - RNA, 15 nt, Chlamydophila pneumoniae CWL029
aaaaauagaaauaag

SEQ ID NO: 2511745 - RNA, 14 nt, Chlamydophila pneumoniae CWL029
aaaaauagauaagu

SEQ ID NO: 2511746 - RNA, 12 nt, Chlamydophila pneumoniae CWL029
aaaaauauaucu

SEQ ID NO: 2511747 - RNA, 21 nt, Chlamydophila pneumoniae CWL029
aaaaaucccagauuacaagag

SEQ ID NO: 2511748 - RNA, 17 nt, Chlamydophila pneumoniae CWL029
aaaaaucccuguucuag

SEQ ID NO: 2511749 - RNA, 22 nt, Chlamydophila pneumoniae CWL029
aaaaaucccuguucuagcaaau

SEQ ID NO: 2511750 - RNA, 17 nt, Chlamydophila pneumoniae CWL029
aaaaauccgauaagaua

SEQ ID NO: 2511751 - RNA, 20 nt, Chlamydophila pneumoniae CWL029
aaaaauccugagagauaggu

SEQ ID NO: 2511752 - RNA, 20 nt, Chlamydophila pneumoniae CWL029
aaaaaucuaacacagucccu

SEQ ID NO: 2511753 - RNA, 23 nt, Chlamydophila pneumoniae CWL029
aaaaaucugcuauaaccaacuuc

SEQ ID NO: 2511754 - RNA, 16 nt, Chlamydophila pneumoniae CWL029
aaaaauguaauuuuuu

SEQ ID NO: 2511755 - RNA, 15 nt, Chlamydophila pneumoniae CWL029
aaaaauuaagaaccc

SEQ ID NO: 2511756 - RNA, 22 nt, Chlamydophila pneumoniae CWL029
aaaaauucuagaccugccaaga

SEQ ID NO: 2511757 - RNA, 14 nt, Chlamydophila pneumoniae CWL029
aaaaauuuaaaaga

SEQ ID NO: 2511758 - RNA, 19 nt, Chlamydophila pneumoniae CWL029
aaaaauuuaaaagauuccu

SEQ ID NO: 2511759 - RNA, 23 nt, Chlamydophila pneumoniae CWL029
aaaaauuugcgaaguccuggauu

SEQ ID NO: 2511760 - RNA, 17 nt, Chlamydophila pneumoniae CWL029
aaaacaacauucguuag

SEQ ID NO: 2511761 - RNA, 11 nt, Chlamydophila pneumoniae CWL029
aaaacaagaag

SEQ ID NO: 2511762 - RNA, 15 nt, Chlamydophila pneumoniae CWL029
aaaacaaggcaaaaa

SEQ ID NO: 2511763 - RNA, 14 nt, Chlamydophila pneumoniae CWL029
aaaacaaucuaaag

SEQ ID NO: 2511764 - RNA, 13 nt, Chlamydophila pneumoniae CWL029
aaaacaauuuccu

SEQ ID NO: 2511765 - RNA, 17 nt, Chlamydophila pneumoniae CWL029
aaaacaccugcccauuu

SEQ ID NO: 2511766 - RNA, 18 nt, Chlamydophila pneumoniae CWL029
aaaacacugcgcaaagaa

SEQ ID NO: 2511767 - RNA, 20 nt, Chlamydophila pneumoniae CWL029
aaaacagauaagacaauaaa

SEQ ID NO: 2511768 - RNA, 13 nt, Chlamydophila pneumoniae CWL029
aaaacauauccca

SEQ ID NO: 2511769 - RNA, 15 nt, Chlamydophila pneumoniae CWL029
aaaacauaucccaua

SEQ ID NO: 2511770 - RNA, 13 nt, Chlamydophila pneumoniae CWL029
aaaacaucuguau

SEQ ID NO: 2511771 - RNA, 13 nt, Chlamydophila pneumoniae CWL029
aaaaccacagaau

SEQ ID NO: 2511772 - RNA, 20 nt, Chlamydophila pneumoniae CWL029
aaaaccacagaaugauaaga

SEQ ID NO: 2511773 - RNA, 22 nt, Chlamydophila pneumoniae CWL029
aaaacccauguuucuuccugaa

SEQ ID NO: 2511774 - RNA, 16 nt, Chlamydophila pneumoniae CWL029
aaaacccucaaagaau

SEQ ID NO: 2511775 - RNA, 17 nt, Chlamydophila pneumoniae CWL029
aaaacgagcaggguaau

SEQ ID NO: 2511776 - RNA, 22 nt, Chlamydophila pneumoniae CWL029
aaaacggcuguacuuccccaaa

SEQ ID NO: 2511777 - RNA, 15 nt, Chlamydophila pneumoniae CWL029
aaaacgguaaauauc

SEQ ID NO: 2511778 - RNA, 20 nt, Chlamydophila pneumoniae CWL029
aaaacgguaaauaucuuaac

SEQ ID NO: 2511779 - RNA, 15 nt, Chlamydophila pneumoniae CWL029
aaaacuacauucuaa

SEQ ID NO: 2511780 - RNA, 13 nt, Chlamydophila pneumoniae CWL029
aaaacuauaaaag

SEQ ID NO: 2511781 - RNA, 21 nt, Chlamydophila pneumoniae CWL029
aaaacucaaggaguuuuaacu

SEQ ID NO: 2511782 - RNA, 21 nt, Chlamydophila pneumoniae CWL029
aaaacuccgcacuugcucuuu

SEQ ID NO: 2511783 - RNA, 20 nt, Chlamydophila pneumoniae CWL029
aaaacugcgcuaucaucauu

SEQ ID NO: 2511784 - RNA, 19 nt, Chlamydophila pneumoniae CWL029
aaaacuguguucaauagca

SEQ ID NO: 2511785 - RNA, 22 nt, Chlamydophila pneumoniae CWL029
aaaacuucccaucuuguucuaa

SEQ ID NO: 2511786 - RNA, 23 nt, Chlamydophila pneumoniae CWL029
aaaacuucuugugauccuugcaa

SEQ ID NO: 2511787 - RNA, 12 nt, Chlamydophila pneumoniae CWL029
aaaagaaaagac

SEQ ID NO: 2511788 - RNA, 20 nt, Chlamydophila pneumoniae CWL029
aaaagaaagaagccuuccuu

SEQ ID NO: 2511789 - RNA, 12 nt, Chlamydophila pneumoniae CWL029
aaaagaaagaau

SEQ ID NO: 2511790 - RNA, 20 nt, Chlamydophila pneumoniae CWL029
aaaagaaagaauaucuuuug

SEQ ID NO: 2511791 - RNA, 16 nt, Chlamydophila pneumoniae CWL029
aaaagaaaucaaacau

SEQ ID NO: 2511792 - RNA, 21 nt, Chlamydophila pneumoniae CWL029
aaaagaacauuaagaggaaag

SEQ ID NO: 2511793 - RNA, 23 nt, Chlamydophila pneumoniae CWL029
aaaagaaccuaggaaauccuccu

SEQ ID NO: 2511794 - RNA, 13 nt, Chlamydophila pneumoniae CWL029
aaaagaauaaaaa

SEQ ID NO: 2511795 - RNA, 14 nt, Chlamydophila pneumoniae CWL029
aaaagaaucucuga

SEQ ID NO: 2511796 - RNA, 13 nt, Chlamydophila pneumoniae CWL029
aaaagacaagaga

SEQ ID NO: 2511797 - RNA, 14 nt, Chlamydophila pneumoniae CWL029
aaaagacaagagaa

SEQ ID NO: 2511798 - RNA, 13 nt, Chlamydophila pneumoniae CWL029
aaaagaccaaaaa

SEQ ID NO: 2511799 - RNA, 13 nt, Chlamydophila pneumoniae CWL029
aaaagaccgccuu

SEQ ID NO: 2511800 - RNA, 15 nt, Chlamydophila pneumoniae CWL029
aaaagagcucaaaaa

SEQ ID NO: 2511801 - RNA, 22 nt, Chlamydophila pneumoniae CWL029
aaaagaucggaguuaucaaaag

SEQ ID NO: 2511802 - RNA, 13 nt, Chlamydophila pneumoniae CWL029
aaaagaucuaagu

SEQ ID NO: 2511803 - RNA, 13 nt, Chlamydophila pneumoniae CWL029
aaaagauucuaaa

SEQ ID NO: 2511804 - RNA, 16 nt, Chlamydophila pneumoniae CWL029
aaaagauucuaaauca

SEQ ID NO: 2511805 - RNA, 22 nt, Chlamydophila pneumoniae CWL029
aaaagauuugcgaaucuaagau

SEQ ID NO: 2511806 - RNA, 15 nt, Chlamydophila pneumoniae CWL029
aaaagcacuuaaaaa

SEQ ID NO: 2511807 - RNA, 21 nt, Chlamydophila pneumoniae CWL029
aaaagcacuuaaaaaacuucc

SEQ ID NO: 2511808 - RNA, 15 nt, Chlamydophila pneumoniae CWL029
aaaagcagacgaaua

SEQ ID NO: 2511809 - RNA, 23 nt, Chlamydophila pneumoniae CWL029
aaaagcauagucgucuuuuaaag

SEQ ID NO: 2511810 - RNA, 20 nt, Chlamydophila pneumoniae CWL029
aaaagcuuaucccauaaaug

SEQ ID NO: 2511811 - RNA, 14 nt, Chlamydophila pneumoniae CWL029
aaaagcuucuuucu

SEQ ID NO: 2511812 - RNA, 16 nt, Chlamydophila pneumoniae CWL029
aaaagcuucuuucuua

SEQ ID NO: 2511813 - RNA, 18 nt, Chlamydophila pneumoniae CWL029
aaaagcuucuuucuuacu

SEQ ID NO: 2511814 - RNA, 22 nt, Chlamydophila pneumoniae CWL029
aaaagcuucuuucuuacuaaag

SEQ ID NO: 2511815 - RNA, 18 nt, Chlamydophila pneumoniae CWL029
aaaagcuuuuuucucuug

SEQ ID NO: 2511816 - RNA, 13 nt, Chlamydophila pneumoniae CWL029
aaaaggaggagga

SEQ ID NO: 2511817 - RNA, 17 nt, Chlamydophila pneumoniae CWL029
aaaaggauucuaugagg

SEQ ID NO: 2511818 - RNA, 12 nt, Chlamydophila pneumoniae CWL029
aaaagggaagcu

SEQ ID NO: 2511819 - RNA, 15 nt, Chlamydophila pneumoniae CWL029
aaaagguuuugaagc

SEQ ID NO: 2511820 - RNA, 23 nt, Chlamydophila pneumoniae CWL029
aaaaguacgaccaacuccucaaa

SEQ ID NO: 2511821 - RNA, 17 nt, Chlamydophila pneumoniae CWL029
aaaagucaugaggacug

SEQ ID NO: 2511822 - RNA, 14 nt, Chlamydophila pneumoniae CWL029
aaaagucucuaggg

SEQ ID NO: 2511823 - RNA, 21 nt, Chlamydophila pneumoniae CWL029
aaaagucucuagggaaaggag

SEQ ID NO: 2511824 - RNA, 22 nt, Chlamydophila pneumoniae CWL029
aaaagucucuagggaaaggagc

SEQ ID NO: 2511825 - RNA, 22 nt, Chlamydophila pneumoniae CWL029
aaaaguuccccaauuucuuuuu

SEQ ID NO: 2511826 - RNA, 14 nt, Chlamydophila pneumoniae CWL029
aaaaguugaggaaa

SEQ ID NO: 2511827 - RNA, 22 nt, Chlamydophila pneumoniae CWL029
aaaaguugccuaaagagauaua

SEQ ID NO: 2511828 - RNA, 22 nt, Chlamydophila pneumoniae CWL029
aaaaguuuuuguucauccagaa

SEQ ID NO: 2511829 - RNA, 13 nt, Chlamydophila pneumoniae CWL029
aaaauaaaaggag

SEQ ID NO: 2511830 - RNA, 14 nt, Chlamydophila pneumoniae CWL029
aaaauaaaaggagc

SEQ ID NO: 2511831 - RNA, 12 nt, Chlamydophila pneumoniae CWL029
aaaauaaacucu

SEQ ID NO: 2511832 - RNA, 17 nt, Chlamydophila pneumoniae CWL029
aaaauaaagaucuucau

SEQ ID NO: 2511833 - RNA, 14 nt, Chlamydophila pneumoniae CWL029
aaaauaaauuuuau

SEQ ID NO: 2511834 - RNA, 22 nt, Chlamydophila pneumoniae CWL029
aaaauaaccccuccaaaaucau

SEQ ID NO: 2511835 - RNA, 18 nt, Chlamydophila pneumoniae CWL029
aaaauaauuuuauuaguu

SEQ ID NO: 2511836 - RNA, 23 nt, Chlamydophila pneumoniae CWL029
aaaauacauagguaaaaccagca

SEQ ID NO: 2511837 - RNA, 13 nt, Chlamydophila pneumoniae CWL029
aaaauagauccug

SEQ ID NO: 2511838 - RNA, 16 nt, Chlamydophila pneumoniae CWL029
aaaauaucaccuacau

SEQ ID NO: 2511839 - RNA, 20 nt, Chlamydophila pneumoniae CWL029
aaaauaucauucacuauugu

SEQ ID NO: 2511840 - RNA, 20 nt, Chlamydophila pneumoniae CWL029
aaaauauuaaauucaaaauc

SEQ ID NO: 2511841 - RNA, 15 nt, Chlamydophila pneumoniae CWL029
aaaauauucuuucaa

SEQ ID NO: 2511842 - RNA, 14 nt, Chlamydophila pneumoniae CWL029
aaaaucaaauagau

SEQ ID NO: 2511843 - RNA, 17 nt, Chlamydophila pneumoniae CWL029
aaaaucaagaagagaaa

SEQ ID NO: 2511844 - RNA, 22 nt, Chlamydophila pneumoniae CWL029
aaaaucaagaagagaaaagaua

SEQ ID NO: 2511845 - RNA, 18 nt, Chlamydophila pneumoniae CWL029
aaaaucaagccacagaga

SEQ ID NO: 2511846 - RNA, 10 nt, Chlamydophila pneumoniae CWL029
aaaaucacau

SEQ ID NO: 2511847 - RNA, 16 nt, Chlamydophila pneumoniae CWL029
aaaaucauucaaauau

SEQ ID NO: 2511848 - RNA, 21 nt, Chlamydophila pneumoniae CWL029
aaaaucguuuuauuuuaggag

SEQ ID NO: 2511849 - RNA, 20 nt, Chlamydophila pneumoniae CWL029
aaaaucuacauguaaagcaa

SEQ ID NO: 2511850 - RNA, 14 nt, Chlamydophila pneumoniae CWL029
aaaaucuccucucu

SEQ ID NO: 2511851 - RNA, 21 nt, Chlamydophila pneumoniae CWL029
aaaaucuccucucucaauaag

SEQ ID NO: 2511852 - RNA, 16 nt, Chlamydophila pneumoniae CWL029
aaaaucugcagcagau

SEQ ID NO: 2511853 - RNA, 19 nt, Chlamydophila pneumoniae CWL029
aaaaucugcuauaaccaac

SEQ ID NO: 2511854 - RNA, 20 nt, Chlamydophila pneumoniae CWL029
aaaaucugcuauaaccaacu

SEQ ID NO: 2511855 - RNA, 23 nt, Chlamydophila pneumoniae CWL029
aaaaucugcucucugaagcuaaa

SEQ ID NO: 2511856 - RNA, 17 nt, Chlamydophila pneumoniae CWL029
aaaaucuucuggaggga

SEQ ID NO: 2511857 - RNA, 22 nt, Chlamydophila pneumoniae CWL029
aaaaucuucuuagccaaaauuu

SEQ ID NO: 2511858 - RNA, 14 nt, Chlamydophila pneumoniae CWL029
aaaaugaaagaaac

SEQ ID NO: 2511859 - RNA, 11 nt, Chlamydophila pneumoniae CWL029
aaaaugaccgc

SEQ ID NO: 2511860 - RNA, 17 nt, Chlamydophila pneumoniae CWL029
aaaaugaggacacaacu

SEQ ID NO: 2511861 - RNA, 14 nt, Chlamydophila pneumoniae CWL029
aaaaugauucauaa

SEQ ID NO: 2511862 - RNA, 18 nt, Chlamydophila pneumoniae CWL029
aaaaugcacuuugaauaa

SEQ ID NO: 2511863 - RNA, 17 nt, Chlamydophila pneumoniae CWL029
aaaaugcccguccccuc

SEQ ID NO: 2511864 - RNA, 20 nt, Chlamydophila pneumoniae CWL029
aaaaugcgaggaaaaaggag

SEQ ID NO: 2511865 - RNA, 21 nt, Chlamydophila pneumoniae CWL029
aaaaugcgcacggauucuaaa

SEQ ID NO: 2511866 - RNA, 23 nt, Chlamydophila pneumoniae CWL029
aaaaugcuccugcaaaaaaccag

SEQ ID NO: 2511867 - RNA, 14 nt, Chlamydophila pneumoniae CWL029
aaaauguaaaaaau

SEQ ID NO: 2511868 - RNA, 16 nt, Chlamydophila pneumoniae CWL029
aaaauguaaaaaauua

SEQ ID NO: 2511869 - RNA, 19 nt, Chlamydophila pneumoniae CWL029
aaaauuaaagugaaagcaa

SEQ ID NO: 2511870 - RNA, 20 nt, Chlamydophila pneumoniae CWL029
aaaauuauguauaaacucca

SEQ ID NO: 2511871 - RNA, 14 nt, Chlamydophila pneumoniae CWL029
aaaauuauuaaacu

SEQ ID NO: 2511872 - RNA, 20 nt, Chlamydophila pneumoniae CWL029
aaaauucaaaucccugaugc

SEQ ID NO: 2511873 - RNA, 19 nt, Chlamydophila pneumoniae CWL029
aaaauucccauagcaugag

SEQ ID NO: 2511874 - RNA, 23 nt, Chlamydophila pneumoniae CWL029
aaaauucgguaguggugaacuaa

SEQ ID NO: 2511875 - RNA, 20 nt, Chlamydophila pneumoniae CWL029
aaaauucucagauugcuuga

SEQ ID NO: 2511876 - RNA, 18 nt, Chlamydophila pneumoniae CWL029
aaaauucuucgagagcau

SEQ ID NO: 2511877 - RNA, 13 nt, Chlamydophila pneumoniae CWL029
aaaauugaaaucu

SEQ ID NO: 2511878 - RNA, 14 nt, Chlamydophila pneumoniae CWL029
aaaauugaaaucuu

SEQ ID NO: 2511879 - RNA, 22 nt, Chlamydophila pneumoniae CWL029
aaaauugaaaucuuuagaauua

SEQ ID NO: 2511880 - RNA, 22 nt, Chlamydophila pneumoniae CWL029
aaaauugauaguguucgagcau

SEQ ID NO: 2511881 - RNA, 22 nt, Chlamydophila pneumoniae CWL029
aaaauugcccauugaccugcuu

SEQ ID NO: 2511882 - RNA, 22 nt, Chlamydophila pneumoniae CWL029
aaaauuguuuguaucaaagaaa

SEQ ID NO: 2511883 - RNA, 14 nt, Chlamydophila pneumoniae CWL029
aaaauuuaaaaaaa

SEQ ID NO: 2511884 - RNA, 11 nt, Chlamydophila pneumoniae CWL029
aaaauuuaaau

SEQ ID NO: 2511885 - RNA, 16 nt, Chlamydophila pneumoniae CWL029
aaaauuuaaauauaga

SEQ ID NO: 2511886 - RNA, 17 nt, Chlamydophila pneumoniae CWL029
aaaauuuaaauauagaa

SEQ ID NO: 2511887 - RNA, 15 nt, Chlamydophila pneumoniae CWL029
aaaauuucuuauaaa

SEQ ID NO: 2511888 - RNA, 17 nt, Chlamydophila pneumoniae CWL029
aaaauuucuuauaaaaa

SEQ ID NO: 2511889 - RNA, 12 nt, Chlamydophila pneumoniae CWL029
aaaauuuuccca

SEQ ID NO: 2511890 - RNA, 11 nt, Chlamydophila pneumoniae CWL029
aaacaaaagca

SEQ ID NO: 2511891 - RNA, 23 nt, Chlamydophila pneumoniae CWL029
aaacaacgaucgucaguaaaaca

SEQ ID NO: 2511892 - RNA, 18 nt, Chlamydophila pneumoniae CWL029
aaacaacugaaaaaccau

SEQ ID NO: 2511893 - RNA, 16 nt, Chlamydophila pneumoniae CWL029
aaacaacuugguaagc

SEQ ID NO: 2511894 - RNA, 15 nt, Chlamydophila pneumoniae CWL029
aaacaagaagaucaa

SEQ ID NO: 2511895 - RNA, 19 nt, Chlamydophila pneumoniae CWL029
aaacaagaagaucaaagau

SEQ ID NO: 2511896 - RNA, 17 nt, Chlamydophila pneumoniae CWL029
aaacaaucuaaagguuu

SEQ ID NO: 2511897 - RNA, 18 nt, Chlamydophila pneumoniae CWL029
aaacaaucuaaagguuuu

SEQ ID NO: 2511898 - RNA, 22 nt, Chlamydophila pneumoniae CWL029
aaacaauuuccugcauggcuuu

SEQ ID NO: 2511899 - RNA, 11 nt, Chlamydophila pneumoniae CWL029
aaacacaaaua

SEQ ID NO: 2511900 - RNA, 17 nt, Chlamydophila pneumoniae CWL029
aaacacaaauagcaaga

SEQ ID NO: 2511901 - RNA, 19 nt, Chlamydophila pneumoniae CWL029
aaacacaaauagcaagagc

SEQ ID NO: 2511902 - RNA, 19 nt, Chlamydophila pneumoniae CWL029
aaacacugcgcaaagaacu

SEQ ID NO: 2511903 - RNA, 18 nt, Chlamydophila pneumoniae CWL029
aaacagauuuuucaagaa

SEQ ID NO: 2511904 - RNA, 15 nt, Chlamydophila pneumoniae CWL029
aaacagcaucaggau

SEQ ID NO: 2511905 - RNA, 23 nt, Chlamydophila pneumoniae CWL029
aaacagcaucaggauucucucug

SEQ ID NO: 2511906 - RNA, 13 nt, Chlamydophila pneumoniae CWL029
aaacaggaauagg

SEQ ID NO: 2511907 - RNA, 16 nt, Chlamydophila pneumoniae CWL029
aaacaggaauaggcuc

SEQ ID NO: 2511908 - RNA, 19 nt, Chlamydophila pneumoniae CWL029
aaacaguaggcgaugcaaa

SEQ ID NO: 2511909 - RNA, 16 nt, Chlamydophila pneumoniae CWL029
aaacauagagauucua

SEQ ID NO: 2511910 - RNA, 18 nt, Chlamydophila pneumoniae CWL029
aaacauagagauucuaca

SEQ ID NO: 2511911 - RNA, 15 nt, Chlamydophila pneumoniae CWL029
aaacaucacucagga

SEQ ID NO: 2511912 - RNA, 19 nt, Chlamydophila pneumoniae CWL029
aaacauuaccguucccuaa

SEQ ID NO: 2511913 - RNA, 15 nt, Chlamydophila pneumoniae CWL029
aaacauuagucaaug

SEQ ID NO: 2511914 - RNA, 13 nt, Chlamydophila pneumoniae CWL029
aaacauuuaaguc

SEQ ID NO: 2511915 - RNA, 16 nt, Chlamydophila pneumoniae CWL029
aaaccaauugagcucu

SEQ ID NO: 2511916 - RNA, 20 nt, Chlamydophila pneumoniae CWL029
aaaccacagaaugauaagaa

SEQ ID NO: 2511917 - RNA, 13 nt, Chlamydophila pneumoniae CWL029
aaaccaggaacaa

SEQ ID NO: 2511918 - RNA, 16 nt, Chlamydophila pneumoniae CWL029
aaaccaggaacaaagg

SEQ ID NO: 2511919 - RNA, 17 nt, Chlamydophila pneumoniae CWL029
aaaccauaagaaugguu

SEQ ID NO: 2511920 - RNA, 17 nt, Chlamydophila pneumoniae CWL029
aaaccaucacuuccugu

SEQ ID NO: 2511921 - RNA, 18 nt, Chlamydophila pneumoniae CWL029
aaacccaauucuuaaaaa

SEQ ID NO: 2511922 - RNA, 14 nt, Chlamydophila pneumoniae CWL029
aaacccauguuucu

SEQ ID NO: 2511923 - RNA, 19 nt, Chlamydophila pneumoniae CWL029
aaacccucuccagaagucg

SEQ ID NO: 2511924 - RNA, 16 nt, Chlamydophila pneumoniae CWL029
aaaccguaacugaggc

SEQ ID NO: 2511925 - RNA, 17 nt, Chlamydophila pneumoniae CWL029
aaaccuucaaugauuuc

SEQ ID NO: 2511926 - RNA, 17 nt, Chlamydophila pneumoniae CWL029
aaaccuucagauccgau

SEQ ID NO: 2511927 - RNA, 14 nt, Chlamydophila pneumoniae CWL029
aaaccuucucucuu

SEQ ID NO: 2511928 - RNA, 20 nt, Chlamydophila pneumoniae CWL029
aaaccuuuuuuuaaaaauau

SEQ ID NO: 2511929 - RNA, 14 nt, Chlamydophila pneumoniae CWL029
aaacgaaagcagug

SEQ ID NO: 2511930 - RNA, 16 nt, Chlamydophila pneumoniae CWL029
aaacgaaagcagugug

SEQ ID NO: 2511931 - RNA, 12 nt, Chlamydophila pneumoniae CWL029
aaacgaauacug

SEQ ID NO: 2511932 - RNA, 16 nt, Chlamydophila pneumoniae CWL029
aaacgaauuucuuguu

SEQ ID NO: 2511933 - RNA, 19 nt, Chlamydophila pneumoniae CWL029
aaacgagacugcaaaggaa

SEQ ID NO: 2511934 - RNA, 17 nt, Chlamydophila pneumoniae CWL029
aaacgaucccuacacug

SEQ ID NO: 2511935 - RNA, 22 nt, Chlamydophila pneumoniae CWL029
aaacgaugagcacauucaagau

SEQ ID NO: 2511936 - RNA, 19 nt, Chlamydophila pneumoniae CWL029
aaacgcaaugauuucucua

SEQ ID NO: 2511937 - RNA, 21 nt, Chlamydophila pneumoniae CWL029
aaacgcccucuagaagacaca

SEQ ID NO: 2511938 - RNA, 23 nt, Chlamydophila pneumoniae CWL029
aaacgcuccguauacugcugcua

SEQ ID NO: 2511939 - RNA, 13 nt, Chlamydophila pneumoniae CWL029
aaacgcucuccua

SEQ ID NO: 2511940 - RNA, 17 nt, Chlamydophila pneumoniae CWL029
aaacggcauuugccccu

SEQ ID NO: 2511941 - RNA, 17 nt, Chlamydophila pneumoniae CWL029
aaacuaaaucaacuaca

SEQ ID NO: 2511942 - RNA, 14 nt, Chlamydophila pneumoniae CWL029
aaacuacauucuaa

SEQ ID NO: 2511943 - RNA, 20 nt, Chlamydophila pneumoniae CWL029
aaacuagauuucuacaaaca

SEQ ID NO: 2511944 - RNA, 20 nt, Chlamydophila pneumoniae CWL029
aaacuccaaguguugccagc

SEQ ID NO: 2511945 - RNA, 14 nt, Chlamydophila pneumoniae CWL029
aaacuccauuguug

SEQ ID NO: 2511946 - RNA, 18 nt, Chlamydophila pneumoniae CWL029
aaacuccccaguuuucca

SEQ ID NO: 2511947 - RNA, 21 nt, Chlamydophila pneumoniae CWL029
aaacuccgcacuugcucuuua

SEQ ID NO: 2511948 - RNA, 18 nt, Chlamydophila pneumoniae CWL029
aaacuccuaggggaauua

SEQ ID NO: 2511949 - RNA, 15 nt, Chlamydophila pneumoniae CWL029
aaacuccuuuuaaaa

SEQ ID NO: 2511950 - RNA, 16 nt, Chlamydophila pneumoniae CWL029
aaacuccuuuuaaaau

SEQ ID NO: 2511951 - RNA, 18 nt, Chlamydophila pneumoniae CWL029
aaacucucuuccuucucc

SEQ ID NO: 2511952 - RNA, 13 nt, Chlamydophila pneumoniae CWL029
aaacugaugccaa

SEQ ID NO: 2511953 - RNA, 15 nt, Chlamydophila pneumoniae CWL029
aaacugcaaaaagau

SEQ ID NO: 2511954 - RNA, 17 nt, Chlamydophila pneumoniae CWL029
aaacuggcggauugcuu

SEQ ID NO: 2511955 - RNA, 20 nt, Chlamydophila pneumoniae CWL029
aaacuggcggauugcuuugc

SEQ ID NO: 2511956 - RNA, 14 nt, Chlamydophila pneumoniae CWL029
aaacugucauccuu

SEQ ID NO: 2511957 - RNA, 14 nt, Chlamydophila pneumoniae CWL029
aaacuuacagccac

SEQ ID NO: 2511958 - RNA, 15 nt, Chlamydophila pneumoniae CWL029
aaacuuaguuuugaa

SEQ ID NO: 2511959 - RNA, 13 nt, Chlamydophila pneumoniae CWL029
aaacuucaaaagu

SEQ ID NO: 2511960 - RNA, 22 nt, Chlamydophila pneumoniae CWL029
aaacuuccuaacuaucucuguu

SEQ ID NO: 2511961 - RNA, 20 nt, Chlamydophila pneumoniae CWL029
aaacuucgauuggaagcaaa

SEQ ID NO: 2511962 - RNA, 23 nt, Chlamydophila pneumoniae CWL029
aaacuucuagacaacaaauugau

SEQ ID NO: 2511963 - RNA, 13 nt, Chlamydophila pneumoniae CWL029
aaacuucucagau

SEQ ID NO: 2511964 - RNA, 12 nt, Chlamydophila pneumoniae CWL029
aaacuucuugug

SEQ ID NO: 2511965 - RNA, 12 nt, Chlamydophila pneumoniae CWL029
aaacuuucuucu

SEQ ID NO: 2511966 - RNA, 13 nt, Chlamydophila pneumoniae CWL029
aaacuuucuucuc

SEQ ID NO: 2511967 - RNA, 19 nt, Chlamydophila pneumoniae CWL029
aaacuuuuuuucaaaucau

SEQ ID NO: 2511968 - RNA, 22 nt, Chlamydophila pneumoniae CWL029
aaacuuuuuuucaaaucaucaa

SEQ ID NO: 2511969 - RNA, 16 nt, Chlamydophila pneumoniae CWL029
aaacuuuuuuucuucu

SEQ ID NO: 2511970 - RNA, 17 nt, Chlamydophila pneumoniae CWL029
aaacuuuuuuucuucuc

SEQ ID NO: 2511971 - RNA, 13 nt, Chlamydophila pneumoniae CWL029
aaagaaagaagcc

SEQ ID NO: 2511972 - RNA, 13 nt, Chlamydophila pneumoniae CWL029
aaagaaagaauau

SEQ ID NO: 2511973 - RNA, 19 nt, Chlamydophila pneumoniae CWL029
aaagaaagugaaaccauuu

SEQ ID NO: 2511974 - RNA, 15 nt, Chlamydophila pneumoniae CWL029
aaagaaauauuaacc

SEQ ID NO: 2511975 - RNA, 23 nt, Chlamydophila pneumoniae CWL029
aaagaaauauuaacccaccagaa

SEQ ID NO: 2511976 - RNA, 12 nt, Chlamydophila pneumoniae CWL029
aaagaaauguaa

SEQ ID NO: 2511977 - RNA, 16 nt, Chlamydophila pneumoniae CWL029
aaagaaauguaagaag

SEQ ID NO: 2511978 - RNA, 21 nt, Chlamydophila pneumoniae CWL029
aaagaaauucuggagucgagc

SEQ ID NO: 2511979 - RNA, 12 nt, Chlamydophila pneumoniae CWL029
aaagaacacucc

SEQ ID NO: 2511980 - RNA, 12 nt, Chlamydophila pneumoniae CWL029
aaagaacagcac

SEQ ID NO: 2511981 - RNA, 24 nt, Chlamydophila pneumoniae CWL029
aaagaacagcacucucugcaggga

SEQ ID NO: 2511982 - RNA, 16 nt, Chlamydophila pneumoniae CWL029
aaagaagacacuguug

SEQ ID NO: 2511983 - RNA, 22 nt, Chlamydophila pneumoniae CWL029
aaagaagacgcucuuagccuag

SEQ ID NO: 2511984 - RNA, 12 nt, Chlamydophila pneumoniae CWL029
aaagaagauuca

SEQ ID NO: 2511985 - RNA, 23 nt, Chlamydophila pneumoniae CWL029
aaagaaguuuacaaauaaaauga

SEQ ID NO: 2511986 - RNA, 21 nt, Chlamydophila pneumoniae CWL029
aaagaauagccgacaugcuuu

SEQ ID NO: 2511987 - RNA, 17 nt, Chlamydophila pneumoniae CWL029
aaagaaugacacagaga

SEQ ID NO: 2511988 - RNA, 18 nt, Chlamydophila pneumoniae CWL029
aaagaaugacacagagaa

SEQ ID NO: 2511989 - RNA, 19 nt, Chlamydophila pneumoniae CWL029
aaagaauucagagaaagcc

SEQ ID NO: 2511990 - RNA, 21 nt, Chlamydophila pneumoniae CWL029
aaagaauuguaguucuuugaa

SEQ ID NO: 2511991 - RNA, 15 nt, Chlamydophila pneumoniae CWL029
aaagacaaaaaaucu

SEQ ID NO: 2511992 - RNA, 15 nt, Chlamydophila pneumoniae CWL029
aaagacaucucuuua

SEQ ID NO: 2511993 - RNA, 22 nt, Chlamydophila pneumoniae CWL029
aaagacaucucuuuaacuucua

SEQ ID NO: 2511994 - RNA, 16 nt, Chlamydophila pneumoniae CWL029
aaagaccaaaaauaaa

SEQ ID NO: 2511995 - RNA, 23 nt, Chlamydophila pneumoniae CWL029
aaagacuagcuuuuuuuaugauu

SEQ ID NO: 2511996 - RNA, 22 nt, Chlamydophila pneumoniae CWL029
aaagacucaugaaauaguguuu

SEQ ID NO: 2511997 - RNA, 14 nt, Chlamydophila pneumoniae CWL029
aaagacucucuucc

SEQ ID NO: 2511998 - RNA, 13 nt, Chlamydophila pneumoniae CWL029
aaagacucuugaa

SEQ ID NO: 2511999 - RNA, 14 nt, Chlamydophila pneumoniae CWL029
aaagacugaaaaga

SEQ ID NO: 2512000 - RNA, 19 nt, Chlamydophila pneumoniae CWL029
aaagacuucuuuauuauag

SEQ ID NO: 2512001 - RNA, 18 nt, Chlamydophila pneumoniae CWL029
aaagagacuguagccuuu

SEQ ID NO: 2512002 - RNA, 17 nt, Chlamydophila pneumoniae CWL029
aaagagcccaaaaacac

SEQ ID NO: 2512003 - RNA, 14 nt, Chlamydophila pneumoniae CWL029
aaagagcucaaaaa

SEQ ID NO: 2512004 - RNA, 16 nt, Chlamydophila pneumoniae CWL029
aaagagcucaaaaagu

SEQ ID NO: 2512005 - RNA, 20 nt, Chlamydophila pneumoniae CWL029
aaagagcucaaaaaguucca

SEQ ID NO: 2512006 - RNA, 23 nt, Chlamydophila pneumoniae CWL029
aaagagcuuugauucacguauag

SEQ ID NO: 2512007 - RNA, 20 nt, Chlamydophila pneumoniae CWL029
aaagaggaagaugauauucu

SEQ ID NO: 2512008 - RNA, 18 nt, Chlamydophila pneumoniae CWL029
aaagaguccuuuuuguuc

SEQ ID NO: 2512009 - RNA, 17 nt, Chlamydophila pneumoniae CWL029
aaagagucucacucuuu

SEQ ID NO: 2512010 - RNA, 24 nt, Chlamydophila pneumoniae CWL029
aaagagucucacucuuuucuagaa

SEQ ID NO: 2512011 - RNA, 17 nt, Chlamydophila pneumoniae CWL029
aaagagugccaagagca

SEQ ID NO: 2512012 - RNA, 21 nt, Chlamydophila pneumoniae CWL029
aaagaguuuguucacauuuuc

SEQ ID NO: 2512013 - RNA, 13 nt, Chlamydophila pneumoniae CWL029
aaagauaaagaag

SEQ ID NO: 2512014 - RNA, 16 nt, Chlamydophila pneumoniae CWL029
aaagauaaagaaguuu

SEQ ID NO: 2512015 - RNA, 22 nt, Chlamydophila pneumoniae CWL029
aaagauaaucuguaagaaaaug

SEQ ID NO: 2512016 - RNA, 21 nt, Chlamydophila pneumoniae CWL029
aaagauagcgacgucaucaua

SEQ ID NO: 2512017 - RNA, 16 nt, Chlamydophila pneumoniae CWL029
aaagauaguuauuaau

SEQ ID NO: 2512018 - RNA, 21 nt, Chlamydophila pneumoniae CWL029
aaagauaguuauuaauaaauu

SEQ ID NO: 2512019 - RNA, 20 nt, Chlamydophila pneumoniae CWL029
aaagauauagauucaugaaa

SEQ ID NO: 2512020 - RNA, 20 nt, Chlamydophila pneumoniae CWL029
aaagaucggaguuaucaaaa

SEQ ID NO: 2512021 - RNA, 18 nt, Chlamydophila pneumoniae CWL029
aaagaucgugaucaaaga

SEQ ID NO: 2512022 - RNA, 21 nt, Chlamydophila pneumoniae CWL029
aaagaucgugaucaaagaaca

SEQ ID NO: 2512023 - RNA, 19 nt, Chlamydophila pneumoniae CWL029
aaagaucguuagagaccca

SEQ ID NO: 2512024 - RNA, 12 nt, Chlamydophila pneumoniae CWL029
aaagaucugaau

SEQ ID NO: 2512025 - RNA, 11 nt, Chlamydophila pneumoniae CWL029
aaagauuaagg

SEQ ID NO: 2512026 - RNA, 17 nt, Chlamydophila pneumoniae CWL029
aaagauuauucuagagu

SEQ ID NO: 2512027 - RNA, 12 nt, Chlamydophila pneumoniae CWL029
aaagauuccuaa

SEQ ID NO: 2512028 - RNA, 13 nt, Chlamydophila pneumoniae CWL029
aaagauucuaaau

SEQ ID NO: 2512029 - RNA, 15 nt, Chlamydophila pneumoniae CWL029
aaagauucuaaauca

SEQ ID NO: 2512030 - RNA, 19 nt, Chlamydophila pneumoniae CWL029
aaagauucuaaaucaacua

SEQ ID NO: 2512031 - RNA, 15 nt, Chlamydophila pneumoniae CWL029
aaagauucugcccaa

SEQ ID NO: 2512032 - RNA, 15 nt, Chlamydophila pneumoniae CWL029
aaagauuucugcugu

SEQ ID NO: 2512033 - RNA, 20 nt, Chlamydophila pneumoniae CWL029
aaagauuugcgaaucuaaga

SEQ ID NO: 2512034 - RNA, 14 nt, Chlamydophila pneumoniae CWL029
aaagcaaaaauucu

SEQ ID NO: 2512035 - RNA, 17 nt, Chlamydophila pneumoniae CWL029
aaagcaaaaugguuguu

SEQ ID NO: 2512036 - RNA, 11 nt, Chlamydophila pneumoniae CWL029
aaagcaaagag

SEQ ID NO: 2512037 - RNA, 21 nt, Chlamydophila pneumoniae CWL029
aaagcaaagauaaagaaguuu

SEQ ID NO: 2512038 - RNA, 20 nt, Chlamydophila pneumoniae CWL029
aaagcaaucguguuuuccug

SEQ ID NO: 2512039 - RNA, 11 nt, Chlamydophila pneumoniae CWL029
aaagcacauac

SEQ ID NO: 2512040 - RNA, 15 nt, Chlamydophila pneumoniae CWL029
aaagcagauccugcu

SEQ ID NO: 2512041 - RNA, 12 nt, Chlamydophila pneumoniae CWL029
aaagcagcgaag

SEQ ID NO: 2512042 - RNA, 22 nt, Chlamydophila pneumoniae CWL029
aaagcagcgaagauuuagggaa

SEQ ID NO: 2512043 - RNA, 17 nt, Chlamydophila pneumoniae CWL029
aaagcaggagcaucauu

SEQ ID NO: 2512044 - RNA, 22 nt, Chlamydophila pneumoniae CWL029
aaagcagugugccaauuuuugu

SEQ ID NO: 2512045 - RNA, 22 nt, Chlamydophila pneumoniae CWL029
aaagcauagucgucuuuuaaag

SEQ ID NO: 2512046 - RNA, 20 nt, Chlamydophila pneumoniae CWL029
aaagcaucacggacuccguc

SEQ ID NO: 2512047 - RNA, 16 nt, Chlamydophila pneumoniae CWL029
aaagcaugaugccauu

SEQ ID NO: 2512048 - RNA, 18 nt, Chlamydophila pneumoniae CWL029
aaagccaagaagauguag

SEQ ID NO: 2512049 - RNA, 12 nt, Chlamydophila pneumoniae CWL029
aaagccacagcc

SEQ ID NO: 2512050 - RNA, 20 nt, Chlamydophila pneumoniae CWL029
aaagccauuccauauccaug

SEQ ID NO: 2512051 - RNA, 23 nt, Chlamydophila pneumoniae CWL029
aaagcccauuccugcaguauuau

SEQ ID NO: 2512052 - RNA, 22 nt, Chlamydophila pneumoniae CWL029
aaagccgauacccaucuagaaa

SEQ ID NO: 2512053 - RNA, 23 nt, Chlamydophila pneumoniae CWL029
aaagccggcccacucaaaagaag

SEQ ID NO: 2512054 - RNA, 16 nt, Chlamydophila pneumoniae CWL029
aaagccuaugauaaag

SEQ ID NO: 2512055 - RNA, 15 nt, Chlamydophila pneumoniae CWL029
aaagccuaugggagg

SEQ ID NO: 2512056 - RNA, 17 nt, Chlamydophila pneumoniae CWL029
aaagccucgaaauuuuc

SEQ ID NO: 2512057 - RNA, 18 nt, Chlamydophila pneumoniae CWL029
aaagccucgaaauuuuca

SEQ ID NO: 2512058 - RNA, 12 nt, Chlamydophila pneumoniae CWL029
aaagccugucuu

SEQ ID NO: 2512059 - RNA, 14 nt, Chlamydophila pneumoniae CWL029
aaagccuuucuuau

SEQ ID NO: 2512060 - RNA, 16 nt, Chlamydophila pneumoniae CWL029
aaagccuuugcucacu

SEQ ID NO: 2512061 - RNA, 20 nt, Chlamydophila pneumoniae CWL029
aaagcguuucgauaauuuuc

SEQ ID NO: 2512062 - RNA, 20 nt, Chlamydophila pneumoniae CWL029
aaagcuacggaugggcacuc

SEQ ID NO: 2512063 - RNA, 20 nt, Chlamydophila pneumoniae CWL029
aaagcuagucuucuuagaaa

SEQ ID NO: 2512064 - RNA, 16 nt, Chlamydophila pneumoniae CWL029
aaagcuauauaggguu

SEQ ID NO: 2512065 - RNA, 14 nt, Chlamydophila pneumoniae CWL029
aaagcuauuucucu

SEQ ID NO: 2512066 - RNA, 23 nt, Chlamydophila pneumoniae CWL029
aaagcuauuucucuaucaucaau

SEQ ID NO: 2512067 - RNA, 15 nt, Chlamydophila pneumoniae CWL029
aaagcucuuucauaa

SEQ ID NO: 2512068 - RNA, 14 nt, Chlamydophila pneumoniae CWL029
aaagcugaaauucu

SEQ ID NO: 2512069 - RNA, 16 nt, Chlamydophila pneumoniae CWL029
aaagcugaauccaggu

SEQ ID NO: 2512070 - RNA, 18 nt, Chlamydophila pneumoniae CWL029
aaagcugcuuuuucuacu

SEQ ID NO: 2512071 - RNA, 22 nt, Chlamydophila pneumoniae CWL029
aaagcuguaaccaacaucaaag

SEQ ID NO: 2512072 - RNA, 16 nt, Chlamydophila pneumoniae CWL029
aaagcuguauugggaa

SEQ ID NO: 2512073 - RNA, 21 nt, Chlamydophila pneumoniae CWL029
aaagcugugguaucgauguaa

SEQ ID NO: 2512074 - RNA, 23 nt, Chlamydophila pneumoniae CWL029
aaagcuuguuccacuugcucuuu

SEQ ID NO: 2512075 - RNA, 23 nt, Chlamydophila pneumoniae CWL029
aaagcuuuuccguaaguaaccaa

SEQ ID NO: 2512076 - RNA, 17 nt, Chlamydophila pneumoniae CWL029
aaagcuuuuuucucuug

SEQ ID NO: 2512077 - RNA, 19 nt, Chlamydophila pneumoniae CWL029
aaagcuuuuuucucuugcu

SEQ ID NO: 2512078 - RNA, 15 nt, Chlamydophila pneumoniae CWL029
aaaggaaaauaaucu

SEQ ID NO: 2512079 - RNA, 23 nt, Chlamydophila pneumoniae CWL029
aaaggaagggauguuuaauacaa

SEQ ID NO: 2512080 - RNA, 15 nt, Chlamydophila pneumoniae CWL029
aaaggaauaugcucu

SEQ ID NO: 2512081 - RNA, 18 nt, Chlamydophila pneumoniae CWL029
aaaggaaucccuuuuuaa

SEQ ID NO: 2512082 - RNA, 20 nt, Chlamydophila pneumoniae CWL029
aaaggacauagacuuugagu

SEQ ID NO: 2512083 - RNA, 19 nt, Chlamydophila pneumoniae CWL029
aaaggaccacaauuccuaa

SEQ ID NO: 2512084 - RNA, 16 nt, Chlamydophila pneumoniae CWL029
aaaggaccuguuuucu

SEQ ID NO: 2512085 - RNA, 16 nt, Chlamydophila pneumoniae CWL029
aaaggagaaagaauug

SEQ ID NO: 2512086 - RNA, 21 nt, Chlamydophila pneumoniae CWL029
aaaggagugggcuucaacucu

SEQ ID NO: 2512087 - RNA, 12 nt, Chlamydophila pneumoniae CWL029
aaaggauauuga

SEQ ID NO: 2512088 - RNA, 23 nt, Chlamydophila pneumoniae CWL029
aaaggauauugauaaaucccgaa

SEQ ID NO: 2512089 - RNA, 15 nt, Chlamydophila pneumoniae CWL029
aaaggaucauuaaag

SEQ ID NO: 2512090 - RNA, 17 nt, Chlamydophila pneumoniae CWL029
aaaggauucuaugagga

SEQ ID NO: 2512091 - RNA, 21 nt, Chlamydophila pneumoniae CWL029
aaaggcucuuuuagagccuuu

SEQ ID NO: 2512092 - RNA, 16 nt, Chlamydophila pneumoniae CWL029
aaagggcgcuucccua

SEQ ID NO: 2512093 - RNA, 21 nt, Chlamydophila pneumoniae CWL029
aaagggucuuuaccagaaaug

SEQ ID NO: 2512094 - RNA, 18 nt, Chlamydophila pneumoniae CWL029
aaaggguuucuuuccauc

SEQ ID NO: 2512095 - RNA, 13 nt, Chlamydophila pneumoniae CWL029
aaagguaaaacua

SEQ ID NO: 2512096 - RNA, 12 nt, Chlamydophila pneumoniae CWL029
aaagguugcuaa

SEQ ID NO: 2512097 - RNA, 22 nt, Chlamydophila pneumoniae CWL029
aaagguugcuaagaucuuuaga

SEQ ID NO: 2512098 - RNA, 14 nt, Chlamydophila pneumoniae CWL029
aaagguuguaagga

SEQ ID NO: 2512099 - RNA, 13 nt, Chlamydophila pneumoniae CWL029
aaagguuuuaaaa

SEQ ID NO: 2512100 - RNA, 14 nt, Chlamydophila pneumoniae CWL029
aaagguuuuauaaa

SEQ ID NO: 2512101 - RNA, 15 nt, Chlamydophila pneumoniae CWL029
aaaguaaaaaauaca

SEQ ID NO: 2512102 - RNA, 18 nt, Chlamydophila pneumoniae CWL029
aaaguacaggcuccauca

SEQ ID NO: 2512103 - RNA, 16 nt, Chlamydophila pneumoniae CWL029
aaaguaccuaggaucu

SEQ ID NO: 2512104 - RNA, 13 nt, Chlamydophila pneumoniae CWL029
aaaguaccuuuaa

SEQ ID NO: 2512105 - RNA, 16 nt, Chlamydophila pneumoniae CWL029
aaaguacgaccaacuc

SEQ ID NO: 2512106 - RNA, 18 nt, Chlamydophila pneumoniae CWL029
aaaguacgcauaggccaa

SEQ ID NO: 2512107 - RNA, 15 nt, Chlamydophila pneumoniae CWL029
aaaguacuacaauaa

SEQ ID NO: 2512108 - RNA, 19 nt, Chlamydophila pneumoniae CWL029
aaaguagccauuccaugga

SEQ ID NO: 2512109 - RNA, 17 nt, Chlamydophila pneumoniae CWL029
aaaguaggcacaucauu

SEQ ID NO: 2512110 - RNA, 19 nt, Chlamydophila pneumoniae CWL029
aaaguaggcacaucauuau

SEQ ID NO: 2512111 - RNA, 20 nt, Chlamydophila pneumoniae CWL029
aaaguaggggcaguuccuaa

SEQ ID NO: 2512112 - RNA, 15 nt, Chlamydophila pneumoniae CWL029
aaaguauauauuuua

SEQ ID NO: 2512113 - RNA, 18 nt, Chlamydophila pneumoniae CWL029
aaaguauuccucuuagga

SEQ ID NO: 2512114 - RNA, 18 nt, Chlamydophila pneumoniae CWL029
aaagucacucaaacccuc

SEQ ID NO: 2512115 - RNA, 15 nt, Chlamydophila pneumoniae CWL029
aaaguccaagaucaa

SEQ ID NO: 2512116 - RNA, 20 nt, Chlamydophila pneumoniae CWL029
aaaguccaagaucaaacgaa

SEQ ID NO: 2512117 - RNA, 13 nt, Chlamydophila pneumoniae CWL029
aaagucucucuaa

SEQ ID NO: 2512118 - RNA, 14 nt, Chlamydophila pneumoniae CWL029
aaagugaaagcaac

SEQ ID NO: 2512119 - RNA, 20 nt, Chlamydophila pneumoniae CWL029
aaagugacuuccuccaaaau

SEQ ID NO: 2512120 - RNA, 19 nt, Chlamydophila pneumoniae CWL029
aaaguggcaaucuuuucuu

SEQ ID NO: 2512121 - RNA, 15 nt, Chlamydophila pneumoniae CWL029
aaaguuaaaccuuuu

SEQ ID NO: 2512122 - RNA, 19 nt, Chlamydophila pneumoniae CWL029
aaaguuaaugcaagcaacu

SEQ ID NO: 2512123 - RNA, 20 nt, Chlamydophila pneumoniae CWL029
aaaguuagguagauagaaau

SEQ ID NO: 2512124 - RNA, 18 nt, Chlamydophila pneumoniae CWL029
aaaguucagcaaagaagu

SEQ ID NO: 2512125 - RNA, 18 nt, Chlamydophila pneumoniae CWL029
aaaguuccaaaucucaau

SEQ ID NO: 2512126 - RNA, 13 nt, Chlamydophila pneumoniae CWL029
aaaguugaacuga

SEQ ID NO: 2512127 - RNA, 17 nt, Chlamydophila pneumoniae CWL029
aaaguugaggaaaggag

SEQ ID NO: 2512128 - RNA, 15 nt, Chlamydophila pneumoniae CWL029
aaaguuuccaaguga

SEQ ID NO: 2512129 - RNA, 20 nt, Chlamydophila pneumoniae CWL029
aaaguuugagcuaagcugaa

SEQ ID NO: 2512130 - RNA, 21 nt, Chlamydophila pneumoniae CWL029
aaauaaaaaaacccucaaaga

SEQ ID NO: 2512131 - RNA, 13 nt, Chlamydophila pneumoniae CWL029
aaauaaaaggagc

SEQ ID NO: 2512132 - RNA, 16 nt, Chlamydophila pneumoniae CWL029
aaauaaaaucaagcca

SEQ ID NO: 2512133 - RNA, 15 nt, Chlamydophila pneumoniae CWL029
aaauaauuuuauuag

SEQ ID NO: 2512134 - RNA, 12 nt, Chlamydophila pneumoniae CWL029
aaauacagauuc

SEQ ID NO: 2512135 - RNA, 16 nt, Chlamydophila pneumoniae CWL029
aaauacagccagcaga

SEQ ID NO: 2512136 - RNA, 17 nt, Chlamydophila pneumoniae CWL029
aaauacagccagcagaa

SEQ ID NO: 2512137 - RNA, 17 nt, Chlamydophila pneumoniae CWL029
aaauacaggccugaugu

SEQ ID NO: 2512138 - RNA, 16 nt, Chlamydophila pneumoniae CWL029
aaauaccaagaugucu

SEQ ID NO: 2512139 - RNA, 14 nt, Chlamydophila pneumoniae CWL029
aaauaccaaggcug

SEQ ID NO: 2512140 - RNA, 17 nt, Chlamydophila pneumoniae CWL029
aaauaccaguagagaau

SEQ ID NO: 2512141 - RNA, 21 nt, Chlamydophila pneumoniae CWL029
aaauacccucggagacucaga

SEQ ID NO: 2512142 - RNA, 14 nt, Chlamydophila pneumoniae CWL029
aaauacuccacuuu

SEQ ID NO: 2512143 - RNA, 20 nt, Chlamydophila pneumoniae CWL029
aaauacuuaggaauuuuucu

SEQ ID NO: 2512144 - RNA, 13 nt, Chlamydophila pneumoniae CWL029
aaauacuucuccu

SEQ ID NO: 2512145 - RNA, 14 nt, Chlamydophila pneumoniae CWL029
aaauacuucuccug

SEQ ID NO: 2512146 - RNA, 12 nt, Chlamydophila pneumoniae CWL029
aaauagaaauaa

SEQ ID NO: 2512147 - RNA, 14 nt, Chlamydophila pneumoniae CWL029
aaauagaaaucuua

SEQ ID NO: 2512148 - RNA, 15 nt, Chlamydophila pneumoniae CWL029
aaauagaaggccagu

SEQ ID NO: 2512149 - RNA, 24 nt, Chlamydophila pneumoniae CWL029
aaauagauaagucgaaucuaaaaa

SEQ ID NO: 2512150 - RNA, 14 nt, Chlamydophila pneumoniae CWL029
aaauagauccugaa

SEQ ID NO: 2512151 - RNA, 15 nt, Chlamydophila pneumoniae CWL029
aaauaggagaagccc

SEQ ID NO: 2512152 - RNA, 17 nt, Chlamydophila pneumoniae CWL029
aaauaggaucucucuuu

SEQ ID NO: 2512153 - RNA, 22 nt, Chlamydophila pneumoniae CWL029
aaauaggcucuacaggagaagc

SEQ ID NO: 2512154 - RNA, 23 nt, Chlamydophila pneumoniae CWL029
aaauaggcucuacaggagaagcg

SEQ ID NO: 2512155 - RNA, 16 nt, Chlamydophila pneumoniae CWL029
aaauaguucaucauau

SEQ ID NO: 2512156 - RNA, 14 nt, Chlamydophila pneumoniae CWL029
aaauauaaauuuau

SEQ ID NO: 2512157 - RNA, 15 nt, Chlamydophila pneumoniae CWL029
aaauauaaauuuaua

SEQ ID NO: 2512158 - RNA, 15 nt, Chlamydophila pneumoniae CWL029
aaauauacugccagc

SEQ ID NO: 2512159 - RNA, 14 nt, Chlamydophila pneumoniae CWL029
aaauauaguuuuca

SEQ ID NO: 2512160 - RNA, 18 nt, Chlamydophila pneumoniae CWL029
aaauauaguuuucauaau

SEQ ID NO: 2512161 - RNA, 19 nt, Chlamydophila pneumoniae CWL029
aaauauaguuuucauaauc

SEQ ID NO: 2512162 - RNA, 18 nt, Chlamydophila pneumoniae CWL029
aaauauaucuucagaauu

SEQ ID NO: 2512163 - RNA, 23 nt, Chlamydophila pneumoniae CWL029
aaauaucaccuacaucagacuga

SEQ ID NO: 2512164 - RNA, 14 nt, Chlamydophila pneumoniae CWL029
aaauaucggaagag

SEQ ID NO: 2512165 - RNA, 21 nt, Chlamydophila pneumoniae CWL029
aaauaucuccguuaccaaaaa

SEQ ID NO: 2512166 - RNA, 23 nt, Chlamydophila pneumoniae CWL029
aaauaucuccguuaccaaaaacu

SEQ ID NO: 2512167 - RNA, 11 nt, Chlamydophila pneumoniae CWL029
aaauaugaauu

SEQ ID NO: 2512168 - RNA, 15 nt, Chlamydophila pneumoniae CWL029
aaauauggggaaagc

SEQ ID NO: 2512169 - RNA, 18 nt, Chlamydophila pneumoniae CWL029
aaauauuaacccaccaga

SEQ ID NO: 2512170 - RNA, 17 nt, Chlamydophila pneumoniae CWL029
aaauauucuuggaagau

SEQ ID NO: 2512171 - RNA, 19 nt, Chlamydophila pneumoniae CWL029
aaauauucuuucaaaccac

SEQ ID NO: 2512172 - RNA, 15 nt, Chlamydophila pneumoniae CWL029
aaaucaaaauuuuua

SEQ ID NO: 2512173 - RNA, 15 nt, Chlamydophila pneumoniae CWL029
aaaucaaacauuacc

SEQ ID NO: 2512174 - RNA, 13 nt, Chlamydophila pneumoniae CWL029
aaaucaacaucac

SEQ ID NO: 2512175 - RNA, 17 nt, Chlamydophila pneumoniae CWL029
aaaucaagccacagaga

SEQ ID NO: 2512176 - RNA, 18 nt, Chlamydophila pneumoniae CWL029
aaaucaagccacagagaa

SEQ ID NO: 2512177 - RNA, 13 nt, Chlamydophila pneumoniae CWL029
aaaucaauaauaa

SEQ ID NO: 2512178 - RNA, 13 nt, Chlamydophila pneumoniae CWL029
aaaucacacuuaa

SEQ ID NO: 2512179 - RNA, 20 nt, Chlamydophila pneumoniae CWL029
aaaucaccagcauuaagaua

SEQ ID NO: 2512180 - RNA, 15 nt, Chlamydophila pneumoniae CWL029
aaaucagaauccuga

SEQ ID NO: 2512181 - RNA, 14 nt, Chlamydophila pneumoniae CWL029
aaaucagacuuaaa

SEQ ID NO: 2512182 - RNA, 20 nt, Chlamydophila pneumoniae CWL029
aaaucauaggcuauaauuaa

SEQ ID NO: 2512183 - RNA, 12 nt, Chlamydophila pneumoniae CWL029
aaaucaucaaaa

SEQ ID NO: 2512184 - RNA, 16 nt, Chlamydophila pneumoniae CWL029
aaaucccgccuuucua

SEQ ID NO: 2512185 - RNA, 13 nt, Chlamydophila pneumoniae CWL029
aaauccgauaaga

SEQ ID NO: 2512186 - RNA, 12 nt, Chlamydophila pneumoniae CWL029
aaauccuaaaaa

SEQ ID NO: 2512187 - RNA, 23 nt, Chlamydophila pneumoniae CWL029
aaauccugcucguaaaucuggaa

SEQ ID NO: 2512188 - RNA, 15 nt, Chlamydophila pneumoniae CWL029
aaaucgacaggggag

SEQ ID NO: 2512189 - RNA, 19 nt, Chlamydophila pneumoniae CWL029
aaaucgugcuuagagccuu

SEQ ID NO: 2512190 - RNA, 15 nt, Chlamydophila pneumoniae CWL029
aaaucuacauguaaa

SEQ ID NO: 2512191 - RNA, 21 nt, Chlamydophila pneumoniae CWL029
aaaucuacucuuuaaaaauag

SEQ ID NO: 2512192 - RNA, 22 nt, Chlamydophila pneumoniae CWL029
aaaucuauacccaguuguaucc

SEQ ID NO: 2512193 - RNA, 13 nt, Chlamydophila pneumoniae CWL029
aaaucuaucugca

SEQ ID NO: 2512194 - RNA, 14 nt, Chlamydophila pneumoniae CWL029
aaaucuauuccccu

SEQ ID NO: 2512195 - RNA, 23 nt, Chlamydophila pneumoniae CWL029
aaaucucgagcuaccuagggucu

SEQ ID NO: 2512196 - RNA, 21 nt, Chlamydophila pneumoniae CWL029
aaaucugcaagauuaucuuua

SEQ ID NO: 2512197 - RNA, 18 nt, Chlamydophila pneumoniae CWL029
aaaucugcucuacuuguc

SEQ ID NO: 2512198 - RNA, 20 nt, Chlamydophila pneumoniae CWL029
aaaucugcuuuuaucucaau

SEQ ID NO: 2512199 - RNA, 22 nt, Chlamydophila pneumoniae CWL029
aaaucuggggcuuccagaaaca

SEQ ID NO: 2512200 - RNA, 18 nt, Chlamydophila pneumoniae CWL029
aaaucuucuggagggagu

SEQ ID NO: 2512201 - RNA, 16 nt, Chlamydophila pneumoniae CWL029
aaaucuuuagaauuaa

SEQ ID NO: 2512202 - RNA, 12 nt, Chlamydophila pneumoniae CWL029
aaaugagaggga

SEQ ID NO: 2512203 - RNA, 23 nt, Chlamydophila pneumoniae CWL029
aaaugauuuggccaacaguguag

SEQ ID NO: 2512204 - RNA, 22 nt, Chlamydophila pneumoniae CWL029
aaaugcaaaccaaaaaaguaac

SEQ ID NO: 2512205 - RNA, 16 nt, Chlamydophila pneumoniae CWL029
aaaugcacuuugaaua

SEQ ID NO: 2512206 - RNA, 21 nt, Chlamydophila pneumoniae CWL029
aaaugcaguucuuguuaaagu

SEQ ID NO: 2512207 - RNA, 12 nt, Chlamydophila pneumoniae CWL029
aaaugccuguac

SEQ ID NO: 2512208 - RNA, 19 nt, Chlamydophila pneumoniae CWL029
aaaugccuuaaauguauug

SEQ ID NO: 2512209 - RNA, 13 nt, Chlamydophila pneumoniae CWL029
aaaugcuccugca

SEQ ID NO: 2512210 - RNA, 22 nt, Chlamydophila pneumoniae CWL029
aaaugcuccugcaaaaaaccag

SEQ ID NO: 2512211 - RNA, 19 nt, Chlamydophila pneumoniae CWL029
aaaugcuuguauaaaugcu

SEQ ID NO: 2512212 - RNA, 16 nt, Chlamydophila pneumoniae CWL029
aaaugguaauuuuuca

SEQ ID NO: 2512213 - RNA, 20 nt, Chlamydophila pneumoniae CWL029
aaaugguaauuuuucaguuc

SEQ ID NO: 2512214 - RNA, 13 nt, Chlamydophila pneumoniae CWL029
aaauguaaaaaau

SEQ ID NO: 2512215 - RNA, 10 nt, Chlamydophila pneumoniae CWL029
aaauguaggg

SEQ ID NO: 2512216 - RNA, 17 nt, Chlamydophila pneumoniae CWL029
aaauguauaggcauuaa

SEQ ID NO: 2512217 - RNA, 23 nt, Chlamydophila pneumoniae CWL029
aaaugugaaaucguaucuuuuug

SEQ ID NO: 2512218 - RNA, 22 nt, Chlamydophila pneumoniae CWL029
aaaugugcucggacagaaagau

SEQ ID NO: 2512219 - RNA, 21 nt, Chlamydophila pneumoniae CWL029
aaauguugauagguagaggca

SEQ ID NO: 2512220 - RNA, 21 nt, Chlamydophila pneumoniae CWL029
aaauguuuaucgacucuucca

SEQ ID NO: 2512221 - RNA, 20 nt, Chlamydophila pneumoniae CWL029
aaauguuuugcgauaucuau

SEQ ID NO: 2512222 - RNA, 21 nt, Chlamydophila pneumoniae CWL029
aaauguuuugcgauaucuaua

SEQ ID NO: 2512223 - RNA, 12 nt, Chlamydophila pneumoniae CWL029
aaauuaaauauc

SEQ ID NO: 2512224 - RNA, 16 nt, Chlamydophila pneumoniae CWL029
aaauuaaauucuuuuc

SEQ ID NO: 2512225 - RNA, 12 nt, Chlamydophila pneumoniae CWL029
aaauuaacagag

SEQ ID NO: 2512226 - RNA, 17 nt, Chlamydophila pneumoniae CWL029
aaauuaagaacccgaua

SEQ ID NO: 2512227 - RNA, 22 nt, Chlamydophila pneumoniae CWL029
aaauuaagucacacuuuccguu

SEQ ID NO: 2512228 - RNA, 21 nt, Chlamydophila pneumoniae CWL029
aaauuaccguuuccuccucuu

SEQ ID NO: 2512229 - RNA, 16 nt, Chlamydophila pneumoniae CWL029
aaauuaucuccaaaga

SEQ ID NO: 2512230 - RNA, 18 nt, Chlamydophila pneumoniae CWL029
aaauucaaaauagaagcc

SEQ ID NO: 2512231 - RNA, 22 nt, Chlamydophila pneumoniae CWL029
aaauucaaaaucaaaguauaua

SEQ ID NO: 2512232 - RNA, 19 nt, Chlamydophila pneumoniae CWL029
aaauucaccaaccaguuuc

SEQ ID NO: 2512233 - RNA, 16 nt, Chlamydophila pneumoniae CWL029
aaauucaggacccuuu

SEQ ID NO: 2512234 - RNA, 19 nt, Chlamydophila pneumoniae CWL029
aaauucaguauaagaugcu

SEQ ID NO: 2512235 - RNA, 14 nt, Chlamydophila pneumoniae CWL029
aaauucauuaaaau

SEQ ID NO: 2512236 - RNA, 23 nt, Chlamydophila pneumoniae CWL029
aaauuccgacccagucaaaauau

SEQ ID NO: 2512237 - RNA, 18 nt, Chlamydophila pneumoniae CWL029
aaauucgaauucucagaa

SEQ ID NO: 2512238 - RNA, 13 nt, Chlamydophila pneumoniae CWL029
aaauucuaagcgc

SEQ ID NO: 2512239 - RNA, 21 nt, Chlamydophila pneumoniae CWL029
aaauucuagguuucaggaaau

SEQ ID NO: 2512240 - RNA, 23 nt, Chlamydophila pneumoniae CWL029
aaauucucauaaccuaaggcaug

SEQ ID NO: 2512241 - RNA, 22 nt, Chlamydophila pneumoniae CWL029
aaauucuggagucgagcagaaa

SEQ ID NO: 2512242 - RNA, 15 nt, Chlamydophila pneumoniae CWL029
aaauucuuaaaacug

SEQ ID NO: 2512243 - RNA, 21 nt, Chlamydophila pneumoniae CWL029
aaauucuuaacaauauaugcu

SEQ ID NO: 2512244 - RNA, 19 nt, Chlamydophila pneumoniae CWL029
aaauugaaaucuuuagaau

SEQ ID NO: 2512245 - RNA, 17 nt, Chlamydophila pneumoniae CWL029
aaauugcauuuaaacua

SEQ ID NO: 2512246 - RNA, 16 nt, Chlamydophila pneumoniae CWL029
aaauuggcuuuugaga

SEQ ID NO: 2512247 - RNA, 20 nt, Chlamydophila pneumoniae CWL029
aaauuguuaucaggaacuaa

SEQ ID NO: 2512248 - RNA, 20 nt, Chlamydophila pneumoniae CWL029
aaauuguuuguaucaaagaa

SEQ ID NO: 2512249 - RNA, 22 nt, Chlamydophila pneumoniae CWL029
aaauuuaagauaucgaccuuaa

SEQ ID NO: 2512250 - RNA, 22 nt, Chlamydophila pneumoniae CWL029
aaauuuaucggcuaaagaaaag

SEQ ID NO: 2512251 - RNA, 20 nt, Chlamydophila pneumoniae CWL029
aaauuuccgcuguauuuuca

SEQ ID NO: 2512252 - RNA, 23 nt, Chlamydophila pneumoniae CWL029
aaauuuccuaccuauauuuuuua

SEQ ID NO: 2512253 - RNA, 16 nt, Chlamydophila pneumoniae CWL029
aaauuucuuauaaaaa

SEQ ID NO: 2512254 - RNA, 20 nt, Chlamydophila pneumoniae CWL029
aaauuugcucuccugcaaaa

SEQ ID NO: 2512255 - RNA, 23 nt, Chlamydophila pneumoniae CWL029
aaauuugcucuccugcaaaaagu

SEQ ID NO: 2512256 - RNA, 17 nt, Chlamydophila pneumoniae CWL029
aaauuuucccauuacag

SEQ ID NO: 2512257 - RNA, 18 nt, Chlamydophila pneumoniae CWL029
aauacaaaaaauaaaauc

SEQ ID NO: 2512258 - RNA, 19 nt, Chlamydophila pneumoniae CWL029
aauacaaaacaaaagccau

SEQ ID NO: 2512259 - RNA, 14 nt, Chlamydophila pneumoniae CWL029
aauacaaacaagaa

SEQ ID NO: 2512260 - RNA, 16 nt, Chlamydophila pneumoniae CWL029
aauacagcauaaaaau

SEQ ID NO: 2512261 - RNA, 20 nt, Chlamydophila pneumoniae CWL029
aauacagccagcagaaggcu

SEQ ID NO: 2512262 - RNA, 19 nt, Chlamydophila pneumoniae CWL029
aauacauagguaaaaccag

SEQ ID NO: 2512263 - RNA, 19 nt, Chlamydophila pneumoniae CWL029
aauacaucaccacugcucc

SEQ ID NO: 2512264 - RNA, 20 nt, Chlamydophila pneumoniae CWL029
aauacaucaccacugcucca

SEQ ID NO: 2512265 - RNA, 21 nt, Chlamydophila pneumoniae CWL029
aauaccaauugggcuaggguu

SEQ ID NO: 2512266 - RNA, 14 nt, Chlamydophila pneumoniae CWL029
aauaccagaagcaa

SEQ ID NO: 2512267 - RNA, 18 nt, Chlamydophila pneumoniae CWL029
aauaccagauaaagcaaa

SEQ ID NO: 2512268 - RNA, 22 nt, Chlamydophila pneumoniae CWL029
aauaccagauaaagcaaagaua

SEQ ID NO: 2512269 - RNA, 21 nt, Chlamydophila pneumoniae CWL029
aauaccaucucuuucuauuuc

SEQ ID NO: 2512270 - RNA, 21 nt, Chlamydophila pneumoniae CWL029
aauacccucaaauuggaauuc

SEQ ID NO: 2512271 - RNA, 17 nt, Chlamydophila pneumoniae CWL029
aauaccguuuuaggaag

SEQ ID NO: 2512272 - RNA, 21 nt, Chlamydophila pneumoniae CWL029
aauaccucaaagccaucuucu

SEQ ID NO: 2512273 - RNA, 22 nt, Chlamydophila pneumoniae CWL029
aauaccuguacgguaaauccau

SEQ ID NO: 2512274 - RNA, 16 nt, Chlamydophila pneumoniae CWL029
aauacgaucugcuuug

SEQ ID NO: 2512275 - RNA, 14 nt, Chlamydophila pneumoniae CWL029
aauacgaucuuuug

SEQ ID NO: 2512276 - RNA, 23 nt, Chlamydophila pneumoniae CWL029
aauacguccagccugcaccagac

SEQ ID NO: 2512277 - RNA, 12 nt, Chlamydophila pneumoniae CWL029
aauacuaagaag

SEQ ID NO: 2512278 - RNA, 14 nt, Chlamydophila pneumoniae CWL029
aauacuccacuuuu

SEQ ID NO: 2512279 - RNA, 18 nt, Chlamydophila pneumoniae CWL029
aauacuguucgauaagaa

SEQ ID NO: 2512280 - RNA, 14 nt, Chlamydophila pneumoniae CWL029
aauacuuaauccug

SEQ ID NO: 2512281 - RNA, 16 nt, Chlamydophila pneumoniae CWL029
aauacuuaauccugua

SEQ ID NO: 2512282 - RNA, 21 nt, Chlamydophila pneumoniae CWL029
aauacuuaggaauuuuucuag

SEQ ID NO: 2512283 - RNA, 13 nt, Chlamydophila pneumoniae CWL029
aauacuucuccug

SEQ ID NO: 2512284 - RNA, 20 nt, Chlamydophila pneumoniae CWL029
aauagaaaagguauuaggaa

SEQ ID NO: 2512285 - RNA, 15 nt, Chlamydophila pneumoniae CWL029
aauagacacuugcuu

SEQ ID NO: 2512286 - RNA, 15 nt, Chlamydophila pneumoniae CWL029
aauagacaggaugga

SEQ ID NO: 2512287 - RNA, 16 nt, Chlamydophila pneumoniae CWL029
aauagagaaagagugc

SEQ ID NO: 2512288 - RNA, 22 nt, Chlamydophila pneumoniae CWL029
aauagagaaagagugccaagag

SEQ ID NO: 2512289 - RNA, 15 nt, Chlamydophila pneumoniae CWL029
aauagagucucuuga

SEQ ID NO: 2512290 - RNA, 21 nt, Chlamydophila pneumoniae CWL029
aauagauccugaaaguacaga

SEQ ID NO: 2512291 - RNA, 13 nt, Chlamydophila pneumoniae CWL029
aauagauucguua

SEQ ID NO: 2512292 - RNA, 22 nt, Chlamydophila pneumoniae CWL029
aauagcaaagacaucuccugca

SEQ ID NO: 2512293 - RNA, 17 nt, Chlamydophila pneumoniae CWL029
aauagcaaagauuucug

SEQ ID NO: 2512294 - RNA, 19 nt, Chlamydophila pneumoniae CWL029
aauagcaagagcuauaccu

SEQ ID NO: 2512295 - RNA, 14 nt, Chlamydophila pneumoniae CWL029
aauagcaagcacuu

SEQ ID NO: 2512296 - RNA, 20 nt, Chlamydophila pneumoniae CWL029
aauagcaagcgcuagugcaa

SEQ ID NO: 2512297 - RNA, 15 nt, Chlamydophila pneumoniae CWL029
aauagcaaguagcuc

SEQ ID NO: 2512298 - RNA, 16 nt, Chlamydophila pneumoniae CWL029
aauagcaaguagcucu

SEQ ID NO: 2512299 - RNA, 14 nt, Chlamydophila pneumoniae CWL029
aauagcaauggcuu

SEQ ID NO: 2512300 - RNA, 23 nt, Chlamydophila pneumoniae CWL029
aauagcaggaaggaauagagaaa

SEQ ID NO: 2512301 - RNA, 16 nt, Chlamydophila pneumoniae CWL029
aauagccucuccuuga

SEQ ID NO: 2512302 - RNA, 19 nt, Chlamydophila pneumoniae CWL029
aauagcgacaugagaaauc

SEQ ID NO: 2512303 - RNA, 15 nt, Chlamydophila pneumoniae CWL029
aauagcuaaagugau

SEQ ID NO: 2512304 - RNA, 21 nt, Chlamydophila pneumoniae CWL029
aauagcucugcgccaugcaca

SEQ ID NO: 2512305 - RNA, 16 nt, Chlamydophila pneumoniae CWL029
aauagcucuggagauu

SEQ ID NO: 2512306 - RNA, 14 nt, Chlamydophila pneumoniae CWL029
aauagcucuuuuca

SEQ ID NO: 2512307 - RNA, 15 nt, Chlamydophila pneumoniae CWL029
aauagcucuuuucau

SEQ ID NO: 2512308 - RNA, 17 nt, Chlamydophila pneumoniae CWL029
aauagcucuuuucauga

SEQ ID NO: 2512309 - RNA, 18 nt, Chlamydophila pneumoniae CWL029
aauagcucuuuucaugau

SEQ ID NO: 2512310 - RNA, 19 nt, Chlamydophila pneumoniae CWL029
aauagcuuacuuucuuuua

SEQ ID NO: 2512311 - RNA, 22 nt, Chlamydophila pneumoniae CWL029
aauagcuucugacucuguugca

SEQ ID NO: 2512312 - RNA, 14 nt, Chlamydophila pneumoniae CWL029
aauaggagaagccc

SEQ ID NO: 2512313 - RNA, 16 nt, Chlamydophila pneumoniae CWL029
aauaggauaagaaauu

SEQ ID NO: 2512314 - RNA, 14 nt, Chlamydophila pneumoniae CWL029
aauaggcacccaaa

SEQ ID NO: 2512315 - RNA, 22 nt, Chlamydophila pneumoniae CWL029
aauaggcauuacacaacucuuu

SEQ ID NO: 2512316 - RNA, 14 nt, Chlamydophila pneumoniae CWL029
aauaguacgcuuuu

SEQ ID NO: 2512317 - RNA, 23 nt, Chlamydophila pneumoniae CWL029
aauagugaggccuccauuucuag

SEQ ID NO: 2512318 - RNA, 22 nt, Chlamydophila pneumoniae CWL029
aauaguugugagacuuucugag

SEQ ID NO: 2512319 - RNA, 13 nt, Chlamydophila pneumoniae CWL029
aauauaaauuuau

SEQ ID NO: 2512320 - RNA, 14 nt, Chlamydophila pneumoniae CWL029
aauauaacucucua

SEQ ID NO: 2512321 - RNA, 23 nt, Chlamydophila pneumoniae CWL029
aauauaacugcauacaaggcaca

SEQ ID NO: 2512322 - RNA, 17 nt, Chlamydophila pneumoniae CWL029
aauauacagauguuuuc

SEQ ID NO: 2512323 - RNA, 23 nt, Chlamydophila pneumoniae CWL029
aauauacagauguuuucguaaau

SEQ ID NO: 2512324 - RNA, 17 nt, Chlamydophila pneumoniae CWL029
aauauagagaucuagau

SEQ ID NO: 2512325 - RNA, 12 nt, Chlamydophila pneumoniae CWL029
aauauauaaaga

SEQ ID NO: 2512326 - RNA, 20 nt, Chlamydophila pneumoniae CWL029
aauauaucgcguguaaaagc

SEQ ID NO: 2512327 - RNA, 15 nt, Chlamydophila pneumoniae CWL029
aauaucaggacaaug

SEQ ID NO: 2512328 - RNA, 17 nt, Chlamydophila pneumoniae CWL029
aauaucaggacaaugaa

SEQ ID NO: 2512329 - RNA, 12 nt, Chlamydophila pneumoniae CWL029
aauaucaucacu

SEQ ID NO: 2512330 - RNA, 14 nt, Chlamydophila pneumoniae CWL029
aauauccagaaaua

SEQ ID NO: 2512331 - RNA, 22 nt, Chlamydophila pneumoniae CWL029
aauaucgaguucuuuuugcaga

SEQ ID NO: 2512332 - RNA, 18 nt, Chlamydophila pneumoniae CWL029
aauaucuccgccauaaca

SEQ ID NO: 2512333 - RNA, 21 nt, Chlamydophila pneumoniae CWL029
aauaucucuggcauaauccug

SEQ ID NO: 2512334 - RNA, 14 nt, Chlamydophila pneumoniae CWL029
aauaugcucuccuu

SEQ ID NO: 2512335 - RNA, 15 nt, Chlamydophila pneumoniae CWL029
aauaugcucugccau

SEQ ID NO: 2512336 - RNA, 23 nt, Chlamydophila pneumoniae CWL029
aauauggacagcguauaggaaac

SEQ ID NO: 2512337 - RNA, 18 nt, Chlamydophila pneumoniae CWL029
aauauggguguaaauuuu

SEQ ID NO: 2512338 - RNA, 22 nt, Chlamydophila pneumoniae CWL029
aauaugguaguuugccuucuua

SEQ ID NO: 2512339 - RNA, 18 nt, Chlamydophila pneumoniae CWL029
aauauuaaauucaaaauc

SEQ ID NO: 2512340 - RNA, 20 nt, Chlamydophila pneumoniae CWL029
aauauuaacccaccagaagg

SEQ ID NO: 2512341 - RNA, 14 nt, Chlamydophila pneumoniae CWL029
aauauucaacaugu

SEQ ID NO: 2512342 - RNA, 15 nt, Chlamydophila pneumoniae CWL029
aauauucuuggaaga

SEQ ID NO: 2512343 - RNA, 19 nt, Chlamydophila pneumoniae CWL029
aauauuuuaccauugagau

SEQ ID NO: 2512344 - RNA, 14 nt, Chlamydophila pneumoniae CWL029
aaucaaccaaaaug

SEQ ID NO: 2512345 - RNA, 12 nt, Chlamydophila pneumoniae CWL029
aaucaagaagag

SEQ ID NO: 2512346 - RNA, 18 nt, Chlamydophila pneumoniae CWL029
aaucaagaguuucgaauu

SEQ ID NO: 2512347 - RNA, 20 nt, Chlamydophila pneumoniae CWL029
aaucaagccacagagaauug

SEQ ID NO: 2512348 - RNA, 13 nt, Chlamydophila pneumoniae CWL029
aaucaauaaaaug

SEQ ID NO: 2512349 - RNA, 22 nt, Chlamydophila pneumoniae CWL029
aaucaauaaaauguccaacuca

SEQ ID NO: 2512350 - RNA, 14 nt, Chlamydophila pneumoniae CWL029
aaucaauccaagaa

SEQ ID NO: 2512351 - RNA, 22 nt, Chlamydophila pneumoniae CWL029
aaucaauccuauggcagcagga

SEQ ID NO: 2512352 - RNA, 19 nt, Chlamydophila pneumoniae CWL029
aaucacaucaguuccauuu

SEQ ID NO: 2512353 - RNA, 15 nt, Chlamydophila pneumoniae CWL029
aaucaccaauuuuuu

SEQ ID NO: 2512354 - RNA, 17 nt, Chlamydophila pneumoniae CWL029
aaucaccauauccauga

SEQ ID NO: 2512355 - RNA, 20 nt, Chlamydophila pneumoniae CWL029
aaucacgacgucaucaccau

SEQ ID NO: 2512356 - RNA, 14 nt, Chlamydophila pneumoniae CWL029
aaucacucuaugau

SEQ ID NO: 2512357 - RNA, 12 nt, Chlamydophila pneumoniae CWL029
aaucacucucua

SEQ ID NO: 2512358 - RNA, 19 nt, Chlamydophila pneumoniae CWL029
aaucacuuaauaauguuuu

SEQ ID NO: 2512359 - RNA, 17 nt, Chlamydophila pneumoniae CWL029
aaucagcacacugcuua

SEQ ID NO: 2512360 - RNA, 15 nt, Chlamydophila pneumoniae CWL029
aaucauaaaaaaagc

SEQ ID NO: 2512361 - RNA, 23 nt, Chlamydophila pneumoniae CWL029
aaucauaacaagucuaucgacac

SEQ ID NO: 2512362 - RNA, 18 nt, Chlamydophila pneumoniae CWL029
aaucauaaccaaaagaau

SEQ ID NO: 2512363 - RNA, 21 nt, Chlamydophila pneumoniae CWL029
aaucauagagauaucaucaaa

SEQ ID NO: 2512364 - RNA, 12 nt, Chlamydophila pneumoniae CWL029
aaucauaucugc

SEQ ID NO: 2512365 - RNA, 13 nt, Chlamydophila pneumoniae CWL029
aaucauaucugcg

SEQ ID NO: 2512366 - RNA, 15 nt, Chlamydophila pneumoniae CWL029
aaucaucaaaaagau

SEQ ID NO: 2512367 - RNA, 15 nt, Chlamydophila pneumoniae CWL029
aaucaugauaaaaau

SEQ ID NO: 2512368 - RNA, 23 nt, Chlamydophila pneumoniae CWL029
aaucaugauaaaaauuuucagga

SEQ ID NO: 2512369 - RNA, 20 nt, Chlamydophila pneumoniae CWL029
aaucauuagaguuugguuug

SEQ ID NO: 2512370 - RNA, 13 nt, Chlamydophila pneumoniae CWL029
aaucauucaaaua

SEQ ID NO: 2512371 - RNA, 15 nt, Chlamydophila pneumoniae CWL029
aaucauucaaauaua

SEQ ID NO: 2512372 - RNA, 14 nt, Chlamydophila pneumoniae CWL029
aauccaaaaaagag

SEQ ID NO: 2512373 - RNA, 21 nt, Chlamydophila pneumoniae CWL029
aauccaaaaaaugcuccugca

SEQ ID NO: 2512374 - RNA, 16 nt, Chlamydophila pneumoniae CWL029
aauccaacaaagauga

SEQ ID NO: 2512375 - RNA, 17 nt, Chlamydophila pneumoniae CWL029
aauccaaggggcuccca

SEQ ID NO: 2512376 - RNA, 21 nt, Chlamydophila pneumoniae CWL029
aauccaccaaugauaauuuca

SEQ ID NO: 2512377 - RNA, 14 nt, Chlamydophila pneumoniae CWL029
aauccacgcuccuc

SEQ ID NO: 2512378 - RNA, 16 nt, Chlamydophila pneumoniae CWL029
aauccacgcuccucua

SEQ ID NO: 2512379 - RNA, 13 nt, Chlamydophila pneumoniae CWL029
aauccaguuuuuu

SEQ ID NO: 2512380 - RNA, 20 nt, Chlamydophila pneumoniae CWL029
aauccauaguccuagcagag

SEQ ID NO: 2512381 - RNA, 15 nt, Chlamydophila pneumoniae CWL029
aauccauucugagaa

SEQ ID NO: 2512382 - RNA, 21 nt, Chlamydophila pneumoniae CWL029
aauccauucugagaaagaagu

SEQ ID NO: 2512383 - RNA, 22 nt, Chlamydophila pneumoniae CWL029
aauccauucugagaaagaaguc

SEQ ID NO: 2512384 - RNA, 15 nt, Chlamydophila pneumoniae CWL029
aauccccaauguuuu

SEQ ID NO: 2512385 - RNA, 16 nt, Chlamydophila pneumoniae CWL029
aaucccgugcuaggaa

SEQ ID NO: 2512386 - RNA, 22 nt, Chlamydophila pneumoniae CWL029
aaucccugaugcaguaauucca

SEQ ID NO: 2512387 - RNA, 15 nt, Chlamydophila pneumoniae CWL029
aaucccugcacucuu

SEQ ID NO: 2512388 - RNA, 19 nt, Chlamydophila pneumoniae CWL029
aaucccuguguguuuuuuc

SEQ ID NO: 2512389 - RNA, 21 nt, Chlamydophila pneumoniae CWL029
aauccgauaagauaaagaauu

SEQ ID NO: 2512390 - RNA, 16 nt, Chlamydophila pneumoniae CWL029
aauccggcauaaaaaa

SEQ ID NO: 2512391 - RNA, 12 nt, Chlamydophila pneumoniae CWL029
aauccuaaaaag

SEQ ID NO: 2512392 - RNA, 20 nt, Chlamydophila pneumoniae CWL029
aauccuccuagguucuuuuu

SEQ ID NO: 2512393 - RNA, 16 nt, Chlamydophila pneumoniae CWL029
aauccucggaagauaa

SEQ ID NO: 2512394 - RNA, 16 nt, Chlamydophila pneumoniae CWL029
aauccugaguaaaauc

SEQ ID NO: 2512395 - RNA, 17 nt, Chlamydophila pneumoniae CWL029
aauccugaguaaaauca

SEQ ID NO: 2512396 - RNA, 18 nt, Chlamydophila pneumoniae CWL029
aauccugaguaaaaucau

SEQ ID NO: 2512397 - RNA, 20 nt, Chlamydophila pneumoniae CWL029
aauccugcauacccuucuuc

SEQ ID NO: 2512398 - RNA, 21 nt, Chlamydophila pneumoniae CWL029
aauccugcauacccuucuucu

SEQ ID NO: 2512399 - RNA, 16 nt, Chlamydophila pneumoniae CWL029
aauccugggcaaugau

SEQ ID NO: 2512400 - RNA, 20 nt, Chlamydophila pneumoniae CWL029
aauccuguagggaaagacuc

SEQ ID NO: 2512401 - RNA, 21 nt, Chlamydophila pneumoniae CWL029
aauccuguagggaaagacuca

SEQ ID NO: 2512402 - RNA, 19 nt, Chlamydophila pneumoniae CWL029
aauccuguucuacauagau

SEQ ID NO: 2512403 - RNA, 12 nt, Chlamydophila pneumoniae CWL029
aauccuuccuua

SEQ ID NO: 2512404 - RNA, 13 nt, Chlamydophila pneumoniae CWL029
aauccuuccuuac

SEQ ID NO: 2512405 - RNA, 21 nt, Chlamydophila pneumoniae CWL029
aauccuuccuuacaagcuucc

SEQ ID NO: 2512406 - RNA, 16 nt, Chlamydophila pneumoniae CWL029
aauccuuuauguauaa

SEQ ID NO: 2512407 - RNA, 19 nt, Chlamydophila pneumoniae CWL029
aaucgagagaagaaauucu

SEQ ID NO: 2512408 - RNA, 22 nt, Chlamydophila pneumoniae CWL029
aaucgagagaagaaauucugac

SEQ ID NO: 2512409 - RNA, 23 nt, Chlamydophila pneumoniae CWL029
aaucgagagaagaaauucugacu

SEQ ID NO: 2512410 - RNA, 17 nt, Chlamydophila pneumoniae CWL029
aaucgauaacguugccu

SEQ ID NO: 2512411 - RNA, 20 nt, Chlamydophila pneumoniae CWL029
aaucgauaacguugccuguu

SEQ ID NO: 2512412 - RNA, 21 nt, Chlamydophila pneumoniae CWL029
aaucgcacuucuauuucugcu

SEQ ID NO: 2512413 - RNA, 19 nt, Chlamydophila pneumoniae CWL029
aaucgccuuacaauuuaaa

SEQ ID NO: 2512414 - RNA, 16 nt, Chlamydophila pneumoniae CWL029
aaucgcuguaaauuca

SEQ ID NO: 2512415 - RNA, 15 nt, Chlamydophila pneumoniae CWL029
aaucguguuuuccug

SEQ ID NO: 2512416 - RNA, 21 nt, Chlamydophila pneumoniae CWL029
aaucguucuuagcgcauguau

SEQ ID NO: 2512417 - RNA, 20 nt, Chlamydophila pneumoniae CWL029
aaucguuucuauagacucua

SEQ ID NO: 2512418 - RNA, 18 nt, Chlamydophila pneumoniae CWL029
aaucguuuuauuuuagga

SEQ ID NO: 2512419 - RNA, 19 nt, Chlamydophila pneumoniae CWL029
aaucuaaaaacuucccauc

SEQ ID NO: 2512420 - RNA, 23 nt, Chlamydophila pneumoniae CWL029
aaucuaaaaacuucccaucuugu

SEQ ID NO: 2512421 - RNA, 14 nt, Chlamydophila pneumoniae CWL029
aaucuaaaaccuga

SEQ ID NO: 2512422 - RNA, 16 nt, Chlamydophila pneumoniae CWL029
aaucuaaaaucacacu

SEQ ID NO: 2512423 - RNA, 15 nt, Chlamydophila pneumoniae CWL029
aaucuaacucuugua

SEQ ID NO: 2512424 - RNA, 18 nt, Chlamydophila pneumoniae CWL029
aaucuaccgugaagauuu

SEQ ID NO: 2512425 - RNA, 15 nt, Chlamydophila pneumoniae CWL029
aaucuauagucuguu

SEQ ID NO: 2512426 - RNA, 17 nt, Chlamydophila pneumoniae CWL029
aaucuauccuucgaccu

SEQ ID NO: 2512427 - RNA, 21 nt, Chlamydophila pneumoniae CWL029
aaucuaucugcacuuucuuuu

SEQ ID NO: 2512428 - RNA, 19 nt, Chlamydophila pneumoniae CWL029
aaucucaaaaucaaauaga

SEQ ID NO: 2512429 - RNA, 22 nt, Chlamydophila pneumoniae CWL029
aaucucagugaacucuucaaga

SEQ ID NO: 2512430 - RNA, 18 nt, Chlamydophila pneumoniae CWL029
aaucucaucuggaaaagc

SEQ ID NO: 2512431 - RNA, 18 nt, Chlamydophila pneumoniae CWL029
aaucucauuccagcaucu

SEQ ID NO: 2512432 - RNA, 22 nt, Chlamydophila pneumoniae CWL029
aaucucauuccagcaucuucuc

SEQ ID NO: 2512433 - RNA, 22 nt, Chlamydophila pneumoniae CWL029
aaucuccaaacauuuuuaagga

SEQ ID NO: 2512434 - RNA, 16 nt, Chlamydophila pneumoniae CWL029
aaucuccucaucagag

SEQ ID NO: 2512435 - RNA, 14 nt, Chlamydophila pneumoniae CWL029
aaucuccucucuca

SEQ ID NO: 2512436 - RNA, 15 nt, Chlamydophila pneumoniae CWL029
aaucucgcuauucca

SEQ ID NO: 2512437 - RNA, 23 nt, Chlamydophila pneumoniae CWL029
aaucucgcuauuccauaaaaaug

SEQ ID NO: 2512438 - RNA, 16 nt, Chlamydophila pneumoniae CWL029
aaucucgggagaacau

SEQ ID NO: 2512439 - RNA, 17 nt, Chlamydophila pneumoniae CWL029
aaucucuaugcgcucua

SEQ ID NO: 2512440 - RNA, 21 nt, Chlamydophila pneumoniae CWL029
aaucucuuuaaaaauuaaagu

SEQ ID NO: 2512441 - RNA, 21 nt, Chlamydophila pneumoniae CWL029
aaucugaaugccugccaaucc

SEQ ID NO: 2512442 - RNA, 24 nt, Chlamydophila pneumoniae CWL029
aaucugacgugcauugaauccuuc

SEQ ID NO: 2512443 - RNA, 22 nt, Chlamydophila pneumoniae CWL029
aaucugagcacauuuuucuaua

SEQ ID NO: 2512444 - RNA, 14 nt, Chlamydophila pneumoniae CWL029
aaucugcaagauua

SEQ ID NO: 2512445 - RNA, 16 nt, Chlamydophila pneumoniae CWL029
aaucugcuauaaccaa

SEQ ID NO: 2512446 - RNA, 15 nt, Chlamydophila pneumoniae CWL029
aaucuggaaugacua

SEQ ID NO: 2512447 - RNA, 18 nt, Chlamydophila pneumoniae CWL029
aaucuggggcuuccagaa

SEQ ID NO: 2512448 - RNA, 19 nt, Chlamydophila pneumoniae CWL029
aaucuggggcuuccagaaa

SEQ ID NO: 2512449 - RNA, 19 nt, Chlamydophila pneumoniae CWL029
aaucugugaguacccaguc

SEQ ID NO: 2512450 - RNA, 17 nt, Chlamydophila pneumoniae CWL029
aaucuuaugggagaagc

SEQ ID NO: 2512451 - RNA, 17 nt, Chlamydophila pneumoniae CWL029
aaucuucgauuguaacu

SEQ ID NO: 2512452 - RNA, 19 nt, Chlamydophila pneumoniae CWL029
aaucuucuuagccaaaauu

SEQ ID NO: 2512453 - RNA, 19 nt, Chlamydophila pneumoniae CWL029
aaucuugagcauccaaaau

SEQ ID NO: 2512454 - RNA, 23 nt, Chlamydophila pneumoniae CWL029
aaucuugagcauccaaaaugucu

SEQ ID NO: 2512455 - RNA, 21 nt, Chlamydophila pneumoniae CWL029
aaucuuguagcaauuaccugc

SEQ ID NO: 2512456 - RNA, 18 nt, Chlamydophila pneumoniae CWL029
aaucuuuaagguugcuuu

SEQ ID NO: 2512457 - RNA, 17 nt, Chlamydophila pneumoniae CWL029
aaucuuucaaaagaaau

SEQ ID NO: 2512458 - RNA, 19 nt, Chlamydophila pneumoniae CWL029
aaucuuugaucgcuugugc

SEQ ID NO: 2512459 - RNA, 18 nt, Chlamydophila pneumoniae CWL029
aaugaaaagagacuguag

SEQ ID NO: 2512460 - RNA, 21 nt, Chlamydophila pneumoniae CWL029
aaugaaaccuucagaucgaau

SEQ ID NO: 2512461 - RNA, 18 nt, Chlamydophila pneumoniae CWL029
aaugaagucuucuuuccc

SEQ ID NO: 2512462 - RNA, 13 nt, Chlamydophila pneumoniae CWL029
aaugaaucgaaga

SEQ ID NO: 2512463 - RNA, 16 nt, Chlamydophila pneumoniae CWL029
aaugaaucgaagaaca

SEQ ID NO: 2512464 - RNA, 13 nt, Chlamydophila pneumoniae CWL029
aaugacacagaga

SEQ ID NO: 2512465 - RNA, 16 nt, Chlamydophila pneumoniae CWL029
aaugacagcugagaaa

SEQ ID NO: 2512466 - RNA, 22 nt, Chlamydophila pneumoniae CWL029
aaugacagcugagaaauuccua

SEQ ID NO: 2512467 - RNA, 21 nt, Chlamydophila pneumoniae CWL029
aaugaccgcaaggagucacug

SEQ ID NO: 2512468 - RNA, 16 nt, Chlamydophila pneumoniae CWL029
aaugacgggagcucuu

SEQ ID NO: 2512469 - RNA, 17 nt, Chlamydophila pneumoniae CWL029
aaugacuaaaugcgagg

SEQ ID NO: 2512470 - RNA, 19 nt, Chlamydophila pneumoniae CWL029
aaugacucuagaguacccc

SEQ ID NO: 2512471 - RNA, 20 nt, Chlamydophila pneumoniae CWL029
aaugacuuuagaaauuccaa

SEQ ID NO: 2512472 - RNA, 13 nt, Chlamydophila pneumoniae CWL029
aaugagacagaca

SEQ ID NO: 2512473 - RNA, 17 nt, Chlamydophila pneumoniae CWL029
aaugauauaaaagcuga

SEQ ID NO: 2512474 - RNA, 14 nt, Chlamydophila pneumoniae CWL029
aaugauauuacaga

SEQ ID NO: 2512475 - RNA, 20 nt, Chlamydophila pneumoniae CWL029
aaugauucauaacauugcuu

SEQ ID NO: 2512476 - RNA, 13 nt, Chlamydophila pneumoniae CWL029
aaugauuucucua

SEQ ID NO: 2512477 - RNA, 16 nt, Chlamydophila pneumoniae CWL029
aaugcaagcaacucuu

SEQ ID NO: 2512478 - RNA, 16 nt, Chlamydophila pneumoniae CWL029
aaugcacuuugaauaa

SEQ ID NO: 2512479 - RNA, 19 nt, Chlamydophila pneumoniae CWL029
aaugcagauagcuuacaga

SEQ ID NO: 2512480 - RNA, 20 nt, Chlamydophila pneumoniae CWL029
aaugcaguucuuguuaaagu

SEQ ID NO: 2512481 - RNA, 14 nt, Chlamydophila pneumoniae CWL029
aaugccaagggcuu

SEQ ID NO: 2512482 - RNA, 19 nt, Chlamydophila pneumoniae CWL029
aaugccauucuuaucugcu

SEQ ID NO: 2512483 - RNA, 16 nt, Chlamydophila pneumoniae CWL029
aaugcccuuuagggaa

SEQ ID NO: 2512484 - RNA, 21 nt, Chlamydophila pneumoniae CWL029
aaugccuguacuaucuuuuuu

SEQ ID NO: 2512485 - RNA, 20 nt, Chlamydophila pneumoniae CWL029
aaugcgaugcggucagaaac

SEQ ID NO: 2512486 - RNA, 22 nt, Chlamydophila pneumoniae CWL029
aaugcgaugcggucagaaacau

SEQ ID NO: 2512487 - RNA, 20 nt, Chlamydophila pneumoniae CWL029
aaugcuacgguuuucugccu

SEQ ID NO: 2512488 - RNA, 13 nt, Chlamydophila pneumoniae CWL029
aaugcuauuuucc

SEQ ID NO: 2512489 - RNA, 14 nt, Chlamydophila pneumoniae CWL029
aaugcucacuucuu

SEQ ID NO: 2512490 - RNA, 19 nt, Chlamydophila pneumoniae CWL029
aaugcugagggaucuucuc

SEQ ID NO: 2512491 - RNA, 18 nt, Chlamydophila pneumoniae CWL029
aaugcuguagauuguuag

SEQ ID NO: 2512492 - RNA, 16 nt, Chlamydophila pneumoniae CWL029
aauggaaauagagaaa

SEQ ID NO: 2512493 - RNA, 23 nt, Chlamydophila pneumoniae CWL029
aauggauuccauaggggaugauu

SEQ ID NO: 2512494 - RNA, 20 nt, Chlamydophila pneumoniae CWL029
aauggcagcuuggaugggaa

SEQ ID NO: 2512495 - RNA, 16 nt, Chlamydophila pneumoniae CWL029
aauggcaugaaagaua

SEQ ID NO: 2512496 - RNA, 21 nt, Chlamydophila pneumoniae CWL029
aauggcuuuuuuugucccaac

SEQ ID NO: 2512497 - RNA, 12 nt, Chlamydophila pneumoniae CWL029
aauguaauuuuu

SEQ ID NO: 2512498 - RNA, 22 nt, Chlamydophila pneumoniae CWL029
aauguagcuguuccaagagucu

SEQ ID NO: 2512499 - RNA, 16 nt, Chlamydophila pneumoniae CWL029
aauguagucaugauuu

SEQ ID NO: 2512500 - RNA, 24 nt, Chlamydophila pneumoniae CWL029
aauguauaggcauuaauaacuuua

SEQ ID NO: 2512501 - RNA, 21 nt, Chlamydophila pneumoniae CWL029
aauguaucggggauugcaaaa

SEQ ID NO: 2512502 - RNA, 14 nt, Chlamydophila pneumoniae CWL029
aaugucgucucaga

SEQ ID NO: 2512503 - RNA, 19 nt, Chlamydophila pneumoniae CWL029
aaugugacgcaagagacaa

SEQ ID NO: 2512504 - RNA, 23 nt, Chlamydophila pneumoniae CWL029
aaugugcaauaggaaaaaauacc

SEQ ID NO: 2512505 - RNA, 16 nt, Chlamydophila pneumoniae CWL029
aaugugcucggcacuu

SEQ ID NO: 2512506 - RNA, 22 nt, Chlamydophila pneumoniae CWL029
aaugugucuugcugauuuuugc

SEQ ID NO: 2512507 - RNA, 21 nt, Chlamydophila pneumoniae CWL029
aauguugggaugaucucguag

SEQ ID NO: 2512508 - RNA, 22 nt, Chlamydophila pneumoniae CWL029
aauguuuagaauuuguccuuug

SEQ ID NO: 2512509 - RNA, 19 nt, Chlamydophila pneumoniae CWL029
aauguuuggccaacagcua

SEQ ID NO: 2512510 - RNA, 19 nt, Chlamydophila pneumoniae CWL029
aauuaaacuuucuucucua

SEQ ID NO: 2512511 - RNA, 14 nt, Chlamydophila pneumoniae CWL029
aauuaacaacacuu

SEQ ID NO: 2512512 - RNA, 13 nt, Chlamydophila pneumoniae CWL029
aauuaacagagcg

SEQ ID NO: 2512513 - RNA, 15 nt, Chlamydophila pneumoniae CWL029
aauuaacagagcgcc

SEQ ID NO: 2512514 - RNA, 16 nt, Chlamydophila pneumoniae CWL029
aauuaacagagcgccu

SEQ ID NO: 2512515 - RNA, 14 nt, Chlamydophila pneumoniae CWL029
aauuaauaaaagag

SEQ ID NO: 2512516 - RNA, 18 nt, Chlamydophila pneumoniae CWL029
aauuaccuugagacaaag

SEQ ID NO: 2512517 - RNA, 21 nt, Chlamydophila pneumoniae CWL029
aauuaccuugagacaaagaau

SEQ ID NO: 2512518 - RNA, 20 nt, Chlamydophila pneumoniae CWL029
aauuacucgcucugcacgga

SEQ ID NO: 2512519 - RNA, 14 nt, Chlamydophila pneumoniae CWL029
aauuacuuggauaa

SEQ ID NO: 2512520 - RNA, 15 nt, Chlamydophila pneumoniae CWL029
aauuagaacagcaug

SEQ ID NO: 2512521 - RNA, 18 nt, Chlamydophila pneumoniae CWL029
aauuagagaaauuuuuaa

SEQ ID NO: 2512522 - RNA, 19 nt, Chlamydophila pneumoniae CWL029
aauuagagaaauuuuuaau

SEQ ID NO: 2512523 - RNA, 13 nt, Chlamydophila pneumoniae CWL029
aauuagagagaau

SEQ ID NO: 2512524 - RNA, 17 nt, Chlamydophila pneumoniae CWL029
aauuagggcuuuuacuc

SEQ ID NO: 2512525 - RNA, 12 nt, Chlamydophila pneumoniae CWL029
aauuaguaaaug

SEQ ID NO: 2512526 - RNA, 16 nt, Chlamydophila pneumoniae CWL029
aauuaguaaaugccuc

SEQ ID NO: 2512527 - RNA, 14 nt, Chlamydophila pneumoniae CWL029
aauuaucagagaca

SEQ ID NO: 2512528 - RNA, 18 nt, Chlamydophila pneumoniae CWL029
aauuaugcccaaggaaaa

SEQ ID NO: 2512529 - RNA, 20 nt, Chlamydophila pneumoniae CWL029
aauuaugcccaaggaaaaac

SEQ ID NO: 2512530 - RNA, 21 nt, Chlamydophila pneumoniae CWL029
aauuaugcccaaggaaaaaca

SEQ ID NO: 2512531 - RNA, 13 nt, Chlamydophila pneumoniae CWL029
aauuauuaaacuc

SEQ ID NO: 2512532 - RNA, 16 nt, Chlamydophila pneumoniae CWL029
aauuauuauuaguuaa

SEQ ID NO: 2512533 - RNA, 14 nt, Chlamydophila pneumoniae CWL029
aauucaaaaagaga

SEQ ID NO: 2512534 - RNA, 16 nt, Chlamydophila pneumoniae CWL029
aauucaaacuccuuuu

SEQ ID NO: 2512535 - RNA, 13 nt, Chlamydophila pneumoniae CWL029
aauucaaaucccu

SEQ ID NO: 2512536 - RNA, 13 nt, Chlamydophila pneumoniae CWL029
aauucagagaaag

SEQ ID NO: 2512537 - RNA, 20 nt, Chlamydophila pneumoniae CWL029
aauucaggacccuuuuccuc

SEQ ID NO: 2512538 - RNA, 15 nt, Chlamydophila pneumoniae CWL029
aauucauauuuacga

SEQ ID NO: 2512539 - RNA, 21 nt, Chlamydophila pneumoniae CWL029
aauucauccagauuagaaaag

SEQ ID NO: 2512540 - RNA, 15 nt, Chlamydophila pneumoniae CWL029
aauucaugcaaaaca

SEQ ID NO: 2512541 - RNA, 23 nt, Chlamydophila pneumoniae CWL029
aauucaugcaaaacaacaucacu

SEQ ID NO: 2512542 - RNA, 18 nt, Chlamydophila pneumoniae CWL029
aauuccaaaauaaaagga

SEQ ID NO: 2512543 - RNA, 15 nt, Chlamydophila pneumoniae CWL029
aauuccagaaaaaga

SEQ ID NO: 2512544 - RNA, 21 nt, Chlamydophila pneumoniae CWL029
aauuccagaaaaagaacauaa

SEQ ID NO: 2512545 - RNA, 15 nt, Chlamydophila pneumoniae CWL029
aauuccaucuggaau

SEQ ID NO: 2512546 - RNA, 21 nt, Chlamydophila pneumoniae CWL029
aauuccccguguuuggagaag

SEQ ID NO: 2512547 - RNA, 20 nt, Chlamydophila pneumoniae CWL029
aauucccguagguagagcug

SEQ ID NO: 2512548 - RNA, 16 nt, Chlamydophila pneumoniae CWL029
aauuccuucucagaaa

SEQ ID NO: 2512549 - RNA, 22 nt, Chlamydophila pneumoniae CWL029
aauuccuucucagaaagauauc

SEQ ID NO: 2512550 - RNA, 16 nt, Chlamydophila pneumoniae CWL029
aauucgaauucucaga

SEQ ID NO: 2512551 - RNA, 18 nt, Chlamydophila pneumoniae CWL029
aauucgaauucucagaaa

SEQ ID NO: 2512552 - RNA, 23 nt, Chlamydophila pneumoniae CWL029
aauucgauguuaaggcuuccaau

SEQ ID NO: 2512553 - RNA, 23 nt, Chlamydophila pneumoniae CWL029
aauucgcucagaaaauguaaaaa

SEQ ID NO: 2512554 - RNA, 16 nt, Chlamydophila pneumoniae CWL029
aauucggcagaaggcu

SEQ ID NO: 2512555 - RNA, 16 nt, Chlamydophila pneumoniae CWL029
aauucucaaggaucuu

SEQ ID NO: 2512556 - RNA, 16 nt, Chlamydophila pneumoniae CWL029
aauucucagaaagccu

SEQ ID NO: 2512557 - RNA, 16 nt, Chlamydophila pneumoniae CWL029
aauucucagauugcuu

SEQ ID NO: 2512558 - RNA, 15 nt, Chlamydophila pneumoniae CWL029
aauucucucucugca

SEQ ID NO: 2512559 - RNA, 18 nt, Chlamydophila pneumoniae CWL029
aauucucugacacuccuc

SEQ ID NO: 2512560 - RNA, 22 nt, Chlamydophila pneumoniae CWL029
aauucucugacacuccucagaa

SEQ ID NO: 2512561 - RNA, 18 nt, Chlamydophila pneumoniae CWL029
aauucugaagauauauuu

SEQ ID NO: 2512562 - RNA, 13 nt, Chlamydophila pneumoniae CWL029
aauucuuaaaaag

SEQ ID NO: 2512563 - RNA, 22 nt, Chlamydophila pneumoniae CWL029
aauucuuuaugagagagcucuu

SEQ ID NO: 2512564 - RNA, 22 nt, Chlamydophila pneumoniae CWL029
aauugagaaauauaacucucua

SEQ ID NO: 2512565 - RNA, 21 nt, Chlamydophila pneumoniae CWL029
aauugcaaaguacuacaauaa

SEQ ID NO: 2512566 - RNA, 18 nt, Chlamydophila pneumoniae CWL029
aauugcaucggacuguaa

SEQ ID NO: 2512567 - RNA, 22 nt, Chlamydophila pneumoniae CWL029
aauugcauuaagauaaacauua

SEQ ID NO: 2512568 - RNA, 13 nt, Chlamydophila pneumoniae CWL029
aauugcauucuua

SEQ ID NO: 2512569 - RNA, 16 nt, Chlamydophila pneumoniae CWL029
aauugcucuugcucua

SEQ ID NO: 2512570 - RNA, 21 nt, Chlamydophila pneumoniae CWL029
aauugcuggaggccaaagaac

SEQ ID NO: 2512571 - RNA, 16 nt, Chlamydophila pneumoniae CWL029
aauugcuguuccauaa

SEQ ID NO: 2512572 - RNA, 22 nt, Chlamydophila pneumoniae CWL029
aauugcuguuccauaauuuuag

SEQ ID NO: 2512573 - RNA, 22 nt, Chlamydophila pneumoniae CWL029
aauugcuugcgcaucagcagcu

SEQ ID NO: 2512574 - RNA, 13 nt, Chlamydophila pneumoniae CWL029
aauugcuuucccc

SEQ ID NO: 2512575 - RNA, 15 nt, Chlamydophila pneumoniae CWL029
aauugcuuucccccu

SEQ ID NO: 2512576 - RNA, 18 nt, Chlamydophila pneumoniae CWL029
aauuggcguaauaauucc

SEQ ID NO: 2512577 - RNA, 19 nt, Chlamydophila pneumoniae CWL029
aauugguggagcucauuua

SEQ ID NO: 2512578 - RNA, 12 nt, Chlamydophila pneumoniae CWL029
aauuguagagag

SEQ ID NO: 2512579 - RNA, 13 nt, Chlamydophila pneumoniae CWL029
aauuguagagaga

SEQ ID NO: 2512580 - RNA, 21 nt, Chlamydophila pneumoniae CWL029
aauuguaucuguauccuuccu

SEQ ID NO: 2512581 - RNA, 15 nt, Chlamydophila pneumoniae CWL029
aauugucuucagugc

SEQ ID NO: 2512582 - RNA, 15 nt, Chlamydophila pneumoniae CWL029
aauugugcucucuaa

SEQ ID NO: 2512583 - RNA, 17 nt, Chlamydophila pneumoniae CWL029
aauuguguguuuucaua

SEQ ID NO: 2512584 - RNA, 16 nt, Chlamydophila pneumoniae CWL029
aauuguuggaauugca

SEQ ID NO: 2512585 - RNA, 11 nt, Chlamydophila pneumoniae CWL029
aauuuaaauau

SEQ ID NO: 2512586 - RNA, 16 nt, Chlamydophila pneumoniae CWL029
aauuuaaaucugcaag

SEQ ID NO: 2512587 - RNA, 13 nt, Chlamydophila pneumoniae CWL029
aauuuaaaugccu

SEQ ID NO: 2512588 - RNA, 18 nt, Chlamydophila pneumoniae CWL029
aauuuagaggagacucua

SEQ ID NO: 2512589 - RNA, 22 nt, Chlamydophila pneumoniae CWL029
aauuucaaagaugcagauacua

SEQ ID NO: 2512590 - RNA, 19 nt, Chlamydophila pneumoniae CWL029
aauuucauuugaaauauga

SEQ ID NO: 2512591 - RNA, 16 nt, Chlamydophila pneumoniae CWL029
aauuuccaaaggaaaa

SEQ ID NO: 2512592 - RNA, 18 nt, Chlamydophila pneumoniae CWL029
aauuuccuaccuauauuu

SEQ ID NO: 2512593 - RNA, 21 nt, Chlamydophila pneumoniae CWL029
aauuuccuuagaagggaaagu

SEQ ID NO: 2512594 - RNA, 21 nt, Chlamydophila pneumoniae CWL029
aauuuccuucaggauuuucca

SEQ ID NO: 2512595 - RNA, 14 nt, Chlamydophila pneumoniae CWL029
aauuucgucuucau

SEQ ID NO: 2512596 - RNA, 20 nt, Chlamydophila pneumoniae CWL029
aauuucuccaguaucuucuc

SEQ ID NO: 2512597 - RNA, 22 nt, Chlamydophila pneumoniae CWL029
aauuucuccaguaucuucucuu

SEQ ID NO: 2512598 - RNA, 15 nt, Chlamydophila pneumoniae CWL029
aauuucuccuagguc

SEQ ID NO: 2512599 - RNA, 15 nt, Chlamydophila pneumoniae CWL029
aauuucugaaacaau

SEQ ID NO: 2512600 - RNA, 17 nt, Chlamydophila pneumoniae CWL029
aauuucugaaacaaugc

SEQ ID NO: 2512601 - RNA, 13 nt, Chlamydophila pneumoniae CWL029
aauuucuuauaaa

SEQ ID NO: 2512602 - RNA, 13 nt, Chlamydophila pneumoniae CWL029
aauuucuucauca

SEQ ID NO: 2512603 - RNA, 23 nt, Chlamydophila pneumoniae CWL029
aauuucuuguuccaauagagucu

SEQ ID NO: 2512604 - RNA, 18 nt, Chlamydophila pneumoniae CWL029
aauuucuuucacaucuuu

SEQ ID NO: 2512605 - RNA, 20 nt, Chlamydophila pneumoniae CWL029
aauuugauuuuucaaauucu

SEQ ID NO: 2512606 - RNA, 21 nt, Chlamydophila pneumoniae CWL029
aauuugcaagagccggaacuu

SEQ ID NO: 2512607 - RNA, 17 nt, Chlamydophila pneumoniae CWL029
aauuugccugaaauccu

SEQ ID NO: 2512608 - RNA, 14 nt, Chlamydophila pneumoniae CWL029
aauuugcgaagucc

SEQ ID NO: 2512609 - RNA, 23 nt, Chlamydophila pneumoniae CWL029
aauuugcguugcauguccauuaa

SEQ ID NO: 2512610 - RNA, 15 nt, Chlamydophila pneumoniae CWL029
aauuugcucuccugc

SEQ ID NO: 2512611 - RNA, 17 nt, Chlamydophila pneumoniae CWL029
aauuuggauuuauguuu

SEQ ID NO: 2512612 - RNA, 16 nt, Chlamydophila pneumoniae CWL029
aauuuuagcuucuuuu

SEQ ID NO: 2512613 - RNA, 20 nt, Chlamydophila pneumoniae CWL029
aauuuuauaggaauaacacc

SEQ ID NO: 2512614 - RNA, 22 nt, Chlamydophila pneumoniae CWL029
aauuuuauaggaauaacaccaa

SEQ ID NO: 2512615 - RNA, 18 nt, Chlamydophila pneumoniae CWL029
aauuuuauuaguuacuga

SEQ ID NO: 2512616 - RNA, 22 nt, Chlamydophila pneumoniae CWL029
aauuuucagccugucuauaaaa

SEQ ID NO: 2512617 - RNA, 18 nt, Chlamydophila pneumoniae CWL029
aauuuucagucuuccuuu

SEQ ID NO: 2512618 - RNA, 17 nt, Chlamydophila pneumoniae CWL029
aauuuucguaaccacag

SEQ ID NO: 2512619 - RNA, 22 nt, Chlamydophila pneumoniae CWL029
aauuuugauaccucuccgucau

SEQ ID NO: 2512620 - RNA, 15 nt, Chlamydophila pneumoniae CWL029
aauuuuucuaagaaa

SEQ ID NO: 2512621 - RNA, 19 nt, Chlamydophila pneumoniae CWL029
aauuuuugcuaaacaaugc

SEQ ID NO: 2512622 - RNA, 20 nt, Chlamydophila pneumoniae CWL029
acaaaaaagggaucuccuuc

SEQ ID NO: 2512623 - RNA, 17 nt, Chlamydophila pneumoniae CWL029
acaaaaaauaaaaucaa

SEQ ID NO: 2512624 - RNA, 13 nt, Chlamydophila pneumoniae CWL029
acaaaaaaucaau

SEQ ID NO: 2512625 - RNA, 15 nt, Chlamydophila pneumoniae CWL029
acaaaaacugcgcua

SEQ ID NO: 2512626 - RNA, 15 nt, Chlamydophila pneumoniae CWL029
acaaaaaggacucuu

SEQ ID NO: 2512627 - RNA, 16 nt, Chlamydophila pneumoniae CWL029
acaaaacaaaagccau

SEQ ID NO: 2512628 - RNA, 12 nt, Chlamydophila pneumoniae CWL029
acaaaauaaaac

SEQ ID NO: 2512629 - RNA, 20 nt, Chlamydophila pneumoniae CWL029
acaaaauccacauccuugua

SEQ ID NO: 2512630 - RNA, 20 nt, Chlamydophila pneumoniae CWL029
acaaaauucaugcaaaacaa

SEQ ID NO: 2512631 - RNA, 22 nt, Chlamydophila pneumoniae CWL029
acaaaauuucuuauaaaaaagg

SEQ ID NO: 2512632 - RNA, 18 nt, Chlamydophila pneumoniae CWL029
acaaacagauuuuucaag

SEQ ID NO: 2512633 - RNA, 23 nt, Chlamydophila pneumoniae CWL029
acaaacagauuuuucaagaacuc

SEQ ID NO: 2512634 - RNA, 12 nt, Chlamydophila pneumoniae CWL029
acaaacaucgaa

SEQ ID NO: 2512635 - RNA, 22 nt, Chlamydophila pneumoniae CWL029
acaaacaucgaaaccacagcaa

SEQ ID NO: 2512636 - RNA, 15 nt, Chlamydophila pneumoniae CWL029
acaaacuaaaucaac

SEQ ID NO: 2512637 - RNA, 21 nt, Chlamydophila pneumoniae CWL029
acaaacuaacauagauaaggu

SEQ ID NO: 2512638 - RNA, 21 nt, Chlamydophila pneumoniae CWL029
acaaacucuauuuucauauca

SEQ ID NO: 2512639 - RNA, 15 nt, Chlamydophila pneumoniae CWL029
acaaagaaccauaga

SEQ ID NO: 2512640 - RNA, 13 nt, Chlamydophila pneumoniae CWL029
acaaagccacagc

SEQ ID NO: 2512641 - RNA, 16 nt, Chlamydophila pneumoniae CWL029
acaaagcgucuaucua

SEQ ID NO: 2512642 - RNA, 21 nt, Chlamydophila pneumoniae CWL029
acaaagcucuccuucagaguu

SEQ ID NO: 2512643 - RNA, 15 nt, Chlamydophila pneumoniae CWL029
acaaaggcauaagau

SEQ ID NO: 2512644 - RNA, 17 nt, Chlamydophila pneumoniae CWL029
acaaaguaggauugaua

SEQ ID NO: 2512645 - RNA, 14 nt, Chlamydophila pneumoniae CWL029
acaaauaaacugac

SEQ ID NO: 2512646 - RNA, 14 nt, Chlamydophila pneumoniae CWL029
acaaauggcaugaa

SEQ ID NO: 2512647 - RNA, 22 nt, Chlamydophila pneumoniae CWL029
acaaaugugacgcaagagacaa

SEQ ID NO: 2512648 - RNA, 22 nt, Chlamydophila pneumoniae CWL029
acaacaaacuaccagaugccuu

SEQ ID NO: 2512649 - RNA, 13 nt, Chlamydophila pneumoniae CWL029
acaacaauaauac

SEQ ID NO: 2512650 - RNA, 14 nt, Chlamydophila pneumoniae CWL029
acaacagaaauguu

SEQ ID NO: 2512651 - RNA, 13 nt, Chlamydophila pneumoniae CWL029
acaacagagacaa

SEQ ID NO: 2512652 - RNA, 14 nt, Chlamydophila pneumoniae CWL029
acaacagagacaag

SEQ ID NO: 2512653 - RNA, 15 nt, Chlamydophila pneumoniae CWL029
acaacaguugcggag

SEQ ID NO: 2512654 - RNA, 17 nt, Chlamydophila pneumoniae CWL029
acaacauaaagaagguu

SEQ ID NO: 2512655 - RNA, 15 nt, Chlamydophila pneumoniae CWL029
acaacaucacuauca

SEQ ID NO: 2512656 - RNA, 14 nt, Chlamydophila pneumoniae CWL029
acaacaucaugaaa

SEQ ID NO: 2512657 - RNA, 17 nt, Chlamydophila pneumoniae CWL029
acaacaucaugaaauac

SEQ ID NO: 2512658 - RNA, 18 nt, Chlamydophila pneumoniae CWL029
acaacauugaguugguuu

SEQ ID NO: 2512659 - RNA, 16 nt, Chlamydophila pneumoniae CWL029
acaaccgccuuuauau

SEQ ID NO: 2512660 - RNA, 21 nt, Chlamydophila pneumoniae CWL029
acaaccuagaaucacauaaaa

SEQ ID NO: 2512661 - RNA, 17 nt, Chlamydophila pneumoniae CWL029
acaacgcaggaagaaca

SEQ ID NO: 2512662 - RNA, 17 nt, Chlamydophila pneumoniae CWL029
acaacgcugcuucucua

SEQ ID NO: 2512663 - RNA, 19 nt, Chlamydophila pneumoniae CWL029
acaacgcugcuucucuacu

SEQ ID NO: 2512664 - RNA, 22 nt, Chlamydophila pneumoniae CWL029
acaacgcugcuucucuacuaaa

SEQ ID NO: 2512665 - RNA, 23 nt, Chlamydophila pneumoniae CWL029
acaacgcugcuucucuacuaaaa

SEQ ID NO: 2512666 - RNA, 15 nt, Chlamydophila pneumoniae CWL029
acaacuagaccaaua

SEQ ID NO: 2512667 - RNA, 22 nt, Chlamydophila pneumoniae CWL029
acaacuagaccaauaaauccaa

SEQ ID NO: 2512668 - RNA, 13 nt, Chlamydophila pneumoniae CWL029
acaacuccuaagu

SEQ ID NO: 2512669 - RNA, 22 nt, Chlamydophila pneumoniae CWL029
acaacuucuaucuuacugaaga

SEQ ID NO: 2512670 - RNA, 15 nt, Chlamydophila pneumoniae CWL029
acaacuucugacaau

SEQ ID NO: 2512671 - RNA, 19 nt, Chlamydophila pneumoniae CWL029
acaagaaccuguuuuucua

SEQ ID NO: 2512672 - RNA, 20 nt, Chlamydophila pneumoniae CWL029
acaagaaccuguuuuucuaa

SEQ ID NO: 2512673 - RNA, 23 nt, Chlamydophila pneumoniae CWL029
acaagacaaugacuguaggaccu

SEQ ID NO: 2512674 - RNA, 18 nt, Chlamydophila pneumoniae CWL029
acaagacaccgaaagaaa

SEQ ID NO: 2512675 - RNA, 22 nt, Chlamydophila pneumoniae CWL029
acaagacgaaagcacauaagau

SEQ ID NO: 2512676 - RNA, 22 nt, Chlamydophila pneumoniae CWL029
acaagagagagcuggacuucug

SEQ ID NO: 2512677 - RNA, 19 nt, Chlamydophila pneumoniae CWL029
acaagagcgcauuuuacag

SEQ ID NO: 2512678 - RNA, 21 nt, Chlamydophila pneumoniae CWL029
acaagcaguaacugcaaagag

SEQ ID NO: 2512679 - RNA, 16 nt, Chlamydophila pneumoniae CWL029
acaagcauaaacuccu

SEQ ID NO: 2512680 - RNA, 19 nt, Chlamydophila pneumoniae CWL029
acaagccucccuaugugaa

SEQ ID NO: 2512681 - RNA, 15 nt, Chlamydophila pneumoniae CWL029
acaagcuucaucaaa

SEQ ID NO: 2512682 - RNA, 19 nt, Chlamydophila pneumoniae CWL029
acaagcuucaucaaaacau

SEQ ID NO: 2512683 - RNA, 14 nt, Chlamydophila pneumoniae CWL029
acaagcuuccuugg

SEQ ID NO: 2512684 - RNA, 16 nt, Chlamydophila pneumoniae CWL029
acaagggaaagaaacu

SEQ ID NO: 2512685 - RNA, 15 nt, Chlamydophila pneumoniae CWL029
acaaggucuuuuccu

SEQ ID NO: 2512686 - RNA, 21 nt, Chlamydophila pneumoniae CWL029
acaagugcauuaucuaagaau

SEQ ID NO: 2512687 - RNA, 17 nt, Chlamydophila pneumoniae CWL029
acaaguuuuuucaaucc

SEQ ID NO: 2512688 - RNA, 19 nt, Chlamydophila pneumoniae CWL029
acaaguuuuuucaauccuu

SEQ ID NO: 2512689 - RNA, 18 nt, Chlamydophila pneumoniae CWL029
acaauaaacgagacugca

SEQ ID NO: 2512690 - RNA, 22 nt, Chlamydophila pneumoniae CWL029
acaauaaccaggggcuuuccuu

SEQ ID NO: 2512691 - RNA, 13 nt, Chlamydophila pneumoniae CWL029
acaauaagaaaau

SEQ ID NO: 2512692 - RNA, 16 nt, Chlamydophila pneumoniae CWL029
acaauaccaucucuuu

SEQ ID NO: 2512693 - RNA, 17 nt, Chlamydophila pneumoniae CWL029
acaauaccaucucuuuc

SEQ ID NO: 2512694 - RNA, 15 nt, Chlamydophila pneumoniae CWL029
acaauacucucugcu

SEQ ID NO: 2512695 - RNA, 21 nt, Chlamydophila pneumoniae CWL029
acaauauaagcaccacgaccu

SEQ ID NO: 2512696 - RNA, 17 nt, Chlamydophila pneumoniae CWL029
acaauauagagaucuag

SEQ ID NO: 2512697 - RNA, 22 nt, Chlamydophila pneumoniae CWL029
acaauccucacuauuaauacuu

SEQ ID NO: 2512698 - RNA, 21 nt, Chlamydophila pneumoniae CWL029
acaaucuacggcauaaccuuu

SEQ ID NO: 2512699 - RNA, 19 nt, Chlamydophila pneumoniae CWL029
acaaucucgcuauuccaua

SEQ ID NO: 2512700 - RNA, 16 nt, Chlamydophila pneumoniae CWL029
acaaucucuuuaaaaa

SEQ ID NO: 2512701 - RNA, 22 nt, Chlamydophila pneumoniae CWL029
acaaugcgauacgaaggaucau

SEQ ID NO: 2512702 - RNA, 17 nt, Chlamydophila pneumoniae CWL029
acaauggaaauagagaa

SEQ ID NO: 2512703 - RNA, 10 nt, Chlamydophila pneumoniae CWL029
acaauguuua

SEQ ID NO: 2512704 - RNA, 14 nt, Chlamydophila pneumoniae CWL029
acaauguuuagaau

SEQ ID NO: 2512705 - RNA, 17 nt, Chlamydophila pneumoniae CWL029
acaauguuuagaauuug

SEQ ID NO: 2512706 - RNA, 14 nt, Chlamydophila pneumoniae CWL029
acaauuacaggaaa

SEQ ID NO: 2512707 - RNA, 23 nt, Chlamydophila pneumoniae CWL029
acaauuagagauucauaaaacug

SEQ ID NO: 2512708 - RNA, 20 nt, Chlamydophila pneumoniae CWL029
acaauucgauguuaaggcuu

SEQ ID NO: 2512709 - RNA, 21 nt, Chlamydophila pneumoniae CWL029
acaauuguaaauacaaaacaa

SEQ ID NO: 2512710 - RNA, 19 nt, Chlamydophila pneumoniae CWL029
acaauuuaaaucugcaaga

SEQ ID NO: 2512711 - RNA, 23 nt, Chlamydophila pneumoniae CWL029
acaauuuccuugguaucccaauc

SEQ ID NO: 2512712 - RNA, 20 nt, Chlamydophila pneumoniae CWL029
acaauuuuaaaaucuccucu

SEQ ID NO: 2512713 - RNA, 17 nt, Chlamydophila pneumoniae CWL029
acacaaaaagcuuuuuu

SEQ ID NO: 2512714 - RNA, 19 nt, Chlamydophila pneumoniae CWL029
acacaacucuuaaaucgcu

SEQ ID NO: 2512715 - RNA, 13 nt, Chlamydophila pneumoniae CWL029
acacaacucuuua

SEQ ID NO: 2512716 - RNA, 12 nt, Chlamydophila pneumoniae CWL029
acacacuuucuu

SEQ ID NO: 2512717 - RNA, 21 nt, Chlamydophila pneumoniae CWL029
acacaggggaacgcucucuag

SEQ ID NO: 2512718 - RNA, 20 nt, Chlamydophila pneumoniae CWL029
acacauugucucuuuuaaag

SEQ ID NO: 2512719 - RNA, 17 nt, Chlamydophila pneumoniae CWL029
acaccaaaagaauacuc

SEQ ID NO: 2512720 - RNA, 16 nt, Chlamydophila pneumoniae CWL029
acaccaacaacaauaa

SEQ ID NO: 2512721 - RNA, 14 nt, Chlamydophila pneumoniae CWL029
acaccaggaagucc

SEQ ID NO: 2512722 - RNA, 22 nt, Chlamydophila pneumoniae CWL029
acaccaggaaguccgauagcaa

SEQ ID NO: 2512723 - RNA, 20 nt, Chlamydophila pneumoniae CWL029
acaccaggaguuggagaauu

SEQ ID NO: 2512724 - RNA, 15 nt, Chlamydophila pneumoniae CWL029
acaccauagaacugc

SEQ ID NO: 2512725 - RNA, 21 nt, Chlamydophila pneumoniae CWL029
acacccucggauaggcuggaa

SEQ ID NO: 2512726 - RNA, 14 nt, Chlamydophila pneumoniae CWL029
acaccgaaagaaau

SEQ ID NO: 2512727 - RNA, 21 nt, Chlamydophila pneumoniae CWL029
acaccucuucucuauaaaaaa

SEQ ID NO: 2512728 - RNA, 21 nt, Chlamydophila pneumoniae CWL029
acaccugcccauuuuuggaaa

SEQ ID NO: 2512729 - RNA, 21 nt, Chlamydophila pneumoniae CWL029
acacgaauuucuaacuuaaua

SEQ ID NO: 2512730 - RNA, 13 nt, Chlamydophila pneumoniae CWL029
acacgacgaggac

SEQ ID NO: 2512731 - RNA, 15 nt, Chlamydophila pneumoniae CWL029
acacgaggagccucu

SEQ ID NO: 2512732 - RNA, 21 nt, Chlamydophila pneumoniae CWL029
acacgcuugugguuagaggaa

SEQ ID NO: 2512733 - RNA, 22 nt, Chlamydophila pneumoniae CWL029
acacgcuuuccuaaccauugcu

SEQ ID NO: 2512734 - RNA, 22 nt, Chlamydophila pneumoniae CWL029
acacucaaauucaaaauagaag

SEQ ID NO: 2512735 - RNA, 13 nt, Chlamydophila pneumoniae CWL029
acacucagagaug

SEQ ID NO: 2512736 - RNA, 14 nt, Chlamydophila pneumoniae CWL029
acacuccucagaau

SEQ ID NO: 2512737 - RNA, 12 nt, Chlamydophila pneumoniae CWL029
acacucuaucau

SEQ ID NO: 2512738 - RNA, 11 nt, Chlamydophila pneumoniae CWL029
acacucucuac

SEQ ID NO: 2512739 - RNA, 21 nt, Chlamydophila pneumoniae CWL029
acacugaacgccaucuccaca

SEQ ID NO: 2512740 - RNA, 18 nt, Chlamydophila pneumoniae CWL029
acacugcgagagaaaguc

SEQ ID NO: 2512741 - RNA, 16 nt, Chlamydophila pneumoniae CWL029
acacuuucaagauugu

SEQ ID NO: 2512742 - RNA, 17 nt, Chlamydophila pneumoniae CWL029
acacuuucuuuaaagaa

SEQ ID NO: 2512743 - RNA, 14 nt, Chlamydophila pneumoniae CWL029
acacuuuguuuuuc

SEQ ID NO: 2512744 - RNA, 16 nt, Chlamydophila pneumoniae CWL029
acagaaaggcuuuucu

SEQ ID NO: 2512745 - RNA, 20 nt, Chlamydophila pneumoniae CWL029
acagaaauugcuucuuccaa

SEQ ID NO: 2512746 - RNA, 21 nt, Chlamydophila pneumoniae CWL029
acagaagucuuggacguuccu

SEQ ID NO: 2512747 - RNA, 20 nt, Chlamydophila pneumoniae CWL029
acagaaguuccuacuucugc

SEQ ID NO: 2512748 - RNA, 15 nt, Chlamydophila pneumoniae CWL029
acagaaugauaagaa

SEQ ID NO: 2512749 - RNA, 16 nt, Chlamydophila pneumoniae CWL029
acagaaugauaagaaa

SEQ ID NO: 2512750 - RNA, 19 nt, Chlamydophila pneumoniae CWL029
acagagaauugcauucuua

SEQ ID NO: 2512751 - RNA, 20 nt, Chlamydophila pneumoniae CWL029
acagagcgccuccaccugca

SEQ ID NO: 2512752 - RNA, 21 nt, Chlamydophila pneumoniae CWL029
acagagucagaagcuauucca

SEQ ID NO: 2512753 - RNA, 12 nt, Chlamydophila pneumoniae CWL029
acagagucuggg

SEQ ID NO: 2512754 - RNA, 20 nt, Chlamydophila pneumoniae CWL029
acagagucugggauguucaa

SEQ ID NO: 2512755 - RNA, 23 nt, Chlamydophila pneumoniae CWL029
acagaguucgcgaccugugauuu

SEQ ID NO: 2512756 - RNA, 17 nt, Chlamydophila pneumoniae CWL029
acagauaagacaauaaa

SEQ ID NO: 2512757 - RNA, 20 nt, Chlamydophila pneumoniae CWL029
acagauaggguaagauugca

SEQ ID NO: 2512758 - RNA, 23 nt, Chlamydophila pneumoniae CWL029
acagaucugcauaauuuuucuua

SEQ ID NO: 2512759 - RNA, 15 nt, Chlamydophila pneumoniae CWL029
acagauguaaaugcu

SEQ ID NO: 2512760 - RNA, 15 nt, Chlamydophila pneumoniae CWL029
acagauuucuucuuc

SEQ ID NO: 2512761 - RNA, 18 nt, Chlamydophila pneumoniae CWL029
acagcaaaguaaugugcg

SEQ ID NO: 2512762 - RNA, 20 nt, Chlamydophila pneumoniae CWL029
acagcaaucugcagguaagg

SEQ ID NO: 2512763 - RNA, 13 nt, Chlamydophila pneumoniae CWL029
acagcacaggcau

SEQ ID NO: 2512764 - RNA, 14 nt, Chlamydophila pneumoniae CWL029
acagcaucaggauu

SEQ ID NO: 2512765 - RNA, 13 nt, Chlamydophila pneumoniae CWL029
acagcaucggcaa

SEQ ID NO: 2512766 - RNA, 18 nt, Chlamydophila pneumoniae CWL029
acagcauggacuccaaga

SEQ ID NO: 2512767 - RNA, 16 nt, Chlamydophila pneumoniae CWL029
acagccuguuuucuuc

SEQ ID NO: 2512768 - RNA, 19 nt, Chlamydophila pneumoniae CWL029
acagcgcgaucacuuuccu

SEQ ID NO: 2512769 - RNA, 14 nt, Chlamydophila pneumoniae CWL029
acagcguauaggaa

SEQ ID NO: 2512770 - RNA, 17 nt, Chlamydophila pneumoniae CWL029
acagcguguauccaucu

SEQ ID NO: 2512771 - RNA, 14 nt, Chlamydophila pneumoniae CWL029
acagcuaauacauc

SEQ ID NO: 2512772 - RNA, 13 nt, Chlamydophila pneumoniae CWL029
acagcuaaucaua

SEQ ID NO: 2512773 - RNA, 12 nt, Chlamydophila pneumoniae CWL029
acagcuccauuu

SEQ ID NO: 2512774 - RNA, 16 nt, Chlamydophila pneumoniae CWL029
acagcuccauuuaaau

SEQ ID NO: 2512775 - RNA, 18 nt, Chlamydophila pneumoniae CWL029
acagcugggaucuggcuc

SEQ ID NO: 2512776 - RNA, 19 nt, Chlamydophila pneumoniae CWL029
acagcugggaucuggcuca

SEQ ID NO: 2512777 - RNA, 14 nt, Chlamydophila pneumoniae CWL029
acagcuucuuuucc

SEQ ID NO: 2512778 - RNA, 15 nt, Chlamydophila pneumoniae CWL029
acagcuucuuuucca

SEQ ID NO: 2512779 - RNA, 18 nt, Chlamydophila pneumoniae CWL029
acagcuucuuuuccagca

SEQ ID NO: 2512780 - RNA, 16 nt, Chlamydophila pneumoniae CWL029
acagcuuuaaucagag

SEQ ID NO: 2512781 - RNA, 14 nt, Chlamydophila pneumoniae CWL029
acaggaauaggcuc

SEQ ID NO: 2512782 - RNA, 18 nt, Chlamydophila pneumoniae CWL029
acaggaauaggcucuuua

SEQ ID NO: 2512783 - RNA, 20 nt, Chlamydophila pneumoniae CWL029
acaggaauucucaucggcau

SEQ ID NO: 2512784 - RNA, 12 nt, Chlamydophila pneumoniae CWL029
acaggagaagcg

SEQ ID NO: 2512785 - RNA, 15 nt, Chlamydophila pneumoniae CWL029
acaggagagagaagg

SEQ ID NO: 2512786 - RNA, 16 nt, Chlamydophila pneumoniae CWL029
acaggagcuagaagag

SEQ ID NO: 2512787 - RNA, 19 nt, Chlamydophila pneumoniae CWL029
acaggcaggccacuuccua

SEQ ID NO: 2512788 - RNA, 19 nt, Chlamydophila pneumoniae CWL029
acaggcucaugaaauuuca

SEQ ID NO: 2512789 - RNA, 19 nt, Chlamydophila pneumoniae CWL029
acaggcuucaucacauuaa

SEQ ID NO: 2512790 - RNA, 15 nt, Chlamydophila pneumoniae CWL029
acagguaauacccuc

SEQ ID NO: 2512791 - RNA, 13 nt, Chlamydophila pneumoniae CWL029
acagguucacuuc

SEQ ID NO: 2512792 - RNA, 22 nt, Chlamydophila pneumoniae CWL029
acaguaggcgaugcaaauucca

SEQ ID NO: 2512793 - RNA, 12 nt, Chlamydophila pneumoniae CWL029
acagucauaaaa

SEQ ID NO: 2512794 - RNA, 17 nt, Chlamydophila pneumoniae CWL029
acagucugugagaaaua

SEQ ID NO: 2512795 - RNA, 18 nt, Chlamydophila pneumoniae CWL029
acagugauuuagaaaucu

SEQ ID NO: 2512796 - RNA, 21 nt, Chlamydophila pneumoniae CWL029
acagugauuuagaaaucucac

SEQ ID NO: 2512797 - RNA, 20 nt, Chlamydophila pneumoniae CWL029
acagugguaugcuuuuccuu

SEQ ID NO: 2512798 - RNA, 16 nt, Chlamydophila pneumoniae CWL029
acaguucuuucugcuu

SEQ ID NO: 2512799 - RNA, 19 nt, Chlamydophila pneumoniae CWL029
acaguuggcguuuucuaga

SEQ ID NO: 2512800 - RNA, 16 nt, Chlamydophila pneumoniae CWL029
acaguuugagaaagac

SEQ ID NO: 2512801 - RNA, 18 nt, Chlamydophila pneumoniae CWL029
acaguuugagaaagacca

SEQ ID NO: 2512802 - RNA, 19 nt, Chlamydophila pneumoniae CWL029
acauaaagaagguuucuag

SEQ ID NO: 2512803 - RNA, 21 nt, Chlamydophila pneumoniae CWL029
acauaaagaucuuuauuuuua

SEQ ID NO: 2512804 - RNA, 13 nt, Chlamydophila pneumoniae CWL029
acauaaagucaaa

SEQ ID NO: 2512805 - RNA, 12 nt, Chlamydophila pneumoniae CWL029
acauaaaucaac

SEQ ID NO: 2512806 - RNA, 20 nt, Chlamydophila pneumoniae CWL029
acauaaaucaacaucacaau

SEQ ID NO: 2512807 - RNA, 15 nt, Chlamydophila pneumoniae CWL029
acauaacacuuuguu

SEQ ID NO: 2512808 - RNA, 21 nt, Chlamydophila pneumoniae CWL029
acauaaccucggucucgcugu

SEQ ID NO: 2512809 - RNA, 18 nt, Chlamydophila pneumoniae CWL029
acauacucgucaaauuca

SEQ ID NO: 2512810 - RNA, 22 nt, Chlamydophila pneumoniae CWL029
acauagaaaacauaucccauag

SEQ ID NO: 2512811 - RNA, 15 nt, Chlamydophila pneumoniae CWL029
acauagacuuugagu

SEQ ID NO: 2512812 - RNA, 18 nt, Chlamydophila pneumoniae CWL029
acauagggaaaguucagu

SEQ ID NO: 2512813 - RNA, 21 nt, Chlamydophila pneumoniae CWL029
acauaguuuuuauuuuuaaau

SEQ ID NO: 2512814 - RNA, 13 nt, Chlamydophila pneumoniae CWL029
acauauccaauga

SEQ ID NO: 2512815 - RNA, 22 nt, Chlamydophila pneumoniae CWL029
acauaucuccuuuaaauaaaau

SEQ ID NO: 2512816 - RNA, 23 nt, Chlamydophila pneumoniae CWL029
acauaucuccuuuaaauaaaauc

SEQ ID NO: 2512817 - RNA, 14 nt, Chlamydophila pneumoniae CWL029
acauauucuccuua

SEQ ID NO: 2512818 - RNA, 22 nt, Chlamydophila pneumoniae CWL029
acauauucuccuuaccaauaug

SEQ ID NO: 2512819 - RNA, 15 nt, Chlamydophila pneumoniae CWL029
acauauugaagauau

SEQ ID NO: 2512820 - RNA, 15 nt, Chlamydophila pneumoniae CWL029
acaucaaaaugcugc

SEQ ID NO: 2512821 - RNA, 14 nt, Chlamydophila pneumoniae CWL029
acaucaaagcaauu

SEQ ID NO: 2512822 - RNA, 16 nt, Chlamydophila pneumoniae CWL029
acaucaaauaguucau

SEQ ID NO: 2512823 - RNA, 14 nt, Chlamydophila pneumoniae CWL029
acaucacuaucaug

SEQ ID NO: 2512824 - RNA, 19 nt, Chlamydophila pneumoniae CWL029
acaucacuuauauuuucua

SEQ ID NO: 2512825 - RNA, 18 nt, Chlamydophila pneumoniae CWL029
acaucagacugaagagca

SEQ ID NO: 2512826 - RNA, 13 nt, Chlamydophila pneumoniae CWL029
acaucagcaacau

SEQ ID NO: 2512827 - RNA, 13 nt, Chlamydophila pneumoniae CWL029
acaucaucagaag

SEQ ID NO: 2512828 - RNA, 19 nt, Chlamydophila pneumoniae CWL029
acaucaucagaagcuccug

SEQ ID NO: 2512829 - RNA, 16 nt, Chlamydophila pneumoniae CWL029
acauccauucuuaaua

SEQ ID NO: 2512830 - RNA, 21 nt, Chlamydophila pneumoniae CWL029
acaucccccgggaagcugucg

SEQ ID NO: 2512831 - RNA, 17 nt, Chlamydophila pneumoniae CWL029
acauccuggagcaugag

SEQ ID NO: 2512832 - RNA, 18 nt, Chlamydophila pneumoniae CWL029
acauccuggagcaugaga

SEQ ID NO: 2512833 - RNA, 13 nt, Chlamydophila pneumoniae CWL029
acauccuguaguu

SEQ ID NO: 2512834 - RNA, 18 nt, Chlamydophila pneumoniae CWL029
acauccuuguagaacuuc

SEQ ID NO: 2512835 - RNA, 21 nt, Chlamydophila pneumoniae CWL029
acauccuuguagaacuucuca

SEQ ID NO: 2512836 - RNA, 14 nt, Chlamydophila pneumoniae CWL029
acaucuaacucuaa

SEQ ID NO: 2512837 - RNA, 22 nt, Chlamydophila pneumoniae CWL029
acaucuccaagauaauuaugua

SEQ ID NO: 2512838 - RNA, 22 nt, Chlamydophila pneumoniae CWL029
acaucuccaagccaugcaauga

SEQ ID NO: 2512839 - RNA, 12 nt, Chlamydophila pneumoniae CWL029
acaucuccugca

SEQ ID NO: 2512840 - RNA, 12 nt, Chlamydophila pneumoniae CWL029
acaucuccuuuc

SEQ ID NO: 2512841 - RNA, 15 nt, Chlamydophila pneumoniae CWL029
acaucugugauuaau

SEQ ID NO: 2512842 - RNA, 14 nt, Chlamydophila pneumoniae CWL029
acaucuuaaaaacu

SEQ ID NO: 2512843 - RNA, 19 nt, Chlamydophila pneumoniae CWL029
acaucuuguucugcacgug

SEQ ID NO: 2512844 - RNA, 15 nt, Chlamydophila pneumoniae CWL029
acaucuuuagaauca

SEQ ID NO: 2512845 - RNA, 13 nt, Chlamydophila pneumoniae CWL029
acaucuuucucua

SEQ ID NO: 2512846 - RNA, 23 nt, Chlamydophila pneumoniae CWL029
acaucuuuguggggcaguaggua

SEQ ID NO: 2512847 - RNA, 16 nt, Chlamydophila pneumoniae CWL029
acaugacaaauaaacu

SEQ ID NO: 2512848 - RNA, 17 nt, Chlamydophila pneumoniae CWL029
acaugacaaauaaacug

SEQ ID NO: 2512849 - RNA, 12 nt, Chlamydophila pneumoniae CWL029
acaugagauacg

SEQ ID NO: 2512850 - RNA, 20 nt, Chlamydophila pneumoniae CWL029
acaugaggauucuuuuugau

SEQ ID NO: 2512851 - RNA, 13 nt, Chlamydophila pneumoniae CWL029
acaugcccaaaca

SEQ ID NO: 2512852 - RNA, 13 nt, Chlamydophila pneumoniae CWL029
acaugccugaaaa

SEQ ID NO: 2512853 - RNA, 22 nt, Chlamydophila pneumoniae CWL029
acaugccugaaaacaaggcaaa

SEQ ID NO: 2512854 - RNA, 14 nt, Chlamydophila pneumoniae CWL029
acaugccuuaggcu

SEQ ID NO: 2512855 - RNA, 19 nt, Chlamydophila pneumoniae CWL029
acaugcgaagggaggagaa

SEQ ID NO: 2512856 - RNA, 23 nt, Chlamydophila pneumoniae CWL029
acaugcgcagaauaaaauggccu

SEQ ID NO: 2512857 - RNA, 16 nt, Chlamydophila pneumoniae CWL029
acaugcgcguauaagg

SEQ ID NO: 2512858 - RNA, 15 nt, Chlamydophila pneumoniae CWL029
acaugcucaagaaga

SEQ ID NO: 2512859 - RNA, 18 nt, Chlamydophila pneumoniae CWL029
acaugcucaagaagauga

SEQ ID NO: 2512860 - RNA, 17 nt, Chlamydophila pneumoniae CWL029
acauguugguagaggcu

SEQ ID NO: 2512861 - RNA, 22 nt, Chlamydophila pneumoniae CWL029
acauuaagcucaaaauuuccuc

SEQ ID NO: 2512862 - RNA, 22 nt, Chlamydophila pneumoniae CWL029
acauuaccguucccuaaaguaa

SEQ ID NO: 2512863 - RNA, 13 nt, Chlamydophila pneumoniae CWL029
acauuagagagug

SEQ ID NO: 2512864 - RNA, 19 nt, Chlamydophila pneumoniae CWL029
acauucaggauacucugaa

SEQ ID NO: 2512865 - RNA, 16 nt, Chlamydophila pneumoniae CWL029
acauuccaaugcauga

SEQ ID NO: 2512866 - RNA, 22 nt, Chlamydophila pneumoniae CWL029
acauucuccgccagaguuuaaa

SEQ ID NO: 2512867 - RNA, 23 nt, Chlamydophila pneumoniae CWL029
acauugcgggcucaaagaaaguc

SEQ ID NO: 2512868 - RNA, 22 nt, Chlamydophila pneumoniae CWL029
acauugcugccaggcuuaaaua

SEQ ID NO: 2512869 - RNA, 14 nt, Chlamydophila pneumoniae CWL029
acauuguuuaaguc

SEQ ID NO: 2512870 - RNA, 13 nt, Chlamydophila pneumoniae CWL029
acauuuagaagua

SEQ ID NO: 2512871 - RNA, 22 nt, Chlamydophila pneumoniae CWL029
acauuucucaccacggaagaua

SEQ ID NO: 2512872 - RNA, 23 nt, Chlamydophila pneumoniae CWL029
acauuucuugauccaucugcucu

SEQ ID NO: 2512873 - RNA, 19 nt, Chlamydophila pneumoniae CWL029
acauuuguugucagcuuug

SEQ ID NO: 2512874 - RNA, 21 nt, Chlamydophila pneumoniae CWL029
acauuuguugucagcuuugcu

SEQ ID NO: 2512875 - RNA, 12 nt, Chlamydophila pneumoniae CWL029
acauuuugguau

SEQ ID NO: 2512876 - RNA, 19 nt, Chlamydophila pneumoniae CWL029
accaaagucgauacccaaa

SEQ ID NO: 2512877 - RNA, 19 nt, Chlamydophila pneumoniae CWL029
accaaagugacuuccucca

SEQ ID NO: 2512878 - RNA, 15 nt, Chlamydophila pneumoniae CWL029
accaaauaauuaaau

SEQ ID NO: 2512879 - RNA, 22 nt, Chlamydophila pneumoniae CWL029
accaaaucaucgcaaucaaaga

SEQ ID NO: 2512880 - RNA, 14 nt, Chlamydophila pneumoniae CWL029
accaaauccuccug

SEQ ID NO: 2512881 - RNA, 13 nt, Chlamydophila pneumoniae CWL029
accaaaucuaucu

SEQ ID NO: 2512882 - RNA, 17 nt, Chlamydophila pneumoniae CWL029
accaacacuuuuaaaga

SEQ ID NO: 2512883 - RNA, 19 nt, Chlamydophila pneumoniae CWL029
accaaccuuguugaaaggc

SEQ ID NO: 2512884 - RNA, 15 nt, Chlamydophila pneumoniae CWL029
accaacugagcuauu

SEQ ID NO: 2512885 - RNA, 17 nt, Chlamydophila pneumoniae CWL029
accaagacaauggaaau

SEQ ID NO: 2512886 - RNA, 23 nt, Chlamydophila pneumoniae CWL029
accaagaugucuccaaagauaca

SEQ ID NO: 2512887 - RNA, 23 nt, Chlamydophila pneumoniae CWL029
accaaggggcguucuugaaaaaa

SEQ ID NO: 2512888 - RNA, 16 nt, Chlamydophila pneumoniae CWL029
accaaguaaaucagac

SEQ ID NO: 2512889 - RNA, 20 nt, Chlamydophila pneumoniae CWL029
accaaguaaaucagacuuaa

SEQ ID NO: 2512890 - RNA, 22 nt, Chlamydophila pneumoniae CWL029
accaaguacaguaucgacuuuu

SEQ ID NO: 2512891 - RNA, 20 nt, Chlamydophila pneumoniae CWL029
accaauaaacuuugugggga

SEQ ID NO: 2512892 - RNA, 20 nt, Chlamydophila pneumoniae CWL029
accaauaaauccaaaaaaug

SEQ ID NO: 2512893 - RNA, 21 nt, Chlamydophila pneumoniae CWL029
accaauaaccgaaacuucuca

SEQ ID NO: 2512894 - RNA, 14 nt, Chlamydophila pneumoniae CWL029
accaauacagcaua

SEQ ID NO: 2512895 - RNA, 14 nt, Chlamydophila pneumoniae CWL029
accaauaugcucug

SEQ ID NO: 2512896 - RNA, 20 nt, Chlamydophila pneumoniae CWL029
accaaucuugagcauccaaa

SEQ ID NO: 2512897 - RNA, 23 nt, Chlamydophila pneumoniae CWL029
accaaucuugagcauccaaaaug

SEQ ID NO: 2512898 - RNA, 20 nt, Chlamydophila pneumoniae CWL029
accaaugauaauuucauuau

SEQ ID NO: 2512899 - RNA, 19 nt, Chlamydophila pneumoniae CWL029
accaaugaucguagcuaaa

SEQ ID NO: 2512900 - RNA, 18 nt, Chlamydophila pneumoniae CWL029
accaauugagcucucuag

SEQ ID NO: 2512901 - RNA, 18 nt, Chlamydophila pneumoniae CWL029
accacaauuccuaaaaca

SEQ ID NO: 2512902 - RNA, 22 nt, Chlamydophila pneumoniae CWL029
accacaauuccuaaaacaagaa

SEQ ID NO: 2512903 - RNA, 20 nt, Chlamydophila pneumoniae CWL029
accacagaggucgauuugaa

SEQ ID NO: 2512904 - RNA, 19 nt, Chlamydophila pneumoniae CWL029
accacagcuguacagaaca

SEQ ID NO: 2512905 - RNA, 19 nt, Chlamydophila pneumoniae CWL029
accacauacucuucauccu

SEQ ID NO: 2512906 - RNA, 17 nt, Chlamydophila pneumoniae CWL029
accaccccaaagcagau

SEQ ID NO: 2512907 - RNA, 13 nt, Chlamydophila pneumoniae CWL029
accaccuaaaaug

SEQ ID NO: 2512908 - RNA, 13 nt, Chlamydophila pneumoniae CWL029
accaccuucccca

SEQ ID NO: 2512909 - RNA, 16 nt, Chlamydophila pneumoniae CWL029
accacgaaauguuaaa

SEQ ID NO: 2512910 - RNA, 22 nt, Chlamydophila pneumoniae CWL029
accacgaacuucagcaagaaaa

SEQ ID NO: 2512911 - RNA, 18 nt, Chlamydophila pneumoniae CWL029
accacgcaucuuaagaga

SEQ ID NO: 2512912 - RNA, 19 nt, Chlamydophila pneumoniae CWL029
accacgcaucuuaagagaa

SEQ ID NO: 2512913 - RNA, 17 nt, Chlamydophila pneumoniae CWL029
accacggauuuucucua

SEQ ID NO: 2512914 - RNA, 19 nt, Chlamydophila pneumoniae CWL029
accacuaccgaauuuucaa

SEQ ID NO: 2512915 - RNA, 19 nt, Chlamydophila pneumoniae CWL029
accacuuaggguucucaaa

SEQ ID NO: 2512916 - RNA, 19 nt, Chlamydophila pneumoniae CWL029
accacuuuagaauuuucuu

SEQ ID NO: 2512917 - RNA, 14 nt, Chlamydophila pneumoniae CWL029
accagaagacuccc

SEQ ID NO: 2512918 - RNA, 16 nt, Chlamydophila pneumoniae CWL029
accagaagacucccaa

SEQ ID NO: 2512919 - RNA, 17 nt, Chlamydophila pneumoniae CWL029
accagaagcaugaauga

SEQ ID NO: 2512920 - RNA, 21 nt, Chlamydophila pneumoniae CWL029
accagaaggaagguucucaaa

SEQ ID NO: 2512921 - RNA, 15 nt, Chlamydophila pneumoniae CWL029
accagauaaagcaaa

SEQ ID NO: 2512922 - RNA, 23 nt, Chlamydophila pneumoniae CWL029
accagauaaagcaaagauaaaga

SEQ ID NO: 2512923 - RNA, 15 nt, Chlamydophila pneumoniae CWL029
accagaugcuaaaga

SEQ ID NO: 2512924 - RNA, 21 nt, Chlamydophila pneumoniae CWL029
accagcauuaagauaaacagc

SEQ ID NO: 2512925 - RNA, 23 nt, Chlamydophila pneumoniae CWL029
accagcauuaagauaaacagcac

SEQ ID NO: 2512926 - RNA, 23 nt, Chlamydophila pneumoniae CWL029
accagcucgagaucuuuuugcca

SEQ ID NO: 2512927 - RNA, 14 nt, Chlamydophila pneumoniae CWL029
accagggagaccua

SEQ ID NO: 2512928 - RNA, 14 nt, Chlamydophila pneumoniae CWL029
accauaaagaauuc

SEQ ID NO: 2512929 - RNA, 18 nt, Chlamydophila pneumoniae CWL029
accauaaggagauuccua

SEQ ID NO: 2512930 - RNA, 14 nt, Chlamydophila pneumoniae CWL029
accaucaagguauu

SEQ ID NO: 2512931 - RNA, 23 nt, Chlamydophila pneumoniae CWL029
accaucaugaaucuuaugggaga

SEQ ID NO: 2512932 - RNA, 18 nt, Chlamydophila pneumoniae CWL029
accauccgacuuuccuca

SEQ ID NO: 2512933 - RNA, 22 nt, Chlamydophila pneumoniae CWL029
accauccgacuuuccucaaagc

SEQ ID NO: 2512934 - RNA, 20 nt, Chlamydophila pneumoniae CWL029
accaucugcguuuaaggguu

SEQ ID NO: 2512935 - RNA, 22 nt, Chlamydophila pneumoniae CWL029
accaugaccuuuagcugcugaa

SEQ ID NO: 2512936 - RNA, 13 nt, Chlamydophila pneumoniae CWL029
accaugaggcugc

SEQ ID NO: 2512937 - RNA, 14 nt, Chlamydophila pneumoniae CWL029
accauuaaauugua

SEQ ID NO: 2512938 - RNA, 13 nt, Chlamydophila pneumoniae CWL029
accauuaagauau

SEQ ID NO: 2512939 - RNA, 18 nt, Chlamydophila pneumoniae CWL029
acccaauucuuaaaaagc

SEQ ID NO: 2512940 - RNA, 14 nt, Chlamydophila pneumoniae CWL029
acccaccagaagga

SEQ ID NO: 2512941 - RNA, 16 nt, Chlamydophila pneumoniae CWL029
acccaccauucuugaa

SEQ ID NO: 2512942 - RNA, 22 nt, Chlamydophila pneumoniae CWL029
acccaccauucuugaagaucuc

SEQ ID NO: 2512943 - RNA, 20 nt, Chlamydophila pneumoniae CWL029
acccagagaauguucccaaa

SEQ ID NO: 2512944 - RNA, 21 nt, Chlamydophila pneumoniae CWL029
acccagagaauguucccaaau

SEQ ID NO: 2512945 - RNA, 18 nt, Chlamydophila pneumoniae CWL029
acccaguuguauccagcu

SEQ ID NO: 2512946 - RNA, 23 nt, Chlamydophila pneumoniae CWL029
acccaguuguauccagcucaagg

SEQ ID NO: 2512947 - RNA, 14 nt, Chlamydophila pneumoniae CWL029
acccauaaucccua

SEQ ID NO: 2512948 - RNA, 20 nt, Chlamydophila pneumoniae CWL029
acccauauuugaauaaagga

SEQ ID NO: 2512949 - RNA, 13 nt, Chlamydophila pneumoniae CWL029
acccaucuagaaa

SEQ ID NO: 2512950 - RNA, 22 nt, Chlamydophila pneumoniae CWL029
acccauguuucuuccugaauca

SEQ ID NO: 2512951 - RNA, 23 nt, Chlamydophila pneumoniae CWL029
acccauugaauuuaugggugaga

SEQ ID NO: 2512952 - RNA, 13 nt, Chlamydophila pneumoniae CWL029
accccaaagcaga

SEQ ID NO: 2512953 - RNA, 20 nt, Chlamydophila pneumoniae CWL029
accccaaagcagauccugcu

SEQ ID NO: 2512954 - RNA, 16 nt, Chlamydophila pneumoniae CWL029
acccccacuucuuuuu

SEQ ID NO: 2512955 - RNA, 12 nt, Chlamydophila pneumoniae CWL029
acccccgcagcu

SEQ ID NO: 2512956 - RNA, 20 nt, Chlamydophila pneumoniae CWL029
acccuagguagcucgagauu

SEQ ID NO: 2512957 - RNA, 14 nt, Chlamydophila pneumoniae CWL029
acccucaaagaaua

SEQ ID NO: 2512958 - RNA, 15 nt, Chlamydophila pneumoniae CWL029
acccucaaagaauac

SEQ ID NO: 2512959 - RNA, 17 nt, Chlamydophila pneumoniae CWL029
acccucaaauuggaauu

SEQ ID NO: 2512960 - RNA, 14 nt, Chlamydophila pneumoniae CWL029
acccuccuuuguau

SEQ ID NO: 2512961 - RNA, 19 nt, Chlamydophila pneumoniae CWL029
acccugggcucacucuaag

SEQ ID NO: 2512962 - RNA, 18 nt, Chlamydophila pneumoniae CWL029
acccuucagaauucucaa

SEQ ID NO: 2512963 - RNA, 20 nt, Chlamydophila pneumoniae CWL029
acccuuuauacuguuuuucu

SEQ ID NO: 2512964 - RNA, 15 nt, Chlamydophila pneumoniae CWL029
accgaaacuucucag

SEQ ID NO: 2512965 - RNA, 13 nt, Chlamydophila pneumoniae CWL029
accgaacagagcg

SEQ ID NO: 2512966 - RNA, 14 nt, Chlamydophila pneumoniae CWL029
accgaaucucucca

SEQ ID NO: 2512967 - RNA, 16 nt, Chlamydophila pneumoniae CWL029
accgaaucucuccagc

SEQ ID NO: 2512968 - RNA, 19 nt, Chlamydophila pneumoniae CWL029
accgaauuuucaauuguaa

SEQ ID NO: 2512969 - RNA, 21 nt, Chlamydophila pneumoniae CWL029
accgacauacucgucaaauuc

SEQ ID NO: 2512970 - RNA, 22 nt, Chlamydophila pneumoniae CWL029
accgagaagcuucaaugaugug

SEQ ID NO: 2512971 - RNA, 17 nt, Chlamydophila pneumoniae CWL029
accgagaugaacauaau

SEQ ID NO: 2512972 - RNA, 19 nt, Chlamydophila pneumoniae CWL029
accgagcuuuuugcuuuuc

SEQ ID NO: 2512973 - RNA, 22 nt, Chlamydophila pneumoniae CWL029
accgaucucaguaggagcagcg

SEQ ID NO: 2512974 - RNA, 20 nt, Chlamydophila pneumoniae CWL029
accgaugauaccaagaugaa

SEQ ID NO: 2512975 - RNA, 23 nt, Chlamydophila pneumoniae CWL029
accgccugacgauaguacuuauc

SEQ ID NO: 2512976 - RNA, 15 nt, Chlamydophila pneumoniae CWL029
accgcgagugugacu

SEQ ID NO: 2512977 - RNA, 18 nt, Chlamydophila pneumoniae CWL029
accgcgagugugacugca

SEQ ID NO: 2512978 - RNA, 18 nt, Chlamydophila pneumoniae CWL029
accgcuaguauuaagaua

SEQ ID NO: 2512979 - RNA, 18 nt, Chlamydophila pneumoniae CWL029
accggacugacuucuaug

SEQ ID NO: 2512980 - RNA, 14 nt, Chlamydophila pneumoniae CWL029
accguaaagaaaag

SEQ ID NO: 2512981 - RNA, 18 nt, Chlamydophila pneumoniae CWL029
accguaaagaaaagcaau

SEQ ID NO: 2512982 - RNA, 19 nt, Chlamydophila pneumoniae CWL029
accguaacugaggcaaaga

SEQ ID NO: 2512983 - RNA, 21 nt, Chlamydophila pneumoniae CWL029
accgucacuguuuuccagaaa

SEQ ID NO: 2512984 - RNA, 20 nt, Chlamydophila pneumoniae CWL029
accgucccaugcguccaaua

SEQ ID NO: 2512985 - RNA, 14 nt, Chlamydophila pneumoniae CWL029
accguuaauuuuug

SEQ ID NO: 2512986 - RNA, 18 nt, Chlamydophila pneumoniae CWL029
accguuaauuuuugcuaa

SEQ ID NO: 2512987 - RNA, 18 nt, Chlamydophila pneumoniae CWL029
accguuucaggaaacuca

SEQ ID NO: 2512988 - RNA, 15 nt, Chlamydophila pneumoniae CWL029
accguuuccuccucu

SEQ ID NO: 2512989 - RNA, 14 nt, Chlamydophila pneumoniae CWL029
accuaauaaagaag

SEQ ID NO: 2512990 - RNA, 13 nt, Chlamydophila pneumoniae CWL029
accuaauacagga

SEQ ID NO: 2512991 - RNA, 22 nt, Chlamydophila pneumoniae CWL029
accuacagaucaggauucuaaa

SEQ ID NO: 2512992 - RNA, 19 nt, Chlamydophila pneumoniae CWL029
accuacaucagacugaaga

SEQ ID NO: 2512993 - RNA, 17 nt, Chlamydophila pneumoniae CWL029
accuacguuuucucuau

SEQ ID NO: 2512994 - RNA, 16 nt, Chlamydophila pneumoniae CWL029
accuacuaaacccugu

SEQ ID NO: 2512995 - RNA, 20 nt, Chlamydophila pneumoniae CWL029
accuacuaaacccuguccaa

SEQ ID NO: 2512996 - RNA, 17 nt, Chlamydophila pneumoniae CWL029
accuacugggaaaucua

SEQ ID NO: 2512997 - RNA, 12 nt, Chlamydophila pneumoniae CWL029
accuaggaggau

SEQ ID NO: 2512998 - RNA, 13 nt, Chlamydophila pneumoniae CWL029
accuauaggcaag

SEQ ID NO: 2512999 - RNA, 22 nt, Chlamydophila pneumoniae CWL029
accuauagguucaccagaagca

SEQ ID NO: 2513000 - RNA, 22 nt, Chlamydophila pneumoniae CWL029
accuaugacggauccuagaaua

SEQ ID NO: 2513001 - RNA, 13 nt, Chlamydophila pneumoniae CWL029
accuauugugcuu

SEQ ID NO: 2513002 - RNA, 20 nt, Chlamydophila pneumoniae CWL029
accuauugugcuuuucucuu

SEQ ID NO: 2513003 - RNA, 16 nt, Chlamydophila pneumoniae CWL029
accuauuuaagggaaa

SEQ ID NO: 2513004 - RNA, 13 nt, Chlamydophila pneumoniae CWL029
accuauuugcaac

SEQ ID NO: 2513005 - RNA, 19 nt, Chlamydophila pneumoniae CWL029
accuauuugcaacaaucuu

SEQ ID NO: 2513006 - RNA, 20 nt, Chlamydophila pneumoniae CWL029
accuauuugcaacaaucuuu

SEQ ID NO: 2513007 - RNA, 18 nt, Chlamydophila pneumoniae CWL029
accucaucucgcagucca

SEQ ID NO: 2513008 - RNA, 21 nt, Chlamydophila pneumoniae CWL029
accuccauagaauccucggaa

SEQ ID NO: 2513009 - RNA, 20 nt, Chlamydophila pneumoniae CWL029
accuccuauuuucuuaugac

SEQ ID NO: 2513010 - RNA, 21 nt, Chlamydophila pneumoniae CWL029
accuccucuucuucaucuucu

SEQ ID NO: 2513011 - RNA, 14 nt, Chlamydophila pneumoniae CWL029
accucgaauuccuc

SEQ ID NO: 2513012 - RNA, 21 nt, Chlamydophila pneumoniae CWL029
accucgaauuccucccagccc

SEQ ID NO: 2513013 - RNA, 22 nt, Chlamydophila pneumoniae CWL029
accucucccuugggauuccuua

SEQ ID NO: 2513014 - RNA, 22 nt, Chlamydophila pneumoniae CWL029
accucuccgucauauuuaaaag

SEQ ID NO: 2513015 - RNA, 15 nt, Chlamydophila pneumoniae CWL029
accucuucaaagaca

SEQ ID NO: 2513016 - RNA, 20 nt, Chlamydophila pneumoniae CWL029
accucuucucuauaaaaaaa

SEQ ID NO: 2513017 - RNA, 22 nt, Chlamydophila pneumoniae CWL029
accugaaagcgcguuccuguag

SEQ ID NO: 2513018 - RNA, 21 nt, Chlamydophila pneumoniae CWL029
accugaagagcgcuauugcua

SEQ ID NO: 2513019 - RNA, 18 nt, Chlamydophila pneumoniae CWL029
accugcaaaugaagggau

SEQ ID NO: 2513020 - RNA, 19 nt, Chlamydophila pneumoniae CWL029
accuggauugauccacaga

SEQ ID NO: 2513021 - RNA, 23 nt, Chlamydophila pneumoniae CWL029
accuggcauugccauaauaaagg

SEQ ID NO: 2513022 - RNA, 21 nt, Chlamydophila pneumoniae CWL029
accuguaaagaccaaauagag

SEQ ID NO: 2513023 - RNA, 18 nt, Chlamydophila pneumoniae CWL029
accuguguaaugagcugg

SEQ ID NO: 2513024 - RNA, 14 nt, Chlamydophila pneumoniae CWL029
accuuacauccaau

SEQ ID NO: 2513025 - RNA, 20 nt, Chlamydophila pneumoniae CWL029
accuuacauccaauuuuguu

SEQ ID NO: 2513026 - RNA, 16 nt, Chlamydophila pneumoniae CWL029
accuuagagugacuca

SEQ ID NO: 2513027 - RNA, 19 nt, Chlamydophila pneumoniae CWL029
accuuaguuuuuucuaagg

SEQ ID NO: 2513028 - RNA, 18 nt, Chlamydophila pneumoniae CWL029
accuucaaugauuucuuu

SEQ ID NO: 2513029 - RNA, 21 nt, Chlamydophila pneumoniae CWL029
accuucaaugauuucuuuagc

SEQ ID NO: 2513030 - RNA, 16 nt, Chlamydophila pneumoniae CWL029
accuucacaagaaaac

SEQ ID NO: 2513031 - RNA, 17 nt, Chlamydophila pneumoniae CWL029
accuucggaucuuccca

SEQ ID NO: 2513032 - RNA, 14 nt, Chlamydophila pneumoniae CWL029
accuugaaguuuuu

SEQ ID NO: 2513033 - RNA, 16 nt, Chlamydophila pneumoniae CWL029
accuugagacaaagaa

SEQ ID NO: 2513034 - RNA, 20 nt, Chlamydophila pneumoniae CWL029
accuugauacugaaucccgu

SEQ ID NO: 2513035 - RNA, 17 nt, Chlamydophila pneumoniae CWL029
accuuguauaagagcaa

SEQ ID NO: 2513036 - RNA, 23 nt, Chlamydophila pneumoniae CWL029
accuuuaacccgcuugcaucuua

SEQ ID NO: 2513037 - RNA, 15 nt, Chlamydophila pneumoniae CWL029
accuuuaggaagcug

SEQ ID NO: 2513038 - RNA, 19 nt, Chlamydophila pneumoniae CWL029
accuuuccuaaaauaauuu

SEQ ID NO: 2513039 - RNA, 18 nt, Chlamydophila pneumoniae CWL029
accuuugguagaaagaca

SEQ ID NO: 2513040 - RNA, 17 nt, Chlamydophila pneumoniae CWL029
accuuuuuuuaaaaaua

SEQ ID NO: 2513041 - RNA, 14 nt, Chlamydophila pneumoniae CWL029
acgaaaacaucugu

SEQ ID NO: 2513042 - RNA, 13 nt, Chlamydophila pneumoniae CWL029
acgaaaaggagaa

SEQ ID NO: 2513043 - RNA, 14 nt, Chlamydophila pneumoniae CWL029
acgaaaaucuacac

SEQ ID NO: 2513044 - RNA, 13 nt, Chlamydophila pneumoniae CWL029
acgaaagcacaua

SEQ ID NO: 2513045 - RNA, 15 nt, Chlamydophila pneumoniae CWL029
acgaaagcacauaag

SEQ ID NO: 2513046 - RNA, 17 nt, Chlamydophila pneumoniae CWL029
acgaaagcacauaagau

SEQ ID NO: 2513047 - RNA, 14 nt, Chlamydophila pneumoniae CWL029
acgaaauguuaaag

SEQ ID NO: 2513048 - RNA, 14 nt, Chlamydophila pneumoniae CWL029
acgaacuaaaggaa

SEQ ID NO: 2513049 - RNA, 15 nt, Chlamydophila pneumoniae CWL029
acgaacuaaaggaac

SEQ ID NO: 2513050 - RNA, 21 nt, Chlamydophila pneumoniae CWL029
acgaacuuugaccagaugauu

SEQ ID NO: 2513051 - RNA, 15 nt, Chlamydophila pneumoniae CWL029
acgaaggaaucugau

SEQ ID NO: 2513052 - RNA, 14 nt, Chlamydophila pneumoniae CWL029
acgaauaauuaaau

SEQ ID NO: 2513053 - RNA, 24 nt, Chlamydophila pneumoniae CWL029
acgaauguguugcucuaccaacug

SEQ ID NO: 2513054 - RNA, 22 nt, Chlamydophila pneumoniae CWL029
acgaauugcuugcgcaucagca

SEQ ID NO: 2513055 - RNA, 18 nt, Chlamydophila pneumoniae CWL029
acgacauacaucaaaaug

SEQ ID NO: 2513056 - RNA, 21 nt, Chlamydophila pneumoniae CWL029
acgacaugccuaaauagcuca

SEQ ID NO: 2513057 - RNA, 17 nt, Chlamydophila pneumoniae CWL029
acgaccaacuccucaaa

SEQ ID NO: 2513058 - RNA, 16 nt, Chlamydophila pneumoniae CWL029
acgaccucgaauuccu

SEQ ID NO: 2513059 - RNA, 16 nt, Chlamydophila pneumoniae CWL029
acgacguuuugcugug

SEQ ID NO: 2513060 - RNA, 14 nt, Chlamydophila pneumoniae CWL029
acgacucugccaug

SEQ ID NO: 2513061 - RNA, 17 nt, Chlamydophila pneumoniae CWL029
acgacucugccaugucu

SEQ ID NO: 2513062 - RNA, 18 nt, Chlamydophila pneumoniae CWL029
acgacucugccaugucua

SEQ ID NO: 2513063 - RNA, 20 nt, Chlamydophila pneumoniae CWL029
acgagaaccaaagcagugua

SEQ ID NO: 2513064 - RNA, 11 nt, Chlamydophila pneumoniae CWL029
acgagacugca

SEQ ID NO: 2513065 - RNA, 17 nt, Chlamydophila pneumoniae CWL029
acgagacugcaaaggaa

SEQ ID NO: 2513066 - RNA, 18 nt, Chlamydophila pneumoniae CWL029
acgagacugcaaaggaag

SEQ ID NO: 2513067 - RNA, 21 nt, Chlamydophila pneumoniae CWL029
acgagcaugcuaagcaucaga

SEQ ID NO: 2513068 - RNA, 17 nt, Chlamydophila pneumoniae CWL029
acgagcccuagauagca

SEQ ID NO: 2513069 - RNA, 20 nt, Chlamydophila pneumoniae CWL029
acgaggagaagucgaaagau

SEQ ID NO: 2513070 - RNA, 13 nt, Chlamydophila pneumoniae CWL029
acgaggagcuuuu

SEQ ID NO: 2513071 - RNA, 21 nt, Chlamydophila pneumoniae CWL029
acgaguucgcggaucuucuuc

SEQ ID NO: 2513072 - RNA, 15 nt, Chlamydophila pneumoniae CWL029
acgauauuugggaua

SEQ ID NO: 2513073 - RNA, 22 nt, Chlamydophila pneumoniae CWL029
acgauauuugggauauuggaga

SEQ ID NO: 2513074 - RNA, 15 nt, Chlamydophila pneumoniae CWL029
acgaucaaauuccuu

SEQ ID NO: 2513075 - RNA, 20 nt, Chlamydophila pneumoniae CWL029
acgaucacauuccaagaaaa

SEQ ID NO: 2513076 - RNA, 18 nt, Chlamydophila pneumoniae CWL029
acgauccaucucaucgaa

SEQ ID NO: 2513077 - RNA, 20 nt, Chlamydophila pneumoniae CWL029
acgaucgucaguaaaacaca

SEQ ID NO: 2513078 - RNA, 12 nt, Chlamydophila pneumoniae CWL029
acgaucuagaag

SEQ ID NO: 2513079 - RNA, 16 nt, Chlamydophila pneumoniae CWL029
acgaugaacguauagg

SEQ ID NO: 2513080 - RNA, 21 nt, Chlamydophila pneumoniae CWL029
acgauucuaggccuaaagaau

SEQ ID NO: 2513081 - RNA, 13 nt, Chlamydophila pneumoniae CWL029
acgauuucuuuua

SEQ ID NO: 2513082 - RNA, 20 nt, Chlamydophila pneumoniae CWL029
acgauuucuuuuaguuguga

SEQ ID NO: 2513083 - RNA, 21 nt, Chlamydophila pneumoniae CWL029
acgcaaaguacuaauuacaga

SEQ ID NO: 2513084 - RNA, 17 nt, Chlamydophila pneumoniae CWL029
acgcaacaucucacaga

SEQ ID NO: 2513085 - RNA, 21 nt, Chlamydophila pneumoniae CWL029
acgcaacaucucacagauacc

SEQ ID NO: 2513086 - RNA, 18 nt, Chlamydophila pneumoniae CWL029
acgcaagagacaagaaaa

SEQ ID NO: 2513087 - RNA, 17 nt, Chlamydophila pneumoniae CWL029
acgcaaugauuucucua

SEQ ID NO: 2513088 - RNA, 13 nt, Chlamydophila pneumoniae CWL029
acgcacgccaaga

SEQ ID NO: 2513089 - RNA, 11 nt, Chlamydophila pneumoniae CWL029
acgcagagaug

SEQ ID NO: 2513090 - RNA, 20 nt, Chlamydophila pneumoniae CWL029
acgcagagaugcuaacaacu

SEQ ID NO: 2513091 - RNA, 14 nt, Chlamydophila pneumoniae CWL029
acgcaggaagaaca

SEQ ID NO: 2513092 - RNA, 18 nt, Chlamydophila pneumoniae CWL029
acgcauagcacuaugaau

SEQ ID NO: 2513093 - RNA, 22 nt, Chlamydophila pneumoniae CWL029
acgccaaugggaauuugauuuu

SEQ ID NO: 2513094 - RNA, 21 nt, Chlamydophila pneumoniae CWL029
acgcccacggaaagcacauac

SEQ ID NO: 2513095 - RNA, 21 nt, Chlamydophila pneumoniae CWL029
acgccgcucuugauagcuaag

SEQ ID NO: 2513096 - RNA, 20 nt, Chlamydophila pneumoniae CWL029
acgccgugccuauagaaauu

SEQ ID NO: 2513097 - RNA, 18 nt, Chlamydophila pneumoniae CWL029
acgccuccuucaaagaua

SEQ ID NO: 2513098 - RNA, 13 nt, Chlamydophila pneumoniae CWL029
acgcgcuucuuca

SEQ ID NO: 2513099 - RNA, 16 nt, Chlamydophila pneumoniae CWL029
acgcuaaacuaaaaug

SEQ ID NO: 2513100 - RNA, 13 nt, Chlamydophila pneumoniae CWL029
acgcuaagcucuu

SEQ ID NO: 2513101 - RNA, 20 nt, Chlamydophila pneumoniae CWL029
acgcuaagcucuuaauuucu

SEQ ID NO: 2513102 - RNA, 18 nt, Chlamydophila pneumoniae CWL029
acgcuacgguacuuuaca

SEQ ID NO: 2513103 - RNA, 10 nt, Chlamydophila pneumoniae CWL029
acgcuauucu

SEQ ID NO: 2513104 - RNA, 13 nt, Chlamydophila pneumoniae CWL029
acgcuauucuuaa

SEQ ID NO: 2513105 - RNA, 17 nt, Chlamydophila pneumoniae CWL029
acgcucccuaugccagu

SEQ ID NO: 2513106 - RNA, 16 nt, Chlamydophila pneumoniae CWL029
acgcucuaaacucucu

SEQ ID NO: 2513107 - RNA, 20 nt, Chlamydophila pneumoniae CWL029
acgcucucgcuaagcaaagc

SEQ ID NO: 2513108 - RNA, 19 nt, Chlamydophila pneumoniae CWL029
acgcuucuuuuuggauauc

SEQ ID NO: 2513109 - RNA, 19 nt, Chlamydophila pneumoniae CWL029
acgcuuuuaucuguuaaaa

SEQ ID NO: 2513110 - RNA, 23 nt, Chlamydophila pneumoniae CWL029
acgcuuuuaucuguuaaaaacaa

SEQ ID NO: 2513111 - RNA, 12 nt, Chlamydophila pneumoniae CWL029
acgcuuuucuaa

SEQ ID NO: 2513112 - RNA, 13 nt, Chlamydophila pneumoniae CWL029
acggaaaaucaca

SEQ ID NO: 2513113 - RNA, 15 nt, Chlamydophila pneumoniae CWL029
acggaaagcacauac

SEQ ID NO: 2513114 - RNA, 18 nt, Chlamydophila pneumoniae CWL029
acggaacaagucuucaau

SEQ ID NO: 2513115 - RNA, 14 nt, Chlamydophila pneumoniae CWL029
acggaacuaaagag

SEQ ID NO: 2513116 - RNA, 20 nt, Chlamydophila pneumoniae CWL029
acggacuucacaaagaacca

SEQ ID NO: 2513117 - RNA, 21 nt, Chlamydophila pneumoniae CWL029
acggauaggaucauugaguuc

SEQ ID NO: 2513118 - RNA, 20 nt, Chlamydophila pneumoniae CWL029
acggauauucuuuagggcua

SEQ ID NO: 2513119 - RNA, 14 nt, Chlamydophila pneumoniae CWL029
acggauucuaaaag

SEQ ID NO: 2513120 - RNA, 20 nt, Chlamydophila pneumoniae CWL029
acggccgacucuacaucuuc

SEQ ID NO: 2513121 - RNA, 21 nt, Chlamydophila pneumoniae CWL029
acggcggagaauaucaucuuc

SEQ ID NO: 2513122 - RNA, 20 nt, Chlamydophila pneumoniae CWL029
acgggcaauauauccaggau

SEQ ID NO: 2513123 - RNA, 23 nt, Chlamydophila pneumoniae CWL029
acgguaaggaggaaucuugauga

SEQ ID NO: 2513124 - RNA, 17 nt, Chlamydophila pneumoniae CWL029
acgguaaugccagcagc

SEQ ID NO: 2513125 - RNA, 19 nt, Chlamydophila pneumoniae CWL029
acgguagucaaaggaucca

SEQ ID NO: 2513126 - RNA, 21 nt, Chlamydophila pneumoniae CWL029
acgguuucugggaugcacacg

SEQ ID NO: 2513127 - RNA, 22 nt, Chlamydophila pneumoniae CWL029
acgguuuucugccuuaccacuu

SEQ ID NO: 2513128 - RNA, 15 nt, Chlamydophila pneumoniae CWL029
acguaauccagauug

SEQ ID NO: 2513129 - RNA, 19 nt, Chlamydophila pneumoniae CWL029
acguacgcaaguaaagaaa

SEQ ID NO: 2513130 - RNA, 22 nt, Chlamydophila pneumoniae CWL029
acguagcauaccuuggaaaggu

SEQ ID NO: 2513131 - RNA, 21 nt, Chlamydophila pneumoniae CWL029
acguauagggaaccuugauac

SEQ ID NO: 2513132 - RNA, 23 nt, Chlamydophila pneumoniae CWL029
acgucacuggggcauaagaacuc

SEQ ID NO: 2513133 - RNA, 15 nt, Chlamydophila pneumoniae CWL029
acgucagcuguccuc

SEQ ID NO: 2513134 - RNA, 13 nt, Chlamydophila pneumoniae CWL029
acgucaucaccau

SEQ ID NO: 2513135 - RNA, 21 nt, Chlamydophila pneumoniae CWL029
acguccauuucauguaagaau

SEQ ID NO: 2513136 - RNA, 19 nt, Chlamydophila pneumoniae CWL029
acguccucaccuugugaga

SEQ ID NO: 2513137 - RNA, 17 nt, Chlamydophila pneumoniae CWL029
acguccugaugccuuuu

SEQ ID NO: 2513138 - RNA, 23 nt, Chlamydophila pneumoniae CWL029
aacuccucuaaggacaaaucucc

SEQ ID NO: 2513139 - RNA, 18 nt, Chlamydophila pneumoniae CWL029
aacucuaaucugauucaa

SEQ ID NO: 2513140 - RNA, 16 nt, Chlamydophila pneumoniae CWL029
aacucuagaucuucaa

SEQ ID NO: 2513141 - RNA, 14 nt, Chlamydophila pneumoniae CWL029
aacucucaguuaaa

SEQ ID NO: 2513142 - RNA, 17 nt, Chlamydophila pneumoniae CWL029
aacucucuucccccaga

SEQ ID NO: 2513143 - RNA, 12 nt, Chlamydophila pneumoniae CWL029
aacucucuuccu

SEQ ID NO: 2513144 - RNA, 13 nt, Chlamydophila pneumoniae CWL029
aacucucuuuaaa

SEQ ID NO: 2513145 - RNA, 19 nt, Chlamydophila pneumoniae CWL029
aacucuuaaagguaaagcu

SEQ ID NO: 2513146 - RNA, 20 nt, Chlamydophila pneumoniae CWL029
aacucuuaaagguaaagcuu

SEQ ID NO: 2513147 - RNA, 23 nt, Chlamydophila pneumoniae CWL029
aacucuuaaagguaaagcuucuu

SEQ ID NO: 2513148 - RNA, 19 nt, Chlamydophila pneumoniae CWL029
aacucuuaagaauaaaaua

SEQ ID NO: 2513149 - RNA, 14 nt, Chlamydophila pneumoniae CWL029
aacucuucaagagc

SEQ ID NO: 2513150 - RNA, 18 nt, Chlamydophila pneumoniae CWL029
aacucuuuaggucuuguc

SEQ ID NO: 2513151 - RNA, 22 nt, Chlamydophila pneumoniae CWL029
aacugagcaacuucuucguuag

SEQ ID NO: 2513152 - RNA, 23 nt, Chlamydophila pneumoniae CWL029
aacugaggcaaagauuuccaauc

SEQ ID NO: 2513153 - RNA, 14 nt, Chlamydophila pneumoniae CWL029
aacugauuaguuug

SEQ ID NO: 2513154 - RNA, 13 nt, Chlamydophila pneumoniae CWL029
aacugcaaaaaga

SEQ ID NO: 2513155 - RNA, 18 nt, Chlamydophila pneumoniae CWL029
aacugcgauacucucagc

SEQ ID NO: 2513156 - RNA, 21 nt, Chlamydophila pneumoniae CWL029
aacugcgauacucucagcaaa

SEQ ID NO: 2513157 - RNA, 23 nt, Chlamydophila pneumoniae CWL029
aacugcgcuagcuccagcaucac

SEQ ID NO: 2513158 - RNA, 18 nt, Chlamydophila pneumoniae CWL029
aacugcgcuaucaucauu

SEQ ID NO: 2513159 - RNA, 18 nt, Chlamydophila pneumoniae CWL029
aacugcuuggucacacca

SEQ ID NO: 2513160 - RNA, 19 nt, Chlamydophila pneumoniae CWL029
aacuggcaaucuaaaauca

SEQ ID NO: 2513161 - RNA, 17 nt, Chlamydophila pneumoniae CWL029
aacuggcuauggaagau

SEQ ID NO: 2513162 - RNA, 23 nt, Chlamydophila pneumoniae CWL029
aacugggcauaguggcucagugu

SEQ ID NO: 2513163 - RNA, 16 nt, Chlamydophila pneumoniae CWL029
aacugugccauaacgc

SEQ ID NO: 2513164 - RNA, 19 nt, Chlamydophila pneumoniae CWL029
aacuguguucaauagcaaa

SEQ ID NO: 2513165 - RNA, 13 nt, Chlamydophila pneumoniae CWL029
aacuguguuuucu

SEQ ID NO: 2513166 - RNA, 17 nt, Chlamydophila pneumoniae CWL029
aacuuaaagacuugcuu

SEQ ID NO: 2513167 - RNA, 21 nt, Chlamydophila pneumoniae CWL029
aacuuaguuuugaaaagauuu

SEQ ID NO: 2513168 - RNA, 18 nt, Chlamydophila pneumoniae CWL029
aacuuaucgaaugcugca

SEQ ID NO: 2513169 - RNA, 13 nt, Chlamydophila pneumoniae CWL029
aacuucaaaaguu

SEQ ID NO: 2513170 - RNA, 19 nt, Chlamydophila pneumoniae CWL029
aacuucaacuucuccaacu

SEQ ID NO: 2513171 - RNA, 20 nt, Chlamydophila pneumoniae CWL029
aacuucaacuucuccaacua

SEQ ID NO: 2513172 - RNA, 16 nt, Chlamydophila pneumoniae CWL029
aacuucaaugaaagcu

SEQ ID NO: 2513173 - RNA, 16 nt, Chlamydophila pneumoniae CWL029
aacuuccugauucugu

SEQ ID NO: 2513174 - RNA, 17 nt, Chlamydophila pneumoniae CWL029
aacuucguuagaaacca

SEQ ID NO: 2513175 - RNA, 21 nt, Chlamydophila pneumoniae CWL029
aacuucguuucgcuuugauaa

SEQ ID NO: 2513176 - RNA, 14 nt, Chlamydophila pneumoniae CWL029
aacuucuaaaagca

SEQ ID NO: 2513177 - RNA, 16 nt, Chlamydophila pneumoniae CWL029
aacuucucagauaaaa

SEQ ID NO: 2513178 - RNA, 23 nt, Chlamydophila pneumoniae CWL029
aacuucuguaucgacuguacaaa

SEQ ID NO: 2513179 - RNA, 18 nt, Chlamydophila pneumoniae CWL029
aacuucuucguuagagaa

SEQ ID NO: 2513180 - RNA, 20 nt, Chlamydophila pneumoniae CWL029
aacuucuugugauccuugca

SEQ ID NO: 2513181 - RNA, 22 nt, Chlamydophila pneumoniae CWL029
aacuugaagaaguacaagugaa

SEQ ID NO: 2513182 - RNA, 14 nt, Chlamydophila pneumoniae CWL029
aacuugaauaccaa

SEQ ID NO: 2513183 - RNA, 17 nt, Chlamydophila pneumoniae CWL029
aacuugauuuguuuagc

SEQ ID NO: 2513184 - RNA, 19 nt, Chlamydophila pneumoniae CWL029
aacuuguuuucguaagaga

SEQ ID NO: 2513185 - RNA, 21 nt, Chlamydophila pneumoniae CWL029
aacuuguuuucguaagagaau

SEQ ID NO: 2513186 - RNA, 17 nt, Chlamydophila pneumoniae CWL029
aacuuuaggauucaguu

SEQ ID NO: 2513187 - RNA, 20 nt, Chlamydophila pneumoniae CWL029
aacuuuaggauucaguuccu

SEQ ID NO: 2513188 - RNA, 24 nt, Chlamydophila pneumoniae CWL029
aacuuuaggauucaguuccucauc

SEQ ID NO: 2513189 - RNA, 17 nt, Chlamydophila pneumoniae CWL029
aacuuuagggaagaaau

SEQ ID NO: 2513190 - RNA, 23 nt, Chlamydophila pneumoniae CWL029
aacuuucgaagcgcucuacaaau

SEQ ID NO: 2513191 - RNA, 17 nt, Chlamydophila pneumoniae CWL029
aacuuucugggagaaag

SEQ ID NO: 2513192 - RNA, 23 nt, Chlamydophila pneumoniae CWL029
aacuuugaccagaugauuuuuug

SEQ ID NO: 2513193 - RNA, 16 nt, Chlamydophila pneumoniae CWL029
aacuuugaggcaaguc

SEQ ID NO: 2513194 - RNA, 15 nt, Chlamydophila pneumoniae CWL029
aacuuuuccaaauuc

SEQ ID NO: 2513195 - RNA, 22 nt, Chlamydophila pneumoniae CWL029
aacuuuuuuacuaucuccuaga

SEQ ID NO: 2513196 - RNA, 15 nt, Chlamydophila pneumoniae CWL029
aacuuuuuuucuucu

SEQ ID NO: 2513197 - RNA, 16 nt, Chlamydophila pneumoniae CWL029
aacuuuuuuucuucuc

SEQ ID NO: 2513198 - RNA, 17 nt, Chlamydophila pneumoniae CWL029
aacuuuuuuucuucucu

SEQ ID NO: 2513199 - RNA, 20 nt, Chlamydophila pneumoniae CWL029
aagaaaaaucuacauguaaa

SEQ ID NO: 2513200 - RNA, 21 nt, Chlamydophila pneumoniae CWL029
aagaaaacaaagucacggcga

SEQ ID NO: 2513201 - RNA, 12 nt, Chlamydophila pneumoniae CWL029
aagaaaagcaau

SEQ ID NO: 2513202 - RNA, 13 nt, Chlamydophila pneumoniae CWL029
aagaaaagcaauc

SEQ ID NO: 2513203 - RNA, 14 nt, Chlamydophila pneumoniae CWL029
aagaaaauaaagau

SEQ ID NO: 2513204 - RNA, 15 nt, Chlamydophila pneumoniae CWL029
aagaaaauaaagauc

SEQ ID NO: 2513205 - RNA, 22 nt, Chlamydophila pneumoniae CWL029
aagaaaauaucaccuacaucag

SEQ ID NO: 2513206 - RNA, 19 nt, Chlamydophila pneumoniae CWL029
aagaaaauccuaacaaaag

SEQ ID NO: 2513207 - RNA, 21 nt, Chlamydophila pneumoniae CWL029
aagaaaauucucagauugcuu

SEQ ID NO: 2513208 - RNA, 11 nt, Chlamydophila pneumoniae CWL029
aagaaacuucc

SEQ ID NO: 2513209 - RNA, 18 nt, Chlamydophila pneumoniae CWL029
aagaaacuuccaaaacga

SEQ ID NO: 2513210 - RNA, 19 nt, Chlamydophila pneumoniae CWL029
aagaaacuuccaaaacgau

SEQ ID NO: 2513211 - RNA, 15 nt, Chlamydophila pneumoniae CWL029
aagaaaucaaacauu

SEQ ID NO: 2513212 - RNA, 16 nt, Chlamydophila pneumoniae CWL029
aagaaaucaaacauua

SEQ ID NO: 2513213 - RNA, 18 nt, Chlamydophila pneumoniae CWL029
aagaaaugcaaaccaaaa

SEQ ID NO: 2513214 - RNA, 21 nt, Chlamydophila pneumoniae CWL029
aagaaaugcaaaccaaaaaag

SEQ ID NO: 2513215 - RNA, 11 nt, Chlamydophila pneumoniae CWL029
aagaaaugccc

SEQ ID NO: 2513216 - RNA, 19 nt, Chlamydophila pneumoniae CWL029
aagaaaugcccugucacua

SEQ ID NO: 2513217 - RNA, 13 nt, Chlamydophila pneumoniae CWL029
aagaaauuaacaa

SEQ ID NO: 2513218 - RNA, 15 nt, Chlamydophila pneumoniae CWL029
aagaaauuaacaaca

SEQ ID NO: 2513219 - RNA, 12 nt, Chlamydophila pneumoniae CWL029
aagaaauucuga

SEQ ID NO: 2513220 - RNA, 17 nt, Chlamydophila pneumoniae CWL029
aagaaauucugacuaua

SEQ ID NO: 2513221 - RNA, 14 nt, Chlamydophila pneumoniae CWL029
aagaacagaggauc

SEQ ID NO: 2513222 - RNA, 13 nt, Chlamydophila pneumoniae CWL029
aagaacagcacuc

SEQ ID NO: 2513223 - RNA, 16 nt, Chlamydophila pneumoniae CWL029
aagaacagcacucucu

SEQ ID NO: 2513224 - RNA, 13 nt, Chlamydophila pneumoniae CWL029
aagaacaguuugc

SEQ ID NO: 2513225 - RNA, 13 nt, Chlamydophila pneumoniae CWL029
aagaacauaaccu

SEQ ID NO: 2513226 - RNA, 14 nt, Chlamydophila pneumoniae CWL029
aagaacaucuuccc

SEQ ID NO: 2513227 - RNA, 13 nt, Chlamydophila pneumoniae CWL029
aagaaccauagau

SEQ ID NO: 2513228 - RNA, 18 nt, Chlamydophila pneumoniae CWL029
aagaacccgauacauccu

SEQ ID NO: 2513229 - RNA, 20 nt, Chlamydophila pneumoniae CWL029
aagaaccucuaauuugauga

SEQ ID NO: 2513230 - RNA, 15 nt, Chlamydophila pneumoniae CWL029
aagaaccuguuuuuc

SEQ ID NO: 2513231 - RNA, 15 nt, Chlamydophila pneumoniae CWL029
aagaacgucaccauu

SEQ ID NO: 2513232 - RNA, 13 nt, Chlamydophila pneumoniae CWL029
aagaacucaacuu

SEQ ID NO: 2513233 - RNA, 16 nt, Chlamydophila pneumoniae CWL029
aagaacuccuuugagu

SEQ ID NO: 2513234 - RNA, 17 nt, Chlamydophila pneumoniae CWL029
aagaacugaagagucaa

SEQ ID NO: 2513235 - RNA, 20 nt, Chlamydophila pneumoniae CWL029
aagaacugcauaaucucacc

SEQ ID NO: 2513236 - RNA, 18 nt, Chlamydophila pneumoniae CWL029
aagaacuuaaaauucaaa

SEQ ID NO: 2513237 - RNA, 15 nt, Chlamydophila pneumoniae CWL029
aagaacuuuagggaa

SEQ ID NO: 2513238 - RNA, 19 nt, Chlamydophila pneumoniae CWL029
aagaacuuuagggaagaaa

SEQ ID NO: 2513239 - RNA, 19 nt, Chlamydophila pneumoniae CWL029
aagaagacuagcuuuucau

SEQ ID NO: 2513240 - RNA, 22 nt, Chlamydophila pneumoniae CWL029
aagaagacuagcuuuucauguu

SEQ ID NO: 2513241 - RNA, 21 nt, Chlamydophila pneumoniae CWL029
aagaagcagcacucuuuuucu

SEQ ID NO: 2513242 - RNA, 17 nt, Chlamydophila pneumoniae CWL029
aagaagccuuccuuguu

SEQ ID NO: 2513243 - RNA, 16 nt, Chlamydophila pneumoniae CWL029
aagaagcucacucuuu

SEQ ID NO: 2513244 - RNA, 20 nt, Chlamydophila pneumoniae CWL029
aagaagcucacucuuuaaaa

SEQ ID NO: 2513245 - RNA, 20 nt, Chlamydophila pneumoniae CWL029
aagaagcucguacuguuccu

SEQ ID NO: 2513246 - RNA, 19 nt, Chlamydophila pneumoniae CWL029
aagaagcucuaucuuuggu

SEQ ID NO: 2513247 - RNA, 14 nt, Chlamydophila pneumoniae CWL029
aagaaggcagagaa

SEQ ID NO: 2513248 - RNA, 18 nt, Chlamydophila pneumoniae CWL029
aagaagguccaugucuaa

SEQ ID NO: 2513249 - RNA, 13 nt, Chlamydophila pneumoniae CWL029
aagaagguugaga

SEQ ID NO: 2513250 - RNA, 17 nt, Chlamydophila pneumoniae CWL029
aagaagguuuauuagaa

SEQ ID NO: 2513251 - RNA, 16 nt, Chlamydophila pneumoniae CWL029
aagaaguacaagugaa

SEQ ID NO: 2513252 - RNA, 13 nt, Chlamydophila pneumoniae CWL029
aagaauaaaauag

SEQ ID NO: 2513253 - RNA, 15 nt, Chlamydophila pneumoniae CWL029
aagaauacucuaaga

SEQ ID NO: 2513254 - RNA, 15 nt, Chlamydophila pneumoniae CWL029
aagaauagcaggaag

SEQ ID NO: 2513255 - RNA, 19 nt, Chlamydophila pneumoniae CWL029
aagaauaucuuuugaaucu

SEQ ID NO: 2513256 - RNA, 22 nt, Chlamydophila pneumoniae CWL029
aagaaucgccgcuugaggagga

SEQ ID NO: 2513257 - RNA, 14 nt, Chlamydophila pneumoniae CWL029
aagaaucguucuua

SEQ ID NO: 2513258 - RNA, 18 nt, Chlamydophila pneumoniae CWL029
aagaaucuauagaacuaa

SEQ ID NO: 2513259 - RNA, 14 nt, Chlamydophila pneumoniae CWL029
aagaaugacacaga

SEQ ID NO: 2513260 - RNA, 20 nt, Chlamydophila pneumoniae CWL029
aagaauguagcuguuccaag

SEQ ID NO: 2513261 - RNA, 21 nt, Chlamydophila pneumoniae CWL029
aagaauguagcuguuccaaga

SEQ ID NO: 2513262 - RNA, 16 nt, Chlamydophila pneumoniae CWL029
aagaauuaagaagaag

SEQ ID NO: 2513263 - RNA, 19 nt, Chlamydophila pneumoniae CWL029
aagaauuaccgcgagccau

SEQ ID NO: 2513264 - RNA, 17 nt, Chlamydophila pneumoniae CWL029
aagaauucuuugccaag

SEQ ID NO: 2513265 - RNA, 22 nt, Chlamydophila pneumoniae CWL029
aagaauucuuugccaaggaccu

SEQ ID NO: 2513266 - RNA, 15 nt, Chlamydophila pneumoniae CWL029
aagaauuucauaaga

SEQ ID NO: 2513267 - RNA, 17 nt, Chlamydophila pneumoniae CWL029
aagaauuucauaagaga

SEQ ID NO: 2513268 - RNA, 20 nt, Chlamydophila pneumoniae CWL029
aagaauuucuucuuuccaua

SEQ ID NO: 2513269 - RNA, 21 nt, Chlamydophila pneumoniae CWL029
aagaauuuguaacucuuaaga

SEQ ID NO: 2513270 - RNA, 15 nt, Chlamydophila pneumoniae CWL029
aagacaauaaaaaag

SEQ ID NO: 2513271 - RNA, 17 nt, Chlamydophila pneumoniae CWL029
aagacaauaaaaaagag

SEQ ID NO: 2513272 - RNA, 19 nt, Chlamydophila pneumoniae CWL029
aagacauccuucuuuaccu

SEQ ID NO: 2513273 - RNA, 15 nt, Chlamydophila pneumoniae CWL029
aagacaucuccugca

SEQ ID NO: 2513274 - RNA, 16 nt, Chlamydophila pneumoniae CWL029
aagacauuauagaggu

SEQ ID NO: 2513275 - RNA, 17 nt, Chlamydophila pneumoniae CWL029
aagacauucauuuuuua

SEQ ID NO: 2513276 - RNA, 20 nt, Chlamydophila pneumoniae CWL029
aagacauucauuuuuuaaua

SEQ ID NO: 2513277 - RNA, 15 nt, Chlamydophila pneumoniae CWL029
aagaccuaacgcaac

SEQ ID NO: 2513278 - RNA, 16 nt, Chlamydophila pneumoniae CWL029
aagaccuaagcucaua

SEQ ID NO: 2513279 - RNA, 21 nt, Chlamydophila pneumoniae CWL029
aagacgacacucaaaucuuuc

SEQ ID NO: 2513280 - RNA, 16 nt, Chlamydophila pneumoniae CWL029
aagacuaaaaaagaga

SEQ ID NO: 2513281 - RNA, 17 nt, Chlamydophila pneumoniae CWL029
aagacuacgacagaagu

SEQ ID NO: 2513282 - RNA, 20 nt, Chlamydophila pneumoniae CWL029
aagacuagcuuuuuuuauga

SEQ ID NO: 2513283 - RNA, 14 nt, Chlamydophila pneumoniae CWL029
aagacucaucuuug

SEQ ID NO: 2513284 - RNA, 19 nt, Chlamydophila pneumoniae CWL029
aagacucaugaaauagugu

SEQ ID NO: 2513285 - RNA, 17 nt, Chlamydophila pneumoniae CWL029
aagacucccaaggaaau

SEQ ID NO: 2513286 - RNA, 19 nt, Chlamydophila pneumoniae CWL029
aagacucucaucagcaaaa

SEQ ID NO: 2513287 - RNA, 15 nt, Chlamydophila pneumoniae CWL029
aagacuguguuuuau

SEQ ID NO: 2513288 - RNA, 21 nt, Chlamydophila pneumoniae CWL029
aagacuucgaugucuuuccag

SEQ ID NO: 2513289 - RNA, 23 nt, Chlamydophila pneumoniae CWL029
aagacuuuuuaaauagcaucccu

SEQ ID NO: 2513290 - RNA, 22 nt, Chlamydophila pneumoniae CWL029
aagacuuuuuaguauacuaaga

SEQ ID NO: 2513291 - RNA, 14 nt, Chlamydophila pneumoniae CWL029
aagagaaaagauag

SEQ ID NO: 2513292 - RNA, 15 nt, Chlamydophila pneumoniae CWL029
aagagaaucuccuca

SEQ ID NO: 2513293 - RNA, 15 nt, Chlamydophila pneumoniae CWL029
aagagacaagaaaau

SEQ ID NO: 2513294 - RNA, 16 nt, Chlamydophila pneumoniae CWL029
aagagacaagaaaaua

SEQ ID NO: 2513295 - RNA, 17 nt, Chlamydophila pneumoniae CWL029
aagagacaagaaaauau

SEQ ID NO: 2513296 - RNA, 18 nt, Chlamydophila pneumoniae CWL029
aagagacguuaucuaaga

SEQ ID NO: 2513297 - RNA, 20 nt, Chlamydophila pneumoniae CWL029
aagagagcuugucacacugc

SEQ ID NO: 2513298 - RNA, 22 nt, Chlamydophila pneumoniae CWL029
aagagauauagguaucagcaag

SEQ ID NO: 2513299 - RNA, 21 nt, Chlamydophila pneumoniae CWL029
aagagcaacaguaauuauuuu

SEQ ID NO: 2513300 - RNA, 17 nt, Chlamydophila pneumoniae CWL029
aagagcccccauaggaa

SEQ ID NO: 2513301 - RNA, 15 nt, Chlamydophila pneumoniae CWL029
aagagcccuugaauc

SEQ ID NO: 2513302 - RNA, 19 nt, Chlamydophila pneumoniae CWL029
aagagcgcguuucaaauag

SEQ ID NO: 2513303 - RNA, 16 nt, Chlamydophila pneumoniae CWL029
aagagcuaaagaaacu

SEQ ID NO: 2513304 - RNA, 22 nt, Chlamydophila pneumoniae CWL029
aagagcucaucggaucuuuucu

SEQ ID NO: 2513305 - RNA, 23 nt, Chlamydophila pneumoniae CWL029
aagagcucguaauccuucuuucu

SEQ ID NO: 2513306 - RNA, 14 nt, Chlamydophila pneumoniae CWL029
aagagcucuugaga

SEQ ID NO: 2513307 - RNA, 21 nt, Chlamydophila pneumoniae CWL029
aagagcuugucuuccacgaag

SEQ ID NO: 2513308 - RNA, 22 nt, Chlamydophila pneumoniae CWL029
aagagcuuguucuguaacacuu

SEQ ID NO: 2513309 - RNA, 20 nt, Chlamydophila pneumoniae CWL029
aagaggagugaaagcuucuu

SEQ ID NO: 2513310 - RNA, 17 nt, Chlamydophila pneumoniae CWL029
aagaggcuuuaaauuuu

SEQ ID NO: 2513311 - RNA, 18 nt, Chlamydophila pneumoniae CWL029
aagagguaauaauaguga

SEQ ID NO: 2513312 - RNA, 16 nt, Chlamydophila pneumoniae CWL029
aagagguucuugcuua

SEQ ID NO: 2513313 - RNA, 18 nt, Chlamydophila pneumoniae CWL029
aagaguagccccagcaac

SEQ ID NO: 2513314 - RNA, 16 nt, Chlamydophila pneumoniae CWL029
aagagucccugauucc

SEQ ID NO: 2513315 - RNA, 17 nt, Chlamydophila pneumoniae CWL029
aagagucucacucuuuu

SEQ ID NO: 2513316 - RNA, 14 nt, Chlamydophila pneumoniae CWL029
aagagucucuugcu

SEQ ID NO: 2513317 - RNA, 19 nt, Chlamydophila pneumoniae CWL029
aagagucuuccuagaccua

SEQ ID NO: 2513318 - RNA, 22 nt, Chlamydophila pneumoniae CWL029
aagagucuuugaugcuaaacga

SEQ ID NO: 2513319 - RNA, 17 nt, Chlamydophila pneumoniae CWL029
aagagugccaagagcau

SEQ ID NO: 2513320 - RNA, 20 nt, Chlamydophila pneumoniae CWL029
aagagugguuccugaaaagc

SEQ ID NO: 2513321 - RNA, 13 nt, Chlamydophila pneumoniae CWL029
aagauaaacagca

SEQ ID NO: 2513322 - RNA, 13 nt, Chlamydophila pneumoniae CWL029
aagauaaacauua

SEQ ID NO: 2513323 - RNA, 13 nt, Chlamydophila pneumoniae CWL029
aagauaaagaagu

SEQ ID NO: 2513324 - RNA, 12 nt, Chlamydophila pneumoniae CWL029
aagauaaauccc

SEQ ID NO: 2513325 - RNA, 13 nt, Chlamydophila pneumoniae CWL029
aagauaaauccca

SEQ ID NO: 2513326 - RNA, 19 nt, Chlamydophila pneumoniae CWL029
aagauaauagagaagaagc

SEQ ID NO: 2513327 - RNA, 20 nt, Chlamydophila pneumoniae CWL029
aagauaaucuguaagaaaau

SEQ ID NO: 2513328 - RNA, 17 nt, Chlamydophila pneumoniae CWL029
aagauaaugucuccauc

SEQ ID NO: 2513329 - RNA, 16 nt, Chlamydophila pneumoniae CWL029
aagauacgaaguccca

SEQ ID NO: 2513330 - RNA, 14 nt, Chlamydophila pneumoniae CWL029
aagauagacucuca

SEQ ID NO: 2513331 - RNA, 19 nt, Chlamydophila pneumoniae CWL029
aagauagacucucacugag

SEQ ID NO: 2513332 - RNA, 18 nt, Chlamydophila pneumoniae CWL029
aagauagcgacgucauca

SEQ ID NO: 2513333 - RNA, 18 nt, Chlamydophila pneumoniae CWL029
aagauaguauuuuugaaa

SEQ ID NO: 2513334 - RNA, 19 nt, Chlamydophila pneumoniae CWL029
aagauaguauuuuugaaac

SEQ ID NO: 2513335 - RNA, 17 nt, Chlamydophila pneumoniae CWL029
aagauaguuauuaauaa

SEQ ID NO: 2513336 - RNA, 15 nt, Chlamydophila pneumoniae CWL029
aagauauauuuuuaa

SEQ ID NO: 2513337 - RNA, 17 nt, Chlamydophila pneumoniae CWL029
aagauaucccaaagcua

SEQ ID NO: 2513338 - RNA, 13 nt, Chlamydophila pneumoniae CWL029
aagauauccuuuu

SEQ ID NO: 2513339 - RNA, 15 nt, Chlamydophila pneumoniae CWL029
aagauauguccguga

SEQ ID NO: 2513340 - RNA, 13 nt, Chlamydophila pneumoniae CWL029
aagauauucaaga

SEQ ID NO: 2513341 - RNA, 14 nt, Chlamydophila pneumoniae CWL029
aagaucauaugcac

SEQ ID NO: 2513342 - RNA, 23 nt, Chlamydophila pneumoniae CWL029
aagaucgcucgaucgugcucugc

SEQ ID NO: 2513343 - RNA, 22 nt, Chlamydophila pneumoniae CWL029
aagaucggaguuaucaaaagga

SEQ ID NO: 2513344 - RNA, 17 nt, Chlamydophila pneumoniae CWL029
aagaucuaacuucacca

SEQ ID NO: 2513345 - RNA, 12 nt, Chlamydophila pneumoniae CWL029
aagaucucuuuu

SEQ ID NO: 2513346 - RNA, 17 nt, Chlamydophila pneumoniae CWL029
aagaucuucauaaccaa

SEQ ID NO: 2513347 - RNA, 17 nt, Chlamydophila pneumoniae CWL029
aagaucuugaacagaga

SEQ ID NO: 2513348 - RNA, 15 nt, Chlamydophila pneumoniae CWL029
aagaugaagaaacuu

SEQ ID NO: 2513349 - RNA, 15 nt, Chlamydophila pneumoniae CWL029
aagaugagaaaaucu

SEQ ID NO: 2513350 - RNA, 12 nt, Chlamydophila pneumoniae CWL029
aagaugcuggaa

SEQ ID NO: 2513351 - RNA, 16 nt, Chlamydophila pneumoniae CWL029
aagauggcaaggaaaa

SEQ ID NO: 2513352 - RNA, 18 nt, Chlamydophila pneumoniae CWL029
aagauggcaaggaaaauu

SEQ ID NO: 2513353 - RNA, 21 nt, Chlamydophila pneumoniae CWL029
aagauguauaaggauaucuuc

SEQ ID NO: 2513354 - RNA, 14 nt, Chlamydophila pneumoniae CWL029
aagauuauucuaga

SEQ ID NO: 2513355 - RNA, 19 nt, Chlamydophila pneumoniae CWL029
aagauuauuuguuucuucc

SEQ ID NO: 2513356 - RNA, 15 nt, Chlamydophila pneumoniae CWL029
aagauucaaagaagu

SEQ ID NO: 2513357 - RNA, 22 nt, Chlamydophila pneumoniae CWL029
aagauuccuaacuucugaagga

SEQ ID NO: 2513358 - RNA, 13 nt, Chlamydophila pneumoniae CWL029
aagauuccuaagc

SEQ ID NO: 2513359 - RNA, 19 nt, Chlamydophila pneumoniae CWL029
aagauuccuuaccuauaua

SEQ ID NO: 2513360 - RNA, 16 nt, Chlamydophila pneumoniae CWL029
aagauucuuuaaucua

SEQ ID NO: 2513361 - RNA, 14 nt, Chlamydophila pneumoniae CWL029
aagauugaaggcac

SEQ ID NO: 2513362 - RNA, 24 nt, Chlamydophila pneumoniae CWL029
aagauugcagguagauccuauagu

SEQ ID NO: 2513363 - RNA, 14 nt, Chlamydophila pneumoniae CWL029
aagauuuugaaaau

SEQ ID NO: 2513364 - RNA, 15 nt, Chlamydophila pneumoniae CWL029
aagauuuuuagaaua

SEQ ID NO: 2513365 - RNA, 13 nt, Chlamydophila pneumoniae CWL029
aagauuuuuucuu

SEQ ID NO: 2513366 - RNA, 13 nt, Chlamydophila pneumoniae CWL029
aagcaaaagauca

SEQ ID NO: 2513367 - RNA, 12 nt, Chlamydophila pneumoniae CWL029
aagcaaaaguca

SEQ ID NO: 2513368 - RNA, 22 nt, Chlamydophila pneumoniae CWL029
aagcaaagaaaauucucagauu

SEQ ID NO: 2513369 - RNA, 17 nt, Chlamydophila pneumoniae CWL029
aagcaaagauaaagaag

SEQ ID NO: 2513370 - RNA, 20 nt, Chlamydophila pneumoniae CWL029
aagcaaagauaaagaaguuu

SEQ ID NO: 2513371 - RNA, 18 nt, Chlamydophila pneumoniae CWL029
aagcaaaugccuguacua

SEQ ID NO: 2513372 - RNA, 17 nt, Chlamydophila pneumoniae CWL029
aagcaacuaaacucucc

SEQ ID NO: 2513373 - RNA, 18 nt, Chlamydophila pneumoniae CWL029
aagcaacuaaacucucca

SEQ ID NO: 2513374 - RNA, 13 nt, Chlamydophila pneumoniae CWL029
aagcaacucuuca

SEQ ID NO: 2513375 - RNA, 14 nt, Chlamydophila pneumoniae CWL029
aagcaaggaaaaaa

SEQ ID NO: 2513376 - RNA, 20 nt, Chlamydophila pneumoniae CWL029
aagcaaggcugccagagauu

SEQ ID NO: 2513377 - RNA, 13 nt, Chlamydophila pneumoniae CWL029
aagcaauccagua

SEQ ID NO: 2513378 - RNA, 14 nt, Chlamydophila pneumoniae CWL029
aagcacccucuuca

SEQ ID NO: 2513379 - RNA, 12 nt, Chlamydophila pneumoniae CWL029
aagcacugauga

SEQ ID NO: 2513380 - RNA, 14 nt, Chlamydophila pneumoniae CWL029
aagcagauagagcu

SEQ ID NO: 2513381 - RNA, 18 nt, Chlamydophila pneumoniae CWL029
aagcagccucuucucuac

SEQ ID NO: 2513382 - RNA, 22 nt, Chlamydophila pneumoniae CWL029
aagcaggugugugguaaaaaua

SEQ ID NO: 2513383 - RNA, 23 nt, Chlamydophila pneumoniae CWL029
aagcagugugccaauuuuuguag

SEQ ID NO: 2513384 - RNA, 21 nt, Chlamydophila pneumoniae CWL029
aagcauagcccgaaauucauu

SEQ ID NO: 2513385 - RNA, 16 nt, Chlamydophila pneumoniae CWL029
aagcauagucgucuuu

SEQ ID NO: 2513386 - RNA, 20 nt, Chlamydophila pneumoniae CWL029
aagcauagucgucuuuuaaa

SEQ ID NO: 2513387 - RNA, 20 nt, Chlamydophila pneumoniae CWL029
aagcaucacggacuccgucu

SEQ ID NO: 2513388 - RNA, 17 nt, Chlamydophila pneumoniae CWL029
aagcaucuuucaucaau

SEQ ID NO: 2513389 - RNA, 18 nt, Chlamydophila pneumoniae CWL029
aagcaucuuucaucaaug

SEQ ID NO: 2513390 - RNA, 14 nt, Chlamydophila pneumoniae CWL029
aagcaugaagcaga

SEQ ID NO: 2513391 - RNA, 23 nt, Chlamydophila pneumoniae CWL029
aagcauucugcuagagcuuucag

SEQ ID NO: 2513392 - RNA, 15 nt, Chlamydophila pneumoniae CWL029
aagcauugcaaauaa

SEQ ID NO: 2513393 - RNA, 20 nt, Chlamydophila pneumoniae CWL029
aagcauugcaaauaagccag

SEQ ID NO: 2513394 - RNA, 14 nt, Chlamydophila pneumoniae CWL029
aagccacagagaau

SEQ ID NO: 2513395 - RNA, 18 nt, Chlamydophila pneumoniae CWL029
aagccacauucuucugau

SEQ ID NO: 2513396 - RNA, 17 nt, Chlamydophila pneumoniae CWL029
aagccauuuucuaagag

SEQ ID NO: 2513397 - RNA, 14 nt, Chlamydophila pneumoniae CWL029
aagcccauuccugc

SEQ ID NO: 2513398 - RNA, 20 nt, Chlamydophila pneumoniae CWL029
aagcccucauccccucagaa

SEQ ID NO: 2513399 - RNA, 21 nt, Chlamydophila pneumoniae CWL029
aagcccucauccccucagaaa

SEQ ID NO: 2513400 - RNA, 20 nt, Chlamydophila pneumoniae CWL029
aagccgauacccaucuagaa

SEQ ID NO: 2513401 - RNA, 23 nt, Chlamydophila pneumoniae CWL029
aagccggcccacucaaaagaaga

SEQ ID NO: 2513402 - RNA, 22 nt, Chlamydophila pneumoniae CWL029
aagccuaaaucuauacccaguu

SEQ ID NO: 2513403 - RNA, 23 nt, Chlamydophila pneumoniae CWL029
aagccuaugggaggaauuccucu

SEQ ID NO: 2513404 - RNA, 20 nt, Chlamydophila pneumoniae CWL029
aagccuccucaagauaaauc

SEQ ID NO: 2513405 - RNA, 23 nt, Chlamydophila pneumoniae CWL029
aagccuccucaagauaaauccca

SEQ ID NO: 2513406 - RNA, 15 nt, Chlamydophila pneumoniae CWL029
aagccucgaaauuuu

SEQ ID NO: 2513407 - RNA, 17 nt, Chlamydophila pneumoniae CWL029
aagccugcggcaaguau

SEQ ID NO: 2513408 - RNA, 14 nt, Chlamydophila pneumoniae CWL029
aagccuucauucca

SEQ ID NO: 2513409 - RNA, 17 nt, Chlamydophila pneumoniae CWL029
aagccuucauuccauga

SEQ ID NO: 2513410 - RNA, 12 nt, Chlamydophila pneumoniae CWL029
aagccuuccuug

SEQ ID NO: 2513411 - RNA, 20 nt, Chlamydophila pneumoniae CWL029
aagccuuucuuauuacagaa

SEQ ID NO: 2513412 - RNA, 19 nt, Chlamydophila pneumoniae CWL029
aagccuuugcucacuguuu

SEQ ID NO: 2513413 - RNA, 21 nt, Chlamydophila pneumoniae CWL029
aagcgcaaaucuuacauaaac

SEQ ID NO: 2513414 - RNA, 15 nt, Chlamydophila pneumoniae CWL029
aagcgcgcuaaaaaa

SEQ ID NO: 2513415 - RNA, 18 nt, Chlamydophila pneumoniae CWL029
aagcggaguccuucuugc

SEQ ID NO: 2513416 - RNA, 17 nt, Chlamydophila pneumoniae CWL029
aagcguagcaaaguuaa

SEQ ID NO: 2513417 - RNA, 22 nt, Chlamydophila pneumoniae CWL029
aagcguauagaauagaauguau

SEQ ID NO: 2513418 - RNA, 20 nt, Chlamydophila pneumoniae CWL029
aagcguuucgauaauuuuca

SEQ ID NO: 2513419 - RNA, 12 nt, Chlamydophila pneumoniae CWL029
aagcuaaaaaau

SEQ ID NO: 2513420 - RNA, 13 nt, Chlamydophila pneumoniae CWL029
aagcuaaaaugcg

SEQ ID NO: 2513421 - RNA, 21 nt, Chlamydophila pneumoniae CWL029
aagcuaacaacuucugacaau

SEQ ID NO: 2513422 - RNA, 21 nt, Chlamydophila pneumoniae CWL029
aagcuacggaugggcacucuu

SEQ ID NO: 2513423 - RNA, 15 nt, Chlamydophila pneumoniae CWL029
aagcuauuguuuuuc

SEQ ID NO: 2513424 - RNA, 16 nt, Chlamydophila pneumoniae CWL029
aagcucacucuuuaaa

SEQ ID NO: 2513425 - RNA, 16 nt, Chlamydophila pneumoniae CWL029
aagcuccucacaucuc

SEQ ID NO: 2513426 - RNA, 13 nt, Chlamydophila pneumoniae CWL029
aagcucuaagucc

SEQ ID NO: 2513427 - RNA, 11 nt, Chlamydophila pneumoniae CWL029
aagcucucucc

SEQ ID NO: 2513428 - RNA, 18 nt, Chlamydophila pneumoniae CWL029
aagcucuuaauuucugcu

SEQ ID NO: 2513429 - RNA, 16 nt, Chlamydophila pneumoniae CWL029
aagcucuucuacuuua

SEQ ID NO: 2513430 - RNA, 19 nt, Chlamydophila pneumoniae CWL029
aagcucuucuacuuuaaga

SEQ ID NO: 2513431 - RNA, 16 nt, Chlamydophila pneumoniae CWL029
aagcucuuucauaaga

SEQ ID NO: 2513432 - RNA, 20 nt, Chlamydophila pneumoniae CWL029
aagcugacaaauagaaagga

SEQ ID NO: 2513433 - RNA, 18 nt, Chlamydophila pneumoniae CWL029
aagcugagguagcaucuc

SEQ ID NO: 2513434 - RNA, 24 nt, Chlamydophila pneumoniae CWL029
aagcugagguagcaucucucucca

SEQ ID NO: 2513435 - RNA, 15 nt, Chlamydophila pneumoniae CWL029
aagcugcaaacugau

SEQ ID NO: 2513436 - RNA, 20 nt, Chlamydophila pneumoniae CWL029
aagcugcaaucucaaaauca

SEQ ID NO: 2513437 - RNA, 18 nt, Chlamydophila pneumoniae CWL029
aagcugccagugacauaa

SEQ ID NO: 2513438 - RNA, 23 nt, Chlamydophila pneumoniae CWL029
aagcugccagugacauaaucaca

SEQ ID NO: 2513439 - RNA, 11 nt, Chlamydophila pneumoniae CWL029
aagcugcugcu

SEQ ID NO: 2513440 - RNA, 23 nt, Chlamydophila pneumoniae CWL029
aagcugcugcuacgacuacaucu

SEQ ID NO: 2513441 - RNA, 21 nt, Chlamydophila pneumoniae CWL029
aagcugcuucgggaacgugcu

SEQ ID NO: 2513442 - RNA, 18 nt, Chlamydophila pneumoniae CWL029
aagcugcuucuucagagu

SEQ ID NO: 2513443 - RNA, 18 nt, Chlamydophila pneumoniae CWL029
aagcuggauucugucuau

SEQ ID NO: 2513444 - RNA, 15 nt, Chlamydophila pneumoniae CWL029
aagcuguaaaugagg

SEQ ID NO: 2513445 - RNA, 22 nt, Chlamydophila pneumoniae CWL029
aagcuguacuugauauuguucu

SEQ ID NO: 2513446 - RNA, 23 nt, Chlamydophila pneumoniae CWL029
aagcuguacuugauauuguucuu

SEQ ID NO: 2513447 - RNA, 12 nt, Chlamydophila pneumoniae CWL029
aagcugugcauu

SEQ ID NO: 2513448 - RNA, 16 nt, Chlamydophila pneumoniae CWL029
aagcugugcauuuucu

SEQ ID NO: 2513449 - RNA, 19 nt, Chlamydophila pneumoniae CWL029
aagcuguggcgauuuuacu

SEQ ID NO: 2513450 - RNA, 18 nt, Chlamydophila pneumoniae CWL029
aagcugugguaucgaugu

SEQ ID NO: 2513451 - RNA, 14 nt, Chlamydophila pneumoniae CWL029
aagcuuauuucugu

SEQ ID NO: 2513452 - RNA, 19 nt, Chlamydophila pneumoniae CWL029
aagcuuauuucuguaguuc

SEQ ID NO: 2513453 - RNA, 18 nt, Chlamydophila pneumoniae CWL029
aagcuucaucaaaacaua

SEQ ID NO: 2513454 - RNA, 17 nt, Chlamydophila pneumoniae CWL029
aagcuuccaucguuaga

SEQ ID NO: 2513455 - RNA, 22 nt, Chlamydophila pneumoniae CWL029
aagcuucggggaagcguagcaa

SEQ ID NO: 2513456 - RNA, 13 nt, Chlamydophila pneumoniae CWL029
aagcuucuuucuc

SEQ ID NO: 2513457 - RNA, 15 nt, Chlamydophila pneumoniae CWL029
aagcuugagaaaagg

SEQ ID NO: 2513458 - RNA, 22 nt, Chlamydophila pneumoniae CWL029
aagcuuguuccacuugcucuuu

SEQ ID NO: 2513459 - RNA, 14 nt, Chlamydophila pneumoniae CWL029
aaggaaaucacaga

SEQ ID NO: 2513460 - RNA, 20 nt, Chlamydophila pneumoniae CWL029
aaggaagaucuugaacagag

SEQ ID NO: 2513461 - RNA, 23 nt, Chlamydophila pneumoniae CWL029
aaggaagaucuugaacagagacu

SEQ ID NO: 2513462 - RNA, 21 nt, Chlamydophila pneumoniae CWL029
aaggaagggauguuuaauaca

SEQ ID NO: 2513463 - RNA, 22 nt, Chlamydophila pneumoniae CWL029
aaggaagggauguuuaauacaa

SEQ ID NO: 2513464 - RNA, 15 nt, Chlamydophila pneumoniae CWL029
aaggaagguucucaa

SEQ ID NO: 2513465 - RNA, 19 nt, Chlamydophila pneumoniae CWL029
aaggaauaugcucuccuug

SEQ ID NO: 2513466 - RNA, 18 nt, Chlamydophila pneumoniae CWL029
aaggaccacaauuccuaa

SEQ ID NO: 2513467 - RNA, 23 nt, Chlamydophila pneumoniae CWL029
aaggaccuguuuucuuuucugaa

SEQ ID NO: 2513468 - RNA, 13 nt, Chlamydophila pneumoniae CWL029
aaggacucuuucu

SEQ ID NO: 2513469 - RNA, 18 nt, Chlamydophila pneumoniae CWL029
aaggacucuuucuauagc

SEQ ID NO: 2513470 - RNA, 13 nt, Chlamydophila pneumoniae CWL029
aaggagagaaaau

SEQ ID NO: 2513471 - RNA, 14 nt, Chlamydophila pneumoniae CWL029
aaggagauuccuaa

SEQ ID NO: 2513472 - RNA, 21 nt, Chlamydophila pneumoniae CWL029
aaggagcggaguaacuaauaa

SEQ ID NO: 2513473 - RNA, 21 nt, Chlamydophila pneumoniae CWL029
aaggaggaggagcacuaggca

SEQ ID NO: 2513474 - RNA, 15 nt, Chlamydophila pneumoniae CWL029
aaggaucauuaaagu

SEQ ID NO: 2513475 - RNA, 13 nt, Chlamydophila pneumoniae CWL029
aaggauccauaac

SEQ ID NO: 2513476 - RNA, 22 nt, Chlamydophila pneumoniae CWL029
aaggaucccaucaucgagcuga

SEQ ID NO: 2513477 - RNA, 20 nt, Chlamydophila pneumoniae CWL029
aaggaucuuauauaaaacuu

SEQ ID NO: 2513478 - RNA, 24 nt, Chlamydophila pneumoniae CWL029
aaggaugcaucucuuaaaacauga

SEQ ID NO: 2513479 - RNA, 17 nt, Chlamydophila pneumoniae CWL029
aaggauucuaugaggac

SEQ ID NO: 2513480 - RNA, 14 nt, Chlamydophila pneumoniae CWL029
aaggauucugagaa

SEQ ID NO: 2513481 - RNA, 21 nt, Chlamydophila pneumoniae CWL029
aaggauucugagaaguuaaga

SEQ ID NO: 2513482 - RNA, 22 nt, Chlamydophila pneumoniae CWL029
aaggauuugcucuguaguaaag

SEQ ID NO: 2513483 - RNA, 19 nt, Chlamydophila pneumoniae CWL029
aaggcaaaaaguugaggaa

SEQ ID NO: 2513484 - RNA, 12 nt, Chlamydophila pneumoniae CWL029
aaggcaagaugu

SEQ ID NO: 2513485 - RNA, 17 nt, Chlamydophila pneumoniae CWL029
aaggcaauagcagcagc

SEQ ID NO: 2513486 - RNA, 19 nt, Chlamydophila pneumoniae CWL029
aaggcacaacaaugacauu

SEQ ID NO: 2513487 - RNA, 19 nt, Chlamydophila pneumoniae CWL029
aaggcacuccaaaacucaa

SEQ ID NO: 2513488 - RNA, 13 nt, Chlamydophila pneumoniae CWL029
aaggcauaacugu

SEQ ID NO: 2513489 - RNA, 14 nt, Chlamydophila pneumoniae CWL029
aaggcauagauaca

SEQ ID NO: 2513490 - RNA, 16 nt, Chlamydophila pneumoniae CWL029
aaggcaucuucuuugc

SEQ ID NO: 2513491 - RNA, 19 nt, Chlamydophila pneumoniae CWL029
aaggcaugccuacaggcaa

SEQ ID NO: 2513492 - RNA, 13 nt, Chlamydophila pneumoniae CWL029
aaggccuaaucuu

SEQ ID NO: 2513493 - RNA, 18 nt, Chlamydophila pneumoniae CWL029
aaggccuaaucuuguagc

SEQ ID NO: 2513494 - RNA, 18 nt, Chlamydophila pneumoniae CWL029
aaggcgccuaacaacuuu

SEQ ID NO: 2513495 - RNA, 18 nt, Chlamydophila pneumoniae CWL029
aaggcggcuuuuugcaag

SEQ ID NO: 2513496 - RNA, 21 nt, Chlamydophila pneumoniae CWL029
aaggcguuuuuuaauucucug

SEQ ID NO: 2513497 - RNA, 22 nt, Chlamydophila pneumoniae CWL029
aaggcguuuuuuaauucucuga

SEQ ID NO: 2513498 - RNA, 14 nt, Chlamydophila pneumoniae CWL029
aaggcuaaaaccua

SEQ ID NO: 2513499 - RNA, 21 nt, Chlamydophila pneumoniae CWL029
aaggcucucaaggucacagca

SEQ ID NO: 2513500 - RNA, 23 nt, Chlamydophila pneumoniae CWL029
aaggcugccagagauucuucaca

SEQ ID NO: 2513501 - RNA, 19 nt, Chlamydophila pneumoniae CWL029
aaggcugcugauccaaaag

SEQ ID NO: 2513502 - RNA, 18 nt, Chlamydophila pneumoniae CWL029
aaggcugcuugagacuug

SEQ ID NO: 2513503 - RNA, 14 nt, Chlamydophila pneumoniae CWL029
aaggcuugaggauu

SEQ ID NO: 2513504 - RNA, 17 nt, Chlamydophila pneumoniae CWL029
aaggcuuuucuuuuucu

SEQ ID NO: 2513505 - RNA, 16 nt, Chlamydophila pneumoniae CWL029
aagggaggagaacuuc

SEQ ID NO: 2513506 - RNA, 14 nt, Chlamydophila pneumoniae CWL029
aagggaucuccuuc

SEQ ID NO: 2513507 - RNA, 19 nt, Chlamydophila pneumoniae CWL029
aagggaucuccuucaugca

SEQ ID NO: 2513508 - RNA, 12 nt, Chlamydophila pneumoniae CWL029
aagggaugaaga

SEQ ID NO: 2513509 - RNA, 17 nt, Chlamydophila pneumoniae CWL029
aagggaugaagauaaaa

SEQ ID NO: 2513510 - RNA, 18 nt, Chlamydophila pneumoniae CWL029
aagggaugaagauaaaau

SEQ ID NO: 2513511 - RNA, 17 nt, Chlamydophila pneumoniae CWL029
aagggaugcucuagaaa

SEQ ID NO: 2513512 - RNA, 14 nt, Chlamydophila pneumoniae CWL029
aagggauucuuguu

SEQ ID NO: 2513513 - RNA, 14 nt, Chlamydophila pneumoniae CWL029
aagggccagaaacg

SEQ ID NO: 2513514 - RNA, 20 nt, Chlamydophila pneumoniae CWL029
aagggggaucuucagagaga

SEQ ID NO: 2513515 - RNA, 15 nt, Chlamydophila pneumoniae CWL029
aaggguuguugccag

SEQ ID NO: 2513516 - RNA, 20 nt, Chlamydophila pneumoniae CWL029
aagguaaaacuacaggaaaa

SEQ ID NO: 2513517 - RNA, 21 nt, Chlamydophila pneumoniae CWL029
aagguaacauccauagagaac

SEQ ID NO: 2513518 - RNA, 15 nt, Chlamydophila pneumoniae CWL029
aagguagaguccaca

SEQ ID NO: 2513519 - RNA, 17 nt, Chlamydophila pneumoniae CWL029
aagguagaguccacagu

SEQ ID NO: 2513520 - RNA, 13 nt, Chlamydophila pneumoniae CWL029
aagguauuucucu

SEQ ID NO: 2513521 - RNA, 13 nt, Chlamydophila pneumoniae CWL029
aagguuccaaaaa

SEQ ID NO: 2513522 - RNA, 19 nt, Chlamydophila pneumoniae CWL029
aagguucccuacuccauug

SEQ ID NO: 2513523 - RNA, 12 nt, Chlamydophila pneumoniae CWL029
aagguucucaaa

SEQ ID NO: 2513524 - RNA, 22 nt, Chlamydophila pneumoniae CWL029
aagguugagacguaaccacagg

SEQ ID NO: 2513525 - RNA, 13 nt, Chlamydophila pneumoniae CWL029
aagguugcuaaga

SEQ ID NO: 2513526 - RNA, 19 nt, Chlamydophila pneumoniae CWL029
aagguugcuuuucuaggau

SEQ ID NO: 2513527 - RNA, 21 nt, Chlamydophila pneumoniae CWL029
aagguugcuuuucuaggauuu

SEQ ID NO: 2513528 - RNA, 14 nt, Chlamydophila pneumoniae CWL029
aagguuuccaugag

SEQ ID NO: 2513529 - RNA, 14 nt, Chlamydophila pneumoniae CWL029
aagguuuuaaauuu

SEQ ID NO: 2513530 - RNA, 18 nt, Chlamydophila pneumoniae CWL029
aagguuuuauaaagaucg

SEQ ID NO: 2513531 - RNA, 15 nt, Chlamydophila pneumoniae CWL029
aaguaaaacugcgcu

SEQ ID NO: 2513532 - RNA, 16 nt, Chlamydophila pneumoniae CWL029
aaguaaaauuucugua

SEQ ID NO: 2513533 - RNA, 16 nt, Chlamydophila pneumoniae CWL029
aaguaacuaucuacac

SEQ ID NO: 2513534 - RNA, 20 nt, Chlamydophila pneumoniae CWL029
aaguaacuaucuacacagua

SEQ ID NO: 2513535 - RNA, 23 nt, Chlamydophila pneumoniae CWL029
aaguaaugugcgcacaagggauu

SEQ ID NO: 2513536 - RNA, 22 nt, Chlamydophila pneumoniae CWL029
aaguacaagugaagacaaguaa

SEQ ID NO: 2513537 - RNA, 14 nt, Chlamydophila pneumoniae CWL029
aaguacacauuguc

SEQ ID NO: 2513538 - RNA, 22 nt, Chlamydophila pneumoniae CWL029
aaguacagaaaggaccuccuca

SEQ ID NO: 2513539 - RNA, 22 nt, Chlamydophila pneumoniae CWL029
aaguacauuaucacagcaaucu

SEQ ID NO: 2513540 - RNA, 16 nt, Chlamydophila pneumoniae CWL029
aaguaccaagaaaaua

SEQ ID NO: 2513541 - RNA, 22 nt, Chlamydophila pneumoniae CWL029
aaguaccuauugugcuuuucuc

SEQ ID NO: 2513542 - RNA, 22 nt, Chlamydophila pneumoniae CWL029
aaguacgaccaacuccucaaaa

SEQ ID NO: 2513543 - RNA, 18 nt, Chlamydophila pneumoniae CWL029
aaguacuaauuacagaau

SEQ ID NO: 2513544 - RNA, 13 nt, Chlamydophila pneumoniae CWL029
aaguacuacaaua

SEQ ID NO: 2513545 - RNA, 15 nt, Chlamydophila pneumoniae CWL029
aaguacugggguagu

SEQ ID NO: 2513546 - RNA, 15 nt, Chlamydophila pneumoniae CWL029
aaguagaauccuucu

SEQ ID NO: 2513547 - RNA, 16 nt, Chlamydophila pneumoniae CWL029
aaguagaauccuucuc

SEQ ID NO: 2513548 - RNA, 14 nt, Chlamydophila pneumoniae CWL029
aaguagcucucucc

SEQ ID NO: 2513549 - RNA, 15 nt, Chlamydophila pneumoniae CWL029
aaguaggaauuuuca

SEQ ID NO: 2513550 - RNA, 18 nt, Chlamydophila pneumoniae CWL029
aaguaggauugauaaauu

SEQ ID NO: 2513551 - RNA, 21 nt, Chlamydophila pneumoniae CWL029
aaguaguggacuauagaugcc

SEQ ID NO: 2513552 - RNA, 23 nt, Chlamydophila pneumoniae CWL029
aaguauagacgggcuuauaaacu

SEQ ID NO: 2513553 - RNA, 23 nt, Chlamydophila pneumoniae CWL029
aaguaucuucaguagaguuagaa

SEQ ID NO: 2513554 - RNA, 22 nt, Chlamydophila pneumoniae CWL029
aaguaucuugauguuugucaca

SEQ ID NO: 2513555 - RNA, 17 nt, Chlamydophila pneumoniae CWL029
aaguauucgauuccuga

SEQ ID NO: 2513556 - RNA, 11 nt, Chlamydophila pneumoniae CWL029
aagucaaaaug

SEQ ID NO: 2513557 - RNA, 17 nt, Chlamydophila pneumoniae CWL029
aagucacggcgaaagcu

SEQ ID NO: 2513558 - RNA, 18 nt, Chlamydophila pneumoniae CWL029
aagucacggcgaaagcua

SEQ ID NO: 2513559 - RNA, 19 nt, Chlamydophila pneumoniae CWL029
aagucagccaagacaaaaa

SEQ ID NO: 2513560 - RNA, 14 nt, Chlamydophila pneumoniae CWL029
aaguccacaagccu

SEQ ID NO: 2513561 - RNA, 23 nt, Chlamydophila pneumoniae CWL029
aaguccagacuuuccucucuuua

SEQ ID NO: 2513562 - RNA, 20 nt, Chlamydophila pneumoniae CWL029
aaguccgauagcaaugaugu

SEQ ID NO: 2513563 - RNA, 19 nt, Chlamydophila pneumoniae CWL029
aaguccuccauguacaguu

SEQ ID NO: 2513564 - RNA, 22 nt, Chlamydophila pneumoniae CWL029
aaguccuggauuuuaaagcaaa

SEQ ID NO: 2513565 - RNA, 13 nt, Chlamydophila pneumoniae CWL029
aagucgagaaaca

SEQ ID NO: 2513566 - RNA, 18 nt, Chlamydophila pneumoniae CWL029
aagugauaaggaagaauu

SEQ ID NO: 2513567 - RNA, 17 nt, Chlamydophila pneumoniae CWL029
aagugaucuugagaaaa

SEQ ID NO: 2513568 - RNA, 18 nt, Chlamydophila pneumoniae CWL029
aagugaucuugagaaaag

SEQ ID NO: 2513569 - RNA, 14 nt, Chlamydophila pneumoniae CWL029
aagugcguuccuau

SEQ ID NO: 2513570 - RNA, 19 nt, Chlamydophila pneumoniae CWL029
aagugcucaguaaauauuu

SEQ ID NO: 2513571 - RNA, 20 nt, Chlamydophila pneumoniae CWL029
aagugucugaguuagcuuuu

SEQ ID NO: 2513572 - RNA, 19 nt, Chlamydophila pneumoniae CWL029
aaguguuucuucauagcau

SEQ ID NO: 2513573 - RNA, 14 nt, Chlamydophila pneumoniae CWL029
aaguuagccuggcu

SEQ ID NO: 2513574 - RNA, 15 nt, Chlamydophila pneumoniae CWL029
aaguuauuauauaua

SEQ ID NO: 2513575 - RNA, 13 nt, Chlamydophila pneumoniae CWL029
aaguucacaagca

SEQ ID NO: 2513576 - RNA, 20 nt, Chlamydophila pneumoniae CWL029
aaguucagacgugcucucua

SEQ ID NO: 2513577 - RNA, 14 nt, Chlamydophila pneumoniae CWL029
aaguucauaaccug

SEQ ID NO: 2513578 - RNA, 12 nt, Chlamydophila pneumoniae CWL029
aaguuccuucag

SEQ ID NO: 2513579 - RNA, 23 nt, Chlamydophila pneumoniae CWL029
aaguucggcgccuucaaaaaaca

SEQ ID NO: 2513580 - RNA, 13 nt, Chlamydophila pneumoniae CWL029
aaguucucaaaga

SEQ ID NO: 2513581 - RNA, 19 nt, Chlamydophila pneumoniae CWL029
aaguucuuggaaaaaagga

SEQ ID NO: 2513582 - RNA, 22 nt, Chlamydophila pneumoniae CWL029
aaguugaaaugagugagaaugc

SEQ ID NO: 2513583 - RNA, 15 nt, Chlamydophila pneumoniae CWL029
aaguugaccuuuuuc

SEQ ID NO: 2513584 - RNA, 18 nt, Chlamydophila pneumoniae CWL029
aaguugacgcgcuucuuc

SEQ ID NO: 2513585 - RNA, 13 nt, Chlamydophila pneumoniae CWL029
aaguugagagaga

SEQ ID NO: 2513586 - RNA, 20 nt, Chlamydophila pneumoniae CWL029
aaguugaguugcguacgaua

SEQ ID NO: 2513587 - RNA, 21 nt, Chlamydophila pneumoniae CWL029
aaguugcaacucucuuuaaac

SEQ ID NO: 2513588 - RNA, 16 nt, Chlamydophila pneumoniae CWL029
aaguugccuaaagaga

SEQ ID NO: 2513589 - RNA, 20 nt, Chlamydophila pneumoniae CWL029
aaguuguagugaaugagcuu

SEQ ID NO: 2513590 - RNA, 19 nt, Chlamydophila pneumoniae CWL029
aaguuguuuauuuagcauu

SEQ ID NO: 2513591 - RNA, 22 nt, Chlamydophila pneumoniae CWL029
aaguuguuucuuguagcucccg

SEQ ID NO: 2513592 - RNA, 14 nt, Chlamydophila pneumoniae CWL029
aaguuuacaaauaa

SEQ ID NO: 2513593 - RNA, 16 nt, Chlamydophila pneumoniae CWL029
aaguuuacaaauaaaa

SEQ ID NO: 2513594 - RNA, 23 nt, Chlamydophila pneumoniae CWL029
aaguuucuuuugcaaaucuucga

SEQ ID NO: 2513595 - RNA, 15 nt, Chlamydophila pneumoniae CWL029
aaguuugcaugcaac

SEQ ID NO: 2513596 - RNA, 20 nt, Chlamydophila pneumoniae CWL029
aaguuuguagcagcaagaac

SEQ ID NO: 2513597 - RNA, 16 nt, Chlamydophila pneumoniae CWL029
aaguuuguauuuucua

SEQ ID NO: 2513598 - RNA, 19 nt, Chlamydophila pneumoniae CWL029
aaguuuguauuuucuacau

SEQ ID NO: 2513599 - RNA, 20 nt, Chlamydophila pneumoniae CWL029
aaguuuguauuuucuacauu

SEQ ID NO: 2513600 - RNA, 17 nt, Chlamydophila pneumoniae CWL029
aaguuuucgauacacaa

SEQ ID NO: 2513601 - RNA, 15 nt, Chlamydophila pneumoniae CWL029
aaguuuugaggauuu

SEQ ID NO: 2513602 - RNA, 20 nt, Chlamydophila pneumoniae CWL029
aaguuuugauuuugcaguga

SEQ ID NO: 2513603 - RNA, 18 nt, Chlamydophila pneumoniae CWL029
aaguuuugcucucuagau

SEQ ID NO: 2513604 - RNA, 20 nt, Chlamydophila pneumoniae CWL029
aaguuuugcucucuagauuu

SEQ ID NO: 2513605 - RNA, 19 nt, Chlamydophila pneumoniae CWL029
aaguuuugguuuuagaaau

SEQ ID NO: 2513606 - RNA, 14 nt, Chlamydophila pneumoniae CWL029
aauaaaaaagagag

SEQ ID NO: 2513607 - RNA, 14 nt, Chlamydophila pneumoniae CWL029
aauaaaacuuucuu

SEQ ID NO: 2513608 - RNA, 14 nt, Chlamydophila pneumoniae CWL029
aauaaaagaacauu

SEQ ID NO: 2513609 - RNA, 14 nt, Chlamydophila pneumoniae CWL029
aauaaaauguccaa

SEQ ID NO: 2513610 - RNA, 14 nt, Chlamydophila pneumoniae CWL029
aauaaaauuuaaaa

SEQ ID NO: 2513611 - RNA, 18 nt, Chlamydophila pneumoniae CWL029
aauaaaauuuaaaaaaau

SEQ ID NO: 2513612 - RNA, 18 nt, Chlamydophila pneumoniae CWL029
aauaacaccaaaagaaua

SEQ ID NO: 2513613 - RNA, 22 nt, Chlamydophila pneumoniae CWL029
aauaaccgaaacuucucagaua

SEQ ID NO: 2513614 - RNA, 21 nt, Chlamydophila pneumoniae CWL029
aauaacuauaauauaacugca

SEQ ID NO: 2513615 - RNA, 15 nt, Chlamydophila pneumoniae CWL029
aauaagauccaaaaa

SEQ ID NO: 2513616 - RNA, 14 nt, Chlamydophila pneumoniae CWL029
aauaagauuuugaa

SEQ ID NO: 2513617 - RNA, 18 nt, Chlamydophila pneumoniae CWL029
aauaagcuugccagcaga

SEQ ID NO: 2513618 - RNA, 19 nt, Chlamydophila pneumoniae CWL029
aauaagcuugccagcagaa

SEQ ID NO: 2513619 - RNA, 20 nt, Chlamydophila pneumoniae CWL029
aauaagcuugccagcagaag

SEQ ID NO: 2513620 - RNA, 22 nt, Chlamydophila pneumoniae CWL029
aauaagcuugccagcagaaguu

SEQ ID NO: 2513621 - RNA, 21 nt, Chlamydophila pneumoniae CWL029
aauaagcuuuccucuccaaaa

SEQ ID NO: 2513622 - RNA, 20 nt, Chlamydophila pneumoniae CWL029
aauaaggcugcuaucaacau

SEQ ID NO: 2513623 - RNA, 16 nt, Chlamydophila pneumoniae CWL029
aauaauacuuaauccu

SEQ ID NO: 2513624 - RNA, 12 nt, Chlamydophila pneumoniae CWL029
aauaauagcaag

SEQ ID NO: 2513625 - RNA, 17 nt, Chlamydophila pneumoniae CWL029
aauaauaggauaagaaa

SEQ ID NO: 2513626 - RNA, 16 nt, Chlamydophila pneumoniae CWL029
aauaauggcaugacgg

SEQ ID NO: 2513627 - RNA, 12 nt, Chlamydophila pneumoniae CWL029
aauaauuaaauc

SEQ ID NO: 2513628 - RNA, 12 nt, Chlamydophila pneumoniae CWL029
aauaauuuuccc

SEQ ID NO: 2513629 - RNA, 11 nt, Chlamydophila pneumoniae CWL029
aaauuuucuaa

SEQ ID NO: 2513630 - RNA, 21 nt, Chlamydophila pneumoniae CWL029
aaauuuucucgggauaaugcu

SEQ ID NO: 2513631 - RNA, 15 nt, Chlamydophila pneumoniae CWL029
aaauuuugcaacaaa

SEQ ID NO: 2513632 - RNA, 12 nt, Chlamydophila pneumoniae CWL029
aaauuuuuaaaa

SEQ ID NO: 2513633 - RNA, 16 nt, Chlamydophila pneumoniae CWL029
aacaaaaacugcgcua

SEQ ID NO: 2513634 - RNA, 20 nt, Chlamydophila pneumoniae CWL029
aacaaaaaggacucuuucua

SEQ ID NO: 2513635 - RNA, 19 nt, Chlamydophila pneumoniae CWL029
aacaaaaggcccaacucuu

SEQ ID NO: 2513636 - RNA, 20 nt, Chlamydophila pneumoniae CWL029
aacaaaauuucuuauaaaaa

SEQ ID NO: 2513637 - RNA, 21 nt, Chlamydophila pneumoniae CWL029
aacaaacuuguuuucguaaga

SEQ ID NO: 2513638 - RNA, 17 nt, Chlamydophila pneumoniae CWL029
aacaaagguuauggaug

SEQ ID NO: 2513639 - RNA, 12 nt, Chlamydophila pneumoniae CWL029
aacaaaguuuau

SEQ ID NO: 2513640 - RNA, 22 nt, Chlamydophila pneumoniae CWL029
aacaaaguuuaugacacagcua

SEQ ID NO: 2513641 - RNA, 18 nt, Chlamydophila pneumoniae CWL029
aacaaauugaugauuuuu

SEQ ID NO: 2513642 - RNA, 19 nt, Chlamydophila pneumoniae CWL029
aacaacauaaagaagguuu

SEQ ID NO: 2513643 - RNA, 11 nt, Chlamydophila pneumoniae CWL029
aacaacaucac

SEQ ID NO: 2513644 - RNA, 23 nt, Chlamydophila pneumoniae CWL029
aacaacaucacuaucauggacaa

SEQ ID NO: 2513645 - RNA, 21 nt, Chlamydophila pneumoniae CWL029
aacaacauucguuaggugacc

SEQ ID NO: 2513646 - RNA, 19 nt, Chlamydophila pneumoniae CWL029
aacaaccaaaagaauuccu

SEQ ID NO: 2513647 - RNA, 22 nt, Chlamydophila pneumoniae CWL029
aacaacucucccauguaguaaa

SEQ ID NO: 2513648 - RNA, 11 nt, Chlamydophila pneumoniae CWL029
aacaacugaaa

SEQ ID NO: 2513649 - RNA, 16 nt, Chlamydophila pneumoniae CWL029
aacaacugaaaaacca

SEQ ID NO: 2513650 - RNA, 23 nt, Chlamydophila pneumoniae CWL029
aacaacuuuccggguaaguacac

SEQ ID NO: 2513651 - RNA, 15 nt, Chlamydophila pneumoniae CWL029
aacaagaagaucaaa

SEQ ID NO: 2513652 - RNA, 14 nt, Chlamydophila pneumoniae CWL029
aacaagacgaaagc

SEQ ID NO: 2513653 - RNA, 16 nt, Chlamydophila pneumoniae CWL029
aacaagauaaccugag

SEQ ID NO: 2513654 - RNA, 23 nt, Chlamydophila pneumoniae CWL029
aacaagauaaccugagaguguug

SEQ ID NO: 2513655 - RNA, 22 nt, Chlamydophila pneumoniae CWL029
aacaagcugcugagcagcaaaa

SEQ ID NO: 2513656 - RNA, 15 nt, Chlamydophila pneumoniae CWL029
aacaaggauuaugaa

SEQ ID NO: 2513657 - RNA, 16 nt, Chlamydophila pneumoniae CWL029
aacaagggaaagaaac

SEQ ID NO: 2513658 - RNA, 18 nt, Chlamydophila pneumoniae CWL029
aacaagggaaagaaacua

SEQ ID NO: 2513659 - RNA, 19 nt, Chlamydophila pneumoniae CWL029
aacaagggaagagaaaacg

SEQ ID NO: 2513660 - RNA, 14 nt, Chlamydophila pneumoniae CWL029
aacaaguaccaaga

SEQ ID NO: 2513661 - RNA, 17 nt, Chlamydophila pneumoniae CWL029
aacaaguuuuuucaauc

SEQ ID NO: 2513662 - RNA, 13 nt, Chlamydophila pneumoniae CWL029
aacaaucuuucuu

SEQ ID NO: 2513663 - RNA, 18 nt, Chlamydophila pneumoniae CWL029
aacaaucuuucuucuaga

SEQ ID NO: 2513664 - RNA, 15 nt, Chlamydophila pneumoniae CWL029
aacaauguaaauuga

SEQ ID NO: 2513665 - RNA, 14 nt, Chlamydophila pneumoniae CWL029
aacacaaauagcaa

SEQ ID NO: 2513666 - RNA, 20 nt, Chlamydophila pneumoniae CWL029
aacacaaauagcaagagcua

SEQ ID NO: 2513667 - RNA, 16 nt, Chlamydophila pneumoniae CWL029
aacacaguuugagaaa

SEQ ID NO: 2513668 - RNA, 23 nt, Chlamydophila pneumoniae CWL029
aacacaguuugagaaagaccacc

SEQ ID NO: 2513669 - RNA, 15 nt, Chlamydophila pneumoniae CWL029
aacacccggcuuuuc

SEQ ID NO: 2513670 - RNA, 17 nt, Chlamydophila pneumoniae CWL029
aacacccggcuuuucca

SEQ ID NO: 2513671 - RNA, 20 nt, Chlamydophila pneumoniae CWL029
aacacccucccucauaagau

SEQ ID NO: 2513672 - RNA, 17 nt, Chlamydophila pneumoniae CWL029
aacaccguuaauuuuug

SEQ ID NO: 2513673 - RNA, 18 nt, Chlamydophila pneumoniae CWL029
aacaccguuaauuuuugc

SEQ ID NO: 2513674 - RNA, 18 nt, Chlamydophila pneumoniae CWL029
aacacgagugccuucuuc

SEQ ID NO: 2513675 - RNA, 16 nt, Chlamydophila pneumoniae CWL029
aacacgcacaaacuaa

SEQ ID NO: 2513676 - RNA, 20 nt, Chlamydophila pneumoniae CWL029
aacacgcccacggaaagcac

SEQ ID NO: 2513677 - RNA, 20 nt, Chlamydophila pneumoniae CWL029
aacacgccugcgaaagcgag

SEQ ID NO: 2513678 - RNA, 23 nt, Chlamydophila pneumoniae CWL029
aacacgucacuggggcauaagaa

SEQ ID NO: 2513679 - RNA, 19 nt, Chlamydophila pneumoniae CWL029
aacacucucuaccaucaug

SEQ ID NO: 2513680 - RNA, 22 nt, Chlamydophila pneumoniae CWL029
aacacugcgcaaagaacucaac

SEQ ID NO: 2513681 - RNA, 22 nt, Chlamydophila pneumoniae CWL029
aacacuuaguccgguuucuucu

SEQ ID NO: 2513682 - RNA, 17 nt, Chlamydophila pneumoniae CWL029
aacacuuuguuuuucaa

SEQ ID NO: 2513683 - RNA, 15 nt, Chlamydophila pneumoniae CWL029
aacagagcgccucca

SEQ ID NO: 2513684 - RNA, 18 nt, Chlamydophila pneumoniae CWL029
aacagagcgucuauuaga

SEQ ID NO: 2513685 - RNA, 20 nt, Chlamydophila pneumoniae CWL029
aacagauaagacaauaaaau

SEQ ID NO: 2513686 - RNA, 23 nt, Chlamydophila pneumoniae CWL029
aacagauuuuucaagaacuccuu

SEQ ID NO: 2513687 - RNA, 14 nt, Chlamydophila pneumoniae CWL029
aacagcaacacucg

SEQ ID NO: 2513688 - RNA, 18 nt, Chlamydophila pneumoniae CWL029
aacagcacucacgcucuc

SEQ ID NO: 2513689 - RNA, 19 nt, Chlamydophila pneumoniae CWL029
aacagccuagcaaaacugu

SEQ ID NO: 2513690 - RNA, 17 nt, Chlamydophila pneumoniae CWL029
aacagcuuuaucuucga

SEQ ID NO: 2513691 - RNA, 14 nt, Chlamydophila pneumoniae CWL029
aacaggauugauaa

SEQ ID NO: 2513692 - RNA, 16 nt, Chlamydophila pneumoniae CWL029
aacaggauugauaaau

SEQ ID NO: 2513693 - RNA, 19 nt, Chlamydophila pneumoniae CWL029
aacaggcacagcaaucaca

SEQ ID NO: 2513694 - RNA, 14 nt, Chlamydophila pneumoniae CWL029
aacagguucacuuc

SEQ ID NO: 2513695 - RNA, 13 nt, Chlamydophila pneumoniae CWL029
aacaguaauuauu

SEQ ID NO: 2513696 - RNA, 15 nt, Chlamydophila pneumoniae CWL029
aacaguccucucccu

SEQ ID NO: 2513697 - RNA, 15 nt, Chlamydophila pneumoniae CWL029
aacagugguaugcuu

SEQ ID NO: 2513698 - RNA, 14 nt, Chlamydophila pneumoniae CWL029
aacaguuccuauuu

SEQ ID NO: 2513699 - RNA, 15 nt, Chlamydophila pneumoniae CWL029
aacaguucuuucugc

SEQ ID NO: 2513700 - RNA, 13 nt, Chlamydophila pneumoniae CWL029
aacauaaagaagg

SEQ ID NO: 2513701 - RNA, 22 nt, Chlamydophila pneumoniae CWL029
aacauacaccccaguuucuuga

SEQ ID NO: 2513702 - RNA, 15 nt, Chlamydophila pneumoniae CWL029
aacauagauaaggua

SEQ ID NO: 2513703 - RNA, 16 nt, Chlamydophila pneumoniae CWL029
aacauagauaagguaa

SEQ ID NO: 2513704 - RNA, 20 nt, Chlamydophila pneumoniae CWL029
aacauauucuccuuaccaau

SEQ ID NO: 2513705 - RNA, 22 nt, Chlamydophila pneumoniae CWL029
aacauauucuccuuaccaauau

SEQ ID NO: 2513706 - RNA, 13 nt, Chlamydophila pneumoniae CWL029
aacaucaaagaau

SEQ ID NO: 2513707 - RNA, 14 nt, Chlamydophila pneumoniae CWL029
aacaucaaagaauu

SEQ ID NO: 2513708 - RNA, 15 nt, Chlamydophila pneumoniae CWL029
aacaucaaagaauua

SEQ ID NO: 2513709 - RNA, 13 nt, Chlamydophila pneumoniae CWL029
aacaucaaagaga

SEQ ID NO: 2513710 - RNA, 12 nt, Chlamydophila pneumoniae CWL029
aacaucaagaau

SEQ ID NO: 2513711 - RNA, 16 nt, Chlamydophila pneumoniae CWL029
aacaucagagaacucu

SEQ ID NO: 2513712 - RNA, 15 nt, Chlamydophila pneumoniae CWL029
aacaucaugaaauac

SEQ ID NO: 2513713 - RNA, 21 nt, Chlamydophila pneumoniae CWL029
aacaucccccgggaagcuguc

SEQ ID NO: 2513714 - RNA, 18 nt, Chlamydophila pneumoniae CWL029
aacaucggagaacuuccu

SEQ ID NO: 2513715 - RNA, 15 nt, Chlamydophila pneumoniae CWL029
aacaucguuaauaua

SEQ ID NO: 2513716 - RNA, 13 nt, Chlamydophila pneumoniae CWL029
aacaucuaaaaau

SEQ ID NO: 2513717 - RNA, 11 nt, Chlamydophila pneumoniae CWL029
aacaugaggau

SEQ ID NO: 2513718 - RNA, 15 nt, Chlamydophila pneumoniae CWL029
aacaugccugaaaac

SEQ ID NO: 2513719 - RNA, 14 nt, Chlamydophila pneumoniae CWL029
aacaugcgcagaau

SEQ ID NO: 2513720 - RNA, 14 nt, Chlamydophila pneumoniae CWL029
aacauggacaauau

SEQ ID NO: 2513721 - RNA, 16 nt, Chlamydophila pneumoniae CWL029
aacauugaguugguuu

SEQ ID NO: 2513722 - RNA, 23 nt, Chlamydophila pneumoniae CWL029
aaccaaccuuguugaaaggcuga

SEQ ID NO: 2513723 - RNA, 21 nt, Chlamydophila pneumoniae CWL029
aaccaaucuugagcauccaaa

SEQ ID NO: 2513724 - RNA, 22 nt, Chlamydophila pneumoniae CWL029
aaccaaucuugagcauccaaaa

SEQ ID NO: 2513725 - RNA, 20 nt, Chlamydophila pneumoniae CWL029
aaccaauugagcucucuagc

SEQ ID NO: 2513726 - RNA, 20 nt, Chlamydophila pneumoniae CWL029
aaccacggauuuucucuaca

SEQ ID NO: 2513727 - RNA, 19 nt, Chlamydophila pneumoniae CWL029
aaccacuguccaugcacga

SEQ ID NO: 2513728 - RNA, 23 nt, Chlamydophila pneumoniae CWL029
aaccacuguccaugcacgagauu

SEQ ID NO: 2513729 - RNA, 19 nt, Chlamydophila pneumoniae CWL029
aaccagaagacucccaagg

SEQ ID NO: 2513730 - RNA, 23 nt, Chlamydophila pneumoniae CWL029
aaccagguagagugucuuccuug

SEQ ID NO: 2513731 - RNA, 20 nt, Chlamydophila pneumoniae CWL029
aaccauagagagccuuuccu

SEQ ID NO: 2513732 - RNA, 20 nt, Chlamydophila pneumoniae CWL029
aaccaucaaucacucuauga

SEQ ID NO: 2513733 - RNA, 19 nt, Chlamydophila pneumoniae CWL029
aaccaucacuuccuguugu

SEQ ID NO: 2513734 - RNA, 13 nt, Chlamydophila pneumoniae CWL029
aaccaugaggcug

SEQ ID NO: 2513735 - RNA, 23 nt, Chlamydophila pneumoniae CWL029
aacccaauucuuaaaaagcuaaa

SEQ ID NO: 2513736 - RNA, 23 nt, Chlamydophila pneumoniae CWL029
aacccauauuccuauaacaacau

SEQ ID NO: 2513737 - RNA, 20 nt, Chlamydophila pneumoniae CWL029
aacccauauuugaauaaagg

SEQ ID NO: 2513738 - RNA, 13 nt, Chlamydophila pneumoniae CWL029
aacccuauuuaag

SEQ ID NO: 2513739 - RNA, 14 nt, Chlamydophila pneumoniae CWL029
aacccuauuuaagg

SEQ ID NO: 2513740 - RNA, 14 nt, Chlamydophila pneumoniae CWL029
aacccucagaacac

SEQ ID NO: 2513741 - RNA, 16 nt, Chlamydophila pneumoniae CWL029
aacccugggcucacuc

SEQ ID NO: 2513742 - RNA, 14 nt, Chlamydophila pneumoniae CWL029
aacccuuuaaugau

SEQ ID NO: 2513743 - RNA, 22 nt, Chlamydophila pneumoniae CWL029
aacccuuuaaugaucacgugga

SEQ ID NO: 2513744 - RNA, 14 nt, Chlamydophila pneumoniae CWL029
aaccgaaacuucuc

SEQ ID NO: 2513745 - RNA, 22 nt, Chlamydophila pneumoniae CWL029
aaccgaaacuucucagauaaaa

SEQ ID NO: 2513746 - RNA, 17 nt, Chlamydophila pneumoniae CWL029
aaccgagacuauuuugg

SEQ ID NO: 2513747 - RNA, 22 nt, Chlamydophila pneumoniae CWL029
aaccgcaaaaagcuucuuucuu

SEQ ID NO: 2513748 - RNA, 20 nt, Chlamydophila pneumoniae CWL029
aaccggguguggcaaaggac

SEQ ID NO: 2513749 - RNA, 22 nt, Chlamydophila pneumoniae CWL029
aaccgucacuguuuuccagaaa

SEQ ID NO: 2513750 - RNA, 21 nt, Chlamydophila pneumoniae CWL029
aaccuagaaucacauaaaaua

SEQ ID NO: 2513751 - RNA, 11 nt, Chlamydophila pneumoniae CWL029
aaccuccacca

SEQ ID NO: 2513752 - RNA, 23 nt, Chlamydophila pneumoniae CWL029
aaccuccaccaggagcuccuccu

SEQ ID NO: 2513753 - RNA, 21 nt, Chlamydophila pneumoniae CWL029
aaccuccuagaagcgcuuuau

SEQ ID NO: 2513754 - RNA, 22 nt, Chlamydophila pneumoniae CWL029
aaccucggucucgcuguuucaa

SEQ ID NO: 2513755 - RNA, 13 nt, Chlamydophila pneumoniae CWL029
aaccucuaaaaac

SEQ ID NO: 2513756 - RNA, 12 nt, Chlamydophila pneumoniae CWL029
aaccucuuuucu

SEQ ID NO: 2513757 - RNA, 13 nt, Chlamydophila pneumoniae CWL029
aaccucuuuucuu

SEQ ID NO: 2513758 - RNA, 13 nt, Chlamydophila pneumoniae CWL029
aaccuucaaugau

SEQ ID NO: 2513759 - RNA, 14 nt, Chlamydophila pneumoniae CWL029
aaccuuuccuaaaa

SEQ ID NO: 2513760 - RNA, 15 nt, Chlamydophila pneumoniae CWL029
aaccuuuuuuuaaaa

SEQ ID NO: 2513761 - RNA, 17 nt, Chlamydophila pneumoniae CWL029
aacgaacaguucauguu

SEQ ID NO: 2513762 - RNA, 13 nt, Chlamydophila pneumoniae CWL029
aacgacguuuaau

SEQ ID NO: 2513763 - RNA, 17 nt, Chlamydophila pneumoniae CWL029
aacgacguuuaauuccu

SEQ ID NO: 2513764 - RNA, 22 nt, Chlamydophila pneumoniae CWL029
aacgacguuuaauuccuuggau

SEQ ID NO: 2513765 - RNA, 17 nt, Chlamydophila pneumoniae CWL029
aacgagaaguuugauaa

SEQ ID NO: 2513766 - RNA, 22 nt, Chlamydophila pneumoniae CWL029
aacgagacugcaaaggaaggga

SEQ ID NO: 2513767 - RNA, 14 nt, Chlamydophila pneumoniae CWL029
aacgagcauuucca

SEQ ID NO: 2513768 - RNA, 14 nt, Chlamydophila pneumoniae CWL029
aacgcacgccaaga

SEQ ID NO: 2513769 - RNA, 20 nt, Chlamydophila pneumoniae CWL029
aacgcaggaagaacaaguuu

SEQ ID NO: 2513770 - RNA, 16 nt, Chlamydophila pneumoniae CWL029
aacgcauaagagacau

SEQ ID NO: 2513771 - RNA, 22 nt, Chlamydophila pneumoniae CWL029
aacgcaugaaccuauaggcaag

SEQ ID NO: 2513772 - RNA, 22 nt, Chlamydophila pneumoniae CWL029
aacgccaacacgcacaaacuaa

SEQ ID NO: 2513773 - RNA, 21 nt, Chlamydophila pneumoniae CWL029
aacgcccuucaggacaugccu

SEQ ID NO: 2513774 - RNA, 17 nt, Chlamydophila pneumoniae CWL029
aacgcccuucuuaguaa

SEQ ID NO: 2513775 - RNA, 18 nt, Chlamydophila pneumoniae CWL029
aacgcgagcuauuuuacu

SEQ ID NO: 2513776 - RNA, 14 nt, Chlamydophila pneumoniae CWL029
aacgcgauuuucaa

SEQ ID NO: 2513777 - RNA, 19 nt, Chlamydophila pneumoniae CWL029
aacgcucucuagcaccuaa

SEQ ID NO: 2513778 - RNA, 13 nt, Chlamydophila pneumoniae CWL029
aacgcuuuucuaa

SEQ ID NO: 2513779 - RNA, 23 nt, Chlamydophila pneumoniae CWL029
aacggaacuaaagagaucacagg

SEQ ID NO: 2513780 - RNA, 21 nt, Chlamydophila pneumoniae CWL029
aacggacauuuucaagcuuuc

SEQ ID NO: 2513781 - RNA, 20 nt, Chlamydophila pneumoniae CWL029
aacggcucuuucuaaaacau

SEQ ID NO: 2513782 - RNA, 19 nt, Chlamydophila pneumoniae CWL029
aacgggagcguuuuuugaa

SEQ ID NO: 2513783 - RNA, 13 nt, Chlamydophila pneumoniae CWL029
aacgguaaauauc

SEQ ID NO: 2513784 - RNA, 14 nt, Chlamydophila pneumoniae CWL029
aacgguaaauaucu

SEQ ID NO: 2513785 - RNA, 17 nt, Chlamydophila pneumoniae CWL029
aacgguaaauaucuuaa

SEQ ID NO: 2513786 - RNA, 23 nt, Chlamydophila pneumoniae CWL029
aacguacucuucuuuuuaucaug

SEQ ID NO: 2513787 - RNA, 12 nt, Chlamydophila pneumoniae CWL029
aacguacuuagg

SEQ ID NO: 2513788 - RNA, 15 nt, Chlamydophila pneumoniae CWL029
aacguacuuagguaa

SEQ ID NO: 2513789 - RNA, 18 nt, Chlamydophila pneumoniae CWL029
aacguagaugucuugguu

SEQ ID NO: 2513790 - RNA, 17 nt, Chlamydophila pneumoniae CWL029
aacguagcuacaaaauu

SEQ ID NO: 2513791 - RNA, 20 nt, Chlamydophila pneumoniae CWL029
aacguauccuugauuuuaaa

SEQ ID NO: 2513792 - RNA, 19 nt, Chlamydophila pneumoniae CWL029
aacgugauugcugcugcua

SEQ ID NO: 2513793 - RNA, 14 nt, Chlamydophila pneumoniae CWL029
aacguggggaaauu

SEQ ID NO: 2513794 - RNA, 12 nt, Chlamydophila pneumoniae CWL029
aacguugauugg

SEQ ID NO: 2513795 - RNA, 14 nt, Chlamydophila pneumoniae CWL029
aacuaaaacagccu

SEQ ID NO: 2513796 - RNA, 20 nt, Chlamydophila pneumoniae CWL029
aacuaaaacagccuagcaaa

SEQ ID NO: 2513797 - RNA, 15 nt, Chlamydophila pneumoniae CWL029
aacuaaaaguuuuuu

SEQ ID NO: 2513798 - RNA, 22 nt, Chlamydophila pneumoniae CWL029
aacuaaaaugguaaaccuaccu

SEQ ID NO: 2513799 - RNA, 14 nt, Chlamydophila pneumoniae CWL029
aacuaaacucucca

SEQ ID NO: 2513800 - RNA, 15 nt, Chlamydophila pneumoniae CWL029
aacuaaauucuuaac

SEQ ID NO: 2513801 - RNA, 20 nt, Chlamydophila pneumoniae CWL029
aacuaacuguaauuucaauu

SEQ ID NO: 2513802 - RNA, 19 nt, Chlamydophila pneumoniae CWL029
aacuaagaauaccuauagg

SEQ ID NO: 2513803 - RNA, 16 nt, Chlamydophila pneumoniae CWL029
aacuacauaauaagca

SEQ ID NO: 2513804 - RNA, 11 nt, Chlamydophila pneumoniae CWL029
aacuacauaua

SEQ ID NO: 2513805 - RNA, 15 nt, Chlamydophila pneumoniae CWL029
aacuaccagaugccu

SEQ ID NO: 2513806 - RNA, 17 nt, Chlamydophila pneumoniae CWL029
aacuacuuaaauccuaa

SEQ ID NO: 2513807 - RNA, 14 nt, Chlamydophila pneumoniae CWL029
aacuagaccaauaa

SEQ ID NO: 2513808 - RNA, 19 nt, Chlamydophila pneumoniae CWL029
aacuaguaacuuaaucaau

SEQ ID NO: 2513809 - RNA, 19 nt, Chlamydophila pneumoniae CWL029
aacuauaauauaacugcau

SEQ ID NO: 2513810 - RNA, 17 nt, Chlamydophila pneumoniae CWL029
aacuauguuauccauac

SEQ ID NO: 2513811 - RNA, 14 nt, Chlamydophila pneumoniae CWL029
aacucaacuuuuuu

SEQ ID NO: 2513812 - RNA, 16 nt, Chlamydophila pneumoniae CWL029
aacucaaucucuuuga

SEQ ID NO: 2513813 - RNA, 17 nt, Chlamydophila pneumoniae CWL029
aacucaaucucuuugac

SEQ ID NO: 2513814 - RNA, 22 nt, Chlamydophila pneumoniae CWL029
aacucaauuaugcccaaggaaa

SEQ ID NO: 2513815 - RNA, 20 nt, Chlamydophila pneumoniae CWL029
aacucaucacaauuuuaaaa

SEQ ID NO: 2513816 - RNA, 22 nt, Chlamydophila pneumoniae CWL029
aacucaucacaauuuuaaaauc

SEQ ID NO: 2513817 - RNA, 19 nt, Chlamydophila pneumoniae CWL029
aacucauccuaaauuaaau

SEQ ID NO: 2513818 - RNA, 20 nt, Chlamydophila pneumoniae CWL029
aacucauccuaaauuaaaua

SEQ ID NO: 2513819 - RNA, 23 nt, Chlamydophila pneumoniae CWL029
aacuccacgaauucuuuaaaauc

SEQ ID NO: 2513820 - RNA, 17 nt, Chlamydophila pneumoniae CWL029
aacuccaggggauaaaa

SEQ ID NO: 2513821 - RNA, 22 nt, Chlamydophila pneumoniae CWL029
aacuccgcacuugcucuuuaau

SEQ ID NO: 2513822 - RNA, 21 nt, Chlamydophila pneumoniae CWL029
aacuccuaagucguuaacauc

SEQ ID NO: 2513823 - RNA, 22 nt, Chlamydophila pneumoniae CWL029
aacuccuaagucguuaacauca

SEQ ID NO: 2513824 - RNA, 14 nt, Chlamydophila pneumoniae CWL029
aacuccucaaaaga

SEQ ID NO: 2513825 - RNA, 16 nt, Chlamydophila pneumoniae CWL029
acgucuccaacagucu

SEQ ID NO: 2513826 - RNA, 13 nt, Chlamydophila pneumoniae CWL029
acgucuuaugaaa

SEQ ID NO: 2513827 - RNA, 16 nt, Chlamydophila pneumoniae CWL029
acgucuuucaccaacu

SEQ ID NO: 2513828 - RNA, 17 nt, Chlamydophila pneumoniae CWL029
acgucuuucaccaacuc

SEQ ID NO: 2513829 - RNA, 14 nt, Chlamydophila pneumoniae CWL029
acgugaucaaaauu

SEQ ID NO: 2513830 - RNA, 18 nt, Chlamydophila pneumoniae CWL029
acgugcucucuacuucug

SEQ ID NO: 2513831 - RNA, 19 nt, Chlamydophila pneumoniae CWL029
acgugcucucuucuucuca

SEQ ID NO: 2513832 - RNA, 14 nt, Chlamydophila pneumoniae CWL029
acguggcuuccaua

SEQ ID NO: 2513833 - RNA, 20 nt, Chlamydophila pneumoniae CWL029
acguuaucuaagacuucugg

SEQ ID NO: 2513834 - RNA, 18 nt, Chlamydophila pneumoniae CWL029
acguucccacgagcacaa

SEQ ID NO: 2513835 - RNA, 13 nt, Chlamydophila pneumoniae CWL029
acguucugcaaca

SEQ ID NO: 2513836 - RNA, 15 nt, Chlamydophila pneumoniae CWL029
acguuguugcaauuc

SEQ ID NO: 2513837 - RNA, 14 nt, Chlamydophila pneumoniae CWL029
acguuuaauuccuu

SEQ ID NO: 2513838 - RNA, 17 nt, Chlamydophila pneumoniae CWL029
acguuugacaaauuuau

SEQ ID NO: 2513839 - RNA, 15 nt, Chlamydophila pneumoniae CWL029
acguuugaucuucuc

SEQ ID NO: 2513840 - RNA, 13 nt, Chlamydophila pneumoniae CWL029
acguuuuuuuccu

SEQ ID NO: 2513841 - RNA, 14 nt, Chlamydophila pneumoniae CWL029
acuaaaaaagagac

SEQ ID NO: 2513842 - RNA, 12 nt, Chlamydophila pneumoniae CWL029
acuaaaacagcc

SEQ ID NO: 2513843 - RNA, 21 nt, Chlamydophila pneumoniae CWL029
acuaaaagaauaauagcaagc

SEQ ID NO: 2513844 - RNA, 15 nt, Chlamydophila pneumoniae CWL029
acuaaaaguuuuuua

SEQ ID NO: 2513845 - RNA, 16 nt, Chlamydophila pneumoniae CWL029
acuaaacgaucaaauu

SEQ ID NO: 2513846 - RNA, 13 nt, Chlamydophila pneumoniae CWL029
acuaaagauacuu

SEQ ID NO: 2513847 - RNA, 18 nt, Chlamydophila pneumoniae CWL029
acuaaagauacuuaucuu

SEQ ID NO: 2513848 - RNA, 12 nt, Chlamydophila pneumoniae CWL029
acuaaaggugaa

SEQ ID NO: 2513849 - RNA, 23 nt, Chlamydophila pneumoniae CWL029
acuaaaucaacuacaucuccaag

SEQ ID NO: 2513850 - RNA, 17 nt, Chlamydophila pneumoniae CWL029
acuaaauucuuaacaau

SEQ ID NO: 2513851 - RNA, 12 nt, Chlamydophila pneumoniae CWL029
acuaacauagau

SEQ ID NO: 2513852 - RNA, 22 nt, Chlamydophila pneumoniae CWL029
acuaacucuguaauauucaaca

SEQ ID NO: 2513853 - RNA, 16 nt, Chlamydophila pneumoniae CWL029
acuaacuguaauuuca

SEQ ID NO: 2513854 - RNA, 17 nt, Chlamydophila pneumoniae CWL029
acuaagauaucuccagg

SEQ ID NO: 2513855 - RNA, 16 nt, Chlamydophila pneumoniae CWL029
acuacaagauaguggu

SEQ ID NO: 2513856 - RNA, 15 nt, Chlamydophila pneumoniae CWL029
acuacaauaaccagg

SEQ ID NO: 2513857 - RNA, 19 nt, Chlamydophila pneumoniae CWL029
acuacagcugcuagagcag

SEQ ID NO: 2513858 - RNA, 15 nt, Chlamydophila pneumoniae CWL029
acuacauaauaagca

SEQ ID NO: 2513859 - RNA, 13 nt, Chlamydophila pneumoniae CWL029
acuacauucagga

SEQ ID NO: 2513860 - RNA, 16 nt, Chlamydophila pneumoniae CWL029
acuacucucaucaagg

SEQ ID NO: 2513861 - RNA, 16 nt, Chlamydophila pneumoniae CWL029
acuacugaaacacuuu

SEQ ID NO: 2513862 - RNA, 21 nt, Chlamydophila pneumoniae CWL029
acuacuguagaguuuucuuuc

SEQ ID NO: 2513863 - RNA, 15 nt, Chlamydophila pneumoniae CWL029
acuacuuaaauccua

SEQ ID NO: 2513864 - RNA, 17 nt, Chlamydophila pneumoniae CWL029
acuacuuacaagaacaa

SEQ ID NO: 2513865 - RNA, 12 nt, Chlamydophila pneumoniae CWL029
acuagaaaaaau

SEQ ID NO: 2513866 - RNA, 13 nt, Chlamydophila pneumoniae CWL029
acuagaauaccgu

SEQ ID NO: 2513867 - RNA, 13 nt, Chlamydophila pneumoniae CWL029
acuagagaaaaag

SEQ ID NO: 2513868 - RNA, 22 nt, Chlamydophila pneumoniae CWL029
acuagagauucgaaagaacuac

SEQ ID NO: 2513869 - RNA, 13 nt, Chlamydophila pneumoniae CWL029
acuagaucgucaa

SEQ ID NO: 2513870 - RNA, 20 nt, Chlamydophila pneumoniae CWL029
acuagauuucuacaaacagg

SEQ ID NO: 2513871 - RNA, 14 nt, Chlamydophila pneumoniae CWL029
acuagcuuuucaug

SEQ ID NO: 2513872 - RNA, 14 nt, Chlamydophila pneumoniae CWL029
acuaggaaaagcau

SEQ ID NO: 2513873 - RNA, 18 nt, Chlamydophila pneumoniae CWL029
acuaggcaugguaggagc

SEQ ID NO: 2513874 - RNA, 23 nt, Chlamydophila pneumoniae CWL029
acuauaagagguucucuuaacug

SEQ ID NO: 2513875 - RNA, 16 nt, Chlamydophila pneumoniae CWL029
acuauagaaaaggaug

SEQ ID NO: 2513876 - RNA, 18 nt, Chlamydophila pneumoniae CWL029
acuauagaaaaggaugca

SEQ ID NO: 2513877 - RNA, 17 nt, Chlamydophila pneumoniae CWL029
acuauagaucucuugaa

SEQ ID NO: 2513878 - RNA, 17 nt, Chlamydophila pneumoniae CWL029
acuauagcaauccauag

SEQ ID NO: 2513879 - RNA, 17 nt, Chlamydophila pneumoniae CWL029
acuauagggagacucuu

SEQ ID NO: 2513880 - RNA, 20 nt, Chlamydophila pneumoniae CWL029
acuaucauggacaagcaaaa

SEQ ID NO: 2513881 - RNA, 23 nt, Chlamydophila pneumoniae CWL029
acuaucauggacaagcaaaagca

SEQ ID NO: 2513882 - RNA, 15 nt, Chlamydophila pneumoniae CWL029
acuaucuacacagua

SEQ ID NO: 2513883 - RNA, 17 nt, Chlamydophila pneumoniae CWL029
acuaucuacacaguagc

SEQ ID NO: 2513884 - RNA, 17 nt, Chlamydophila pneumoniae CWL029
acuaucucuguuuuuug

SEQ ID NO: 2513885 - RNA, 15 nt, Chlamydophila pneumoniae CWL029
acuaucuucuaaaac

SEQ ID NO: 2513886 - RNA, 15 nt, Chlamydophila pneumoniae CWL029
acuauguuauccaua

SEQ ID NO: 2513887 - RNA, 18 nt, Chlamydophila pneumoniae CWL029
acuauuaauacuuugcca

SEQ ID NO: 2513888 - RNA, 20 nt, Chlamydophila pneumoniae CWL029
acuauuaauacuuugccaac

SEQ ID NO: 2513889 - RNA, 15 nt, Chlamydophila pneumoniae CWL029
acuauuuucauucca

SEQ ID NO: 2513890 - RNA, 13 nt, Chlamydophila pneumoniae CWL029
acucaaaagaaga

SEQ ID NO: 2513891 - RNA, 12 nt, Chlamydophila pneumoniae CWL029
acucaaagaacu

SEQ ID NO: 2513892 - RNA, 15 nt, Chlamydophila pneumoniae CWL029
acucaaauucaaaau

SEQ ID NO: 2513893 - RNA, 20 nt, Chlamydophila pneumoniae CWL029
acucaaauucaaaauagaag

SEQ ID NO: 2513894 - RNA, 16 nt, Chlamydophila pneumoniae CWL029
acucaacuuuuuuacu

SEQ ID NO: 2513895 - RNA, 20 nt, Chlamydophila pneumoniae CWL029
acucaaggaguuuuaacuaa

SEQ ID NO: 2513896 - RNA, 17 nt, Chlamydophila pneumoniae CWL029
acucaaucucuuugaca

SEQ ID NO: 2513897 - RNA, 21 nt, Chlamydophila pneumoniae CWL029
acucaauuaugcccaaggaaa

SEQ ID NO: 2513898 - RNA, 22 nt, Chlamydophila pneumoniae CWL029
acucaauuaugcccaaggaaaa

SEQ ID NO: 2513899 - RNA, 15 nt, Chlamydophila pneumoniae CWL029
acucacaaacaacag

SEQ ID NO: 2513900 - RNA, 18 nt, Chlamydophila pneumoniae CWL029
acucacaaacaacagaaa

SEQ ID NO: 2513901 - RNA, 19 nt, Chlamydophila pneumoniae CWL029
acucacaaacaacagaaau

SEQ ID NO: 2513902 - RNA, 22 nt, Chlamydophila pneumoniae CWL029
acucacagaguucgcgaccugu

SEQ ID NO: 2513903 - RNA, 14 nt, Chlamydophila pneumoniae CWL029
acucacauuugcuu

SEQ ID NO: 2513904 - RNA, 18 nt, Chlamydophila pneumoniae CWL029
acucacauuugcuuuaac

SEQ ID NO: 2513905 - RNA, 19 nt, Chlamydophila pneumoniae CWL029
acucacauuugcuuuaaca

SEQ ID NO: 2513906 - RNA, 24 nt, Chlamydophila pneumoniae CWL029
acucacauuugcuuuaacagaagc

SEQ ID NO: 2513907 - RNA, 18 nt, Chlamydophila pneumoniae CWL029
acucacgcucucgcuaag

SEQ ID NO: 2513908 - RNA, 13 nt, Chlamydophila pneumoniae CWL029
acucagagaaaau

SEQ ID NO: 2513909 - RNA, 23 nt, Chlamydophila pneumoniae CWL029
acucagcguucgcucucuuuaaa

SEQ ID NO: 2513910 - RNA, 21 nt, Chlamydophila pneumoniae CWL029
acucaggauauauagagcaga

SEQ ID NO: 2513911 - RNA, 24 nt, Chlamydophila pneumoniae CWL029
acucaggcuuuaaguguuucuuca

SEQ ID NO: 2513912 - RNA, 19 nt, Chlamydophila pneumoniae CWL029
acucaucacaauuuuaaaa

SEQ ID NO: 2513913 - RNA, 14 nt, Chlamydophila pneumoniae CWL029
acucaucaguaaaa

SEQ ID NO: 2513914 - RNA, 18 nt, Chlamydophila pneumoniae CWL029
acucauccuaaauuaaau

SEQ ID NO: 2513915 - RNA, 15 nt, Chlamydophila pneumoniae CWL029
acucaugaaagugcu

SEQ ID NO: 2513916 - RNA, 13 nt, Chlamydophila pneumoniae CWL029
acuccaagaauag

SEQ ID NO: 2513917 - RNA, 19 nt, Chlamydophila pneumoniae CWL029
acuccaagaauagcaggaa

SEQ ID NO: 2513918 - RNA, 17 nt, Chlamydophila pneumoniae CWL029
acuccaagucagccaag

SEQ ID NO: 2513919 - RNA, 21 nt, Chlamydophila pneumoniae CWL029
acuccaagucagccaagacaa

SEQ ID NO: 2513920 - RNA, 23 nt, Chlamydophila pneumoniae CWL029
acuccaagucagccaagacaaaa

SEQ ID NO: 2513921 - RNA, 20 nt, Chlamydophila pneumoniae CWL029
acuccacgaauucuuuaaaa

SEQ ID NO: 2513922 - RNA, 13 nt, Chlamydophila pneumoniae CWL029
acuccacuuuuuu

SEQ ID NO: 2513923 - RNA, 14 nt, Chlamydophila pneumoniae CWL029
acuccagaaaguau

SEQ ID NO: 2513924 - RNA, 20 nt, Chlamydophila pneumoniae CWL029
agaaaaaucuaacacagucc

SEQ ID NO: 2513925 - RNA, 21 nt, Chlamydophila pneumoniae CWL029
agaaaaauucuucgagagcau

SEQ ID NO: 2513926 - RNA, 14 nt, Chlamydophila pneumoniae CWL029
agaaaacauagaga

SEQ ID NO: 2513927 - RNA, 18 nt, Chlamydophila pneumoniae CWL029
agaaaacgccaacuguau

SEQ ID NO: 2513928 - RNA, 14 nt, Chlamydophila pneumoniae CWL029
agaaaagaaagaag

SEQ ID NO: 2513929 - RNA, 15 nt, Chlamydophila pneumoniae CWL029
agaaaagaacagggg

SEQ ID NO: 2513930 - RNA, 16 nt, Chlamydophila pneumoniae CWL029
agaaaagaacagggga

SEQ ID NO: 2513931 - RNA, 20 nt, Chlamydophila pneumoniae CWL029
agaaaauaguacgcuuuuua

SEQ ID NO: 2513932 - RNA, 14 nt, Chlamydophila pneumoniae CWL029
agaaaauaucacau

SEQ ID NO: 2513933 - RNA, 20 nt, Chlamydophila pneumoniae CWL029
agaaaauaucacauuccaau

SEQ ID NO: 2513934 - RNA, 19 nt, Chlamydophila pneumoniae CWL029
agaaaaucaacucuccauc

SEQ ID NO: 2513935 - RNA, 22 nt, Chlamydophila pneumoniae CWL029
agaaaaucucuaagaaucuaua

SEQ ID NO: 2513936 - RNA, 18 nt, Chlamydophila pneumoniae CWL029
agaaaaucugcagcagau

SEQ ID NO: 2513937 - RNA, 16 nt, Chlamydophila pneumoniae CWL029
agaaaauguaaaaaau

SEQ ID NO: 2513938 - RNA, 20 nt, Chlamydophila pneumoniae CWL029
agaaaauucucagauugcuu

SEQ ID NO: 2513939 - RNA, 14 nt, Chlamydophila pneumoniae CWL029
agaaacaacugaaa

SEQ ID NO: 2513940 - RNA, 21 nt, Chlamydophila pneumoniae CWL029
agaaacacaaauucaccaacc

SEQ ID NO: 2513941 - RNA, 19 nt, Chlamydophila pneumoniae CWL029
agaaacacaguuugagaaa

SEQ ID NO: 2513942 - RNA, 19 nt, Chlamydophila pneumoniae CWL029
agaaacccgcaacucuuua

SEQ ID NO: 2513943 - RNA, 23 nt, Chlamydophila pneumoniae CWL029
agaaacuagggagaucuuauaga

SEQ ID NO: 2513944 - RNA, 15 nt, Chlamydophila pneumoniae CWL029
agaaacuccaaaaua

SEQ ID NO: 2513945 - RNA, 16 nt, Chlamydophila pneumoniae CWL029
agaaacuccaaaauau

SEQ ID NO: 2513946 - RNA, 17 nt, Chlamydophila pneumoniae CWL029
agaaacuccaaaauauu

SEQ ID NO: 2513947 - RNA, 12 nt, Chlamydophila pneumoniae CWL029
agaaacugcucc

SEQ ID NO: 2513948 - RNA, 19 nt, Chlamydophila pneumoniae CWL029
agaaacugcuccugaagcu

SEQ ID NO: 2513949 - RNA, 21 nt, Chlamydophila pneumoniae CWL029
agaaacugcuccugaagcuga

SEQ ID NO: 2513950 - RNA, 17 nt, Chlamydophila pneumoniae CWL029
agaaacuuaguuuugaa

SEQ ID NO: 2513951 - RNA, 23 nt, Chlamydophila pneumoniae CWL029
agaaacuuaguuuugaaaagauu

SEQ ID NO: 2513952 - RNA, 20 nt, Chlamydophila pneumoniae CWL029
agaaacuuuaaaagcauagu

SEQ ID NO: 2513953 - RNA, 20 nt, Chlamydophila pneumoniae CWL029
agaaagaaguccuagggagu

SEQ ID NO: 2513954 - RNA, 20 nt, Chlamydophila pneumoniae CWL029
agaaagaaugacacagagaa

SEQ ID NO: 2513955 - RNA, 22 nt, Chlamydophila pneumoniae CWL029
agaaagaaugacacagagaaca

SEQ ID NO: 2513956 - RNA, 15 nt, Chlamydophila pneumoniae CWL029
agaaagacaaaaaau

SEQ ID NO: 2513957 - RNA, 14 nt, Chlamydophila pneumoniae CWL029
agaaagaccaccuu

SEQ ID NO: 2513958 - RNA, 20 nt, Chlamydophila pneumoniae CWL029
agaaagagcuaaagaaacuu

SEQ ID NO: 2513959 - RNA, 21 nt, Chlamydophila pneumoniae CWL029
agaaagagucucacucuuuuc

SEQ ID NO: 2513960 - RNA, 23 nt, Chlamydophila pneumoniae CWL029
agaaagagucucacucuuuucua

SEQ ID NO: 2513961 - RNA, 11 nt, Chlamydophila pneumoniae CWL029
agaaagauauc

SEQ ID NO: 2513962 - RNA, 22 nt, Chlamydophila pneumoniae CWL029
agaaagauucugcccaaagcua

SEQ ID NO: 2513963 - RNA, 23 nt, Chlamydophila pneumoniae CWL029
agaaagccuuugcucacuguuuu

SEQ ID NO: 2513964 - RNA, 17 nt, Chlamydophila pneumoniae CWL029
agaaaggcgcucuuacc

SEQ ID NO: 2513965 - RNA, 22 nt, Chlamydophila pneumoniae CWL029
agaaaggcuuuucuuuuucuag

SEQ ID NO: 2513966 - RNA, 21 nt, Chlamydophila pneumoniae CWL029
agaaauacgcuuuucuucuuu

SEQ ID NO: 2513967 - RNA, 19 nt, Chlamydophila pneumoniae CWL029
agaaauaggucucuugcca

SEQ ID NO: 2513968 - RNA, 14 nt, Chlamydophila pneumoniae CWL029
agaaauauaacucu

SEQ ID NO: 2513969 - RNA, 17 nt, Chlamydophila pneumoniae CWL029
agaaauauaacucucua

SEQ ID NO: 2513970 - RNA, 18 nt, Chlamydophila pneumoniae CWL029
agaaauauacucuugcuu

SEQ ID NO: 2513971 - RNA, 15 nt, Chlamydophila pneumoniae CWL029
agaaaucaaacauua

SEQ ID NO: 2513972 - RNA, 16 nt, Chlamydophila pneumoniae CWL029
agaaaucgacagggga

SEQ ID NO: 2513973 - RNA, 19 nt, Chlamydophila pneumoniae CWL029
agaaaucucagugaacucu

SEQ ID NO: 2513974 - RNA, 17 nt, Chlamydophila pneumoniae CWL029
agaaaucugcauuccag

SEQ ID NO: 2513975 - RNA, 19 nt, Chlamydophila pneumoniae CWL029
agaaaucugcauuccagga

SEQ ID NO: 2513976 - RNA, 18 nt, Chlamydophila pneumoniae CWL029
agaaaugaaacgaaagca

SEQ ID NO: 2513977 - RNA, 21 nt, Chlamydophila pneumoniae CWL029
agaaaugcaaaccaaaaaagu

SEQ ID NO: 2513978 - RNA, 13 nt, Chlamydophila pneumoniae CWL029
agaaaugcucuuc

SEQ ID NO: 2513979 - RNA, 16 nt, Chlamydophila pneumoniae CWL029
agaaauuaacagagcg

SEQ ID NO: 2513980 - RNA, 14 nt, Chlamydophila pneumoniae CWL029
agaaauuccaauuu

SEQ ID NO: 2513981 - RNA, 20 nt, Chlamydophila pneumoniae CWL029
agaaauuccaauuuuugcau

SEQ ID NO: 2513982 - RNA, 21 nt, Chlamydophila pneumoniae CWL029
agaaauuccaauuuuugcaua

SEQ ID NO: 2513983 - RNA, 14 nt, Chlamydophila pneumoniae CWL029
agaaauucuaagag

SEQ ID NO: 2513984 - RNA, 21 nt, Chlamydophila pneumoniae CWL029
agaaauucuaagcgcucuuca

SEQ ID NO: 2513985 - RNA, 19 nt, Chlamydophila pneumoniae CWL029
agaaauucuguagauacua

SEQ ID NO: 2513986 - RNA, 13 nt, Chlamydophila pneumoniae CWL029
agaaauucuuccc

SEQ ID NO: 2513987 - RNA, 21 nt, Chlamydophila pneumoniae CWL029
agaaauuuuuaauuuuucuaa

SEQ ID NO: 2513988 - RNA, 21 nt, Chlamydophila pneumoniae CWL029
agaacaacgcugcuucucuac

SEQ ID NO: 2513989 - RNA, 11 nt, Chlamydophila pneumoniae CWL029
agaacaagaag

SEQ ID NO: 2513990 - RNA, 18 nt, Chlamydophila pneumoniae CWL029
agaacaagaaguaggaaa

SEQ ID NO: 2513991 - RNA, 22 nt, Chlamydophila pneumoniae CWL029
agaacaaggcuccguugaauua

SEQ ID NO: 2513992 - RNA, 22 nt, Chlamydophila pneumoniae CWL029
agaacaaguuuuuucaauccuu

SEQ ID NO: 2513993 - RNA, 18 nt, Chlamydophila pneumoniae CWL029
agaacaauaucagcagcu

SEQ ID NO: 2513994 - RNA, 20 nt, Chlamydophila pneumoniae CWL029
agaacaccaucacauccugu

SEQ ID NO: 2513995 - RNA, 17 nt, Chlamydophila pneumoniae CWL029
agaacacucagagaugu

SEQ ID NO: 2513996 - RNA, 22 nt, Chlamydophila pneumoniae CWL029
agaacagaggaucuagaaaaug

SEQ ID NO: 2513997 - RNA, 13 nt, Chlamydophila pneumoniae CWL029
agaacagcagaaa

SEQ ID NO: 2513998 - RNA, 16 nt, Chlamydophila pneumoniae CWL029
agaacauaaccucggu

SEQ ID NO: 2513999 - RNA, 21 nt, Chlamydophila pneumoniae CWL029
agaacauagucguuuucucga

SEQ ID NO: 2514000 - RNA, 21 nt, Chlamydophila pneumoniae CWL029
agaacaugaccuuuaggaacu

SEQ ID NO: 2514001 - RNA, 22 nt, Chlamydophila pneumoniae CWL029
agaaccuaggaaauccuccuag

SEQ ID NO: 2514002 - RNA, 11 nt, Chlamydophila pneumoniae CWL029
agaaccuccac

SEQ ID NO: 2514003 - RNA, 12 nt, Chlamydophila pneumoniae CWL029
agaaccuccacc

SEQ ID NO: 2514004 - RNA, 23 nt, Chlamydophila pneumoniae CWL029
agaaccuccaccaggagcuccuc

SEQ ID NO: 2514005 - RNA, 14 nt, Chlamydophila pneumoniae CWL029
agaaccuguuuuuc

SEQ ID NO: 2514006 - RNA, 16 nt, Chlamydophila pneumoniae CWL029
agaaccuguuuuucua

SEQ ID NO: 2514007 - RNA, 15 nt, Chlamydophila pneumoniae CWL029
agaaccuucacaaga

SEQ ID NO: 2514008 - RNA, 19 nt, Chlamydophila pneumoniae CWL029
agaacgaacaguucauguu

SEQ ID NO: 2514009 - RNA, 12 nt, Chlamydophila pneumoniae CWL029
agaacgaauuuc

SEQ ID NO: 2514010 - RNA, 20 nt, Chlamydophila pneumoniae CWL029
agaacguauacgucccacaa

SEQ ID NO: 2514011 - RNA, 21 nt, Chlamydophila pneumoniae CWL029
agaacguccucaccuugugag

SEQ ID NO: 2514012 - RNA, 14 nt, Chlamydophila pneumoniae CWL029
agaacguggggaaa

SEQ ID NO: 2514013 - RNA, 18 nt, Chlamydophila pneumoniae CWL029
agaacguggggaaauuaa

SEQ ID NO: 2514014 - RNA, 15 nt, Chlamydophila pneumoniae CWL029
agaacuacucucauu

SEQ ID NO: 2514015 - RNA, 16 nt, Chlamydophila pneumoniae CWL029
agaacuccauucagau

SEQ ID NO: 2514016 - RNA, 15 nt, Chlamydophila pneumoniae CWL029
agaacuccuuugagu

SEQ ID NO: 2514017 - RNA, 20 nt, Chlamydophila pneumoniae CWL029
agaacucuauuuggcucgcu

SEQ ID NO: 2514018 - RNA, 23 nt, Chlamydophila pneumoniae CWL029
agaacugcauaaucucaccagaa

SEQ ID NO: 2514019 - RNA, 19 nt, Chlamydophila pneumoniae CWL029
agaacugcuuggucacacc

SEQ ID NO: 2514020 - RNA, 16 nt, Chlamydophila pneumoniae CWL029
agaacuucaaugaaag

SEQ ID NO: 2514021 - RNA, 13 nt, Chlamydophila pneumoniae CWL029
agaacuucuccaa

SEQ ID NO: 2514022 - RNA, 21 nt, Chlamydophila pneumoniae CWL029
agaacuuuaacgaagaaggga

SEQ ID NO: 2514023 - RNA, 15 nt, Chlamydophila pneumoniae CWL029
agaacuuuagggaag

SEQ ID NO: 2514024 - RNA, 19 nt, Chlamydophila pneumoniae CWL029
agaacuuucgucuuugcuu

SEQ ID NO: 2514025 - RNA, 24 nt, Chlamydophila pneumoniae CWL029
agaacuuucgucuuugcuuucuag

SEQ ID NO: 2514026 - RNA, 16 nt, Chlamydophila pneumoniae CWL029
agaacuuuugaauuaa

SEQ ID NO: 2514027 - RNA, 16 nt, Chlamydophila pneumoniae CWL029
agaagaaccucauuuu

SEQ ID NO: 2514028 - RNA, 10 nt, Chlamydophila pneumoniae CWL029
agaagacgcu

SEQ ID NO: 2514029 - RNA, 19 nt, Chlamydophila pneumoniae CWL029
agaagacucccaaggaaau

SEQ ID NO: 2514030 - RNA, 14 nt, Chlamydophila pneumoniae CWL029
agaagagaaaagau

SEQ ID NO: 2514031 - RNA, 15 nt, Chlamydophila pneumoniae CWL029
agaagagaaaagaua

SEQ ID NO: 2514032 - RNA, 14 nt, Chlamydophila pneumoniae CWL029
agaagagucauuau

SEQ ID NO: 2514033 - RNA, 15 nt, Chlamydophila pneumoniae CWL029
agaagauucaagcaa

SEQ ID NO: 2514034 - RNA, 14 nt, Chlamydophila pneumoniae CWL029
agaagcaagaauca

SEQ ID NO: 2514035 - RNA, 22 nt, Chlamydophila pneumoniae CWL029
agaagcacuucuuuaggagcau

SEQ ID NO: 2514036 - RNA, 20 nt, Chlamydophila pneumoniae CWL029
agaagcaugaagcagaaacu

SEQ ID NO: 2514037 - RNA, 15 nt, Chlamydophila pneumoniae CWL029
agaagccuuccuugu

SEQ ID NO: 2514038 - RNA, 22 nt, Chlamydophila pneumoniae CWL029
agaagcuccugaguauccgaau

SEQ ID NO: 2514039 - RNA, 22 nt, Chlamydophila pneumoniae CWL029
agaagcugacaaauagaaagga

SEQ ID NO: 2514040 - RNA, 16 nt, Chlamydophila pneumoniae CWL029
agaaggaggaguccuu

SEQ ID NO: 2514041 - RNA, 16 nt, Chlamydophila pneumoniae CWL029
agaaggccaguuacug

SEQ ID NO: 2514042 - RNA, 18 nt, Chlamydophila pneumoniae CWL029
agaaggcuuguuucuguu

SEQ ID NO: 2514043 - RNA, 13 nt, Chlamydophila pneumoniae CWL029
agaagggacuugu

SEQ ID NO: 2514044 - RNA, 13 nt, Chlamydophila pneumoniae CWL029
agaaggggguucu

SEQ ID NO: 2514045 - RNA, 16 nt, Chlamydophila pneumoniae CWL029
agaagguuuauuagaa

SEQ ID NO: 2514046 - RNA, 20 nt, Chlamydophila pneumoniae CWL029
agaagguuuauuagaaguau

SEQ ID NO: 2514047 - RNA, 18 nt, Chlamydophila pneumoniae CWL029
agaaguagggucccuuga

SEQ ID NO: 2514048 - RNA, 22 nt, Chlamydophila pneumoniae CWL029
agaaguauucgauuccugaggc

SEQ ID NO: 2514049 - RNA, 14 nt, Chlamydophila pneumoniae CWL029
agaagucgcaguaa

SEQ ID NO: 2514050 - RNA, 20 nt, Chlamydophila pneumoniae CWL029
agaagucgcuagaucacaag

SEQ ID NO: 2514051 - RNA, 19 nt, Chlamydophila pneumoniae CWL029
agaagugaucuugagaaaa

SEQ ID NO: 2514052 - RNA, 15 nt, Chlamydophila pneumoniae CWL029
agaaguggccuugcc

SEQ ID NO: 2514053 - RNA, 17 nt, Chlamydophila pneumoniae CWL029
agaaguuuacaaauaaa

SEQ ID NO: 2514054 - RNA, 19 nt, Chlamydophila pneumoniae CWL029
agaaguuuacaaauaaaau

SEQ ID NO: 2514055 - RNA, 12 nt, Chlamydophila pneumoniae CWL029
agaauaaaacuu

SEQ ID NO: 2514056 - RNA, 21 nt, Chlamydophila pneumoniae CWL029
agaauaaaacuuucuuuuuga

SEQ ID NO: 2514057 - RNA, 14 nt, Chlamydophila pneumoniae CWL029
agaauaaaauagga

SEQ ID NO: 2514058 - RNA, 15 nt, Chlamydophila pneumoniae CWL029
agaauaaaauggccu

SEQ ID NO: 2514059 - RNA, 12 nt, Chlamydophila pneumoniae CWL029
agaauaaagauu

SEQ ID NO: 2514060 - RNA, 21 nt, Chlamydophila pneumoniae CWL029
agaauaacgcaagggcggaga

SEQ ID NO: 2514061 - RNA, 14 nt, Chlamydophila pneumoniae CWL029
agaauacaaacaag

SEQ ID NO: 2514062 - RNA, 16 nt, Chlamydophila pneumoniae CWL029
agaauaccuauagguu

SEQ ID NO: 2514063 - RNA, 17 nt, Chlamydophila pneumoniae CWL029
agaauacucuagguuuu

SEQ ID NO: 2514064 - RNA, 16 nt, Chlamydophila pneumoniae CWL029
agaauagcaggaagga

SEQ ID NO: 2514065 - RNA, 24 nt, Chlamydophila pneumoniae CWL029
agaauagccauaauuagaacagca

SEQ ID NO: 2514066 - RNA, 21 nt, Chlamydophila pneumoniae CWL029
agaauagggguagugaucugc

SEQ ID NO: 2514067 - RNA, 14 nt, Chlamydophila pneumoniae CWL029
agaauaugaacugc

SEQ ID NO: 2514068 - RNA, 13 nt, Chlamydophila pneumoniae CWL029
agaaucaauaaaa

SEQ ID NO: 2514069 - RNA, 22 nt, Chlamydophila pneumoniae CWL029
agaaucauaacaagucuaucga

SEQ ID NO: 2514070 - RNA, 17 nt, Chlamydophila pneumoniae CWL029
agaauccauuuugccca

SEQ ID NO: 2514071 - RNA, 23 nt, Chlamydophila pneumoniae CWL029
agaauccauuuugcccacuucua

SEQ ID NO: 2514072 - RNA, 20 nt, Chlamydophila pneumoniae CWL029
agaauccucggaagauaaau

SEQ ID NO: 2514073 - RNA, 21 nt, Chlamydophila pneumoniae CWL029
agaauccucuauccaucaucg

SEQ ID NO: 2514074 - RNA, 22 nt, Chlamydophila pneumoniae CWL029
agaauccugaguaaaaucauag

SEQ ID NO: 2514075 - RNA, 12 nt, Chlamydophila pneumoniae CWL029
agaauccuuuuu

SEQ ID NO: 2514076 - RNA, 18 nt, Chlamydophila pneumoniae CWL029
agaauccuuuuuaggaaa

SEQ ID NO: 2514077 - RNA, 18 nt, Chlamydophila pneumoniae CWL029
agaaucggaucuucaauu

SEQ ID NO: 2514078 - RNA, 21 nt, Chlamydophila pneumoniae CWL029
agaaucguucccaucacauaa

SEQ ID NO: 2514079 - RNA, 15 nt, Chlamydophila pneumoniae CWL029
agaaucuaaguaaaa

SEQ ID NO: 2514080 - RNA, 16 nt, Chlamydophila pneumoniae CWL029
agaaucuauagaacua

SEQ ID NO: 2514081 - RNA, 17 nt, Chlamydophila pneumoniae CWL029
agaaucuccauuuagaa

SEQ ID NO: 2514082 - RNA, 18 nt, Chlamydophila pneumoniae CWL029
agaaucuccauuuagaau

SEQ ID NO: 2514083 - RNA, 14 nt, Chlamydophila pneumoniae CWL029
agaaucuccucauc

SEQ ID NO: 2514084 - RNA, 12 nt, Chlamydophila pneumoniae CWL029
agaaucuuuucu

SEQ ID NO: 2514085 - RNA, 17 nt, Chlamydophila pneumoniae CWL029
agaaucuuuucuagaaa

SEQ ID NO: 2514086 - RNA, 16 nt, Chlamydophila pneumoniae CWL029
agaaugacacagagaa

SEQ ID NO: 2514087 - RNA, 20 nt, Chlamydophila pneumoniae CWL029
agaaugacacagagaacaau

SEQ ID NO: 2514088 - RNA, 23 nt, Chlamydophila pneumoniae CWL029
agaaugacacagagaacaauaaa

SEQ ID NO: 2514089 - RNA, 15 nt, Chlamydophila pneumoniae CWL029
agaaugauaagaaag

SEQ ID NO: 2514090 - RNA, 16 nt, Chlamydophila pneumoniae CWL029
agaaugauaagaaagc

SEQ ID NO: 2514091 - RNA, 11 nt, Chlamydophila pneumoniae CWL029
agaaugaugca

SEQ ID NO: 2514092 - RNA, 14 nt, Chlamydophila pneumoniae CWL029
agaaugaugcaagc

SEQ ID NO: 2514093 - RNA, 15 nt, Chlamydophila pneumoniae CWL029
agaaugcccuguucu

SEQ ID NO: 2514094 - RNA, 21 nt, Chlamydophila pneumoniae CWL029
agaaugcuguaaucgagagaa

SEQ ID NO: 2514095 - RNA, 19 nt, Chlamydophila pneumoniae CWL029
agaauguacauagaggaga

SEQ ID NO: 2514096 - RNA, 14 nt, Chlamydophila pneumoniae CWL029
agaauguaugugaa

SEQ ID NO: 2514097 - RNA, 17 nt, Chlamydophila pneumoniae CWL029
agaauguaugugaaaga

SEQ ID NO: 2514098 - RNA, 19 nt, Chlamydophila pneumoniae CWL029
agaauguucccaaauagaa

SEQ ID NO: 2514099 - RNA, 20 nt, Chlamydophila pneumoniae CWL029
agaauuaagaagaagcugac

SEQ ID NO: 2514100 - RNA, 13 nt, Chlamydophila pneumoniae CWL029
agaauucagagaa

SEQ ID NO: 2514101 - RNA, 15 nt, Chlamydophila pneumoniae CWL029
agaauucagagaaag

SEQ ID NO: 2514102 - RNA, 16 nt, Chlamydophila pneumoniae CWL029
agaauugcaaaguacu

SEQ ID NO: 2514103 - RNA, 13 nt, Chlamydophila pneumoniae CWL029
agaauuucuucuu

SEQ ID NO: 2514104 - RNA, 14 nt, Chlamydophila pneumoniae CWL029
agaauuuguccuuu

SEQ ID NO: 2514105 - RNA, 15 nt, Chlamydophila pneumoniae CWL029
agaauuuguccuuug

SEQ ID NO: 2514106 - RNA, 14 nt, Chlamydophila pneumoniae CWL029
agaauuuucaugau

SEQ ID NO: 2514107 - RNA, 14 nt, Chlamydophila pneumoniae CWL029
agaauuuucugcga

SEQ ID NO: 2514108 - RNA, 20 nt, Chlamydophila pneumoniae CWL029
agaauuuucuuuugcagcaa

SEQ ID NO: 2514109 - RNA, 22 nt, Chlamydophila pneumoniae CWL029
agacaaagaauccccccuucua

SEQ ID NO: 2514110 - RNA, 16 nt, Chlamydophila pneumoniae CWL029
agacaaagccacagcc

SEQ ID NO: 2514111 - RNA, 13 nt, Chlamydophila pneumoniae CWL029
agacaaaguuguu

SEQ ID NO: 2514112 - RNA, 15 nt, Chlamydophila pneumoniae CWL029
agacaagagagagcu

SEQ ID NO: 2514113 - RNA, 16 nt, Chlamydophila pneumoniae CWL029
agacaagagagagcug

SEQ ID NO: 2514114 - RNA, 16 nt, Chlamydophila pneumoniae CWL029
agacaaguucaucaaa

SEQ ID NO: 2514115 - RNA, 14 nt, Chlamydophila pneumoniae CWL029
agacaauaaaaaag

SEQ ID NO: 2514116 - RNA, 17 nt, Chlamydophila pneumoniae CWL029
agacaauaaaauagccc

SEQ ID NO: 2514117 - RNA, 17 nt, Chlamydophila pneumoniae CWL029
agacaaugacuguagga

SEQ ID NO: 2514118 - RNA, 23 nt, Chlamydophila pneumoniae CWL029
agacaaugucgucucagaaaaau

SEQ ID NO: 2514119 - RNA, 19 nt, Chlamydophila pneumoniae CWL029
agacacaaaaagcuuuuuu

SEQ ID NO: 2514120 - RNA, 14 nt, Chlamydophila pneumoniae CWL029
agacacacuuucuu

SEQ ID NO: 2514121 - RNA, 17 nt, Chlamydophila pneumoniae CWL029
agacacacuuucuuuaa

SEQ ID NO: 2514122 - RNA, 22 nt, Chlamydophila pneumoniae CWL029
agacacacuuucuuuaaagaau

SEQ ID NO: 2514123 - RNA, 22 nt, Chlamydophila pneumoniae CWL029
agacacaggggaacgcucucua

SEQ ID NO: 2514124 - RNA, 15 nt, Chlamydophila pneumoniae CWL029
agacaccgaaagaaa

SEQ ID NO: 2514125 - RNA, 20 nt, Chlamydophila pneumoniae CWL029
agacacuugcuuaaggaaac

SEQ ID NO: 2514126 - RNA, 16 nt, Chlamydophila pneumoniae CWL029
agacagaugcuucaag

SEQ ID NO: 2514127 - RNA, 22 nt, Chlamydophila pneumoniae CWL029
agacagaugcuucaaggcaucu

SEQ ID NO: 2514128 - RNA, 20 nt, Chlamydophila pneumoniae CWL029
agacagccuguuuucuucua

SEQ ID NO: 2514129 - RNA, 22 nt, Chlamydophila pneumoniae CWL029
agacaggagcuacugaaagaug

SEQ ID NO: 2514130 - RNA, 22 nt, Chlamydophila pneumoniae CWL029
agacaucucugcuuuccacacg

SEQ ID NO: 2514131 - RNA, 17 nt, Chlamydophila pneumoniae CWL029
agacauucauuuuuuaa

SEQ ID NO: 2514132 - RNA, 23 nt, Chlamydophila pneumoniae CWL029
agacauucccuaaagcugccagu

SEQ ID NO: 2514133 - RNA, 16 nt, Chlamydophila pneumoniae CWL029
agaccaaacuuucuuu

SEQ ID NO: 2514134 - RNA, 21 nt, Chlamydophila pneumoniae CWL029
agaccaaacuuucuuuucuau

SEQ ID NO: 2514135 - RNA, 15 nt, Chlamydophila pneumoniae CWL029
agaccaauaaaucca

SEQ ID NO: 2514136 - RNA, 19 nt, Chlamydophila pneumoniae CWL029
agaccacgaaauguuaaag

SEQ ID NO: 2514137 - RNA, 14 nt, Chlamydophila pneumoniae CWL029
agaccauaaaauca

SEQ ID NO: 2514138 - RNA, 23 nt, Chlamydophila pneumoniae CWL029
agaccauaaaaucaacaaguucu

SEQ ID NO: 2514139 - RNA, 20 nt, Chlamydophila pneumoniae CWL029
agaccaugaccuuuagcugc

SEQ ID NO: 2514140 - RNA, 22 nt, Chlamydophila pneumoniae CWL029
agaccggaucccguaaaagaac

SEQ ID NO: 2514141 - RNA, 17 nt, Chlamydophila pneumoniae CWL029
agaccguccuccccaua

SEQ ID NO: 2514142 - RNA, 14 nt, Chlamydophila pneumoniae CWL029
agaccuaaaaaggu

SEQ ID NO: 2514143 - RNA, 21 nt, Chlamydophila pneumoniae CWL029
agaccuaacgcaacauccauu

SEQ ID NO: 2514144 - RNA, 18 nt, Chlamydophila pneumoniae CWL029
agaccugccaagauacua

SEQ ID NO: 2514145 - RNA, 16 nt, Chlamydophila pneumoniae CWL029
agacgaggagaagucg

SEQ ID NO: 2514146 - RNA, 23 nt, Chlamydophila pneumoniae CWL029
agacgcuagguugcaugcuugaa

SEQ ID NO: 2514147 - RNA, 22 nt, Chlamydophila pneumoniae CWL029
agacgcuuuuaucuguuaaaaa

SEQ ID NO: 2514148 - RNA, 13 nt, Chlamydophila pneumoniae CWL029
agacguaaccaca

SEQ ID NO: 2514149 - RNA, 19 nt, Chlamydophila pneumoniae CWL029
agacguaggugccugaaga

SEQ ID NO: 2514150 - RNA, 23 nt, Chlamydophila pneumoniae CWL029
agacgugcucucuacuucuguag

SEQ ID NO: 2514151 - RNA, 14 nt, Chlamydophila pneumoniae CWL029
agacuaaaaaagag

SEQ ID NO: 2514152 - RNA, 20 nt, Chlamydophila pneumoniae CWL029
agacuaaaugacgaguugaa

SEQ ID NO: 2514153 - RNA, 21 nt, Chlamydophila pneumoniae CWL029
agacuaaaugacgaguugaag

SEQ ID NO: 2514154 - RNA, 17 nt, Chlamydophila pneumoniae CWL029
agacuagcuuuuuuuau

SEQ ID NO: 2514155 - RNA, 16 nt, Chlamydophila pneumoniae CWL029
agacuauagaaaagga

SEQ ID NO: 2514156 - RNA, 21 nt, Chlamydophila pneumoniae CWL029
agacucacauuugcuuuaaca

SEQ ID NO: 2514157 - RNA, 14 nt, Chlamydophila pneumoniae CWL029
agacucagagaaaa

SEQ ID NO: 2514158 - RNA, 21 nt, Chlamydophila pneumoniae CWL029
agacucaucuuugaacaacuc

SEQ ID NO: 2514159 - RNA, 22 nt, Chlamydophila pneumoniae CWL029
agacucccaaggaaauuaugga

SEQ ID NO: 2514160 - RNA, 23 nt, Chlamydophila pneumoniae CWL029
agacucucacugagugucccaug

SEQ ID NO: 2514161 - RNA, 14 nt, Chlamydophila pneumoniae CWL029
agacucucaucagc

SEQ ID NO: 2514162 - RNA, 16 nt, Chlamydophila pneumoniae CWL029
agacucucuuccaaaa

SEQ ID NO: 2514163 - RNA, 16 nt, Chlamydophila pneumoniae CWL029
agacugcaaaggaagg

SEQ ID NO: 2514164 - RNA, 23 nt, Chlamydophila pneumoniae CWL029
agacuggucuaacuuagagcgaa

SEQ ID NO: 2514165 - RNA, 17 nt, Chlamydophila pneumoniae CWL029
agacuuguucagcuaga

SEQ ID NO: 2514166 - RNA, 23 nt, Chlamydophila pneumoniae CWL029
agacuuguucagcuagagcacau

SEQ ID NO: 2514167 - RNA, 13 nt, Chlamydophila pneumoniae CWL029
agacuuuccucuc

SEQ ID NO: 2514168 - RNA, 13 nt, Chlamydophila pneumoniae CWL029
agacuuucugacg

SEQ ID NO: 2514169 - RNA, 18 nt, Chlamydophila pneumoniae CWL029
agacuuugccauuucuau

SEQ ID NO: 2514170 - RNA, 19 nt, Chlamydophila pneumoniae CWL029
agagaaaauaucacauucc

SEQ ID NO: 2514171 - RNA, 11 nt, Chlamydophila pneumoniae CWL029
agagaaaauca

SEQ ID NO: 2514172 - RNA, 15 nt, Chlamydophila pneumoniae CWL029
agagaaacacaaauu

SEQ ID NO: 2514173 - RNA, 20 nt, Chlamydophila pneumoniae CWL029
agagaaaggcgcucuuaccu

SEQ ID NO: 2514174 - RNA, 17 nt, Chlamydophila pneumoniae CWL029
agagaaauuaacagagc

SEQ ID NO: 2514175 - RNA, 17 nt, Chlamydophila pneumoniae CWL029
agagaacuccauucaga

SEQ ID NO: 2514176 - RNA, 17 nt, Chlamydophila pneumoniae CWL029
agagaacuuucgucuuu

SEQ ID NO: 2514177 - RNA, 15 nt, Chlamydophila pneumoniae CWL029
agagaagaagcaaaa

SEQ ID NO: 2514178 - RNA, 14 nt, Chlamydophila pneumoniae CWL029
agagaagacaggag

SEQ ID NO: 2514179 - RNA, 17 nt, Chlamydophila pneumoniae CWL029
agagaagacaggagcua

SEQ ID NO: 2514180 - RNA, 21 nt, Chlamydophila pneumoniae CWL029
agagaagagguguccauaaug

SEQ ID NO: 2514181 - RNA, 15 nt, Chlamydophila pneumoniae CWL029
agagaagcagaaucu

SEQ ID NO: 2514182 - RNA, 22 nt, Chlamydophila pneumoniae CWL029
agagaauccguuagaacucgaa

SEQ ID NO: 2514183 - RNA, 22 nt, Chlamydophila pneumoniae CWL029
agagaauccuuuuuaggaaagg

SEQ ID NO: 2514184 - RNA, 18 nt, Chlamydophila pneumoniae CWL029
agagaaucgagaacaguu

SEQ ID NO: 2514185 - RNA, 19 nt, Chlamydophila pneumoniae CWL029
agagaaucuccucaucaga

SEQ ID NO: 2514186 - RNA, 15 nt, Chlamydophila pneumoniae CWL029
agagaauguucccaa

SEQ ID NO: 2514187 - RNA, 18 nt, Chlamydophila pneumoniae CWL029
agagaauguuccuguaaa

SEQ ID NO: 2514188 - RNA, 22 nt, Chlamydophila pneumoniae CWL029
agagaauuauuauuaguuaauu

SEQ ID NO: 2514189 - RNA, 21 nt, Chlamydophila pneumoniae CWL029
agagaauuugauauccagggu

SEQ ID NO: 2514190 - RNA, 14 nt, Chlamydophila pneumoniae CWL029
agagacaaagccac

SEQ ID NO: 2514191 - RNA, 17 nt, Chlamydophila pneumoniae CWL029
agagacaaagccacagc

SEQ ID NO: 2514192 - RNA, 13 nt, Chlamydophila pneumoniae CWL029
agagacaagaaaa

SEQ ID NO: 2514193 - RNA, 14 nt, Chlamydophila pneumoniae CWL029
agagacacagaagg

SEQ ID NO: 2514194 - RNA, 20 nt, Chlamydophila pneumoniae CWL029
agagacaucguauauaagau

SEQ ID NO: 2514195 - RNA, 20 nt, Chlamydophila pneumoniae CWL029
agagacccaacaguucuuuc

SEQ ID NO: 2514196 - RNA, 12 nt, Chlamydophila pneumoniae CWL029
agagaccuucuc

SEQ ID NO: 2514197 - RNA, 15 nt, Chlamydophila pneumoniae CWL029
agagaccuucucuuc

SEQ ID NO: 2514198 - RNA, 18 nt, Chlamydophila pneumoniae CWL029
agagaccuucucuucaga

SEQ ID NO: 2514199 - RNA, 16 nt, Chlamydophila pneumoniae CWL029
agagacuguagccuuu

SEQ ID NO: 2514200 - RNA, 12 nt, Chlamydophila pneumoniae CWL029
agagagaaacuu

SEQ ID NO: 2514201 - RNA, 19 nt, Chlamydophila pneumoniae CWL029
agagagagucggcuuuaga

SEQ ID NO: 2514202 - RNA, 18 nt, Chlamydophila pneumoniae CWL029
agagagaucacuguauuu

SEQ ID NO: 2514203 - RNA, 15 nt, Chlamydophila pneumoniae CWL029
agagagccuuuccua

SEQ ID NO: 2514204 - RNA, 23 nt, Chlamydophila pneumoniae CWL029
agagagucuucguuucuuugagu

SEQ ID NO: 2514205 - RNA, 17 nt, Chlamydophila pneumoniae CWL029
agagaguucucucuuca

SEQ ID NO: 2514206 - RNA, 14 nt, Chlamydophila pneumoniae CWL029
agagauauagguau

SEQ ID NO: 2514207 - RNA, 22 nt, Chlamydophila pneumoniae CWL029
agagauauagguaucagcaaga

SEQ ID NO: 2514208 - RNA, 13 nt, Chlamydophila pneumoniae CWL029
agagaucacugua

SEQ ID NO: 2514209 - RNA, 17 nt, Chlamydophila pneumoniae CWL029
agagauccaaugacaau

SEQ ID NO: 2514210 - RNA, 15 nt, Chlamydophila pneumoniae CWL029
agagaugcuaacaac

SEQ ID NO: 2514211 - RNA, 16 nt, Chlamydophila pneumoniae CWL029
agagauucauaaaacu

SEQ ID NO: 2514212 - RNA, 17 nt, Chlamydophila pneumoniae CWL029
agagauucauaaaacug

SEQ ID NO: 2514213 - RNA, 14 nt, Chlamydophila pneumoniae CWL029
agagauucuacaaa

SEQ ID NO: 2514214 - RNA, 21 nt, Chlamydophila pneumoniae CWL029
agagauugccaggagagcuaa

SEQ ID NO: 2514215 - RNA, 18 nt, Chlamydophila pneumoniae CWL029
agagauuguaauuuccuu

SEQ ID NO: 2514216 - RNA, 21 nt, Chlamydophila pneumoniae CWL029
agagauuuuaaagccuccuca

SEQ ID NO: 2514217 - RNA, 21 nt, Chlamydophila pneumoniae CWL029
agagauuuuccauaggaacaa

SEQ ID NO: 2514218 - RNA, 22 nt, Chlamydophila pneumoniae CWL029
agagauuuuccauaggaacaaa

SEQ ID NO: 2514219 - RNA, 14 nt, Chlamydophila pneumoniae CWL029
agagauuuuucuag

SEQ ID NO: 2514220 - RNA, 20 nt, Chlamydophila pneumoniae CWL029
agagcaagauucuucagaau

SEQ ID NO: 2514221 - RNA, 17 nt, Chlamydophila pneumoniae CWL029
agagcaauuaagaaacu

SEQ ID NO: 2514222 - RNA, 20 nt, Chlamydophila pneumoniae CWL029
agagccauuuuccaggacca

SEQ ID NO: 2514223 - RNA, 19 nt, Chlamydophila pneumoniae CWL029
agagcccuugugcaucuau

SEQ ID NO: 2514224 - RNA, 15 nt, Chlamydophila pneumoniae CWL029
agagccggaacuuca

SEQ ID NO: 2514225 - RNA, 15 nt, Chlamydophila pneumoniae CWL029
agagccucuaagaaa

SEQ ID NO: 2514226 - RNA, 15 nt, Chlamydophila pneumoniae CWL029
agagccuuuucagau

SEQ ID NO: 2514227 - RNA, 18 nt, Chlamydophila pneumoniae CWL029
agagccuuuucagauuuu

SEQ ID NO: 2514228 - RNA, 16 nt, Chlamydophila pneumoniae CWL029
agagcuaaagaaacuu

SEQ ID NO: 2514229 - RNA, 22 nt, Chlamydophila pneumoniae CWL029
agagcuaaagaaacuucugacc

SEQ ID NO: 2514230 - RNA, 12 nt, Chlamydophila pneumoniae CWL029
agagcuagaaug

SEQ ID NO: 2514231 - RNA, 13 nt, Chlamydophila pneumoniae CWL029
agagcuaugauga

SEQ ID NO: 2514232 - RNA, 18 nt, Chlamydophila pneumoniae CWL029
agagcugauccagcucca

SEQ ID NO: 2514233 - RNA, 22 nt, Chlamydophila pneumoniae CWL029
agagcuggggauggucuucccc

SEQ ID NO: 2514234 - RNA, 16 nt, Chlamydophila pneumoniae CWL029
agagcuuccauuggaa

SEQ ID NO: 2514235 - RNA, 20 nt, Chlamydophila pneumoniae CWL029
agagcuuccauuggaauccu

SEQ ID NO: 2514236 - RNA, 21 nt, Chlamydophila pneumoniae CWL029
agagcuugguuuucuccuucu

SEQ ID NO: 2514237 - RNA, 20 nt, Chlamydophila pneumoniae CWL029
agagcuugucacacugcgag

SEQ ID NO: 2514238 - RNA, 14 nt, Chlamydophila pneumoniae CWL029
agagcuuucagaaa

SEQ ID NO: 2514239 - RNA, 15 nt, Chlamydophila pneumoniae CWL029
agagcuuucagaaaa

SEQ ID NO: 2514240 - RNA, 19 nt, Chlamydophila pneumoniae CWL029
agagcuuuuagguagagaa

SEQ ID NO: 2514241 - RNA, 18 nt, Chlamydophila pneumoniae CWL029
agaggaagcacaccaagu

SEQ ID NO: 2514242 - RNA, 21 nt, Chlamydophila pneumoniae CWL029
agaggaccgagaugaacauaa

SEQ ID NO: 2514243 - RNA, 15 nt, Chlamydophila pneumoniae CWL029
agaggacucccucaa

SEQ ID NO: 2514244 - RNA, 15 nt, Chlamydophila pneumoniae CWL029
agaggagagaauccu

SEQ ID NO: 2514245 - RNA, 17 nt, Chlamydophila pneumoniae CWL029
agaggagauccuaagag

SEQ ID NO: 2514246 - RNA, 14 nt, Chlamydophila pneumoniae CWL029
agaggagccuccau

SEQ ID NO: 2514247 - RNA, 23 nt, Chlamydophila pneumoniae CWL029
agaggaucuagaaaaugaagagc

SEQ ID NO: 2514248 - RNA, 13 nt, Chlamydophila pneumoniae CWL029
agaggaucuucaa

SEQ ID NO: 2514249 - RNA, 13 nt, Chlamydophila pneumoniae CWL029
agaggcaauugag

SEQ ID NO: 2514250 - RNA, 18 nt, Chlamydophila pneumoniae CWL029
agaggccuuuuagaguau

SEQ ID NO: 2514251 - RNA, 20 nt, Chlamydophila pneumoniae CWL029
agagggaucauguagcagag

SEQ ID NO: 2514252 - RNA, 20 nt, Chlamydophila pneumoniae CWL029
agaggguuuuuuugcugcga

SEQ ID NO: 2514253 - RNA, 16 nt, Chlamydophila pneumoniae CWL029
agagguaaccagagag

SEQ ID NO: 2514254 - RNA, 17 nt, Chlamydophila pneumoniae CWL029
agaggucacuauagauc

SEQ ID NO: 2514255 - RNA, 14 nt, Chlamydophila pneumoniae CWL029
agagguucccucaa

SEQ ID NO: 2514256 - RNA, 15 nt, Chlamydophila pneumoniae CWL029
agagguugagugaau

SEQ ID NO: 2514257 - RNA, 20 nt, Chlamydophila pneumoniae CWL029
agaguacgugaucucacgaa

SEQ ID NO: 2514258 - RNA, 12 nt, Chlamydophila pneumoniae CWL029
agaguagcccca

SEQ ID NO: 2514259 - RNA, 17 nt, Chlamydophila pneumoniae CWL029
agagucaaacuuauaca

SEQ ID NO: 2514260 - RNA, 14 nt, Chlamydophila pneumoniae CWL029
agaguccaagguuc

SEQ ID NO: 2514261 - RNA, 16 nt, Chlamydophila pneumoniae CWL029
agaguccgaagccuuc

SEQ ID NO: 2514262 - RNA, 16 nt, Chlamydophila pneumoniae CWL029
agaguccuucuuuucc

SEQ ID NO: 2514263 - RNA, 15 nt, Chlamydophila pneumoniae CWL029
agaguccuuuuuguu

SEQ ID NO: 2514264 - RNA, 20 nt, Chlamydophila pneumoniae CWL029
agagucucacucuuuucuag

SEQ ID NO: 2514265 - RNA, 17 nt, Chlamydophila pneumoniae CWL029
agagucucuugcuuuug

SEQ ID NO: 2514266 - RNA, 17 nt, Chlamydophila pneumoniae CWL029
agagucugcagcagaug

SEQ ID NO: 2514267 - RNA, 18 nt, Chlamydophila pneumoniae CWL029
agaguggucauugccuug

SEQ ID NO: 2514268 - RNA, 15 nt, Chlamydophila pneumoniae CWL029
agagugucuaagaua

SEQ ID NO: 2514269 - RNA, 21 nt, Chlamydophila pneumoniae CWL029
agaguguuguuggagcagaaa

SEQ ID NO: 2514270 - RNA, 14 nt, Chlamydophila pneumoniae CWL029
agaguuagauguaa

SEQ ID NO: 2514271 - RNA, 14 nt, Chlamydophila pneumoniae CWL029
agaguugauaaaua

SEQ ID NO: 2514272 - RNA, 12 nt, Chlamydophila pneumoniae CWL029
agaguugauugu

SEQ ID NO: 2514273 - RNA, 22 nt, Chlamydophila pneumoniae CWL029
agaguugccaggaaacguucuu

SEQ ID NO: 2514274 - RNA, 15 nt, Chlamydophila pneumoniae CWL029
agaguugcuuuaugg

SEQ ID NO: 2514275 - RNA, 23 nt, Chlamydophila pneumoniae CWL029
agaguugcuuuauggcucaacuu

SEQ ID NO: 2514276 - RNA, 20 nt, Chlamydophila pneumoniae CWL029
agaguuucgaauucaaugag

SEQ ID NO: 2514277 - RNA, 14 nt, Chlamydophila pneumoniae CWL029
agaguuucuuuuga

SEQ ID NO: 2514278 - RNA, 19 nt, Chlamydophila pneumoniae CWL029
agaguuuuacaucaaugau

SEQ ID NO: 2514279 - RNA, 18 nt, Chlamydophila pneumoniae CWL029
agaguuuuuuagaggagc

SEQ ID NO: 2514280 - RNA, 20 nt, Chlamydophila pneumoniae CWL029
agaguuuuuuagaggagcuu

SEQ ID NO: 2514281 - RNA, 18 nt, Chlamydophila pneumoniae CWL029
agauaaacagcacaggca

SEQ ID NO: 2514282 - RNA, 13 nt, Chlamydophila pneumoniae CWL029
agauaaacauuaa

SEQ ID NO: 2514283 - RNA, 19 nt, Chlamydophila pneumoniae CWL029
agauaaagacaucucuuua

SEQ ID NO: 2514284 - RNA, 23 nt, Chlamydophila pneumoniae CWL029
agauaaaggcauaacugugcucc

SEQ ID NO: 2514285 - RNA, 13 nt, Chlamydophila pneumoniae CWL029
agauaaaucccac

SEQ ID NO: 2514286 - RNA, 23 nt, Chlamydophila pneumoniae CWL029
agauaagucgaaucuaaaaacuu

SEQ ID NO: 2514287 - RNA, 14 nt, Chlamydophila pneumoniae CWL029
agauaauagagaag

SEQ ID NO: 2514288 - RNA, 17 nt, Chlamydophila pneumoniae CWL029
agauaauagagaagaag

SEQ ID NO: 2514289 - RNA, 19 nt, Chlamydophila pneumoniae CWL029
agauaauagagaagaagca

SEQ ID NO: 2514290 - RNA, 20 nt, Chlamydophila pneumoniae CWL029
agauaaucuguaagaaaaug

SEQ ID NO: 2514291 - RNA, 15 nt, Chlamydophila pneumoniae CWL029
agauacgaaguccca

SEQ ID NO: 2514292 - RNA, 21 nt, Chlamydophila pneumoniae CWL029
agauacuaucugccauaggau

SEQ ID NO: 2514293 - RNA, 22 nt, Chlamydophila pneumoniae CWL029
agauacuaucugccauaggauc

SEQ ID NO: 2514294 - RNA, 14 nt, Chlamydophila pneumoniae CWL029
agauagagauaagu

SEQ ID NO: 2514295 - RNA, 14 nt, Chlamydophila pneumoniae CWL029
agauagcaaaucaa

SEQ ID NO: 2514296 - RNA, 16 nt, Chlamydophila pneumoniae CWL029
agauagcaaaucaaua

SEQ ID NO: 2514297 - RNA, 20 nt, Chlamydophila pneumoniae CWL029
agauagcuuacagagaaauu

SEQ ID NO: 2514298 - RNA, 16 nt, Chlamydophila pneumoniae CWL029
agauagguuuuuguaa

SEQ ID NO: 2514299 - RNA, 21 nt, Chlamydophila pneumoniae CWL029
agauaguauuuuugaaaccaa

SEQ ID NO: 2514300 - RNA, 12 nt, Chlamydophila pneumoniae CWL029
agauauagagag

SEQ ID NO: 2514301 - RNA, 22 nt, Chlamydophila pneumoniae CWL029
agauaucgaccuuaaaauugaa

SEQ ID NO: 2514302 - RNA, 12 nt, Chlamydophila pneumoniae CWL029
agauaucuugua

SEQ ID NO: 2514303 - RNA, 13 nt, Chlamydophila pneumoniae CWL029
agauaugaagaga

SEQ ID NO: 2514304 - RNA, 23 nt, Chlamydophila pneumoniae CWL029
agauauuaucgauaggaagccag

SEQ ID NO: 2514305 - RNA, 19 nt, Chlamydophila pneumoniae CWL029
agauauucaagaggaccga

SEQ ID NO: 2514306 - RNA, 14 nt, Chlamydophila pneumoniae CWL029
agaucaaaacuccg

SEQ ID NO: 2514307 - RNA, 23 nt, Chlamydophila pneumoniae CWL029
agaucaaguccucgccgcugccc

SEQ ID NO: 2514308 - RNA, 15 nt, Chlamydophila pneumoniae CWL029
agaucaauauagaga

SEQ ID NO: 2514309 - RNA, 13 nt, Chlamydophila pneumoniae CWL029
agaucacaucaag

SEQ ID NO: 2514310 - RNA, 19 nt, Chlamydophila pneumoniae CWL029
agaucagaggaaucuaaga

SEQ ID NO: 2514311 - RNA, 17 nt, Chlamydophila pneumoniae CWL029
agaucaggauucuaaaa

SEQ ID NO: 2514312 - RNA, 14 nt, Chlamydophila pneumoniae CWL029
agaucauaaacagc

SEQ ID NO: 2514313 - RNA, 20 nt, Chlamydophila pneumoniae CWL029
agaucaucucccaaauagcu

SEQ ID NO: 2514314 - RNA, 16 nt, Chlamydophila pneumoniae CWL029
agaucauuagcaucau

SEQ ID NO: 2514315 - RNA, 14 nt, Chlamydophila pneumoniae CWL029
agauccaaagccug

SEQ ID NO: 2514316 - RNA, 21 nt, Chlamydophila pneumoniae CWL029
agguuccacagagaccuucuc

SEQ ID NO: 2514317 - RNA, 17 nt, Chlamydophila pneumoniae CWL029
agguuccugcuugauuu

SEQ ID NO: 2514318 - RNA, 21 nt, Chlamydophila pneumoniae CWL029
agguucuugcuuauugucuua

SEQ ID NO: 2514319 - RNA, 18 nt, Chlamydophila pneumoniae CWL029
agguugagugaauuucuu

SEQ ID NO: 2514320 - RNA, 14 nt, Chlamydophila pneumoniae CWL029
agguugcuuuucua

SEQ ID NO: 2514321 - RNA, 22 nt, Chlamydophila pneumoniae CWL029
agguugggcagaagcuucugaa

SEQ ID NO: 2514322 - RNA, 16 nt, Chlamydophila pneumoniae CWL029
agguuguccuauagag

SEQ ID NO: 2514323 - RNA, 23 nt, Chlamydophila pneumoniae CWL029
agguuuugaagcuccucacaucu

SEQ ID NO: 2514324 - RNA, 15 nt, Chlamydophila pneumoniae CWL029
aguaaaacacaaaua

SEQ ID NO: 2514325 - RNA, 22 nt, Chlamydophila pneumoniae CWL029
aguaaaaucauaggcuauaauu

SEQ ID NO: 2514326 - RNA, 15 nt, Chlamydophila pneumoniae CWL029
aguaaaauuucugua

SEQ ID NO: 2514327 - RNA, 14 nt, Chlamydophila pneumoniae CWL029
aguaaagccacauu

SEQ ID NO: 2514328 - RNA, 20 nt, Chlamydophila pneumoniae CWL029
aguaaagccacauucuucug

SEQ ID NO: 2514329 - RNA, 13 nt, Chlamydophila pneumoniae CWL029
aguaaaguaugca

SEQ ID NO: 2514330 - RNA, 23 nt, Chlamydophila pneumoniae CWL029
aguaaauauuuuaccauugagau

SEQ ID NO: 2514331 - RNA, 13 nt, Chlamydophila pneumoniae CWL029
aguaacuaucuac

SEQ ID NO: 2514332 - RNA, 15 nt, Chlamydophila pneumoniae CWL029
aguaacuaucuacac

SEQ ID NO: 2514333 - RNA, 14 nt, Chlamydophila pneumoniae CWL029
aguaacugcaaaga

SEQ ID NO: 2514334 - RNA, 16 nt, Chlamydophila pneumoniae CWL029
aguaacugcaaagaga

SEQ ID NO: 2514335 - RNA, 15 nt, Chlamydophila pneumoniae CWL029
aguaacuuaaucaau

SEQ ID NO: 2514336 - RNA, 15 nt, Chlamydophila pneumoniae CWL029
aguaagaagucuuca

SEQ ID NO: 2514337 - RNA, 17 nt, Chlamydophila pneumoniae CWL029
aguaaggaacaauguaa

SEQ ID NO: 2514338 - RNA, 19 nt, Chlamydophila pneumoniae CWL029
aguaaggaacaauguaaau

SEQ ID NO: 2514339 - RNA, 13 nt, Chlamydophila pneumoniae CWL029
aguaaggagagac

SEQ ID NO: 2514340 - RNA, 13 nt, Chlamydophila pneumoniae CWL029
aguaagucuucga

SEQ ID NO: 2514341 - RNA, 23 nt, Chlamydophila pneumoniae CWL029
aguaauaucuccgccauaacacu

SEQ ID NO: 2514342 - RNA, 20 nt, Chlamydophila pneumoniae CWL029
aguaaucacuucagcacgaa

SEQ ID NO: 2514343 - RNA, 16 nt, Chlamydophila pneumoniae CWL029
aguaauccuaauuccu

SEQ ID NO: 2514344 - RNA, 16 nt, Chlamydophila pneumoniae CWL029
aguaauguuaacgaau

SEQ ID NO: 2514345 - RNA, 14 nt, Chlamydophila pneumoniae CWL029
aguaauuacagcuu

SEQ ID NO: 2514346 - RNA, 23 nt, Chlamydophila pneumoniae CWL029
aguaauuauuuucuacacuguug

SEQ ID NO: 2514347 - RNA, 22 nt, Chlamydophila pneumoniae CWL029
aguaauuccaaaauaaaaggag

SEQ ID NO: 2514348 - RNA, 13 nt, Chlamydophila pneumoniae CWL029
aguaauuucuccg

SEQ ID NO: 2514349 - RNA, 21 nt, Chlamydophila pneumoniae CWL029
aguacagauuucagauaaucu

SEQ ID NO: 2514350 - RNA, 15 nt, Chlamydophila pneumoniae CWL029
aguaccaagaaaaua

SEQ ID NO: 2514351 - RNA, 15 nt, Chlamydophila pneumoniae CWL029
aguacccagucaucg

SEQ ID NO: 2514352 - RNA, 22 nt, Chlamydophila pneumoniae CWL029
aguaccucaucucuggaauaca

SEQ ID NO: 2514353 - RNA, 16 nt, Chlamydophila pneumoniae CWL029
aguacgauccaucuca

SEQ ID NO: 2514354 - RNA, 17 nt, Chlamydophila pneumoniae CWL029
aguacgcaaaguacuaa

SEQ ID NO: 2514355 - RNA, 17 nt, Chlamydophila pneumoniae CWL029
aguacgugaucucacga

SEQ ID NO: 2514356 - RNA, 18 nt, Chlamydophila pneumoniae CWL029
aguacuuauccugaacau

SEQ ID NO: 2514357 - RNA, 19 nt, Chlamydophila pneumoniae CWL029
aguacuuauccugaacauc

SEQ ID NO: 2514358 - RNA, 21 nt, Chlamydophila pneumoniae CWL029
aguacuucuuacccuaauuug

SEQ ID NO: 2514359 - RNA, 17 nt, Chlamydophila pneumoniae CWL029
aguagaauccuucuccc

SEQ ID NO: 2514360 - RNA, 19 nt, Chlamydophila pneumoniae CWL029
aguagaauccuucucccuc

SEQ ID NO: 2514361 - RNA, 19 nt, Chlamydophila pneumoniae CWL029
aguagagccucuaagaaaa

SEQ ID NO: 2514362 - RNA, 18 nt, Chlamydophila pneumoniae CWL029
aguagaggaauucuggaa

SEQ ID NO: 2514363 - RNA, 17 nt, Chlamydophila pneumoniae CWL029
aguagcauccuguagag

SEQ ID NO: 2514364 - RNA, 22 nt, Chlamydophila pneumoniae CWL029
aguagcgaauccagaauuuucu

SEQ ID NO: 2514365 - RNA, 20 nt, Chlamydophila pneumoniae CWL029
aguagcucucuccuggagag

SEQ ID NO: 2514366 - RNA, 15 nt, Chlamydophila pneumoniae CWL029
aguagcuugugcuaa

SEQ ID NO: 2514367 - RNA, 13 nt, Chlamydophila pneumoniae CWL029
aguaggagcagcg

SEQ ID NO: 2514368 - RNA, 14 nt, Chlamydophila pneumoniae CWL029
aguagguaagaagc

SEQ ID NO: 2514369 - RNA, 22 nt, Chlamydophila pneumoniae CWL029
aguauaauagugagcucccuga

SEQ ID NO: 2514370 - RNA, 13 nt, Chlamydophila pneumoniae CWL029
aguauaaucagaa

SEQ ID NO: 2514371 - RNA, 15 nt, Chlamydophila pneumoniae CWL029
aguauacaagcgaaa

SEQ ID NO: 2514372 - RNA, 20 nt, Chlamydophila pneumoniae CWL029
aguauagcuuuuaguuuccc

SEQ ID NO: 2514373 - RNA, 14 nt, Chlamydophila pneumoniae CWL029
aguauagucugguu

SEQ ID NO: 2514374 - RNA, 23 nt, Chlamydophila pneumoniae CWL029
aguauccuccuucugcaugaaua

SEQ ID NO: 2514375 - RNA, 22 nt, Chlamydophila pneumoniae CWL029
aguaucgagcucuuuaagaacu

SEQ ID NO: 2514376 - RNA, 23 nt, Chlamydophila pneumoniae CWL029
aguaucgggauuuugucgagaac

SEQ ID NO: 2514377 - RNA, 17 nt, Chlamydophila pneumoniae CWL029
aguaucuaaaacuucuu

SEQ ID NO: 2514378 - RNA, 12 nt, Chlamydophila pneumoniae CWL029
aguaucuagcuu

SEQ ID NO: 2514379 - RNA, 16 nt, Chlamydophila pneumoniae CWL029
aguauggcaaauaaaa

SEQ ID NO: 2514380 - RNA, 14 nt, Chlamydophila pneumoniae CWL029
aguauggcauucuu

SEQ ID NO: 2514381 - RNA, 21 nt, Chlamydophila pneumoniae CWL029
aguauuaaagaugaaguuccc

SEQ ID NO: 2514382 - RNA, 14 nt, Chlamydophila pneumoniae CWL029
aguauuaaucuuau

SEQ ID NO: 2514383 - RNA, 18 nt, Chlamydophila pneumoniae CWL029
aguauuccaucacaguua

SEQ ID NO: 2514384 - RNA, 15 nt, Chlamydophila pneumoniae CWL029
aguauucccuccgca

SEQ ID NO: 2514385 - RNA, 19 nt, Chlamydophila pneumoniae CWL029
aguauucgauuccugaggc

SEQ ID NO: 2514386 - RNA, 11 nt, Chlamydophila pneumoniae CWL029
agucaaagggc

SEQ ID NO: 2514387 - RNA, 20 nt, Chlamydophila pneumoniae CWL029
agucaaauacuucuccugaa

SEQ ID NO: 2514388 - RNA, 13 nt, Chlamydophila pneumoniae CWL029
agucacacuuucc

SEQ ID NO: 2514389 - RNA, 15 nt, Chlamydophila pneumoniae CWL029
agucacacuuuccgu

SEQ ID NO: 2514390 - RNA, 24 nt, Chlamydophila pneumoniae CWL029
agucacggcgaaagcuacagcuaa

SEQ ID NO: 2514391 - RNA, 16 nt, Chlamydophila pneumoniae CWL029
agucagccaagacaaa

SEQ ID NO: 2514392 - RNA, 18 nt, Chlamydophila pneumoniae CWL029
agucagccaagacaaaaa

SEQ ID NO: 2514393 - RNA, 19 nt, Chlamydophila pneumoniae CWL029
agucaggaagaugcuggaa

SEQ ID NO: 2514394 - RNA, 16 nt, Chlamydophila pneumoniae CWL029
agucauaagcucuauu

SEQ ID NO: 2514395 - RNA, 22 nt, Chlamydophila pneumoniae CWL029
agucaugauuuuucaaucaaua

SEQ ID NO: 2514396 - RNA, 23 nt, Chlamydophila pneumoniae CWL029
agucauguccguucgagagguuc

SEQ ID NO: 2514397 - RNA, 16 nt, Chlamydophila pneumoniae CWL029
agucauuaucacagau

SEQ ID NO: 2514398 - RNA, 13 nt, Chlamydophila pneumoniae CWL029
aguccaagaucaa

SEQ ID NO: 2514399 - RNA, 13 nt, Chlamydophila pneumoniae CWL029
aguccaagguucu

SEQ ID NO: 2514400 - RNA, 10 nt, Chlamydophila pneumoniae CWL029
aguccacauc

SEQ ID NO: 2514401 - RNA, 15 nt, Chlamydophila pneumoniae CWL029
aguccagacuuuccu

SEQ ID NO: 2514402 - RNA, 16 nt, Chlamydophila pneumoniae CWL029
aguccagacuuuccuc

SEQ ID NO: 2514403 - RNA, 15 nt, Chlamydophila pneumoniae CWL029
aguccaguuuguuga

SEQ ID NO: 2514404 - RNA, 16 nt, Chlamydophila pneumoniae CWL029
aguccauguacagaaa

SEQ ID NO: 2514405 - RNA, 18 nt, Chlamydophila pneumoniae CWL029
aguccauguacagaaaau

SEQ ID NO: 2514406 - RNA, 23 nt, Chlamydophila pneumoniae CWL029
agucccuaaccucgccucuuguc

SEQ ID NO: 2514407 - RNA, 19 nt, Chlamydophila pneumoniae CWL029
agucccuugcgggagaagu

SEQ ID NO: 2514408 - RNA, 18 nt, Chlamydophila pneumoniae CWL029
agucccuugucaacaaaa

SEQ ID NO: 2514409 - RNA, 23 nt, Chlamydophila pneumoniae CWL029
aguccgcaugaacgugcaucucu

SEQ ID NO: 2514410 - RNA, 13 nt, Chlamydophila pneumoniae CWL029
aguccuaaaauuu

SEQ ID NO: 2514411 - RNA, 19 nt, Chlamydophila pneumoniae CWL029
aguccuaucaaagcaaaag

SEQ ID NO: 2514412 - RNA, 20 nt, Chlamydophila pneumoniae CWL029
aguccucucccuuaaggaaa

SEQ ID NO: 2514413 - RNA, 20 nt, Chlamydophila pneumoniae CWL029
aguccuucuagguauuuguu

SEQ ID NO: 2514414 - RNA, 12 nt, Chlamydophila pneumoniae CWL029
aggcauuaauaa

SEQ ID NO: 2514415 - RNA, 19 nt, Chlamydophila pneumoniae CWL029
aggcauuacacaacucuuu

SEQ ID NO: 2514416 - RNA, 16 nt, Chlamydophila pneumoniae CWL029
aggcauuggaaaucuu

SEQ ID NO: 2514417 - RNA, 13 nt, Chlamydophila pneumoniae CWL029
aggccaaagaaca

SEQ ID NO: 2514418 - RNA, 20 nt, Chlamydophila pneumoniae CWL029
aggcccccuacagcagaaac

SEQ ID NO: 2514419 - RNA, 23 nt, Chlamydophila pneumoniae CWL029
aggccuaaaaucaccauauccau

SEQ ID NO: 2514420 - RNA, 18 nt, Chlamydophila pneumoniae CWL029
aggccuccauuucuagga

SEQ ID NO: 2514421 - RNA, 23 nt, Chlamydophila pneumoniae CWL029
aggccuccauuucuaggaauugc

SEQ ID NO: 2514422 - RNA, 16 nt, Chlamydophila pneumoniae CWL029
aggccuccuucauuca

SEQ ID NO: 2514423 - RNA, 17 nt, Chlamydophila pneumoniae CWL029
aggcgauaguaaacaga

SEQ ID NO: 2514424 - RNA, 21 nt, Chlamydophila pneumoniae CWL029
aggcuaaaaccuagacucugc

SEQ ID NO: 2514425 - RNA, 15 nt, Chlamydophila pneumoniae CWL029
aggcuacugaagagg

SEQ ID NO: 2514426 - RNA, 21 nt, Chlamydophila pneumoniae CWL029
aggcuauaauuaacguuucuu

SEQ ID NO: 2514427 - RNA, 14 nt, Chlamydophila pneumoniae CWL029
aggcuauuguguuu

SEQ ID NO: 2514428 - RNA, 13 nt, Chlamydophila pneumoniae CWL029
aggcuccagcaua

SEQ ID NO: 2514429 - RNA, 20 nt, Chlamydophila pneumoniae CWL029
aggcuccucugcuaagcaca

SEQ ID NO: 2514430 - RNA, 22 nt, Chlamydophila pneumoniae CWL029
aggcucuacaggagaagcggaa

SEQ ID NO: 2514431 - RNA, 22 nt, Chlamydophila pneumoniae CWL029
aggcucucgacacuauguguuu

SEQ ID NO: 2514432 - RNA, 16 nt, Chlamydophila pneumoniae CWL029
aggcucuuuagcaaac

SEQ ID NO: 2514433 - RNA, 23 nt, Chlamydophila pneumoniae CWL029
aggcugcuacgugaucaaaauua

SEQ ID NO: 2514434 - RNA, 13 nt, Chlamydophila pneumoniae CWL029
aggcugcuaucaa

SEQ ID NO: 2514435 - RNA, 15 nt, Chlamydophila pneumoniae CWL029
aggcuguguaaaagu

SEQ ID NO: 2514436 - RNA, 17 nt, Chlamydophila pneumoniae CWL029
aggcuguguaaaaguua

SEQ ID NO: 2514437 - RNA, 15 nt, Chlamydophila pneumoniae CWL029
aggcuuguuucuguu

SEQ ID NO: 2514438 - RNA, 20 nt, Chlamydophila pneumoniae CWL029
aggcuuuaaguguuucuuca

SEQ ID NO: 2514439 - RNA, 10 nt, Chlamydophila pneumoniae CWL029
agggaaaaag

SEQ ID NO: 2514440 - RNA, 23 nt, Chlamydophila pneumoniae CWL029
agggaaaaugcgaucuucacgac

SEQ ID NO: 2514441 - RNA, 13 nt, Chlamydophila pneumoniae CWL029
agggaaacaccgu

SEQ ID NO: 2514442 - RNA, 14 nt, Chlamydophila pneumoniae CWL029
agggaaagaaacua

SEQ ID NO: 2514443 - RNA, 22 nt, Chlamydophila pneumoniae CWL029
agggaaaggagcgcuacuguau

SEQ ID NO: 2514444 - RNA, 18 nt, Chlamydophila pneumoniae CWL029
agggaaaguucaguaaaa

SEQ ID NO: 2514445 - RNA, 18 nt, Chlamydophila pneumoniae CWL029
agggaaaugucacucuag

SEQ ID NO: 2514446 - RNA, 19 nt, Chlamydophila pneumoniae CWL029
agggaauccccaauguuuu

SEQ ID NO: 2514447 - RNA, 22 nt, Chlamydophila pneumoniae CWL029
agggaauuucauguccuccaug

SEQ ID NO: 2514448 - RNA, 23 nt, Chlamydophila pneumoniae CWL029
agggaauuuucucauagcuuccu

SEQ ID NO: 2514449 - RNA, 17 nt, Chlamydophila pneumoniae CWL029
agggacagucuccugga

SEQ ID NO: 2514450 - RNA, 23 nt, Chlamydophila pneumoniae CWL029
agggacagucuccuggaacagua

SEQ ID NO: 2514451 - RNA, 18 nt, Chlamydophila pneumoniae CWL029
agggacuucucaaagaca

SEQ ID NO: 2514452 - RNA, 17 nt, Chlamydophila pneumoniae CWL029
agggagacucuugaggc

SEQ ID NO: 2514453 - RNA, 19 nt, Chlamydophila pneumoniae CWL029
agggaucauguagcagagc

SEQ ID NO: 2514454 - RNA, 10 nt, Chlamydophila pneumoniae CWL029
agggauccca

SEQ ID NO: 2514455 - RNA, 20 nt, Chlamydophila pneumoniae CWL029
agggaucuccuucaugcagu

SEQ ID NO: 2514456 - RNA, 15 nt, Chlamydophila pneumoniae CWL029
agggaugaagauaaa

SEQ ID NO: 2514457 - RNA, 12 nt, Chlamydophila pneumoniae CWL029
agggaugggauc

SEQ ID NO: 2514458 - RNA, 19 nt, Chlamydophila pneumoniae CWL029
agggauucuuguuggauug

SEQ ID NO: 2514459 - RNA, 22 nt, Chlamydophila pneumoniae CWL029
agggauucuuguuggauugaaa

SEQ ID NO: 2514460 - RNA, 18 nt, Chlamydophila pneumoniae CWL029
agggcaaccauucaucua

SEQ ID NO: 2514461 - RNA, 22 nt, Chlamydophila pneumoniae CWL029
agggcauucuguaauuuugaga

SEQ ID NO: 2514462 - RNA, 14 nt, Chlamydophila pneumoniae CWL029
agggcggaauacuu

SEQ ID NO: 2514463 - RNA, 14 nt, Chlamydophila pneumoniae CWL029
agggcuucaacauu

SEQ ID NO: 2514464 - RNA, 14 nt, Chlamydophila pneumoniae CWL029
agggcuuccuuacu

SEQ ID NO: 2514465 - RNA, 18 nt, Chlamydophila pneumoniae CWL029
agggcuucguggaacuuu

SEQ ID NO: 2514466 - RNA, 15 nt, Chlamydophila pneumoniae CWL029
aggggaagaggaaug

SEQ ID NO: 2514467 - RNA, 18 nt, Chlamydophila pneumoniae CWL029
aggggcguucuugaaaaa

SEQ ID NO: 2514468 - RNA, 14 nt, Chlamydophila pneumoniae CWL029
aggggcuccuaaag

SEQ ID NO: 2514469 - RNA, 13 nt, Chlamydophila pneumoniae CWL029
aggggcucgacac

SEQ ID NO: 2514470 - RNA, 13 nt, Chlamydophila pneumoniae CWL029
aggggcuuuccuu

SEQ ID NO: 2514471 - RNA, 23 nt, Chlamydophila pneumoniae CWL029
agggggaucuucagagagaacag

SEQ ID NO: 2514472 - RNA, 16 nt, Chlamydophila pneumoniae CWL029
agggggccugccauga

SEQ ID NO: 2514473 - RNA, 19 nt, Chlamydophila pneumoniae CWL029
agggguucccucuccuuga

SEQ ID NO: 2514474 - RNA, 18 nt, Chlamydophila pneumoniae CWL029
aggguaagauugcaggua

SEQ ID NO: 2514475 - RNA, 23 nt, Chlamydophila pneumoniae CWL029
aggguagccauccacgaccugca

SEQ ID NO: 2514476 - RNA, 23 nt, Chlamydophila pneumoniae CWL029
agggucggauuuagauuaaagag

SEQ ID NO: 2514477 - RNA, 16 nt, Chlamydophila pneumoniae CWL029
aggguucaauuccuuu

SEQ ID NO: 2514478 - RNA, 15 nt, Chlamydophila pneumoniae CWL029
aggguucucaaagau

SEQ ID NO: 2514479 - RNA, 12 nt, Chlamydophila pneumoniae CWL029
aggguuugcaug

SEQ ID NO: 2514480 - RNA, 19 nt, Chlamydophila pneumoniae CWL029
aggguuuugaaauaauuuu

SEQ ID NO: 2514481 - RNA, 21 nt, Chlamydophila pneumoniae CWL029
aggguuuugaaauaauuuuca

SEQ ID NO: 2514482 - RNA, 15 nt, Chlamydophila pneumoniae CWL029
agguaaaauaaagag

SEQ ID NO: 2514483 - RNA, 19 nt, Chlamydophila pneumoniae CWL029
agguaacauccauagagaa

SEQ ID NO: 2514484 - RNA, 15 nt, Chlamydophila pneumoniae CWL029
agguaaccagagagc

SEQ ID NO: 2514485 - RNA, 21 nt, Chlamydophila pneumoniae CWL029
agguaaccagagagcuuuuag

SEQ ID NO: 2514486 - RNA, 22 nt, Chlamydophila pneumoniae CWL029
agguaagggaugcucuagaaaa

SEQ ID NO: 2514487 - RNA, 16 nt, Chlamydophila pneumoniae CWL029
agguaauacccucaaa

SEQ ID NO: 2514488 - RNA, 16 nt, Chlamydophila pneumoniae CWL029
agguaauccucgauac

SEQ ID NO: 2514489 - RNA, 16 nt, Chlamydophila pneumoniae CWL029
agguaaugucguaccc

SEQ ID NO: 2514490 - RNA, 21 nt, Chlamydophila pneumoniae CWL029
agguacuuuauagaaaguaca

SEQ ID NO: 2514491 - RNA, 14 nt, Chlamydophila pneumoniae CWL029
agguagaguccaca

SEQ ID NO: 2514492 - RNA, 23 nt, Chlamydophila pneumoniae CWL029
agguagaguccacagucauaaaa

SEQ ID NO: 2514493 - RNA, 14 nt, Chlamydophila pneumoniae CWL029
agguagagugucuu

SEQ ID NO: 2514494 - RNA, 15 nt, Chlamydophila pneumoniae CWL029
agguagauagaaauu

SEQ ID NO: 2514495 - RNA, 20 nt, Chlamydophila pneumoniae CWL029
agguagcagaguuuuucccu

SEQ ID NO: 2514496 - RNA, 17 nt, Chlamydophila pneumoniae CWL029
agguaguuuucuucuuu

SEQ ID NO: 2514497 - RNA, 14 nt, Chlamydophila pneumoniae CWL029
agguaucuccuuga

SEQ ID NO: 2514498 - RNA, 23 nt, Chlamydophila pneumoniae CWL029
agguauuuccuucuguuuucaca

SEQ ID NO: 2514499 - RNA, 14 nt, Chlamydophila pneumoniae CWL029
aggucacuacccug

SEQ ID NO: 2514500 - RNA, 22 nt, Chlamydophila pneumoniae CWL029
aggucgauaucccacagaaaug

SEQ ID NO: 2514501 - RNA, 22 nt, Chlamydophila pneumoniae CWL029
aggucggggagaacaccucuuc

SEQ ID NO: 2514502 - RNA, 17 nt, Chlamydophila pneumoniae CWL029
aggucugcugaggagag

SEQ ID NO: 2514503 - RNA, 16 nt, Chlamydophila pneumoniae CWL029
aggucuuuuccuguag

SEQ ID NO: 2514504 - RNA, 15 nt, Chlamydophila pneumoniae CWL029
aggucuuuucuuuuu

SEQ ID NO: 2514505 - RNA, 14 nt, Chlamydophila pneumoniae CWL029
aggugaaaguacag

SEQ ID NO: 2514506 - RNA, 16 nt, Chlamydophila pneumoniae CWL029
aggugcaucauuuuca

SEQ ID NO: 2514507 - RNA, 17 nt, Chlamydophila pneumoniae CWL029
agguguagguuccugcu

SEQ ID NO: 2514508 - RNA, 15 nt, Chlamydophila pneumoniae CWL029
agguuaucuuuuugg

SEQ ID NO: 2514509 - RNA, 16 nt, Chlamydophila pneumoniae CWL029
agguuauguacuagau

SEQ ID NO: 2514510 - RNA, 13 nt, Chlamydophila pneumoniae CWL029
agguucaccagaa

SEQ ID NO: 2514511 - RNA, 12 nt, Chlamydophila pneumoniae CWL029
agguucacuuca

SEQ ID NO: 2514512 - RNA, 19 nt, Chlamydophila pneumoniae CWL029
aguccuucuugcaaagaua

SEQ ID NO: 2514513 - RNA, 13 nt, Chlamydophila pneumoniae CWL029
aguccuucuuuuc

SEQ ID NO: 2514514 - RNA, 17 nt, Chlamydophila pneumoniae CWL029
aguccuugaauuaguuu

SEQ ID NO: 2514515 - RNA, 23 nt, Chlamydophila pneumoniae CWL029
aguccuuuaccaucgucuccaaa

SEQ ID NO: 2514516 - RNA, 23 nt, Chlamydophila pneumoniae CWL029
aguccuuuuuguucaaagauugc

SEQ ID NO: 2514517 - RNA, 16 nt, Chlamydophila pneumoniae CWL029
agucgaaucuaaaaac

SEQ ID NO: 2514518 - RNA, 13 nt, Chlamydophila pneumoniae CWL029
agucgagaaacaa

SEQ ID NO: 2514519 - RNA, 18 nt, Chlamydophila pneumoniae CWL029
agucgauuucccagaagg

SEQ ID NO: 2514520 - RNA, 15 nt, Chlamydophila pneumoniae CWL029
agucgcuagaucaca

SEQ ID NO: 2514521 - RNA, 23 nt, Chlamydophila pneumoniae CWL029
agucgcuagaucacaagaaagaa

SEQ ID NO: 2514522 - RNA, 19 nt, Chlamydophila pneumoniae CWL029
agucgggaccauaaagaau

SEQ ID NO: 2514523 - RNA, 20 nt, Chlamydophila pneumoniae CWL029
agucguauucagguucugaa

SEQ ID NO: 2514524 - RNA, 20 nt, Chlamydophila pneumoniae CWL029
agucguuuagcuauuugaaa

SEQ ID NO: 2514525 - RNA, 21 nt, Chlamydophila pneumoniae CWL029
agucguuuucucgaauagaaa

SEQ ID NO: 2514526 - RNA, 13 nt, Chlamydophila pneumoniae CWL029
agucuauuugaaa

SEQ ID NO: 2514527 - RNA, 14 nt, Chlamydophila pneumoniae CWL029
agucuauuugaaaa

SEQ ID NO: 2514528 - RNA, 22 nt, Chlamydophila pneumoniae CWL029
agucuauuugaaaagaaagaau

SEQ ID NO: 2514529 - RNA, 12 nt, Chlamydophila pneumoniae CWL029
agucucauggau

SEQ ID NO: 2514530 - RNA, 23 nt, Chlamydophila pneumoniae CWL029
agucucauggauuacugaagauc

SEQ ID NO: 2514531 - RNA, 19 nt, Chlamydophila pneumoniae CWL029
agucuccauaauucugcac

SEQ ID NO: 2514532 - RNA, 23 nt, Chlamydophila pneumoniae CWL029
agucucgguuuccugaagaugag

SEQ ID NO: 2514533 - RNA, 14 nt, Chlamydophila pneumoniae CWL029
agucucucuaucua

SEQ ID NO: 2514534 - RNA, 18 nt, Chlamydophila pneumoniae CWL029
agucucuuucagcucaag

SEQ ID NO: 2514535 - RNA, 17 nt, Chlamydophila pneumoniae CWL029
agucugaacauucuuaa

SEQ ID NO: 2514536 - RNA, 14 nt, Chlamydophila pneumoniae CWL029
agucugcagcagau

SEQ ID NO: 2514537 - RNA, 18 nt, Chlamydophila pneumoniae CWL029
agucugguuuuucuccug

SEQ ID NO: 2514538 - RNA, 18 nt, Chlamydophila pneumoniae CWL029
agucugugagaaauaggu

SEQ ID NO: 2514539 - RNA, 15 nt, Chlamydophila pneumoniae CWL029
agucuguuuuggaaa

SEQ ID NO: 2514540 - RNA, 18 nt, Chlamydophila pneumoniae CWL029
agucuguuuuggaaagaa

SEQ ID NO: 2514541 - RNA, 22 nt, Chlamydophila pneumoniae CWL029
agucuguuuuggaaagaaggga

SEQ ID NO: 2514542 - RNA, 18 nt, Chlamydophila pneumoniae CWL029
agucuucaggugaaggaa

SEQ ID NO: 2514543 - RNA, 17 nt, Chlamydophila pneumoniae CWL029
agucuucccucuccuug

SEQ ID NO: 2514544 - RNA, 23 nt, Chlamydophila pneumoniae CWL029
agucuucccucuccuugaagcaa

SEQ ID NO: 2514545 - RNA, 19 nt, Chlamydophila pneumoniae CWL029
agucuucuuagaaagacua

SEQ ID NO: 2514546 - RNA, 17 nt, Chlamydophila pneumoniae CWL029
agucuucuuuccccaag

SEQ ID NO: 2514547 - RNA, 15 nt, Chlamydophila pneumoniae CWL029
agucuugcgccagca

SEQ ID NO: 2514548 - RNA, 18 nt, Chlamydophila pneumoniae CWL029
agucuugcgccagcaaag

SEQ ID NO: 2514549 - RNA, 23 nt, Chlamydophila pneumoniae CWL029
agucuugcgccagcaaagauuaa

SEQ ID NO: 2514550 - RNA, 16 nt, Chlamydophila pneumoniae CWL029
agucuuggacguuccu

SEQ ID NO: 2514551 - RNA, 17 nt, Chlamydophila pneumoniae CWL029
agucuuucuaagaagac

SEQ ID NO: 2514552 - RNA, 22 nt, Chlamydophila pneumoniae CWL029
agugaaauuuugcaacaaaagg

SEQ ID NO: 2514553 - RNA, 17 nt, Chlamydophila pneumoniae CWL029
agugaacacucucuacc

SEQ ID NO: 2514554 - RNA, 15 nt, Chlamydophila pneumoniae CWL029
agugaacuuuuguac

SEQ ID NO: 2514555 - RNA, 22 nt, Chlamydophila pneumoniae CWL029
agugaacuuuuguacacagaga

SEQ ID NO: 2514556 - RNA, 23 nt, Chlamydophila pneumoniae CWL029
agugaagacaaguaaacagcaaa

SEQ ID NO: 2514557 - RNA, 20 nt, Chlamydophila pneumoniae CWL029
agugaagcugcuucuucaga

SEQ ID NO: 2514558 - RNA, 17 nt, Chlamydophila pneumoniae CWL029
agugaaugagcuucaca

SEQ ID NO: 2514559 - RNA, 22 nt, Chlamydophila pneumoniae CWL029
agugaaugagcuucacaucuuu

SEQ ID NO: 2514560 - RNA, 16 nt, Chlamydophila pneumoniae CWL029
agugacaccaacaaca

SEQ ID NO: 2514561 - RNA, 17 nt, Chlamydophila pneumoniae CWL029
agugaccauagcauaga

SEQ ID NO: 2514562 - RNA, 16 nt, Chlamydophila pneumoniae CWL029
agugacuuccuccaaa

SEQ ID NO: 2514563 - RNA, 14 nt, Chlamydophila pneumoniae CWL029
agugacuuuucuuc

SEQ ID NO: 2514564 - RNA, 11 nt, Chlamydophila pneumoniae CWL029
agugagauacg

SEQ ID NO: 2514565 - RNA, 14 nt, Chlamydophila pneumoniae CWL029
agugagaucaaaaa

SEQ ID NO: 2514566 - RNA, 22 nt, Chlamydophila pneumoniae CWL029
agugagcucccugauguugccc

SEQ ID NO: 2514567 - RNA, 21 nt, Chlamydophila pneumoniae CWL029
agugaggccuccauuucuagg

SEQ ID NO: 2514568 - RNA, 16 nt, Chlamydophila pneumoniae CWL029
agugaucagaaaugaa

SEQ ID NO: 2514569 - RNA, 14 nt, Chlamydophila pneumoniae CWL029
agugauuccuguca

SEQ ID NO: 2514570 - RNA, 16 nt, Chlamydophila pneumoniae CWL029
agugcguacucuucuu

SEQ ID NO: 2514571 - RNA, 15 nt, Chlamydophila pneumoniae CWL029
agugcuuucaggagu

SEQ ID NO: 2514572 - RNA, 20 nt, Chlamydophila pneumoniae CWL029
aguggaaauugugaaaaaaa

SEQ ID NO: 2514573 - RNA, 17 nt, Chlamydophila pneumoniae CWL029
aguggacggggagagcc

SEQ ID NO: 2514574 - RNA, 19 nt, Chlamydophila pneumoniae CWL029
aguggcuuauagagagaau

SEQ ID NO: 2514575 - RNA, 14 nt, Chlamydophila pneumoniae CWL029
agugggaauguugu

SEQ ID NO: 2514576 - RNA, 16 nt, Chlamydophila pneumoniae CWL029
aguggucggcagaaac

SEQ ID NO: 2514577 - RNA, 19 nt, Chlamydophila pneumoniae CWL029
agugguuccugaaaagcau

SEQ ID NO: 2514578 - RNA, 23 nt, Chlamydophila pneumoniae CWL029
aguguaacauugaccuaaaggaa

SEQ ID NO: 2514579 - RNA, 21 nt, Chlamydophila pneumoniae CWL029
aguguauaacguagaugucuu

SEQ ID NO: 2514580 - RNA, 17 nt, Chlamydophila pneumoniae CWL029
agugucauacgcagcac

SEQ ID NO: 2514581 - RNA, 20 nt, Chlamydophila pneumoniae CWL029
agugucauacgcagcacgca

SEQ ID NO: 2514582 - RNA, 19 nt, Chlamydophila pneumoniae CWL029
agugucaucggcuucucca

SEQ ID NO: 2514583 - RNA, 22 nt, Chlamydophila pneumoniae CWL029
agugucuaagauauagagagag

SEQ ID NO: 2514584 - RNA, 17 nt, Chlamydophila pneumoniae CWL029
agugugacugcagagaa

SEQ ID NO: 2514585 - RNA, 19 nt, Chlamydophila pneumoniae CWL029
agugugacugcagagaaau

SEQ ID NO: 2514586 - RNA, 15 nt, Chlamydophila pneumoniae CWL029
aguguguaaauguuu

SEQ ID NO: 2514587 - RNA, 16 nt, Chlamydophila pneumoniae CWL029
aguguguaaauguuuu

SEQ ID NO: 2514588 - RNA, 16 nt, Chlamydophila pneumoniae CWL029
aguguguuucaaacaa

SEQ ID NO: 2514589 - RNA, 17 nt, Chlamydophila pneumoniae CWL029
aguuaaaccuuuuuuua

SEQ ID NO: 2514590 - RNA, 19 nt, Chlamydophila pneumoniae CWL029
aguuaacuguguaugaauc

SEQ ID NO: 2514591 - RNA, 19 nt, Chlamydophila pneumoniae CWL029
aguuacgcgaccucuguag

SEQ ID NO: 2514592 - RNA, 14 nt, Chlamydophila pneumoniae CWL029
aguuacgugagaac

SEQ ID NO: 2514593 - RNA, 20 nt, Chlamydophila pneumoniae CWL029
aguuagaagagucauuauca

SEQ ID NO: 2514594 - RNA, 20 nt, Chlamydophila pneumoniae CWL029
aguuagauguaaucauaaaa

SEQ ID NO: 2514595 - RNA, 13 nt, Chlamydophila pneumoniae CWL029
aguuaucaaaagg

SEQ ID NO: 2514596 - RNA, 14 nt, Chlamydophila pneumoniae CWL029
aguuauuaauaaau

SEQ ID NO: 2514597 - RNA, 14 nt, Chlamydophila pneumoniae CWL029
aguuauuauauaua

SEQ ID NO: 2514598 - RNA, 13 nt, Chlamydophila pneumoniae CWL029
aguucacaagcag

SEQ ID NO: 2514599 - RNA, 22 nt, Chlamydophila pneumoniae CWL029
aguucacaagugcauuaucuaa

SEQ ID NO: 2514600 - RNA, 19 nt, Chlamydophila pneumoniae CWL029
aguucacacguaagaaagg

SEQ ID NO: 2514601 - RNA, 17 nt, Chlamydophila pneumoniae CWL029
aguucagcaaagaaguu

SEQ ID NO: 2514602 - RNA, 22 nt, Chlamydophila pneumoniae CWL029
aguucaucauauuuuucuugaa

SEQ ID NO: 2514603 - RNA, 16 nt, Chlamydophila pneumoniae CWL029
aguucaucuagaugau

SEQ ID NO: 2514604 - RNA, 16 nt, Chlamydophila pneumoniae CWL029
aguucauuagcuaaau

SEQ ID NO: 2514605 - RNA, 17 nt, Chlamydophila pneumoniae CWL029
aguucauuuuaguuuuc

SEQ ID NO: 2514606 - RNA, 16 nt, Chlamydophila pneumoniae CWL029
aguuccaagacaauaa

SEQ ID NO: 2514607 - RNA, 20 nt, Chlamydophila pneumoniae CWL029
aguuccaagacaauaaaaaa

SEQ ID NO: 2514608 - RNA, 16 nt, Chlamydophila pneumoniae CWL029
aguucccacuggacuu

SEQ ID NO: 2514609 - RNA, 14 nt, Chlamydophila pneumoniae CWL029
aguuccgauaaaga

SEQ ID NO: 2514610 - RNA, 15 nt, Chlamydophila pneumoniae CWL029
aguuccucauccuca

SEQ ID NO: 2514611 - RNA, 20 nt, Chlamydophila pneumoniae CWL029
aguuccucauccucaucauc

SEQ ID NO: 2514612 - RNA, 21 nt, Chlamydophila pneumoniae CWL029
aguuccucauccucaucauca

SEQ ID NO: 2514613 - RNA, 22 nt, Chlamydophila pneumoniae CWL029
aguuccucauccucaucaucag

SEQ ID NO: 2514614 - RNA, 16 nt, Chlamydophila pneumoniae CWL029
aguucgcacuaauuuc

SEQ ID NO: 2514615 - RNA, 17 nt, Chlamydophila pneumoniae CWL029
aguucgcggaucuucuu

SEQ ID NO: 2514616 - RNA, 20 nt, Chlamydophila pneumoniae CWL029
aguucgcggaucuucuucug

SEQ ID NO: 2514617 - RNA, 17 nt, Chlamydophila pneumoniae CWL029
aguucgggcuaaucauu

SEQ ID NO: 2514618 - RNA, 21 nt, Chlamydophila pneumoniae CWL029
aguucuaggaugcuugugaga

SEQ ID NO: 2514619 - RNA, 14 nt, Chlamydophila pneumoniae CWL029
aguucucaaagaca

SEQ ID NO: 2514620 - RNA, 17 nt, Chlamydophila pneumoniae CWL029
aguucucuaagacugug

SEQ ID NO: 2514621 - RNA, 15 nt, Chlamydophila pneumoniae CWL029
aguucucucuucacu

SEQ ID NO: 2514622 - RNA, 13 nt, Chlamydophila pneumoniae CWL029
aguucuuccuucu

SEQ ID NO: 2514623 - RNA, 13 nt, Chlamydophila pneumoniae CWL029
aguucuugaaacu

SEQ ID NO: 2514624 - RNA, 18 nt, Chlamydophila pneumoniae CWL029
aguucuugauucucuucc

SEQ ID NO: 2514625 - RNA, 21 nt, Chlamydophila pneumoniae CWL029
aguucuuguaauaaaagaaca

SEQ ID NO: 2514626 - RNA, 22 nt, Chlamydophila pneumoniae CWL029
aguucuuguaauaaaagaacau

SEQ ID NO: 2514627 - RNA, 23 nt, Chlamydophila pneumoniae CWL029
aguucuuguuaaaguaaaaaaua

SEQ ID NO: 2514628 - RNA, 19 nt, Chlamydophila pneumoniae CWL029
aguucuuuagcuacagaaa

SEQ ID NO: 2514629 - RNA, 17 nt, Chlamydophila pneumoniae CWL029
aguucuuuuguuugucu

SEQ ID NO: 2514630 - RNA, 12 nt, Chlamydophila pneumoniae CWL029
aguugaaaugag

SEQ ID NO: 2514631 - RNA, 21 nt, Chlamydophila pneumoniae CWL029
aguugaaaugagugagaaugc

SEQ ID NO: 2514632 - RNA, 20 nt, Chlamydophila pneumoniae CWL029
aguugaacugacaccaggag

SEQ ID NO: 2514633 - RNA, 21 nt, Chlamydophila pneumoniae CWL029
aguugaaguuuugcucucuag

SEQ ID NO: 2514634 - RNA, 16 nt, Chlamydophila pneumoniae CWL029
aguugaccuuuuucau

SEQ ID NO: 2514635 - RNA, 18 nt, Chlamydophila pneumoniae CWL029
aguugacgcgcuucuuca

SEQ ID NO: 2514636 - RNA, 13 nt, Chlamydophila pneumoniae CWL029
aguugaggaaagg

SEQ ID NO: 2514637 - RNA, 15 nt, Chlamydophila pneumoniae CWL029
aguugaggaaaggag

SEQ ID NO: 2514638 - RNA, 16 nt, Chlamydophila pneumoniae CWL029
aguugaugagaaaaag

SEQ ID NO: 2514639 - RNA, 19 nt, Chlamydophila pneumoniae CWL029
aguugauuguagagacaua

SEQ ID NO: 2514640 - RNA, 19 nt, Chlamydophila pneumoniae CWL029
aguugccuaaagagauaua

SEQ ID NO: 2514641 - RNA, 14 nt, Chlamydophila pneumoniae CWL029
aguugcgcagugga

SEQ ID NO: 2514642 - RNA, 21 nt, Chlamydophila pneumoniae CWL029
aguugcgcaguggacggggag

SEQ ID NO: 2514643 - RNA, 19 nt, Chlamydophila pneumoniae CWL029
aguugcgcgcccucuucua

SEQ ID NO: 2514644 - RNA, 17 nt, Chlamydophila pneumoniae CWL029
aguuggaacauaucgau

SEQ ID NO: 2514645 - RNA, 15 nt, Chlamydophila pneumoniae CWL029
aguuggaucauucuu

SEQ ID NO: 2514646 - RNA, 15 nt, Chlamydophila pneumoniae CWL029
aguuggcguuuucua

SEQ ID NO: 2514647 - RNA, 13 nt, Chlamydophila pneumoniae CWL029
aguugggcauuua

SEQ ID NO: 2514648 - RNA, 22 nt, Chlamydophila pneumoniae CWL029
aguuguacaauuugcuccucca

SEQ ID NO: 2514649 - RNA, 18 nt, Chlamydophila pneumoniae CWL029
aguuguagugaaugagcu

SEQ ID NO: 2514650 - RNA, 19 nt, Chlamydophila pneumoniae CWL029
aguuguuguggaaucacgu

SEQ ID NO: 2514651 - RNA, 16 nt, Chlamydophila pneumoniae CWL029
aguuguuucuagaaaa

SEQ ID NO: 2514652 - RNA, 17 nt, Chlamydophila pneumoniae CWL029
aguuuaauguuuggcca

SEQ ID NO: 2514653 - RNA, 17 nt, Chlamydophila pneumoniae CWL029
aguuucaaucucuccuu

SEQ ID NO: 2514654 - RNA, 23 nt, Chlamydophila pneumoniae CWL029
aguuucaaucucuccuugacaaa

SEQ ID NO: 2514655 - RNA, 23 nt, Chlamydophila pneumoniae CWL029
aguuucccgacauuuaacaucuu

SEQ ID NO: 2514656 - RNA, 23 nt, Chlamydophila pneumoniae CWL029
aguuucuaaaacagaaauugcuu

SEQ ID NO: 2514657 - RNA, 21 nt, Chlamydophila pneumoniae CWL029
aguuucuuuugcaaaucuucg

SEQ ID NO: 2514658 - RNA, 22 nt, Chlamydophila pneumoniae CWL029
aguuugagaaagaccaccuucc

SEQ ID NO: 2514659 - RNA, 13 nt, Chlamydophila pneumoniae CWL029
aguuugagcagua

SEQ ID NO: 2514660 - RNA, 21 nt, Chlamydophila pneumoniae CWL029
aguuuguagcagcaagaacau

SEQ ID NO: 2514661 - RNA, 16 nt, Chlamydophila pneumoniae CWL029
aguuuguucacuuggu

SEQ ID NO: 2514662 - RNA, 20 nt, Chlamydophila pneumoniae CWL029
aguuuguuuuaauuguagag

SEQ ID NO: 2514663 - RNA, 17 nt, Chlamydophila pneumoniae CWL029
aguuuuaaugagagcau

SEQ ID NO: 2514664 - RNA, 20 nt, Chlamydophila pneumoniae CWL029
aguuuucuuaacuccagcga

SEQ ID NO: 2514665 - RNA, 16 nt, Chlamydophila pneumoniae CWL029
aguuuugaggauuucu

SEQ ID NO: 2514666 - RNA, 20 nt, Chlamydophila pneumoniae CWL029
aguuuugguuuuagaaaugu

SEQ ID NO: 2514667 - RNA, 15 nt, Chlamydophila pneumoniae CWL029
aguuuuuaauuuucu

SEQ ID NO: 2514668 - RNA, 16 nt, Chlamydophila pneumoniae CWL029
aguuuuuauuuuuaaa

SEQ ID NO: 2514669 - RNA, 19 nt, Chlamydophila pneumoniae CWL029
aguuuuuguucauccagaa

SEQ ID NO: 2514670 - RNA, 12 nt, Chlamydophila pneumoniae CWL029
aguuuuuuagag

SEQ ID NO: 2514671 - RNA, 20 nt, Chlamydophila pneumoniae CWL029
aguuuuuucaauccuuccuu

SEQ ID NO: 2514672 - RNA, 17 nt, Chlamydophila pneumoniae CWL029
aguuuuuuucuaaauuu

SEQ ID NO: 2514673 - RNA, 12 nt, Chlamydophila pneumoniae CWL029
aguuuuuuucuu

SEQ ID NO: 2514674 - RNA, 16 nt, Chlamydophila pneumoniae CWL029
auaaaaaguuuuuguu

SEQ ID NO: 2514675 - RNA, 20 nt, Chlamydophila pneumoniae CWL029
auaaaaaugguaauuuuuca

SEQ ID NO: 2514676 - RNA, 15 nt, Chlamydophila pneumoniae CWL029
auaaaaauguaauuu

SEQ ID NO: 2514677 - RNA, 16 nt, Chlamydophila pneumoniae CWL029
auaaaaauuaagaacc

SEQ ID NO: 2514678 - RNA, 16 nt, Chlamydophila pneumoniae CWL029
auaaaaauucucauaa

SEQ ID NO: 2514679 - RNA, 21 nt, Chlamydophila pneumoniae CWL029
auaaaaauuuucaggaacuuu

SEQ ID NO: 2514680 - RNA, 14 nt, Chlamydophila pneumoniae CWL029
auaaaacauaggcu

SEQ ID NO: 2514681 - RNA, 22 nt, Chlamydophila pneumoniae CWL029
auaaaacgugauugcugcugcu

SEQ ID NO: 2514682 - RNA, 14 nt, Chlamydophila pneumoniae CWL029
auaaaagaaagaau

SEQ ID NO: 2514683 - RNA, 22 nt, Chlamydophila pneumoniae CWL029
auaaaagaacgauaaaauugaa

SEQ ID NO: 2514684 - RNA, 16 nt, Chlamydophila pneumoniae CWL029
auaaaagaggaagaug

SEQ ID NO: 2514685 - RNA, 15 nt, Chlamydophila pneumoniae CWL029
auaaaaucauguccu

SEQ ID NO: 2514686 - RNA, 21 nt, Chlamydophila pneumoniae CWL029
auaaaauugaaaucuuuagaa

SEQ ID NO: 2514687 - RNA, 13 nt, Chlamydophila pneumoniae CWL029
auaaaauuggcuu

SEQ ID NO: 2514688 - RNA, 24 nt, Chlamydophila pneumoniae CWL029
auaaacagcgguugccuuucucuu

SEQ ID NO: 2514689 - RNA, 21 nt, Chlamydophila pneumoniae CWL029
auaaacauauucuccuuacca

SEQ ID NO: 2514690 - RNA, 20 nt, Chlamydophila pneumoniae CWL029
auaaacucuuguugucuaug

SEQ ID NO: 2514691 - RNA, 22 nt, Chlamydophila pneumoniae CWL029
auaaacuucaaugaagaaaaau

SEQ ID NO: 2514692 - RNA, 16 nt, Chlamydophila pneumoniae CWL029
auaaagaagguugaga

SEQ ID NO: 2514693 - RNA, 22 nt, Chlamydophila pneumoniae CWL029
auaaagaaguuuacaaauaaaa

SEQ ID NO: 2514694 - RNA, 16 nt, Chlamydophila pneumoniae CWL029
auaaagacaucucuuu

SEQ ID NO: 2514695 - RNA, 21 nt, Chlamydophila pneumoniae CWL029
auaaagaucgggucuacaaca

SEQ ID NO: 2514696 - RNA, 22 nt, Chlamydophila pneumoniae CWL029
auaaagaucuuuauuuuuaaaa

SEQ ID NO: 2514697 - RNA, 22 nt, Chlamydophila pneumoniae CWL029
auaaagcaaagauaaagaaguu

SEQ ID NO: 2514698 - RNA, 15 nt, Chlamydophila pneumoniae CWL029
auaaagcaaaugccu

SEQ ID NO: 2514699 - RNA, 19 nt, Chlamydophila pneumoniae CWL029
auaaagcaacuguaaauuu

SEQ ID NO: 2514700 - RNA, 21 nt, Chlamydophila pneumoniae CWL029
auaaagcccuuuugaauaucc

SEQ ID NO: 2514701 - RNA, 14 nt, Chlamydophila pneumoniae CWL029
auaaaggacauaga

SEQ ID NO: 2514702 - RNA, 20 nt, Chlamydophila pneumoniae CWL029
auaaaggaccuguuuucuuu

SEQ ID NO: 2514703 - RNA, 24 nt, Chlamydophila pneumoniae CWL029
auaaaggcauaacugugcuccaua

SEQ ID NO: 2514704 - RNA, 22 nt, Chlamydophila pneumoniae CWL029
auaaagguuacaagcaauacua

SEQ ID NO: 2514705 - RNA, 23 nt, Chlamydophila pneumoniae CWL029
auaaagguuacaagcaauacuaa

SEQ ID NO: 2514706 - RNA, 18 nt, Chlamydophila pneumoniae CWL029
auaaaguuuguaaaaacu

SEQ ID NO: 2514707 - RNA, 14 nt, Chlamydophila pneumoniae CWL029
auagauaugccuca

SEQ ID NO: 2514708 - RNA, 13 nt, Chlamydophila pneumoniae CWL029
auagauccugaaa

SEQ ID NO: 2514709 - RNA, 21 nt, Chlamydophila pneumoniae CWL029
auagauccugaaaguacagaa

SEQ ID NO: 2514710 - RNA, 12 nt, Chlamydophila pneumoniae CWL029
auagaucucuug

SEQ ID NO: 2514711 - RNA, 13 nt, Chlamydophila pneumoniae CWL029
auagaucucuuga

SEQ ID NO: 2514712 - RNA, 17 nt, Chlamydophila pneumoniae CWL029
auagauuccccaaacuu

SEQ ID NO: 2514713 - RNA, 23 nt, Chlamydophila pneumoniae CWL029
auagauucguuauccucgucuuc

SEQ ID NO: 2514714 - RNA, 17 nt, Chlamydophila pneumoniae CWL029
auagcaaagauuucugc

SEQ ID NO: 2514715 - RNA, 17 nt, Chlamydophila pneumoniae CWL029
auagcaauggcuuuuuu

SEQ ID NO: 2514716 - RNA, 20 nt, Chlamydophila pneumoniae CWL029
auagcaauggcuuuuuuugu

SEQ ID NO: 2514717 - RNA, 17 nt, Chlamydophila pneumoniae CWL029
auagcaguauagagaag

SEQ ID NO: 2514718 - RNA, 13 nt, Chlamydophila pneumoniae CWL029
auagcagucuugc

SEQ ID NO: 2514719 - RNA, 15 nt, Chlamydophila pneumoniae CWL029
auagcauacgacagu

SEQ ID NO: 2514720 - RNA, 17 nt, Chlamydophila pneumoniae CWL029
auagcaucccuucuucu

SEQ ID NO: 2514721 - RNA, 20 nt, Chlamydophila pneumoniae CWL029
auagcauggagaauaaucuc

SEQ ID NO: 2514722 - RNA, 16 nt, Chlamydophila pneumoniae CWL029
auagccaaagacucuu

SEQ ID NO: 2514723 - RNA, 17 nt, Chlamydophila pneumoniae CWL029
auagccaucauagcaaa

SEQ ID NO: 2514724 - RNA, 18 nt, Chlamydophila pneumoniae CWL029
auagccaugguuauagau

SEQ ID NO: 2514725 - RNA, 20 nt, Chlamydophila pneumoniae CWL029
auagccgacaugcuuuccuu

SEQ ID NO: 2514726 - RNA, 21 nt, Chlamydophila pneumoniae CWL029
auagccgacaugcuuuccuuc

SEQ ID NO: 2514727 - RNA, 17 nt, Chlamydophila pneumoniae CWL029
auagccuccauuuagac

SEQ ID NO: 2514728 - RNA, 18 nt, Chlamydophila pneumoniae CWL029
auagccuccauuuagaca

SEQ ID NO: 2514729 - RNA, 21 nt, Chlamydophila pneumoniae CWL029
auagccucgagcagaaacucc

SEQ ID NO: 2514730 - RNA, 19 nt, Chlamydophila pneumoniae CWL029
auagccucuucuacaccau

SEQ ID NO: 2514731 - RNA, 20 nt, Chlamydophila pneumoniae CWL029
auagccucuucuacaccaua

SEQ ID NO: 2514732 - RNA, 23 nt, Chlamydophila pneumoniae CWL029
auagccuuccauaucuagaaguu

SEQ ID NO: 2514733 - RNA, 19 nt, Chlamydophila pneumoniae CWL029
auagcgaaagucaaagggc

SEQ ID NO: 2514734 - RNA, 19 nt, Chlamydophila pneumoniae CWL029
auagcgacaugagaaaucu

SEQ ID NO: 2514735 - RNA, 20 nt, Chlamydophila pneumoniae CWL029
auagcggucacugugauuuu

SEQ ID NO: 2514736 - RNA, 13 nt, Chlamydophila pneumoniae CWL029
auagcgucuguua

SEQ ID NO: 2514737 - RNA, 16 nt, Chlamydophila pneumoniae CWL029
auagcucagcucuaau

SEQ ID NO: 2514738 - RNA, 20 nt, Chlamydophila pneumoniae CWL029
auagcucagcucuaauucuu

SEQ ID NO: 2514739 - RNA, 17 nt, Chlamydophila pneumoniae CWL029
auagcuccuuggcuaug

SEQ ID NO: 2514740 - RNA, 20 nt, Chlamydophila pneumoniae CWL029
auagcucguuauauuuuucu

SEQ ID NO: 2514741 - RNA, 17 nt, Chlamydophila pneumoniae CWL029
auagcuggaucuucuga

SEQ ID NO: 2514742 - RNA, 18 nt, Chlamydophila pneumoniae CWL029
auagcuggaucuucugau

SEQ ID NO: 2514743 - RNA, 23 nt, Chlamydophila pneumoniae CWL029
auagcuggcaaugauauccucaa

SEQ ID NO: 2514744 - RNA, 21 nt, Chlamydophila pneumoniae CWL029
auagcuggggauuaguagcua

SEQ ID NO: 2514745 - RNA, 19 nt, Chlamydophila pneumoniae CWL029
auagcuuacuuagaacuau

SEQ ID NO: 2514746 - RNA, 15 nt, Chlamydophila pneumoniae CWL029
auagcuuccuguagu

SEQ ID NO: 2514747 - RNA, 16 nt, Chlamydophila pneumoniae CWL029
auagcuuugaagagca

SEQ ID NO: 2514748 - RNA, 17 nt, Chlamydophila pneumoniae CWL029
auagcuuuggaacgugc

SEQ ID NO: 2514749 - RNA, 23 nt, Chlamydophila pneumoniae CWL029
auaggaaacgcccuucuuaguaa

SEQ ID NO: 2514750 - RNA, 21 nt, Chlamydophila pneumoniae CWL029
auaggaauaacaccaaaagaa

SEQ ID NO: 2514751 - RNA, 16 nt, Chlamydophila pneumoniae CWL029
auaggaauuagagaaa

SEQ ID NO: 2514752 - RNA, 13 nt, Chlamydophila pneumoniae CWL029
auaggauaagaaa

SEQ ID NO: 2514753 - RNA, 16 nt, Chlamydophila pneumoniae CWL029
auaggauccaggaguu

SEQ ID NO: 2514754 - RNA, 15 nt, Chlamydophila pneumoniae CWL029
auaggcaaguguuuu

SEQ ID NO: 2514755 - RNA, 20 nt, Chlamydophila pneumoniae CWL029
auaggcucuuuagcaaacau

SEQ ID NO: 2514756 - RNA, 22 nt, Chlamydophila pneumoniae CWL029
auagggcaggcggaaaggaagg

SEQ ID NO: 2514757 - RNA, 22 nt, Chlamydophila pneumoniae CWL029
auaggguugugucucugaagac

SEQ ID NO: 2514758 - RNA, 13 nt, Chlamydophila pneumoniae CWL029
auagguagaggca

SEQ ID NO: 2514759 - RNA, 17 nt, Chlamydophila pneumoniae CWL029
auagguaucagcaagau

SEQ ID NO: 2514760 - RNA, 21 nt, Chlamydophila pneumoniae CWL029
auaguagcgaauccagaauuu

SEQ ID NO: 2514761 - RNA, 18 nt, Chlamydophila pneumoniae CWL029
auaguaucguaagccggc

SEQ ID NO: 2514762 - RNA, 15 nt, Chlamydophila pneumoniae CWL029
auaguauuuuuaaau

SEQ ID NO: 2514763 - RNA, 22 nt, Chlamydophila pneumoniae CWL029
auagucgcuagugcgaugggaa

SEQ ID NO: 2514764 - RNA, 19 nt, Chlamydophila pneumoniae CWL029
auagucuucuacuaggcgc

SEQ ID NO: 2514765 - RNA, 22 nt, Chlamydophila pneumoniae CWL029
auaguggcgaauccuagagaac

SEQ ID NO: 2514766 - RNA, 15 nt, Chlamydophila pneumoniae CWL029
auaguguuccaaaac

SEQ ID NO: 2514767 - RNA, 16 nt, Chlamydophila pneumoniae CWL029
auaguuaaauuuccaa

SEQ ID NO: 2514768 - RNA, 20 nt, Chlamydophila pneumoniae CWL029
auaguuucuaucuaaucaau

SEQ ID NO: 2514769 - RNA, 20 nt, Chlamydophila pneumoniae CWL029
auaguuuuuauuuuuaaaua

SEQ ID NO: 2514770 - RNA, 22 nt, Chlamydophila pneumoniae CWL029
auaguuuuugcuguuucuucug

SEQ ID NO: 2514771 - RNA, 13 nt, Chlamydophila pneumoniae CWL029
auauaaaagaaga

SEQ ID NO: 2514772 - RNA, 17 nt, Chlamydophila pneumoniae CWL029
auauaaagacucucuuc

SEQ ID NO: 2514773 - RNA, 15 nt, Chlamydophila pneumoniae CWL029
auauaaagaucuuuu

SEQ ID NO: 2514774 - RNA, 19 nt, Chlamydophila pneumoniae CWL029
auauaaaugcuauuuuccu

SEQ ID NO: 2514775 - RNA, 22 nt, Chlamydophila pneumoniae CWL029
auauaagauaauagagaagaag

SEQ ID NO: 2514776 - RNA, 21 nt, Chlamydophila pneumoniae CWL029
auauaagggggaucuucagag

SEQ ID NO: 2514777 - RNA, 21 nt, Chlamydophila pneumoniae CWL029
auauaauaguggcuauacccu

SEQ ID NO: 2514778 - RNA, 15 nt, Chlamydophila pneumoniae CWL029
auauaaucguuuuuu

SEQ ID NO: 2514779 - RNA, 13 nt, Chlamydophila pneumoniae CWL029
auauacuuauacc

SEQ ID NO: 2514780 - RNA, 17 nt, Chlamydophila pneumoniae CWL029
auauagaagcugcugcu

SEQ ID NO: 2514781 - RNA, 12 nt, Chlamydophila pneumoniae CWL029
auauagagaucu

SEQ ID NO: 2514782 - RNA, 19 nt, Chlamydophila pneumoniae CWL029
auauaggcgugugaaaucu

SEQ ID NO: 2514783 - RNA, 22 nt, Chlamydophila pneumoniae CWL029
auauagguuuagauugccuuug

SEQ ID NO: 2514784 - RNA, 17 nt, Chlamydophila pneumoniae CWL029
auauauaagaucuuuca

SEQ ID NO: 2514785 - RNA, 22 nt, Chlamydophila pneumoniae CWL029
auauauaagaucuuucauuuua

SEQ ID NO: 2514786 - RNA, 13 nt, Chlamydophila pneumoniae CWL029
auauauagagcag

SEQ ID NO: 2514787 - RNA, 23 nt, Chlamydophila pneumoniae CWL029
auauaugaguuuacuaacucugu

SEQ ID NO: 2514788 - RNA, 16 nt, Chlamydophila pneumoniae CWL029
auaucaaagaucugaa

SEQ ID NO: 2514789 - RNA, 20 nt, Chlamydophila pneumoniae CWL029
auaucaccagguccuucugg

SEQ ID NO: 2514790 - RNA, 13 nt, Chlamydophila pneumoniae CWL029
auaucagcaaaaa

SEQ ID NO: 2514791 - RNA, 14 nt, Chlamydophila pneumoniae CWL029
auaucagcaaaaaa

SEQ ID NO: 2514792 - RNA, 19 nt, Chlamydophila pneumoniae CWL029
auaucauauuuuuguccug

SEQ ID NO: 2514793 - RNA, 14 nt, Chlamydophila pneumoniae CWL029
auaucaucuuccuc

SEQ ID NO: 2514794 - RNA, 15 nt, Chlamydophila pneumoniae CWL029
auaucaucuuccucu

SEQ ID NO: 2514795 - RNA, 22 nt, Chlamydophila pneumoniae CWL029
auaucaugcaauacuuuucucc

SEQ ID NO: 2514796 - RNA, 16 nt, Chlamydophila pneumoniae CWL029
auaucauuaagaagau

SEQ ID NO: 2514797 - RNA, 18 nt, Chlamydophila pneumoniae CWL029
auaucauuaagaagauuc

SEQ ID NO: 2514798 - RNA, 21 nt, Chlamydophila pneumoniae CWL029
auauccaccuuaccaucgaca

SEQ ID NO: 2514799 - RNA, 18 nt, Chlamydophila pneumoniae CWL029
auauccguagguguuaag

SEQ ID NO: 2514800 - RNA, 20 nt, Chlamydophila pneumoniae CWL029
auauccguauggauuucucc

SEQ ID NO: 2514801 - RNA, 22 nt, Chlamydophila pneumoniae CWL029
auaucgaguucuuuuugcagau

SEQ ID NO: 2514802 - RNA, 15 nt, Chlamydophila pneumoniae CWL029
auaucguaggaccua

SEQ ID NO: 2514803 - RNA, 20 nt, Chlamydophila pneumoniae CWL029
auaucuaauaaaauuggcuu

SEQ ID NO: 2514804 - RNA, 15 nt, Chlamydophila pneumoniae CWL029
auaucuauaaaugua

SEQ ID NO: 2514805 - RNA, 23 nt, Chlamydophila pneumoniae CWL029
auaaauaauuacaauuuuagaua

SEQ ID NO: 2514806 - RNA, 19 nt, Chlamydophila pneumoniae CWL029
auaaauacaggccugaugu

SEQ ID NO: 2514807 - RNA, 21 nt, Chlamydophila pneumoniae CWL029
auaaauccccaccaacaaugc

SEQ ID NO: 2514808 - RNA, 15 nt, Chlamydophila pneumoniae CWL029
auaaaucuauaucca

SEQ ID NO: 2514809 - RNA, 14 nt, Chlamydophila pneumoniae CWL029
auaaauguagggau

SEQ ID NO: 2514810 - RNA, 19 nt, Chlamydophila pneumoniae CWL029
auaaauucaagacuauaga

SEQ ID NO: 2514811 - RNA, 15 nt, Chlamydophila pneumoniae CWL029
auaaauuuaucugcu

SEQ ID NO: 2514812 - RNA, 16 nt, Chlamydophila pneumoniae CWL029
auaacaaucagaugag

SEQ ID NO: 2514813 - RNA, 15 nt, Chlamydophila pneumoniae CWL029
auaacaccaaaagaa

SEQ ID NO: 2514814 - RNA, 20 nt, Chlamydophila pneumoniae CWL029
auaacaccaaaagaauacuc

SEQ ID NO: 2514815 - RNA, 22 nt, Chlamydophila pneumoniae CWL029
auaacacuucuuucuugcucug

SEQ ID NO: 2514816 - RNA, 23 nt, Chlamydophila pneumoniae CWL029
auaacagagauggucuuggguuu

SEQ ID NO: 2514817 - RNA, 14 nt, Chlamydophila pneumoniae CWL029
auaacaucaagaau

SEQ ID NO: 2514818 - RNA, 16 nt, Chlamydophila pneumoniae CWL029
auaacaucaagaauuu

SEQ ID NO: 2514819 - RNA, 21 nt, Chlamydophila pneumoniae CWL029
auaacaucuaaaaaugcacuu

SEQ ID NO: 2514820 - RNA, 16 nt, Chlamydophila pneumoniae CWL029
auaacaugcgcagaau

SEQ ID NO: 2514821 - RNA, 16 nt, Chlamydophila pneumoniae CWL029
auaacauuuagauaaa

SEQ ID NO: 2514822 - RNA, 20 nt, Chlamydophila pneumoniae CWL029
auaacauuuagauaaagaaa

SEQ ID NO: 2514823 - RNA, 15 nt, Chlamydophila pneumoniae CWL029
auaaccaaaagaauu

SEQ ID NO: 2514824 - RNA, 17 nt, Chlamydophila pneumoniae CWL029
auaaccaacuuccuaua

SEQ ID NO: 2514825 - RNA, 19 nt, Chlamydophila pneumoniae CWL029
auaaccacuauacccucug

SEQ ID NO: 2514826 - RNA, 23 nt, Chlamydophila pneumoniae CWL029
auaacccaggacaucacaauuac

SEQ ID NO: 2514827 - RNA, 22 nt, Chlamydophila pneumoniae CWL029
auaaccgaaacuucucagauaa

SEQ ID NO: 2514828 - RNA, 12 nt, Chlamydophila pneumoniae CWL029
auaaccugagag

SEQ ID NO: 2514829 - RNA, 13 nt, Chlamydophila pneumoniae CWL029
auaaccugggcaa

SEQ ID NO: 2514830 - RNA, 23 nt, Chlamydophila pneumoniae CWL029
auaacgggguugucucuacaggg

SEQ ID NO: 2514831 - RNA, 23 nt, Chlamydophila pneumoniae CWL029
auaacuauugggaaugcauuuca

SEQ ID NO: 2514832 - RNA, 19 nt, Chlamydophila pneumoniae CWL029
auaacuccaggggauaaaa

SEQ ID NO: 2514833 - RNA, 23 nt, Chlamydophila pneumoniae CWL029
auaacuccaggggauaaaacuau

SEQ ID NO: 2514834 - RNA, 21 nt, Chlamydophila pneumoniae CWL029
auaacugcauacaaggcacau

SEQ ID NO: 2514835 - RNA, 13 nt, Chlamydophila pneumoniae CWL029
auaacuuuaucau

SEQ ID NO: 2514836 - RNA, 19 nt, Chlamydophila pneumoniae CWL029
auaacuuugcaugaggaga

SEQ ID NO: 2514837 - RNA, 20 nt, Chlamydophila pneumoniae CWL029
auaacuuugcaugaggagac

SEQ ID NO: 2514838 - RNA, 18 nt, Chlamydophila pneumoniae CWL029
auaagaaaauccuaacaa

SEQ ID NO: 2514839 - RNA, 18 nt, Chlamydophila pneumoniae CWL029
auaagaacuuuagggaag

SEQ ID NO: 2514840 - RNA, 13 nt, Chlamydophila pneumoniae CWL029
auaagagacauuu

SEQ ID NO: 2514841 - RNA, 17 nt, Chlamydophila pneumoniae CWL029
auaagauaaagaauucu

SEQ ID NO: 2514842 - RNA, 15 nt, Chlamydophila pneumoniae CWL029
auaagauaauagaga

SEQ ID NO: 2514843 - RNA, 17 nt, Chlamydophila pneumoniae CWL029
auaagauaauagagaag

SEQ ID NO: 2514844 - RNA, 15 nt, Chlamydophila pneumoniae CWL029
auaagauagcucuug

SEQ ID NO: 2514845 - RNA, 11 nt, Chlamydophila pneumoniae CWL029
auaagaucaau

SEQ ID NO: 2514846 - RNA, 14 nt, Chlamydophila pneumoniae CWL029
auaagauccaaaaa

SEQ ID NO: 2514847 - RNA, 18 nt, Chlamydophila pneumoniae CWL029
auaagauccaaaaauucu

SEQ ID NO: 2514848 - RNA, 14 nt, Chlamydophila pneumoniae CWL029
auaagauuuugaaa

SEQ ID NO: 2514849 - RNA, 16 nt, Chlamydophila pneumoniae CWL029
auaagcaagcaacuga

SEQ ID NO: 2514850 - RNA, 20 nt, Chlamydophila pneumoniae CWL029
auaagcaccacgaccuauac

SEQ ID NO: 2514851 - RNA, 16 nt, Chlamydophila pneumoniae CWL029
auaagcaggaaaagca

SEQ ID NO: 2514852 - RNA, 18 nt, Chlamydophila pneumoniae CWL029
auaagcaggaaaagcaaa

SEQ ID NO: 2514853 - RNA, 16 nt, Chlamydophila pneumoniae CWL029
auaagccaguacuaaa

SEQ ID NO: 2514854 - RNA, 20 nt, Chlamydophila pneumoniae CWL029
auaagcuaacaccucuucaa

SEQ ID NO: 2514855 - RNA, 21 nt, Chlamydophila pneumoniae CWL029
auaagcuugccagcagaaguu

SEQ ID NO: 2514856 - RNA, 19 nt, Chlamydophila pneumoniae CWL029
auaaggauucugagaaguu

SEQ ID NO: 2514857 - RNA, 14 nt, Chlamydophila pneumoniae CWL029
auaaggcuuuucug

SEQ ID NO: 2514858 - RNA, 20 nt, Chlamydophila pneumoniae CWL029
auaaggcuuuucugcuccug

SEQ ID NO: 2514859 - RNA, 18 nt, Chlamydophila pneumoniae CWL029
auaagggggaucuucaga

SEQ ID NO: 2514860 - RNA, 23 nt, Chlamydophila pneumoniae CWL029
auaagggggaucuucagagagaa

SEQ ID NO: 2514861 - RNA, 20 nt, Chlamydophila pneumoniae CWL029
auaagucgaaucuaaaaacu

SEQ ID NO: 2514862 - RNA, 19 nt, Chlamydophila pneumoniae CWL029
auaagugacuuuucuucuu

SEQ ID NO: 2514863 - RNA, 17 nt, Chlamydophila pneumoniae CWL029
auaaguuacuuucugau

SEQ ID NO: 2514864 - RNA, 13 nt, Chlamydophila pneumoniae CWL029
auaaguucuucca

SEQ ID NO: 2514865 - RNA, 13 nt, Chlamydophila pneumoniae CWL029
auaauaaaagcac

SEQ ID NO: 2514866 - RNA, 20 nt, Chlamydophila pneumoniae CWL029
auaauaagcaggaaaagcaa

SEQ ID NO: 2514867 - RNA, 13 nt, Chlamydophila pneumoniae CWL029
auaauagagccuc

SEQ ID NO: 2514868 - RNA, 14 nt, Chlamydophila pneumoniae CWL029
auaauagagccucc

SEQ ID NO: 2514869 - RNA, 15 nt, Chlamydophila pneumoniae CWL029
auaauaggauaagaa

SEQ ID NO: 2514870 - RNA, 17 nt, Chlamydophila pneumoniae CWL029
auaauaggauaagaaau

SEQ ID NO: 2514871 - RNA, 19 nt, Chlamydophila pneumoniae CWL029
auaauaggauaagaaauua

SEQ ID NO: 2514872 - RNA, 20 nt, Chlamydophila pneumoniae CWL029
auaauaggauaagaaauuaa

SEQ ID NO: 2514873 - RNA, 16 nt, Chlamydophila pneumoniae CWL029
auaauagucucuguaa

SEQ ID NO: 2514874 - RNA, 14 nt, Chlamydophila pneumoniae CWL029
auaauagugagcuc

SEQ ID NO: 2514875 - RNA, 18 nt, Chlamydophila pneumoniae CWL029
auaauaucgguuccuaua

SEQ ID NO: 2514876 - RNA, 13 nt, Chlamydophila pneumoniae CWL029
auaaucaaccaaa

SEQ ID NO: 2514877 - RNA, 14 nt, Chlamydophila pneumoniae CWL029
auaaucaaccaaaa

SEQ ID NO: 2514878 - RNA, 14 nt, Chlamydophila pneumoniae CWL029
auaaucagaggagc

SEQ ID NO: 2514879 - RNA, 20 nt, Chlamydophila pneumoniae CWL029
auaaucagaggagccuccau

SEQ ID NO: 2514880 - RNA, 15 nt, Chlamydophila pneumoniae CWL029
auaaucucaccagaa

SEQ ID NO: 2514881 - RNA, 22 nt, Chlamydophila pneumoniae CWL029
auaaucucaccagaagcaacua

SEQ ID NO: 2514882 - RNA, 18 nt, Chlamydophila pneumoniae CWL029
auaaucucuuucauaaau

SEQ ID NO: 2514883 - RNA, 22 nt, Chlamydophila pneumoniae CWL029
auaaucuucaaaagacuuaccg

SEQ ID NO: 2514884 - RNA, 13 nt, Chlamydophila pneumoniae CWL029
auaaugaagcagg

SEQ ID NO: 2514885 - RNA, 19 nt, Chlamydophila pneumoniae CWL029
auaaugauuccuagaaucu

SEQ ID NO: 2514886 - RNA, 19 nt, Chlamydophila pneumoniae CWL029
auaaugcucacuucuuugc

SEQ ID NO: 2514887 - RNA, 15 nt, Chlamydophila pneumoniae CWL029
auaaugguacaauac

SEQ ID NO: 2514888 - RNA, 12 nt, Chlamydophila pneumoniae CWL029
auaauuaaacuc

SEQ ID NO: 2514889 - RNA, 13 nt, Chlamydophila pneumoniae CWL029
auaauuaaauaua

SEQ ID NO: 2514890 - RNA, 14 nt, Chlamydophila pneumoniae CWL029
auaauuagaacagc

SEQ ID NO: 2514891 - RNA, 15 nt, Chlamydophila pneumoniae CWL029
auaauuagaacagca

SEQ ID NO: 2514892 - RNA, 15 nt, Chlamydophila pneumoniae CWL029
auaauuagagagaau

SEQ ID NO: 2514893 - RNA, 14 nt, Chlamydophila pneumoniae CWL029
auaauucgugucau

SEQ ID NO: 2514894 - RNA, 21 nt, Chlamydophila pneumoniae CWL029
auaauuggcguaauaauucca

SEQ ID NO: 2514895 - RNA, 12 nt, Chlamydophila pneumoniae CWL029
auacaaaaaaua

SEQ ID NO: 2514896 - RNA, 21 nt, Chlamydophila pneumoniae CWL029
auacaaaacaaaagccauucc

SEQ ID NO: 2514897 - RNA, 22 nt, Chlamydophila pneumoniae CWL029
auacaaacaagaagcguacuuu

SEQ ID NO: 2514898 - RNA, 16 nt, Chlamydophila pneumoniae CWL029
auacaaacaucgaaac

SEQ ID NO: 2514899 - RNA, 12 nt, Chlamydophila pneumoniae CWL029
auacaagcaauu

SEQ ID NO: 2514900 - RNA, 17 nt, Chlamydophila pneumoniae CWL029
auacaagcaauuccccu

SEQ ID NO: 2514901 - RNA, 17 nt, Chlamydophila pneumoniae CWL029
auacaagcgaaagcagc

SEQ ID NO: 2514902 - RNA, 17 nt, Chlamydophila pneumoniae CWL029
auacaauccagaaucuc

SEQ ID NO: 2514903 - RNA, 19 nt, Chlamydophila pneumoniae CWL029
auacaauccagaaucucca

SEQ ID NO: 2514904 - RNA, 14 nt, Chlamydophila pneumoniae CWL029
auacacaaaucauu

SEQ ID NO: 2514905 - RNA, 22 nt, Chlamydophila pneumoniae CWL029
auacacaaaucauuuaaagcug

SEQ ID NO: 2514906 - RNA, 21 nt, Chlamydophila pneumoniae CWL029
auacacccgcaagcacuuguu

SEQ ID NO: 2514907 - RNA, 19 nt, Chlamydophila pneumoniae CWL029
auacagauaucaaagcauu

SEQ ID NO: 2514908 - RNA, 22 nt, Chlamydophila pneumoniae CWL029
auacagauguaaaugcuccuug

SEQ ID NO: 2514909 - RNA, 22 nt, Chlamydophila pneumoniae CWL029
auacagauguuuucguaaauau

SEQ ID NO: 2514910 - RNA, 15 nt, Chlamydophila pneumoniae CWL029
auacagcauaaaaau

SEQ ID NO: 2514911 - RNA, 14 nt, Chlamydophila pneumoniae CWL029
auacagccagcaga

SEQ ID NO: 2514912 - RNA, 22 nt, Chlamydophila pneumoniae CWL029
auacagcgcgaucacuuuccug

SEQ ID NO: 2514913 - RNA, 23 nt, Chlamydophila pneumoniae CWL029
auacagcuguuuacuuuucucuu

SEQ ID NO: 2514914 - RNA, 14 nt, Chlamydophila pneumoniae CWL029
auacaguuggcguu

SEQ ID NO: 2514915 - RNA, 19 nt, Chlamydophila pneumoniae CWL029
auacaguuggcguuuucua

SEQ ID NO: 2514916 - RNA, 16 nt, Chlamydophila pneumoniae CWL029
auacaucaaaaugcug

SEQ ID NO: 2514917 - RNA, 19 nt, Chlamydophila pneumoniae CWL029
auacaucaccacugcucca

SEQ ID NO: 2514918 - RNA, 19 nt, Chlamydophila pneumoniae CWL029
auacaucccauucaauaau

SEQ ID NO: 2514919 - RNA, 14 nt, Chlamydophila pneumoniae CWL029
auaccaaaauacca

SEQ ID NO: 2514920 - RNA, 23 nt, Chlamydophila pneumoniae CWL029
auaccaagaugucuccaaagaua

SEQ ID NO: 2514921 - RNA, 11 nt, Chlamydophila pneumoniae CWL029
auaccacagcu

SEQ ID NO: 2514922 - RNA, 19 nt, Chlamydophila pneumoniae CWL029
auaccaccccaaagcagau

SEQ ID NO: 2514923 - RNA, 19 nt, Chlamydophila pneumoniae CWL029
auaccacgcaucuuaagag

SEQ ID NO: 2514924 - RNA, 16 nt, Chlamydophila pneumoniae CWL029
auaccacuacugagcu

SEQ ID NO: 2514925 - RNA, 17 nt, Chlamydophila pneumoniae CWL029
auaccacuacugagcuu

SEQ ID NO: 2514926 - RNA, 21 nt, Chlamydophila pneumoniae CWL029
auaccagauaaagcaaagaua

SEQ ID NO: 2514927 - RNA, 13 nt, Chlamydophila pneumoniae CWL029
auaccaucaaggu

SEQ ID NO: 2514928 - RNA, 16 nt, Chlamydophila pneumoniae CWL029
auacccacaaagauca

SEQ ID NO: 2514929 - RNA, 15 nt, Chlamydophila pneumoniae CWL029
auacccaucuagaaa

SEQ ID NO: 2514930 - RNA, 16 nt, Chlamydophila pneumoniae CWL029
auacccaucuagaaac

SEQ ID NO: 2514931 - RNA, 22 nt, Chlamydophila pneumoniae CWL029
auacccucggagacucagagaa

SEQ ID NO: 2514932 - RNA, 13 nt, Chlamydophila pneumoniae CWL029
auacccuucuucu

SEQ ID NO: 2514933 - RNA, 19 nt, Chlamydophila pneumoniae CWL029
auaccgcuguuuuauagca

SEQ ID NO: 2514934 - RNA, 15 nt, Chlamydophila pneumoniae CWL029
auaccggcaaauaaa

SEQ ID NO: 2514935 - RNA, 12 nt, Chlamydophila pneumoniae CWL029
auaccuacuaaa

SEQ ID NO: 2514936 - RNA, 18 nt, Chlamydophila pneumoniae CWL029
auaccuccuccaaucugc

SEQ ID NO: 2514937 - RNA, 20 nt, Chlamydophila pneumoniae CWL029
auaccuguacgguaaaucca

SEQ ID NO: 2514938 - RNA, 23 nt, Chlamydophila pneumoniae CWL029
auaccuuucuaagaauucuuugc

SEQ ID NO: 2514939 - RNA, 14 nt, Chlamydophila pneumoniae CWL029
auacgaaggaucau

SEQ ID NO: 2514940 - RNA, 13 nt, Chlamydophila pneumoniae CWL029
auacgcagcacgc

SEQ ID NO: 2514941 - RNA, 22 nt, Chlamydophila pneumoniae CWL029
auacgccgggccacuucaucuu

SEQ ID NO: 2514942 - RNA, 21 nt, Chlamydophila pneumoniae CWL029
auacggacuucacaaagaacc

SEQ ID NO: 2514943 - RNA, 16 nt, Chlamydophila pneumoniae CWL029
auacguaguccuuauu

SEQ ID NO: 2514944 - RNA, 17 nt, Chlamydophila pneumoniae CWL029
auacguaguccuuauuu

SEQ ID NO: 2514945 - RNA, 16 nt, Chlamydophila pneumoniae CWL029
auacguuuuuuuccuu

SEQ ID NO: 2514946 - RNA, 22 nt, Chlamydophila pneumoniae CWL029
auacguuuuuuuccuuucuuuu

SEQ ID NO: 2514947 - RNA, 15 nt, Chlamydophila pneumoniae CWL029
auacuacucucauca

SEQ ID NO: 2514948 - RNA, 20 nt, Chlamydophila pneumoniae CWL029
auacuacuuacaagaacaag

SEQ ID NO: 2514949 - RNA, 15 nt, Chlamydophila pneumoniae CWL029
auacucauauuuugu

SEQ ID NO: 2514950 - RNA, 15 nt, Chlamydophila pneumoniae CWL029
auacuccacuuuuuu

SEQ ID NO: 2514951 - RNA, 18 nt, Chlamydophila pneumoniae CWL029
auacuccacuuuuuuccc

SEQ ID NO: 2514952 - RNA, 18 nt, Chlamydophila pneumoniae CWL029
auacucuagguuuucucu

SEQ ID NO: 2514953 - RNA, 18 nt, Chlamydophila pneumoniae CWL029
auacugcugcuaagccaa

SEQ ID NO: 2514954 - RNA, 18 nt, Chlamydophila pneumoniae CWL029
auacuguuaacaaguacc

SEQ ID NO: 2514955 - RNA, 17 nt, Chlamydophila pneumoniae CWL029
auacuguugauccuucu

SEQ ID NO: 2514956 - RNA, 23 nt, Chlamydophila pneumoniae CWL029
auacuuaauccuguagggaaaga

SEQ ID NO: 2514957 - RNA, 12 nt, Chlamydophila pneumoniae CWL029
auacuuauacca

SEQ ID NO: 2514958 - RNA, 16 nt, Chlamydophila pneumoniae CWL029
auacuuauauuggcuu

SEQ ID NO: 2514959 - RNA, 13 nt, Chlamydophila pneumoniae CWL029
auacuucuccuga

SEQ ID NO: 2514960 - RNA, 14 nt, Chlamydophila pneumoniae CWL029
auacuucuccugaa

SEQ ID NO: 2514961 - RNA, 23 nt, Chlamydophila pneumoniae CWL029
auacuuuaggaggggggauucug

SEQ ID NO: 2514962 - RNA, 18 nt, Chlamydophila pneumoniae CWL029
auagaaaacauagagauu

SEQ ID NO: 2514963 - RNA, 21 nt, Chlamydophila pneumoniae CWL029
auagaaaaucauucaaauaua

SEQ ID NO: 2514964 - RNA, 13 nt, Chlamydophila pneumoniae CWL029
auagaaaguacag

SEQ ID NO: 2514965 - RNA, 18 nt, Chlamydophila pneumoniae CWL029
auagaaaguacagauuuc

SEQ ID NO: 2514966 - RNA, 19 nt, Chlamydophila pneumoniae CWL029
auagaaauaagcaucuaga

SEQ ID NO: 2514967 - RNA, 14 nt, Chlamydophila pneumoniae CWL029
auagaaaugagaga

SEQ ID NO: 2514968 - RNA, 14 nt, Chlamydophila pneumoniae CWL029
auagaaauucugua

SEQ ID NO: 2514969 - RNA, 16 nt, Chlamydophila pneumoniae CWL029
auagaaauucuguaga

SEQ ID NO: 2514970 - RNA, 20 nt, Chlamydophila pneumoniae CWL029
auagaacgaauuucaacagc

SEQ ID NO: 2514971 - RNA, 14 nt, Chlamydophila pneumoniae CWL029
auagaauagaaugu

SEQ ID NO: 2514972 - RNA, 19 nt, Chlamydophila pneumoniae CWL029
auagaauccucggaagaua

SEQ ID NO: 2514973 - RNA, 12 nt, Chlamydophila pneumoniae CWL029
auagacaaccua

SEQ ID NO: 2514974 - RNA, 15 nt, Chlamydophila pneumoniae CWL029
auagacacuugcuua

SEQ ID NO: 2514975 - RNA, 20 nt, Chlamydophila pneumoniae CWL029
auagacacuugcuuaaggaa

SEQ ID NO: 2514976 - RNA, 20 nt, Chlamydophila pneumoniae CWL029
auagacauucccuaaagcug

SEQ ID NO: 2514977 - RNA, 23 nt, Chlamydophila pneumoniae CWL029
auagacauucccuaaagcugcca

SEQ ID NO: 2514978 - RNA, 17 nt, Chlamydophila pneumoniae CWL029
auagaccccccauucca

SEQ ID NO: 2514979 - RNA, 15 nt, Chlamydophila pneumoniae CWL029
auagacuccuuaaca

SEQ ID NO: 2514980 - RNA, 15 nt, Chlamydophila pneumoniae CWL029
auagacucucacuga

SEQ ID NO: 2514981 - RNA, 13 nt, Chlamydophila pneumoniae CWL029
auagacucuuccu

SEQ ID NO: 2514982 - RNA, 17 nt, Chlamydophila pneumoniae CWL029
auagagagaaugacuuu

SEQ ID NO: 2514983 - RNA, 14 nt, Chlamydophila pneumoniae CWL029
auagagauucuaca

SEQ ID NO: 2514984 - RNA, 17 nt, Chlamydophila pneumoniae CWL029
auagagccuagagaguu

SEQ ID NO: 2514985 - RNA, 20 nt, Chlamydophila pneumoniae CWL029
auagagccuagagaguucuu

SEQ ID NO: 2514986 - RNA, 14 nt, Chlamydophila pneumoniae CWL029
auagagccuccucc

SEQ ID NO: 2514987 - RNA, 14 nt, Chlamydophila pneumoniae CWL029
auagagcgguucuu

SEQ ID NO: 2514988 - RNA, 18 nt, Chlamydophila pneumoniae CWL029
auagagcgguucuuucua

SEQ ID NO: 2514989 - RNA, 22 nt, Chlamydophila pneumoniae CWL029
auagagcgguucuuucuagaau

SEQ ID NO: 2514990 - RNA, 13 nt, Chlamydophila pneumoniae CWL029
auagagcucuaaa

SEQ ID NO: 2514991 - RNA, 14 nt, Chlamydophila pneumoniae CWL029
auagagcucuaaaa

SEQ ID NO: 2514992 - RNA, 18 nt, Chlamydophila pneumoniae CWL029
auagagcuucuuuaucua

SEQ ID NO: 2514993 - RNA, 17 nt, Chlamydophila pneumoniae CWL029
auagaggaccgaaaaac

SEQ ID NO: 2514994 - RNA, 20 nt, Chlamydophila pneumoniae CWL029
auagaggagauccuaagaga

SEQ ID NO: 2514995 - RNA, 20 nt, Chlamydophila pneumoniae CWL029
auagaguagcucaucuagaa

SEQ ID NO: 2514996 - RNA, 20 nt, Chlamydophila pneumoniae CWL029
auagaguaucuaaaacuucu

SEQ ID NO: 2514997 - RNA, 18 nt, Chlamydophila pneumoniae CWL029
auagagugaccauagcau

SEQ ID NO: 2514998 - RNA, 19 nt, Chlamydophila pneumoniae CWL029
auagaguucgcacuaauuu

SEQ ID NO: 2514999 - RNA, 14 nt, Chlamydophila pneumoniae CWL029
auagauaaaucccc

SEQ ID NO: 2515000 - RNA, 13 nt, Chlamydophila pneumoniae CWL029
auagauaugccuc

SEQ ID NO: 2515001 - RNA, 16 nt, Chlamydophila pneumoniae CWL029
auaucuauaaauguag

SEQ ID NO: 2515002 - RNA, 17 nt, Chlamydophila pneumoniae CWL029
auaucuauagaaggcau

SEQ ID NO: 2515003 - RNA, 21 nt, Chlamydophila pneumoniae CWL029
auaucuauagaaggcaucccg

SEQ ID NO: 2515004 - RNA, 23 nt, Chlamydophila pneumoniae CWL029
auaucuccguuaccaaaaacugg

SEQ ID NO: 2515005 - RNA, 19 nt, Chlamydophila pneumoniae CWL029
auaucuccuuuaaauaaaa

SEQ ID NO: 2515006 - RNA, 21 nt, Chlamydophila pneumoniae CWL029
auaucucuaccgaacagagcg

SEQ ID NO: 2515007 - RNA, 17 nt, Chlamydophila pneumoniae CWL029
auaucucuggcauaauc

SEQ ID NO: 2515008 - RNA, 22 nt, Chlamydophila pneumoniae CWL029
auaucucuggcauaauccugaa

SEQ ID NO: 2515009 - RNA, 14 nt, Chlamydophila pneumoniae CWL029
auaucugagcauaa

SEQ ID NO: 2515010 - RNA, 11 nt, Chlamydophila pneumoniae CWL029
auaucuucaga

SEQ ID NO: 2515011 - RNA, 18 nt, Chlamydophila pneumoniae CWL029
auaucuugaauucucaag

SEQ ID NO: 2515012 - RNA, 13 nt, Chlamydophila pneumoniae CWL029
auaugaagagacg

SEQ ID NO: 2515013 - RNA, 17 nt, Chlamydophila pneumoniae CWL029
auaugaaugacugcaga

SEQ ID NO: 2515014 - RNA, 16 nt, Chlamydophila pneumoniae CWL029
auaugcuuuucaaaua

SEQ ID NO: 2515015 - RNA, 13 nt, Chlamydophila pneumoniae CWL029
auauggaauggcu

SEQ ID NO: 2515016 - RNA, 21 nt, Chlamydophila pneumoniae CWL029
auauggcugucacggaagaac

SEQ ID NO: 2515017 - RNA, 22 nt, Chlamydophila pneumoniae CWL029
auaugggacuucaagccaaaac

SEQ ID NO: 2515018 - RNA, 22 nt, Chlamydophila pneumoniae CWL029
auauggguguaaauuuuuccuu

SEQ ID NO: 2515019 - RNA, 19 nt, Chlamydophila pneumoniae CWL029
auauguccgugagcaacaa

SEQ ID NO: 2515020 - RNA, 14 nt, Chlamydophila pneumoniae CWL029
auaugucuugcuuu

SEQ ID NO: 2515021 - RNA, 12 nt, Chlamydophila pneumoniae CWL029
auauuaaauuca

SEQ ID NO: 2515022 - RNA, 17 nt, Chlamydophila pneumoniae CWL029
auauuaacccaccagaa

SEQ ID NO: 2515023 - RNA, 20 nt, Chlamydophila pneumoniae CWL029
auauucaagaggaccgagau

SEQ ID NO: 2515024 - RNA, 18 nt, Chlamydophila pneumoniae CWL029
auauuccuauaacaacau

SEQ ID NO: 2515025 - RNA, 14 nt, Chlamydophila pneumoniae CWL029
auauuccuggaaca

SEQ ID NO: 2515026 - RNA, 13 nt, Chlamydophila pneumoniae CWL029
auauucuaaaggg

SEQ ID NO: 2515027 - RNA, 15 nt, Chlamydophila pneumoniae CWL029
auauucucgaaaaau

SEQ ID NO: 2515028 - RNA, 14 nt, Chlamydophila pneumoniae CWL029
auauucugauucuc

SEQ ID NO: 2515029 - RNA, 17 nt, Chlamydophila pneumoniae CWL029
auauucuuucaaaccac

SEQ ID NO: 2515030 - RNA, 16 nt, Chlamydophila pneumoniae CWL029
auauugacaacacgau

SEQ ID NO: 2515031 - RNA, 22 nt, Chlamydophila pneumoniae CWL029
auauugccuucuucuuguucuu

SEQ ID NO: 2515032 - RNA, 14 nt, Chlamydophila pneumoniae CWL029
auauugcucuugua

SEQ ID NO: 2515033 - RNA, 17 nt, Chlamydophila pneumoniae CWL029
auauugugcauuaccuc

SEQ ID NO: 2515034 - RNA, 15 nt, Chlamydophila pneumoniae CWL029
auauuguucuuccaa

SEQ ID NO: 2515035 - RNA, 11 nt, Chlamydophila pneumoniae CWL029
auauuuaaaag

SEQ ID NO: 2515036 - RNA, 12 nt, Chlamydophila pneumoniae CWL029
auauuuaaaagg

SEQ ID NO: 2515037 - RNA, 16 nt, Chlamydophila pneumoniae CWL029
auauuuccaguauucu

SEQ ID NO: 2515038 - RNA, 20 nt, Chlamydophila pneumoniae CWL029
auauuuucuugucucuugcg

SEQ ID NO: 2515039 - RNA, 15 nt, Chlamydophila pneumoniae CWL029
auauuuuuauuuaaa

SEQ ID NO: 2515040 - RNA, 19 nt, Chlamydophila pneumoniae CWL029
aucaaaaaaaacgccauac

SEQ ID NO: 2515041 - RNA, 14 nt, Chlamydophila pneumoniae CWL029
aucaaaaaaaagac

SEQ ID NO: 2515042 - RNA, 19 nt, Chlamydophila pneumoniae CWL029
aucaaaaaaaagaccaaau

SEQ ID NO: 2515043 - RNA, 12 nt, Chlamydophila pneumoniae CWL029
aucaaaaaugau

SEQ ID NO: 2515044 - RNA, 15 nt, Chlamydophila pneumoniae CWL029
aucaaaaugcugcuu

SEQ ID NO: 2515045 - RNA, 15 nt, Chlamydophila pneumoniae CWL029
aucaaagaaagugaa

SEQ ID NO: 2515046 - RNA, 11 nt, Chlamydophila pneumoniae CWL029
aucaaagaauu

SEQ ID NO: 2515047 - RNA, 17 nt, Chlamydophila pneumoniae CWL029
aucaaagcaaaagucau

SEQ ID NO: 2515048 - RNA, 21 nt, Chlamydophila pneumoniae CWL029
aucaaaggcaauagcagcagc

SEQ ID NO: 2515049 - RNA, 21 nt, Chlamydophila pneumoniae CWL029
aucaaaggcugcuugagacuu

SEQ ID NO: 2515050 - RNA, 17 nt, Chlamydophila pneumoniae CWL029
aucaaaguauauauuuu

SEQ ID NO: 2515051 - RNA, 21 nt, Chlamydophila pneumoniae CWL029
aucaaaguauauauuuuacaa

SEQ ID NO: 2515052 - RNA, 18 nt, Chlamydophila pneumoniae CWL029
aucaaauaaggcugcuau

SEQ ID NO: 2515053 - RNA, 16 nt, Chlamydophila pneumoniae CWL029
aucaaauagauuuuua

SEQ ID NO: 2515054 - RNA, 13 nt, Chlamydophila pneumoniae CWL029
aucaaccaaaaug

SEQ ID NO: 2515055 - RNA, 22 nt, Chlamydophila pneumoniae CWL029
aucaaccgaagauccuagagaa

SEQ ID NO: 2515056 - RNA, 14 nt, Chlamydophila pneumoniae CWL029
aucaacucuccauc

SEQ ID NO: 2515057 - RNA, 17 nt, Chlamydophila pneumoniae CWL029
aucaagaagagaaaaga

SEQ ID NO: 2515058 - RNA, 18 nt, Chlamydophila pneumoniae CWL029
aucaagaagagaaaagau

SEQ ID NO: 2515059 - RNA, 16 nt, Chlamydophila pneumoniae CWL029
aucaagagcucguaau

SEQ ID NO: 2515060 - RNA, 21 nt, Chlamydophila pneumoniae CWL029
aucaagagcucguaauccuuc

SEQ ID NO: 2515061 - RNA, 16 nt, Chlamydophila pneumoniae CWL029
aucaagauaaaggcau

SEQ ID NO: 2515062 - RNA, 20 nt, Chlamydophila pneumoniae CWL029
aucaauaaguagauuaaagg

SEQ ID NO: 2515063 - RNA, 14 nt, Chlamydophila pneumoniae CWL029
aucaaucacucuau

SEQ ID NO: 2515064 - RNA, 22 nt, Chlamydophila pneumoniae CWL029
aucaauccuauggcagcaggaa

SEQ ID NO: 2515065 - RNA, 17 nt, Chlamydophila pneumoniae CWL029
aucaaugagaucugcaa

SEQ ID NO: 2515066 - RNA, 14 nt, Chlamydophila pneumoniae CWL029
aucaauuuuaccac

SEQ ID NO: 2515067 - RNA, 19 nt, Chlamydophila pneumoniae CWL029
aucacaaauugucugagga

SEQ ID NO: 2515068 - RNA, 15 nt, Chlamydophila pneumoniae CWL029
aucacaagaaagaau

SEQ ID NO: 2515069 - RNA, 18 nt, Chlamydophila pneumoniae CWL029
aucacaauuuuaaaaucu

SEQ ID NO: 2515070 - RNA, 21 nt, Chlamydophila pneumoniae CWL029
aucacaauuuuaaaaucuccu

SEQ ID NO: 2515071 - RNA, 22 nt, Chlamydophila pneumoniae CWL029
aucacacuuaaagguaaaacua

SEQ ID NO: 2515072 - RNA, 13 nt, Chlamydophila pneumoniae CWL029
aucacacuuucau

SEQ ID NO: 2515073 - RNA, 16 nt, Chlamydophila pneumoniae CWL029
aucacacuuucaucca

SEQ ID NO: 2515074 - RNA, 13 nt, Chlamydophila pneumoniae CWL029
aucacaguuaaga

SEQ ID NO: 2515075 - RNA, 21 nt, Chlamydophila pneumoniae CWL029
aucacaguuaagacgcagaaa

SEQ ID NO: 2515076 - RNA, 15 nt, Chlamydophila pneumoniae CWL029
aucacauagaaaaca

SEQ ID NO: 2515077 - RNA, 12 nt, Chlamydophila pneumoniae CWL029
aucacaucaguu

SEQ ID NO: 2515078 - RNA, 15 nt, Chlamydophila pneumoniae CWL029
aucacauuccaagaa

SEQ ID NO: 2515079 - RNA, 19 nt, Chlamydophila pneumoniae CWL029
aucacauuccaagaaaaau

SEQ ID NO: 2515080 - RNA, 16 nt, Chlamydophila pneumoniae CWL029
aucaccagcauuaaga

SEQ ID NO: 2515081 - RNA, 19 nt, Chlamydophila pneumoniae CWL029
aucaccguacuucccucau

SEQ ID NO: 2515082 - RNA, 15 nt, Chlamydophila pneumoniae CWL029
aucaccuacaucaga

SEQ ID NO: 2515083 - RNA, 21 nt, Chlamydophila pneumoniae CWL029
aucaccuucggaucuucccau

SEQ ID NO: 2515084 - RNA, 14 nt, Chlamydophila pneumoniae CWL029
aucacgaaaaggag

SEQ ID NO: 2515085 - RNA, 15 nt, Chlamydophila pneumoniae CWL029
aucacguccuucuau

SEQ ID NO: 2515086 - RNA, 20 nt, Chlamydophila pneumoniae CWL029
aucagaaaugaagccaaaag

SEQ ID NO: 2515087 - RNA, 19 nt, Chlamydophila pneumoniae CWL029
aucagaacaacgcugcuuc

SEQ ID NO: 2515088 - RNA, 19 nt, Chlamydophila pneumoniae CWL029
aucagaagguaaauuuuua

SEQ ID NO: 2515089 - RNA, 18 nt, Chlamydophila pneumoniae CWL029
aucagaaucuaaguaaaa

SEQ ID NO: 2515090 - RNA, 16 nt, Chlamydophila pneumoniae CWL029
aucagacugaagagca

SEQ ID NO: 2515091 - RNA, 16 nt, Chlamydophila pneumoniae CWL029
aucagagacaaguuca

SEQ ID NO: 2515092 - RNA, 12 nt, Chlamydophila pneumoniae CWL029
aucagaggagcc

SEQ ID NO: 2515093 - RNA, 22 nt, Chlamydophila pneumoniae CWL029
aucagaggccaccaaaaauucc

SEQ ID NO: 2515094 - RNA, 18 nt, Chlamydophila pneumoniae CWL029
aucagauguaaagagcaa

SEQ ID NO: 2515095 - RNA, 19 nt, Chlamydophila pneumoniae CWL029
aucagauguaaagagcaac

SEQ ID NO: 2515096 - RNA, 15 nt, Chlamydophila pneumoniae CWL029
aucagcaaaacuccc

SEQ ID NO: 2515097 - RNA, 17 nt, Chlamydophila pneumoniae CWL029
aucagcaacauaaaguu

SEQ ID NO: 2515098 - RNA, 17 nt, Chlamydophila pneumoniae CWL029
aucagcaagaucuaacu

SEQ ID NO: 2515099 - RNA, 15 nt, Chlamydophila pneumoniae CWL029
aucagcacacugcuu

SEQ ID NO: 2515100 - RNA, 21 nt, Chlamydophila pneumoniae CWL029
agauccuauaguaauuucucc

SEQ ID NO: 2515101 - RNA, 20 nt, Chlamydophila pneumoniae CWL029
agauccucaaagaguuuuuu

SEQ ID NO: 2515102 - RNA, 21 nt, Chlamydophila pneumoniae CWL029
agauccucuauagauugguaa

SEQ ID NO: 2515103 - RNA, 17 nt, Chlamydophila pneumoniae CWL029
agauccugaaaguacag

SEQ ID NO: 2515104 - RNA, 22 nt, Chlamydophila pneumoniae CWL029
agauccugagaccauacacaaa

SEQ ID NO: 2515105 - RNA, 23 nt, Chlamydophila pneumoniae CWL029
agauccuuuaaagauuccccaua

SEQ ID NO: 2515106 - RNA, 15 nt, Chlamydophila pneumoniae CWL029
agaucgaucucugug

SEQ ID NO: 2515107 - RNA, 22 nt, Chlamydophila pneumoniae CWL029
agaucgaucucugugguuccug

SEQ ID NO: 2515108 - RNA, 20 nt, Chlamydophila pneumoniae CWL029
agaucgggucuacaacaguu

SEQ ID NO: 2515109 - RNA, 17 nt, Chlamydophila pneumoniae CWL029
agaucguuagagaccca

SEQ ID NO: 2515110 - RNA, 14 nt, Chlamydophila pneumoniae CWL029
agaucuacaagacu

SEQ ID NO: 2515111 - RNA, 23 nt, Chlamydophila pneumoniae CWL029
agaucuacaagacuacgacagaa

SEQ ID NO: 2515112 - RNA, 18 nt, Chlamydophila pneumoniae CWL029
agaucuccgaagacuacc

SEQ ID NO: 2515113 - RNA, 18 nt, Chlamydophila pneumoniae CWL029
agaucuccgccuacaaua

SEQ ID NO: 2515114 - RNA, 20 nt, Chlamydophila pneumoniae CWL029
agaucucuguguuuugagga

SEQ ID NO: 2515115 - RNA, 17 nt, Chlamydophila pneumoniae CWL029
agaucucuuuagcaauc

SEQ ID NO: 2515116 - RNA, 21 nt, Chlamydophila pneumoniae CWL029
agaucucuuuagcaaucucuu

SEQ ID NO: 2515117 - RNA, 23 nt, Chlamydophila pneumoniae CWL029
agaucuggagagggaaggaauaa

SEQ ID NO: 2515118 - RNA, 20 nt, Chlamydophila pneumoniae CWL029
agaucuucugaaaucaaaaa

SEQ ID NO: 2515119 - RNA, 18 nt, Chlamydophila pneumoniae CWL029
agaucuugaaaagauuuu

SEQ ID NO: 2515120 - RNA, 11 nt, Chlamydophila pneumoniae CWL029
agaucuugaac

SEQ ID NO: 2515121 - RNA, 16 nt, Chlamydophila pneumoniae CWL029
agaucuuuauuuuuaa

SEQ ID NO: 2515122 - RNA, 13 nt, Chlamydophila pneumoniae CWL029
agaucuuuuguaa

SEQ ID NO: 2515123 - RNA, 20 nt, Chlamydophila pneumoniae CWL029
agaugaacgucuaaacgcga

SEQ ID NO: 2515124 - RNA, 14 nt, Chlamydophila pneumoniae CWL029
agaugaaguuccca

SEQ ID NO: 2515125 - RNA, 15 nt, Chlamydophila pneumoniae CWL029
agaugaaguucccac

SEQ ID NO: 2515126 - RNA, 16 nt, Chlamydophila pneumoniae CWL029
agaugagguaucccac

SEQ ID NO: 2515127 - RNA, 22 nt, Chlamydophila pneumoniae CWL029
agaugcgcucggauuucaugau

SEQ ID NO: 2515128 - RNA, 15 nt, Chlamydophila pneumoniae CWL029
agaugcuaacaacuc

SEQ ID NO: 2515129 - RNA, 13 nt, Chlamydophila pneumoniae CWL029
agaugcuggaacu

SEQ ID NO: 2515130 - RNA, 17 nt, Chlamydophila pneumoniae CWL029
agaugcuucuaaacaau

SEQ ID NO: 2515131 - RNA, 21 nt, Chlamydophila pneumoniae CWL029
agauggcaaggaaaauucagu

SEQ ID NO: 2515132 - RNA, 22 nt, Chlamydophila pneumoniae CWL029
agauggucgagaaccuccacca

SEQ ID NO: 2515133 - RNA, 22 nt, Chlamydophila pneumoniae CWL029
agauggucuuggguuuuaaaug

SEQ ID NO: 2515134 - RNA, 15 nt, Chlamydophila pneumoniae CWL029
agauguaaagagcaa

SEQ ID NO: 2515135 - RNA, 17 nt, Chlamydophila pneumoniae CWL029
agauguaaagagcaaca

SEQ ID NO: 2515136 - RNA, 21 nt, Chlamydophila pneumoniae CWL029
agauguaaagagcaacaguaa

SEQ ID NO: 2515137 - RNA, 22 nt, Chlamydophila pneumoniae CWL029
agauguggcagaguccuucuuu

SEQ ID NO: 2515138 - RNA, 21 nt, Chlamydophila pneumoniae CWL029
agauguguacggguaaccuga

SEQ ID NO: 2515139 - RNA, 18 nt, Chlamydophila pneumoniae CWL029
agauguuaugaguuuuua

SEQ ID NO: 2515140 - RNA, 24 nt, Chlamydophila pneumoniae CWL029
agauguuuucguaaauaugaauua

SEQ ID NO: 2515141 - RNA, 20 nt, Chlamydophila pneumoniae CWL029
agauuaccgaagagccccca

SEQ ID NO: 2515142 - RNA, 20 nt, Chlamydophila pneumoniae CWL029
agauuauuuguuucuuccau

SEQ ID NO: 2515143 - RNA, 15 nt, Chlamydophila pneumoniae CWL029
agauucaagcaaugc

SEQ ID NO: 2515144 - RNA, 17 nt, Chlamydophila pneumoniae CWL029
agauucaagcaaugccu

SEQ ID NO: 2515145 - RNA, 15 nt, Chlamydophila pneumoniae CWL029
agauucauaaaacug

SEQ ID NO: 2515146 - RNA, 22 nt, Chlamydophila pneumoniae CWL029
agauucccugcggacagaaacu

SEQ ID NO: 2515147 - RNA, 23 nt, Chlamydophila pneumoniae CWL029
agauucccugcggacagaaacug

SEQ ID NO: 2515148 - RNA, 16 nt, Chlamydophila pneumoniae CWL029
agauuccuaacuucug

SEQ ID NO: 2515149 - RNA, 15 nt, Chlamydophila pneumoniae CWL029
agauucuaaaucaac

SEQ ID NO: 2515150 - RNA, 20 nt, Chlamydophila pneumoniae CWL029
agauucuaaaucaacuacac

SEQ ID NO: 2515151 - RNA, 12 nt, Chlamydophila pneumoniae CWL029
agauucuacaaa

SEQ ID NO: 2515152 - RNA, 12 nt, Chlamydophila pneumoniae CWL029
agauucugaaga

SEQ ID NO: 2515153 - RNA, 21 nt, Chlamydophila pneumoniae CWL029
agauucugcccaaagcuaaaa

SEQ ID NO: 2515154 - RNA, 20 nt, Chlamydophila pneumoniae CWL029
agauucugcuuuaucucuau

SEQ ID NO: 2515155 - RNA, 16 nt, Chlamydophila pneumoniae CWL029
agauucuucagaaucu

SEQ ID NO: 2515156 - RNA, 21 nt, Chlamydophila pneumoniae CWL029
agauugaaggcaccaacacuu

SEQ ID NO: 2515157 - RNA, 15 nt, Chlamydophila pneumoniae CWL029
agauugaaucccauc

SEQ ID NO: 2515158 - RNA, 22 nt, Chlamydophila pneumoniae CWL029
agauugaggauaaguucuucca

SEQ ID NO: 2515159 - RNA, 21 nt, Chlamydophila pneumoniae CWL029
agauugcagguagauccuaua

SEQ ID NO: 2515160 - RNA, 20 nt, Chlamydophila pneumoniae CWL029
agauugccuuugaucaggag

SEQ ID NO: 2515161 - RNA, 21 nt, Chlamydophila pneumoniae CWL029
agauuggaauauaaucguuuu

SEQ ID NO: 2515162 - RNA, 16 nt, Chlamydophila pneumoniae CWL029
agauuguuagugagau

SEQ ID NO: 2515163 - RNA, 13 nt, Chlamydophila pneumoniae CWL029
agauuuagggaag

SEQ ID NO: 2515164 - RNA, 16 nt, Chlamydophila pneumoniae CWL029
agauuuaguucaccac

SEQ ID NO: 2515165 - RNA, 15 nt, Chlamydophila pneumoniae CWL029
agauuuauuuugucu

SEQ ID NO: 2515166 - RNA, 12 nt, Chlamydophila pneumoniae CWL029
agauuuccuccg

SEQ ID NO: 2515167 - RNA, 17 nt, Chlamydophila pneumoniae CWL029
agauuuccuuaagcuuc

SEQ ID NO: 2515168 - RNA, 19 nt, Chlamydophila pneumoniae CWL029
agauuucuaauccuccaaa

SEQ ID NO: 2515169 - RNA, 15 nt, Chlamydophila pneumoniae CWL029
agauuucuacaaaca

SEQ ID NO: 2515170 - RNA, 20 nt, Chlamydophila pneumoniae CWL029
agauuucuauagagcaucau

SEQ ID NO: 2515171 - RNA, 23 nt, Chlamydophila pneumoniae CWL029
agauuuuguaggaacaugccaaa

SEQ ID NO: 2515172 - RNA, 14 nt, Chlamydophila pneumoniae CWL029
agauuuuuagaaua

SEQ ID NO: 2515173 - RNA, 21 nt, Chlamydophila pneumoniae CWL029
agauuuuucaagaacuccuuu

SEQ ID NO: 2515174 - RNA, 13 nt, Chlamydophila pneumoniae CWL029
agauuuuucuuuu

SEQ ID NO: 2515175 - RNA, 21 nt, Chlamydophila pneumoniae CWL029
agauuuuucuuuuagagaaau

SEQ ID NO: 2515176 - RNA, 15 nt, Chlamydophila pneumoniae CWL029
agcaaaaauucuagg

SEQ ID NO: 2515177 - RNA, 13 nt, Chlamydophila pneumoniae CWL029
agcaaaacuagga

SEQ ID NO: 2515178 - RNA, 20 nt, Chlamydophila pneumoniae CWL029
agcaaaaugcgaggaaaaag

SEQ ID NO: 2515179 - RNA, 19 nt, Chlamydophila pneumoniae CWL029
agcaaacggagagcauuua

SEQ ID NO: 2515180 - RNA, 13 nt, Chlamydophila pneumoniae CWL029
agcaaagaaaauu

SEQ ID NO: 2515181 - RNA, 19 nt, Chlamydophila pneumoniae CWL029
agcaaagaaaauucucaga

SEQ ID NO: 2515182 - RNA, 21 nt, Chlamydophila pneumoniae CWL029
agcaaagaaaauucucagauu

SEQ ID NO: 2515183 - RNA, 16 nt, Chlamydophila pneumoniae CWL029
agcaaagauaaagaag

SEQ ID NO: 2515184 - RNA, 20 nt, Chlamydophila pneumoniae CWL029
agcaaagcggcucuuacuuc

SEQ ID NO: 2515185 - RNA, 13 nt, Chlamydophila pneumoniae CWL029
agcaacaaccaaa

SEQ ID NO: 2515186 - RNA, 14 nt, Chlamydophila pneumoniae CWL029
agcaacaaccaaaa

SEQ ID NO: 2515187 - RNA, 18 nt, Chlamydophila pneumoniae CWL029
agcaacaucguuaauaua

SEQ ID NO: 2515188 - RNA, 19 nt, Chlamydophila pneumoniae CWL029
agcaacaucguuaauauaa

SEQ ID NO: 2515189 - RNA, 22 nt, Chlamydophila pneumoniae CWL029
agcaacaucguuaauauaauug

SEQ ID NO: 2515190 - RNA, 19 nt, Chlamydophila pneumoniae CWL029
agcaaccuuuccuaaaaua

SEQ ID NO: 2515191 - RNA, 22 nt, Chlamydophila pneumoniae CWL029
agcaacgcaugacgcuuuucca

SEQ ID NO: 2515192 - RNA, 14 nt, Chlamydophila pneumoniae CWL029
agcaacuaaacucu

SEQ ID NO: 2515193 - RNA, 14 nt, Chlamydophila pneumoniae CWL029
agcaacuaaagcau

SEQ ID NO: 2515194 - RNA, 12 nt, Chlamydophila pneumoniae CWL029
agcaacucuuca

SEQ ID NO: 2515195 - RNA, 23 nt, Chlamydophila pneumoniae CWL029
agcaacuucuucguuagagaaga

SEQ ID NO: 2515196 - RNA, 17 nt, Chlamydophila pneumoniae CWL029
agcaagaauuucuucua

SEQ ID NO: 2515197 - RNA, 13 nt, Chlamydophila pneumoniae CWL029
agcaagagcucuu

SEQ ID NO: 2515198 - RNA, 19 nt, Chlamydophila pneumoniae CWL029
agcaagagcucuugagaaa

SEQ ID NO: 2515199 - RNA, 18 nt, Chlamydophila pneumoniae CWL029
agcaagauucuucagaau

SEQ ID NO: 2515200 - RNA, 13 nt, Chlamydophila pneumoniae CWL029
agcaaggaaaaaa

SEQ ID NO: 2515201 - RNA, 14 nt, Chlamydophila pneumoniae CWL029
agcaaggaaaaaaa

SEQ ID NO: 2515202 - RNA, 21 nt, Chlamydophila pneumoniae CWL029
agcaaggaaaaaaaaucugcu

SEQ ID NO: 2515203 - RNA, 18 nt, Chlamydophila pneumoniae CWL029
agcaaggggaguuuucuu

SEQ ID NO: 2515204 - RNA, 19 nt, Chlamydophila pneumoniae CWL029
agcaaggggaguuuucuua

SEQ ID NO: 2515205 - RNA, 15 nt, Chlamydophila pneumoniae CWL029
agcaaguagcucucu

SEQ ID NO: 2515206 - RNA, 23 nt, Chlamydophila pneumoniae CWL029
agcaaguuguugauaauuacaga

SEQ ID NO: 2515207 - RNA, 20 nt, Chlamydophila pneumoniae CWL029
agcaauaucuauagaaggca

SEQ ID NO: 2515208 - RNA, 13 nt, Chlamydophila pneumoniae CWL029
agcaauaucugug

SEQ ID NO: 2515209 - RNA, 22 nt, Chlamydophila pneumoniae CWL029
agcaaucaguaaacccucagaa

SEQ ID NO: 2515210 - RNA, 19 nt, Chlamydophila pneumoniae CWL029
agcaaucccccagcauuca

SEQ ID NO: 2515211 - RNA, 16 nt, Chlamydophila pneumoniae CWL029
agcaaugauguuuuuu

SEQ ID NO: 2515212 - RNA, 18 nt, Chlamydophila pneumoniae CWL029
agcaauuaccugcccuug

SEQ ID NO: 2515213 - RNA, 18 nt, Chlamydophila pneumoniae CWL029
agcaauucgguagagcua

SEQ ID NO: 2515214 - RNA, 22 nt, Chlamydophila pneumoniae CWL029
agcacauaagaugaaguuuaau

SEQ ID NO: 2515215 - RNA, 22 nt, Chlamydophila pneumoniae CWL029
agcacauacaguacgcaaagua

SEQ ID NO: 2515216 - RNA, 15 nt, Chlamydophila pneumoniae CWL029
agcacauuuuucuau

SEQ ID NO: 2515217 - RNA, 18 nt, Chlamydophila pneumoniae CWL029
agcacauuuuucuauaau

SEQ ID NO: 2515218 - RNA, 14 nt, Chlamydophila pneumoniae CWL029
agcaccacgaccua

SEQ ID NO: 2515219 - RNA, 14 nt, Chlamydophila pneumoniae CWL029
agcacgcacuaauc

SEQ ID NO: 2515220 - RNA, 17 nt, Chlamydophila pneumoniae CWL029
agcacgcacuaaucuau

SEQ ID NO: 2515221 - RNA, 18 nt, Chlamydophila pneumoniae CWL029
agcacguagguuguacuu

SEQ ID NO: 2515222 - RNA, 23 nt, Chlamydophila pneumoniae CWL029
agcacuaaaagggaagcuuccau

SEQ ID NO: 2515223 - RNA, 22 nt, Chlamydophila pneumoniae CWL029
agcacuuaaaaaacuuccuaac

SEQ ID NO: 2515224 - RNA, 15 nt, Chlamydophila pneumoniae CWL029
agcacuucuuuagga

SEQ ID NO: 2515225 - RNA, 20 nt, Chlamydophila pneumoniae CWL029
agcacuuguuuuuucuucug

SEQ ID NO: 2515226 - RNA, 22 nt, Chlamydophila pneumoniae CWL029
agcacuuguuuuuucuucuguu

SEQ ID NO: 2515227 - RNA, 18 nt, Chlamydophila pneumoniae CWL029
agcagaaacuccaaaaua

SEQ ID NO: 2515228 - RNA, 21 nt, Chlamydophila pneumoniae CWL029
agcagaaguccuaucaaagca

SEQ ID NO: 2515229 - RNA, 23 nt, Chlamydophila pneumoniae CWL029
agcagaccucucccuugggauuc

SEQ ID NO: 2515230 - RNA, 13 nt, Chlamydophila pneumoniae CWL029
agcagcaaaaauu

SEQ ID NO: 2515231 - RNA, 18 nt, Chlamydophila pneumoniae CWL029
agcagcaaauacuccagg

SEQ ID NO: 2515232 - RNA, 13 nt, Chlamydophila pneumoniae CWL029
agcagcagaauca

SEQ ID NO: 2515233 - RNA, 14 nt, Chlamydophila pneumoniae CWL029
agcagccucuucuc

SEQ ID NO: 2515234 - RNA, 15 nt, Chlamydophila pneumoniae CWL029
agcagccucuucucu

SEQ ID NO: 2515235 - RNA, 22 nt, Chlamydophila pneumoniae CWL029
agcagcugucaauccaacaaag

SEQ ID NO: 2515236 - RNA, 17 nt, Chlamydophila pneumoniae CWL029
agcagcuucgcaaucuu

SEQ ID NO: 2515237 - RNA, 15 nt, Chlamydophila pneumoniae CWL029
agcaggaaaagcaaa

SEQ ID NO: 2515238 - RNA, 20 nt, Chlamydophila pneumoniae CWL029
agcaggaauaaucaaccaaa

SEQ ID NO: 2515239 - RNA, 13 nt, Chlamydophila pneumoniae CWL029
agcaggagcauca

SEQ ID NO: 2515240 - RNA, 21 nt, Chlamydophila pneumoniae CWL029
agcaggaguuuucaagucugu

SEQ ID NO: 2515241 - RNA, 23 nt, Chlamydophila pneumoniae CWL029
agcagggaaaaugcgaucuucac

SEQ ID NO: 2515242 - RNA, 20 nt, Chlamydophila pneumoniae CWL029
agcaggugugugguaaaaau

SEQ ID NO: 2515243 - RNA, 12 nt, Chlamydophila pneumoniae CWL029
agcagugugcca

SEQ ID NO: 2515244 - RNA, 13 nt, Chlamydophila pneumoniae CWL029
agcagugugccaa

SEQ ID NO: 2515245 - RNA, 12 nt, Chlamydophila pneumoniae CWL029
agcauaaaaauu

SEQ ID NO: 2515246 - RNA, 13 nt, Chlamydophila pneumoniae CWL029
agcauaacuugaa

SEQ ID NO: 2515247 - RNA, 20 nt, Chlamydophila pneumoniae CWL029
agcauaaguuagccuggcua

SEQ ID NO: 2515248 - RNA, 14 nt, Chlamydophila pneumoniae CWL029
agcauacuuauauu

SEQ ID NO: 2515249 - RNA, 20 nt, Chlamydophila pneumoniae CWL029
agcauagacucuuccuucua

SEQ ID NO: 2515250 - RNA, 14 nt, Chlamydophila pneumoniae CWL029
agcauagagagaag

SEQ ID NO: 2515251 - RNA, 21 nt, Chlamydophila pneumoniae CWL029
agcauagagcucuaaaaaaga

SEQ ID NO: 2515252 - RNA, 20 nt, Chlamydophila pneumoniae CWL029
agcauaguguuccaaaacag

SEQ ID NO: 2515253 - RNA, 22 nt, Chlamydophila pneumoniae CWL029
agcauauuuaaauauaaauuua

SEQ ID NO: 2515254 - RNA, 18 nt, Chlamydophila pneumoniae CWL029
agcaucauuaauuccauc

SEQ ID NO: 2515255 - RNA, 17 nt, Chlamydophila pneumoniae CWL029
agcauccuguagagcaa

SEQ ID NO: 2515256 - RNA, 21 nt, Chlamydophila pneumoniae CWL029
agcauccuguagagcaagauu

SEQ ID NO: 2515257 - RNA, 18 nt, Chlamydophila pneumoniae CWL029
agcaucgcuuaacaaacu

SEQ ID NO: 2515258 - RNA, 19 nt, Chlamydophila pneumoniae CWL029
agcaucgcuuaacaaacuu

SEQ ID NO: 2515259 - RNA, 15 nt, Chlamydophila pneumoniae CWL029
agcaucguauuuucc

SEQ ID NO: 2515260 - RNA, 21 nt, Chlamydophila pneumoniae CWL029
agcaucugagucauaagcucu

SEQ ID NO: 2515261 - RNA, 17 nt, Chlamydophila pneumoniae CWL029
agcaucuuucaucaaug

SEQ ID NO: 2515262 - RNA, 13 nt, Chlamydophila pneumoniae CWL029
agcaugaagcaga

SEQ ID NO: 2515263 - RNA, 16 nt, Chlamydophila pneumoniae CWL029
agcaugcuaagcauca

SEQ ID NO: 2515264 - RNA, 17 nt, Chlamydophila pneumoniae CWL029
agcaugcuaagcaucag

SEQ ID NO: 2515265 - RNA, 21 nt, Chlamydophila pneumoniae CWL029
agcaugcuaagcaucagaauc

SEQ ID NO: 2515266 - RNA, 15 nt, Chlamydophila pneumoniae CWL029
agcauggagaauaau

SEQ ID NO: 2515267 - RNA, 20 nt, Chlamydophila pneumoniae CWL029
agcauggagaauaaucucuu

SEQ ID NO: 2515268 - RNA, 14 nt, Chlamydophila pneumoniae CWL029
agcaugugcagaag

SEQ ID NO: 2515269 - RNA, 18 nt, Chlamydophila pneumoniae CWL029
agcauguucgauuuucuc

SEQ ID NO: 2515270 - RNA, 13 nt, Chlamydophila pneumoniae CWL029
agcauuaggaaag

SEQ ID NO: 2515271 - RNA, 15 nt, Chlamydophila pneumoniae CWL029
agcauuagggaaagg

SEQ ID NO: 2515272 - RNA, 23 nt, Chlamydophila pneumoniae CWL029
agcauucccgacucaaucaaauu

SEQ ID NO: 2515273 - RNA, 16 nt, Chlamydophila pneumoniae CWL029
agcauucugcuagagc

SEQ ID NO: 2515274 - RNA, 17 nt, Chlamydophila pneumoniae CWL029
agcauucugcuagagcu

SEQ ID NO: 2515275 - RNA, 18 nt, Chlamydophila pneumoniae CWL029
agcauucugcuagagcuu

SEQ ID NO: 2515276 - RNA, 16 nt, Chlamydophila pneumoniae CWL029
agcauuguuuguccua

SEQ ID NO: 2515277 - RNA, 21 nt, Chlamydophila pneumoniae CWL029
agcauuuccaaacccauauuc

SEQ ID NO: 2515278 - RNA, 11 nt, Chlamydophila pneumoniae CWL029
agcauuucucu

SEQ ID NO: 2515279 - RNA, 16 nt, Chlamydophila pneumoniae CWL029
agcauuucuuucucuu

SEQ ID NO: 2515280 - RNA, 22 nt, Chlamydophila pneumoniae CWL029
agcauuuuacgaaucuuuuuca

SEQ ID NO: 2515281 - RNA, 23 nt, Chlamydophila pneumoniae CWL029
agcauuuuacgaaucuuuuucau

SEQ ID NO: 2515282 - RNA, 21 nt, Chlamydophila pneumoniae CWL029
agcauuuucucugagcagcuu

SEQ ID NO: 2515283 - RNA, 19 nt, Chlamydophila pneumoniae CWL029
agccaaauaccaaggcugc

SEQ ID NO: 2515284 - RNA, 23 nt, Chlamydophila pneumoniae CWL029
agccaagaaaacauaaaguuaua

SEQ ID NO: 2515285 - RNA, 21 nt, Chlamydophila pneumoniae CWL029
agccaagaagauguagagucg

SEQ ID NO: 2515286 - RNA, 17 nt, Chlamydophila pneumoniae CWL029
agccacagagaauugca

SEQ ID NO: 2515287 - RNA, 18 nt, Chlamydophila pneumoniae CWL029
agccacauucuucugaua

SEQ ID NO: 2515288 - RNA, 17 nt, Chlamydophila pneumoniae CWL029
agccacccccacuucuu

SEQ ID NO: 2515289 - RNA, 20 nt, Chlamydophila pneumoniae CWL029
agccacccccacuucuuuuu

SEQ ID NO: 2515290 - RNA, 14 nt, Chlamydophila pneumoniae CWL029
agccaccuuggcuu

SEQ ID NO: 2515291 - RNA, 21 nt, Chlamydophila pneumoniae CWL029
agccaccuuggcuucuaucuu

SEQ ID NO: 2515292 - RNA, 15 nt, Chlamydophila pneumoniae CWL029
agccacuaaguuuag

SEQ ID NO: 2515293 - RNA, 22 nt, Chlamydophila pneumoniae CWL029
agccagacuggucuaacuuaga

SEQ ID NO: 2515294 - RNA, 17 nt, Chlamydophila pneumoniae CWL029
agccagcagaaggcugc

SEQ ID NO: 2515295 - RNA, 14 nt, Chlamydophila pneumoniae CWL029
acuccaggguguuu

SEQ ID NO: 2515296 - RNA, 15 nt, Chlamydophila pneumoniae CWL029
acucccaaggaaauu

SEQ ID NO: 2515297 - RNA, 14 nt, Chlamydophila pneumoniae CWL029
acucccguuuuguu

SEQ ID NO: 2515298 - RNA, 15 nt, Chlamydophila pneumoniae CWL029
acucccguuuuguug

SEQ ID NO: 2515299 - RNA, 15 nt, Chlamydophila pneumoniae CWL029
acucccucaaaauuu

SEQ ID NO: 2515300 - RNA, 16 nt, Chlamydophila pneumoniae CWL029
acuccgagcauuuuac

SEQ ID NO: 2515301 - RNA, 22 nt, Chlamydophila pneumoniae CWL029
acuccuaagucguuaacaucaa

SEQ ID NO: 2515302 - RNA, 21 nt, Chlamydophila pneumoniae CWL029
acuccuuaaacuuuacaaucu

SEQ ID NO: 2515303 - RNA, 21 nt, Chlamydophila pneumoniae CWL029
acuccuuugagucuuuuucag

SEQ ID NO: 2515304 - RNA, 13 nt, Chlamydophila pneumoniae CWL029
acuccuuuuaaaa

SEQ ID NO: 2515305 - RNA, 18 nt, Chlamydophila pneumoniae CWL029
acucgaauuguguguuuu

SEQ ID NO: 2515306 - RNA, 18 nt, Chlamydophila pneumoniae CWL029
acucgauuauuucuuguu

SEQ ID NO: 2515307 - RNA, 19 nt, Chlamydophila pneumoniae CWL029
acucgccauaauagucucu

SEQ ID NO: 2515308 - RNA, 20 nt, Chlamydophila pneumoniae CWL029
acucgccauaauagucucug

SEQ ID NO: 2515309 - RNA, 17 nt, Chlamydophila pneumoniae CWL029
acucgccgaaaguaucu

SEQ ID NO: 2515310 - RNA, 16 nt, Chlamydophila pneumoniae CWL029
acucggugggccucuu

SEQ ID NO: 2515311 - RNA, 18 nt, Chlamydophila pneumoniae CWL029
acucuaaucugauucaau

SEQ ID NO: 2515312 - RNA, 19 nt, Chlamydophila pneumoniae CWL029
acucuacaguaguaaauaa

SEQ ID NO: 2515313 - RNA, 22 nt, Chlamydophila pneumoniae CWL029
acucuacaguaguaaauaauaa

SEQ ID NO: 2515314 - RNA, 15 nt, Chlamydophila pneumoniae CWL029
acucuacaucuucuu

SEQ ID NO: 2515315 - RNA, 16 nt, Chlamydophila pneumoniae CWL029
acucuagggucaagaa

SEQ ID NO: 2515316 - RNA, 15 nt, Chlamydophila pneumoniae CWL029
acucuagguuuucuc

SEQ ID NO: 2515317 - RNA, 21 nt, Chlamydophila pneumoniae CWL029
acucuaguuuuucuuuagaga

SEQ ID NO: 2515318 - RNA, 22 nt, Chlamydophila pneumoniae CWL029
acucuaugaucuacagauaggg

SEQ ID NO: 2515319 - RNA, 16 nt, Chlamydophila pneumoniae CWL029
acucucaucagcaaaa

SEQ ID NO: 2515320 - RNA, 18 nt, Chlamydophila pneumoniae CWL029
acucuccauccucagucu

SEQ ID NO: 2515321 - RNA, 23 nt, Chlamydophila pneumoniae CWL029
acucucccauguaguaaauuccu

SEQ ID NO: 2515322 - RNA, 16 nt, Chlamydophila pneumoniae CWL029
acucucuuccaaaagu

SEQ ID NO: 2515323 - RNA, 15 nt, Chlamydophila pneumoniae CWL029
acucucuuccuucuc

SEQ ID NO: 2515324 - RNA, 22 nt, Chlamydophila pneumoniae CWL029
acucugcccgucuuagaaucca

SEQ ID NO: 2515325 - RNA, 22 nt, Chlamydophila pneumoniae CWL029
acucuguaauauucaacauguu

SEQ ID NO: 2515326 - RNA, 23 nt, Chlamydophila pneumoniae CWL029
acucuguuuccuugugucuuaaa

SEQ ID NO: 2515327 - RNA, 21 nt, Chlamydophila pneumoniae CWL029
acucuuccaauuguaaaucau

SEQ ID NO: 2515328 - RNA, 22 nt, Chlamydophila pneumoniae CWL029
acucuuccaauuguaaaucauu

SEQ ID NO: 2515329 - RNA, 23 nt, Chlamydophila pneumoniae CWL029
acucuuccaauuguaaaucauug

SEQ ID NO: 2515330 - RNA, 23 nt, Chlamydophila pneumoniae CWL029
acucuuccacaauguuuagaauu

SEQ ID NO: 2515331 - RNA, 22 nt, Chlamydophila pneumoniae CWL029
acucuuguugucuauggaagcg

SEQ ID NO: 2515332 - RNA, 14 nt, Chlamydophila pneumoniae CWL029
acucuuuaaaaaua

SEQ ID NO: 2515333 - RNA, 23 nt, Chlamydophila pneumoniae CWL029
acucuuuaaaagggcgcuucccu

SEQ ID NO: 2515334 - RNA, 19 nt, Chlamydophila pneumoniae CWL029
acucuuuuaagacaauaua

SEQ ID NO: 2515335 - RNA, 16 nt, Chlamydophila pneumoniae CWL029
acucuuuucuagaaac

SEQ ID NO: 2515336 - RNA, 23 nt, Chlamydophila pneumoniae CWL029
acucuuuucuagaaacugcuccu

SEQ ID NO: 2515337 - RNA, 16 nt, Chlamydophila pneumoniae CWL029
acugaaaaaccauaag

SEQ ID NO: 2515338 - RNA, 12 nt, Chlamydophila pneumoniae CWL029
acugaaagaugu

SEQ ID NO: 2515339 - RNA, 18 nt, Chlamydophila pneumoniae CWL029
acugaacgccaucuccac

SEQ ID NO: 2515340 - RNA, 14 nt, Chlamydophila pneumoniae CWL029
acugaagagcaauu

SEQ ID NO: 2515341 - RNA, 13 nt, Chlamydophila pneumoniae CWL029
acugaccugauac

SEQ ID NO: 2515342 - RNA, 19 nt, Chlamydophila pneumoniae CWL029
acugagcuucuaucuugaa

SEQ ID NO: 2515343 - RNA, 14 nt, Chlamydophila pneumoniae CWL029
acugaggcaaagau

SEQ ID NO: 2515344 - RNA, 13 nt, Chlamydophila pneumoniae CWL029
acugaugaaaaag

SEQ ID NO: 2515345 - RNA, 22 nt, Chlamydophila pneumoniae CWL029
acugaugaaaaagcugacacuc

SEQ ID NO: 2515346 - RNA, 22 nt, Chlamydophila pneumoniae CWL029
acugaugccaagaaauauacug

SEQ ID NO: 2515347 - RNA, 15 nt, Chlamydophila pneumoniae CWL029
acugcagagaaauuc

SEQ ID NO: 2515348 - RNA, 13 nt, Chlamydophila pneumoniae CWL029
acugcagauugca

SEQ ID NO: 2515349 - RNA, 16 nt, Chlamydophila pneumoniae CWL029
acugcauaaucucacc

SEQ ID NO: 2515350 - RNA, 17 nt, Chlamydophila pneumoniae CWL029
acugcugacaucuccaa

SEQ ID NO: 2515351 - RNA, 19 nt, Chlamydophila pneumoniae CWL029
acugcuuacaauugaaaau

SEQ ID NO: 2515352 - RNA, 17 nt, Chlamydophila pneumoniae CWL029
acugcuuuaggcccaag

SEQ ID NO: 2515353 - RNA, 13 nt, Chlamydophila pneumoniae CWL029
acuggaaugacau

SEQ ID NO: 2515354 - RNA, 15 nt, Chlamydophila pneumoniae CWL029
acuggagagguaacc

SEQ ID NO: 2515355 - RNA, 22 nt, Chlamydophila pneumoniae CWL029
acuggagagguaaccagagagc

SEQ ID NO: 2515356 - RNA, 17 nt, Chlamydophila pneumoniae CWL029
acuggcgacuugccaau

SEQ ID NO: 2515357 - RNA, 20 nt, Chlamydophila pneumoniae CWL029
acugggaaaucuaaacagua

SEQ ID NO: 2515358 - RNA, 22 nt, Chlamydophila pneumoniae CWL029
acuguaaauuucauuugaaaua

SEQ ID NO: 2515359 - RNA, 15 nt, Chlamydophila pneumoniae CWL029
acuguauagaaacug

SEQ ID NO: 2515360 - RNA, 21 nt, Chlamydophila pneumoniae CWL029
acugucauguauccgaaaucu

SEQ ID NO: 2515361 - RNA, 14 nt, Chlamydophila pneumoniae CWL029
acuguccauccaaa

SEQ ID NO: 2515362 - RNA, 19 nt, Chlamydophila pneumoniae CWL029
acuguccauccaaauagag

SEQ ID NO: 2515363 - RNA, 13 nt, Chlamydophila pneumoniae CWL029
acugugauuuucu

SEQ ID NO: 2515364 - RNA, 17 nt, Chlamydophila pneumoniae CWL029
acuguguucaauagcaa

SEQ ID NO: 2515365 - RNA, 18 nt, Chlamydophila pneumoniae CWL029
acuguguucaauagcaaa

SEQ ID NO: 2515366 - RNA, 18 nt, Chlamydophila pneumoniae CWL029
acuguuaacaagauucuc

SEQ ID NO: 2515367 - RNA, 18 nt, Chlamydophila pneumoniae CWL029
acuguucgauaagaacuu

SEQ ID NO: 2515368 - RNA, 17 nt, Chlamydophila pneumoniae CWL029
acuguugauccuucuua

SEQ ID NO: 2515369 - RNA, 18 nt, Chlamydophila pneumoniae CWL029
acuguugauccuucuuau

SEQ ID NO: 2515370 - RNA, 23 nt, Chlamydophila pneumoniae CWL029
acuguugauccuucuuaugguca

SEQ ID NO: 2515371 - RNA, 18 nt, Chlamydophila pneumoniae CWL029
acuguugcauuagauacg

SEQ ID NO: 2515372 - RNA, 19 nt, Chlamydophila pneumoniae CWL029
acuguuuguuuauuaucua

SEQ ID NO: 2515373 - RNA, 22 nt, Chlamydophila pneumoniae CWL029
acuguuuguuuauuaucuacag

SEQ ID NO: 2515374 - RNA, 19 nt, Chlamydophila pneumoniae CWL029
acuguuuuuuaucuccuga

SEQ ID NO: 2515375 - RNA, 13 nt, Chlamydophila pneumoniae CWL029
acuuaaaaaacuu

SEQ ID NO: 2515376 - RNA, 19 nt, Chlamydophila pneumoniae CWL029
acuuaaagcuugagaaaag

SEQ ID NO: 2515377 - RNA, 13 nt, Chlamydophila pneumoniae CWL029
acuuaagauacuu

SEQ ID NO: 2515378 - RNA, 22 nt, Chlamydophila pneumoniae CWL029
acuuaagauacuucuccacagc

SEQ ID NO: 2515379 - RNA, 18 nt, Chlamydophila pneumoniae CWL029
acuuaauaauguuuuaau

SEQ ID NO: 2515380 - RNA, 18 nt, Chlamydophila pneumoniae CWL029
acuuaauccuguagggaa

SEQ ID NO: 2515381 - RNA, 23 nt, Chlamydophila pneumoniae CWL029
acuuacagccaccuuggcuucua

SEQ ID NO: 2515382 - RNA, 14 nt, Chlamydophila pneumoniae CWL029
acuuacgaaucuua

SEQ ID NO: 2515383 - RNA, 22 nt, Chlamydophila pneumoniae CWL029
acuuacuaaaggugaaaguaca

SEQ ID NO: 2515384 - RNA, 15 nt, Chlamydophila pneumoniae CWL029
acuuagagucuucga

SEQ ID NO: 2515385 - RNA, 16 nt, Chlamydophila pneumoniae CWL029
acuuagaucuuuucua

SEQ ID NO: 2515386 - RNA, 13 nt, Chlamydophila pneumoniae CWL029
acuuagcaaugaa

SEQ ID NO: 2515387 - RNA, 16 nt, Chlamydophila pneumoniae CWL029
acuuaggaauuuuucu

SEQ ID NO: 2515388 - RNA, 17 nt, Chlamydophila pneumoniae CWL029
acuuaggaauuuuucua

SEQ ID NO: 2515389 - RNA, 14 nt, Chlamydophila pneumoniae CWL029
acuuaguuuugaaa

SEQ ID NO: 2515390 - RNA, 15 nt, Chlamydophila pneumoniae CWL029
acuuaguuuugaaaa

SEQ ID NO: 2515391 - RNA, 15 nt, Chlamydophila pneumoniae CWL029
acuuauauuggcuuu

SEQ ID NO: 2515392 - RNA, 14 nt, Chlamydophila pneumoniae CWL029
acuuauauuuucua

SEQ ID NO: 2515393 - RNA, 16 nt, Chlamydophila pneumoniae CWL029
acuuaucuuuaaauuc

SEQ ID NO: 2515394 - RNA, 22 nt, Chlamydophila pneumoniae CWL029
acuuauguacugagguagcaua

SEQ ID NO: 2515395 - RNA, 22 nt, Chlamydophila pneumoniae CWL029
acuuauguucuaugagauagga

SEQ ID NO: 2515396 - RNA, 23 nt, Chlamydophila pneumoniae CWL029
acuuauuguucuugguguauagu

SEQ ID NO: 2515397 - RNA, 16 nt, Chlamydophila pneumoniae CWL029
acuucaaaugaaauuc

SEQ ID NO: 2515398 - RNA, 17 nt, Chlamydophila pneumoniae CWL029
acuucaaaugaaauucu

SEQ ID NO: 2515399 - RNA, 16 nt, Chlamydophila pneumoniae CWL029
acuucaacuucuccaa

SEQ ID NO: 2515400 - RNA, 18 nt, Chlamydophila pneumoniae CWL029
acuucaacuucuccaacu

SEQ ID NO: 2515401 - RNA, 19 nt, Chlamydophila pneumoniae CWL029
acuucaaugaaagcuguau

SEQ ID NO: 2515402 - RNA, 16 nt, Chlamydophila pneumoniae CWL029
acuucacaaagaacca

SEQ ID NO: 2515403 - RNA, 23 nt, Chlamydophila pneumoniae CWL029
acuucaccuugaaguuuuuucuc

SEQ ID NO: 2515404 - RNA, 16 nt, Chlamydophila pneumoniae CWL029
acuucacguugcaaug

SEQ ID NO: 2515405 - RNA, 19 nt, Chlamydophila pneumoniae CWL029
acuucaggaaauaauuugu

SEQ ID NO: 2515406 - RNA, 23 nt, Chlamydophila pneumoniae CWL029
acuucaggaaauaauuuguuuag

SEQ ID NO: 2515407 - RNA, 17 nt, Chlamydophila pneumoniae CWL029
acuucaguuguugcuuu

SEQ ID NO: 2515408 - RNA, 17 nt, Chlamydophila pneumoniae CWL029
acuucaucgacaguauu

SEQ ID NO: 2515409 - RNA, 21 nt, Chlamydophila pneumoniae CWL029
acuuccaaaacgauccuguuc

SEQ ID NO: 2515410 - RNA, 17 nt, Chlamydophila pneumoniae CWL029
acuucccaucuuguucu

SEQ ID NO: 2515411 - RNA, 17 nt, Chlamydophila pneumoniae CWL029
acuuccccaaacaugga

SEQ ID NO: 2515412 - RNA, 15 nt, Chlamydophila pneumoniae CWL029
acuucccucaugaag

SEQ ID NO: 2515413 - RNA, 22 nt, Chlamydophila pneumoniae CWL029
acuuccuacgacaugccuaaau

SEQ ID NO: 2515414 - RNA, 20 nt, Chlamydophila pneumoniae CWL029
acuuccuacggcaagaaucg

SEQ ID NO: 2515415 - RNA, 19 nt, Chlamydophila pneumoniae CWL029
acuuccuccaauaaucacu

SEQ ID NO: 2515416 - RNA, 16 nt, Chlamydophila pneumoniae CWL029
acuucgacacgaacuu

SEQ ID NO: 2515417 - RNA, 14 nt, Chlamydophila pneumoniae CWL029
acuucgaugucuuu

SEQ ID NO: 2515418 - RNA, 16 nt, Chlamydophila pneumoniae CWL029
acuucgaugucuuucc

SEQ ID NO: 2515419 - RNA, 21 nt, Chlamydophila pneumoniae CWL029
acuucgaugucuuuccaggca

SEQ ID NO: 2515420 - RNA, 22 nt, Chlamydophila pneumoniae CWL029
acuucguuucgcuuugauaaua

SEQ ID NO: 2515421 - RNA, 18 nt, Chlamydophila pneumoniae CWL029
acuucuaugauaucacca

SEQ ID NO: 2515422 - RNA, 19 nt, Chlamydophila pneumoniae CWL029
acuucuaugauaucaccag

SEQ ID NO: 2515423 - RNA, 12 nt, Chlamydophila pneumoniae CWL029
acuucucaaaga

SEQ ID NO: 2515424 - RNA, 21 nt, Chlamydophila pneumoniae CWL029
acuucucagcaucucgaacaa

SEQ ID NO: 2515425 - RNA, 17 nt, Chlamydophila pneumoniae CWL029
acuucugcuaguccugu

SEQ ID NO: 2515426 - RNA, 11 nt, Chlamydophila pneumoniae CWL029
acuucugguuu

SEQ ID NO: 2515427 - RNA, 21 nt, Chlamydophila pneumoniae CWL029
acuucuguaguuuguucacuu

SEQ ID NO: 2515428 - RNA, 19 nt, Chlamydophila pneumoniae CWL029
acuucuucguuagagaaga

SEQ ID NO: 2515429 - RNA, 22 nt, Chlamydophila pneumoniae CWL029
acuucuucguuagagaagaggu

SEQ ID NO: 2515430 - RNA, 17 nt, Chlamydophila pneumoniae CWL029
acuucuucucgguuuaa

SEQ ID NO: 2515431 - RNA, 13 nt, Chlamydophila pneumoniae CWL029
acuucuucuuuuc

SEQ ID NO: 2515432 - RNA, 21 nt, Chlamydophila pneumoniae CWL029
acuucuugugauccuugcaaa

SEQ ID NO: 2515433 - RNA, 23 nt, Chlamydophila pneumoniae CWL029
acuucuuuaggagcauagacucu

SEQ ID NO: 2515434 - RNA, 22 nt, Chlamydophila pneumoniae CWL029
acuucuuugccguauagauuuu

SEQ ID NO: 2515435 - RNA, 12 nt, Chlamydophila pneumoniae CWL029
acuucuuuuucu

SEQ ID NO: 2515436 - RNA, 17 nt, Chlamydophila pneumoniae CWL029
acuugcauuuuuuggaa

SEQ ID NO: 2515437 - RNA, 15 nt, Chlamydophila pneumoniae CWL029
acuugcccaaaaguu

SEQ ID NO: 2515438 - RNA, 17 nt, Chlamydophila pneumoniae CWL029
acuugcgauacaauaaa

SEQ ID NO: 2515439 - RNA, 16 nt, Chlamydophila pneumoniae CWL029
acuugcucugaagcuc

SEQ ID NO: 2515440 - RNA, 15 nt, Chlamydophila pneumoniae CWL029
acuugcucuuuaaua

SEQ ID NO: 2515441 - RNA, 13 nt, Chlamydophila pneumoniae CWL029
acuugcucuuuag

SEQ ID NO: 2515442 - RNA, 14 nt, Chlamydophila pneumoniae CWL029
acuugcuuauccaa

SEQ ID NO: 2515443 - RNA, 21 nt, Chlamydophila pneumoniae CWL029
acuugcuuuuuugaaagcugg

SEQ ID NO: 2515444 - RNA, 14 nt, Chlamydophila pneumoniae CWL029
acuugggagaugcu

SEQ ID NO: 2515445 - RNA, 16 nt, Chlamydophila pneumoniae CWL029
acuuggucauuauagu

SEQ ID NO: 2515446 - RNA, 23 nt, Chlamydophila pneumoniae CWL029
acuuguaccguaaagaaaagcaa

SEQ ID NO: 2515447 - RNA, 12 nt, Chlamydophila pneumoniae CWL029
acuuguuucucc

SEQ ID NO: 2515448 - RNA, 16 nt, Chlamydophila pneumoniae CWL029
acuuguuucuccuauu

SEQ ID NO: 2515449 - RNA, 21 nt, Chlamydophila pneumoniae CWL029
acuuuaaucaagccuaaaucu

SEQ ID NO: 2515450 - RNA, 22 nt, Chlamydophila pneumoniae CWL029
acuuuaaucaagccuaaaucua

SEQ ID NO: 2515451 - RNA, 20 nt, Chlamydophila pneumoniae CWL029
acuuuacacuauaagacauu

SEQ ID NO: 2515452 - RNA, 23 nt, Chlamydophila pneumoniae CWL029
acuuuacuucggaugagauccaa

SEQ ID NO: 2515453 - RNA, 22 nt, Chlamydophila pneumoniae CWL029
acuuuagaaauuccaauuuuug

SEQ ID NO: 2515454 - RNA, 22 nt, Chlamydophila pneumoniae CWL029
acuuuaggcccugacuuagagu

SEQ ID NO: 2515455 - RNA, 16 nt, Chlamydophila pneumoniae CWL029
acuuuagggaagaaau

SEQ ID NO: 2515456 - RNA, 18 nt, Chlamydophila pneumoniae CWL029
acuuuagggaagaaauua

SEQ ID NO: 2515457 - RNA, 23 nt, Chlamydophila pneumoniae CWL029
acuuuagggaagaaauuaacaac

SEQ ID NO: 2515458 - RNA, 15 nt, Chlamydophila pneumoniae CWL029
acuuuauagaaagua

SEQ ID NO: 2515459 - RNA, 12 nt, Chlamydophila pneumoniae CWL029
acuuuauucucu

SEQ ID NO: 2515460 - RNA, 18 nt, Chlamydophila pneumoniae CWL029
acuuucccuucuaaggaa

SEQ ID NO: 2515461 - RNA, 12 nt, Chlamydophila pneumoniae CWL029
acuuuccucucu

SEQ ID NO: 2515462 - RNA, 15 nt, Chlamydophila pneumoniae CWL029
acuuuccucucuuua

SEQ ID NO: 2515463 - RNA, 22 nt, Chlamydophila pneumoniae CWL029
acuuucugagccccuugcaaaa

SEQ ID NO: 2515464 - RNA, 23 nt, Chlamydophila pneumoniae CWL029
acuuucugagccccuugcaaaag

SEQ ID NO: 2515465 - RNA, 16 nt, Chlamydophila pneumoniae CWL029
acuuucugauugagaa

SEQ ID NO: 2515466 - RNA, 18 nt, Chlamydophila pneumoniae CWL029
acuuucugauugagaaua

SEQ ID NO: 2515467 - RNA, 20 nt, Chlamydophila pneumoniae CWL029
acuuucugauugagaauaaa

SEQ ID NO: 2515468 - RNA, 12 nt, Chlamydophila pneumoniae CWL029
acuuucuucucu

SEQ ID NO: 2515469 - RNA, 22 nt, Chlamydophila pneumoniae CWL029
acuuucuucucuaggaagauuu

SEQ ID NO: 2515470 - RNA, 13 nt, Chlamydophila pneumoniae CWL029
acuuucuuuaaag

SEQ ID NO: 2515471 - RNA, 16 nt, Chlamydophila pneumoniae CWL029
acuuugaccagaugau

SEQ ID NO: 2515472 - RNA, 22 nt, Chlamydophila pneumoniae CWL029
acuuugaggcaagucucaaagg

SEQ ID NO: 2515473 - RNA, 18 nt, Chlamydophila pneumoniae CWL029
acuuugauuguauagcuu

SEQ ID NO: 2515474 - RNA, 17 nt, Chlamydophila pneumoniae CWL029
acuuugcaauacaccaa

SEQ ID NO: 2515475 - RNA, 16 nt, Chlamydophila pneumoniae CWL029
acuuugccaacagcug

SEQ ID NO: 2515476 - RNA, 15 nt, Chlamydophila pneumoniae CWL029
acuuugccauuucua

SEQ ID NO: 2515477 - RNA, 15 nt, Chlamydophila pneumoniae CWL029
acuuugugauuacag

SEQ ID NO: 2515478 - RNA, 22 nt, Chlamydophila pneumoniae CWL029
acuuuguuaauagaagaucauu

SEQ ID NO: 2515479 - RNA, 15 nt, Chlamydophila pneumoniae CWL029
acuuuuacugaaauu

SEQ ID NO: 2515480 - RNA, 20 nt, Chlamydophila pneumoniae CWL029
acuuuucucuuuaauccagu

SEQ ID NO: 2515481 - RNA, 18 nt, Chlamydophila pneumoniae CWL029
acuuuugaauuaaaaguu

SEQ ID NO: 2515482 - RNA, 18 nt, Chlamydophila pneumoniae CWL029
acuuuuguugcaauucca

SEQ ID NO: 2515483 - RNA, 20 nt, Chlamydophila pneumoniae CWL029
acuuuuugccacaacucauc

SEQ ID NO: 2515484 - RNA, 13 nt, Chlamydophila pneumoniae CWL029
acuuuuuucccuc

SEQ ID NO: 2515485 - RNA, 21 nt, Chlamydophila pneumoniae CWL029
acuuuuuucccuccaccagaa

SEQ ID NO: 2515486 - RNA, 14 nt, Chlamydophila pneumoniae CWL029
acuuuuuuguuaau

SEQ ID NO: 2515487 - RNA, 14 nt, Chlamydophila pneumoniae CWL029
acuuuuuuucaaau

SEQ ID NO: 2515488 - RNA, 16 nt, Chlamydophila pneumoniae CWL029
acuuuuuuucuucucu

SEQ ID NO: 2515489 - RNA, 22 nt, Chlamydophila pneumoniae CWL029
acuuuuuuucuucucuaagaaa

SEQ ID NO: 2515490 - RNA, 19 nt, Chlamydophila pneumoniae CWL029
agaaaaaccccuagaacuu

SEQ ID NO: 2515491 - RNA, 14 nt, Chlamydophila pneumoniae CWL029
agccaguacuaaau

SEQ ID NO: 2515492 - RNA, 23 nt, Chlamydophila pneumoniae CWL029
agccaguacuaaauuaguaaaug

SEQ ID NO: 2515493 - RNA, 21 nt, Chlamydophila pneumoniae CWL029
agccauaauuagaacagcaug

SEQ ID NO: 2515494 - RNA, 23 nt, Chlamydophila pneumoniae CWL029
agccaucgguucggucucuucuc

SEQ ID NO: 2515495 - RNA, 16 nt, Chlamydophila pneumoniae CWL029
agccaugacaaagggu

SEQ ID NO: 2515496 - RNA, 15 nt, Chlamydophila pneumoniae CWL029
agccauuuuccagga

SEQ ID NO: 2515497 - RNA, 12 nt, Chlamydophila pneumoniae CWL029
agccauuuucua

SEQ ID NO: 2515498 - RNA, 15 nt, Chlamydophila pneumoniae CWL029
agccauuuucuaaga

SEQ ID NO: 2515499 - RNA, 20 nt, Chlamydophila pneumoniae CWL029
agccauuuucuaagagaucu

SEQ ID NO: 2515500 - RNA, 13 nt, Chlamydophila pneumoniae CWL029
agcccauuccugc

SEQ ID NO: 2515501 - RNA, 13 nt, Chlamydophila pneumoniae CWL029
agccccagcaacc

SEQ ID NO: 2515502 - RNA, 23 nt, Chlamydophila pneumoniae CWL029
agcccuagaguaaagaguagccc

SEQ ID NO: 2515503 - RNA, 14 nt, Chlamydophila pneumoniae CWL029
agcccuagauagca

SEQ ID NO: 2515504 - RNA, 17 nt, Chlamydophila pneumoniae CWL029
agcccuagauagcaaau

SEQ ID NO: 2515505 - RNA, 18 nt, Chlamydophila pneumoniae CWL029
agcccuagauagcaaauc

SEQ ID NO: 2515506 - RNA, 13 nt, Chlamydophila pneumoniae CWL029
agcccuauagaaa

SEQ ID NO: 2515507 - RNA, 20 nt, Chlamydophila pneumoniae CWL029
agcccuccaguuuuacgaac

SEQ ID NO: 2515508 - RNA, 16 nt, Chlamydophila pneumoniae CWL029
agcccucgguuauuuu

SEQ ID NO: 2515509 - RNA, 21 nt, Chlamydophila pneumoniae CWL029
agcccuugguuuccuccuuuc

SEQ ID NO: 2515510 - RNA, 19 nt, Chlamydophila pneumoniae CWL029
agccgauacccaucuagaa

SEQ ID NO: 2515511 - RNA, 18 nt, Chlamydophila pneumoniae CWL029
agccgauguugcagaaug

SEQ ID NO: 2515512 - RNA, 13 nt, Chlamydophila pneumoniae CWL029
agccggagcuucu

SEQ ID NO: 2515513 - RNA, 20 nt, Chlamydophila pneumoniae CWL029
agccguaggguauccugcuc

SEQ ID NO: 2515514 - RNA, 22 nt, Chlamydophila pneumoniae CWL029
agccuagcaaaacuguguucaa

SEQ ID NO: 2515515 - RNA, 23 nt, Chlamydophila pneumoniae CWL029
agccuauaucgccguuaaagacu

SEQ ID NO: 2515516 - RNA, 16 nt, Chlamydophila pneumoniae CWL029
agccuaugauaaagcc

SEQ ID NO: 2515517 - RNA, 12 nt, Chlamydophila pneumoniae CWL029
agccucacagaa

SEQ ID NO: 2515518 - RNA, 22 nt, Chlamydophila pneumoniae CWL029
agccuccucaagauaaauccca

SEQ ID NO: 2515519 - RNA, 17 nt, Chlamydophila pneumoniae CWL029
agccucgaaauuuucag

SEQ ID NO: 2515520 - RNA, 21 nt, Chlamydophila pneumoniae CWL029
agccucgaaauuuucagaaga

SEQ ID NO: 2515521 - RNA, 23 nt, Chlamydophila pneumoniae CWL029
agccucgagcagaaacuccaaaa

SEQ ID NO: 2515522 - RNA, 21 nt, Chlamydophila pneumoniae CWL029
agccucgauuugaucuugcuc

SEQ ID NO: 2515523 - RNA, 16 nt, Chlamydophila pneumoniae CWL029
agccucuacccucuga

SEQ ID NO: 2515524 - RNA, 17 nt, Chlamydophila pneumoniae CWL029
agccugcaccagacccu

SEQ ID NO: 2515525 - RNA, 14 nt, Chlamydophila pneumoniae CWL029
agccuggaaagcuu

SEQ ID NO: 2515526 - RNA, 14 nt, Chlamydophila pneumoniae CWL029
agccuggaaaugaa

SEQ ID NO: 2515527 - RNA, 19 nt, Chlamydophila pneumoniae CWL029
agccugucuuaucuaaaga

SEQ ID NO: 2515528 - RNA, 13 nt, Chlamydophila pneumoniae CWL029
agccuucauucca

SEQ ID NO: 2515529 - RNA, 20 nt, Chlamydophila pneumoniae CWL029
agccuugcagcauccugaac

SEQ ID NO: 2515530 - RNA, 15 nt, Chlamydophila pneumoniae CWL029
agccuuggcucuaga

SEQ ID NO: 2515531 - RNA, 17 nt, Chlamydophila pneumoniae CWL029
agccuuggcucuagaaa

SEQ ID NO: 2515532 - RNA, 17 nt, Chlamydophila pneumoniae CWL029
agcgaaagcagcgaaga

SEQ ID NO: 2515533 - RNA, 12 nt, Chlamydophila pneumoniae CWL029
agcgaaugaaaa

SEQ ID NO: 2515534 - RNA, 22 nt, Chlamydophila pneumoniae CWL029
agcgagaacaccauaaaacaau

SEQ ID NO: 2515535 - RNA, 16 nt, Chlamydophila pneumoniae CWL029
agcgauagcuaaaccu

SEQ ID NO: 2515536 - RNA, 19 nt, Chlamydophila pneumoniae CWL029
agcgaucacauagaaaaca

SEQ ID NO: 2515537 - RNA, 20 nt, Chlamydophila pneumoniae CWL029
agcgaucgcaaucagcaaca

SEQ ID NO: 2515538 - RNA, 21 nt, Chlamydophila pneumoniae CWL029
agcgaucgcaaucagcaacau

SEQ ID NO: 2515539 - RNA, 19 nt, Chlamydophila pneumoniae CWL029
agcgaucucucuuccugcu

SEQ ID NO: 2515540 - RNA, 12 nt, Chlamydophila pneumoniae CWL029
agcgcaaaucuu

SEQ ID NO: 2515541 - RNA, 20 nt, Chlamydophila pneumoniae CWL029
agcgcucgugggaggaaucc

SEQ ID NO: 2515542 - RNA, 16 nt, Chlamydophila pneumoniae CWL029
agcgcuuuuuuaaagu

SEQ ID NO: 2515543 - RNA, 19 nt, Chlamydophila pneumoniae CWL029
agcggaacaacuuugaggc

SEQ ID NO: 2515544 - RNA, 17 nt, Chlamydophila pneumoniae CWL029
agcggacuuuagcgcua

SEQ ID NO: 2515545 - RNA, 17 nt, Chlamydophila pneumoniae CWL029
agcgggauaggcaagau

SEQ ID NO: 2515546 - RNA, 21 nt, Chlamydophila pneumoniae CWL029
agcguacuuuacacuauaaga

SEQ ID NO: 2515547 - RNA, 16 nt, Chlamydophila pneumoniae CWL029
agcguauuccccacug

SEQ ID NO: 2515548 - RNA, 23 nt, Chlamydophila pneumoniae CWL029
agcgucaauguuaaucuaauuuu

SEQ ID NO: 2515549 - RNA, 22 nt, Chlamydophila pneumoniae CWL029
agcgucuaucgacucuucgccc

SEQ ID NO: 2515550 - RNA, 15 nt, Chlamydophila pneumoniae CWL029
agcguguauccaucu

SEQ ID NO: 2515551 - RNA, 14 nt, Chlamydophila pneumoniae CWL029
agcguugcuaagca

SEQ ID NO: 2515552 - RNA, 20 nt, Chlamydophila pneumoniae CWL029
agcguuucgacgagaaggaa

SEQ ID NO: 2515553 - RNA, 18 nt, Chlamydophila pneumoniae CWL029
agcguuuuuugaaaauuu

SEQ ID NO: 2515554 - RNA, 14 nt, Chlamydophila pneumoniae CWL029
agcuaaagaaacuu

SEQ ID NO: 2515555 - RNA, 19 nt, Chlamydophila pneumoniae CWL029
agcuaaagaaacuucugac

SEQ ID NO: 2515556 - RNA, 12 nt, Chlamydophila pneumoniae CWL029
agcuaaaucaaa

SEQ ID NO: 2515557 - RNA, 20 nt, Chlamydophila pneumoniae CWL029
agcuaaauuguuaucaggaa

SEQ ID NO: 2515558 - RNA, 22 nt, Chlamydophila pneumoniae CWL029
agcuaaauuguuaucaggaacu

SEQ ID NO: 2515559 - RNA, 12 nt, Chlamydophila pneumoniae CWL029
agcuaagagcau

SEQ ID NO: 2515560 - RNA, 20 nt, Chlamydophila pneumoniae CWL029
agcuaagggaaauccacaga

SEQ ID NO: 2515561 - RNA, 17 nt, Chlamydophila pneumoniae CWL029
agcuaaguaacaguccu

SEQ ID NO: 2515562 - RNA, 19 nt, Chlamydophila pneumoniae CWL029
agcuaaguaacaguccucu

SEQ ID NO: 2515563 - RNA, 17 nt, Chlamydophila pneumoniae CWL029
agcuaauaagauccaaa

SEQ ID NO: 2515564 - RNA, 16 nt, Chlamydophila pneumoniae CWL029
agcuaaucaauccaag

SEQ ID NO: 2515565 - RNA, 18 nt, Chlamydophila pneumoniae CWL029
agcuaaucaauccaagaa

SEQ ID NO: 2515566 - RNA, 21 nt, Chlamydophila pneumoniae CWL029
agcuaauuuaaaugccuuaaa

SEQ ID NO: 2515567 - RNA, 15 nt, Chlamydophila pneumoniae CWL029
agcuacaaguccccc

SEQ ID NO: 2515568 - RNA, 19 nt, Chlamydophila pneumoniae CWL029
agcuacagaaagagcuaaa

SEQ ID NO: 2515569 - RNA, 20 nt, Chlamydophila pneumoniae CWL029
agcuaccuagggucuucucg

SEQ ID NO: 2515570 - RNA, 12 nt, Chlamydophila pneumoniae CWL029
agcuacuucuuc

SEQ ID NO: 2515571 - RNA, 13 nt, Chlamydophila pneumoniae CWL029
agcuagaaagucc

SEQ ID NO: 2515572 - RNA, 13 nt, Chlamydophila pneumoniae CWL029
agcuagaagagcg

SEQ ID NO: 2515573 - RNA, 20 nt, Chlamydophila pneumoniae CWL029
agcuagagcacauagaaaca

SEQ ID NO: 2515574 - RNA, 19 nt, Chlamydophila pneumoniae CWL029
agcuaggcgauaguaaaca

SEQ ID NO: 2515575 - RNA, 17 nt, Chlamydophila pneumoniae CWL029
agcuagucuucuuagaa

SEQ ID NO: 2515576 - RNA, 17 nt, Chlamydophila pneumoniae CWL029
agcuagucuuucuaaga

SEQ ID NO: 2515577 - RNA, 18 nt, Chlamydophila pneumoniae CWL029
agcuagucuuucuaagaa

SEQ ID NO: 2515578 - RNA, 20 nt, Chlamydophila pneumoniae CWL029
agcuauagauuuuggagaca

SEQ ID NO: 2515579 - RNA, 23 nt, Chlamydophila pneumoniae CWL029
agcuauauaggguugugucucug

SEQ ID NO: 2515580 - RNA, 22 nt, Chlamydophila pneumoniae CWL029
agcuaucuugagcaucacggag

SEQ ID NO: 2515581 - RNA, 20 nt, Chlamydophila pneumoniae CWL029
agcuauuuuacuuacuaaag

SEQ ID NO: 2515582 - RNA, 12 nt, Chlamydophila pneumoniae CWL029
agcuauuuuuga

SEQ ID NO: 2515583 - RNA, 23 nt, Chlamydophila pneumoniae CWL029
agcuauuuuugaggaacgcacgc

SEQ ID NO: 2515584 - RNA, 12 nt, Chlamydophila pneumoniae CWL029
agcucaaggcau

SEQ ID NO: 2515585 - RNA, 13 nt, Chlamydophila pneumoniae CWL029
agcucacaacccu

SEQ ID NO: 2515586 - RNA, 16 nt, Chlamydophila pneumoniae CWL029
agcucacaacccuuua

SEQ ID NO: 2515587 - RNA, 20 nt, Chlamydophila pneumoniae CWL029
agcucacgcaccauuccuua

SEQ ID NO: 2515588 - RNA, 18 nt, Chlamydophila pneumoniae CWL029
agcucaucggaucuuuuc

SEQ ID NO: 2515589 - RNA, 16 nt, Chlamydophila pneumoniae CWL029
agcucaucuagaaaga

SEQ ID NO: 2515590 - RNA, 17 nt, Chlamydophila pneumoniae CWL029
agcucaucuagaaagau

SEQ ID NO: 2515591 - RNA, 17 nt, Chlamydophila pneumoniae CWL029
agcucauuaucaagaaa

SEQ ID NO: 2515592 - RNA, 20 nt, Chlamydophila pneumoniae CWL029
agcucauuaucaagaaauuc

SEQ ID NO: 2515593 - RNA, 21 nt, Chlamydophila pneumoniae CWL029
agcucauuaucaagaaauucu

SEQ ID NO: 2515594 - RNA, 17 nt, Chlamydophila pneumoniae CWL029
agcuccauaagcuuuuc

SEQ ID NO: 2515595 - RNA, 18 nt, Chlamydophila pneumoniae CWL029
agcuccauuuaaauggau

SEQ ID NO: 2515596 - RNA, 21 nt, Chlamydophila pneumoniae CWL029
agcucccaacaagggaaagaa

SEQ ID NO: 2515597 - RNA, 14 nt, Chlamydophila pneumoniae CWL029
agcucccucuagag

SEQ ID NO: 2515598 - RNA, 16 nt, Chlamydophila pneumoniae CWL029
agcucccucuagagcu

SEQ ID NO: 2515599 - RNA, 17 nt, Chlamydophila pneumoniae CWL029
agcucccucuagagcuu

SEQ ID NO: 2515600 - RNA, 14 nt, Chlamydophila pneumoniae CWL029
agcuccgcuagagg

SEQ ID NO: 2515601 - RNA, 20 nt, Chlamydophila pneumoniae CWL029
agcuccguaauggagagcuu

SEQ ID NO: 2515602 - RNA, 14 nt, Chlamydophila pneumoniae CWL029
agcuccuuggcuau

SEQ ID NO: 2515603 - RNA, 15 nt, Chlamydophila pneumoniae CWL029
agcucgaccucuagc

SEQ ID NO: 2515604 - RNA, 16 nt, Chlamydophila pneumoniae CWL029
agcucgagaucuuuuu

SEQ ID NO: 2515605 - RNA, 22 nt, Chlamydophila pneumoniae CWL029
agcucggauggacuacugaaac

SEQ ID NO: 2515606 - RNA, 17 nt, Chlamydophila pneumoniae CWL029
agcucguaauccuucuu

SEQ ID NO: 2515607 - RNA, 23 nt, Chlamydophila pneumoniae CWL029
agcucuaaaaaagauaaagcuac

SEQ ID NO: 2515608 - RNA, 19 nt, Chlamydophila pneumoniae CWL029
agcucuaaguccaacauca

SEQ ID NO: 2515609 - RNA, 23 nt, Chlamydophila pneumoniae CWL029
agcucuaauucuucuacagaaua

SEQ ID NO: 2515610 - RNA, 20 nt, Chlamydophila pneumoniae CWL029
agcucuaggauaucauauuu

SEQ ID NO: 2515611 - RNA, 18 nt, Chlamydophila pneumoniae CWL029
agcucuagggguuucccu

SEQ ID NO: 2515612 - RNA, 15 nt, Chlamydophila pneumoniae CWL029
agcucuauuucugcc

SEQ ID NO: 2515613 - RNA, 15 nt, Chlamydophila pneumoniae CWL029
agcucucgacgaaca

SEQ ID NO: 2515614 - RNA, 18 nt, Chlamydophila pneumoniae CWL029
agcucucgacgaacaugc

SEQ ID NO: 2515615 - RNA, 22 nt, Chlamydophila pneumoniae CWL029
agcucucuugauugcuaucaaa

SEQ ID NO: 2515616 - RNA, 17 nt, Chlamydophila pneumoniae CWL029
agcucucuugcuauacc

SEQ ID NO: 2515617 - RNA, 18 nt, Chlamydophila pneumoniae CWL029
agcucuggauugaaagag

SEQ ID NO: 2515618 - RNA, 22 nt, Chlamydophila pneumoniae CWL029
agcucuucagcaagucgguaau

SEQ ID NO: 2515619 - RNA, 19 nt, Chlamydophila pneumoniae CWL029
agcucuuucauaagauugc

SEQ ID NO: 2515620 - RNA, 22 nt, Chlamydophila pneumoniae CWL029
agcucuuucauaagauugccau

SEQ ID NO: 2515621 - RNA, 14 nt, Chlamydophila pneumoniae CWL029
agcucuuucuugga

SEQ ID NO: 2515622 - RNA, 20 nt, Chlamydophila pneumoniae CWL029
agcucuuugggauaaaaagu

SEQ ID NO: 2515623 - RNA, 14 nt, Chlamydophila pneumoniae CWL029
agcugaauccaggu

SEQ ID NO: 2515624 - RNA, 19 nt, Chlamydophila pneumoniae CWL029
agcugacaacaaaugugac

SEQ ID NO: 2515625 - RNA, 17 nt, Chlamydophila pneumoniae CWL029
agcugagcuaucuucaa

SEQ ID NO: 2515626 - RNA, 15 nt, Chlamydophila pneumoniae CWL029
agcugaggcaucuau

SEQ ID NO: 2515627 - RNA, 15 nt, Chlamydophila pneumoniae CWL029
agcugcaaucucaaa

SEQ ID NO: 2515628 - RNA, 19 nt, Chlamydophila pneumoniae CWL029
agcugcaaucucaaaauca

SEQ ID NO: 2515629 - RNA, 18 nt, Chlamydophila pneumoniae CWL029
agcugccagugacauaau

SEQ ID NO: 2515630 - RNA, 22 nt, Chlamydophila pneumoniae CWL029
agcugccagugacauaaucaca

SEQ ID NO: 2515631 - RNA, 19 nt, Chlamydophila pneumoniae CWL029
agcugcucuuuuagaaugu

SEQ ID NO: 2515632 - RNA, 20 nt, Chlamydophila pneumoniae CWL029
agcugcugguccuaaaaaaa

SEQ ID NO: 2515633 - RNA, 15 nt, Chlamydophila pneumoniae CWL029
agcugcuucuucaga

SEQ ID NO: 2515634 - RNA, 16 nt, Chlamydophila pneumoniae CWL029
agcugcuuuuucuacu

SEQ ID NO: 2515635 - RNA, 16 nt, Chlamydophila pneumoniae CWL029
agcuguauugggaaug

SEQ ID NO: 2515636 - RNA, 14 nt, Chlamydophila pneumoniae CWL029
agcugucaauccaa

SEQ ID NO: 2515637 - RNA, 20 nt, Chlamydophila pneumoniae CWL029
agcugucaauccaacaaaga

SEQ ID NO: 2515638 - RNA, 20 nt, Chlamydophila pneumoniae CWL029
agcuguccagucuauagccu

SEQ ID NO: 2515639 - RNA, 18 nt, Chlamydophila pneumoniae CWL029
agcuguggcgauuuuacu

SEQ ID NO: 2515640 - RNA, 13 nt, Chlamydophila pneumoniae CWL029
agcuguuguucug

SEQ ID NO: 2515641 - RNA, 16 nt, Chlamydophila pneumoniae CWL029
agcuguuuacuuuucu

SEQ ID NO: 2515642 - RNA, 20 nt, Chlamydophila pneumoniae CWL029
agcuguuuacuuuucucuuu

SEQ ID NO: 2515643 - RNA, 14 nt, Chlamydophila pneumoniae CWL029
agcuuacuuagaac

SEQ ID NO: 2515644 - RNA, 21 nt, Chlamydophila pneumoniae CWL029
agcuuacuuagaacuauagga

SEQ ID NO: 2515645 - RNA, 18 nt, Chlamydophila pneumoniae CWL029
agcuuacuuucuuuuagc

SEQ ID NO: 2515646 - RNA, 17 nt, Chlamydophila pneumoniae CWL029
agcuucaaaaagcuccc

SEQ ID NO: 2515647 - RNA, 22 nt, Chlamydophila pneumoniae CWL029
agcuucaaaggcaaccucugca

SEQ ID NO: 2515648 - RNA, 14 nt, Chlamydophila pneumoniae CWL029
agcuucaaguuucu

SEQ ID NO: 2515649 - RNA, 15 nt, Chlamydophila pneumoniae CWL029
agcuucccaauugua

SEQ ID NO: 2515650 - RNA, 16 nt, Chlamydophila pneumoniae CWL029
agcuucccaauuguau

SEQ ID NO: 2515651 - RNA, 23 nt, Chlamydophila pneumoniae CWL029
agcuuccggcuuguaggaucuga

SEQ ID NO: 2515652 - RNA, 20 nt, Chlamydophila pneumoniae CWL029
agcuuccucacguucugcaa

SEQ ID NO: 2515653 - RNA, 23 nt, Chlamydophila pneumoniae CWL029
agcuuccucacguucugcaacaa

SEQ ID NO: 2515654 - RNA, 15 nt, Chlamydophila pneumoniae CWL029
agcuuccugcuccuc

SEQ ID NO: 2515655 - RNA, 17 nt, Chlamydophila pneumoniae CWL029
agcuuccugcuccucuu

SEQ ID NO: 2515656 - RNA, 23 nt, Chlamydophila pneumoniae CWL029
agcuuccugcuccucuucuuccc

SEQ ID NO: 2515657 - RNA, 20 nt, Chlamydophila pneumoniae CWL029
agcuucggggaagcguagca

SEQ ID NO: 2515658 - RNA, 15 nt, Chlamydophila pneumoniae CWL029
agcuucuacagcauc

SEQ ID NO: 2515659 - RNA, 16 nt, Chlamydophila pneumoniae CWL029
agcuucugaacuguuc

SEQ ID NO: 2515660 - RNA, 18 nt, Chlamydophila pneumoniae CWL029
agcuucuucaacgaggaa

SEQ ID NO: 2515661 - RNA, 22 nt, Chlamydophila pneumoniae CWL029
agcuucuuguuuuuguggacaa

SEQ ID NO: 2515662 - RNA, 19 nt, Chlamydophila pneumoniae CWL029
agcuucuuuaucuagcucu

SEQ ID NO: 2515663 - RNA, 20 nt, Chlamydophila pneumoniae CWL029
agcuucuuuaucuagcucuu

SEQ ID NO: 2515664 - RNA, 17 nt, Chlamydophila pneumoniae CWL029
agcuucuuucuaggccg

SEQ ID NO: 2515665 - RNA, 15 nt, Chlamydophila pneumoniae CWL029
agcuucuuucuuacu

SEQ ID NO: 2515666 - RNA, 17 nt, Chlamydophila pneumoniae CWL029
agcuucuuuuccagcaa

SEQ ID NO: 2515667 - RNA, 22 nt, Chlamydophila pneumoniae CWL029
agcuucuuuuccagcaaagcga

SEQ ID NO: 2515668 - RNA, 14 nt, Chlamydophila pneumoniae CWL029
agcuugcguuuccu

SEQ ID NO: 2515669 - RNA, 21 nt, Chlamydophila pneumoniae CWL029
agcuuggggguggucuagaga

SEQ ID NO: 2515670 - RNA, 20 nt, Chlamydophila pneumoniae CWL029
agcuugguuuucuccuucuc

SEQ ID NO: 2515671 - RNA, 17 nt, Chlamydophila pneumoniae CWL029
agcuuuaacaugccaaa

SEQ ID NO: 2515672 - RNA, 12 nt, Chlamydophila pneumoniae CWL029
agcuuuaaucag

SEQ ID NO: 2515673 - RNA, 16 nt, Chlamydophila pneumoniae CWL029
agcuuucagaaaagaa

SEQ ID NO: 2515674 - RNA, 17 nt, Chlamydophila pneumoniae CWL029
agcuuucguuuucuagc

SEQ ID NO: 2515675 - RNA, 23 nt, Chlamydophila pneumoniae CWL029
agcuuucguuuucuagcauagug

SEQ ID NO: 2515676 - RNA, 21 nt, Chlamydophila pneumoniae CWL029
agcuuucuuggagaagaggua

SEQ ID NO: 2515677 - RNA, 23 nt, Chlamydophila pneumoniae CWL029
agcuuugcuuaaaaagucugaau

SEQ ID NO: 2515678 - RNA, 22 nt, Chlamydophila pneumoniae CWL029
agcuuuggcgucugcccuuucu

SEQ ID NO: 2515679 - RNA, 21 nt, Chlamydophila pneumoniae CWL029
agcuuugucucuauagugcau

SEQ ID NO: 2515680 - RNA, 17 nt, Chlamydophila pneumoniae CWL029
agcuuuuaguuucccac

SEQ ID NO: 2515681 - RNA, 23 nt, Chlamydophila pneumoniae CWL029
agcuuuuccguaaguaaccaaua

SEQ ID NO: 2515682 - RNA, 20 nt, Chlamydophila pneumoniae CWL029
agcuuuugcuacagcuucuu

SEQ ID NO: 2515683 - RNA, 13 nt, Chlamydophila pneumoniae CWL029
agcuuuugugaua

SEQ ID NO: 2515684 - RNA, 12 nt, Chlamydophila pneumoniae CWL029
agcuuuuugcuu

SEQ ID NO: 2515685 - RNA, 18 nt, Chlamydophila pneumoniae CWL029
agcuuuuugcuuuucccu

SEQ ID NO: 2515686 - RNA, 14 nt, Chlamydophila pneumoniae CWL029
agcuuuuuucucuu

SEQ ID NO: 2515687 - RNA, 22 nt, Chlamydophila pneumoniae CWL029
agcuuuuuucucuugcuucaga

SEQ ID NO: 2515688 - RNA, 19 nt, Chlamydophila pneumoniae CWL029
aggaaaaaaaaucugcuau

SEQ ID NO: 2515689 - RNA, 16 nt, Chlamydophila pneumoniae CWL029
aggaaaauucuuaaaa

SEQ ID NO: 2515690 - RNA, 21 nt, Chlamydophila pneumoniae CWL029
aggaaacgauuucuucuucua

SEQ ID NO: 2515691 - RNA, 21 nt, Chlamydophila pneumoniae CWL029
aggaaauaccacagcuguaca

SEQ ID NO: 2515692 - RNA, 21 nt, Chlamydophila pneumoniae CWL029
aggaaaucccgagauaugaag

SEQ ID NO: 2515693 - RNA, 19 nt, Chlamydophila pneumoniae CWL029
aggaaauuacaaucucuag

SEQ ID NO: 2515694 - RNA, 11 nt, Chlamydophila pneumoniae CWL029
aggaaauuccg

SEQ ID NO: 2515695 - RNA, 14 nt, Chlamydophila pneumoniae CWL029
aggaacaaagccaa

SEQ ID NO: 2515696 - RNA, 20 nt, Chlamydophila pneumoniae CWL029
aggaacaaagcucuccuuca

SEQ ID NO: 2515697 - RNA, 22 nt, Chlamydophila pneumoniae CWL029
aggaacagcauuagggaaaggu

SEQ ID NO: 2515698 - RNA, 14 nt, Chlamydophila pneumoniae CWL029
aggaacaugccaaa

SEQ ID NO: 2515699 - RNA, 15 nt, Chlamydophila pneumoniae CWL029
aggaacuugaauacc

SEQ ID NO: 2515700 - RNA, 19 nt, Chlamydophila pneumoniae CWL029
aggaagaucuugaacagag

SEQ ID NO: 2515701 - RNA, 22 nt, Chlamydophila pneumoniae CWL029
aggaagaugaauaccagaagca

SEQ ID NO: 2515702 - RNA, 12 nt, Chlamydophila pneumoniae CWL029
aggaagcucuuc

SEQ ID NO: 2515703 - RNA, 14 nt, Chlamydophila pneumoniae CWL029
aggaagcucuucua

SEQ ID NO: 2515704 - RNA, 16 nt, Chlamydophila pneumoniae CWL029
aggaaggaaaucacag

SEQ ID NO: 2515705 - RNA, 15 nt, Chlamydophila pneumoniae CWL029
aggaaggaauagaga

SEQ ID NO: 2515706 - RNA, 19 nt, Chlamydophila pneumoniae CWL029
aggaauaacaccaaaagaa

SEQ ID NO: 2515707 - RNA, 21 nt, Chlamydophila pneumoniae CWL029
aggaauaacaccaaaagaaua

SEQ ID NO: 2515708 - RNA, 15 nt, Chlamydophila pneumoniae CWL029
aggaauagagaaaga

SEQ ID NO: 2515709 - RNA, 17 nt, Chlamydophila pneumoniae CWL029
aggaauagagaaagagu

SEQ ID NO: 2515710 - RNA, 11 nt, Chlamydophila pneumoniae CWL029
aggaaucacug

SEQ ID NO: 2515711 - RNA, 14 nt, Chlamydophila pneumoniae CWL029
aggaaucauaacca

SEQ ID NO: 2515712 - RNA, 23 nt, Chlamydophila pneumoniae CWL029
aggaaucuugaugaccucuauac

SEQ ID NO: 2515713 - RNA, 15 nt, Chlamydophila pneumoniae CWL029
aggaauuagagaaau

SEQ ID NO: 2515714 - RNA, 17 nt, Chlamydophila pneumoniae CWL029
aggaauucuuuaugaga

SEQ ID NO: 2515715 - RNA, 15 nt, Chlamydophila pneumoniae CWL029
aggaauuuucagccu

SEQ ID NO: 2515716 - RNA, 14 nt, Chlamydophila pneumoniae CWL029
aggaauuuuucuag

SEQ ID NO: 2515717 - RNA, 19 nt, Chlamydophila pneumoniae CWL029
aggacagccggagcuucua

SEQ ID NO: 2515718 - RNA, 17 nt, Chlamydophila pneumoniae CWL029
aggaccacaauuccuaa

SEQ ID NO: 2515719 - RNA, 21 nt, Chlamydophila pneumoniae CWL029
aggaccgugguaucccugagc

SEQ ID NO: 2515720 - RNA, 16 nt, Chlamydophila pneumoniae CWL029
aggaccuaagggcucu

SEQ ID NO: 2515721 - RNA, 16 nt, Chlamydophila pneumoniae CWL029
aggaccuacugggaaa

SEQ ID NO: 2515722 - RNA, 16 nt, Chlamydophila pneumoniae CWL029
aggaccuguaguaaaa

SEQ ID NO: 2515723 - RNA, 15 nt, Chlamydophila pneumoniae CWL029
aggaccugugaguaa

SEQ ID NO: 2515724 - RNA, 18 nt, Chlamydophila pneumoniae CWL029
aggaccuguuuucuuuuc

SEQ ID NO: 2515725 - RNA, 21 nt, Chlamydophila pneumoniae CWL029
aggacguaacguagucaaaaa

SEQ ID NO: 2515726 - RNA, 14 nt, Chlamydophila pneumoniae CWL029
aggacucuuucuau

SEQ ID NO: 2515727 - RNA, 23 nt, Chlamydophila pneumoniae CWL029
aggacuguuuguuuauuaucuac

SEQ ID NO: 2515728 - RNA, 17 nt, Chlamydophila pneumoniae CWL029
aggacuucgcaaauuuu

SEQ ID NO: 2515729 - RNA, 21 nt, Chlamydophila pneumoniae CWL029
aggagaacaauaucagcagcu

SEQ ID NO: 2515730 - RNA, 14 nt, Chlamydophila pneumoniae CWL029
aggagaagucgaaa

SEQ ID NO: 2515731 - RNA, 19 nt, Chlamydophila pneumoniae CWL029
aggagaauacaaacaagaa

SEQ ID NO: 2515732 - RNA, 20 nt, Chlamydophila pneumoniae CWL029
aggagacuaaaagaauaaua

SEQ ID NO: 2515733 - RNA, 16 nt, Chlamydophila pneumoniae CWL029
aggagagaauccuuuu

SEQ ID NO: 2515734 - RNA, 20 nt, Chlamydophila pneumoniae CWL029
aggagagcacuuuuaauauu

SEQ ID NO: 2515735 - RNA, 17 nt, Chlamydophila pneumoniae CWL029
aggagagcuagugguau

SEQ ID NO: 2515736 - RNA, 21 nt, Chlamydophila pneumoniae CWL029
aggagagcuugguuuucuccu

SEQ ID NO: 2515737 - RNA, 22 nt, Chlamydophila pneumoniae CWL029
aggagagcuugguuuucuccuu

SEQ ID NO: 2515738 - RNA, 20 nt, Chlamydophila pneumoniae CWL029
aggagcaucauuaauuccau

SEQ ID NO: 2515739 - RNA, 15 nt, Chlamydophila pneumoniae CWL029
aggagcgauagcuca

SEQ ID NO: 2515740 - RNA, 17 nt, Chlamydophila pneumoniae CWL029
aggagcgggauaggcaa

SEQ ID NO: 2515741 - RNA, 13 nt, Chlamydophila pneumoniae CWL029
aggagcuaaagcu

SEQ ID NO: 2515742 - RNA, 17 nt, Chlamydophila pneumoniae CWL029
aggagcucccuaagauu

SEQ ID NO: 2515743 - RNA, 16 nt, Chlamydophila pneumoniae CWL029
aggaggauuuccuagg

SEQ ID NO: 2515744 - RNA, 21 nt, Chlamydophila pneumoniae CWL029
aggaggauuuccuagguucuu

SEQ ID NO: 2515745 - RNA, 19 nt, Chlamydophila pneumoniae CWL029
aggagguccuuggcauuca

SEQ ID NO: 2515746 - RNA, 13 nt, Chlamydophila pneumoniae CWL029
aggagguggugga

SEQ ID NO: 2515747 - RNA, 18 nt, Chlamydophila pneumoniae CWL029
aggaguuuucaagucugu

SEQ ID NO: 2515748 - RNA, 20 nt, Chlamydophila pneumoniae CWL029
aggaguuuucaagucuguaa

SEQ ID NO: 2515749 - RNA, 12 nt, Chlamydophila pneumoniae CWL029
aggaguuuucca

SEQ ID NO: 2515750 - RNA, 13 nt, Chlamydophila pneumoniae CWL029
aggaguuuuccaa

SEQ ID NO: 2515751 - RNA, 18 nt, Chlamydophila pneumoniae CWL029
aggauaaguucuuccaaa

SEQ ID NO: 2515752 - RNA, 17 nt, Chlamydophila pneumoniae CWL029
aggauacgaauaaguuu

SEQ ID NO: 2515753 - RNA, 16 nt, Chlamydophila pneumoniae CWL029
aggauacucacagagu

SEQ ID NO: 2515754 - RNA, 21 nt, Chlamydophila pneumoniae CWL029
aggauagaccccccauuccaa

SEQ ID NO: 2515755 - RNA, 22 nt, Chlamydophila pneumoniae CWL029
aggauagcaauucgguagagcu

SEQ ID NO: 2515756 - RNA, 19 nt, Chlamydophila pneumoniae CWL029
aggauagugacuccugguu

SEQ ID NO: 2515757 - RNA, 16 nt, Chlamydophila pneumoniae CWL029
aggauauauagagcag

SEQ ID NO: 2515758 - RNA, 15 nt, Chlamydophila pneumoniae CWL029
aggauaucauauuuu

SEQ ID NO: 2515759 - RNA, 22 nt, Chlamydophila pneumoniae CWL029
aggaucauaccgacaagcauca

SEQ ID NO: 2515760 - RNA, 17 nt, Chlamydophila pneumoniae CWL029
aggaucauuaaagucca

SEQ ID NO: 2515761 - RNA, 17 nt, Chlamydophila pneumoniae CWL029
aggaucuuauauaaaac

SEQ ID NO: 2515762 - RNA, 19 nt, Chlamydophila pneumoniae CWL029
aggaucuuauauaaaacuu

SEQ ID NO: 2515763 - RNA, 20 nt, Chlamydophila pneumoniae CWL029
aggaucuuuggguucuucca

SEQ ID NO: 2515764 - RNA, 16 nt, Chlamydophila pneumoniae CWL029
aggaugcuugugagau

SEQ ID NO: 2515765 - RNA, 14 nt, Chlamydophila pneumoniae CWL029
aggauuaguaacua

SEQ ID NO: 2515766 - RNA, 12 nt, Chlamydophila pneumoniae CWL029
aggauuccuuga

SEQ ID NO: 2515767 - RNA, 16 nt, Chlamydophila pneumoniae CWL029
aggauuccuugacuau

SEQ ID NO: 2515768 - RNA, 18 nt, Chlamydophila pneumoniae CWL029
aggauucuaaaaagaaaa

SEQ ID NO: 2515769 - RNA, 13 nt, Chlamydophila pneumoniae CWL029
aggauucucucug

SEQ ID NO: 2515770 - RNA, 23 nt, Chlamydophila pneumoniae CWL029
aggauucugagaaguuaagacaa

SEQ ID NO: 2515771 - RNA, 17 nt, Chlamydophila pneumoniae CWL029
aggauucuuuugcaaug

SEQ ID NO: 2515772 - RNA, 15 nt, Chlamydophila pneumoniae CWL029
aggauucuuuuugau

SEQ ID NO: 2515773 - RNA, 14 nt, Chlamydophila pneumoniae CWL029
aggauugauaaaua

SEQ ID NO: 2515774 - RNA, 13 nt, Chlamydophila pneumoniae CWL029
aggauuuuccauu

SEQ ID NO: 2515775 - RNA, 15 nt, Chlamydophila pneumoniae CWL029
aggcaacaacgccua

SEQ ID NO: 2515776 - RNA, 16 nt, Chlamydophila pneumoniae CWL029
aggcaaggagagcuuc

SEQ ID NO: 2515777 - RNA, 16 nt, Chlamydophila pneumoniae CWL029
aggcacagcaaucaca

SEQ ID NO: 2515778 - RNA, 14 nt, Chlamydophila pneumoniae CWL029
aggcacauguagga

SEQ ID NO: 2515779 - RNA, 20 nt, Chlamydophila pneumoniae CWL029
aggcaggccacuuccuauaa

SEQ ID NO: 2515780 - RNA, 19 nt, Chlamydophila pneumoniae CWL029
aggcauacaguagaaacau

SEQ ID NO: 2515781 - RNA, 13 nt, Chlamydophila pneumoniae CWL029
aggcaucacuaau

SEQ ID NO: 2515782 - RNA, 20 nt, Chlamydophila pneumoniae CWL029
aggcaucuagagucucuuuc

SEQ ID NO: 2515783 - RNA, 23 nt, Chlamydophila pneumoniae CWL029
aggcaucuagagucucuuucagc

SEQ ID NO: 2515784 - RNA, 18 nt, Chlamydophila pneumoniae CWL029
aucucaaugcgauaacca

SEQ ID NO: 2515785 - RNA, 19 nt, Chlamydophila pneumoniae CWL029
aucucacuggcuccuaaac

SEQ ID NO: 2515786 - RNA, 10 nt, Chlamydophila pneumoniae CWL029
aucucaguag

SEQ ID NO: 2515787 - RNA, 17 nt, Chlamydophila pneumoniae CWL029
aucucauuccagcaucu

SEQ ID NO: 2515788 - RNA, 22 nt, Chlamydophila pneumoniae CWL029
aucucauuucguagacgcucua

SEQ ID NO: 2515789 - RNA, 19 nt, Chlamydophila pneumoniae CWL029
aucuccaaacauuuuuaag

SEQ ID NO: 2515790 - RNA, 14 nt, Chlamydophila pneumoniae CWL029
aucuccaaagauca

SEQ ID NO: 2515791 - RNA, 19 nt, Chlamydophila pneumoniae CWL029
aucuccaagccaugcaaug

SEQ ID NO: 2515792 - RNA, 23 nt, Chlamydophila pneumoniae CWL029
aucuccagguagcagaguuuuuc

SEQ ID NO: 2515793 - RNA, 17 nt, Chlamydophila pneumoniae CWL029
aucucccaagacgagaa

SEQ ID NO: 2515794 - RNA, 22 nt, Chlamydophila pneumoniae CWL029
aucuccgcauggcguaaugcuc

SEQ ID NO: 2515795 - RNA, 17 nt, Chlamydophila pneumoniae CWL029
aucuccggaacgcagag

SEQ ID NO: 2515796 - RNA, 14 nt, Chlamydophila pneumoniae CWL029
aucuccucaucaga

SEQ ID NO: 2515797 - RNA, 15 nt, Chlamydophila pneumoniae CWL029
aucuccugaagccau

SEQ ID NO: 2515798 - RNA, 21 nt, Chlamydophila pneumoniae CWL029
aucuccugaagccaugacaaa

SEQ ID NO: 2515799 - RNA, 14 nt, Chlamydophila pneumoniae CWL029
aucuccuucaugca

SEQ ID NO: 2515800 - RNA, 16 nt, Chlamydophila pneumoniae CWL029
aucucgcuauuccaua

SEQ ID NO: 2515801 - RNA, 18 nt, Chlamydophila pneumoniae CWL029
aucucgggagaacaugcc

SEQ ID NO: 2515802 - RNA, 20 nt, Chlamydophila pneumoniae CWL029
aucucguacguggaaaguag

SEQ ID NO: 2515803 - RNA, 22 nt, Chlamydophila pneumoniae CWL029
aucucguagcuauuuuugagga

SEQ ID NO: 2515804 - RNA, 22 nt, Chlamydophila pneumoniae CWL029
aucucguagcucaggaaaacuu

SEQ ID NO: 2515805 - RNA, 24 nt, Chlamydophila pneumoniae CWL029
aucucuaccgaacagagcgucuau

SEQ ID NO: 2515806 - RNA, 21 nt, Chlamydophila pneumoniae CWL029
aucucuagggauaauuaaacu

SEQ ID NO: 2515807 - RNA, 23 nt, Chlamydophila pneumoniae CWL029
aucucuagggauaauuaaacucu

SEQ ID NO: 2515808 - RNA, 15 nt, Chlamydophila pneumoniae CWL029
aucucuaguucuaga

SEQ ID NO: 2515809 - RNA, 18 nt, Chlamydophila pneumoniae CWL029
aucucuaguucuagaaag

SEQ ID NO: 2515810 - RNA, 14 nt, Chlamydophila pneumoniae CWL029
aucucucuuuaaaa

SEQ ID NO: 2515811 - RNA, 17 nt, Chlamydophila pneumoniae CWL029
aucucugaccaucaaug

SEQ ID NO: 2515812 - RNA, 19 nt, Chlamydophila pneumoniae CWL029
aucucugaccaucaaugag

SEQ ID NO: 2515813 - RNA, 18 nt, Chlamydophila pneumoniae CWL029
aucucugacuugcaagcu

SEQ ID NO: 2515814 - RNA, 22 nt, Chlamydophila pneumoniae CWL029
aucucugacuugcaagcuucuu

SEQ ID NO: 2515815 - RNA, 21 nt, Chlamydophila pneumoniae CWL029
aucucugcccccuguuugaac

SEQ ID NO: 2515816 - RNA, 17 nt, Chlamydophila pneumoniae CWL029
aucucugcuuuccacac

SEQ ID NO: 2515817 - RNA, 16 nt, Chlamydophila pneumoniae CWL029
aucucuggaauacauu

SEQ ID NO: 2515818 - RNA, 18 nt, Chlamydophila pneumoniae CWL029
aucucuggaauacauucc

SEQ ID NO: 2515819 - RNA, 13 nt, Chlamydophila pneumoniae CWL029
aucucugugccau

SEQ ID NO: 2515820 - RNA, 22 nt, Chlamydophila pneumoniae CWL029
aucucugugccaucuguagacc

SEQ ID NO: 2515821 - RNA, 23 nt, Chlamydophila pneumoniae CWL029
aucucuguuuuuugaaaacuuca

SEQ ID NO: 2515822 - RNA, 13 nt, Chlamydophila pneumoniae CWL029
aucucuuaaaaua

SEQ ID NO: 2515823 - RNA, 16 nt, Chlamydophila pneumoniae CWL029
aucucuugaagcacuu

SEQ ID NO: 2515824 - RNA, 15 nt, Chlamydophila pneumoniae CWL029
aucucuuuaaauguu

SEQ ID NO: 2515825 - RNA, 13 nt, Chlamydophila pneumoniae CWL029
aucucuuuaacuu

SEQ ID NO: 2515826 - RNA, 11 nt, Chlamydophila pneumoniae CWL029
aucucuuucac

SEQ ID NO: 2515827 - RNA, 19 nt, Chlamydophila pneumoniae CWL029
aucucuuucacaaaggcga

SEQ ID NO: 2515828 - RNA, 18 nt, Chlamydophila pneumoniae CWL029
aucucuuucauaaauuca

SEQ ID NO: 2515829 - RNA, 23 nt, Chlamydophila pneumoniae CWL029
aucucuuuuggaagaccuuugga

SEQ ID NO: 2515830 - RNA, 20 nt, Chlamydophila pneumoniae CWL029
aucugacagaccuugcauua

SEQ ID NO: 2515831 - RNA, 15 nt, Chlamydophila pneumoniae CWL029
aucugagcacauuuu

SEQ ID NO: 2515832 - RNA, 21 nt, Chlamydophila pneumoniae CWL029
aucugagcauaacuugaagaa

SEQ ID NO: 2515833 - RNA, 23 nt, Chlamydophila pneumoniae CWL029
aucugagucauaagcucuauuuc

SEQ ID NO: 2515834 - RNA, 22 nt, Chlamydophila pneumoniae CWL029
aucugaucuucagggacaucau

SEQ ID NO: 2515835 - RNA, 18 nt, Chlamydophila pneumoniae CWL029
aucugaugcaccauaaua

SEQ ID NO: 2515836 - RNA, 21 nt, Chlamydophila pneumoniae CWL029
aucugaugcaccauaauauaa

SEQ ID NO: 2515837 - RNA, 21 nt, Chlamydophila pneumoniae CWL029
aucugcaauuccgaagaagaa

SEQ ID NO: 2515838 - RNA, 21 nt, Chlamydophila pneumoniae CWL029
aucugcagcguuucuagggac

SEQ ID NO: 2515839 - RNA, 19 nt, Chlamydophila pneumoniae CWL029
aucugcagguaagggaugc

SEQ ID NO: 2515840 - RNA, 19 nt, Chlamydophila pneumoniae CWL029
aucugcgacaaaaaugccu

SEQ ID NO: 2515841 - RNA, 22 nt, Chlamydophila pneumoniae CWL029
aucugcgacaaaaaugccugaa

SEQ ID NO: 2515842 - RNA, 19 nt, Chlamydophila pneumoniae CWL029
aucugcuauaaccaacuuc

SEQ ID NO: 2515843 - RNA, 17 nt, Chlamydophila pneumoniae CWL029
aucugcuucuacgguaa

SEQ ID NO: 2515844 - RNA, 20 nt, Chlamydophila pneumoniae CWL029
aucuggaaaagccucgaaau

SEQ ID NO: 2515845 - RNA, 18 nt, Chlamydophila pneumoniae CWL029
aucuggggcuuccagaaa

SEQ ID NO: 2515846 - RNA, 23 nt, Chlamydophila pneumoniae CWL029
aucuguaauagcaggaguuuuca

SEQ ID NO: 2515847 - RNA, 18 nt, Chlamydophila pneumoniae CWL029
aucuguaguaggcacuua

SEQ ID NO: 2515848 - RNA, 20 nt, Chlamydophila pneumoniae CWL029
aucuguauaugcuuggcaau

SEQ ID NO: 2515849 - RNA, 15 nt, Chlamydophila pneumoniae CWL029
aucuguauccuuccu

SEQ ID NO: 2515850 - RNA, 17 nt, Chlamydophila pneumoniae CWL029
aucuguauccuuccuua

SEQ ID NO: 2515851 - RNA, 17 nt, Chlamydophila pneumoniae CWL029
aucugucauuaaaaauu

SEQ ID NO: 2515852 - RNA, 23 nt, Chlamydophila pneumoniae CWL029
aucugucauuaaaaauuuaaaag

SEQ ID NO: 2515853 - RNA, 14 nt, Chlamydophila pneumoniae CWL029
aucuguuaaaaaca

SEQ ID NO: 2515854 - RNA, 12 nt, Chlamydophila pneumoniae CWL029
aucuuacauaaa

SEQ ID NO: 2515855 - RNA, 17 nt, Chlamydophila pneumoniae CWL029
aucuuacauaaaccuuu

SEQ ID NO: 2515856 - RNA, 16 nt, Chlamydophila pneumoniae CWL029
aucuuauauaaaacuu

SEQ ID NO: 2515857 - RNA, 22 nt, Chlamydophila pneumoniae CWL029
aucuuaugccuuuguuuuaucu

SEQ ID NO: 2515858 - RNA, 12 nt, Chlamydophila pneumoniae CWL029
aucuucaaaaga

SEQ ID NO: 2515859 - RNA, 21 nt, Chlamydophila pneumoniae CWL029
aucuucacgacauacaucaaa

SEQ ID NO: 2515860 - RNA, 16 nt, Chlamydophila pneumoniae CWL029
aucuucagaauuuuau

SEQ ID NO: 2515861 - RNA, 13 nt, Chlamydophila pneumoniae CWL029
aucuucagagaga

SEQ ID NO: 2515862 - RNA, 15 nt, Chlamydophila pneumoniae CWL029
aucuucagagagaac

SEQ ID NO: 2515863 - RNA, 16 nt, Chlamydophila pneumoniae CWL029
aucuucagagagaaca

SEQ ID NO: 2515864 - RNA, 16 nt, Chlamydophila pneumoniae CWL029
aucuucagggucuaag

SEQ ID NO: 2515865 - RNA, 13 nt, Chlamydophila pneumoniae CWL029
aucuucauaacca

SEQ ID NO: 2515866 - RNA, 13 nt, Chlamydophila pneumoniae CWL029
aucuuccucuuuu

SEQ ID NO: 2515867 - RNA, 19 nt, Chlamydophila pneumoniae CWL029
aucuucuaaaaccacagaa

SEQ ID NO: 2515868 - RNA, 19 nt, Chlamydophila pneumoniae CWL029
aucuucuggguucuccaca

SEQ ID NO: 2515869 - RNA, 19 nt, Chlamydophila pneumoniae CWL029
aucuucuuagccaaaauuu

SEQ ID NO: 2515870 - RNA, 23 nt, Chlamydophila pneumoniae CWL029
aucuucuucuggcugagagaagc

SEQ ID NO: 2515871 - RNA, 18 nt, Chlamydophila pneumoniae CWL029
aucuucuuggcuuucccc

SEQ ID NO: 2515872 - RNA, 15 nt, Chlamydophila pneumoniae CWL029
aucuugaacagagac

SEQ ID NO: 2515873 - RNA, 23 nt, Chlamydophila pneumoniae CWL029
aucuugaacagagacuuccucuu

SEQ ID NO: 2515874 - RNA, 14 nt, Chlamydophila pneumoniae CWL029
aucuugagaaaaga

SEQ ID NO: 2515875 - RNA, 16 nt, Chlamydophila pneumoniae CWL029
aucuugagaaaagaac

SEQ ID NO: 2515876 - RNA, 19 nt, Chlamydophila pneumoniae CWL029
aucuugagccacuuuuaau

SEQ ID NO: 2515877 - RNA, 21 nt, Chlamydophila pneumoniae CWL029
aucuugauauugaaagaucau

SEQ ID NO: 2515878 - RNA, 22 nt, Chlamydophila pneumoniae CWL029
aucuugaugaccucuauaccua

SEQ ID NO: 2515879 - RNA, 15 nt, Chlamydophila pneumoniae CWL029
aucuugauuaggaac

SEQ ID NO: 2515880 - RNA, 16 nt, Chlamydophila pneumoniae CWL029
aucuugcucaggagau

SEQ ID NO: 2515881 - RNA, 19 nt, Chlamydophila pneumoniae CWL029
aucuuguaaguuacggaac

SEQ ID NO: 2515882 - RNA, 15 nt, Chlamydophila pneumoniae CWL029
aucuuguucuaaaau

SEQ ID NO: 2515883 - RNA, 23 nt, Chlamydophila pneumoniae CWL029
aucuuguucuaaaaugaaauacu

SEQ ID NO: 2515884 - RNA, 11 nt, Chlamydophila pneumoniae CWL029
aucuuguugua

SEQ ID NO: 2515885 - RNA, 17 nt, Chlamydophila pneumoniae CWL029
aucuuuaaauucgccaa

SEQ ID NO: 2515886 - RNA, 18 nt, Chlamydophila pneumoniae CWL029
aucuuuaaauucgccaaa

SEQ ID NO: 2515887 - RNA, 21 nt, Chlamydophila pneumoniae CWL029
aucuuuaagauuuuuagaaua

SEQ ID NO: 2515888 - RNA, 14 nt, Chlamydophila pneumoniae CWL029
aucuuuagaauaag

SEQ ID NO: 2515889 - RNA, 14 nt, Chlamydophila pneumoniae CWL029
aucuuuagaaucaa

SEQ ID NO: 2515890 - RNA, 19 nt, Chlamydophila pneumoniae CWL029
aucuuuaguuuaccugaaa

SEQ ID NO: 2515891 - RNA, 18 nt, Chlamydophila pneumoniae CWL029
aucuuuauuuaaauaaaa

SEQ ID NO: 2515892 - RNA, 19 nt, Chlamydophila pneumoniae CWL029
aucuuuauuuuuaaaaaua

SEQ ID NO: 2515893 - RNA, 15 nt, Chlamydophila pneumoniae CWL029
aucuuucaaaagaaa

SEQ ID NO: 2515894 - RNA, 19 nt, Chlamydophila pneumoniae CWL029
aucuuucaauguaauugcg

SEQ ID NO: 2515895 - RNA, 21 nt, Chlamydophila pneumoniae CWL029
aucuuucauucccuuuuucca

SEQ ID NO: 2515896 - RNA, 21 nt, Chlamydophila pneumoniae CWL029
aucuuuccucucaugaaauuu

SEQ ID NO: 2515897 - RNA, 12 nt, Chlamydophila pneumoniae CWL029
aucuuucuucua

SEQ ID NO: 2515898 - RNA, 15 nt, Chlamydophila pneumoniae CWL029
aucuuugaacaaaaa

SEQ ID NO: 2515899 - RNA, 20 nt, Chlamydophila pneumoniae CWL029
aucuuugagaucuugaauga

SEQ ID NO: 2515900 - RNA, 21 nt, Chlamydophila pneumoniae CWL029
aucuuugagaucuugaaugau

SEQ ID NO: 2515901 - RNA, 15 nt, Chlamydophila pneumoniae CWL029
aucuuuguugagaag

SEQ ID NO: 2515902 - RNA, 13 nt, Chlamydophila pneumoniae CWL029
aucuuuucuagaa

SEQ ID NO: 2515903 - RNA, 18 nt, Chlamydophila pneumoniae CWL029
aucuuuucuuucuaagau

SEQ ID NO: 2515904 - RNA, 23 nt, Chlamydophila pneumoniae CWL029
aucuuuugauuaggcuucagaga

SEQ ID NO: 2515905 - RNA, 23 nt, Chlamydophila pneumoniae CWL029
aucuuuugguugugucaacccuu

SEQ ID NO: 2515906 - RNA, 12 nt, Chlamydophila pneumoniae CWL029
aucuuuuuuaaa

SEQ ID NO: 2515907 - RNA, 14 nt, Chlamydophila pneumoniae CWL029
aucuuuuuuaaagc

SEQ ID NO: 2515908 - RNA, 19 nt, Chlamydophila pneumoniae CWL029
augaaaaaagaauaaaaau

SEQ ID NO: 2515909 - RNA, 13 nt, Chlamydophila pneumoniae CWL029
augaaaaucugcu

SEQ ID NO: 2515910 - RNA, 18 nt, Chlamydophila pneumoniae CWL029
augaaaaucugcucucug

SEQ ID NO: 2515911 - RNA, 15 nt, Chlamydophila pneumoniae CWL029
augaaaccuucagau

SEQ ID NO: 2515912 - RNA, 16 nt, Chlamydophila pneumoniae CWL029
augaaacgaaagcagu

SEQ ID NO: 2515913 - RNA, 21 nt, Chlamydophila pneumoniae CWL029
augaaagugcucuuuuaacuu

SEQ ID NO: 2515914 - RNA, 14 nt, Chlamydophila pneumoniae CWL029
augaacgauuucuu

SEQ ID NO: 2515915 - RNA, 19 nt, Chlamydophila pneumoniae CWL029
augaacucaggcuuuaagu

SEQ ID NO: 2515916 - RNA, 20 nt, Chlamydophila pneumoniae CWL029
augaacugccugagaaaagu

SEQ ID NO: 2515917 - RNA, 14 nt, Chlamydophila pneumoniae CWL029
augaagaaaaaucu

SEQ ID NO: 2515918 - RNA, 23 nt, Chlamydophila pneumoniae CWL029
augaagagaguucucucuucacu

SEQ ID NO: 2515919 - RNA, 14 nt, Chlamydophila pneumoniae CWL029
augaagauaaaauc

SEQ ID NO: 2515920 - RNA, 17 nt, Chlamydophila pneumoniae CWL029
augaaucacagcgcugu

SEQ ID NO: 2515921 - RNA, 21 nt, Chlamydophila pneumoniae CWL029
augaaucgaagaacagaggau

SEQ ID NO: 2515922 - RNA, 16 nt, Chlamydophila pneumoniae CWL029
augaaucugguuccuu

SEQ ID NO: 2515923 - RNA, 14 nt, Chlamydophila pneumoniae CWL029
augaaugacugcag

SEQ ID NO: 2515924 - RNA, 15 nt, Chlamydophila pneumoniae CWL029
augaaugauuuccau

SEQ ID NO: 2515925 - RNA, 17 nt, Chlamydophila pneumoniae CWL029
augaauugucaucucau

SEQ ID NO: 2515926 - RNA, 20 nt, Chlamydophila pneumoniae CWL029
augacaaaggguuucuuucc

SEQ ID NO: 2515927 - RNA, 16 nt, Chlamydophila pneumoniae CWL029
augacaacagagacaa

SEQ ID NO: 2515928 - RNA, 18 nt, Chlamydophila pneumoniae CWL029
augacagggaaagaacag

SEQ ID NO: 2515929 - RNA, 22 nt, Chlamydophila pneumoniae CWL029
augacauugcaauacaucuuaa

SEQ ID NO: 2515930 - RNA, 14 nt, Chlamydophila pneumoniae CWL029
augaccgcaaggag

SEQ ID NO: 2515931 - RNA, 13 nt, Chlamydophila pneumoniae CWL029
augaccuuauagu

SEQ ID NO: 2515932 - RNA, 16 nt, Chlamydophila pneumoniae CWL029
augaccuuuagcugcu

SEQ ID NO: 2515933 - RNA, 20 nt, Chlamydophila pneumoniae CWL029
augacguuaauaaagaggcu

SEQ ID NO: 2515934 - RNA, 12 nt, Chlamydophila pneumoniae CWL029
augacucuagag

SEQ ID NO: 2515935 - RNA, 20 nt, Chlamydophila pneumoniae CWL029
augacugcagauugcacuug

SEQ ID NO: 2515936 - RNA, 22 nt, Chlamydophila pneumoniae CWL029
augacuuuuguugcaauuccau

SEQ ID NO: 2515937 - RNA, 12 nt, Chlamydophila pneumoniae CWL029
augagaaaaaga

SEQ ID NO: 2515938 - RNA, 17 nt, Chlamydophila pneumoniae CWL029
augagaacguaagcuuu

SEQ ID NO: 2515939 - RNA, 22 nt, Chlamydophila pneumoniae CWL029
augagaacgucuaaagacgaag

SEQ ID NO: 2515940 - RNA, 21 nt, Chlamydophila pneumoniae CWL029
augagaauuuucaugauauuu

SEQ ID NO: 2515941 - RNA, 13 nt, Chlamydophila pneumoniae CWL029
augagagagcucu

SEQ ID NO: 2515942 - RNA, 18 nt, Chlamydophila pneumoniae CWL029
augagagagcucuucagc

SEQ ID NO: 2515943 - RNA, 17 nt, Chlamydophila pneumoniae CWL029
augagaguuucuaaugu

SEQ ID NO: 2515944 - RNA, 19 nt, Chlamydophila pneumoniae CWL029
augagauccaaagccugaa

SEQ ID NO: 2515945 - RNA, 23 nt, Chlamydophila pneumoniae CWL029
augagauccaaagccugaaaaau

SEQ ID NO: 2515946 - RNA, 21 nt, Chlamydophila pneumoniae CWL029
augagcucacgcaccauuccu

SEQ ID NO: 2515947 - RNA, 21 nt, Chlamydophila pneumoniae CWL029
augaggagcucccucuagagc

SEQ ID NO: 2515948 - RNA, 17 nt, Chlamydophila pneumoniae CWL029
augaggcacauguagga

SEQ ID NO: 2515949 - RNA, 13 nt, Chlamydophila pneumoniae CWL029
augagggaaaugc

SEQ ID NO: 2515950 - RNA, 19 nt, Chlamydophila pneumoniae CWL029
augagggucggauuuagau

SEQ ID NO: 2515951 - RNA, 18 nt, Chlamydophila pneumoniae CWL029
augaguuuacuaacucug

SEQ ID NO: 2515952 - RNA, 14 nt, Chlamydophila pneumoniae CWL029
augauaaagccugc

SEQ ID NO: 2515953 - RNA, 17 nt, Chlamydophila pneumoniae CWL029
augauaaagccugcacg

SEQ ID NO: 2515954 - RNA, 18 nt, Chlamydophila pneumoniae CWL029
augauaccaccuaaaaug

SEQ ID NO: 2515955 - RNA, 13 nt, Chlamydophila pneumoniae CWL029
augauaucaccag

SEQ ID NO: 2515956 - RNA, 21 nt, Chlamydophila pneumoniae CWL029
augaucgggguuucagaagga

SEQ ID NO: 2515957 - RNA, 21 nt, Chlamydophila pneumoniae CWL029
augaucucuucaugaaaaaag

SEQ ID NO: 2515958 - RNA, 19 nt, Chlamydophila pneumoniae CWL029
augaugcaagcagauagag

SEQ ID NO: 2515959 - RNA, 20 nt, Chlamydophila pneumoniae CWL029
augaugccauugaucagaau

SEQ ID NO: 2515960 - RNA, 18 nt, Chlamydophila pneumoniae CWL029
augauuuucgguuacuuu

SEQ ID NO: 2515961 - RNA, 14 nt, Chlamydophila pneumoniae CWL029
augauuuuuugaau

SEQ ID NO: 2515962 - RNA, 15 nt, Chlamydophila pneumoniae CWL029
augcaaaccaaaaaa

SEQ ID NO: 2515963 - RNA, 21 nt, Chlamydophila pneumoniae CWL029
augcaaauuccagaaaaagaa

SEQ ID NO: 2515964 - RNA, 21 nt, Chlamydophila pneumoniae CWL029
augcaacagagucagaagcua

SEQ ID NO: 2515965 - RNA, 16 nt, Chlamydophila pneumoniae CWL029
augcaauacuuuucuc

SEQ ID NO: 2515966 - RNA, 12 nt, Chlamydophila pneumoniae CWL029
augcacaaaaua

SEQ ID NO: 2515967 - RNA, 14 nt, Chlamydophila pneumoniae CWL029
augcacaaaauaaa

SEQ ID NO: 2515968 - RNA, 16 nt, Chlamydophila pneumoniae CWL029
augcaccauaauauaa

SEQ ID NO: 2515969 - RNA, 17 nt, Chlamydophila pneumoniae CWL029
augcaccauaauauaau

SEQ ID NO: 2515970 - RNA, 20 nt, Chlamydophila pneumoniae CWL029
augcacgcuuucgucuaaaa

SEQ ID NO: 2515971 - RNA, 20 nt, Chlamydophila pneumoniae CWL029
augcagauacuaaacuccau

SEQ ID NO: 2515972 - RNA, 15 nt, Chlamydophila pneumoniae CWL029
augcaggccaggaga

SEQ ID NO: 2515973 - RNA, 19 nt, Chlamydophila pneumoniae CWL029
augcauacguuaacaagga

SEQ ID NO: 2515974 - RNA, 12 nt, Chlamydophila pneumoniae CWL029
augcaucucuua

SEQ ID NO: 2515975 - RNA, 18 nt, Chlamydophila pneumoniae CWL029
augcaucucuuaaaacau

SEQ ID NO: 2515976 - RNA, 22 nt, Chlamydophila pneumoniae CWL029
augcauucugauccgaaaagaa

SEQ ID NO: 2515977 - RNA, 23 nt, Chlamydophila pneumoniae CWL029
augcauuuguuuggaaaugagag

SEQ ID NO: 2515978 - RNA, 15 nt, Chlamydophila pneumoniae CWL029
augccaguuccuaaa

SEQ ID NO: 2515979 - RNA, 19 nt, Chlamydophila pneumoniae CWL029
augccaguuccuaaagcuu

SEQ ID NO: 2515980 - RNA, 18 nt, Chlamydophila pneumoniae CWL029
augccauaaauacaggcc

SEQ ID NO: 2515981 - RNA, 15 nt, Chlamydophila pneumoniae CWL029
augccauuguagaga

SEQ ID NO: 2515982 - RNA, 11 nt, Chlamydophila pneumoniae CWL029
augcccaaaca

SEQ ID NO: 2515983 - RNA, 12 nt, Chlamydophila pneumoniae CWL029
augcccuguucu

SEQ ID NO: 2515984 - RNA, 17 nt, Chlamydophila pneumoniae CWL029
augccuaaauagcucag

SEQ ID NO: 2515985 - RNA, 22 nt, Chlamydophila pneumoniae CWL029
augccuaaauagcucaguuggu

SEQ ID NO: 2515986 - RNA, 15 nt, Chlamydophila pneumoniae CWL029
augccucaggucugc

SEQ ID NO: 2515987 - RNA, 19 nt, Chlamydophila pneumoniae CWL029
augccucaggucugcugag

SEQ ID NO: 2515988 - RNA, 20 nt, Chlamydophila pneumoniae CWL029
augccucuuucauacuaaaa

SEQ ID NO: 2515989 - RNA, 14 nt, Chlamydophila pneumoniae CWL029
augccugaaaacaa

SEQ ID NO: 2515990 - RNA, 19 nt, Chlamydophila pneumoniae CWL029
augccugaaaacaaggcaa

SEQ ID NO: 2515991 - RNA, 23 nt, Chlamydophila pneumoniae CWL029
augccuggccaucaucaccagaa

SEQ ID NO: 2515992 - RNA, 17 nt, Chlamydophila pneumoniae CWL029
augccuuuggcaaucau

SEQ ID NO: 2515993 - RNA, 19 nt, Chlamydophila pneumoniae CWL029
augcgcacggauucuaaaa

SEQ ID NO: 2515994 - RNA, 18 nt, Chlamydophila pneumoniae CWL029
augcgcagcucggaugga

SEQ ID NO: 2515995 - RNA, 12 nt, Chlamydophila pneumoniae CWL029
augcgcucuaag

SEQ ID NO: 2515996 - RNA, 20 nt, Chlamydophila pneumoniae CWL029
augcuaaauuugucaucaca

SEQ ID NO: 2515997 - RNA, 23 nt, Chlamydophila pneumoniae CWL029
augcuaaauuugucaucacauca

SEQ ID NO: 2515998 - RNA, 12 nt, Chlamydophila pneumoniae CWL029
augcuaauaaaa

SEQ ID NO: 2515999 - RNA, 15 nt, Chlamydophila pneumoniae CWL029
augcuaauaaaaugc

SEQ ID NO: 2516000 - RNA, 21 nt, Chlamydophila pneumoniae CWL029
augcuaauuggauauagggag

SEQ ID NO: 2516001 - RNA, 15 nt, Chlamydophila pneumoniae CWL029
augcuacaaacucuu

SEQ ID NO: 2516002 - RNA, 22 nt, Chlamydophila pneumoniae CWL029
augcuauagcuggaucuucuga

SEQ ID NO: 2516003 - RNA, 17 nt, Chlamydophila pneumoniae CWL029
augcuauuuuccucuau

SEQ ID NO: 2516004 - RNA, 13 nt, Chlamydophila pneumoniae CWL029
augcuauuuuucc

SEQ ID NO: 2516005 - RNA, 18 nt, Chlamydophila pneumoniae CWL029
augcucauuaauaauauc

SEQ ID NO: 2516006 - RNA, 22 nt, Chlamydophila pneumoniae CWL029
augcucauuaauaauaucuaac

SEQ ID NO: 2516007 - RNA, 20 nt, Chlamydophila pneumoniae CWL029
augcuccugcaaaaaaccag

SEQ ID NO: 2516008 - RNA, 13 nt, Chlamydophila pneumoniae CWL029
augcucuagaaaa

SEQ ID NO: 2516009 - RNA, 16 nt, Chlamydophila pneumoniae CWL029
augcugcacaguucac

SEQ ID NO: 2516010 - RNA, 11 nt, Chlamydophila pneumoniae CWL029
augcuggaacu

SEQ ID NO: 2516011 - RNA, 15 nt, Chlamydophila pneumoniae CWL029
augcuguugauucaa

SEQ ID NO: 2516012 - RNA, 16 nt, Chlamydophila pneumoniae CWL029
augcuuagccauggca

SEQ ID NO: 2516013 - RNA, 19 nt, Chlamydophila pneumoniae CWL029
augcuugaaguucucaaag

SEQ ID NO: 2516014 - RNA, 15 nt, Chlamydophila pneumoniae CWL029
auggaaacauagaau

SEQ ID NO: 2516015 - RNA, 14 nt, Chlamydophila pneumoniae CWL029
auggaaagaaacaa

SEQ ID NO: 2516016 - RNA, 14 nt, Chlamydophila pneumoniae CWL029
auggaaauagagaa

SEQ ID NO: 2516017 - RNA, 13 nt, Chlamydophila pneumoniae CWL029
auggaacauccuu

SEQ ID NO: 2516018 - RNA, 13 nt, Chlamydophila pneumoniae CWL029
auggaaugccaaa

SEQ ID NO: 2516019 - RNA, 23 nt, Chlamydophila pneumoniae CWL029
auggacagcguauaggaaacugu

SEQ ID NO: 2516020 - RNA, 15 nt, Chlamydophila pneumoniae CWL029
auggaucccuguagu

SEQ ID NO: 2516021 - RNA, 14 nt, Chlamydophila pneumoniae CWL029
auggaugcuaaauu

SEQ ID NO: 2516022 - RNA, 19 nt, Chlamydophila pneumoniae CWL029
auggauuaucuuagggaau

SEQ ID NO: 2516023 - RNA, 15 nt, Chlamydophila pneumoniae CWL029
auggcacuugagcac

SEQ ID NO: 2516024 - RNA, 18 nt, Chlamydophila pneumoniae CWL029
auggcauagcgaaaguca

SEQ ID NO: 2516025 - RNA, 17 nt, Chlamydophila pneumoniae CWL029
auggcgauaaaugcuga

SEQ ID NO: 2516026 - RNA, 15 nt, Chlamydophila pneumoniae CWL029
auggcggucuuuguu

SEQ ID NO: 2516027 - RNA, 16 nt, Chlamydophila pneumoniae CWL029
auggcuauuuuuaaaa

SEQ ID NO: 2516028 - RNA, 16 nt, Chlamydophila pneumoniae CWL029
auggcuggaaagccaa

SEQ ID NO: 2516029 - RNA, 15 nt, Chlamydophila pneumoniae CWL029
augggaauaaaaaug

SEQ ID NO: 2516030 - RNA, 15 nt, Chlamydophila pneumoniae CWL029
augggaauuugauuu

SEQ ID NO: 2516031 - RNA, 16 nt, Chlamydophila pneumoniae CWL029
augggagaagcuaagg

SEQ ID NO: 2516032 - RNA, 18 nt, Chlamydophila pneumoniae CWL029
augggauccugcaaagcc

SEQ ID NO: 2516033 - RNA, 16 nt, Chlamydophila pneumoniae CWL029
augggguccauucuga

SEQ ID NO: 2516034 - RNA, 22 nt, Chlamydophila pneumoniae CWL029
augggugagauuauaaagauaa

SEQ ID NO: 2516035 - RNA, 23 nt, Chlamydophila pneumoniae CWL029
auggguuuccuggucuccagaag

SEQ ID NO: 2516036 - RNA, 13 nt, Chlamydophila pneumoniae CWL029
augguaauuuuuc

SEQ ID NO: 2516037 - RNA, 14 nt, Chlamydophila pneumoniae CWL029
augguacaauacug

SEQ ID NO: 2516038 - RNA, 23 nt, Chlamydophila pneumoniae CWL029
augguauucccuaacaggaaaga

SEQ ID NO: 2516039 - RNA, 16 nt, Chlamydophila pneumoniae CWL029
auggucaggaagaaag

SEQ ID NO: 2516040 - RNA, 19 nt, Chlamydophila pneumoniae CWL029
auggucagucucgugcaua

SEQ ID NO: 2516041 - RNA, 16 nt, Chlamydophila pneumoniae CWL029
auggucccuauagaac

SEQ ID NO: 2516042 - RNA, 18 nt, Chlamydophila pneumoniae CWL029
auggucucccucacaaga

SEQ ID NO: 2516043 - RNA, 20 nt, Chlamydophila pneumoniae CWL029
auggucucccucacaagaag

SEQ ID NO: 2516044 - RNA, 17 nt, Chlamydophila pneumoniae CWL029
auggugaagaauaauag

SEQ ID NO: 2516045 - RNA, 16 nt, Chlamydophila pneumoniae CWL029
auggugagauuucuaa

SEQ ID NO: 2516046 - RNA, 16 nt, Chlamydophila pneumoniae CWL029
auguaagaaggcagag

SEQ ID NO: 2516047 - RNA, 14 nt, Chlamydophila pneumoniae CWL029
auguaagaauguag

SEQ ID NO: 2516048 - RNA, 17 nt, Chlamydophila pneumoniae CWL029
auguaaucccagauuuu

SEQ ID NO: 2516049 - RNA, 18 nt, Chlamydophila pneumoniae CWL029
auguaaucccagauuuuu

SEQ ID NO: 2516050 - RNA, 12 nt, Chlamydophila pneumoniae CWL029
auguaauuuuuu

SEQ ID NO: 2516051 - RNA, 18 nt, Chlamydophila pneumoniae CWL029
auguacaagcuucaucaa

SEQ ID NO: 2516052 - RNA, 18 nt, Chlamydophila pneumoniae CWL029
auguacagaaaauaagaa

SEQ ID NO: 2516053 - RNA, 21 nt, Chlamydophila pneumoniae CWL029
auguacaguuuguaaaaagcc

SEQ ID NO: 2516054 - RNA, 22 nt, Chlamydophila pneumoniae CWL029
auguacccagcgaugucuuuga

SEQ ID NO: 2516055 - RNA, 22 nt, Chlamydophila pneumoniae CWL029
auguagaaggggguucuaagaa

SEQ ID NO: 2516056 - RNA, 24 nt, Chlamydophila pneumoniae CWL029
auguagaaggggguucuaagaaau

SEQ ID NO: 2516057 - RNA, 11 nt, Chlamydophila pneumoniae CWL029
auguagagucg

SEQ ID NO: 2516058 - RNA, 23 nt, Chlamydophila pneumoniae CWL029
auguagguaugacucguguggau

SEQ ID NO: 2516059 - RNA, 20 nt, Chlamydophila pneumoniae CWL029
auguaguaaauuccucuuga

SEQ ID NO: 2516060 - RNA, 15 nt, Chlamydophila pneumoniae CWL029
auguaguuagagaag

SEQ ID NO: 2516061 - RNA, 21 nt, Chlamydophila pneumoniae CWL029
auguaguuugggaugacuggc

SEQ ID NO: 2516062 - RNA, 15 nt, Chlamydophila pneumoniae CWL029
auguauaaacuccac

SEQ ID NO: 2516063 - RNA, 23 nt, Chlamydophila pneumoniae CWL029
auguaucggggauugcaaaauuu

SEQ ID NO: 2516064 - RNA, 22 nt, Chlamydophila pneumoniae CWL029
auguauggugcgcgucuccuug

SEQ ID NO: 2516065 - RNA, 16 nt, Chlamydophila pneumoniae CWL029
auguauuguguucccu

SEQ ID NO: 2516066 - RNA, 18 nt, Chlamydophila pneumoniae CWL029
augucacucuagaaaaua

SEQ ID NO: 2516067 - RNA, 21 nt, Chlamydophila pneumoniae CWL029
augucacucuagaaaauauuc

SEQ ID NO: 2516068 - RNA, 15 nt, Chlamydophila pneumoniae CWL029
augucaguaucaaua

SEQ ID NO: 2516069 - RNA, 22 nt, Chlamydophila pneumoniae CWL029
augucaguaucaauaaucggcc

SEQ ID NO: 2516070 - RNA, 22 nt, Chlamydophila pneumoniae CWL029
auguccguucgagagguucccu

SEQ ID NO: 2516071 - RNA, 14 nt, Chlamydophila pneumoniae CWL029
augucgucucagaa

SEQ ID NO: 2516072 - RNA, 14 nt, Chlamydophila pneumoniae CWL029
augucuaaaggagu

SEQ ID NO: 2516073 - RNA, 13 nt, Chlamydophila pneumoniae CWL029
augucuccauaca

SEQ ID NO: 2516074 - RNA, 20 nt, Chlamydophila pneumoniae CWL029
augucuuguugcaugggaau

SEQ ID NO: 2516075 - RNA, 16 nt, Chlamydophila pneumoniae CWL029
augugaagccauuuuc

SEQ ID NO: 2516076 - RNA, 19 nt, Chlamydophila pneumoniae CWL029
augugacgcaagagacaag

SEQ ID NO: 2516077 - RNA, 15 nt, Chlamydophila pneumoniae CWL029
auuuuucaagaacuc

SEQ ID NO: 2516078 - RNA, 17 nt, Chlamydophila pneumoniae CWL029
auuuuucaagaacuccu

SEQ ID NO: 2516079 - RNA, 22 nt, Chlamydophila pneumoniae CWL029
auuuuucaagaacuccuuugag

SEQ ID NO: 2516080 - RNA, 18 nt, Chlamydophila pneumoniae CWL029
auuuuucaauaaccagaa

SEQ ID NO: 2516081 - RNA, 14 nt, Chlamydophila pneumoniae CWL029
auuuuuccagaaau

SEQ ID NO: 2516082 - RNA, 14 nt, Chlamydophila pneumoniae CWL029
auuuuuccuccucc

SEQ ID NO: 2516083 - RNA, 17 nt, Chlamydophila pneumoniae CWL029
auuuuuccuucaacaca

SEQ ID NO: 2516084 - RNA, 21 nt, Chlamydophila pneumoniae CWL029
auuuuucgagaauauacagau

SEQ ID NO: 2516085 - RNA, 15 nt, Chlamydophila pneumoniae CWL029
auuuuugaauaugau

SEQ ID NO: 2516086 - RNA, 15 nt, Chlamydophila pneumoniae CWL029
auuuuugcuaaacaa

SEQ ID NO: 2516087 - RNA, 18 nt, Chlamydophila pneumoniae CWL029
auuuuugcuaagagcucu

SEQ ID NO: 2516088 - RNA, 16 nt, Chlamydophila pneumoniae CWL029
auuuuugggaaaagaa

SEQ ID NO: 2516089 - RNA, 11 nt, Chlamydophila pneumoniae CWL029
auuuuuucuug

SEQ ID NO: 2516090 - RNA, 15 nt, Chlamydophila pneumoniae CWL029
auuuuuugagaaaua

SEQ ID NO: 2516091 - RNA, 19 nt, Chlamydophila pneumoniae CWL029
caaaaaagagcccaaaaac

SEQ ID NO: 2516092 - RNA, 13 nt, Chlamydophila pneumoniae CWL029
caaaaaaguaacu

SEQ ID NO: 2516093 - RNA, 15 nt, Chlamydophila pneumoniae CWL029
caaaaaauuuuauag

SEQ ID NO: 2516094 - RNA, 13 nt, Chlamydophila pneumoniae CWL029
caaaaacuuucga

SEQ ID NO: 2516095 - RNA, 17 nt, Chlamydophila pneumoniae CWL029
caaaaagcuucuuucuu

SEQ ID NO: 2516096 - RNA, 20 nt, Chlamydophila pneumoniae CWL029
caaaaagcuucuuucuuacu

SEQ ID NO: 2516097 - RNA, 15 nt, Chlamydophila pneumoniae CWL029
caaaaaggacucuuu

SEQ ID NO: 2516098 - RNA, 18 nt, Chlamydophila pneumoniae CWL029
caaaaaguuccauagagu

SEQ ID NO: 2516099 - RNA, 15 nt, Chlamydophila pneumoniae CWL029
caaaaaguugaggaa

SEQ ID NO: 2516100 - RNA, 19 nt, Chlamydophila pneumoniae CWL029
caaaaauaaacauauucuc

SEQ ID NO: 2516101 - RNA, 21 nt, Chlamydophila pneumoniae CWL029
caaaaauaaacauauucuccu

SEQ ID NO: 2516102 - RNA, 23 nt, Chlamydophila pneumoniae CWL029
caaaaauaaacauauucuccuua

SEQ ID NO: 2516103 - RNA, 21 nt, Chlamydophila pneumoniae CWL029
caaaaaucgugcuuagagccu

SEQ ID NO: 2516104 - RNA, 22 nt, Chlamydophila pneumoniae CWL029
caaaaaugauaccaccuaaaau

SEQ ID NO: 2516105 - RNA, 20 nt, Chlamydophila pneumoniae CWL029
caaaacagcaucaggauucu

SEQ ID NO: 2516106 - RNA, 16 nt, Chlamydophila pneumoniae CWL029
caaaacauaaccuccu

SEQ ID NO: 2516107 - RNA, 19 nt, Chlamydophila pneumoniae CWL029
caaaacauaaccuccucuu

SEQ ID NO: 2516108 - RNA, 20 nt, Chlamydophila pneumoniae CWL029
caaaacucaaggaguuuuaa

SEQ ID NO: 2516109 - RNA, 11 nt, Chlamydophila pneumoniae CWL029
caaaagaaaag

SEQ ID NO: 2516110 - RNA, 18 nt, Chlamydophila pneumoniae CWL029
caaaagaaaucaaacauu

SEQ ID NO: 2516111 - RNA, 19 nt, Chlamydophila pneumoniae CWL029
caaaagaaaucaaacauua

SEQ ID NO: 2516112 - RNA, 16 nt, Chlamydophila pneumoniae CWL029
caaaagaauuccuaaa

SEQ ID NO: 2516113 - RNA, 21 nt, Chlamydophila pneumoniae CWL029
caaaagaauuccuaaaacgag

SEQ ID NO: 2516114 - RNA, 14 nt, Chlamydophila pneumoniae CWL029
caaaagaccaaaaa

SEQ ID NO: 2516115 - RNA, 21 nt, Chlamydophila pneumoniae CWL029
caaaagccauuccauauccau

SEQ ID NO: 2516116 - RNA, 18 nt, Chlamydophila pneumoniae CWL029
caaaagcucuacaagcuc

SEQ ID NO: 2516117 - RNA, 20 nt, Chlamydophila pneumoniae CWL029
caaaaggcacaacaaugaca

SEQ ID NO: 2516118 - RNA, 17 nt, Chlamydophila pneumoniae CWL029
caaaaggcccaacucuu

SEQ ID NO: 2516119 - RNA, 18 nt, Chlamydophila pneumoniae CWL029
caaaaggcccaacucuug

SEQ ID NO: 2516120 - RNA, 15 nt, Chlamydophila pneumoniae CWL029
caaaagguuuuauaa

SEQ ID NO: 2516121 - RNA, 21 nt, Chlamydophila pneumoniae CWL029
caaaagguuuuauaaagaucg

SEQ ID NO: 2516122 - RNA, 18 nt, Chlamydophila pneumoniae CWL029
caaaagucaugaggacug

SEQ ID NO: 2516123 - RNA, 15 nt, Chlamydophila pneumoniae CWL029
caaaauaaaaggagc

SEQ ID NO: 2516124 - RNA, 15 nt, Chlamydophila pneumoniae CWL029
caaaauauucuuuca

SEQ ID NO: 2516125 - RNA, 17 nt, Chlamydophila pneumoniae CWL029
caaaaucaaaguauaua

SEQ ID NO: 2516126 - RNA, 21 nt, Chlamydophila pneumoniae CWL029
caaaauccacauccuuguaga

SEQ ID NO: 2516127 - RNA, 12 nt, Chlamydophila pneumoniae CWL029
caaaaucucuau

SEQ ID NO: 2516128 - RNA, 17 nt, Chlamydophila pneumoniae CWL029
caaaaugcgaggaaaaa

SEQ ID NO: 2516129 - RNA, 18 nt, Chlamydophila pneumoniae CWL029
caaaaugcgaggaaaaag

SEQ ID NO: 2516130 - RNA, 16 nt, Chlamydophila pneumoniae CWL029
caaaaugggauccugc

SEQ ID NO: 2516131 - RNA, 18 nt, Chlamydophila pneumoniae CWL029
caaaaugggauccugcaa

SEQ ID NO: 2516132 - RNA, 22 nt, Chlamydophila pneumoniae CWL029
caaaaugucuuuuucaauugcu

SEQ ID NO: 2516133 - RNA, 14 nt, Chlamydophila pneumoniae CWL029
caaaauguuuaucg

SEQ ID NO: 2516134 - RNA, 22 nt, Chlamydophila pneumoniae CWL029
caaaauuauguauaaacuccac

SEQ ID NO: 2516135 - RNA, 19 nt, Chlamydophila pneumoniae CWL029
caaaauucaugcaaaacaa

SEQ ID NO: 2516136 - RNA, 13 nt, Chlamydophila pneumoniae CWL029
caaacaagaagcg

SEQ ID NO: 2516137 - RNA, 16 nt, Chlamydophila pneumoniae CWL029
caaacagauuuuucaa

SEQ ID NO: 2516138 - RNA, 21 nt, Chlamydophila pneumoniae CWL029
caaacagauuuuucaagaacu

SEQ ID NO: 2516139 - RNA, 12 nt, Chlamydophila pneumoniae CWL029
caaacaucaaag

SEQ ID NO: 2516140 - RNA, 17 nt, Chlamydophila pneumoniae CWL029
caaacaucacucaggau

SEQ ID NO: 2516141 - RNA, 18 nt, Chlamydophila pneumoniae CWL029
caaacaucauuguugcug

SEQ ID NO: 2516142 - RNA, 14 nt, Chlamydophila pneumoniae CWL029
caaacauuuuuaag

SEQ ID NO: 2516143 - RNA, 16 nt, Chlamydophila pneumoniae CWL029
caaacauuuuuaagga

SEQ ID NO: 2516144 - RNA, 14 nt, Chlamydophila pneumoniae CWL029
caaaccaaaaaagu

SEQ ID NO: 2516145 - RNA, 15 nt, Chlamydophila pneumoniae CWL029
caaaccacggauuuu

SEQ ID NO: 2516146 - RNA, 20 nt, Chlamydophila pneumoniae CWL029
caaaccacggauuuucucua

SEQ ID NO: 2516147 - RNA, 21 nt, Chlamydophila pneumoniae CWL029
caaaccacggauuuucucuac

SEQ ID NO: 2516148 - RNA, 23 nt, Chlamydophila pneumoniae CWL029
caaaccaucugcguuuaaggguu

SEQ ID NO: 2516149 - RNA, 21 nt, Chlamydophila pneumoniae CWL029
caaacccauauuugaauaaag

SEQ ID NO: 2516150 - RNA, 20 nt, Chlamydophila pneumoniae CWL029
caaacccucuccagaagucg

SEQ ID NO: 2516151 - RNA, 19 nt, Chlamydophila pneumoniae CWL029
caaacccugggcucacucu

SEQ ID NO: 2516152 - RNA, 20 nt, Chlamydophila pneumoniae CWL029
caaacccugggcucacucua

SEQ ID NO: 2516153 - RNA, 13 nt, Chlamydophila pneumoniae CWL029
caaaccucuaaaa

SEQ ID NO: 2516154 - RNA, 14 nt, Chlamydophila pneumoniae CWL029
caaaccucuaaaaa

SEQ ID NO: 2516155 - RNA, 15 nt, Chlamydophila pneumoniae CWL029
caaaccucuaaaaac

SEQ ID NO: 2516156 - RNA, 12 nt, Chlamydophila pneumoniae CWL029
caaacgaauuuc

SEQ ID NO: 2516157 - RNA, 20 nt, Chlamydophila pneumoniae CWL029
caaacgaauuucuuguucca

SEQ ID NO: 2516158 - RNA, 18 nt, Chlamydophila pneumoniae CWL029
caaacgcaaugauuucuc

SEQ ID NO: 2516159 - RNA, 22 nt, Chlamydophila pneumoniae CWL029
caaacuccccaguuuuccaucc

SEQ ID NO: 2516160 - RNA, 16 nt, Chlamydophila pneumoniae CWL029
caaacuccuuuuaaaa

SEQ ID NO: 2516161 - RNA, 14 nt, Chlamydophila pneumoniae CWL029
caaacugaucugaa

SEQ ID NO: 2516162 - RNA, 16 nt, Chlamydophila pneumoniae CWL029
caaacugaucugaaau

SEQ ID NO: 2516163 - RNA, 17 nt, Chlamydophila pneumoniae CWL029
caaacugaugccaagaa

SEQ ID NO: 2516164 - RNA, 22 nt, Chlamydophila pneumoniae CWL029
caaacugauuaguuuguuuuaa

SEQ ID NO: 2516165 - RNA, 14 nt, Chlamydophila pneumoniae CWL029
caaacuucuucucg

SEQ ID NO: 2516166 - RNA, 21 nt, Chlamydophila pneumoniae CWL029
caaacuuggucauuauaguag

SEQ ID NO: 2516167 - RNA, 18 nt, Chlamydophila pneumoniae CWL029
caaacuuguuuucguaag

SEQ ID NO: 2516168 - RNA, 23 nt, Chlamydophila pneumoniae CWL029
caaacuuguuuucguaagagaau

SEQ ID NO: 2516169 - RNA, 19 nt, Chlamydophila pneumoniae CWL029
caaagaaaauucucagauu

SEQ ID NO: 2516170 - RNA, 21 nt, Chlamydophila pneumoniae CWL029
caaagaaaauucucagauugc

SEQ ID NO: 2516171 - RNA, 19 nt, Chlamydophila pneumoniae CWL029
caaagaacacccccgcagc

SEQ ID NO: 2516172 - RNA, 20 nt, Chlamydophila pneumoniae CWL029
caaagaacagcacucucugc

SEQ ID NO: 2516173 - RNA, 17 nt, Chlamydophila pneumoniae CWL029
caaagaacucaacuuuu

SEQ ID NO: 2516174 - RNA, 19 nt, Chlamydophila pneumoniae CWL029
caaagaacucaacuuuuuu

SEQ ID NO: 2516175 - RNA, 17 nt, Chlamydophila pneumoniae CWL029
aucaggacaaugaagaa

SEQ ID NO: 2516176 - RNA, 18 nt, Chlamydophila pneumoniae CWL029
aucaggauggucauacca

SEQ ID NO: 2516177 - RNA, 17 nt, Chlamydophila pneumoniae CWL029
aucaggauucuaaaaag

SEQ ID NO: 2516178 - RNA, 19 nt, Chlamydophila pneumoniae CWL029
aucaggauucuaaaaagaa

SEQ ID NO: 2516179 - RNA, 22 nt, Chlamydophila pneumoniae CWL029
aucaggauucuaaaaagaaaag

SEQ ID NO: 2516180 - RNA, 14 nt, Chlamydophila pneumoniae CWL029
aucagggacucuuu

SEQ ID NO: 2516181 - RNA, 16 nt, Chlamydophila pneumoniae CWL029
aucaguaaaagacuga

SEQ ID NO: 2516182 - RNA, 16 nt, Chlamydophila pneumoniae CWL029
aucagugcugccauga

SEQ ID NO: 2516183 - RNA, 15 nt, Chlamydophila pneumoniae CWL029
aucaguucaucuaga

SEQ ID NO: 2516184 - RNA, 12 nt, Chlamydophila pneumoniae CWL029
aucauaaacagc

SEQ ID NO: 2516185 - RNA, 17 nt, Chlamydophila pneumoniae CWL029
aucauaaccaaaagaau

SEQ ID NO: 2516186 - RNA, 22 nt, Chlamydophila pneumoniae CWL029
aucauagaugucaguaucaaua

SEQ ID NO: 2516187 - RNA, 18 nt, Chlamydophila pneumoniae CWL029
aucauagccaucauagca

SEQ ID NO: 2516188 - RNA, 13 nt, Chlamydophila pneumoniae CWL029
aucauaucuucaa

SEQ ID NO: 2516189 - RNA, 15 nt, Chlamydophila pneumoniae CWL029
aucaucgaagaacuu

SEQ ID NO: 2516190 - RNA, 21 nt, Chlamydophila pneumoniae CWL029
aucaucuacgauguuuucuua

SEQ ID NO: 2516191 - RNA, 10 nt, Chlamydophila pneumoniae CWL029
aucaucuccc

SEQ ID NO: 2516192 - RNA, 19 nt, Chlamydophila pneumoniae CWL029
aucaucucccaaauagcua

SEQ ID NO: 2516193 - RNA, 14 nt, Chlamydophila pneumoniae CWL029
aucaugaaaaggau

SEQ ID NO: 2516194 - RNA, 20 nt, Chlamydophila pneumoniae CWL029
aucaugauaaaaauuuucag

SEQ ID NO: 2516195 - RNA, 17 nt, Chlamydophila pneumoniae CWL029
aucaugcaauacuuuuc

SEQ ID NO: 2516196 - RNA, 21 nt, Chlamydophila pneumoniae CWL029
aucaugcaauacuuuucuccc

SEQ ID NO: 2516197 - RNA, 21 nt, Chlamydophila pneumoniae CWL029
aucauguagugcuucuucuau

SEQ ID NO: 2516198 - RNA, 14 nt, Chlamydophila pneumoniae CWL029
aucauuaagaagau

SEQ ID NO: 2516199 - RNA, 19 nt, Chlamydophila pneumoniae CWL029
aucauuaaggugugcuccu

SEQ ID NO: 2516200 - RNA, 18 nt, Chlamydophila pneumoniae CWL029
aucauuagcaucaucucc

SEQ ID NO: 2516201 - RNA, 11 nt, Chlamydophila pneumoniae CWL029
aucauucuuua

SEQ ID NO: 2516202 - RNA, 21 nt, Chlamydophila pneumoniae CWL029
aucauugcuauugaaaaaucc

SEQ ID NO: 2516203 - RNA, 22 nt, Chlamydophila pneumoniae CWL029
aucauuuaaagcugaaauucuu

SEQ ID NO: 2516204 - RNA, 19 nt, Chlamydophila pneumoniae CWL029
aucauuuucauagcagcua

SEQ ID NO: 2516205 - RNA, 21 nt, Chlamydophila pneumoniae CWL029
auccaaaaaagagcccaaaaa

SEQ ID NO: 2516206 - RNA, 21 nt, Chlamydophila pneumoniae CWL029
auccaaaaaaugcuccugcaa

SEQ ID NO: 2516207 - RNA, 23 nt, Chlamydophila pneumoniae CWL029
auccaaaagcggcccagaucacc

SEQ ID NO: 2516208 - RNA, 18 nt, Chlamydophila pneumoniae CWL029
auccaaaaugucuuuuuc

SEQ ID NO: 2516209 - RNA, 18 nt, Chlamydophila pneumoniae CWL029
auccaaacgguuaaugaa

SEQ ID NO: 2516210 - RNA, 21 nt, Chlamydophila pneumoniae CWL029
auccaaacgguuaaugaacuc

SEQ ID NO: 2516211 - RNA, 12 nt, Chlamydophila pneumoniae CWL029
auccaaagacuu

SEQ ID NO: 2516212 - RNA, 19 nt, Chlamydophila pneumoniae CWL029
auccaaagccugaaaaaua

SEQ ID NO: 2516213 - RNA, 19 nt, Chlamydophila pneumoniae CWL029
auccaaagcuauuucucua

SEQ ID NO: 2516214 - RNA, 22 nt, Chlamydophila pneumoniae CWL029
auccaaauugcaauuuucuaaa

SEQ ID NO: 2516215 - RNA, 15 nt, Chlamydophila pneumoniae CWL029
auccaacaaagauga

SEQ ID NO: 2516216 - RNA, 16 nt, Chlamydophila pneumoniae CWL029
auccaacaaagaugac

SEQ ID NO: 2516217 - RNA, 14 nt, Chlamydophila pneumoniae CWL029
auccaagaauagcc

SEQ ID NO: 2516218 - RNA, 17 nt, Chlamydophila pneumoniae CWL029
auccaagaauagccaua

SEQ ID NO: 2516219 - RNA, 13 nt, Chlamydophila pneumoniae CWL029
auccaagaaugaa

SEQ ID NO: 2516220 - RNA, 14 nt, Chlamydophila pneumoniae CWL029
auccaagauaccau

SEQ ID NO: 2516221 - RNA, 22 nt, Chlamydophila pneumoniae CWL029
auccaaguguucgaguucuuua

SEQ ID NO: 2516222 - RNA, 14 nt, Chlamydophila pneumoniae CWL029
auccaauagccaaa

SEQ ID NO: 2516223 - RNA, 23 nt, Chlamydophila pneumoniae CWL029
auccacagacugcaggaaauuau

SEQ ID NO: 2516224 - RNA, 20 nt, Chlamydophila pneumoniae CWL029
auccacagaucguaaucugu

SEQ ID NO: 2516225 - RNA, 22 nt, Chlamydophila pneumoniae CWL029
auccacauccuuguagaacuuc

SEQ ID NO: 2516226 - RNA, 15 nt, Chlamydophila pneumoniae CWL029
auccaccaagacuga

SEQ ID NO: 2516227 - RNA, 16 nt, Chlamydophila pneumoniae CWL029
auccacugcuuuaggc

SEQ ID NO: 2516228 - RNA, 15 nt, Chlamydophila pneumoniae CWL029
auccagacaagacac

SEQ ID NO: 2516229 - RNA, 16 nt, Chlamydophila pneumoniae CWL029
auccagacaagacacu

SEQ ID NO: 2516230 - RNA, 20 nt, Chlamydophila pneumoniae CWL029
auccagauuguucaaaaaua

SEQ ID NO: 2516231 - RNA, 21 nt, Chlamydophila pneumoniae CWL029
auccagccacccccacuucuu

SEQ ID NO: 2516232 - RNA, 15 nt, Chlamydophila pneumoniae CWL029
auccaggaauagaaa

SEQ ID NO: 2516233 - RNA, 15 nt, Chlamydophila pneumoniae CWL029
auccagguuguccua

SEQ ID NO: 2516234 - RNA, 17 nt, Chlamydophila pneumoniae CWL029
auccagguuguccuaua

SEQ ID NO: 2516235 - RNA, 19 nt, Chlamydophila pneumoniae CWL029
auccaguagaucuucugaa

SEQ ID NO: 2516236 - RNA, 21 nt, Chlamydophila pneumoniae CWL029
auccaguagaucuucugaaau

SEQ ID NO: 2516237 - RNA, 21 nt, Chlamydophila pneumoniae CWL029
auccaucggcauuucuccaca

SEQ ID NO: 2516238 - RNA, 17 nt, Chlamydophila pneumoniae CWL029
auccaugcuagaagaca

SEQ ID NO: 2516239 - RNA, 13 nt, Chlamydophila pneumoniae CWL029
auccauuuugccc

SEQ ID NO: 2516240 - RNA, 15 nt, Chlamydophila pneumoniae CWL029
aucccaaacuucuuc

SEQ ID NO: 2516241 - RNA, 23 nt, Chlamydophila pneumoniae CWL029
aucccaagggagaggucugcucu

SEQ ID NO: 2516242 - RNA, 16 nt, Chlamydophila pneumoniae CWL029
aucccaaguauggucc

SEQ ID NO: 2516243 - RNA, 19 nt, Chlamydophila pneumoniae CWL029
aucccacgggucaggaggu

SEQ ID NO: 2516244 - RNA, 23 nt, Chlamydophila pneumoniae CWL029
aucccagauaaagacaucucuuu

SEQ ID NO: 2516245 - RNA, 21 nt, Chlamydophila pneumoniae CWL029
aucccauaaauguauaggcau

SEQ ID NO: 2516246 - RNA, 16 nt, Chlamydophila pneumoniae CWL029
aucccaucaaaggcaa

SEQ ID NO: 2516247 - RNA, 17 nt, Chlamydophila pneumoniae CWL029
auccccguccuguacca

SEQ ID NO: 2516248 - RNA, 14 nt, Chlamydophila pneumoniae CWL029
auccccucagaaag

SEQ ID NO: 2516249 - RNA, 14 nt, Chlamydophila pneumoniae CWL029
aucccgaagcaauc

SEQ ID NO: 2516250 - RNA, 18 nt, Chlamydophila pneumoniae CWL029
aucccgaagcaauccagu

SEQ ID NO: 2516251 - RNA, 15 nt, Chlamydophila pneumoniae CWL029
aucccgaguccuaaa

SEQ ID NO: 2516252 - RNA, 19 nt, Chlamydophila pneumoniae CWL029
aucccuaagguuuccauga

SEQ ID NO: 2516253 - RNA, 17 nt, Chlamydophila pneumoniae CWL029
aucccuagggaaagcau

SEQ ID NO: 2516254 - RNA, 16 nt, Chlamydophila pneumoniae CWL029
aucccucaaaaucaca

SEQ ID NO: 2516255 - RNA, 18 nt, Chlamydophila pneumoniae CWL029
aucccuguaguuucuaaa

SEQ ID NO: 2516256 - RNA, 21 nt, Chlamydophila pneumoniae CWL029
aucccuguaguuucuaaaaca

SEQ ID NO: 2516257 - RNA, 12 nt, Chlamydophila pneumoniae CWL029
auccgaagacuc

SEQ ID NO: 2516258 - RNA, 17 nt, Chlamydophila pneumoniae CWL029
auccgaaucuauccaua

SEQ ID NO: 2516259 - RNA, 16 nt, Chlamydophila pneumoniae CWL029
auccgacuuuccucaa

SEQ ID NO: 2516260 - RNA, 14 nt, Chlamydophila pneumoniae CWL029
auccgauauacuua

SEQ ID NO: 2516261 - RNA, 18 nt, Chlamydophila pneumoniae CWL029
auccgcacuuacauuggc

SEQ ID NO: 2516262 - RNA, 19 nt, Chlamydophila pneumoniae CWL029
auccggaaggaguucuuuu

SEQ ID NO: 2516263 - RNA, 22 nt, Chlamydophila pneumoniae CWL029
auccguagugagguuugcaauu

SEQ ID NO: 2516264 - RNA, 21 nt, Chlamydophila pneumoniae CWL029
auccgucagccuuagcagcac

SEQ ID NO: 2516265 - RNA, 24 nt, Chlamydophila pneumoniae CWL029
auccgucagccuuagcagcaccca

SEQ ID NO: 2516266 - RNA, 15 nt, Chlamydophila pneumoniae CWL029
auccuaauuccuuca

SEQ ID NO: 2516267 - RNA, 19 nt, Chlamydophila pneumoniae CWL029
auccuacgagcgcuuucuu

SEQ ID NO: 2516268 - RNA, 17 nt, Chlamydophila pneumoniae CWL029
auccuauaguaauuucu

SEQ ID NO: 2516269 - RNA, 15 nt, Chlamydophila pneumoniae CWL029
auccucacuagagau

SEQ ID NO: 2516270 - RNA, 18 nt, Chlamydophila pneumoniae CWL029
auccucaggaccuaaggg

SEQ ID NO: 2516271 - RNA, 16 nt, Chlamydophila pneumoniae CWL029
auccucaucaucagaa

SEQ ID NO: 2516272 - RNA, 22 nt, Chlamydophila pneumoniae CWL029
auccuccuagguucuuuuuuug

SEQ ID NO: 2516273 - RNA, 15 nt, Chlamydophila pneumoniae CWL029
auccugaaaguacag

SEQ ID NO: 2516274 - RNA, 17 nt, Chlamydophila pneumoniae CWL029
auccugaaaguacagaa

SEQ ID NO: 2516275 - RNA, 22 nt, Chlamydophila pneumoniae CWL029
auccugaacaucuccagcagca

SEQ ID NO: 2516276 - RNA, 22 nt, Chlamydophila pneumoniae CWL029
auccugagaccauacacaaauc

SEQ ID NO: 2516277 - RNA, 18 nt, Chlamydophila pneumoniae CWL029
auccugaguaaaaucaua

SEQ ID NO: 2516278 - RNA, 19 nt, Chlamydophila pneumoniae CWL029
auccugcaaagcccccucc

SEQ ID NO: 2516279 - RNA, 23 nt, Chlamydophila pneumoniae CWL029
auccugcaaagcccccuccccca

SEQ ID NO: 2516280 - RNA, 18 nt, Chlamydophila pneumoniae CWL029
auccugcaauccacgcuc

SEQ ID NO: 2516281 - RNA, 20 nt, Chlamydophila pneumoniae CWL029
auccugcauacccuucuucu

SEQ ID NO: 2516282 - RNA, 15 nt, Chlamydophila pneumoniae CWL029
auccugcuccaaaau

SEQ ID NO: 2516283 - RNA, 16 nt, Chlamydophila pneumoniae CWL029
auccugcuccaaaaug

SEQ ID NO: 2516284 - RNA, 15 nt, Chlamydophila pneumoniae CWL029
auccuggagcaugag

SEQ ID NO: 2516285 - RNA, 21 nt, Chlamydophila pneumoniae CWL029
auccuguaacacccucccuca

SEQ ID NO: 2516286 - RNA, 14 nt, Chlamydophila pneumoniae CWL029
auccuguagagcaa

SEQ ID NO: 2516287 - RNA, 17 nt, Chlamydophila pneumoniae CWL029
auccuguagcuuuaugc

SEQ ID NO: 2516288 - RNA, 16 nt, Chlamydophila pneumoniae CWL029
auccuuccuuacaagc

SEQ ID NO: 2516289 - RNA, 16 nt, Chlamydophila pneumoniae CWL029
auccuucgaccuauuu

SEQ ID NO: 2516290 - RNA, 21 nt, Chlamydophila pneumoniae CWL029
auccuucuacaaugauauaaa

SEQ ID NO: 2516291 - RNA, 14 nt, Chlamydophila pneumoniae CWL029
auccuucucccucu

SEQ ID NO: 2516292 - RNA, 23 nt, Chlamydophila pneumoniae CWL029
auccuugauuuuaaaaugaccgc

SEQ ID NO: 2516293 - RNA, 19 nt, Chlamydophila pneumoniae CWL029
auccuugcaaaacagcauc

SEQ ID NO: 2516294 - RNA, 15 nt, Chlamydophila pneumoniae CWL029
auccuuucacaaaga

SEQ ID NO: 2516295 - RNA, 16 nt, Chlamydophila pneumoniae CWL029
auccuuucacaaagaa

SEQ ID NO: 2516296 - RNA, 18 nt, Chlamydophila pneumoniae CWL029
auccuuucacaaagaauu

SEQ ID NO: 2516297 - RNA, 15 nt, Chlamydophila pneumoniae CWL029
auccuuuggaagcua

SEQ ID NO: 2516298 - RNA, 20 nt, Chlamydophila pneumoniae CWL029
auccuuuggaagcuaucauu

SEQ ID NO: 2516299 - RNA, 15 nt, Chlamydophila pneumoniae CWL029
aucgaaaaauaccuc

SEQ ID NO: 2516300 - RNA, 19 nt, Chlamydophila pneumoniae CWL029
aucgaaaccacagcaaaga

SEQ ID NO: 2516301 - RNA, 22 nt, Chlamydophila pneumoniae CWL029
aucgaaucuugauauugaaaga

SEQ ID NO: 2516302 - RNA, 19 nt, Chlamydophila pneumoniae CWL029
aucgacaccuauaccaaau

SEQ ID NO: 2516303 - RNA, 21 nt, Chlamydophila pneumoniae CWL029
aucgacaggggaguuuucaaa

SEQ ID NO: 2516304 - RNA, 19 nt, Chlamydophila pneumoniae CWL029
aucgaccauccuguagcuu

SEQ ID NO: 2516305 - RNA, 15 nt, Chlamydophila pneumoniae CWL029
aucgaccuuaaaauu

SEQ ID NO: 2516306 - RNA, 13 nt, Chlamydophila pneumoniae CWL029
aucgacucuucca

SEQ ID NO: 2516307 - RNA, 23 nt, Chlamydophila pneumoniae CWL029
aucgauaacgauuucuugaagau

SEQ ID NO: 2516308 - RNA, 14 nt, Chlamydophila pneumoniae CWL029
aucgaucucugugg

SEQ ID NO: 2516309 - RNA, 15 nt, Chlamydophila pneumoniae CWL029
aucgcaaauuuccau

SEQ ID NO: 2516310 - RNA, 15 nt, Chlamydophila pneumoniae CWL029
aucgcaaucaaagag

SEQ ID NO: 2516311 - RNA, 20 nt, Chlamydophila pneumoniae CWL029
aucgcaaucagcaacaucgu

SEQ ID NO: 2516312 - RNA, 12 nt, Chlamydophila pneumoniae CWL029
aucgcacuucua

SEQ ID NO: 2516313 - RNA, 19 nt, Chlamydophila pneumoniae CWL029
aucgcacuucuauuucugc

SEQ ID NO: 2516314 - RNA, 12 nt, Chlamydophila pneumoniae CWL029
aucgcaucaaaa

SEQ ID NO: 2516315 - RNA, 20 nt, Chlamydophila pneumoniae CWL029
aucgcaucaaaaaauacaua

SEQ ID NO: 2516316 - RNA, 15 nt, Chlamydophila pneumoniae CWL029
aucgcccaauuuuua

SEQ ID NO: 2516317 - RNA, 18 nt, Chlamydophila pneumoniae CWL029
aucgccuuccuuaacaac

SEQ ID NO: 2516318 - RNA, 22 nt, Chlamydophila pneumoniae CWL029
aucggaagcgauguuccuuuuu

SEQ ID NO: 2516319 - RNA, 20 nt, Chlamydophila pneumoniae CWL029
aucggaucuuuucuuucuaa

SEQ ID NO: 2516320 - RNA, 20 nt, Chlamydophila pneumoniae CWL029
aucggauuuuacucccugaa

SEQ ID NO: 2516321 - RNA, 16 nt, Chlamydophila pneumoniae CWL029
aucggcagcagcauaa

SEQ ID NO: 2516322 - RNA, 20 nt, Chlamydophila pneumoniae CWL029
aucggcuucuccaacuucca

SEQ ID NO: 2516323 - RNA, 18 nt, Chlamydophila pneumoniae CWL029
aucgggguuucagaagga

SEQ ID NO: 2516324 - RNA, 15 nt, Chlamydophila pneumoniae CWL029
aucguacaggacugu

SEQ ID NO: 2516325 - RNA, 16 nt, Chlamydophila pneumoniae CWL029
aucgucccuaaagcuu

SEQ ID NO: 2516326 - RNA, 17 nt, Chlamydophila pneumoniae CWL029
aucgucgccuuuuccua

SEQ ID NO: 2516327 - RNA, 22 nt, Chlamydophila pneumoniae CWL029
aucgugacucuuaucuggagau

SEQ ID NO: 2516328 - RNA, 20 nt, Chlamydophila pneumoniae CWL029
aucgugauugcugucagaac

SEQ ID NO: 2516329 - RNA, 23 nt, Chlamydophila pneumoniae CWL029
aucgugauugcugucagaacaag

SEQ ID NO: 2516330 - RNA, 15 nt, Chlamydophila pneumoniae CWL029
aucguuaucaaaagg

SEQ ID NO: 2516331 - RNA, 20 nt, Chlamydophila pneumoniae CWL029
aucguuuuguggcuuuucua

SEQ ID NO: 2516332 - RNA, 19 nt, Chlamydophila pneumoniae CWL029
aucuaaaagcacuuaaaaa

SEQ ID NO: 2516333 - RNA, 14 nt, Chlamydophila pneumoniae CWL029
aucuaaaaucacac

SEQ ID NO: 2516334 - RNA, 15 nt, Chlamydophila pneumoniae CWL029
aucuaaagaaaugua

SEQ ID NO: 2516335 - RNA, 20 nt, Chlamydophila pneumoniae CWL029
aucuaaagguuuuaaauuua

SEQ ID NO: 2516336 - RNA, 19 nt, Chlamydophila pneumoniae CWL029
aucuaaccaaccuuguuga

SEQ ID NO: 2516337 - RNA, 21 nt, Chlamydophila pneumoniae CWL029
aucuaacuucaccauauaaua

SEQ ID NO: 2516338 - RNA, 18 nt, Chlamydophila pneumoniae CWL029
aucuaagaugguuauuau

SEQ ID NO: 2516339 - RNA, 23 nt, Chlamydophila pneumoniae CWL029
aucuaagccagaggcccgaagca

SEQ ID NO: 2516340 - RNA, 16 nt, Chlamydophila pneumoniae CWL029
aucuaaggcuuugccu

SEQ ID NO: 2516341 - RNA, 18 nt, Chlamydophila pneumoniae CWL029
aucuaaucaauucgcuca

SEQ ID NO: 2516342 - RNA, 17 nt, Chlamydophila pneumoniae CWL029
aucuacaaaaacuagaa

SEQ ID NO: 2516343 - RNA, 19 nt, Chlamydophila pneumoniae CWL029
aucuacaaaaacuagaaua

SEQ ID NO: 2516344 - RNA, 17 nt, Chlamydophila pneumoniae CWL029
aucuacaaacagauuuu

SEQ ID NO: 2516345 - RNA, 20 nt, Chlamydophila pneumoniae CWL029
aucuacaaacagauuuuuca

SEQ ID NO: 2516346 - RNA, 20 nt, Chlamydophila pneumoniae CWL029
aucuacaagacuacgacaga

SEQ ID NO: 2516347 - RNA, 18 nt, Chlamydophila pneumoniae CWL029
aucuacacacacgccaau

SEQ ID NO: 2516348 - RNA, 21 nt, Chlamydophila pneumoniae CWL029
aucuacacgcuauagcaacag

SEQ ID NO: 2516349 - RNA, 13 nt, Chlamydophila pneumoniae CWL029
aucuacagagaga

SEQ ID NO: 2516350 - RNA, 14 nt, Chlamydophila pneumoniae CWL029
aucuacagagagaa

SEQ ID NO: 2516351 - RNA, 18 nt, Chlamydophila pneumoniae CWL029
aucuacagagagaaacuu

SEQ ID NO: 2516352 - RNA, 18 nt, Chlamydophila pneumoniae CWL029
aucuacagcuauagaagc

SEQ ID NO: 2516353 - RNA, 21 nt, Chlamydophila pneumoniae CWL029
aucuacauauucguguaaauc

SEQ ID NO: 2516354 - RNA, 15 nt, Chlamydophila pneumoniae CWL029
aucuacucuuuaaaa

SEQ ID NO: 2516355 - RNA, 14 nt, Chlamydophila pneumoniae CWL029
aucuagaaaaugaa

SEQ ID NO: 2516356 - RNA, 14 nt, Chlamydophila pneumoniae CWL029
aucuagaaagauuu

SEQ ID NO: 2516357 - RNA, 14 nt, Chlamydophila pneumoniae CWL029
aucuagaacauaca

SEQ ID NO: 2516358 - RNA, 20 nt, Chlamydophila pneumoniae CWL029
aucuagauuuugagaaugaa

SEQ ID NO: 2516359 - RNA, 22 nt, Chlamydophila pneumoniae CWL029
aucuaggucgauaucccacaga

SEQ ID NO: 2516360 - RNA, 19 nt, Chlamydophila pneumoniae CWL029
aucuauagaauuuccaauc

SEQ ID NO: 2516361 - RNA, 23 nt, Chlamydophila pneumoniae CWL029
aucuauagcauuguuuggcaguu

SEQ ID NO: 2516362 - RNA, 18 nt, Chlamydophila pneumoniae CWL029
aucuauaggauuugcaua

SEQ ID NO: 2516363 - RNA, 21 nt, Chlamydophila pneumoniae CWL029
aucuauagucuguuuuggaaa

SEQ ID NO: 2516364 - RNA, 21 nt, Chlamydophila pneumoniae CWL029
aucuauauccacaaucucuuu

SEQ ID NO: 2516365 - RNA, 20 nt, Chlamydophila pneumoniae CWL029
aucuauccuuaggugaaaua

SEQ ID NO: 2516366 - RNA, 22 nt, Chlamydophila pneumoniae CWL029
aucuauccuuaggugaaauauu

SEQ ID NO: 2516367 - RNA, 17 nt, Chlamydophila pneumoniae CWL029
aucuaugaaguccugau

SEQ ID NO: 2516368 - RNA, 15 nt, Chlamydophila pneumoniae CWL029
aucuaugagaguaag

SEQ ID NO: 2516369 - RNA, 16 nt, Chlamydophila pneumoniae CWL029
aucucaaaaucaaaua

SEQ ID NO: 2516370 - RNA, 21 nt, Chlamydophila pneumoniae CWL029
augugcagaagguuccacaga

SEQ ID NO: 2516371 - RNA, 14 nt, Chlamydophila pneumoniae CWL029
augugcugaagacc

SEQ ID NO: 2516372 - RNA, 18 nt, Chlamydophila pneumoniae CWL029
augugcuuuugguucuug

SEQ ID NO: 2516373 - RNA, 23 nt, Chlamydophila pneumoniae CWL029
augugucuugcugauuuuugcua

SEQ ID NO: 2516374 - RNA, 17 nt, Chlamydophila pneumoniae CWL029
auguguuuccuuuucuc

SEQ ID NO: 2516375 - RNA, 23 nt, Chlamydophila pneumoniae CWL029
auguuaaaggaauaugcucuccu

SEQ ID NO: 2516376 - RNA, 18 nt, Chlamydophila pneumoniae CWL029
auguuaagcguauagaau

SEQ ID NO: 2516377 - RNA, 19 nt, Chlamydophila pneumoniae CWL029
auguuaauaagcauauuua

SEQ ID NO: 2516378 - RNA, 23 nt, Chlamydophila pneumoniae CWL029
auguuaauaagcauauuuaaaua

SEQ ID NO: 2516379 - RNA, 15 nt, Chlamydophila pneumoniae CWL029
auguuaaucuaauuu

SEQ ID NO: 2516380 - RNA, 13 nt, Chlamydophila pneumoniae CWL029
auguuaugaguuu

SEQ ID NO: 2516381 - RNA, 15 nt, Chlamydophila pneumoniae CWL029
auguuaugaguuuuu

SEQ ID NO: 2516382 - RNA, 17 nt, Chlamydophila pneumoniae CWL029
auguucucgcaaugcuu

SEQ ID NO: 2516383 - RNA, 13 nt, Chlamydophila pneumoniae CWL029
auguucucuccag

SEQ ID NO: 2516384 - RNA, 20 nt, Chlamydophila pneumoniae CWL029
auguugcuaagcgaaccaaa

SEQ ID NO: 2516385 - RNA, 15 nt, Chlamydophila pneumoniae CWL029
auguugucucauggg

SEQ ID NO: 2516386 - RNA, 14 nt, Chlamydophila pneumoniae CWL029
auguuuaaagcaua

SEQ ID NO: 2516387 - RNA, 20 nt, Chlamydophila pneumoniae CWL029
auguuucuaagcugaaagaa

SEQ ID NO: 2516388 - RNA, 20 nt, Chlamydophila pneumoniae CWL029
auguuucuuccugaaucagc

SEQ ID NO: 2516389 - RNA, 21 nt, Chlamydophila pneumoniae CWL029
auguuuguaguguugaauaag

SEQ ID NO: 2516390 - RNA, 22 nt, Chlamydophila pneumoniae CWL029
auguuuguaguguugaauaaga

SEQ ID NO: 2516391 - RNA, 15 nt, Chlamydophila pneumoniae CWL029
auuaaaaauuuaaaa

SEQ ID NO: 2516392 - RNA, 17 nt, Chlamydophila pneumoniae CWL029
auuaaaaauuuaaaaga

SEQ ID NO: 2516393 - RNA, 21 nt, Chlamydophila pneumoniae CWL029
auuaaaaguuccaaaucucaa

SEQ ID NO: 2516394 - RNA, 17 nt, Chlamydophila pneumoniae CWL029
auuaaagugaaagcaac

SEQ ID NO: 2516395 - RNA, 18 nt, Chlamydophila pneumoniae CWL029
auuaaauauauaaagaac

SEQ ID NO: 2516396 - RNA, 19 nt, Chlamydophila pneumoniae CWL029
auuaaaucguacuucacuu

SEQ ID NO: 2516397 - RNA, 22 nt, Chlamydophila pneumoniae CWL029
auuaaaucguacuucacuucug

SEQ ID NO: 2516398 - RNA, 19 nt, Chlamydophila pneumoniae CWL029
auuaaaucguauugacuuu

SEQ ID NO: 2516399 - RNA, 22 nt, Chlamydophila pneumoniae CWL029
auuaaaucguauugacuuuggu

SEQ ID NO: 2516400 - RNA, 24 nt, Chlamydophila pneumoniae CWL029
auuaaauucuuuucuacaugcuca

SEQ ID NO: 2516401 - RNA, 19 nt, Chlamydophila pneumoniae CWL029
auuaaauuguauggaauuc

SEQ ID NO: 2516402 - RNA, 20 nt, Chlamydophila pneumoniae CWL029
auuaacagagcgccuccacc

SEQ ID NO: 2516403 - RNA, 12 nt, Chlamydophila pneumoniae CWL029
auuaacuuuaua

SEQ ID NO: 2516404 - RNA, 18 nt, Chlamydophila pneumoniae CWL029
auuaacuuuauacagcug

SEQ ID NO: 2516405 - RNA, 18 nt, Chlamydophila pneumoniae CWL029
auuaagaacaucuuccca

SEQ ID NO: 2516406 - RNA, 14 nt, Chlamydophila pneumoniae CWL029
auuaagaagaagcu

SEQ ID NO: 2516407 - RNA, 11 nt, Chlamydophila pneumoniae CWL029
auuaagaagau

SEQ ID NO: 2516408 - RNA, 14 nt, Chlamydophila pneumoniae CWL029
auuaagaauggaug

SEQ ID NO: 2516409 - RNA, 15 nt, Chlamydophila pneumoniae CWL029
auuaagaauggaugu

SEQ ID NO: 2516410 - RNA, 17 nt, Chlamydophila pneumoniae CWL029
auuaagacucaauacuu

SEQ ID NO: 2516411 - RNA, 20 nt, Chlamydophila pneumoniae CWL029
auuaagacucaauacuucag

SEQ ID NO: 2516412 - RNA, 16 nt, Chlamydophila pneumoniae CWL029
auuaagauaaacagca

SEQ ID NO: 2516413 - RNA, 18 nt, Chlamydophila pneumoniae CWL029
auuaagauaaacauuaag

SEQ ID NO: 2516414 - RNA, 19 nt, Chlamydophila pneumoniae CWL029
auuaagauagacucucacu

SEQ ID NO: 2516415 - RNA, 11 nt, Chlamydophila pneumoniae CWL029
auuaagauauc

SEQ ID NO: 2516416 - RNA, 18 nt, Chlamydophila pneumoniae CWL029
auuaagauccuuuaaaga

SEQ ID NO: 2516417 - RNA, 13 nt, Chlamydophila pneumoniae CWL029
auuaauaaauuua

SEQ ID NO: 2516418 - RNA, 16 nt, Chlamydophila pneumoniae CWL029
auuaauaaauuuaucu

SEQ ID NO: 2516419 - RNA, 17 nt, Chlamydophila pneumoniae CWL029
auuaauacuuugccaac

SEQ ID NO: 2516420 - RNA, 16 nt, Chlamydophila pneumoniae CWL029
auuaauaucccaguuu

SEQ ID NO: 2516421 - RNA, 18 nt, Chlamydophila pneumoniae CWL029
auuaauccuugagggcua

SEQ ID NO: 2516422 - RNA, 19 nt, Chlamydophila pneumoniae CWL029
auuacacaacucuuucccu

SEQ ID NO: 2516423 - RNA, 18 nt, Chlamydophila pneumoniae CWL029
auuacagaaaggcuuuuc

SEQ ID NO: 2516424 - RNA, 23 nt, Chlamydophila pneumoniae CWL029
auuacagaucugcauaauuuuuc

SEQ ID NO: 2516425 - RNA, 22 nt, Chlamydophila pneumoniae CWL029
auuacagauuucuucuucagag

SEQ ID NO: 2516426 - RNA, 16 nt, Chlamydophila pneumoniae CWL029
auuacaggaaacucua

SEQ ID NO: 2516427 - RNA, 18 nt, Chlamydophila pneumoniae CWL029
auuacaggaaacucuauc

SEQ ID NO: 2516428 - RNA, 17 nt, Chlamydophila pneumoniae CWL029
auuaccguuuccuccuc

SEQ ID NO: 2516429 - RNA, 19 nt, Chlamydophila pneumoniae CWL029
auuaccuccuauuuucuua

SEQ ID NO: 2516430 - RNA, 17 nt, Chlamydophila pneumoniae CWL029
auuaccuuaucgccaac

SEQ ID NO: 2516431 - RNA, 15 nt, Chlamydophila pneumoniae CWL029
auuaccuugagacaa

SEQ ID NO: 2516432 - RNA, 23 nt, Chlamydophila pneumoniae CWL029
auuacggaaaauacagccagcag

SEQ ID NO: 2516433 - RNA, 20 nt, Chlamydophila pneumoniae CWL029
auuagaaaagauaaaacauu

SEQ ID NO: 2516434 - RNA, 14 nt, Chlamydophila pneumoniae CWL029
auuagaaguaucuu

SEQ ID NO: 2516435 - RNA, 15 nt, Chlamydophila pneumoniae CWL029
auuagaaucucugcc

SEQ ID NO: 2516436 - RNA, 13 nt, Chlamydophila pneumoniae CWL029
auuagagaauccg

SEQ ID NO: 2516437 - RNA, 17 nt, Chlamydophila pneumoniae CWL029
auuagagccccaacccu

SEQ ID NO: 2516438 - RNA, 15 nt, Chlamydophila pneumoniae CWL029
auuagaguuugguuu

SEQ ID NO: 2516439 - RNA, 13 nt, Chlamydophila pneumoniae CWL029
auuagcuaaauca

SEQ ID NO: 2516440 - RNA, 15 nt, Chlamydophila pneumoniae CWL029
auuagcuaaaucaaa

SEQ ID NO: 2516441 - RNA, 20 nt, Chlamydophila pneumoniae CWL029
auuaguaaaugccucuuuca

SEQ ID NO: 2516442 - RNA, 14 nt, Chlamydophila pneumoniae CWL029
auuaguaacuaaau

SEQ ID NO: 2516443 - RNA, 20 nt, Chlamydophila pneumoniae CWL029
auuaguagcuauucucaaau

SEQ ID NO: 2516444 - RNA, 23 nt, Chlamydophila pneumoniae CWL029
auuaguuucacauaguuuaauaa

SEQ ID NO: 2516445 - RNA, 12 nt, Chlamydophila pneumoniae CWL029
auuaguuuguuu

SEQ ID NO: 2516446 - RNA, 15 nt, Chlamydophila pneumoniae CWL029
auuauacuuuuuuua

SEQ ID NO: 2516447 - RNA, 22 nt, Chlamydophila pneumoniae CWL029
auuauauauaagaucuuucauu

SEQ ID NO: 2516448 - RNA, 17 nt, Chlamydophila pneumoniae CWL029
auuaucaagaaauucuu

SEQ ID NO: 2516449 - RNA, 19 nt, Chlamydophila pneumoniae CWL029
auuaucaagaaauucuucc

SEQ ID NO: 2516450 - RNA, 14 nt, Chlamydophila pneumoniae CWL029
auuaucagagacaa

SEQ ID NO: 2516451 - RNA, 21 nt, Chlamydophila pneumoniae CWL029
auuaucagagacaaguucauc

SEQ ID NO: 2516452 - RNA, 16 nt, Chlamydophila pneumoniae CWL029
auuaucccaaacuucu

SEQ ID NO: 2516453 - RNA, 17 nt, Chlamydophila pneumoniae CWL029
auuaucccaaacuucuu

SEQ ID NO: 2516454 - RNA, 19 nt, Chlamydophila pneumoniae CWL029
auuaucguuucaguuuuau

SEQ ID NO: 2516455 - RNA, 14 nt, Chlamydophila pneumoniae CWL029
auuaucuaagaaua

SEQ ID NO: 2516456 - RNA, 11 nt, Chlamydophila pneumoniae CWL029
auuaucuacag

SEQ ID NO: 2516457 - RNA, 12 nt, Chlamydophila pneumoniae CWL029
auuaucuccaaa

SEQ ID NO: 2516458 - RNA, 18 nt, Chlamydophila pneumoniae CWL029
auuaucuccaaagaucau

SEQ ID NO: 2516459 - RNA, 15 nt, Chlamydophila pneumoniae CWL029
auuaucuuagggaau

SEQ ID NO: 2516460 - RNA, 17 nt, Chlamydophila pneumoniae CWL029
auuaucuuguuucguaa

SEQ ID NO: 2516461 - RNA, 19 nt, Chlamydophila pneumoniae CWL029
auuaugcccaaggaaaaac

SEQ ID NO: 2516462 - RNA, 20 nt, Chlamydophila pneumoniae CWL029
auuaugcccaaggaaaaaca

SEQ ID NO: 2516463 - RNA, 15 nt, Chlamydophila pneumoniae CWL029
auuauguagaucaua

SEQ ID NO: 2516464 - RNA, 17 nt, Chlamydophila pneumoniae CWL029
auuauguagaucuacaa

SEQ ID NO: 2516465 - RNA, 17 nt, Chlamydophila pneumoniae CWL029
auuauguauaaacucca

SEQ ID NO: 2516466 - RNA, 18 nt, Chlamydophila pneumoniae CWL029
auuauuaaacgaauacug

SEQ ID NO: 2516467 - RNA, 12 nt, Chlamydophila pneumoniae CWL029
auuauuaaacuc

SEQ ID NO: 2516468 - RNA, 12 nt, Chlamydophila pneumoniae CWL029
auuauucccuaa

SEQ ID NO: 2516469 - RNA, 23 nt, Chlamydophila pneumoniae CWL029
auuauucccuaagguagagucca

SEQ ID NO: 2516470 - RNA, 15 nt, Chlamydophila pneumoniae CWL029
auuauucuagaguug

SEQ ID NO: 2516471 - RNA, 15 nt, Chlamydophila pneumoniae CWL029
auuauuucuaaaaaa

SEQ ID NO: 2516472 - RNA, 17 nt, Chlamydophila pneumoniae CWL029
auuauuucuaaaaaaua

SEQ ID NO: 2516473 - RNA, 11 nt, Chlamydophila pneumoniae CWL029
auuauuuuaaa

SEQ ID NO: 2516474 - RNA, 12 nt, Chlamydophila pneumoniae CWL029
auuauuuuaaag

SEQ ID NO: 2516475 - RNA, 13 nt, Chlamydophila pneumoniae CWL029
auuauuuuaaagu

SEQ ID NO: 2516476 - RNA, 15 nt, Chlamydophila pneumoniae CWL029
auucaaaaucaaagu

SEQ ID NO: 2516477 - RNA, 16 nt, Chlamydophila pneumoniae CWL029
auucaaacuccuuuua

SEQ ID NO: 2516478 - RNA, 20 nt, Chlamydophila pneumoniae CWL029
auucaaacuccuuuuaaaau

SEQ ID NO: 2516479 - RNA, 23 nt, Chlamydophila pneumoniae CWL029
auucaaauauaugaguuuacuaa

SEQ ID NO: 2516480 - RNA, 17 nt, Chlamydophila pneumoniae CWL029
auucaacacggacacua

SEQ ID NO: 2516481 - RNA, 17 nt, Chlamydophila pneumoniae CWL029
auucaacauguuaauaa

SEQ ID NO: 2516482 - RNA, 16 nt, Chlamydophila pneumoniae CWL029
auucaauaauuucaaa

SEQ ID NO: 2516483 - RNA, 21 nt, Chlamydophila pneumoniae CWL029
auucaauaauuucaaagaugc

SEQ ID NO: 2516484 - RNA, 18 nt, Chlamydophila pneumoniae CWL029
auucaaugagcaucugag

SEQ ID NO: 2516485 - RNA, 15 nt, Chlamydophila pneumoniae CWL029
auucaaugcagcuaa

SEQ ID NO: 2516486 - RNA, 15 nt, Chlamydophila pneumoniae CWL029
auucacaaaucuucc

SEQ ID NO: 2516487 - RNA, 15 nt, Chlamydophila pneumoniae CWL029
auucacaucuuaaaa

SEQ ID NO: 2516488 - RNA, 19 nt, Chlamydophila pneumoniae CWL029
auucacaucuuaaaaacua

SEQ ID NO: 2516489 - RNA, 18 nt, Chlamydophila pneumoniae CWL029
auucacguauagguugaa

SEQ ID NO: 2516490 - RNA, 14 nt, Chlamydophila pneumoniae CWL029
auucacuggaauga

SEQ ID NO: 2516491 - RNA, 12 nt, Chlamydophila pneumoniae CWL029
auucagagaaag

SEQ ID NO: 2516492 - RNA, 19 nt, Chlamydophila pneumoniae CWL029
auucagauggucagucucg

SEQ ID NO: 2516493 - RNA, 17 nt, Chlamydophila pneumoniae CWL029
auucaggacccuuuucc

SEQ ID NO: 2516494 - RNA, 18 nt, Chlamydophila pneumoniae CWL029
auucaggauacucugaac

SEQ ID NO: 2516495 - RNA, 16 nt, Chlamydophila pneumoniae CWL029
auucagugucuugaag

SEQ ID NO: 2516496 - RNA, 19 nt, Chlamydophila pneumoniae CWL029
auucauauuuacgaaaaca

SEQ ID NO: 2516497 - RNA, 22 nt, Chlamydophila pneumoniae CWL029
auucaugaaaugcuuucagugc

SEQ ID NO: 2516498 - RNA, 16 nt, Chlamydophila pneumoniae CWL029
auucauuaagaacauc

SEQ ID NO: 2516499 - RNA, 14 nt, Chlamydophila pneumoniae CWL029
auucauuuuuuaau

SEQ ID NO: 2516500 - RNA, 16 nt, Chlamydophila pneumoniae CWL029
auuccaaagcuaggcg

SEQ ID NO: 2516501 - RNA, 14 nt, Chlamydophila pneumoniae CWL029
auuccaacuacaua

SEQ ID NO: 2516502 - RNA, 16 nt, Chlamydophila pneumoniae CWL029
auuccaacuacauaau

SEQ ID NO: 2516503 - RNA, 15 nt, Chlamydophila pneumoniae CWL029
auuccagaaaaagaa

SEQ ID NO: 2516504 - RNA, 14 nt, Chlamydophila pneumoniae CWL029
auuccagcaucuuc

SEQ ID NO: 2516505 - RNA, 19 nt, Chlamydophila pneumoniae CWL029
auuccagcaucuucucgaa

SEQ ID NO: 2516506 - RNA, 21 nt, Chlamydophila pneumoniae CWL029
auuccaggacguaaaaagaaa

SEQ ID NO: 2516507 - RNA, 17 nt, Chlamydophila pneumoniae CWL029
auuccaggauucuauaa

SEQ ID NO: 2516508 - RNA, 23 nt, Chlamydophila pneumoniae CWL029
auuccaggauucuauaacuacaa

SEQ ID NO: 2516509 - RNA, 12 nt, Chlamydophila pneumoniae CWL029
auuccauccugu

SEQ ID NO: 2516510 - RNA, 12 nt, Chlamydophila pneumoniae CWL029
auuccauggaua

SEQ ID NO: 2516511 - RNA, 14 nt, Chlamydophila pneumoniae CWL029
auucccaagaacuu

SEQ ID NO: 2516512 - RNA, 14 nt, Chlamydophila pneumoniae CWL029
auuccccaaacuua

SEQ ID NO: 2516513 - RNA, 18 nt, Chlamydophila pneumoniae CWL029
auuccccagggagaucua

SEQ ID NO: 2516514 - RNA, 20 nt, Chlamydophila pneumoniae CWL029
auucccggaggcaaagauca

SEQ ID NO: 2516515 - RNA, 17 nt, Chlamydophila pneumoniae CWL029
auucccgggaugugguu

SEQ ID NO: 2516516 - RNA, 21 nt, Chlamydophila pneumoniae CWL029
auucccuaacaggaaagaaua

SEQ ID NO: 2516517 - RNA, 13 nt, Chlamydophila pneumoniae CWL029
auucccuccgcag

SEQ ID NO: 2516518 - RNA, 13 nt, Chlamydophila pneumoniae CWL029
auucccuccuucc

SEQ ID NO: 2516519 - RNA, 16 nt, Chlamydophila pneumoniae CWL029
auucccugacacagag

SEQ ID NO: 2516520 - RNA, 20 nt, Chlamydophila pneumoniae CWL029
auucccuuuuuccauaccca

SEQ ID NO: 2516521 - RNA, 20 nt, Chlamydophila pneumoniae CWL029
auuccguacgcuauaaauaa

SEQ ID NO: 2516522 - RNA, 16 nt, Chlamydophila pneumoniae CWL029
auuccuaaaacaagaa

SEQ ID NO: 2516523 - RNA, 13 nt, Chlamydophila pneumoniae CWL029
auuccuaaaauuu

SEQ ID NO: 2516524 - RNA, 19 nt, Chlamydophila pneumoniae CWL029
auuccuaaguuagagacac

SEQ ID NO: 2516525 - RNA, 12 nt, Chlamydophila pneumoniae CWL029
auuccuacaucu

SEQ ID NO: 2516526 - RNA, 21 nt, Chlamydophila pneumoniae CWL029
auuccuagccaucgcgaagcu

SEQ ID NO: 2516527 - RNA, 17 nt, Chlamydophila pneumoniae CWL029
auuccucucacauuugc

SEQ ID NO: 2516528 - RNA, 14 nt, Chlamydophila pneumoniae CWL029
auuccucuugaucu

SEQ ID NO: 2516529 - RNA, 20 nt, Chlamydophila pneumoniae CWL029
auuccugaggcuauagaaua

SEQ ID NO: 2516530 - RNA, 17 nt, Chlamydophila pneumoniae CWL029
auuccuuaaugguagcu

SEQ ID NO: 2516531 - RNA, 23 nt, Chlamydophila pneumoniae CWL029
auuccuucauacguuuuuuuccu

SEQ ID NO: 2516532 - RNA, 16 nt, Chlamydophila pneumoniae CWL029
auuccuucucagaaag

SEQ ID NO: 2516533 - RNA, 14 nt, Chlamydophila pneumoniae CWL029
auuccuuucuccag

SEQ ID NO: 2516534 - RNA, 21 nt, Chlamydophila pneumoniae CWL029
auucgaaaaacgguaaauauc

SEQ ID NO: 2516535 - RNA, 17 nt, Chlamydophila pneumoniae CWL029
auucgauguuaaggcuu

SEQ ID NO: 2516536 - RNA, 19 nt, Chlamydophila pneumoniae CWL029
auucgauuccugaggcuau

SEQ ID NO: 2516537 - RNA, 20 nt, Chlamydophila pneumoniae CWL029
auucgccaaacgaauuucuu

SEQ ID NO: 2516538 - RNA, 14 nt, Chlamydophila pneumoniae CWL029
auucgcuacauaaa

SEQ ID NO: 2516539 - RNA, 17 nt, Chlamydophila pneumoniae CWL029
auucgcucagaaaaugu

SEQ ID NO: 2516540 - RNA, 16 nt, Chlamydophila pneumoniae CWL029
auucgcugucuagaac

SEQ ID NO: 2516541 - RNA, 13 nt, Chlamydophila pneumoniae CWL029
auucguuauccuc

SEQ ID NO: 2516542 - RNA, 11 nt, Chlamydophila pneumoniae CWL029
auucuaaaaag

SEQ ID NO: 2516543 - RNA, 15 nt, Chlamydophila pneumoniae CWL029
auucuaaaaagaaaa

SEQ ID NO: 2516544 - RNA, 16 nt, Chlamydophila pneumoniae CWL029
auucuaaaagagcaag

SEQ ID NO: 2516545 - RNA, 22 nt, Chlamydophila pneumoniae CWL029
auucuaaaucaacuacacuuau

SEQ ID NO: 2516546 - RNA, 15 nt, Chlamydophila pneumoniae CWL029
auucuaagagauccu

SEQ ID NO: 2516547 - RNA, 18 nt, Chlamydophila pneumoniae CWL029
auucuaagcgcucuucaa

SEQ ID NO: 2516548 - RNA, 22 nt, Chlamydophila pneumoniae CWL029
auucuaaggugcuauuuuaaac

SEQ ID NO: 2516549 - RNA, 20 nt, Chlamydophila pneumoniae CWL029
auucuagaguugcuuuaugg

SEQ ID NO: 2516550 - RNA, 20 nt, Chlamydophila pneumoniae CWL029
auucuaggggagguaaaaua

SEQ ID NO: 2516551 - RNA, 22 nt, Chlamydophila pneumoniae CWL029
auucuaggggagguaaaauaaa

SEQ ID NO: 2516552 - RNA, 17 nt, Chlamydophila pneumoniae CWL029
auucuauaacuacaaaa

SEQ ID NO: 2516553 - RNA, 23 nt, Chlamydophila pneumoniae CWL029
auucuauuuauuuuauuaguuuu

SEQ ID NO: 2516554 - RNA, 14 nt, Chlamydophila pneumoniae CWL029
auucucacucuaug

SEQ ID NO: 2516555 - RNA, 13 nt, Chlamydophila pneumoniae CWL029
auucucagcuuca

SEQ ID NO: 2516556 - RNA, 17 nt, Chlamydophila pneumoniae CWL029
auucuccgccagaguuu

SEQ ID NO: 2516557 - RNA, 22 nt, Chlamydophila pneumoniae CWL029
auucuccgccguggaauagcuu

SEQ ID NO: 2516558 - RNA, 13 nt, Chlamydophila pneumoniae CWL029
auucucgaaaaau

SEQ ID NO: 2516559 - RNA, 14 nt, Chlamydophila pneumoniae CWL029
auucucgaaaaauu

SEQ ID NO: 2516560 - RNA, 17 nt, Chlamydophila pneumoniae CWL029
auucucgagcagcugca

SEQ ID NO: 2516561 - RNA, 13 nt, Chlamydophila pneumoniae CWL029
auucucugacacu

SEQ ID NO: 2516562 - RNA, 23 nt, Chlamydophila pneumoniae CWL029
auucucugacacuccucagaauc

SEQ ID NO: 2516563 - RNA, 23 nt, Chlamydophila pneumoniae CWL029
auucugaagauauauuuuuaaag

SEQ ID NO: 2516564 - RNA, 12 nt, Chlamydophila pneumoniae CWL029
auucugaagcug

SEQ ID NO: 2516565 - RNA, 14 nt, Chlamydophila pneumoniae CWL029
auucugaagcugca

SEQ ID NO: 2516566 - RNA, 15 nt, Chlamydophila pneumoniae CWL029
auucugagaaagaag

SEQ ID NO: 2516567 - RNA, 17 nt, Chlamydophila pneumoniae CWL029
auuuauuuugucuuuuu

SEQ ID NO: 2516568 - RNA, 20 nt, Chlamydophila pneumoniae CWL029
auuuauuuugucuuuuuaag

SEQ ID NO: 2516569 - RNA, 14 nt, Chlamydophila pneumoniae CWL029
auuucaaagaugca

SEQ ID NO: 2516570 - RNA, 14 nt, Chlamydophila pneumoniae CWL029
auuucaggagcucc

SEQ ID NO: 2516571 - RNA, 18 nt, Chlamydophila pneumoniae CWL029
auuucauaagagaacuuu

SEQ ID NO: 2516572 - RNA, 19 nt, Chlamydophila pneumoniae CWL029
auuuccaauccauucugag

SEQ ID NO: 2516573 - RNA, 14 nt, Chlamydophila pneumoniae CWL029
auuuccaguauucu

SEQ ID NO: 2516574 - RNA, 17 nt, Chlamydophila pneumoniae CWL029
auuucccauauagcucg

SEQ ID NO: 2516575 - RNA, 19 nt, Chlamydophila pneumoniae CWL029
auuuccuaccuauauuuuu

SEQ ID NO: 2516576 - RNA, 18 nt, Chlamydophila pneumoniae CWL029
auuuccuagguucuuuuc

SEQ ID NO: 2516577 - RNA, 19 nt, Chlamydophila pneumoniae CWL029
auuuccuagguucuuuucg

SEQ ID NO: 2516578 - RNA, 18 nt, Chlamydophila pneumoniae CWL029
auuuccugacuauaaaau

SEQ ID NO: 2516579 - RNA, 13 nt, Chlamydophila pneumoniae CWL029
auuuccuucucca

SEQ ID NO: 2516580 - RNA, 14 nt, Chlamydophila pneumoniae CWL029
auuuccuucuuuua

SEQ ID NO: 2516581 - RNA, 18 nt, Chlamydophila pneumoniae CWL029
auuucggacgauauuuag

SEQ ID NO: 2516582 - RNA, 14 nt, Chlamydophila pneumoniae CWL029
auuucuaacuuaau

SEQ ID NO: 2516583 - RNA, 19 nt, Chlamydophila pneumoniae CWL029
auuucuaacuuaauagauu

SEQ ID NO: 2516584 - RNA, 16 nt, Chlamydophila pneumoniae CWL029
auuucuagcuaauaau

SEQ ID NO: 2516585 - RNA, 22 nt, Chlamydophila pneumoniae CWL029
auuucuaggacagcacauagag

SEQ ID NO: 2516586 - RNA, 19 nt, Chlamydophila pneumoniae CWL029
auuucuauagagcaucaua

SEQ ID NO: 2516587 - RNA, 13 nt, Chlamydophila pneumoniae CWL029
auuucuauuauuu

SEQ ID NO: 2516588 - RNA, 15 nt, Chlamydophila pneumoniae CWL029
auuucuccagcagcu

SEQ ID NO: 2516589 - RNA, 18 nt, Chlamydophila pneumoniae CWL029
auuucuccgucaagaaca

SEQ ID NO: 2516590 - RNA, 19 nt, Chlamydophila pneumoniae CWL029
auuucuccgucaagaacaa

SEQ ID NO: 2516591 - RNA, 22 nt, Chlamydophila pneumoniae CWL029
auuucuccgucaagaacaagag

SEQ ID NO: 2516592 - RNA, 23 nt, Chlamydophila pneumoniae CWL029
auuucucuaagcagccucuucuc

SEQ ID NO: 2516593 - RNA, 14 nt, Chlamydophila pneumoniae CWL029
auuucucuccacag

SEQ ID NO: 2516594 - RNA, 17 nt, Chlamydophila pneumoniae CWL029
auuucuguaguucuugc

SEQ ID NO: 2516595 - RNA, 18 nt, Chlamydophila pneumoniae CWL029
auuucuguaguucuugcc

SEQ ID NO: 2516596 - RNA, 20 nt, Chlamydophila pneumoniae CWL029
auuucuguaguucuugccaa

SEQ ID NO: 2516597 - RNA, 15 nt, Chlamydophila pneumoniae CWL029
auuucuguucugcuu

SEQ ID NO: 2516598 - RNA, 14 nt, Chlamydophila pneumoniae CWL029
auuucuuaauuucc

SEQ ID NO: 2516599 - RNA, 14 nt, Chlamydophila pneumoniae CWL029
auuucuuauaaaaa

SEQ ID NO: 2516600 - RNA, 21 nt, Chlamydophila pneumoniae CWL029
auuucuucaauaggaauuaga

SEQ ID NO: 2516601 - RNA, 17 nt, Chlamydophila pneumoniae CWL029
auuucuucuuagaaaca

SEQ ID NO: 2516602 - RNA, 21 nt, Chlamydophila pneumoniae CWL029
auuucuucuuagaaacacagu

SEQ ID NO: 2516603 - RNA, 22 nt, Chlamydophila pneumoniae CWL029
auuucuucuuagaaacacaguu

SEQ ID NO: 2516604 - RNA, 13 nt, Chlamydophila pneumoniae CWL029
auuucuucuucua

SEQ ID NO: 2516605 - RNA, 14 nt, Chlamydophila pneumoniae CWL029
auuucuucuuucca

SEQ ID NO: 2516606 - RNA, 18 nt, Chlamydophila pneumoniae CWL029
auuucuugacuuguuucu

SEQ ID NO: 2516607 - RNA, 23 nt, Chlamydophila pneumoniae CWL029
auuucuugagucugaacauucuu

SEQ ID NO: 2516608 - RNA, 16 nt, Chlamydophila pneumoniae CWL029
auuucuuucacaucuu

SEQ ID NO: 2516609 - RNA, 22 nt, Chlamydophila pneumoniae CWL029
auuucuuucacaucuuuagaau

SEQ ID NO: 2516610 - RNA, 14 nt, Chlamydophila pneumoniae CWL029
auuucuuucucuuc

SEQ ID NO: 2516611 - RNA, 20 nt, Chlamydophila pneumoniae CWL029
auuugaaccuccgcccccuu

SEQ ID NO: 2516612 - RNA, 23 nt, Chlamydophila pneumoniae CWL029
auuugaauaguugugagacuuuc

SEQ ID NO: 2516613 - RNA, 13 nt, Chlamydophila pneumoniae CWL029
auuugauuuuuca

SEQ ID NO: 2516614 - RNA, 16 nt, Chlamydophila pneumoniae CWL029
auuugauuuuucaaau

SEQ ID NO: 2516615 - RNA, 23 nt, Chlamydophila pneumoniae CWL029
auuugcaagagccggaacuucag

SEQ ID NO: 2516616 - RNA, 19 nt, Chlamydophila pneumoniae CWL029
auuuguaagaaucauaaca

SEQ ID NO: 2516617 - RNA, 12 nt, Chlamydophila pneumoniae CWL029
auuugucaucac

SEQ ID NO: 2516618 - RNA, 19 nt, Chlamydophila pneumoniae CWL029
auuuguccuuugcuaagaa

SEQ ID NO: 2516619 - RNA, 19 nt, Chlamydophila pneumoniae CWL029
auuugucucagcauuuuau

SEQ ID NO: 2516620 - RNA, 22 nt, Chlamydophila pneumoniae CWL029
auuugugggacucuuccuucua

SEQ ID NO: 2516621 - RNA, 20 nt, Chlamydophila pneumoniae CWL029
auuuguugucagcuuugcuu

SEQ ID NO: 2516622 - RNA, 14 nt, Chlamydophila pneumoniae CWL029
auuuguuuagcaua

SEQ ID NO: 2516623 - RNA, 16 nt, Chlamydophila pneumoniae CWL029
auuuuaaaaucuccuc

SEQ ID NO: 2516624 - RNA, 17 nt, Chlamydophila pneumoniae CWL029
auuuuaaacuuacagcc

SEQ ID NO: 2516625 - RNA, 22 nt, Chlamydophila pneumoniae CWL029
auuuuaaacuuacagccaccuu

SEQ ID NO: 2516626 - RNA, 17 nt, Chlamydophila pneumoniae CWL029
auuuuaaagcaaaaauu

SEQ ID NO: 2516627 - RNA, 14 nt, Chlamydophila pneumoniae CWL029
auuuuaaagccucc

SEQ ID NO: 2516628 - RNA, 13 nt, Chlamydophila pneumoniae CWL029
auuuuaaagucac

SEQ ID NO: 2516629 - RNA, 18 nt, Chlamydophila pneumoniae CWL029
auuuuaaagucacuuuca

SEQ ID NO: 2516630 - RNA, 14 nt, Chlamydophila pneumoniae CWL029
auuuuaauucaaaa

SEQ ID NO: 2516631 - RNA, 14 nt, Chlamydophila pneumoniae CWL029
auuuuacgaaucuu

SEQ ID NO: 2516632 - RNA, 19 nt, Chlamydophila pneumoniae CWL029
auuuuagaacuucaaugaa

SEQ ID NO: 2516633 - RNA, 22 nt, Chlamydophila pneumoniae CWL029
auuuuagauacgcuuacaaaua

SEQ ID NO: 2516634 - RNA, 14 nt, Chlamydophila pneumoniae CWL029
auuuuagcauaauc

SEQ ID NO: 2516635 - RNA, 22 nt, Chlamydophila pneumoniae CWL029
auuuuagcuccgaggcuucuga

SEQ ID NO: 2516636 - RNA, 18 nt, Chlamydophila pneumoniae CWL029
auuuuagcuucuuuuuuu

SEQ ID NO: 2516637 - RNA, 21 nt, Chlamydophila pneumoniae CWL029
auuuuagggaugguuuccucu

SEQ ID NO: 2516638 - RNA, 13 nt, Chlamydophila pneumoniae CWL029
auuuuaguuuuca

SEQ ID NO: 2516639 - RNA, 12 nt, Chlamydophila pneumoniae CWL029
auuuucaagcuu

SEQ ID NO: 2516640 - RNA, 17 nt, Chlamydophila pneumoniae CWL029
auuuucagccugucuau

SEQ ID NO: 2516641 - RNA, 21 nt, Chlamydophila pneumoniae CWL029
auuuucagccugucuauaaaa

SEQ ID NO: 2516642 - RNA, 15 nt, Chlamydophila pneumoniae CWL029
auuuucauagcagcu

SEQ ID NO: 2516643 - RNA, 23 nt, Chlamydophila pneumoniae CWL029
auuuucaugggcagcgauauaag

SEQ ID NO: 2516644 - RNA, 15 nt, Chlamydophila pneumoniae CWL029
auuuucccaauaucc

SEQ ID NO: 2516645 - RNA, 17 nt, Chlamydophila pneumoniae CWL029
auuuucccaauauccuc

SEQ ID NO: 2516646 - RNA, 17 nt, Chlamydophila pneumoniae CWL029
auuuuccgcaaaggaaa

SEQ ID NO: 2516647 - RNA, 15 nt, Chlamydophila pneumoniae CWL029
auuuucuaaagauuu

SEQ ID NO: 2516648 - RNA, 20 nt, Chlamydophila pneumoniae CWL029
auuuucuagaaacaacugaa

SEQ ID NO: 2516649 - RNA, 21 nt, Chlamydophila pneumoniae CWL029
auuuucuauucgcugucuaga

SEQ ID NO: 2516650 - RNA, 15 nt, Chlamydophila pneumoniae CWL029
auuuucucaauagug

SEQ ID NO: 2516651 - RNA, 15 nt, Chlamydophila pneumoniae CWL029
auuuucucauagcuu

SEQ ID NO: 2516652 - RNA, 16 nt, Chlamydophila pneumoniae CWL029
auuuucucuacacaga

SEQ ID NO: 2516653 - RNA, 20 nt, Chlamydophila pneumoniae CWL029
auuuucuggugccuguaauu

SEQ ID NO: 2516654 - RNA, 21 nt, Chlamydophila pneumoniae CWL029
auuuucuuaugaccaagaaca

SEQ ID NO: 2516655 - RNA, 17 nt, Chlamydophila pneumoniae CWL029
auuuucuugucucuugc

SEQ ID NO: 2516656 - RNA, 16 nt, Chlamydophila pneumoniae CWL029
auuuugacguaaugca

SEQ ID NO: 2516657 - RNA, 14 nt, Chlamydophila pneumoniae CWL029
auuuugaugcuucu

SEQ ID NO: 2516658 - RNA, 11 nt, Chlamydophila pneumoniae CWL029
auuuuggugag

SEQ ID NO: 2516659 - RNA, 16 nt, Chlamydophila pneumoniae CWL029
auuuuggugagaucau

SEQ ID NO: 2516660 - RNA, 14 nt, Chlamydophila pneumoniae CWL029
auuuuuaaauacag

SEQ ID NO: 2516661 - RNA, 20 nt, Chlamydophila pneumoniae CWL029
auuuuuaauuuuucuaagaa

SEQ ID NO: 2516662 - RNA, 12 nt, Chlamydophila pneumoniae CWL029
auuuuuagaaua

SEQ ID NO: 2516663 - RNA, 16 nt, Chlamydophila pneumoniae CWL029
auuuuuagaauagaag

SEQ ID NO: 2516664 - RNA, 13 nt, Chlamydophila pneumoniae CWL029
auuuuuauuuccu

SEQ ID NO: 2516665 - RNA, 17 nt, Chlamydophila pneumoniae CWL029
caccagcucgagaucuu

SEQ ID NO: 2516666 - RNA, 17 nt, Chlamydophila pneumoniae CWL029
caccaggagcuccuccu

SEQ ID NO: 2516667 - RNA, 16 nt, Chlamydophila pneumoniae CWL029
caccagggguuucuaa

SEQ ID NO: 2516668 - RNA, 18 nt, Chlamydophila pneumoniae CWL029
caccagggguuucuaaau

SEQ ID NO: 2516669 - RNA, 16 nt, Chlamydophila pneumoniae CWL029
caccagguccuucugg

SEQ ID NO: 2516670 - RNA, 22 nt, Chlamydophila pneumoniae CWL029
caccauauccaugacuuuuguu

SEQ ID NO: 2516671 - RNA, 13 nt, Chlamydophila pneumoniae CWL029
caccauauucuca

SEQ ID NO: 2516672 - RNA, 21 nt, Chlamydophila pneumoniae CWL029
caccauccaaagcuauuucuc

SEQ ID NO: 2516673 - RNA, 22 nt, Chlamydophila pneumoniae CWL029
cacccaaacugaugccaagaaa

SEQ ID NO: 2516674 - RNA, 14 nt, Chlamydophila pneumoniae CWL029
cacccacuccagaa

SEQ ID NO: 2516675 - RNA, 14 nt, Chlamydophila pneumoniae CWL029
cacccccacuucuu

SEQ ID NO: 2516676 - RNA, 12 nt, Chlamydophila pneumoniae CWL029
cacccugacagg

SEQ ID NO: 2516677 - RNA, 16 nt, Chlamydophila pneumoniae CWL029
caccuaaaguuugagc

SEQ ID NO: 2516678 - RNA, 23 nt, Chlamydophila pneumoniae CWL029
caccucaauaaaucuauuccccu

SEQ ID NO: 2516679 - RNA, 23 nt, Chlamydophila pneumoniae CWL029
caccuuaauggcuccuacuccua

SEQ ID NO: 2516680 - RNA, 20 nt, Chlamydophila pneumoniae CWL029
caccuuagagugacucauca

SEQ ID NO: 2516681 - RNA, 19 nt, Chlamydophila pneumoniae CWL029
caccuugaaguuuuuucuc

SEQ ID NO: 2516682 - RNA, 21 nt, Chlamydophila pneumoniae CWL029
caccuugaaguuuuuucucuc

SEQ ID NO: 2516683 - RNA, 13 nt, Chlamydophila pneumoniae CWL029
cacgaaaaggaga

SEQ ID NO: 2516684 - RNA, 22 nt, Chlamydophila pneumoniae CWL029
cacgaauccguaccagcugaua

SEQ ID NO: 2516685 - RNA, 17 nt, Chlamydophila pneumoniae CWL029
cacgaauuucuaacuua

SEQ ID NO: 2516686 - RNA, 15 nt, Chlamydophila pneumoniae CWL029
cacgacauacaucaa

SEQ ID NO: 2516687 - RNA, 14 nt, Chlamydophila pneumoniae CWL029
cacgacgucaucac

SEQ ID NO: 2516688 - RNA, 17 nt, Chlamydophila pneumoniae CWL029
cacgagucccuucuuuc

SEQ ID NO: 2516689 - RNA, 23 nt, Chlamydophila pneumoniae CWL029
cacgaguucgcggaucuucuucu

SEQ ID NO: 2516690 - RNA, 17 nt, Chlamydophila pneumoniae CWL029
cacgaucuagaagauga

SEQ ID NO: 2516691 - RNA, 17 nt, Chlamydophila pneumoniae CWL029
cacgaucuucggaauac

SEQ ID NO: 2516692 - RNA, 14 nt, Chlamydophila pneumoniae CWL029
cacgcaacaucuca

SEQ ID NO: 2516693 - RNA, 21 nt, Chlamydophila pneumoniae CWL029
cacgcacaaacuaacauagau

SEQ ID NO: 2516694 - RNA, 14 nt, Chlamydophila pneumoniae CWL029
cacgccaaaguacu

SEQ ID NO: 2516695 - RNA, 18 nt, Chlamydophila pneumoniae CWL029
cacgccacaaguuauccu

SEQ ID NO: 2516696 - RNA, 12 nt, Chlamydophila pneumoniae CWL029
cacgccuauaga

SEQ ID NO: 2516697 - RNA, 18 nt, Chlamydophila pneumoniae CWL029
cacgccuccuucaaagau

SEQ ID NO: 2516698 - RNA, 19 nt, Chlamydophila pneumoniae CWL029
cacgccuccuucaaagaua

SEQ ID NO: 2516699 - RNA, 23 nt, Chlamydophila pneumoniae CWL029
cacgcucacgagucccuucuuuc

SEQ ID NO: 2516700 - RNA, 23 nt, Chlamydophila pneumoniae CWL029
cacgcuugugguuagaggaagca

SEQ ID NO: 2516701 - RNA, 13 nt, Chlamydophila pneumoniae CWL029
cacggaaauauuc

SEQ ID NO: 2516702 - RNA, 17 nt, Chlamydophila pneumoniae CWL029
cacggacacuauuaucu

SEQ ID NO: 2516703 - RNA, 14 nt, Chlamydophila pneumoniae CWL029
cacggacuccgucu

SEQ ID NO: 2516704 - RNA, 13 nt, Chlamydophila pneumoniae CWL029
cacggauucuaaa

SEQ ID NO: 2516705 - RNA, 17 nt, Chlamydophila pneumoniae CWL029
cacggauuuucucuaca

SEQ ID NO: 2516706 - RNA, 23 nt, Chlamydophila pneumoniae CWL029
cacggcggagaauaucaucuucc

SEQ ID NO: 2516707 - RNA, 20 nt, Chlamydophila pneumoniae CWL029
cacgggauagccgagaucuu

SEQ ID NO: 2516708 - RNA, 21 nt, Chlamydophila pneumoniae CWL029
cacgggucaggagguggugga

SEQ ID NO: 2516709 - RNA, 16 nt, Chlamydophila pneumoniae CWL029
cacguaggcauacagu

SEQ ID NO: 2516710 - RNA, 21 nt, Chlamydophila pneumoniae CWL029
cacguaggcauacaguagaaa

SEQ ID NO: 2516711 - RNA, 20 nt, Chlamydophila pneumoniae CWL029
cacgucuaagaaucguucuu

SEQ ID NO: 2516712 - RNA, 23 nt, Chlamydophila pneumoniae CWL029
cacguuacgaauguguugcucua

SEQ ID NO: 2516713 - RNA, 19 nt, Chlamydophila pneumoniae CWL029
cacguucccacgagcacaa

SEQ ID NO: 2516714 - RNA, 17 nt, Chlamydophila pneumoniae CWL029
cacguuugacaaauuua

SEQ ID NO: 2516715 - RNA, 16 nt, Chlamydophila pneumoniae CWL029
cacuaaaagggaagcu

SEQ ID NO: 2516716 - RNA, 18 nt, Chlamydophila pneumoniae CWL029
cacuaaguuuaggcagga

SEQ ID NO: 2516717 - RNA, 20 nt, Chlamydophila pneumoniae CWL029
cacuacagcuucauuaucuu

SEQ ID NO: 2516718 - RNA, 17 nt, Chlamydophila pneumoniae CWL029
cacuauacccucugcuu

SEQ ID NO: 2516719 - RNA, 21 nt, Chlamydophila pneumoniae CWL029
cacuauccggaaggaguucuu

SEQ ID NO: 2516720 - RNA, 13 nt, Chlamydophila pneumoniae CWL029
cacuaucuguaau

SEQ ID NO: 2516721 - RNA, 18 nt, Chlamydophila pneumoniae CWL029
cacuauguguuuccuuuu

SEQ ID NO: 2516722 - RNA, 20 nt, Chlamydophila pneumoniae CWL029
cacuauguguuuccuuuucu

SEQ ID NO: 2516723 - RNA, 21 nt, Chlamydophila pneumoniae CWL029
cacuauguguuuccuuuucuc

SEQ ID NO: 2516724 - RNA, 13 nt, Chlamydophila pneumoniae CWL029
cacuauuaucugc

SEQ ID NO: 2516725 - RNA, 19 nt, Chlamydophila pneumoniae CWL029
cacuauuaucugcagaaac

SEQ ID NO: 2516726 - RNA, 12 nt, Chlamydophila pneumoniae CWL029
cacucaaaagaa

SEQ ID NO: 2516727 - RNA, 14 nt, Chlamydophila pneumoniae CWL029
cacucaaacccucu

SEQ ID NO: 2516728 - RNA, 17 nt, Chlamydophila pneumoniae CWL029
cacucaaacccucucca

SEQ ID NO: 2516729 - RNA, 19 nt, Chlamydophila pneumoniae CWL029
cacucaaacccucuccaga

SEQ ID NO: 2516730 - RNA, 14 nt, Chlamydophila pneumoniae CWL029
cacucagcucccau

SEQ ID NO: 2516731 - RNA, 13 nt, Chlamydophila pneumoniae CWL029
cacuccaaaacuc

SEQ ID NO: 2516732 - RNA, 22 nt, Chlamydophila pneumoniae CWL029
cacuccagaaaguauuccucuu

SEQ ID NO: 2516733 - RNA, 12 nt, Chlamydophila pneumoniae CWL029
cacucccuaggu

SEQ ID NO: 2516734 - RNA, 18 nt, Chlamydophila pneumoniae CWL029
cacucguugccaaucuuu

SEQ ID NO: 2516735 - RNA, 13 nt, Chlamydophila pneumoniae CWL029
cacucuaagcgaa

SEQ ID NO: 2516736 - RNA, 23 nt, Chlamydophila pneumoniae CWL029
cacucuagaaaauauuccuggaa

SEQ ID NO: 2516737 - RNA, 20 nt, Chlamydophila pneumoniae CWL029
cacucuaucauaucuucaaa

SEQ ID NO: 2516738 - RNA, 17 nt, Chlamydophila pneumoniae CWL029
cacucuuucagaaagaa

SEQ ID NO: 2516739 - RNA, 13 nt, Chlamydophila pneumoniae CWL029
cacucuuucugua

SEQ ID NO: 2516740 - RNA, 12 nt, Chlamydophila pneumoniae CWL029
cacucuuuucua

SEQ ID NO: 2516741 - RNA, 18 nt, Chlamydophila pneumoniae CWL029
cacugaugaaaaagcuga

SEQ ID NO: 2516742 - RNA, 13 nt, Chlamydophila pneumoniae CWL029
cacugcgagagaa

SEQ ID NO: 2516743 - RNA, 20 nt, Chlamydophila pneumoniae CWL029
cacuggggcauaagaacucu

SEQ ID NO: 2516744 - RNA, 21 nt, Chlamydophila pneumoniae CWL029
caaagaacuuaaaauucaaau

SEQ ID NO: 2516745 - RNA, 16 nt, Chlamydophila pneumoniae CWL029
caaagaauucagagaa

SEQ ID NO: 2516746 - RNA, 17 nt, Chlamydophila pneumoniae CWL029
caaagaauucagagaaa

SEQ ID NO: 2516747 - RNA, 20 nt, Chlamydophila pneumoniae CWL029
caaagacaggcucaugaaau

SEQ ID NO: 2516748 - RNA, 14 nt, Chlamydophila pneumoniae CWL029
caaagacauccaag

SEQ ID NO: 2516749 - RNA, 20 nt, Chlamydophila pneumoniae CWL029
caaagacguaggugccugaa

SEQ ID NO: 2516750 - RNA, 23 nt, Chlamydophila pneumoniae CWL029
caaagacuagagucacuagcaga

SEQ ID NO: 2516751 - RNA, 15 nt, Chlamydophila pneumoniae CWL029
caaagagcaaaggag

SEQ ID NO: 2516752 - RNA, 22 nt, Chlamydophila pneumoniae CWL029
caaagagucucuugcuuuugua

SEQ ID NO: 2516753 - RNA, 15 nt, Chlamydophila pneumoniae CWL029
caaagaguuuuuuag

SEQ ID NO: 2516754 - RNA, 13 nt, Chlamydophila pneumoniae CWL029
caaagauauaagg

SEQ ID NO: 2516755 - RNA, 13 nt, Chlamydophila pneumoniae CWL029
caaagaucacuga

SEQ ID NO: 2516756 - RNA, 15 nt, Chlamydophila pneumoniae CWL029
caaagaucacugaga

SEQ ID NO: 2516757 - RNA, 12 nt, Chlamydophila pneumoniae CWL029
caaagauuccua

SEQ ID NO: 2516758 - RNA, 13 nt, Chlamydophila pneumoniae CWL029
caaagauuccuaa

SEQ ID NO: 2516759 - RNA, 14 nt, Chlamydophila pneumoniae CWL029
caaagauuuccaau

SEQ ID NO: 2516760 - RNA, 12 nt, Chlamydophila pneumoniae CWL029
caaagcaaagag

SEQ ID NO: 2516761 - RNA, 15 nt, Chlamydophila pneumoniae CWL029
caaagcaaagagcaa

SEQ ID NO: 2516762 - RNA, 19 nt, Chlamydophila pneumoniae CWL029
caaagcaucuuguauugcu

SEQ ID NO: 2516763 - RNA, 15 nt, Chlamydophila pneumoniae CWL029
caaagccaaauucuc

SEQ ID NO: 2516764 - RNA, 16 nt, Chlamydophila pneumoniae CWL029
caaagcccccuccccc

SEQ ID NO: 2516765 - RNA, 20 nt, Chlamydophila pneumoniae CWL029
caaagccggcccacucaaaa

SEQ ID NO: 2516766 - RNA, 20 nt, Chlamydophila pneumoniae CWL029
caaagcgucuaucuagauuu

SEQ ID NO: 2516767 - RNA, 22 nt, Chlamydophila pneumoniae CWL029
caaagcuaggcgauaguaaaca

SEQ ID NO: 2516768 - RNA, 20 nt, Chlamydophila pneumoniae CWL029
caaagcuauuucucuaucau

SEQ ID NO: 2516769 - RNA, 11 nt, Chlamydophila pneumoniae CWL029
caaaggaaggg

SEQ ID NO: 2516770 - RNA, 22 nt, Chlamydophila pneumoniae CWL029
caaaggaagggauguuuaauac

SEQ ID NO: 2516771 - RNA, 21 nt, Chlamydophila pneumoniae CWL029
caaaggaccacaauuccuaaa

SEQ ID NO: 2516772 - RNA, 15 nt, Chlamydophila pneumoniae CWL029
caaaggcaaccucug

SEQ ID NO: 2516773 - RNA, 21 nt, Chlamydophila pneumoniae CWL029
caaaggcaauagcagcagcgu

SEQ ID NO: 2516774 - RNA, 17 nt, Chlamydophila pneumoniae CWL029
caaaggguuucuuucca

SEQ ID NO: 2516775 - RNA, 20 nt, Chlamydophila pneumoniae CWL029
caaagguuuuugauugcgaa

SEQ ID NO: 2516776 - RNA, 23 nt, Chlamydophila pneumoniae CWL029
caaaguaaugugcgcacaaggga

SEQ ID NO: 2516777 - RNA, 20 nt, Chlamydophila pneumoniae CWL029
caaaguacuaauuacagaau

SEQ ID NO: 2516778 - RNA, 22 nt, Chlamydophila pneumoniae CWL029
caaaguaggauugauaaauuug

SEQ ID NO: 2516779 - RNA, 20 nt, Chlamydophila pneumoniae CWL029
caaagucaaauacuucuccu

SEQ ID NO: 2516780 - RNA, 20 nt, Chlamydophila pneumoniae CWL029
caaaguuaaugcaagcaacu

SEQ ID NO: 2516781 - RNA, 12 nt, Chlamydophila pneumoniae CWL029
caaauaaaacaa

SEQ ID NO: 2516782 - RNA, 16 nt, Chlamydophila pneumoniae CWL029
caaauaaagcaacugu

SEQ ID NO: 2516783 - RNA, 20 nt, Chlamydophila pneumoniae CWL029
caaauaagccaguacuaaau

SEQ ID NO: 2516784 - RNA, 13 nt, Chlamydophila pneumoniae CWL029
caaauaaggcugc

SEQ ID NO: 2516785 - RNA, 21 nt, Chlamydophila pneumoniae CWL029
caaauaaggcugcuaucaaca

SEQ ID NO: 2516786 - RNA, 17 nt, Chlamydophila pneumoniae CWL029
caaauaauuaaauauau

SEQ ID NO: 2516787 - RNA, 14 nt, Chlamydophila pneumoniae CWL029
caaauagauuuuua

SEQ ID NO: 2516788 - RNA, 22 nt, Chlamydophila pneumoniae CWL029
caaauagcaagagcuauaccua

SEQ ID NO: 2516789 - RNA, 21 nt, Chlamydophila pneumoniae CWL029
caaauaggaucucucuuuccu

SEQ ID NO: 2516790 - RNA, 17 nt, Chlamydophila pneumoniae CWL029
caaauaguucaucauau

SEQ ID NO: 2516791 - RNA, 21 nt, Chlamydophila pneumoniae CWL029
caaaucaucgcaaucaaagag

SEQ ID NO: 2516792 - RNA, 15 nt, Chlamydophila pneumoniae CWL029
caaaucuaaaaccug

SEQ ID NO: 2516793 - RNA, 21 nt, Chlamydophila pneumoniae CWL029
caaaucucauuccagcaucuu

SEQ ID NO: 2516794 - RNA, 19 nt, Chlamydophila pneumoniae CWL029
caaaucuuccccuaaaaau

SEQ ID NO: 2516795 - RNA, 21 nt, Chlamydophila pneumoniae CWL029
caaaugccuguacuaucuuuu

SEQ ID NO: 2516796 - RNA, 16 nt, Chlamydophila pneumoniae CWL029
caaauucaaaauagaa

SEQ ID NO: 2516797 - RNA, 18 nt, Chlamydophila pneumoniae CWL029
caaauucaaaauagaagc

SEQ ID NO: 2516798 - RNA, 14 nt, Chlamydophila pneumoniae CWL029
caaauucaaccaaa

SEQ ID NO: 2516799 - RNA, 14 nt, Chlamydophila pneumoniae CWL029
caaauuccuucuca

SEQ ID NO: 2516800 - RNA, 18 nt, Chlamydophila pneumoniae CWL029
caaauuccuucucagaaa

SEQ ID NO: 2516801 - RNA, 23 nt, Chlamydophila pneumoniae CWL029
caaauuccuucucagaaagauau

SEQ ID NO: 2516802 - RNA, 18 nt, Chlamydophila pneumoniae CWL029
cagaaagaaggucuucca

SEQ ID NO: 2516803 - RNA, 15 nt, Chlamydophila pneumoniae CWL029
cagaaagacgaucuu

SEQ ID NO: 2516804 - RNA, 16 nt, Chlamydophila pneumoniae CWL029
cagaaagagcuaaaga

SEQ ID NO: 2516805 - RNA, 17 nt, Chlamydophila pneumoniae CWL029
cagaaagagcuaaagaa

SEQ ID NO: 2516806 - RNA, 22 nt, Chlamydophila pneumoniae CWL029
cagaaagauugugcucacgaau

SEQ ID NO: 2516807 - RNA, 18 nt, Chlamydophila pneumoniae CWL029
cagaaaggagauccacag

SEQ ID NO: 2516808 - RNA, 15 nt, Chlamydophila pneumoniae CWL029
cagaaaugucgugug

SEQ ID NO: 2516809 - RNA, 20 nt, Chlamydophila pneumoniae CWL029
cagaaauuuuuacaaucucg

SEQ ID NO: 2516810 - RNA, 13 nt, Chlamydophila pneumoniae CWL029
cagaacaacgcug

SEQ ID NO: 2516811 - RNA, 21 nt, Chlamydophila pneumoniae CWL029
cagaacaacgcugcuucucua

SEQ ID NO: 2516812 - RNA, 13 nt, Chlamydophila pneumoniae CWL029
cagaagcaaaggu

SEQ ID NO: 2516813 - RNA, 21 nt, Chlamydophila pneumoniae CWL029
cagaagcaacuaaacucucca

SEQ ID NO: 2516814 - RNA, 16 nt, Chlamydophila pneumoniae CWL029
cagaagcauugaggac

SEQ ID NO: 2516815 - RNA, 20 nt, Chlamydophila pneumoniae CWL029
cagaagcauugaggacaaca

SEQ ID NO: 2516816 - RNA, 15 nt, Chlamydophila pneumoniae CWL029
cagaagcuccugagu

SEQ ID NO: 2516817 - RNA, 20 nt, Chlamydophila pneumoniae CWL029
cagaaggacccuccuuugua

SEQ ID NO: 2516818 - RNA, 15 nt, Chlamydophila pneumoniae CWL029
cagaagguaaauuuu

SEQ ID NO: 2516819 - RNA, 20 nt, Chlamydophila pneumoniae CWL029
cagaagguuccacagagacc

SEQ ID NO: 2516820 - RNA, 16 nt, Chlamydophila pneumoniae CWL029
cagaagucuuggacgu

SEQ ID NO: 2516821 - RNA, 17 nt, Chlamydophila pneumoniae CWL029
cagaagugaucuugaga

SEQ ID NO: 2516822 - RNA, 14 nt, Chlamydophila pneumoniae CWL029
cagaaguuccuacu

SEQ ID NO: 2516823 - RNA, 18 nt, Chlamydophila pneumoniae CWL029
cagaaguuccuacuucug

SEQ ID NO: 2516824 - RNA, 23 nt, Chlamydophila pneumoniae CWL029
cagaaguuccuacuucugcagga

SEQ ID NO: 2516825 - RNA, 13 nt, Chlamydophila pneumoniae CWL029
cagaaguuccuuc

SEQ ID NO: 2516826 - RNA, 21 nt, Chlamydophila pneumoniae CWL029
cagaauauagacuuguauucu

SEQ ID NO: 2516827 - RNA, 18 nt, Chlamydophila pneumoniae CWL029
cagaaucauaaucugcgu

SEQ ID NO: 2516828 - RNA, 14 nt, Chlamydophila pneumoniae CWL029
cagaaucccgugcu

SEQ ID NO: 2516829 - RNA, 19 nt, Chlamydophila pneumoniae CWL029
cagaauccugaguaaaauc

SEQ ID NO: 2516830 - RNA, 20 nt, Chlamydophila pneumoniae CWL029
cagaauccugaguaaaauca

SEQ ID NO: 2516831 - RNA, 17 nt, Chlamydophila pneumoniae CWL029
cagaaucuaaguaaaac

SEQ ID NO: 2516832 - RNA, 15 nt, Chlamydophila pneumoniae CWL029
cagaaucuaugagag

SEQ ID NO: 2516833 - RNA, 16 nt, Chlamydophila pneumoniae CWL029
cagaauguacauagag

SEQ ID NO: 2516834 - RNA, 18 nt, Chlamydophila pneumoniae CWL029
cagaauuuuaucagaaac

SEQ ID NO: 2516835 - RNA, 19 nt, Chlamydophila pneumoniae CWL029
cagaauuuuaucagaaacu

SEQ ID NO: 2516836 - RNA, 17 nt, Chlamydophila pneumoniae CWL029
cagacaagcaaggaaaa

SEQ ID NO: 2516837 - RNA, 15 nt, Chlamydophila pneumoniae CWL029
cagacacaaaaagcu

SEQ ID NO: 2516838 - RNA, 23 nt, Chlamydophila pneumoniae CWL029
cagaccuaaaaaggucagcccug

SEQ ID NO: 2516839 - RNA, 19 nt, Chlamydophila pneumoniae CWL029
cagaccucucccuugggau

SEQ ID NO: 2516840 - RNA, 20 nt, Chlamydophila pneumoniae CWL029
cagaccucucccuugggauu

SEQ ID NO: 2516841 - RNA, 22 nt, Chlamydophila pneumoniae CWL029
cagacucgccgaaaguaucuuc

SEQ ID NO: 2516842 - RNA, 22 nt, Chlamydophila pneumoniae CWL029
cagacugaagucguuuagauuu

SEQ ID NO: 2516843 - RNA, 12 nt, Chlamydophila pneumoniae CWL029
cagagaaaauca

SEQ ID NO: 2516844 - RNA, 15 nt, Chlamydophila pneumoniae CWL029
cagagaaaaucaacu

SEQ ID NO: 2516845 - RNA, 23 nt, Chlamydophila pneumoniae CWL029
cagagaaauuaacagagcgccuc

SEQ ID NO: 2516846 - RNA, 18 nt, Chlamydophila pneumoniae CWL029
cagagaauguucccaaau

SEQ ID NO: 2516847 - RNA, 14 nt, Chlamydophila pneumoniae CWL029
cagagaccuucucu

SEQ ID NO: 2516848 - RNA, 21 nt, Chlamydophila pneumoniae CWL029
cagagacuuccucuucaauuu

SEQ ID NO: 2516849 - RNA, 22 nt, Chlamydophila pneumoniae CWL029
cagagacuuccucuucaauuuc

SEQ ID NO: 2516850 - RNA, 14 nt, Chlamydophila pneumoniae CWL029
cagagagaacagga

SEQ ID NO: 2516851 - RNA, 17 nt, Chlamydophila pneumoniae CWL029
cagagaugcuaacaacu

SEQ ID NO: 2516852 - RNA, 22 nt, Chlamydophila pneumoniae CWL029
cagcuaauuuaaaugccuuaaa

SEQ ID NO: 2516853 - RNA, 19 nt, Chlamydophila pneumoniae CWL029
cagcuagagcacauagaaa

SEQ ID NO: 2516854 - RNA, 21 nt, Chlamydophila pneumoniae CWL029
cagcuauagauuuaagagucu

SEQ ID NO: 2516855 - RNA, 12 nt, Chlamydophila pneumoniae CWL029
cagcuccauaag

SEQ ID NO: 2516856 - RNA, 19 nt, Chlamydophila pneumoniae CWL029
cagcuccauaagcuuuucu

SEQ ID NO: 2516857 - RNA, 16 nt, Chlamydophila pneumoniae CWL029
cagcuccauuuaaaug

SEQ ID NO: 2516858 - RNA, 18 nt, Chlamydophila pneumoniae CWL029
cagcucccaugugcugaa

SEQ ID NO: 2516859 - RNA, 23 nt, Chlamydophila pneumoniae CWL029
cagcucucuugauugcuaucaaa

SEQ ID NO: 2516860 - RNA, 17 nt, Chlamydophila pneumoniae CWL029
cagcugauauccuugcu

SEQ ID NO: 2516861 - RNA, 15 nt, Chlamydophila pneumoniae CWL029
cagcuucgcaaucuu

SEQ ID NO: 2516862 - RNA, 16 nt, Chlamydophila pneumoniae CWL029
cagcuucgcaaucuuu

SEQ ID NO: 2516863 - RNA, 15 nt, Chlamydophila pneumoniae CWL029
cagcuucuacagcau

SEQ ID NO: 2516864 - RNA, 17 nt, Chlamydophila pneumoniae CWL029
cagcuucuauugcugua

SEQ ID NO: 2516865 - RNA, 21 nt, Chlamydophila pneumoniae CWL029
cagcuucucuaguuguaauuu

SEQ ID NO: 2516866 - RNA, 17 nt, Chlamydophila pneumoniae CWL029
cagcuucuggagaaaaa

SEQ ID NO: 2516867 - RNA, 20 nt, Chlamydophila pneumoniae CWL029
cagcuucuugauguacagua

SEQ ID NO: 2516868 - RNA, 17 nt, Chlamydophila pneumoniae CWL029
cagcuuuagcuuuuacu

SEQ ID NO: 2516869 - RNA, 17 nt, Chlamydophila pneumoniae CWL029
cagcuuuaucaggaucu

SEQ ID NO: 2516870 - RNA, 22 nt, Chlamydophila pneumoniae CWL029
cagcuuuaucaggaucuugauu

SEQ ID NO: 2516871 - RNA, 23 nt, Chlamydophila pneumoniae CWL029
cagcuuugcuuaaaaagucugaa

SEQ ID NO: 2516872 - RNA, 14 nt, Chlamydophila pneumoniae CWL029
caggaaaagcaaaa

SEQ ID NO: 2516873 - RNA, 17 nt, Chlamydophila pneumoniae CWL029
caggaaagaauaggggu

SEQ ID NO: 2516874 - RNA, 12 nt, Chlamydophila pneumoniae CWL029
caggaaauuccg

SEQ ID NO: 2516875 - RNA, 17 nt, Chlamydophila pneumoniae CWL029
caggaaguccauguaca

SEQ ID NO: 2516876 - RNA, 16 nt, Chlamydophila pneumoniae CWL029
caggaauaaucaacca

SEQ ID NO: 2516877 - RNA, 23 nt, Chlamydophila pneumoniae CWL029
caggaaucacuguaucagcaagc

SEQ ID NO: 2516878 - RNA, 15 nt, Chlamydophila pneumoniae CWL029
caggacaugccuuag

SEQ ID NO: 2516879 - RNA, 20 nt, Chlamydophila pneumoniae CWL029
caggaccuaagggcucuccu

SEQ ID NO: 2516880 - RNA, 17 nt, Chlamydophila pneumoniae CWL029
caggaccugugaguaaa

SEQ ID NO: 2516881 - RNA, 20 nt, Chlamydophila pneumoniae CWL029
caggaccugugaguaaaaug

SEQ ID NO: 2516882 - RNA, 16 nt, Chlamydophila pneumoniae CWL029
caggacgcacauuuag

SEQ ID NO: 2516883 - RNA, 14 nt, Chlamydophila pneumoniae CWL029
caggacuucgcaaa

SEQ ID NO: 2516884 - RNA, 20 nt, Chlamydophila pneumoniae CWL029
caggagaacaauaucagcag

SEQ ID NO: 2516885 - RNA, 23 nt, Chlamydophila pneumoniae CWL029
caggagagagaaggcucucaagg

SEQ ID NO: 2516886 - RNA, 16 nt, Chlamydophila pneumoniae CWL029
caggagcuagaagagc

SEQ ID NO: 2516887 - RNA, 17 nt, Chlamydophila pneumoniae CWL029
caggagcuagaagagcg

SEQ ID NO: 2516888 - RNA, 14 nt, Chlamydophila pneumoniae CWL029
caggagcuccuccu

SEQ ID NO: 2516889 - RNA, 15 nt, Chlamydophila pneumoniae CWL029
caggagcuccuccuu

SEQ ID NO: 2516890 - RNA, 12 nt, Chlamydophila pneumoniae CWL029
caggagcuccug

SEQ ID NO: 2516891 - RNA, 17 nt, Chlamydophila pneumoniae CWL029
caggagcuccugcggau

SEQ ID NO: 2516892 - RNA, 11 nt, Chlamydophila pneumoniae CWL029
caggaggcgcg

SEQ ID NO: 2516893 - RNA, 20 nt, Chlamydophila pneumoniae CWL029
caggaggugguggagcuugu

SEQ ID NO: 2516894 - RNA, 22 nt, Chlamydophila pneumoniae CWL029
caggaguuccgcggccaucauu

SEQ ID NO: 2516895 - RNA, 16 nt, Chlamydophila pneumoniae CWL029
caggaguucuugauuc

SEQ ID NO: 2516896 - RNA, 22 nt, Chlamydophila pneumoniae CWL029
caggauacucugaacaggaaua

SEQ ID NO: 2516897 - RNA, 17 nt, Chlamydophila pneumoniae CWL029
caggauauugcggaaau

SEQ ID NO: 2516898 - RNA, 22 nt, Chlamydophila pneumoniae CWL029
caggaucccaaguaugguccau

SEQ ID NO: 2516899 - RNA, 19 nt, Chlamydophila pneumoniae CWL029
caggauuacggaaaauaca

SEQ ID NO: 2516900 - RNA, 18 nt, Chlamydophila pneumoniae CWL029
caggauucuaaaaagaaa

SEQ ID NO: 2516901 - RNA, 19 nt, Chlamydophila pneumoniae CWL029
caggauucuauaacuacaa

SEQ ID NO: 2516902 - RNA, 15 nt, Chlamydophila pneumoniae CWL029
caggauuuuccauua

SEQ ID NO: 2516903 - RNA, 13 nt, Chlamydophila pneumoniae CWL029
caggcauucuuca

SEQ ID NO: 2516904 - RNA, 18 nt, Chlamydophila pneumoniae CWL029
caggccuggugcuuaaaa

SEQ ID NO: 2516905 - RNA, 14 nt, Chlamydophila pneumoniae CWL029
caggcucaugaaau

SEQ ID NO: 2516906 - RNA, 19 nt, Chlamydophila pneumoniae CWL029
caggcugcgcuacacccag

SEQ ID NO: 2516907 - RNA, 14 nt, Chlamydophila pneumoniae CWL029
cagggaaagaacag

SEQ ID NO: 2516908 - RNA, 14 nt, Chlamydophila pneumoniae CWL029
cagggaauagguag

SEQ ID NO: 2516909 - RNA, 21 nt, Chlamydophila pneumoniae CWL029
cagggaauccuguaacacccu

SEQ ID NO: 2516910 - RNA, 19 nt, Chlamydophila pneumoniae CWL029
cagggacucuuuccauagc

SEQ ID NO: 2516911 - RNA, 23 nt, Chlamydophila pneumoniae CWL029
cagggagaucuacgccuucaagu

SEQ ID NO: 2516912 - RNA, 22 nt, Chlamydophila pneumoniae CWL029
cagggccugagaccauaaaauc

SEQ ID NO: 2516913 - RNA, 14 nt, Chlamydophila pneumoniae CWL029
caggggauaaaacu

SEQ ID NO: 2516914 - RNA, 23 nt, Chlamydophila pneumoniae CWL029
caggggaugugauguucugcugc

SEQ ID NO: 2516915 - RNA, 17 nt, Chlamydophila pneumoniae CWL029
cagguaagggaugcucu

SEQ ID NO: 2516916 - RNA, 21 nt, Chlamydophila pneumoniae CWL029
cagguaagggaugcucuagaa

SEQ ID NO: 2516917 - RNA, 21 nt, Chlamydophila pneumoniae CWL029
cagguagauccuauaguaauu

SEQ ID NO: 2516918 - RNA, 16 nt, Chlamydophila pneumoniae CWL029
cagguagucccuuucu

SEQ ID NO: 2516919 - RNA, 22 nt, Chlamydophila pneumoniae CWL029
cagguagucccuuucuauuuca

SEQ ID NO: 2516920 - RNA, 20 nt, Chlamydophila pneumoniae CWL029
caggucguaaacggacgcua

SEQ ID NO: 2516921 - RNA, 15 nt, Chlamydophila pneumoniae CWL029
caggucugcugagga

SEQ ID NO: 2516922 - RNA, 19 nt, Chlamydophila pneumoniae CWL029
caggugcggaacucaucac

SEQ ID NO: 2516923 - RNA, 18 nt, Chlamydophila pneumoniae CWL029
cagguucacuucaucgac

SEQ ID NO: 2516924 - RNA, 16 nt, Chlamydophila pneumoniae CWL029
caguaaaacacaaaua

SEQ ID NO: 2516925 - RNA, 21 nt, Chlamydophila pneumoniae CWL029
caguaauguuaacgaauugcu

SEQ ID NO: 2516926 - RNA, 14 nt, Chlamydophila pneumoniae CWL029
caguaauuccaaaa

SEQ ID NO: 2516927 - RNA, 16 nt, Chlamydophila pneumoniae CWL029
caguaauuccaaaaua

SEQ ID NO: 2516928 - RNA, 20 nt, Chlamydophila pneumoniae CWL029
caguagagccucuaagaaaa

SEQ ID NO: 2516929 - RNA, 21 nt, Chlamydophila pneumoniae CWL029
caguagagccucuaagaaaau

SEQ ID NO: 2516930 - RNA, 17 nt, Chlamydophila pneumoniae CWL029
caguagaggaauucugg

SEQ ID NO: 2516931 - RNA, 22 nt, Chlamydophila pneumoniae CWL029
caguaggagcagcggcacccuc

SEQ ID NO: 2516932 - RNA, 22 nt, Chlamydophila pneumoniae CWL029
caguaggcgaugcaaauuccag

SEQ ID NO: 2516933 - RNA, 14 nt, Chlamydophila pneumoniae CWL029
caguagguaagaag

SEQ ID NO: 2516934 - RNA, 19 nt, Chlamydophila pneumoniae CWL029
caguagguaagaagcuguc

SEQ ID NO: 2516935 - RNA, 13 nt, Chlamydophila pneumoniae CWL029
caguauagagaag

SEQ ID NO: 2516936 - RNA, 19 nt, Chlamydophila pneumoniae CWL029
caguaucaauaaucggccg

SEQ ID NO: 2516937 - RNA, 20 nt, Chlamydophila pneumoniae CWL029
caguauggcguuuuuuuuga

SEQ ID NO: 2516938 - RNA, 15 nt, Chlamydophila pneumoniae CWL029
caguauuauaaauag

SEQ ID NO: 2516939 - RNA, 23 nt, Chlamydophila pneumoniae CWL029
caguauuauaaauagaaaucuua

SEQ ID NO: 2516940 - RNA, 23 nt, Chlamydophila pneumoniae CWL029
caguauuccaucacaguuaagac

SEQ ID NO: 2516941 - RNA, 22 nt, Chlamydophila pneumoniae CWL029
cagucucauggauuacugaaga

SEQ ID NO: 2516942 - RNA, 14 nt, Chlamydophila pneumoniae CWL029
cagucuccuggaac

SEQ ID NO: 2516943 - RNA, 22 nt, Chlamydophila pneumoniae CWL029
cagucuccuggaacaguauaau

SEQ ID NO: 2516944 - RNA, 23 nt, Chlamydophila pneumoniae CWL029
cagucuugcgccagcaaagauua

SEQ ID NO: 2516945 - RNA, 18 nt, Chlamydophila pneumoniae CWL029
cagugaaauuuugcaaca

SEQ ID NO: 2516946 - RNA, 18 nt, Chlamydophila pneumoniae CWL029
caguggcuuauagagaga

SEQ ID NO: 2516947 - RNA, 23 nt, Chlamydophila pneumoniae CWL029
caguguccacugcagcagguguc

SEQ ID NO: 2516948 - RNA, 21 nt, Chlamydophila pneumoniae CWL029
caguguuauuuggacguacua

SEQ ID NO: 2516949 - RNA, 14 nt, Chlamydophila pneumoniae CWL029
caguuaaagagcau

SEQ ID NO: 2516950 - RNA, 20 nt, Chlamydophila pneumoniae CWL029
caguuccuaaagcuuuugcu

SEQ ID NO: 2516951 - RNA, 15 nt, Chlamydophila pneumoniae CWL029
caguuccuaaauuca

SEQ ID NO: 2516952 - RNA, 13 nt, Chlamydophila pneumoniae CWL029
caguuccuauuuu

SEQ ID NO: 2516953 - RNA, 15 nt, Chlamydophila pneumoniae CWL029
caguuccuauuuuuu

SEQ ID NO: 2516954 - RNA, 16 nt, Chlamydophila pneumoniae CWL029
caguuccuauuuuuug

SEQ ID NO: 2516955 - RNA, 15 nt, Chlamydophila pneumoniae CWL029
caguucgacaaccaa

SEQ ID NO: 2516956 - RNA, 11 nt, Chlamydophila pneumoniae CWL029
caguucuucau

SEQ ID NO: 2516957 - RNA, 20 nt, Chlamydophila pneumoniae CWL029
caguugcgcgcccucuucua

SEQ ID NO: 2516958 - RNA, 18 nt, Chlamydophila pneumoniae CWL029
caguuggcguuuucuaga

SEQ ID NO: 2516959 - RNA, 21 nt, Chlamydophila pneumoniae CWL029
caguugguagagcaacacauu

SEQ ID NO: 2516960 - RNA, 17 nt, Chlamydophila pneumoniae CWL029
caguuguacaauuugcu

SEQ ID NO: 2516961 - RNA, 22 nt, Chlamydophila pneumoniae CWL029
caguuguauccagcucaaggca

SEQ ID NO: 2516962 - RNA, 12 nt, Chlamydophila pneumoniae CWL029
caguuguuucua

SEQ ID NO: 2516963 - RNA, 23 nt, Chlamydophila pneumoniae CWL029
caguuugagaaagaccaccuucc

SEQ ID NO: 2516964 - RNA, 15 nt, Chlamydophila pneumoniae CWL029
caguuuuccauccac

SEQ ID NO: 2516965 - RNA, 14 nt, Chlamydophila pneumoniae CWL029
cauaaaaaaagcua

SEQ ID NO: 2516966 - RNA, 17 nt, Chlamydophila pneumoniae CWL029
cauaaaaauguaauuuu

SEQ ID NO: 2516967 - RNA, 15 nt, Chlamydophila pneumoniae CWL029
cauaaaaauucucau

SEQ ID NO: 2516968 - RNA, 14 nt, Chlamydophila pneumoniae CWL029
cauaaaaauuucau

SEQ ID NO: 2516969 - RNA, 19 nt, Chlamydophila pneumoniae CWL029
cauaaacuccuaggggaau

SEQ ID NO: 2516970 - RNA, 19 nt, Chlamydophila pneumoniae CWL029
cauaaagacccuucuuucc

SEQ ID NO: 2516971 - RNA, 18 nt, Chlamydophila pneumoniae CWL029
cauaaagaucuuuauuuu

SEQ ID NO: 2516972 - RNA, 21 nt, Chlamydophila pneumoniae CWL029
cauaaagaucuuuauuuuuaa

SEQ ID NO: 2516973 - RNA, 23 nt, Chlamydophila pneumoniae CWL029
cauaaagccccacccacuccaga

SEQ ID NO: 2516974 - RNA, 19 nt, Chlamydophila pneumoniae CWL029
cauaaaggcucuuuuagag

SEQ ID NO: 2516975 - RNA, 20 nt, Chlamydophila pneumoniae CWL029
cauaaaguauauugacaaca

SEQ ID NO: 2516976 - RNA, 21 nt, Chlamydophila pneumoniae CWL029
cauaaaguucggcgccuucaa

SEQ ID NO: 2516977 - RNA, 22 nt, Chlamydophila pneumoniae CWL029
cauaaaguucggcgccuucaaa

SEQ ID NO: 2516978 - RNA, 20 nt, Chlamydophila pneumoniae CWL029
cauaaauaggcucuacagga

SEQ ID NO: 2516979 - RNA, 21 nt, Chlamydophila pneumoniae CWL029
cauaaauaggcucuacaggag

SEQ ID NO: 2516980 - RNA, 21 nt, Chlamydophila pneumoniae CWL029
cauaaauguauaggcauuaau

SEQ ID NO: 2516981 - RNA, 19 nt, Chlamydophila pneumoniae CWL029
cauaacaagggaagagaaa

SEQ ID NO: 2516982 - RNA, 17 nt, Chlamydophila pneumoniae CWL029
cauaacaagucuaucga

SEQ ID NO: 2516983 - RNA, 18 nt, Chlamydophila pneumoniae CWL029
cauaacauuuagauaaag

SEQ ID NO: 2516984 - RNA, 17 nt, Chlamydophila pneumoniae CWL029
cauaaccaaguaaauca

SEQ ID NO: 2516985 - RNA, 12 nt, Chlamydophila pneumoniae CWL029
cauaacccaaag

SEQ ID NO: 2516986 - RNA, 17 nt, Chlamydophila pneumoniae CWL029
cauaaccuccucuucuu

SEQ ID NO: 2516987 - RNA, 18 nt, Chlamydophila pneumoniae CWL029
cauaaccucggucucgcu

SEQ ID NO: 2516988 - RNA, 13 nt, Chlamydophila pneumoniae CWL029
cauaaccugggca

SEQ ID NO: 2516989 - RNA, 19 nt, Chlamydophila pneumoniae CWL029
cauaaccugggcaauauuu

SEQ ID NO: 2516990 - RNA, 20 nt, Chlamydophila pneumoniae CWL029
cauaaccugggcaauauuuu

SEQ ID NO: 2516991 - RNA, 20 nt, Chlamydophila pneumoniae CWL029
cauaaccuuugacaacacca

SEQ ID NO: 2516992 - RNA, 11 nt, Chlamydophila pneumoniae CWL029
cauaacugugc

SEQ ID NO: 2516993 - RNA, 19 nt, Chlamydophila pneumoniae CWL029
cauaagaacucuauuuggc

SEQ ID NO: 2516994 - RNA, 21 nt, Chlamydophila pneumoniae CWL029
cauaagauugccauguacaug

SEQ ID NO: 2516995 - RNA, 16 nt, Chlamydophila pneumoniae CWL029
cauaagauuuccccaa

SEQ ID NO: 2516996 - RNA, 15 nt, Chlamydophila pneumoniae CWL029
cauaagcucuauuuc

SEQ ID NO: 2516997 - RNA, 17 nt, Chlamydophila pneumoniae CWL029
cauaagcuuuucuucca

SEQ ID NO: 2516998 - RNA, 15 nt, Chlamydophila pneumoniae CWL029
cauaaguauagagag

SEQ ID NO: 2516999 - RNA, 20 nt, Chlamydophila pneumoniae CWL029
cauaauaagcaggaaaagca

SEQ ID NO: 2517000 - RNA, 21 nt, Chlamydophila pneumoniae CWL029
cauaauaagcaggaaaagcaa

SEQ ID NO: 2517001 - RNA, 20 nt, Chlamydophila pneumoniae CWL029
cauaauauaauaguggcuau

SEQ ID NO: 2517002 - RNA, 21 nt, Chlamydophila pneumoniae CWL029
cauaaucacacucguagccuu

SEQ ID NO: 2517003 - RNA, 15 nt, Chlamydophila pneumoniae CWL029
cauaaucucaccaga

SEQ ID NO: 2517004 - RNA, 16 nt, Chlamydophila pneumoniae CWL029
cauaaugagacagaca

SEQ ID NO: 2517005 - RNA, 17 nt, Chlamydophila pneumoniae CWL029
cauaaugagacagacag

SEQ ID NO: 2517006 - RNA, 16 nt, Chlamydophila pneumoniae CWL029
cauaauuagagagaau

SEQ ID NO: 2517007 - RNA, 13 nt, Chlamydophila pneumoniae CWL029
cauaauucugcac

SEQ ID NO: 2517008 - RNA, 14 nt, Chlamydophila pneumoniae CWL029
cauaauuuuucuua

SEQ ID NO: 2517009 - RNA, 17 nt, Chlamydophila pneumoniae CWL029
cauacacaaaucauuua

SEQ ID NO: 2517010 - RNA, 17 nt, Chlamydophila pneumoniae CWL029
cauacaccccaguuucu

SEQ ID NO: 2517011 - RNA, 19 nt, Chlamydophila pneumoniae CWL029
cauacaccccaguuucuug

SEQ ID NO: 2517012 - RNA, 16 nt, Chlamydophila pneumoniae CWL029
cauacaguagaaacau

SEQ ID NO: 2517013 - RNA, 18 nt, Chlamydophila pneumoniae CWL029
cauacaucguauccaaau

SEQ ID NO: 2517014 - RNA, 18 nt, Chlamydophila pneumoniae CWL029
cauacaugcuaauccagc

SEQ ID NO: 2517015 - RNA, 19 nt, Chlamydophila pneumoniae CWL029
cauacaugcuaauccagca

SEQ ID NO: 2517016 - RNA, 15 nt, Chlamydophila pneumoniae CWL029
cauacauucuauucu

SEQ ID NO: 2517017 - RNA, 13 nt, Chlamydophila pneumoniae CWL029
cauacccaaauuu

SEQ ID NO: 2517018 - RNA, 18 nt, Chlamydophila pneumoniae CWL029
cauacccuucuucuucag

SEQ ID NO: 2517019 - RNA, 13 nt, Chlamydophila pneumoniae CWL029
cauacgacaguaa

SEQ ID NO: 2517020 - RNA, 21 nt, Chlamydophila pneumoniae CWL029
cauacgccgugccuauagaaa

SEQ ID NO: 2517021 - RNA, 23 nt, Chlamydophila pneumoniae CWL029
cauacgccgugccuauagaaauu

SEQ ID NO: 2517022 - RNA, 12 nt, Chlamydophila pneumoniae CWL029
cauacgguauac

SEQ ID NO: 2517023 - RNA, 15 nt, Chlamydophila pneumoniae CWL029
cauacucgucaaauu

SEQ ID NO: 2517024 - RNA, 14 nt, Chlamydophila pneumoniae CWL029
cauacucuucaucc

SEQ ID NO: 2517025 - RNA, 18 nt, Chlamydophila pneumoniae CWL029
cauacucuucauccugau

SEQ ID NO: 2517026 - RNA, 13 nt, Chlamydophila pneumoniae CWL029
cauacugauauac

SEQ ID NO: 2517027 - RNA, 14 nt, Chlamydophila pneumoniae CWL029
cauacugauauaca

SEQ ID NO: 2517028 - RNA, 15 nt, Chlamydophila pneumoniae CWL029
cauacuuauccuuuu

SEQ ID NO: 2517029 - RNA, 16 nt, Chlamydophila pneumoniae CWL029
cauacuuauccuuuuc

SEQ ID NO: 2517030 - RNA, 11 nt, Chlamydophila pneumoniae CWL029
cauagaauaaa

SEQ ID NO: 2517031 - RNA, 22 nt, Chlamydophila pneumoniae CWL029
cauagaauccucggaagauaaa

SEQ ID NO: 2517032 - RNA, 15 nt, Chlamydophila pneumoniae CWL029
cauagacucuuccuu

SEQ ID NO: 2517033 - RNA, 18 nt, Chlamydophila pneumoniae CWL029
cauagagauaucaucaaa

SEQ ID NO: 2517034 - RNA, 21 nt, Chlamydophila pneumoniae CWL029
cauagagauaucaucaaaaga

SEQ ID NO: 2517035 - RNA, 15 nt, Chlamydophila pneumoniae CWL029
cauagagauucuaca

SEQ ID NO: 2517036 - RNA, 19 nt, Chlamydophila pneumoniae CWL029
cauagaggagauccuaaga

SEQ ID NO: 2517037 - RNA, 20 nt, Chlamydophila pneumoniae CWL029
cauagaguucgcacuaauuu

SEQ ID NO: 2517038 - RNA, 14 nt, Chlamydophila pneumoniae CWL029
cauagcaacuacag

SEQ ID NO: 2517039 - RNA, 16 nt, Chlamydophila pneumoniae CWL029
cauagcagcuauacgu

SEQ ID NO: 2517040 - RNA, 23 nt, Chlamydophila pneumoniae CWL029
cauagccaucauagcaaacggaa

SEQ ID NO: 2517041 - RNA, 20 nt, Chlamydophila pneumoniae CWL029
cauagcgaaagucaaagggc

SEQ ID NO: 2517042 - RNA, 14 nt, Chlamydophila pneumoniae CWL029
cauagcgagaacac

SEQ ID NO: 2517043 - RNA, 22 nt, Chlamydophila pneumoniae CWL029
cauagcuaaguaacaguccucu

SEQ ID NO: 2517044 - RNA, 16 nt, Chlamydophila pneumoniae CWL029
cauagcugaggcaucu

SEQ ID NO: 2517045 - RNA, 17 nt, Chlamydophila pneumoniae CWL029
cauagcuuuagaagccc

SEQ ID NO: 2517046 - RNA, 21 nt, Chlamydophila pneumoniae CWL029
cauaggaaugccaaaccucuu

SEQ ID NO: 2517047 - RNA, 15 nt, Chlamydophila pneumoniae CWL029
cauaggggaugauuu

SEQ ID NO: 2517048 - RNA, 23 nt, Chlamydophila pneumoniae CWL029
cauaggguaguuaucucccaaga

SEQ ID NO: 2517049 - RNA, 20 nt, Chlamydophila pneumoniae CWL029
cauagguaauacgagaggaa

SEQ ID NO: 2517050 - RNA, 16 nt, Chlamydophila pneumoniae CWL029
cauagguuagaaauga

SEQ ID NO: 2517051 - RNA, 15 nt, Chlamydophila pneumoniae CWL029
cauaguuuuuauuuu

SEQ ID NO: 2517052 - RNA, 18 nt, Chlamydophila pneumoniae CWL029
cauaguuuuuauuuuuaa

SEQ ID NO: 2517053 - RNA, 20 nt, Chlamydophila pneumoniae CWL029
cauaguuuuuauuuuuaaau

SEQ ID NO: 2517054 - RNA, 21 nt, Chlamydophila pneumoniae CWL029
cauaguuuuuauuuuuaaaua

SEQ ID NO: 2517055 - RNA, 20 nt, Chlamydophila pneumoniae CWL029
cauauaaagacucucuucca

SEQ ID NO: 2517056 - RNA, 22 nt, Chlamydophila pneumoniae CWL029
cauauaaagacucucuuccaaa

SEQ ID NO: 2517057 - RNA, 20 nt, Chlamydophila pneumoniae CWL029
cauauacguggcuuccauaa

SEQ ID NO: 2517058 - RNA, 21 nt, Chlamydophila pneumoniae CWL029
cauauacguggcuuccauaac

SEQ ID NO: 2517059 - RNA, 18 nt, Chlamydophila pneumoniae CWL029
cauauacuguuaacaagu

SEQ ID NO: 2517060 - RNA, 20 nt, Chlamydophila pneumoniae CWL029
cauauagcucguuauauuuu

SEQ ID NO: 2517061 - RNA, 21 nt, Chlamydophila pneumoniae CWL029
cauauccaaugagagagagac

SEQ ID NO: 2517062 - RNA, 20 nt, Chlamydophila pneumoniae CWL029
cauaucuccuuuaaauaaaa

SEQ ID NO: 2517063 - RNA, 14 nt, Chlamydophila pneumoniae CWL029
cauaugcucucccg

SEQ ID NO: 2517064 - RNA, 16 nt, Chlamydophila pneumoniae CWL029
cauauuccuauaacaa

SEQ ID NO: 2517065 - RNA, 18 nt, Chlamydophila pneumoniae CWL029
cauauucuaagcuuauuu

SEQ ID NO: 2517066 - RNA, 13 nt, Chlamydophila pneumoniae CWL029
cauauucuccuua

SEQ ID NO: 2517067 - RNA, 22 nt, Chlamydophila pneumoniae CWL029
cauauugagcagcguagacagg

SEQ ID NO: 2517068 - RNA, 13 nt, Chlamydophila pneumoniae CWL029
cauauuuaaauau

SEQ ID NO: 2517069 - RNA, 17 nt, Chlamydophila pneumoniae CWL029
cauauuuauuuaaacca

SEQ ID NO: 2517070 - RNA, 14 nt, Chlamydophila pneumoniae CWL029
cauauuugaauaaa

SEQ ID NO: 2517071 - RNA, 16 nt, Chlamydophila pneumoniae CWL029
cauauuugaauaaagg

SEQ ID NO: 2517072 - RNA, 16 nt, Chlamydophila pneumoniae CWL029
cauauuuuucuugaag

SEQ ID NO: 2517073 - RNA, 13 nt, Chlamydophila pneumoniae CWL029
caucaaaaaauac

SEQ ID NO: 2517074 - RNA, 13 nt, Chlamydophila pneumoniae CWL029
caucaaaacauaa

SEQ ID NO: 2517075 - RNA, 21 nt, Chlamydophila pneumoniae CWL029
caucaaaagauaugucuugcu

SEQ ID NO: 2517076 - RNA, 23 nt, Chlamydophila pneumoniae CWL029
caucaaaagauaugucuugcuuu

SEQ ID NO: 2517077 - RNA, 23 nt, Chlamydophila pneumoniae CWL029
caucaaagaauuauugauauuau

SEQ ID NO: 2517078 - RNA, 19 nt, Chlamydophila pneumoniae CWL029
caucaaauaaggcugcuau

SEQ ID NO: 2517079 - RNA, 20 nt, Chlamydophila pneumoniae CWL029
caucaaauaguucaucauau

SEQ ID NO: 2517080 - RNA, 21 nt, Chlamydophila pneumoniae CWL029
caucaaccgaagauccuagag

SEQ ID NO: 2517081 - RNA, 13 nt, Chlamydophila pneumoniae CWL029
caucaaggccuau

SEQ ID NO: 2517082 - RNA, 22 nt, Chlamydophila pneumoniae CWL029
caucaaugagaucugcaaacgc

SEQ ID NO: 2517083 - RNA, 23 nt, Chlamydophila pneumoniae CWL029
caucaaugguuaaaacccauguu

SEQ ID NO: 2517084 - RNA, 15 nt, Chlamydophila pneumoniae CWL029
caucacaaucgugau

SEQ ID NO: 2517085 - RNA, 19 nt, Chlamydophila pneumoniae CWL029
caucacaauuacaggaaac

SEQ ID NO: 2517086 - RNA, 16 nt, Chlamydophila pneumoniae CWL029
caucacaauuuuaaaa

SEQ ID NO: 2517087 - RNA, 22 nt, Chlamydophila pneumoniae CWL029
caucaccauccaaagcuauuuc

SEQ ID NO: 2517088 - RNA, 15 nt, Chlamydophila pneumoniae CWL029
caucacgaaaaggag

SEQ ID NO: 2517089 - RNA, 14 nt, Chlamydophila pneumoniae CWL029
caucacgaggagcu

SEQ ID NO: 2517090 - RNA, 18 nt, Chlamydophila pneumoniae CWL029
caucacgaggagcuuuua

SEQ ID NO: 2517091 - RNA, 18 nt, Chlamydophila pneumoniae CWL029
caucagaaaucaaagggu

SEQ ID NO: 2517092 - RNA, 14 nt, Chlamydophila pneumoniae CWL029
caucagaagcuccu

SEQ ID NO: 2517093 - RNA, 14 nt, Chlamydophila pneumoniae CWL029
caucagaaguggcc

SEQ ID NO: 2517094 - RNA, 18 nt, Chlamydophila pneumoniae CWL029
caucagaaguggccuugc

SEQ ID NO: 2517095 - RNA, 18 nt, Chlamydophila pneumoniae CWL029
caucagaggccaccaaaa

SEQ ID NO: 2517096 - RNA, 18 nt, Chlamydophila pneumoniae CWL029
auucugagaaagaagucc

SEQ ID NO: 2517097 - RNA, 21 nt, Chlamydophila pneumoniae CWL029
auucugagaaagaaguccuag

SEQ ID NO: 2517098 - RNA, 19 nt, Chlamydophila pneumoniae CWL029
auucugaugaccucaucuc

SEQ ID NO: 2517099 - RNA, 21 nt, Chlamydophila pneumoniae CWL029
auucugauucuccgucccccg

SEQ ID NO: 2517100 - RNA, 20 nt, Chlamydophila pneumoniae CWL029
auucugcccaaagcuaaaau

SEQ ID NO: 2517101 - RNA, 21 nt, Chlamydophila pneumoniae CWL029
auucugcccaaagcuaaaaug

SEQ ID NO: 2517102 - RNA, 18 nt, Chlamydophila pneumoniae CWL029
auucugcuuuaucucuau

SEQ ID NO: 2517103 - RNA, 21 nt, Chlamydophila pneumoniae CWL029
auucuggagucgagcagaaau

SEQ ID NO: 2517104 - RNA, 13 nt, Chlamydophila pneumoniae CWL029
auucuuaaaaagc

SEQ ID NO: 2517105 - RNA, 15 nt, Chlamydophila pneumoniae CWL029
auucuuaaaaagcua

SEQ ID NO: 2517106 - RNA, 18 nt, Chlamydophila pneumoniae CWL029
auucuucagaaucuuugu

SEQ ID NO: 2517107 - RNA, 22 nt, Chlamydophila pneumoniae CWL029
auucuucagaaucuuugugaua

SEQ ID NO: 2517108 - RNA, 22 nt, Chlamydophila pneumoniae CWL029
auucuucauuguagaggucacu

SEQ ID NO: 2517109 - RNA, 15 nt, Chlamydophila pneumoniae CWL029
auucuucgagagcau

SEQ ID NO: 2517110 - RNA, 17 nt, Chlamydophila pneumoniae CWL029
auucuucugucuguauu

SEQ ID NO: 2517111 - RNA, 17 nt, Chlamydophila pneumoniae CWL029
auucuugcauagcggca

SEQ ID NO: 2517112 - RNA, 17 nt, Chlamydophila pneumoniae CWL029
auucuuguuggauugaa

SEQ ID NO: 2517113 - RNA, 15 nt, Chlamydophila pneumoniae CWL029
auucuuuaaucuauc

SEQ ID NO: 2517114 - RNA, 14 nt, Chlamydophila pneumoniae CWL029
auucuuuauaaaua

SEQ ID NO: 2517115 - RNA, 21 nt, Chlamydophila pneumoniae CWL029
auucuuuauccccagaucucu

SEQ ID NO: 2517116 - RNA, 21 nt, Chlamydophila pneumoniae CWL029
auucuuuaugagagagcucuu

SEQ ID NO: 2517117 - RNA, 13 nt, Chlamydophila pneumoniae CWL029
auucuuugccaag

SEQ ID NO: 2517118 - RNA, 23 nt, Chlamydophila pneumoniae CWL029
auucuuuuguaaucuaagaaucu

SEQ ID NO: 2517119 - RNA, 20 nt, Chlamydophila pneumoniae CWL029
auucuuuuucuauuaaaaau

SEQ ID NO: 2517120 - RNA, 19 nt, Chlamydophila pneumoniae CWL029
auugaaaccguaacugagg

SEQ ID NO: 2517121 - RNA, 14 nt, Chlamydophila pneumoniae CWL029
auugaagauauuau

SEQ ID NO: 2517122 - RNA, 22 nt, Chlamydophila pneumoniae CWL029
auugaauaagcuuuccucucca

SEQ ID NO: 2517123 - RNA, 20 nt, Chlamydophila pneumoniae CWL029
auugaauaucgaguucuuuu

SEQ ID NO: 2517124 - RNA, 16 nt, Chlamydophila pneumoniae CWL029
auugaaucccaucaaa

SEQ ID NO: 2517125 - RNA, 18 nt, Chlamydophila pneumoniae CWL029
auugaaucccaucaaagg

SEQ ID NO: 2517126 - RNA, 20 nt, Chlamydophila pneumoniae CWL029
auugaccugcuuuuuuucua

SEQ ID NO: 2517127 - RNA, 21 nt, Chlamydophila pneumoniae CWL029
auugaccugcuuuuuuucuag

SEQ ID NO: 2517128 - RNA, 19 nt, Chlamydophila pneumoniae CWL029
auugacguagacgauuuuc

SEQ ID NO: 2517129 - RNA, 20 nt, Chlamydophila pneumoniae CWL029
auugacuagcucucuugcua

SEQ ID NO: 2517130 - RNA, 15 nt, Chlamydophila pneumoniae CWL029
auugacugcuagagu

SEQ ID NO: 2517131 - RNA, 14 nt, Chlamydophila pneumoniae CWL029
auugagaauaaaac

SEQ ID NO: 2517132 - RNA, 16 nt, Chlamydophila pneumoniae CWL029
auugaggauaaguucu

SEQ ID NO: 2517133 - RNA, 20 nt, Chlamydophila pneumoniae CWL029
auugaggauaaguucuucca

SEQ ID NO: 2517134 - RNA, 13 nt, Chlamydophila pneumoniae CWL029
auugauaaugauu

SEQ ID NO: 2517135 - RNA, 15 nt, Chlamydophila pneumoniae CWL029
auugauguuccuuga

SEQ ID NO: 2517136 - RNA, 14 nt, Chlamydophila pneumoniae CWL029
auugcaaaauuuaa

SEQ ID NO: 2517137 - RNA, 19 nt, Chlamydophila pneumoniae CWL029
auugcaauuuucuaaagau

SEQ ID NO: 2517138 - RNA, 17 nt, Chlamydophila pneumoniae CWL029
auugcacucaucuugag

SEQ ID NO: 2517139 - RNA, 18 nt, Chlamydophila pneumoniae CWL029
auugcacucaucuugagu

SEQ ID NO: 2517140 - RNA, 17 nt, Chlamydophila pneumoniae CWL029
auugcagguagauccua

SEQ ID NO: 2517141 - RNA, 20 nt, Chlamydophila pneumoniae CWL029
auugcauuaagauaaacauu

SEQ ID NO: 2517142 - RNA, 14 nt, Chlamydophila pneumoniae CWL029
auugcauucuuaau

SEQ ID NO: 2517143 - RNA, 15 nt, Chlamydophila pneumoniae CWL029
auugcauuuaaacua

SEQ ID NO: 2517144 - RNA, 22 nt, Chlamydophila pneumoniae CWL029
auugcauuuaaacuaagaauac

SEQ ID NO: 2517145 - RNA, 19 nt, Chlamydophila pneumoniae CWL029
auugccgugaguugcaauu

SEQ ID NO: 2517146 - RNA, 18 nt, Chlamydophila pneumoniae CWL029
auugcgggcucaaagaaa

SEQ ID NO: 2517147 - RNA, 14 nt, Chlamydophila pneumoniae CWL029
auugcuaagcauuu

SEQ ID NO: 2517148 - RNA, 18 nt, Chlamydophila pneumoniae CWL029
auugcuacuguccaucca

SEQ ID NO: 2517149 - RNA, 22 nt, Chlamydophila pneumoniae CWL029
auugcucguauuagaguuucuu

SEQ ID NO: 2517150 - RNA, 13 nt, Chlamydophila pneumoniae CWL029
auugcugcugcua

SEQ ID NO: 2517151 - RNA, 16 nt, Chlamydophila pneumoniae CWL029
auugcuugcgcagcuu

SEQ ID NO: 2517152 - RNA, 17 nt, Chlamydophila pneumoniae CWL029
auugcuugcgcagcuuc

SEQ ID NO: 2517153 - RNA, 21 nt, Chlamydophila pneumoniae CWL029
auugcuugcgcaucagcagcu

SEQ ID NO: 2517154 - RNA, 14 nt, Chlamydophila pneumoniae CWL029
auugcuuucccccu

SEQ ID NO: 2517155 - RNA, 18 nt, Chlamydophila pneumoniae CWL029
auuggaggauaaaugagu

SEQ ID NO: 2517156 - RNA, 12 nt, Chlamydophila pneumoniae CWL029
auuggagucuaa

SEQ ID NO: 2517157 - RNA, 20 nt, Chlamydophila pneumoniae CWL029
auuggaucuugauaaaagau

SEQ ID NO: 2517158 - RNA, 15 nt, Chlamydophila pneumoniae CWL029
auuggaugauagcua

SEQ ID NO: 2517159 - RNA, 20 nt, Chlamydophila pneumoniae CWL029
auuggcauagagccuagaga

SEQ ID NO: 2517160 - RNA, 16 nt, Chlamydophila pneumoniae CWL029
auugggagguucgcag

SEQ ID NO: 2517161 - RNA, 22 nt, Chlamydophila pneumoniae CWL029
auugggagguucgcagaacuuc

SEQ ID NO: 2517162 - RNA, 15 nt, Chlamydophila pneumoniae CWL029
auugguaaggagagu

SEQ ID NO: 2517163 - RNA, 21 nt, Chlamydophila pneumoniae CWL029
auuguaaaucauuggaaccau

SEQ ID NO: 2517164 - RNA, 13 nt, Chlamydophila pneumoniae CWL029
auuguagagauua

SEQ ID NO: 2517165 - RNA, 15 nt, Chlamydophila pneumoniae CWL029
auuguauagcuuacu

SEQ ID NO: 2517166 - RNA, 12 nt, Chlamydophila pneumoniae CWL029
auugucuuaaaa

SEQ ID NO: 2517167 - RNA, 12 nt, Chlamydophila pneumoniae CWL029
auugucuucagu

SEQ ID NO: 2517168 - RNA, 23 nt, Chlamydophila pneumoniae CWL029
auugugcauuaccuccuauuuuc

SEQ ID NO: 2517169 - RNA, 17 nt, Chlamydophila pneumoniae CWL029
auugugcucaauacaga

SEQ ID NO: 2517170 - RNA, 20 nt, Chlamydophila pneumoniae CWL029
auuguggaacgcauaagaga

SEQ ID NO: 2517171 - RNA, 14 nt, Chlamydophila pneumoniae CWL029
auuguuaucaggaa

SEQ ID NO: 2517172 - RNA, 15 nt, Chlamydophila pneumoniae CWL029
auuguucaaaaauag

SEQ ID NO: 2517173 - RNA, 23 nt, Chlamydophila pneumoniae CWL029
auuguucuuuacuacaugaggau

SEQ ID NO: 2517174 - RNA, 21 nt, Chlamydophila pneumoniae CWL029
auuguuuaaguccuucuuccc

SEQ ID NO: 2517175 - RNA, 16 nt, Chlamydophila pneumoniae CWL029
auuguuuguaucaaag

SEQ ID NO: 2517176 - RNA, 11 nt, Chlamydophila pneumoniae CWL029
auuguuuuguu

SEQ ID NO: 2517177 - RNA, 14 nt, Chlamydophila pneumoniae CWL029
auuguuuuugcaaa

SEQ ID NO: 2517178 - RNA, 17 nt, Chlamydophila pneumoniae CWL029
auuuaaagcugaaauuc

SEQ ID NO: 2517179 - RNA, 20 nt, Chlamydophila pneumoniae CWL029
auuuaaaugccuuaaaugua

SEQ ID NO: 2517180 - RNA, 23 nt, Chlamydophila pneumoniae CWL029
auuuaagauaucgaccuuaaaau

SEQ ID NO: 2517181 - RNA, 20 nt, Chlamydophila pneumoniae CWL029
auuuacaauuguguuugcag

SEQ ID NO: 2517182 - RNA, 16 nt, Chlamydophila pneumoniae CWL029
auuuacgaaaacaucu

SEQ ID NO: 2517183 - RNA, 20 nt, Chlamydophila pneumoniae CWL029
auuuacuuuuaauccuuuca

SEQ ID NO: 2517184 - RNA, 15 nt, Chlamydophila pneumoniae CWL029
auuuagaaaucucac

SEQ ID NO: 2517185 - RNA, 18 nt, Chlamydophila pneumoniae CWL029
auuuagaaaucucacugg

SEQ ID NO: 2517186 - RNA, 17 nt, Chlamydophila pneumoniae CWL029
auuuagaaucuuuucua

SEQ ID NO: 2517187 - RNA, 21 nt, Chlamydophila pneumoniae CWL029
auuuagauaaagaaagcgcuc

SEQ ID NO: 2517188 - RNA, 23 nt, Chlamydophila pneumoniae CWL029
auuuaggaugaauccaaaauaaa

SEQ ID NO: 2517189 - RNA, 16 nt, Chlamydophila pneumoniae CWL029
auuuagggaagaguuc

SEQ ID NO: 2517190 - RNA, 13 nt, Chlamydophila pneumoniae CWL029
auuuaguucacca

SEQ ID NO: 2517191 - RNA, 22 nt, Chlamydophila pneumoniae CWL029
auuuauaguggcgaauccuaga

SEQ ID NO: 2517192 - RNA, 20 nt, Chlamydophila pneumoniae CWL029
auuuauguuuucucgaagaa

SEQ ID NO: 2517193 - RNA, 21 nt, Chlamydophila pneumoniae CWL029
auuuauuaucuuguuucguaa

SEQ ID NO: 2517194 - RNA, 21 nt, Chlamydophila pneumoniae CWL029
caucagcagcugucaauccaa

SEQ ID NO: 2517195 - RNA, 14 nt, Chlamydophila pneumoniae CWL029
caucaggauucucu

SEQ ID NO: 2517196 - RNA, 18 nt, Chlamydophila pneumoniae CWL029
caucaggcggaugaccuu

SEQ ID NO: 2517197 - RNA, 20 nt, Chlamydophila pneumoniae CWL029
caucaguggcgacugcaaca

SEQ ID NO: 2517198 - RNA, 17 nt, Chlamydophila pneumoniae CWL029
caucaucagaagcuccu

SEQ ID NO: 2517199 - RNA, 17 nt, Chlamydophila pneumoniae CWL029
caucauccucaggaccu

SEQ ID NO: 2517200 - RNA, 12 nt, Chlamydophila pneumoniae CWL029
caucaucgagcu

SEQ ID NO: 2517201 - RNA, 18 nt, Chlamydophila pneumoniae CWL029
caucaucuccugaagcca

SEQ ID NO: 2517202 - RNA, 20 nt, Chlamydophila pneumoniae CWL029
caucaugaaauacccgcacc

SEQ ID NO: 2517203 - RNA, 19 nt, Chlamydophila pneumoniae CWL029
caucauuuucauagcagcu

SEQ ID NO: 2517204 - RNA, 18 nt, Chlamydophila pneumoniae CWL029
cauccaaaaugucuuuuu

SEQ ID NO: 2517205 - RNA, 22 nt, Chlamydophila pneumoniae CWL029
cauccacgaccucgaauuccuc

SEQ ID NO: 2517206 - RNA, 12 nt, Chlamydophila pneumoniae CWL029
cauccagaagua

SEQ ID NO: 2517207 - RNA, 17 nt, Chlamydophila pneumoniae CWL029
cauccagacaagacacu

SEQ ID NO: 2517208 - RNA, 19 nt, Chlamydophila pneumoniae CWL029
caucccuggauuucuucug

SEQ ID NO: 2517209 - RNA, 14 nt, Chlamydophila pneumoniae CWL029
cauccucagucucu

SEQ ID NO: 2517210 - RNA, 21 nt, Chlamydophila pneumoniae CWL029
cauccucaucaucagaaauca

SEQ ID NO: 2517211 - RNA, 21 nt, Chlamydophila pneumoniae CWL029
cauccugaacggcucuuucua

SEQ ID NO: 2517212 - RNA, 14 nt, Chlamydophila pneumoniae CWL029
cauccugaucuucu

SEQ ID NO: 2517213 - RNA, 12 nt, Chlamydophila pneumoniae CWL029
cauccuucuuua

SEQ ID NO: 2517214 - RNA, 21 nt, Chlamydophila pneumoniae CWL029
cauccuuuagcuguuucucug

SEQ ID NO: 2517215 - RNA, 15 nt, Chlamydophila pneumoniae CWL029
caucgaaaccacagc

SEQ ID NO: 2517216 - RNA, 13 nt, Chlamydophila pneumoniae CWL029
caucgaagaacuu

SEQ ID NO: 2517217 - RNA, 19 nt, Chlamydophila pneumoniae CWL029
caucgaagcgccgcauuac

SEQ ID NO: 2517218 - RNA, 23 nt, Chlamydophila pneumoniae CWL029
caucgagaaaugcucuucugcag

SEQ ID NO: 2517219 - RNA, 19 nt, Chlamydophila pneumoniae CWL029
caucgcaguuccauagcua

SEQ ID NO: 2517220 - RNA, 19 nt, Chlamydophila pneumoniae CWL029
caucgguucggucucuucu

SEQ ID NO: 2517221 - RNA, 23 nt, Chlamydophila pneumoniae CWL029
caucgguucggucucuucucugu

SEQ ID NO: 2517222 - RNA, 24 nt, Chlamydophila pneumoniae CWL029
caucgguucggucucuucucuguu

SEQ ID NO: 2517223 - RNA, 19 nt, Chlamydophila pneumoniae CWL029
caucgucuccaaaaauucc

SEQ ID NO: 2517224 - RNA, 14 nt, Chlamydophila pneumoniae CWL029
caucuaaaaaugca

SEQ ID NO: 2517225 - RNA, 20 nt, Chlamydophila pneumoniae CWL029
caucuaacgucagcuguccu

SEQ ID NO: 2517226 - RNA, 15 nt, Chlamydophila pneumoniae CWL029
caucuaacucuaauc

SEQ ID NO: 2517227 - RNA, 13 nt, Chlamydophila pneumoniae CWL029
caucuaagccaga

SEQ ID NO: 2517228 - RNA, 20 nt, Chlamydophila pneumoniae CWL029
caucuaauuuuaaauuuugu

SEQ ID NO: 2517229 - RNA, 22 nt, Chlamydophila pneumoniae CWL029
caucuacgauguuuucuuaucc

SEQ ID NO: 2517230 - RNA, 17 nt, Chlamydophila pneumoniae CWL029
caucuagaaagauuuau

SEQ ID NO: 2517231 - RNA, 22 nt, Chlamydophila pneumoniae CWL029
caucuagaaagauuuauuuugu

SEQ ID NO: 2517232 - RNA, 20 nt, Chlamydophila pneumoniae CWL029
caucuagaagcauucucaau

SEQ ID NO: 2517233 - RNA, 22 nt, Chlamydophila pneumoniae CWL029
caucuagaagcauucucaauuc

SEQ ID NO: 2517234 - RNA, 17 nt, Chlamydophila pneumoniae CWL029
caucucacaagcauccu

SEQ ID NO: 2517235 - RNA, 21 nt, Chlamydophila pneumoniae CWL029
caucuccaagauaauuaugua

SEQ ID NO: 2517236 - RNA, 18 nt, Chlamydophila pneumoniae CWL029
caucucgcaguccaaaga

SEQ ID NO: 2517237 - RNA, 11 nt, Chlamydophila pneumoniae CWL029
caucucucucc

SEQ ID NO: 2517238 - RNA, 23 nt, Chlamydophila pneumoniae CWL029
caucucuggaauacauuccuagc

SEQ ID NO: 2517239 - RNA, 22 nt, Chlamydophila pneumoniae CWL029
caucuggaauggccacagcuau

SEQ ID NO: 2517240 - RNA, 14 nt, Chlamydophila pneumoniae CWL029
caucugucauuaaa

SEQ ID NO: 2517241 - RNA, 21 nt, Chlamydophila pneumoniae CWL029
caucugucauuaaaaauuuaa

SEQ ID NO: 2517242 - RNA, 23 nt, Chlamydophila pneumoniae CWL029
caucugucauuaaaaauuuaaaa

SEQ ID NO: 2517243 - RNA, 23 nt, Chlamydophila pneumoniae CWL029
caucuuaucaagagcucguaauc

SEQ ID NO: 2517244 - RNA, 22 nt, Chlamydophila pneumoniae CWL029
caucuucacuaaaugacgcaca

SEQ ID NO: 2517245 - RNA, 12 nt, Chlamydophila pneumoniae CWL029
caucuuccucuu

SEQ ID NO: 2517246 - RNA, 19 nt, Chlamydophila pneumoniae CWL029
caucuucuuggcuuucccc

SEQ ID NO: 2517247 - RNA, 15 nt, Chlamydophila pneumoniae CWL029
caucuuuggcacaau

SEQ ID NO: 2517248 - RNA, 13 nt, Chlamydophila pneumoniae CWL029
caucuuuuacaga

SEQ ID NO: 2517249 - RNA, 17 nt, Chlamydophila pneumoniae CWL029
caucuuuuacagacuga

SEQ ID NO: 2517250 - RNA, 19 nt, Chlamydophila pneumoniae CWL029
caucuuuucaaaagaaaag

SEQ ID NO: 2517251 - RNA, 18 nt, Chlamydophila pneumoniae CWL029
caugaaaauacaacggau

SEQ ID NO: 2517252 - RNA, 23 nt, Chlamydophila pneumoniae CWL029
caugaaagauaaugucuccaucg

SEQ ID NO: 2517253 - RNA, 16 nt, Chlamydophila pneumoniae CWL029
caugaaauuucauucu

SEQ ID NO: 2517254 - RNA, 21 nt, Chlamydophila pneumoniae CWL029
caugaacgugcaucucuucag

SEQ ID NO: 2517255 - RNA, 18 nt, Chlamydophila pneumoniae CWL029
caugaagcagaaacuuua

SEQ ID NO: 2517256 - RNA, 15 nt, Chlamydophila pneumoniae CWL029
caugaaucugguucc

SEQ ID NO: 2517257 - RNA, 23 nt, Chlamydophila pneumoniae CWL029
caugaauugucaucucauaguuu

SEQ ID NO: 2517258 - RNA, 19 nt, Chlamydophila pneumoniae CWL029
caugacauaggcaaauccu

SEQ ID NO: 2517259 - RNA, 21 nt, Chlamydophila pneumoniae CWL029
caugaccuuuaggaacuugaa

SEQ ID NO: 2517260 - RNA, 22 nt, Chlamydophila pneumoniae CWL029
caugaccuuuaggaacuugaau

SEQ ID NO: 2517261 - RNA, 15 nt, Chlamydophila pneumoniae CWL029
caugacuauuuucau

SEQ ID NO: 2517262 - RNA, 20 nt, Chlamydophila pneumoniae CWL029
caugagaaauacgcuuuucu

SEQ ID NO: 2517263 - RNA, 23 nt, Chlamydophila pneumoniae CWL029
caugagagucgaaacacucauga

SEQ ID NO: 2517264 - RNA, 17 nt, Chlamydophila pneumoniae CWL029
caugagcucaggcaaca

SEQ ID NO: 2517265 - RNA, 17 nt, Chlamydophila pneumoniae CWL029
caugaggagaccuuuau

SEQ ID NO: 2517266 - RNA, 12 nt, Chlamydophila pneumoniae CWL029
caugaggcugcu

SEQ ID NO: 2517267 - RNA, 23 nt, Chlamydophila pneumoniae CWL029
caugaggcugcuacgugaucaaa

SEQ ID NO: 2517268 - RNA, 14 nt, Chlamydophila pneumoniae CWL029
caugaugccauuga

SEQ ID NO: 2517269 - RNA, 13 nt, Chlamydophila pneumoniae CWL029
caugauuuuucaa

SEQ ID NO: 2517270 - RNA, 18 nt, Chlamydophila pneumoniae CWL029
caugcacgagagccucgg

SEQ ID NO: 2517271 - RNA, 22 nt, Chlamydophila pneumoniae CWL029
caugcacgagagccucggaagu

SEQ ID NO: 2517272 - RNA, 17 nt, Chlamydophila pneumoniae CWL029
caugcauagaauaaaga

SEQ ID NO: 2517273 - RNA, 12 nt, Chlamydophila pneumoniae CWL029
caugccaaauau

SEQ ID NO: 2517274 - RNA, 19 nt, Chlamydophila pneumoniae CWL029
caugccaaauaucucuggc

SEQ ID NO: 2517275 - RNA, 20 nt, Chlamydophila pneumoniae CWL029
caugccaaauaucucuggca

SEQ ID NO: 2517276 - RNA, 22 nt, Chlamydophila pneumoniae CWL029
caugcccccacaaaaccuggau

SEQ ID NO: 2517277 - RNA, 19 nt, Chlamydophila pneumoniae CWL029
caugccuaaauagcucagu

SEQ ID NO: 2517278 - RNA, 22 nt, Chlamydophila pneumoniae CWL029
caugccuggccaucaucaccag

SEQ ID NO: 2517279 - RNA, 20 nt, Chlamydophila pneumoniae CWL029
caugccuuuggcaaucaucu

SEQ ID NO: 2517280 - RNA, 16 nt, Chlamydophila pneumoniae CWL029
caugcggacuuuauuc

SEQ ID NO: 2517281 - RNA, 16 nt, Chlamydophila pneumoniae CWL029
caugcuaauaauuccu

SEQ ID NO: 2517282 - RNA, 17 nt, Chlamydophila pneumoniae CWL029
caugcuaauaauuccug

SEQ ID NO: 2517283 - RNA, 23 nt, Chlamydophila pneumoniae CWL029
caugcuaauccagcaacaaccaa

SEQ ID NO: 2517284 - RNA, 12 nt, Chlamydophila pneumoniae CWL029
caugcucaagaa

SEQ ID NO: 2517285 - RNA, 20 nt, Chlamydophila pneumoniae CWL029
caugcuugaggaauucuuua

SEQ ID NO: 2517286 - RNA, 15 nt, Chlamydophila pneumoniae CWL029
caugcuuuccuucca

SEQ ID NO: 2517287 - RNA, 22 nt, Chlamydophila pneumoniae CWL029
cauggaagugcggcucucuuca

SEQ ID NO: 2517288 - RNA, 19 nt, Chlamydophila pneumoniae CWL029
cauggacaagcaaaagcaa

SEQ ID NO: 2517289 - RNA, 15 nt, Chlamydophila pneumoniae CWL029
cauggacuccaagaa

SEQ ID NO: 2517290 - RNA, 14 nt, Chlamydophila pneumoniae CWL029
cauggagguucuca

SEQ ID NO: 2517291 - RNA, 15 nt, Chlamydophila pneumoniae CWL029
ccagcaucuucucga

SEQ ID NO: 2517292 - RNA, 22 nt, Chlamydophila pneumoniae CWL029
ccagcauuaagauaaacagcac

SEQ ID NO: 2517293 - RNA, 16 nt, Chlamydophila pneumoniae CWL029
ccagcgaugucuuuga

SEQ ID NO: 2517294 - RNA, 14 nt, Chlamydophila pneumoniae CWL029
ccagcuccuuuuga

SEQ ID NO: 2517295 - RNA, 18 nt, Chlamydophila pneumoniae CWL029
ccagcugagcuaucuuca

SEQ ID NO: 2517296 - RNA, 15 nt, Chlamydophila pneumoniae CWL029
ccagcugugguggug

SEQ ID NO: 2517297 - RNA, 16 nt, Chlamydophila pneumoniae CWL029
ccagcuguggugguga

SEQ ID NO: 2517298 - RNA, 14 nt, Chlamydophila pneumoniae CWL029
ccagcuucuuucua

SEQ ID NO: 2517299 - RNA, 22 nt, Chlamydophila pneumoniae CWL029
ccagcuucuuucuaggccggga

SEQ ID NO: 2517300 - RNA, 17 nt, Chlamydophila pneumoniae CWL029
ccaggaaacguucuuuc

SEQ ID NO: 2517301 - RNA, 22 nt, Chlamydophila pneumoniae CWL029
ccaggaaacguucuuucaauaa

SEQ ID NO: 2517302 - RNA, 15 nt, Chlamydophila pneumoniae CWL029
ccaggaauagaaaga

SEQ ID NO: 2517303 - RNA, 22 nt, Chlamydophila pneumoniae CWL029
ccaggaauagaaagacauccuu

SEQ ID NO: 2517304 - RNA, 22 nt, Chlamydophila pneumoniae CWL029
ccaggagacuaaaagaauaaua

SEQ ID NO: 2517305 - RNA, 18 nt, Chlamydophila pneumoniae CWL029
ccaggagagcuaacagca

SEQ ID NO: 2517306 - RNA, 19 nt, Chlamydophila pneumoniae CWL029
ccaggagagcuaacagcac

SEQ ID NO: 2517307 - RNA, 11 nt, Chlamydophila pneumoniae CWL029
cccauuccugc

SEQ ID NO: 2517308 - RNA, 12 nt, Chlamydophila pneumoniae CWL029
cccauuccugca

SEQ ID NO: 2517309 - RNA, 17 nt, Chlamydophila pneumoniae CWL029
ccccaagcucucuccau

SEQ ID NO: 2517310 - RNA, 22 nt, Chlamydophila pneumoniae CWL029
ccccaaucaguucaucuagaug

SEQ ID NO: 2517311 - RNA, 14 nt, Chlamydophila pneumoniae CWL029
ccccacccacucca

SEQ ID NO: 2517312 - RNA, 22 nt, Chlamydophila pneumoniae CWL029
ccccaguuucuugauauuuguc

SEQ ID NO: 2517313 - RNA, 13 nt, Chlamydophila pneumoniae CWL029
ccccauaaaaauu

SEQ ID NO: 2517314 - RNA, 14 nt, Chlamydophila pneumoniae CWL029
cccccagcauucac

SEQ ID NO: 2517315 - RNA, 17 nt, Chlamydophila pneumoniae CWL029
cccccugcugccaugca

SEQ ID NO: 2517316 - RNA, 20 nt, Chlamydophila pneumoniae CWL029
ccccggguuguccagagaca

SEQ ID NO: 2517317 - RNA, 20 nt, Chlamydophila pneumoniae CWL029
ccccguucguggagcaucau

SEQ ID NO: 2517318 - RNA, 15 nt, Chlamydophila pneumoniae CWL029
ccccuccaacaaaca

SEQ ID NO: 2517319 - RNA, 21 nt, Chlamydophila pneumoniae CWL029
ccccuggcguucaggauuuag

SEQ ID NO: 2517320 - RNA, 14 nt, Chlamydophila pneumoniae CWL029
ccccuugcacccca

SEQ ID NO: 2517321 - RNA, 13 nt, Chlamydophila pneumoniae CWL029
cccgagcuuccau

SEQ ID NO: 2517322 - RNA, 16 nt, Chlamydophila pneumoniae CWL029
cccggaggcaaagauc

SEQ ID NO: 2517323 - RNA, 14 nt, Chlamydophila pneumoniae CWL029
cccuacagcagaaa

SEQ ID NO: 2517324 - RNA, 12 nt, Chlamydophila pneumoniae CWL029
cccuacccucau

SEQ ID NO: 2517325 - RNA, 19 nt, Chlamydophila pneumoniae CWL029
cccucaagcgauuucgaaa

SEQ ID NO: 2517326 - RNA, 23 nt, Chlamydophila pneumoniae CWL029
cccucacaagaagcaaacccaca

SEQ ID NO: 2517327 - RNA, 20 nt, Chlamydophila pneumoniae CWL029
cccucauaagauuuccccaa

SEQ ID NO: 2517328 - RNA, 19 nt, Chlamydophila pneumoniae CWL029
cccuccaaaaucaucagcu

SEQ ID NO: 2517329 - RNA, 13 nt, Chlamydophila pneumoniae CWL029
cccuccaccagaa

SEQ ID NO: 2517330 - RNA, 13 nt, Chlamydophila pneumoniae CWL029
cccucgccaaacc

SEQ ID NO: 2517331 - RNA, 23 nt, Chlamydophila pneumoniae CWL029
cccucgguuauuuuuccagaaau

SEQ ID NO: 2517332 - RNA, 14 nt, Chlamydophila pneumoniae CWL029
cccucuccagaagu

SEQ ID NO: 2517333 - RNA, 11 nt, Chlamydophila pneumoniae CWL029
cccucuccuug

SEQ ID NO: 2517334 - RNA, 18 nt, Chlamydophila pneumoniae CWL029
cccucugauuauuucuaa

SEQ ID NO: 2517335 - RNA, 11 nt, Chlamydophila pneumoniae CWL029
cccucuucauc

SEQ ID NO: 2517336 - RNA, 18 nt, Chlamydophila pneumoniae CWL029
cccucuugcuuuuccguu

SEQ ID NO: 2517337 - RNA, 18 nt, Chlamydophila pneumoniae CWL029
cccugaaugcaacagagu

SEQ ID NO: 2517338 - RNA, 16 nt, Chlamydophila pneumoniae CWL029
cccugcggacagaaac

SEQ ID NO: 2517339 - RNA, 17 nt, Chlamydophila pneumoniae CWL029
cccuggucuguauuuuc

SEQ ID NO: 2517340 - RNA, 21 nt, Chlamydophila pneumoniae CWL029
cccuguccaacuaaaacagcc

SEQ ID NO: 2517341 - RNA, 23 nt, Chlamydophila pneumoniae CWL029
cccuuaaagagaaucuccucauc

SEQ ID NO: 2517342 - RNA, 19 nt, Chlamydophila pneumoniae CWL029
cccuuacgguaauccccaa

SEQ ID NO: 2517343 - RNA, 12 nt, Chlamydophila pneumoniae CWL029
cccuucuaauac

SEQ ID NO: 2517344 - RNA, 12 nt, Chlamydophila pneumoniae CWL029
cccuucuuagua

SEQ ID NO: 2517345 - RNA, 15 nt, Chlamydophila pneumoniae CWL029
cccuucuucuucagc

SEQ ID NO: 2517346 - RNA, 13 nt, Chlamydophila pneumoniae CWL029
cccuugaaucaua

SEQ ID NO: 2517347 - RNA, 17 nt, Chlamydophila pneumoniae CWL029
cccuugcaaaaguuguc

SEQ ID NO: 2517348 - RNA, 23 nt, Chlamydophila pneumoniae CWL029
cccuuuaaaaguacgaccaacuc

SEQ ID NO: 2517349 - RNA, 13 nt, Chlamydophila pneumoniae CWL029
cccuuucugcaau

SEQ ID NO: 2517350 - RNA, 16 nt, Chlamydophila pneumoniae CWL029
ccgaaacuucucagau

SEQ ID NO: 2517351 - RNA, 12 nt, Chlamydophila pneumoniae CWL029
ccgaacagagcg

SEQ ID NO: 2517352 - RNA, 13 nt, Chlamydophila pneumoniae CWL029
ccgaagcauuccc

SEQ ID NO: 2517353 - RNA, 17 nt, Chlamydophila pneumoniae CWL029
ccgaagcauucccgacu

SEQ ID NO: 2517354 - RNA, 15 nt, Chlamydophila pneumoniae CWL029
ccgaauaggcauuac

SEQ ID NO: 2517355 - RNA, 13 nt, Chlamydophila pneumoniae CWL029
ccgaaucucucca

SEQ ID NO: 2517356 - RNA, 14 nt, Chlamydophila pneumoniae CWL029
ccgacauuuaacau

SEQ ID NO: 2517357 - RNA, 15 nt, Chlamydophila pneumoniae CWL029
ccgacuuuccucaaa

SEQ ID NO: 2517358 - RNA, 13 nt, Chlamydophila pneumoniae CWL029
ccgagaauacaga

SEQ ID NO: 2517359 - RNA, 15 nt, Chlamydophila pneumoniae CWL029
ccgaguccuaaaauu

SEQ ID NO: 2517360 - RNA, 21 nt, Chlamydophila pneumoniae CWL029
ccgaugaggguaucucgucau

SEQ ID NO: 2517361 - RNA, 19 nt, Chlamydophila pneumoniae CWL029
ccgcacucauaggguaguu

SEQ ID NO: 2517362 - RNA, 13 nt, Chlamydophila pneumoniae CWL029
ccgcagcuucucu

SEQ ID NO: 2517363 - RNA, 19 nt, Chlamydophila pneumoniae CWL029
ccgcaggucgcaucaauga

SEQ ID NO: 2517364 - RNA, 14 nt, Chlamydophila pneumoniae CWL029
ccgcauuuccuagu

SEQ ID NO: 2517365 - RNA, 17 nt, Chlamydophila pneumoniae CWL029
ccgccauaacacuuugc

SEQ ID NO: 2517366 - RNA, 16 nt, Chlamydophila pneumoniae CWL029
ccgccguggaauagcu

SEQ ID NO: 2517367 - RNA, 14 nt, Chlamydophila pneumoniae CWL029
ccgccuuucuaccc

SEQ ID NO: 2517368 - RNA, 14 nt, Chlamydophila pneumoniae CWL029
ccgcuguauuuuca

SEQ ID NO: 2517369 - RNA, 15 nt, Chlamydophila pneumoniae CWL029
ccggaaggaguucuu

SEQ ID NO: 2517370 - RNA, 18 nt, Chlamydophila pneumoniae CWL029
ccggauucuuuaucccca

SEQ ID NO: 2517371 - RNA, 13 nt, Chlamydophila pneumoniae CWL029
ccguaacugaggc

SEQ ID NO: 2517372 - RNA, 14 nt, Chlamydophila pneumoniae CWL029
ccguaacugaggca

SEQ ID NO: 2517373 - RNA, 15 nt, Chlamydophila pneumoniae CWL029
ccguagccccuuaaa

SEQ ID NO: 2517374 - RNA, 20 nt, Chlamydophila pneumoniae CWL029
ccguaggguauccugcucca

SEQ ID NO: 2517375 - RNA, 16 nt, Chlamydophila pneumoniae CWL029
ccguauaacuuuaugu

SEQ ID NO: 2517376 - RNA, 21 nt, Chlamydophila pneumoniae CWL029
ccguauuuuuuacguucuuuc

SEQ ID NO: 2517377 - RNA, 17 nt, Chlamydophila pneumoniae CWL029
ccgucaagaacaagagc

SEQ ID NO: 2517378 - RNA, 18 nt, Chlamydophila pneumoniae CWL029
ccgucauauuuaaaaggc

SEQ ID NO: 2517379 - RNA, 15 nt, Chlamydophila pneumoniae CWL029
ccguccaguucuuca

SEQ ID NO: 2517380 - RNA, 16 nt, Chlamydophila pneumoniae CWL029
ccguggaauagcuucu

SEQ ID NO: 2517381 - RNA, 14 nt, Chlamydophila pneumoniae CWL029
ccguuaauuuuugc

SEQ ID NO: 2517382 - RNA, 13 nt, Chlamydophila pneumoniae CWL029
ccguuucaggaaa

SEQ ID NO: 2517383 - RNA, 23 nt, Chlamydophila pneumoniae CWL029
ccguuucaggaaacucaaucucu

SEQ ID NO: 2517384 - RNA, 13 nt, Chlamydophila pneumoniae CWL029
ccguuuccuccuc

SEQ ID NO: 2517385 - RNA, 14 nt, Chlamydophila pneumoniae CWL029
ccguuuccuccucu

SEQ ID NO: 2517386 - RNA, 19 nt, Chlamydophila pneumoniae CWL029
ccuaaaaaggucagcccug

SEQ ID NO: 2517387 - RNA, 13 nt, Chlamydophila pneumoniae CWL029
ccuaaaacaagaa

SEQ ID NO: 2517388 - RNA, 20 nt, Chlamydophila pneumoniae CWL029
ccuaaaauggugaagaauaa

SEQ ID NO: 2517389 - RNA, 21 nt, Chlamydophila pneumoniae CWL029
ccuaaagaauuuguaacucuu

SEQ ID NO: 2517390 - RNA, 20 nt, Chlamydophila pneumoniae CWL029
ccuaaaguaacgauaagaag

SEQ ID NO: 2517391 - RNA, 17 nt, Chlamydophila pneumoniae CWL029
ccuaaauucauaacacc

SEQ ID NO: 2517392 - RNA, 16 nt, Chlamydophila pneumoniae CWL029
ccuaacuaucucuguu

SEQ ID NO: 2517393 - RNA, 23 nt, Chlamydophila pneumoniae CWL029
ccuaacuaucucuguuuuuugaa

SEQ ID NO: 2517394 - RNA, 15 nt, Chlamydophila pneumoniae CWL029
ccuaagagauuuucc

SEQ ID NO: 2517395 - RNA, 23 nt, Chlamydophila pneumoniae CWL029
ccuaagagauuuuccauaggaac

SEQ ID NO: 2517396 - RNA, 19 nt, Chlamydophila pneumoniae CWL029
ccuaaggagaauccuuuag

SEQ ID NO: 2517397 - RNA, 23 nt, Chlamydophila pneumoniae CWL029
ccuaagguuuccaugagaauaug

SEQ ID NO: 2517398 - RNA, 17 nt, Chlamydophila pneumoniae CWL029
ccuaagugauaaggaag

SEQ ID NO: 2517399 - RNA, 13 nt, Chlamydophila pneumoniae CWL029
ccuaauaaagaag

SEQ ID NO: 2517400 - RNA, 23 nt, Chlamydophila pneumoniae CWL029
ccuacacugguagcuaaauuuag

SEQ ID NO: 2517401 - RNA, 21 nt, Chlamydophila pneumoniae CWL029
ccuacaggcaggccacuuccu

SEQ ID NO: 2517402 - RNA, 14 nt, Chlamydophila pneumoniae CWL029
ccuacaucugugau

SEQ ID NO: 2517403 - RNA, 17 nt, Chlamydophila pneumoniae CWL029
ccuacauggaucccugu

SEQ ID NO: 2517404 - RNA, 20 nt, Chlamydophila pneumoniae CWL029
ccuaccaaaguuuguagcau

SEQ ID NO: 2517405 - RNA, 14 nt, Chlamydophila pneumoniae CWL029
ccuacccaauuugu

SEQ ID NO: 2517406 - RNA, 19 nt, Chlamydophila pneumoniae CWL029
ccuaccuauuuaagggaaa

SEQ ID NO: 2517407 - RNA, 20 nt, Chlamydophila pneumoniae CWL029
ccuaccucugggaagacucu

SEQ ID NO: 2517408 - RNA, 15 nt, Chlamydophila pneumoniae CWL029
ccuaccugaggagcg

SEQ ID NO: 2517409 - RNA, 11 nt, Chlamydophila pneumoniae CWL029
ccuaccugcua

SEQ ID NO: 2517410 - RNA, 15 nt, Chlamydophila pneumoniae CWL029
ccuacgaauccaaaa

SEQ ID NO: 2517411 - RNA, 22 nt, Chlamydophila pneumoniae CWL029
ccuacgacaugccuaaauagcu

SEQ ID NO: 2517412 - RNA, 14 nt, Chlamydophila pneumoniae CWL029
ccuacuaaacccug

SEQ ID NO: 2517413 - RNA, 16 nt, Chlamydophila pneumoniae CWL029
ccuacugggaaaucua

SEQ ID NO: 2517414 - RNA, 20 nt, Chlamydophila pneumoniae CWL029
ccuagaaaagcaaccuuaaa

SEQ ID NO: 2517415 - RNA, 23 nt, Chlamydophila pneumoniae CWL029
ccuagaaggaggaguccuucuag

SEQ ID NO: 2517416 - RNA, 19 nt, Chlamydophila pneumoniae CWL029
ccuagaauaggaauugcag

SEQ ID NO: 2517417 - RNA, 18 nt, Chlamydophila pneumoniae CWL029
ccuagaaucacauaaaau

SEQ ID NO: 2517418 - RNA, 19 nt, Chlamydophila pneumoniae CWL029
ccuagagaguucuuguaau

SEQ ID NO: 2517419 - RNA, 16 nt, Chlamydophila pneumoniae CWL029
ccuaggagaaaucaca

SEQ ID NO: 2517420 - RNA, 14 nt, Chlamydophila pneumoniae CWL029
ccuagggucuucuc

SEQ ID NO: 2517421 - RNA, 16 nt, Chlamydophila pneumoniae CWL029
ccuagggucuucucga

SEQ ID NO: 2517422 - RNA, 13 nt, Chlamydophila pneumoniae CWL029
ccuagguucuuuu

SEQ ID NO: 2517423 - RNA, 23 nt, Chlamydophila pneumoniae CWL029
ccuaguucauuagcuaaaucaaa

SEQ ID NO: 2517424 - RNA, 21 nt, Chlamydophila pneumoniae CWL029
ccuauaaagcaaaugccugua

SEQ ID NO: 2517425 - RNA, 13 nt, Chlamydophila pneumoniae CWL029
ccuauagcaaaga

SEQ ID NO: 2517426 - RNA, 15 nt, Chlamydophila pneumoniae CWL029
ccuauaguaauuucu

SEQ ID NO: 2517427 - RNA, 22 nt, Chlamydophila pneumoniae CWL029
ccuauaucgccguuaaagacuu

SEQ ID NO: 2517428 - RNA, 13 nt, Chlamydophila pneumoniae CWL029
ccuauauuuuuua

SEQ ID NO: 2517429 - RNA, 14 nt, Chlamydophila pneumoniae CWL029
ccuaucaaagcaaa

SEQ ID NO: 2517430 - RNA, 12 nt, Chlamydophila pneumoniae CWL029
ccuaugauaaag

SEQ ID NO: 2517431 - RNA, 16 nt, Chlamydophila pneumoniae CWL029
ccuaugauaaagccug

SEQ ID NO: 2517432 - RNA, 19 nt, Chlamydophila pneumoniae CWL029
ccuauggcagcaggaauaa

SEQ ID NO: 2517433 - RNA, 23 nt, Chlamydophila pneumoniae CWL029
ccuauggcagcaggaauaaucaa

SEQ ID NO: 2517434 - RNA, 22 nt, Chlamydophila pneumoniae CWL029
ccuauuugcaacaaucuuucuu

SEQ ID NO: 2517435 - RNA, 23 nt, Chlamydophila pneumoniae CWL029
ccuauuuucuuaugaccaagaac

SEQ ID NO: 2517436 - RNA, 22 nt, Chlamydophila pneumoniae CWL029
ccucaaagccgaggauucgcua

SEQ ID NO: 2517437 - RNA, 13 nt, Chlamydophila pneumoniae CWL029
ccucacaagaagc

SEQ ID NO: 2517438 - RNA, 20 nt, Chlamydophila pneumoniae CWL029
ccucacagaauuguuuuguu

SEQ ID NO: 2517439 - RNA, 15 nt, Chlamydophila pneumoniae CWL029
ccucacaucuccuuu

SEQ ID NO: 2517440 - RNA, 13 nt, Chlamydophila pneumoniae CWL029
ccucagucucucu

SEQ ID NO: 2517441 - RNA, 21 nt, Chlamydophila pneumoniae CWL029
ccucaucagaggccaccaaaa

SEQ ID NO: 2517442 - RNA, 17 nt, Chlamydophila pneumoniae CWL029
ccucaucaucagaaauc

SEQ ID NO: 2517443 - RNA, 17 nt, Chlamydophila pneumoniae CWL029
ccucauccccucagaaa

SEQ ID NO: 2517444 - RNA, 19 nt, Chlamydophila pneumoniae CWL029
ccucauccccucagaaagg

SEQ ID NO: 2517445 - RNA, 12 nt, Chlamydophila pneumoniae CWL029
ccuccaaaauca

SEQ ID NO: 2517446 - RNA, 21 nt, Chlamydophila pneumoniae CWL029
ccuccaaaaucaucagcuccg

SEQ ID NO: 2517447 - RNA, 15 nt, Chlamydophila pneumoniae CWL029
ccuccaaauacgaac

SEQ ID NO: 2517448 - RNA, 17 nt, Chlamydophila pneumoniae CWL029
ccuccaacaaacaauuc

SEQ ID NO: 2517449 - RNA, 12 nt, Chlamydophila pneumoniae CWL029
ccuccaauaauc

SEQ ID NO: 2517450 - RNA, 14 nt, Chlamydophila pneumoniae CWL029
ccuccaccaggagc

SEQ ID NO: 2517451 - RNA, 15 nt, Chlamydophila pneumoniae CWL029
ccuccaccaggagcu

SEQ ID NO: 2517452 - RNA, 16 nt, Chlamydophila pneumoniae CWL029
ccuccauggaaagaaa

SEQ ID NO: 2517453 - RNA, 16 nt, Chlamydophila pneumoniae CWL029
ccuccgaggagggaaa

SEQ ID NO: 2517454 - RNA, 22 nt, Chlamydophila pneumoniae CWL029
ccuccgaggagggaaacaccgu

SEQ ID NO: 2517455 - RNA, 21 nt, Chlamydophila pneumoniae CWL029
ccuccgauugcuaaucccuuc

SEQ ID NO: 2517456 - RNA, 11 nt, Chlamydophila pneumoniae CWL029
ccuccucuucu

SEQ ID NO: 2517457 - RNA, 16 nt, Chlamydophila pneumoniae CWL029
ccuccucuucuucauc

SEQ ID NO: 2517458 - RNA, 13 nt, Chlamydophila pneumoniae CWL029
ccuccugcagggg

SEQ ID NO: 2517459 - RNA, 17 nt, Chlamydophila pneumoniae CWL029
ccucgaauuccucccag

SEQ ID NO: 2517460 - RNA, 20 nt, Chlamydophila pneumoniae CWL029
ccucgagcagaaacuccaaa

SEQ ID NO: 2517461 - RNA, 21 nt, Chlamydophila pneumoniae CWL029
ccucgagcagaaacuccaaaa

SEQ ID NO: 2517462 - RNA, 22 nt, Chlamydophila pneumoniae CWL029
ccucgcaauccaggaauagaaa

SEQ ID NO: 2517463 - RNA, 15 nt, Chlamydophila pneumoniae CWL029
ccucgccgcugcccu

SEQ ID NO: 2517464 - RNA, 15 nt, Chlamydophila pneumoniae CWL029
ccucuaaaaacccua

SEQ ID NO: 2517465 - RNA, 18 nt, Chlamydophila pneumoniae CWL029
ccucuaaggacaaaucuc

SEQ ID NO: 2517466 - RNA, 20 nt, Chlamydophila pneumoniae CWL029
ccucuaaggacaaaucuccc

SEQ ID NO: 2517467 - RNA, 19 nt, Chlamydophila pneumoniae CWL029
ccucuaaugacagcugaga

SEQ ID NO: 2517468 - RNA, 17 nt, Chlamydophila pneumoniae CWL029
ccucuagaagacacagg

SEQ ID NO: 2517469 - RNA, 18 nt, Chlamydophila pneumoniae CWL029
ccucuauccaucaucgaa

SEQ ID NO: 2517470 - RNA, 15 nt, Chlamydophila pneumoniae CWL029
ccucuccuugaaaau

SEQ ID NO: 2517471 - RNA, 20 nt, Chlamydophila pneumoniae CWL029
ccucucucaagucuauuuga

SEQ ID NO: 2517472 - RNA, 20 nt, Chlamydophila pneumoniae CWL029
ccucugcauguugcaaagca

SEQ ID NO: 2517473 - RNA, 16 nt, Chlamydophila pneumoniae CWL029
ccucugggaagacucu

SEQ ID NO: 2517474 - RNA, 22 nt, Chlamydophila pneumoniae CWL029
ccucugggaagacucucaucag

SEQ ID NO: 2517475 - RNA, 18 nt, Chlamydophila pneumoniae CWL029
ccucuguagguuuuucca

SEQ ID NO: 2517476 - RNA, 12 nt, Chlamydophila pneumoniae CWL029
ccucuucuucau

SEQ ID NO: 2517477 - RNA, 18 nt, Chlamydophila pneumoniae CWL029
ccucuucuucccuuucaa

SEQ ID NO: 2517478 - RNA, 17 nt, Chlamydophila pneumoniae CWL029
cauggauauggaauggc

SEQ ID NO: 2517479 - RNA, 15 nt, Chlamydophila pneumoniae CWL029
cauggauucacaucu

SEQ ID NO: 2517480 - RNA, 13 nt, Chlamydophila pneumoniae CWL029
cauggcuauuuuu

SEQ ID NO: 2517481 - RNA, 21 nt, Chlamydophila pneumoniae CWL029
cauggcuauuuuuaaaaugau

SEQ ID NO: 2517482 - RNA, 15 nt, Chlamydophila pneumoniae CWL029
cauggcuggaaagcc

SEQ ID NO: 2517483 - RNA, 17 nt, Chlamydophila pneumoniae CWL029
cauggcuggaaagccaa

SEQ ID NO: 2517484 - RNA, 22 nt, Chlamydophila pneumoniae CWL029
cauggcuuugugagcugcuggu

SEQ ID NO: 2517485 - RNA, 14 nt, Chlamydophila pneumoniae CWL029
caugguuauagaua

SEQ ID NO: 2517486 - RNA, 12 nt, Chlamydophila pneumoniae CWL029
cauguaaacaaa

SEQ ID NO: 2517487 - RNA, 15 nt, Chlamydophila pneumoniae CWL029
cauguaacugaaagu

SEQ ID NO: 2517488 - RNA, 16 nt, Chlamydophila pneumoniae CWL029
cauguaacugaaagua

SEQ ID NO: 2517489 - RNA, 19 nt, Chlamydophila pneumoniae CWL029
cauguacaguuuguaaaaa

SEQ ID NO: 2517490 - RNA, 21 nt, Chlamydophila pneumoniae CWL029
cauguccuccauggaaagaaa

SEQ ID NO: 2517491 - RNA, 17 nt, Chlamydophila pneumoniae CWL029
caugucuucauaugcuc

SEQ ID NO: 2517492 - RNA, 13 nt, Chlamydophila pneumoniae CWL029
caugugcugaaga

SEQ ID NO: 2517493 - RNA, 18 nt, Chlamydophila pneumoniae CWL029
cauguuaagcguauagaa

SEQ ID NO: 2517494 - RNA, 23 nt, Chlamydophila pneumoniae CWL029
cauguuaauaagcauauuuaaau

SEQ ID NO: 2517495 - RNA, 22 nt, Chlamydophila pneumoniae CWL029
cauguuaucaagacgacacuca

SEQ ID NO: 2517496 - RNA, 20 nt, Chlamydophila pneumoniae CWL029
cauguuuaauaucagcuucu

SEQ ID NO: 2517497 - RNA, 14 nt, Chlamydophila pneumoniae CWL029
cauguuucuuccug

SEQ ID NO: 2517498 - RNA, 17 nt, Chlamydophila pneumoniae CWL029
cauuaagauaaacauua

SEQ ID NO: 2517499 - RNA, 12 nt, Chlamydophila pneumoniae CWL029
cauuaagcaauc

SEQ ID NO: 2517500 - RNA, 13 nt, Chlamydophila pneumoniae CWL029
cauuaaggaaucc

SEQ ID NO: 2517501 - RNA, 12 nt, Chlamydophila pneumoniae CWL029
cauuaaggugug

SEQ ID NO: 2517502 - RNA, 12 nt, Chlamydophila pneumoniae CWL029
cauuaaguacug

SEQ ID NO: 2517503 - RNA, 15 nt, Chlamydophila pneumoniae CWL029
cauuaauaucccagu

SEQ ID NO: 2517504 - RNA, 15 nt, Chlamydophila pneumoniae CWL029
cauuaccguucccua

SEQ ID NO: 2517505 - RNA, 22 nt, Chlamydophila pneumoniae CWL029
cauuacgguuucugggaugcac

SEQ ID NO: 2517506 - RNA, 22 nt, Chlamydophila pneumoniae CWL029
cauuagcccuacgaauccaaaa

SEQ ID NO: 2517507 - RNA, 16 nt, Chlamydophila pneumoniae CWL029
cauuagcuaaaucaaa

SEQ ID NO: 2517508 - RNA, 15 nt, Chlamydophila pneumoniae CWL029
cauuagggcauucug

SEQ ID NO: 2517509 - RNA, 17 nt, Chlamydophila pneumoniae CWL029
cauuagggcauucugua

SEQ ID NO: 2517510 - RNA, 19 nt, Chlamydophila pneumoniae CWL029
cauuauacuuuuuuuauau

SEQ ID NO: 2517511 - RNA, 19 nt, Chlamydophila pneumoniae CWL029
cauuaucaagaaauucuuc

SEQ ID NO: 2517512 - RNA, 16 nt, Chlamydophila pneumoniae CWL029
cauuaucacagaugua

SEQ ID NO: 2517513 - RNA, 21 nt, Chlamydophila pneumoniae CWL029
cauuaucuucguaauaacuau

SEQ ID NO: 2517514 - RNA, 15 nt, Chlamydophila pneumoniae CWL029
cauuauuaaacgaau

SEQ ID NO: 2517515 - RNA, 17 nt, Chlamydophila pneumoniae CWL029
cauuauuaaacgaauac

SEQ ID NO: 2517516 - RNA, 13 nt, Chlamydophila pneumoniae CWL029
cauuauucccuaa

SEQ ID NO: 2517517 - RNA, 22 nt, Chlamydophila pneumoniae CWL029
cauucacagcagucgugauauc

SEQ ID NO: 2517518 - RNA, 12 nt, Chlamydophila pneumoniae CWL029
cauucauuuuuu

SEQ ID NO: 2517519 - RNA, 13 nt, Chlamydophila pneumoniae CWL029
cauucauuuuuua

SEQ ID NO: 2517520 - RNA, 19 nt, Chlamydophila pneumoniae CWL029
cauucauuuuuuaauaaaa

SEQ ID NO: 2517521 - RNA, 16 nt, Chlamydophila pneumoniae CWL029
ccuuuaguuaacuccu

SEQ ID NO: 2517522 - RNA, 22 nt, Chlamydophila pneumoniae CWL029
ccuuuauauaaagguuacaagc

SEQ ID NO: 2517523 - RNA, 14 nt, Chlamydophila pneumoniae CWL029
ccuuucuuuugcuu

SEQ ID NO: 2517524 - RNA, 18 nt, Chlamydophila pneumoniae CWL029
ccuuugagucuuuuucag

SEQ ID NO: 2517525 - RNA, 19 nt, Chlamydophila pneumoniae CWL029
ccuuugagucuuuuucaga

SEQ ID NO: 2517526 - RNA, 22 nt, Chlamydophila pneumoniae CWL029
ccuuugguagaaagacaaaaaa

SEQ ID NO: 2517527 - RNA, 20 nt, Chlamydophila pneumoniae CWL029
ccuuuguuuuaucuuuaguu

SEQ ID NO: 2517528 - RNA, 22 nt, Chlamydophila pneumoniae CWL029
ccuuuuaaaauuuugauaccuc

SEQ ID NO: 2517529 - RNA, 19 nt, Chlamydophila pneumoniae CWL029
ccuuuucagauuuuuuaac

SEQ ID NO: 2517530 - RNA, 17 nt, Chlamydophila pneumoniae CWL029
ccuuuuccuaaaucugc

SEQ ID NO: 2517531 - RNA, 16 nt, Chlamydophila pneumoniae CWL029
ccuuuucuccuucugg

SEQ ID NO: 2517532 - RNA, 22 nt, Chlamydophila pneumoniae CWL029
ccuuuugaauucugaugaccuc

SEQ ID NO: 2517533 - RNA, 13 nt, Chlamydophila pneumoniae CWL029
ccuuuuuaggaaa

SEQ ID NO: 2517534 - RNA, 19 nt, Chlamydophila pneumoniae CWL029
ccuuuuucugcuucuccaa

SEQ ID NO: 2517535 - RNA, 15 nt, Chlamydophila pneumoniae CWL029
cgaaaaaccuucucc

SEQ ID NO: 2517536 - RNA, 18 nt, Chlamydophila pneumoniae CWL029
cgaaaaacgguaaauauc

SEQ ID NO: 2517537 - RNA, 21 nt, Chlamydophila pneumoniae CWL029
cgaaacaacuuuuuucguuug

SEQ ID NO: 2517538 - RNA, 15 nt, Chlamydophila pneumoniae CWL029
cgaaaccacagcaaa

SEQ ID NO: 2517539 - RNA, 20 nt, Chlamydophila pneumoniae CWL029
cgaaaccacagcaaagacua

SEQ ID NO: 2517540 - RNA, 19 nt, Chlamydophila pneumoniae CWL029
cgaaaccggacugacuucu

SEQ ID NO: 2517541 - RNA, 18 nt, Chlamydophila pneumoniae CWL029
cgaaacucuuugaggaua

SEQ ID NO: 2517542 - RNA, 23 nt, Chlamydophila pneumoniae CWL029
cgaaagaacuacuuaaauccuaa

SEQ ID NO: 2517543 - RNA, 13 nt, Chlamydophila pneumoniae CWL029
cgaaagaucagag

SEQ ID NO: 2517544 - RNA, 20 nt, Chlamydophila pneumoniae CWL029
cgaaagucccgcaacuaaac

SEQ ID NO: 2517545 - RNA, 14 nt, Chlamydophila pneumoniae CWL029
cgaaauccuaaaaa

SEQ ID NO: 2517546 - RNA, 15 nt, Chlamydophila pneumoniae CWL029
cgaaauucauuaaaa

SEQ ID NO: 2517547 - RNA, 15 nt, Chlamydophila pneumoniae CWL029
cgaacagcuccugga

SEQ ID NO: 2517548 - RNA, 18 nt, Chlamydophila pneumoniae CWL029
cgaacaguucauguugcu

SEQ ID NO: 2517549 - RNA, 12 nt, Chlamydophila pneumoniae CWL029
cgaacaguuccu

SEQ ID NO: 2517550 - RNA, 19 nt, Chlamydophila pneumoniae CWL029
cgaacuaaaggaacugugc

SEQ ID NO: 2517551 - RNA, 17 nt, Chlamydophila pneumoniae CWL029
cgaacuguacgaauuuc

SEQ ID NO: 2517552 - RNA, 21 nt, Chlamydophila pneumoniae CWL029
cgaacuguacgaauuucacac

SEQ ID NO: 2517553 - RNA, 13 nt, Chlamydophila pneumoniae CWL029
cuaccagaugccu

SEQ ID NO: 2517554 - RNA, 14 nt, Chlamydophila pneumoniae CWL029
cuaccauuaaggaa

SEQ ID NO: 2517555 - RNA, 15 nt, Chlamydophila pneumoniae CWL029
cuaccauuaaggaau

SEQ ID NO: 2517556 - RNA, 21 nt, Chlamydophila pneumoniae CWL029
cuaccccacgcuaaacuaaaa

SEQ ID NO: 2517557 - RNA, 15 nt, Chlamydophila pneumoniae CWL029
cuacccucaucaucc

SEQ ID NO: 2517558 - RNA, 13 nt, Chlamydophila pneumoniae CWL029
cuaccgaacagag

SEQ ID NO: 2517559 - RNA, 13 nt, Chlamydophila pneumoniae CWL029
cuaccuaccuauu

SEQ ID NO: 2517560 - RNA, 17 nt, Chlamydophila pneumoniae CWL029
cuaccuaccuauuuaag

SEQ ID NO: 2517561 - RNA, 14 nt, Chlamydophila pneumoniae CWL029
cuaccuauauuuuu

SEQ ID NO: 2517562 - RNA, 23 nt, Chlamydophila pneumoniae CWL029
cuaccuguguaaugagcuggaag

SEQ ID NO: 2517563 - RNA, 16 nt, Chlamydophila pneumoniae CWL029
cuacgacuacaucuug

SEQ ID NO: 2517564 - RNA, 16 nt, Chlamydophila pneumoniae CWL029
cuacgagcgcuuucuu

SEQ ID NO: 2517565 - RNA, 19 nt, Chlamydophila pneumoniae CWL029
cuacgguuuucugccuuac

SEQ ID NO: 2517566 - RNA, 16 nt, Chlamydophila pneumoniae CWL029
cuacgugaucaaaauu

SEQ ID NO: 2517567 - RNA, 17 nt, Chlamydophila pneumoniae CWL029
cuacgugaucaaaauua

SEQ ID NO: 2517568 - RNA, 18 nt, Chlamydophila pneumoniae CWL029
cuacuuaaauccuaagca

SEQ ID NO: 2517569 - RNA, 13 nt, Chlamydophila pneumoniae CWL029
cuacuuacaagaa

SEQ ID NO: 2517570 - RNA, 13 nt, Chlamydophila pneumoniae CWL029
cuacuuauuguuc

SEQ ID NO: 2517571 - RNA, 19 nt, Chlamydophila pneumoniae CWL029
cuacuucaggaaauaauuu

SEQ ID NO: 2517572 - RNA, 15 nt, Chlamydophila pneumoniae CWL029
cuacuucuucuuuuc

SEQ ID NO: 2517573 - RNA, 19 nt, Chlamydophila pneumoniae CWL029
cuacuugucugauuaguuc

SEQ ID NO: 2517574 - RNA, 12 nt, Chlamydophila pneumoniae CWL029
cuacuuuaaagu

SEQ ID NO: 2517575 - RNA, 20 nt, Chlamydophila pneumoniae CWL029
cuacuuuaaaguggcaaucu

SEQ ID NO: 2517576 - RNA, 16 nt, Chlamydophila pneumoniae CWL029
cuagaaaacgcucucc

SEQ ID NO: 2517577 - RNA, 20 nt, Chlamydophila pneumoniae CWL029
cuagaaaacgcucuccuaga

SEQ ID NO: 2517578 - RNA, 21 nt, Chlamydophila pneumoniae CWL029
cuagaaaagauucuaaaucaa

SEQ ID NO: 2517579 - RNA, 23 nt, Chlamydophila pneumoniae CWL029
cuagaaaagauucuaaaucaacu

SEQ ID NO: 2517580 - RNA, 12 nt, Chlamydophila pneumoniae CWL029
cuagaaauauac

SEQ ID NO: 2517581 - RNA, 18 nt, Chlamydophila pneumoniae CWL029
cuagaacacucagagaug

SEQ ID NO: 2517582 - RNA, 20 nt, Chlamydophila pneumoniae CWL029
cuagaagacauucauuuuuu

SEQ ID NO: 2517583 - RNA, 21 nt, Chlamydophila pneumoniae CWL029
cuagaagacauucauuuuuua

SEQ ID NO: 2517584 - RNA, 23 nt, Chlamydophila pneumoniae CWL029
cuagaaucaccaauuuuuucccc

SEQ ID NO: 2517585 - RNA, 16 nt, Chlamydophila pneumoniae CWL029
cuagaauggcguaaua

SEQ ID NO: 2517586 - RNA, 18 nt, Chlamydophila pneumoniae CWL029
cuagacaacaaauugaug

SEQ ID NO: 2517587 - RNA, 16 nt, Chlamydophila pneumoniae CWL029
cuagacacgccuccuu

SEQ ID NO: 2517588 - RNA, 14 nt, Chlamydophila pneumoniae CWL029
cuagacagccuuga

SEQ ID NO: 2517589 - RNA, 18 nt, Chlamydophila pneumoniae CWL029
cuagagaaccuccuauuc

SEQ ID NO: 2517590 - RNA, 22 nt, Chlamydophila pneumoniae CWL029
cuagagaguucuuguaauaaaa

SEQ ID NO: 2517591 - RNA, 19 nt, Chlamydophila pneumoniae CWL029
cuagagaucuuuuuauuaa

SEQ ID NO: 2517592 - RNA, 20 nt, Chlamydophila pneumoniae CWL029
cuagagaucuuuuuauuaaa

SEQ ID NO: 2517593 - RNA, 14 nt, Chlamydophila pneumoniae CWL029
cuagagauuuuucu

SEQ ID NO: 2517594 - RNA, 19 nt, Chlamydophila pneumoniae CWL029
cuagagcacauagaaacag

SEQ ID NO: 2517595 - RNA, 20 nt, Chlamydophila pneumoniae CWL029
cuagagcauuccgagcugca

SEQ ID NO: 2517596 - RNA, 21 nt, Chlamydophila pneumoniae CWL029
cuagagcuuucagaaaagaaa

SEQ ID NO: 2517597 - RNA, 17 nt, Chlamydophila pneumoniae CWL029
cuagaggaucuucaagg

SEQ ID NO: 2517598 - RNA, 17 nt, Chlamydophila pneumoniae CWL029
cuagagguauuuccuuc

SEQ ID NO: 2517599 - RNA, 21 nt, Chlamydophila pneumoniae CWL029
cuagaguccaagguucuggga

SEQ ID NO: 2517600 - RNA, 14 nt, Chlamydophila pneumoniae CWL029
cuagaguucauuuu

SEQ ID NO: 2517601 - RNA, 21 nt, Chlamydophila pneumoniae CWL029
cuagaguugcuuuauggcuca

SEQ ID NO: 2517602 - RNA, 16 nt, Chlamydophila pneumoniae CWL029
cuagaucaaaacuccg

SEQ ID NO: 2517603 - RNA, 13 nt, Chlamydophila pneumoniae CWL029
cuagaucacaaga

SEQ ID NO: 2517604 - RNA, 15 nt, Chlamydophila pneumoniae CWL029
cuagcaccuaauaaa

SEQ ID NO: 2517605 - RNA, 14 nt, Chlamydophila pneumoniae CWL029
cuagcagagaaauu

SEQ ID NO: 2517606 - RNA, 21 nt, Chlamydophila pneumoniae CWL029
cuagccaucgcgaagcuuucc

SEQ ID NO: 2517607 - RNA, 14 nt, Chlamydophila pneumoniae CWL029
cuagcuccagcauc

SEQ ID NO: 2517608 - RNA, 23 nt, Chlamydophila pneumoniae CWL029
cuagcuuugucucuauagugcau

SEQ ID NO: 2517609 - RNA, 15 nt, Chlamydophila pneumoniae CWL029
cuagcuuuuuuuaug

SEQ ID NO: 2517610 - RNA, 21 nt, Chlamydophila pneumoniae CWL029
cuaggaacucuuuaaaagggc

SEQ ID NO: 2517611 - RNA, 17 nt, Chlamydophila pneumoniae CWL029
cuaggaaucuuuuagag

SEQ ID NO: 2517612 - RNA, 19 nt, Chlamydophila pneumoniae CWL029
cuaggacagcacauagagu

SEQ ID NO: 2517613 - RNA, 16 nt, Chlamydophila pneumoniae CWL029
cuaggagaaaucacac

SEQ ID NO: 2517614 - RNA, 19 nt, Chlamydophila pneumoniae CWL029
cuaggcaugguaggagccg

SEQ ID NO: 2517615 - RNA, 21 nt, Chlamydophila pneumoniae CWL029
cuaggccgggauuuuaauuca

SEQ ID NO: 2517616 - RNA, 19 nt, Chlamydophila pneumoniae CWL029
cuagggaucccaaaaaaug

SEQ ID NO: 2517617 - RNA, 14 nt, Chlamydophila pneumoniae CWL029
cuagguucuuuuuu

SEQ ID NO: 2517618 - RNA, 23 nt, Chlamydophila pneumoniae CWL029
cuaguauuaagauagacucucac

SEQ ID NO: 2517619 - RNA, 15 nt, Chlamydophila pneumoniae CWL029
cuaguccuguacauc

SEQ ID NO: 2517620 - RNA, 12 nt, Chlamydophila pneumoniae CWL029
cuagucuucuua

SEQ ID NO: 2517621 - RNA, 21 nt, Chlamydophila pneumoniae CWL029
cuagucuuucaaccuccgcuc

SEQ ID NO: 2517622 - RNA, 20 nt, Chlamydophila pneumoniae CWL029
cuagugaagcugcuucuuca

SEQ ID NO: 2517623 - RNA, 14 nt, Chlamydophila pneumoniae CWL029
cuaguucuucuuua

SEQ ID NO: 2517624 - RNA, 12 nt, Chlamydophila pneumoniae CWL029
cuaguuuuucuu

SEQ ID NO: 2517625 - RNA, 19 nt, Chlamydophila pneumoniae CWL029
cuaguuuuucuuuagagau

SEQ ID NO: 2517626 - RNA, 19 nt, Chlamydophila pneumoniae CWL029
cuauaaaaaccuuaucgca

SEQ ID NO: 2517627 - RNA, 17 nt, Chlamydophila pneumoniae CWL029
cuauaaagcaaaugccu

SEQ ID NO: 2517628 - RNA, 13 nt, Chlamydophila pneumoniae CWL029
cuauaacaacauu

SEQ ID NO: 2517629 - RNA, 23 nt, Chlamydophila pneumoniae CWL029
cuauaaccaacuuccuauaaaaa

SEQ ID NO: 2517630 - RNA, 15 nt, Chlamydophila pneumoniae CWL029
cuauaacuacaaaau

SEQ ID NO: 2517631 - RNA, 20 nt, Chlamydophila pneumoniae CWL029
cuauaagacauuauagaggu

SEQ ID NO: 2517632 - RNA, 13 nt, Chlamydophila pneumoniae CWL029
cuauaauaaccuc

SEQ ID NO: 2517633 - RNA, 15 nt, Chlamydophila pneumoniae CWL029
cuauaauaaccucca

SEQ ID NO: 2517634 - RNA, 17 nt, Chlamydophila pneumoniae CWL029
cuauaccaucuuuaaaa

SEQ ID NO: 2517635 - RNA, 21 nt, Chlamydophila pneumoniae CWL029
cuauaccaucuuuaaaaggcc

SEQ ID NO: 2517636 - RNA, 14 nt, Chlamydophila pneumoniae CWL029
cuauacccucugcu

SEQ ID NO: 2517637 - RNA, 18 nt, Chlamydophila pneumoniae CWL029
cuauacguaauccagauu

SEQ ID NO: 2517638 - RNA, 20 nt, Chlamydophila pneumoniae CWL029
cuauacucucuguagcacuu

SEQ ID NO: 2517639 - RNA, 14 nt, Chlamydophila pneumoniae CWL029
cuauagaaaaggau

SEQ ID NO: 2517640 - RNA, 19 nt, Chlamydophila pneumoniae CWL029
cuauagaaaaggaugcauc

SEQ ID NO: 2517641 - RNA, 16 nt, Chlamydophila pneumoniae CWL029
cuauagaacuaacugu

SEQ ID NO: 2517642 - RNA, 14 nt, Chlamydophila pneumoniae CWL029
cuauagaaggcauc

SEQ ID NO: 2517643 - RNA, 15 nt, Chlamydophila pneumoniae CWL029
cuauagagacacgaa

SEQ ID NO: 2517644 - RNA, 15 nt, Chlamydophila pneumoniae CWL029
cuauagccucuucua

SEQ ID NO: 2517645 - RNA, 17 nt, Chlamydophila pneumoniae CWL029
cuauagccucuucuaca

SEQ ID NO: 2517646 - RNA, 17 nt, Chlamydophila pneumoniae CWL029
cuauagcuggaucuucu

SEQ ID NO: 2517647 - RNA, 12 nt, Chlamydophila pneumoniae CWL029
cuauaguagaag

SEQ ID NO: 2517648 - RNA, 15 nt, Chlamydophila pneumoniae CWL029
cuauaucauuaagaa

SEQ ID NO: 2517649 - RNA, 16 nt, Chlamydophila pneumoniae CWL029
cuauaucauuaagaag

SEQ ID NO: 2517650 - RNA, 16 nt, Chlamydophila pneumoniae CWL029
cuauauccacaaucuc

SEQ ID NO: 2517651 - RNA, 19 nt, Chlamydophila pneumoniae CWL029
cuauaugaaugauuuccau

SEQ ID NO: 2517652 - RNA, 13 nt, Chlamydophila pneumoniae CWL029
cuauauuuuuucc

SEQ ID NO: 2517653 - RNA, 14 nt, Chlamydophila pneumoniae CWL029
cuauauuuuuuccc

SEQ ID NO: 2517654 - RNA, 22 nt, Chlamydophila pneumoniae CWL029
cuaucagagcgaucgcaaucag

SEQ ID NO: 2517655 - RNA, 16 nt, Chlamydophila pneumoniae CWL029
cuaucauaucuucaaa

SEQ ID NO: 2517656 - RNA, 20 nt, Chlamydophila pneumoniae CWL029
cuaucaucaaugguuaaaac

SEQ ID NO: 2517657 - RNA, 13 nt, Chlamydophila pneumoniae CWL029
cuauccaucaucg

SEQ ID NO: 2517658 - RNA, 13 nt, Chlamydophila pneumoniae CWL029
cuauccuauuuua

SEQ ID NO: 2517659 - RNA, 13 nt, Chlamydophila pneumoniae CWL029
cuaucgaagagcc

SEQ ID NO: 2517660 - RNA, 14 nt, Chlamydophila pneumoniae CWL029
cuaucgaagagccc

SEQ ID NO: 2517661 - RNA, 20 nt, Chlamydophila pneumoniae CWL029
cuaucgauagccauuagaau

SEQ ID NO: 2517662 - RNA, 16 nt, Chlamydophila pneumoniae CWL029
cuaucuaaucaauucg

SEQ ID NO: 2517663 - RNA, 13 nt, Chlamydophila pneumoniae CWL029
cuaucuccagaaa

SEQ ID NO: 2517664 - RNA, 23 nt, Chlamydophila pneumoniae CWL029
cuaucugccauaggauccaggag

SEQ ID NO: 2517665 - RNA, 15 nt, Chlamydophila pneumoniae CWL029
cuaucuuuacuaaca

SEQ ID NO: 2517666 - RNA, 16 nt, Chlamydophila pneumoniae CWL029
cuaucuuuacuaacaa

SEQ ID NO: 2517667 - RNA, 18 nt, Chlamydophila pneumoniae CWL029
cuaucuuuacuaacaaaa

SEQ ID NO: 2517668 - RNA, 18 nt, Chlamydophila pneumoniae CWL029
cuaucuuuauuuaaauaa

SEQ ID NO: 2517669 - RNA, 23 nt, Chlamydophila pneumoniae CWL029
cuaugaggaacugggcauagugg

SEQ ID NO: 2517670 - RNA, 23 nt, Chlamydophila pneumoniae CWL029
cuaugaggacgacgcaucuccuc

SEQ ID NO: 2517671 - RNA, 17 nt, Chlamydophila pneumoniae CWL029
cuaugauccgaaaacuc

SEQ ID NO: 2517672 - RNA, 19 nt, Chlamydophila pneumoniae CWL029
cuaugauccgaaaacucuu

SEQ ID NO: 2517673 - RNA, 21 nt, Chlamydophila pneumoniae CWL029
cuaugaucgggguuucagaag

SEQ ID NO: 2517674 - RNA, 16 nt, Chlamydophila pneumoniae CWL029
cuaugcacaaaauaaa

SEQ ID NO: 2517675 - RNA, 17 nt, Chlamydophila pneumoniae CWL029
cuaugcacaaaauaaaa

SEQ ID NO: 2517676 - RNA, 14 nt, Chlamydophila pneumoniae CWL029
cuauggaaagaguc

SEQ ID NO: 2517677 - RNA, 14 nt, Chlamydophila pneumoniae CWL029
cuaugggaggaauu

SEQ ID NO: 2517678 - RNA, 19 nt, Chlamydophila pneumoniae CWL029
cuaugggaggaauuccucu

SEQ ID NO: 2517679 - RNA, 20 nt, Chlamydophila pneumoniae CWL029
cuaugggaggaauuccucuc

SEQ ID NO: 2517680 - RNA, 19 nt, Chlamydophila pneumoniae CWL029
cuauggucucccucacaag

SEQ ID NO: 2517681 - RNA, 15 nt, Chlamydophila pneumoniae CWL029
cuaugucuguuccca

SEQ ID NO: 2517682 - RNA, 13 nt, Chlamydophila pneumoniae CWL029
cuauguguucucg

SEQ ID NO: 2517683 - RNA, 15 nt, Chlamydophila pneumoniae CWL029
cuauguguuuccuuu

SEQ ID NO: 2517684 - RNA, 14 nt, Chlamydophila pneumoniae CWL029
cuauguuuaaagca

SEQ ID NO: 2517685 - RNA, 13 nt, Chlamydophila pneumoniae CWL029
cuauuaagucacc

SEQ ID NO: 2517686 - RNA, 15 nt, Chlamydophila pneumoniae CWL029
cuauuaauacuuugc

SEQ ID NO: 2517687 - RNA, 15 nt, Chlamydophila pneumoniae CWL029
cuauuacuagauccc

SEQ ID NO: 2517688 - RNA, 16 nt, Chlamydophila pneumoniae CWL029
cuauuagauuuccucc

SEQ ID NO: 2517689 - RNA, 20 nt, Chlamydophila pneumoniae CWL029
cuauuagcgcggucacuuca

SEQ ID NO: 2517690 - RNA, 15 nt, Chlamydophila pneumoniae CWL029
cuauuauuuuaaagu

SEQ ID NO: 2517691 - RNA, 20 nt, Chlamydophila pneumoniae CWL029
cuauucccgacucggagacc

SEQ ID NO: 2517692 - RNA, 22 nt, Chlamydophila pneumoniae CWL029
cuauucuauacgcuuaacauga

SEQ ID NO: 2517693 - RNA, 20 nt, Chlamydophila pneumoniae CWL029
cuauucucaaauuucaauaa

SEQ ID NO: 2517694 - RNA, 13 nt, Chlamydophila pneumoniae CWL029
cuauugugcuuuu

SEQ ID NO: 2517695 - RNA, 14 nt, Chlamydophila pneumoniae CWL029
cuauuuaaggacgu

SEQ ID NO: 2517696 - RNA, 17 nt, Chlamydophila pneumoniae CWL029
cuauuuacugaaacauu

SEQ ID NO: 2517697 - RNA, 20 nt, Chlamydophila pneumoniae CWL029
cuauuucugccuuaugcuca

SEQ ID NO: 2517698 - RNA, 21 nt, Chlamydophila pneumoniae CWL029
cuauuuucccuuugucuauga

SEQ ID NO: 2517699 - RNA, 19 nt, Chlamydophila pneumoniae CWL029
cuauuuuccucuauauuuu

SEQ ID NO: 2517700 - RNA, 14 nt, Chlamydophila pneumoniae CWL029
cuauuuuuaaaaug

SEQ ID NO: 2517701 - RNA, 19 nt, Chlamydophila pneumoniae CWL029
cuauuuuuccauggcuauu

SEQ ID NO: 2517702 - RNA, 14 nt, Chlamydophila pneumoniae CWL029
cuauuuuugaggaa

SEQ ID NO: 2517703 - RNA, 13 nt, Chlamydophila pneumoniae CWL029
cucaaaaucacau

SEQ ID NO: 2517704 - RNA, 12 nt, Chlamydophila pneumoniae CWL029
cucaaaauuuaa

SEQ ID NO: 2517705 - RNA, 13 nt, Chlamydophila pneumoniae CWL029
cucaaagaauacu

SEQ ID NO: 2517706 - RNA, 19 nt, Chlamydophila pneumoniae CWL029
cucaaaucucauuccagca

SEQ ID NO: 2517707 - RNA, 13 nt, Chlamydophila pneumoniae CWL029
cucaaaucuuuca

SEQ ID NO: 2517708 - RNA, 17 nt, Chlamydophila pneumoniae CWL029
cucaaaucuuucaagga

SEQ ID NO: 2517709 - RNA, 23 nt, Chlamydophila pneumoniae CWL029
cucaaauuggaauucgcauuuuu

SEQ ID NO: 2517710 - RNA, 17 nt, Chlamydophila pneumoniae CWL029
cucaagagcaugcuuga

SEQ ID NO: 2517711 - RNA, 20 nt, Chlamydophila pneumoniae CWL029
cucaagagcaugcuugagga

SEQ ID NO: 2517712 - RNA, 23 nt, Chlamydophila pneumoniae CWL029
cucaagauaaaucccacuaucug

SEQ ID NO: 2517713 - RNA, 22 nt, Chlamydophila pneumoniae CWL029
cucaagcgauuucgaaaaagcc

SEQ ID NO: 2517714 - RNA, 19 nt, Chlamydophila pneumoniae CWL029
cucaaggaucuuauauaaa

SEQ ID NO: 2517715 - RNA, 14 nt, Chlamydophila pneumoniae CWL029
cucaaggcaucuag

SEQ ID NO: 2517716 - RNA, 15 nt, Chlamydophila pneumoniae CWL029
cucaaggucacagca

SEQ ID NO: 2517717 - RNA, 17 nt, Chlamydophila pneumoniae CWL029
cucaaggucacagcauu

SEQ ID NO: 2517718 - RNA, 19 nt, Chlamydophila pneumoniae CWL029
cucaauaguguaacauuga

SEQ ID NO: 2517719 - RNA, 17 nt, Chlamydophila pneumoniae CWL029
cucaaucgauaaucaaa

SEQ ID NO: 2517720 - RNA, 18 nt, Chlamydophila pneumoniae CWL029
cucaaugcgauaaccacu

SEQ ID NO: 2517721 - RNA, 16 nt, Chlamydophila pneumoniae CWL029
cucacaaaagucucua

SEQ ID NO: 2517722 - RNA, 15 nt, Chlamydophila pneumoniae CWL029
cucacaaacaacaga

SEQ ID NO: 2517723 - RNA, 17 nt, Chlamydophila pneumoniae CWL029
cucacaaacaacagaaa

SEQ ID NO: 2517724 - RNA, 20 nt, Chlamydophila pneumoniae CWL029
cucacaaacaacagaaaugu

SEQ ID NO: 2517725 - RNA, 19 nt, Chlamydophila pneumoniae CWL029
cucacaacccuuuaucaag

SEQ ID NO: 2517726 - RNA, 15 nt, Chlamydophila pneumoniae CWL029
cucacaagcauccua

SEQ ID NO: 2517727 - RNA, 18 nt, Chlamydophila pneumoniae CWL029
cucacacgaauaauuaaa

SEQ ID NO: 2517728 - RNA, 20 nt, Chlamydophila pneumoniae CWL029
cucacacgaauaauuaaauc

SEQ ID NO: 2517729 - RNA, 16 nt, Chlamydophila pneumoniae CWL029
cucacauguuucacuu

SEQ ID NO: 2517730 - RNA, 16 nt, Chlamydophila pneumoniae CWL029
cucaccagaagcaacu

SEQ ID NO: 2517731 - RNA, 19 nt, Chlamydophila pneumoniae CWL029
cucaccagaagcaacuaaa

SEQ ID NO: 2517732 - RNA, 14 nt, Chlamydophila pneumoniae CWL029
cucacgggauagcc

SEQ ID NO: 2517733 - RNA, 14 nt, Chlamydophila pneumoniae CWL029
cucacuagagauuc

SEQ ID NO: 2517734 - RNA, 18 nt, Chlamydophila pneumoniae CWL029
cucacugagugucccaug

SEQ ID NO: 2517735 - RNA, 21 nt, Chlamydophila pneumoniae CWL029
cucagaaaaaucuaacacagu

SEQ ID NO: 2517736 - RNA, 18 nt, Chlamydophila pneumoniae CWL029
cucagaaaauguaaaaaa

SEQ ID NO: 2517737 - RNA, 15 nt, Chlamydophila pneumoniae CWL029
cucagagaaaaucaa

SEQ ID NO: 2517738 - RNA, 14 nt, Chlamydophila pneumoniae CWL029
cucagcaaagacau

SEQ ID NO: 2517739 - RNA, 22 nt, Chlamydophila pneumoniae CWL029
cucagcaaagacauccaagccu

SEQ ID NO: 2517740 - RNA, 18 nt, Chlamydophila pneumoniae CWL029
cucagcguucgcucucuu

SEQ ID NO: 2517741 - RNA, 13 nt, Chlamydophila pneumoniae CWL029
cucaggaaaacuu

SEQ ID NO: 2517742 - RNA, 15 nt, Chlamydophila pneumoniae CWL029
cucaggaaaacuuaa

SEQ ID NO: 2517743 - RNA, 23 nt, Chlamydophila pneumoniae CWL029
cucaggaccuaagggcucuccua

SEQ ID NO: 2517744 - RNA, 19 nt, Chlamydophila pneumoniae CWL029
cucaggagauacaagcaau

SEQ ID NO: 2517745 - RNA, 15 nt, Chlamydophila pneumoniae CWL029
cucaggcuuuaagug

SEQ ID NO: 2517746 - RNA, 19 nt, Chlamydophila pneumoniae CWL029
cucaggcuuuaaguguuuc

SEQ ID NO: 2517747 - RNA, 20 nt, Chlamydophila pneumoniae CWL029
cucaggucugcugaggagag

SEQ ID NO: 2517748 - RNA, 15 nt, Chlamydophila pneumoniae CWL029
cucagucacaauaua

SEQ ID NO: 2517749 - RNA, 23 nt, Chlamydophila pneumoniae CWL029
cucagugaacucuucaagagcuu

SEQ ID NO: 2517750 - RNA, 15 nt, Chlamydophila pneumoniae CWL029
cucaguguauuguuu

SEQ ID NO: 2517751 - RNA, 12 nt, Chlamydophila pneumoniae CWL029
cucaguugagaa

SEQ ID NO: 2517752 - RNA, 15 nt, Chlamydophila pneumoniae CWL029
cucauaacccaaagg

SEQ ID NO: 2517753 - RNA, 18 nt, Chlamydophila pneumoniae CWL029
cucauaguuucuaucuaa

SEQ ID NO: 2517754 - RNA, 21 nt, Chlamydophila pneumoniae CWL029
cucauauuuugucuucaucau

SEQ ID NO: 2517755 - RNA, 18 nt, Chlamydophila pneumoniae CWL029
cucaucacaauuuuaaaa

SEQ ID NO: 2517756 - RNA, 23 nt, Chlamydophila pneumoniae CWL029
cucaucagaaguggccuugccag

SEQ ID NO: 2517757 - RNA, 21 nt, Chlamydophila pneumoniae CWL029
cucaucagaggccaccaaaaa

SEQ ID NO: 2517758 - RNA, 17 nt, Chlamydophila pneumoniae CWL029
cucaucagcaaaacucc

SEQ ID NO: 2517759 - RNA, 21 nt, Chlamydophila pneumoniae CWL029
cucaucaguaaaagacugaaa

SEQ ID NO: 2517760 - RNA, 22 nt, Chlamydophila pneumoniae CWL029
cucaucauaaauaggcucuaca

SEQ ID NO: 2517761 - RNA, 14 nt, Chlamydophila pneumoniae CWL029
cucaucaucagaaa

SEQ ID NO: 2517762 - RNA, 13 nt, Chlamydophila pneumoniae CWL029
cucaucauccuca

SEQ ID NO: 2517763 - RNA, 20 nt, Chlamydophila pneumoniae CWL029
cucaucauccucaggaccua

SEQ ID NO: 2517764 - RNA, 16 nt, Chlamydophila pneumoniae CWL029
cucauccagacaagac

SEQ ID NO: 2517765 - RNA, 17 nt, Chlamydophila pneumoniae CWL029
cucauccagacaagaca

SEQ ID NO: 2517766 - RNA, 15 nt, Chlamydophila pneumoniae CWL029
cucaucgaaucuuga

SEQ ID NO: 2517767 - RNA, 23 nt, Chlamydophila pneumoniae CWL029
cucaucgaaucuugauauugaaa

SEQ ID NO: 2517768 - RNA, 18 nt, Chlamydophila pneumoniae CWL029
cucaucggaucuuuucuu

SEQ ID NO: 2517769 - RNA, 19 nt, Chlamydophila pneumoniae CWL029
cucaucggaucuuuucuuu

SEQ ID NO: 2517770 - RNA, 20 nt, Chlamydophila pneumoniae CWL029
cucaucuuugaacaacuccu

SEQ ID NO: 2517771 - RNA, 17 nt, Chlamydophila pneumoniae CWL029
cucaugaaauuuucuaa

SEQ ID NO: 2517772 - RNA, 13 nt, Chlamydophila pneumoniae CWL029
cucaugaagaauu

SEQ ID NO: 2517773 - RNA, 21 nt, Chlamydophila pneumoniae CWL029
cucaugaagaauuaccgcgag

SEQ ID NO: 2517774 - RNA, 19 nt, Chlamydophila pneumoniae CWL029
cucaugcggacuuuauucu

SEQ ID NO: 2517775 - RNA, 20 nt, Chlamydophila pneumoniae CWL029
cucaugcggacuuuauucuc

SEQ ID NO: 2517776 - RNA, 15 nt, Chlamydophila pneumoniae CWL029
cucauggauuacuga

SEQ ID NO: 2517777 - RNA, 17 nt, Chlamydophila pneumoniae CWL029
cucauuccagcaucuuc

SEQ ID NO: 2517778 - RNA, 15 nt, Chlamydophila pneumoniae CWL029
cucauugcggcacca

SEQ ID NO: 2517779 - RNA, 23 nt, Chlamydophila pneumoniae CWL029
cucauuucguagacgcucuaaac

SEQ ID NO: 2517780 - RNA, 16 nt, Chlamydophila pneumoniae CWL029
cuccaaaaauucccau

SEQ ID NO: 2517781 - RNA, 18 nt, Chlamydophila pneumoniae CWL029
cuccaaaagaccaaaaau

SEQ ID NO: 2517782 - RNA, 19 nt, Chlamydophila pneumoniae CWL029
cuccaaaagaccaaaaaua

SEQ ID NO: 2517783 - RNA, 18 nt, Chlamydophila pneumoniae CWL029
cuccaaaagcucuacaag

SEQ ID NO: 2517784 - RNA, 23 nt, Chlamydophila pneumoniae CWL029
cuccaaaauaaucucgcaguccu

SEQ ID NO: 2517785 - RNA, 15 nt, Chlamydophila pneumoniae CWL029
cuccaaaauauucuu

SEQ ID NO: 2517786 - RNA, 21 nt, Chlamydophila pneumoniae CWL029
cuccaaacauuuuuaaggaaa

SEQ ID NO: 2517787 - RNA, 11 nt, Chlamydophila pneumoniae CWL029
cuccaaauaaa

SEQ ID NO: 2517788 - RNA, 13 nt, Chlamydophila pneumoniae CWL029
cuccaaauaaagc

SEQ ID NO: 2517789 - RNA, 17 nt, Chlamydophila pneumoniae CWL029
cuccaaauguucucucc

SEQ ID NO: 2517790 - RNA, 13 nt, Chlamydophila pneumoniae CWL029
cuccaacagucug

SEQ ID NO: 2517791 - RNA, 19 nt, Chlamydophila pneumoniae CWL029
cuccaacuaaaccuucaau

SEQ ID NO: 2517792 - RNA, 13 nt, Chlamydophila pneumoniae CWL029
cuccaacuuccau

SEQ ID NO: 2517793 - RNA, 15 nt, Chlamydophila pneumoniae CWL029
cuccaagauaauuau

SEQ ID NO: 2517794 - RNA, 18 nt, Chlamydophila pneumoniae CWL029
cuccaagucagccaagac

SEQ ID NO: 2517795 - RNA, 20 nt, Chlamydophila pneumoniae CWL029
cuccaaugagcucuauuucu

SEQ ID NO: 2517796 - RNA, 19 nt, Chlamydophila pneumoniae CWL029
cuccacaggaaugaaaccu

SEQ ID NO: 2517797 - RNA, 14 nt, Chlamydophila pneumoniae CWL029
cuccacaugccugc

SEQ ID NO: 2517798 - RNA, 19 nt, Chlamydophila pneumoniae CWL029
cuccaccaggagcuccucc

SEQ ID NO: 2517799 - RNA, 22 nt, Chlamydophila pneumoniae CWL029
cuccaccaggagcuccuccuug

SEQ ID NO: 2517800 - RNA, 22 nt, Chlamydophila pneumoniae CWL029
cuccacgccaaaguacucgcuu

SEQ ID NO: 2517801 - RNA, 17 nt, Chlamydophila pneumoniae CWL029
cuccagaaacgcagcuu

SEQ ID NO: 2517802 - RNA, 18 nt, Chlamydophila pneumoniae CWL029
cuccagaaacgcagcuuu

SEQ ID NO: 2517803 - RNA, 20 nt, Chlamydophila pneumoniae CWL029
cuccagaaacgcagcuuucc

SEQ ID NO: 2517804 - RNA, 14 nt, Chlamydophila pneumoniae CWL029
cuccagaaauuuuu

SEQ ID NO: 2517805 - RNA, 19 nt, Chlamydophila pneumoniae CWL029
cuccagaaauuuuuacaau

SEQ ID NO: 2517806 - RNA, 22 nt, Chlamydophila pneumoniae CWL029
cuccagaaauuuuuacaaucuc

SEQ ID NO: 2517807 - RNA, 12 nt, Chlamydophila pneumoniae CWL029
cuccagaagcaa

SEQ ID NO: 2517808 - RNA, 16 nt, Chlamydophila pneumoniae CWL029
cuccagaagcaagaau

SEQ ID NO: 2517809 - RNA, 22 nt, Chlamydophila pneumoniae CWL029
cuccaggguguuugcauaguau

SEQ ID NO: 2517810 - RNA, 23 nt, Chlamydophila pneumoniae CWL029
cuccagguagcagaguuuuuccc

SEQ ID NO: 2517811 - RNA, 13 nt, Chlamydophila pneumoniae CWL029
cuccauacagcgc

SEQ ID NO: 2517812 - RNA, 22 nt, Chlamydophila pneumoniae CWL029
cuccauagaauccucggaagau

SEQ ID NO: 2517813 - RNA, 17 nt, Chlamydophila pneumoniae CWL029
cuccauuggcauagagc

SEQ ID NO: 2517814 - RNA, 22 nt, Chlamydophila pneumoniae CWL029
cuccauuggcauagagccuaga

SEQ ID NO: 2517815 - RNA, 13 nt, Chlamydophila pneumoniae CWL029
cuccauuuagaau

SEQ ID NO: 2517816 - RNA, 18 nt, Chlamydophila pneumoniae CWL029
cuccauuuagacaagaca

SEQ ID NO: 2517817 - RNA, 21 nt, Chlamydophila pneumoniae CWL029
cuccauuucuaggaauugcug

SEQ ID NO: 2517818 - RNA, 20 nt, Chlamydophila pneumoniae CWL029
cucccaacaagggaaagaaa

SEQ ID NO: 2517819 - RNA, 17 nt, Chlamydophila pneumoniae CWL029
cucccaauauccagaaa

SEQ ID NO: 2517820 - RNA, 14 nt, Chlamydophila pneumoniae CWL029
cucccauuucugga

SEQ ID NO: 2517821 - RNA, 22 nt, Chlamydophila pneumoniae CWL029
cucccauuucuggagaaugccc

SEQ ID NO: 2517822 - RNA, 13 nt, Chlamydophila pneumoniae CWL029
cuccccauacaua

SEQ ID NO: 2517823 - RNA, 17 nt, Chlamydophila pneumoniae CWL029
cuccgaauggagaagga

SEQ ID NO: 2517824 - RNA, 13 nt, Chlamydophila pneumoniae CWL029
cuccgagaaacaa

SEQ ID NO: 2517825 - RNA, 13 nt, Chlamydophila pneumoniae CWL029
cuccgaggaggga

SEQ ID NO: 2517826 - RNA, 21 nt, Chlamydophila pneumoniae CWL029
cuccgauagagauucuuucuc

SEQ ID NO: 2517827 - RNA, 23 nt, Chlamydophila pneumoniae CWL029
cuccgcuuuuacgaaugagauca

SEQ ID NO: 2517828 - RNA, 21 nt, Chlamydophila pneumoniae CWL029
cuccgucaagaacaagagcuu

SEQ ID NO: 2517829 - RNA, 20 nt, Chlamydophila pneumoniae CWL029
cuccguccaguucuucauuc

SEQ ID NO: 2517830 - RNA, 19 nt, Chlamydophila pneumoniae CWL029
cuccuaaaccaucacuucc

SEQ ID NO: 2517831 - RNA, 22 nt, Chlamydophila pneumoniae CWL029
cuccuaaacucaauuaugccca

SEQ ID NO: 2517832 - RNA, 23 nt, Chlamydophila pneumoniae CWL029
cuccuaaggaaaccacguccauu

SEQ ID NO: 2517833 - RNA, 21 nt, Chlamydophila pneumoniae CWL029
cuccuaagucguuaacaucaa

SEQ ID NO: 2517834 - RNA, 14 nt, Chlamydophila pneumoniae CWL029
cuccuagacagccu

SEQ ID NO: 2517835 - RNA, 12 nt, Chlamydophila pneumoniae CWL029
cuccuaggggaa

SEQ ID NO: 2517836 - RNA, 18 nt, Chlamydophila pneumoniae CWL029
cuccuauugguguaucuc

SEQ ID NO: 2517837 - RNA, 20 nt, Chlamydophila pneumoniae CWL029
cuccuauugguguaucucuu

SEQ ID NO: 2517838 - RNA, 12 nt, Chlamydophila pneumoniae CWL029
cuccucaaaaga

SEQ ID NO: 2517839 - RNA, 19 nt, Chlamydophila pneumoniae CWL029
cuccucagaauccauuuug

SEQ ID NO: 2517840 - RNA, 12 nt, Chlamydophila pneumoniae CWL029
cuccucaucaga

SEQ ID NO: 2517841 - RNA, 16 nt, Chlamydophila pneumoniae CWL029
cuccuccaaucugcug

SEQ ID NO: 2517842 - RNA, 18 nt, Chlamydophila pneumoniae CWL029
cuccuccaaugagcucua

SEQ ID NO: 2517843 - RNA, 19 nt, Chlamydophila pneumoniae CWL029
cuccuccaaugagcucuau

SEQ ID NO: 2517844 - RNA, 16 nt, Chlamydophila pneumoniae CWL029
cuccuccuucugcaau

SEQ ID NO: 2517845 - RNA, 23 nt, Chlamydophila pneumoniae CWL029
cuccucguuaauaagaaccucua

SEQ ID NO: 2517846 - RNA, 17 nt, Chlamydophila pneumoniae CWL029
cuccucuaacuucauua

SEQ ID NO: 2517847 - RNA, 17 nt, Chlamydophila pneumoniae CWL029
cuccucucucaauaaga

SEQ ID NO: 2517848 - RNA, 15 nt, Chlamydophila pneumoniae CWL029
cuccucugcuaagca

SEQ ID NO: 2517849 - RNA, 20 nt, Chlamydophila pneumoniae CWL029
cgaacuucagcaagaaaaua

SEQ ID NO: 2517850 - RNA, 16 nt, Chlamydophila pneumoniae CWL029
cgaagaacagaggauc

SEQ ID NO: 2517851 - RNA, 21 nt, Chlamydophila pneumoniae CWL029
cgaagacaaugucgucucaga

SEQ ID NO: 2517852 - RNA, 15 nt, Chlamydophila pneumoniae CWL029
cgaagacuuguucuu

SEQ ID NO: 2517853 - RNA, 20 nt, Chlamydophila pneumoniae CWL029
cgaagacuuguucuucauua

SEQ ID NO: 2517854 - RNA, 22 nt, Chlamydophila pneumoniae CWL029
cgaagagcccucuucacuuaua

SEQ ID NO: 2517855 - RNA, 17 nt, Chlamydophila pneumoniae CWL029
cgaagauccuagagaau

SEQ ID NO: 2517856 - RNA, 19 nt, Chlamydophila pneumoniae CWL029
cgaagauuuagggaagagu

SEQ ID NO: 2517857 - RNA, 20 nt, Chlamydophila pneumoniae CWL029
cgaagcauucccgacucaau

SEQ ID NO: 2517858 - RNA, 18 nt, Chlamydophila pneumoniae CWL029
cgaagcgccgcauuacag

SEQ ID NO: 2517859 - RNA, 18 nt, Chlamydophila pneumoniae CWL029
cgaagcuugcugauuucu

SEQ ID NO: 2517860 - RNA, 23 nt, Chlamydophila pneumoniae CWL029
cgaagcuugcugauuucuuuuuc

SEQ ID NO: 2517861 - RNA, 23 nt, Chlamydophila pneumoniae CWL029
cgaagggaguuucccgacauuua

SEQ ID NO: 2517862 - RNA, 19 nt, Chlamydophila pneumoniae CWL029
cgaaggggaagaggaaugc

SEQ ID NO: 2517863 - RNA, 20 nt, Chlamydophila pneumoniae CWL029
cgaaggggaagaggaaugcc

SEQ ID NO: 2517864 - RNA, 14 nt, Chlamydophila pneumoniae CWL029
cgaaguccuggauu

SEQ ID NO: 2517865 - RNA, 18 nt, Chlamydophila pneumoniae CWL029
cgaauaaggcuugaggau

SEQ ID NO: 2517866 - RNA, 18 nt, Chlamydophila pneumoniae CWL029
cgaauagaaaagguauua

SEQ ID NO: 2517867 - RNA, 17 nt, Chlamydophila pneumoniae CWL029
cgaaucuuucaaaagaa

SEQ ID NO: 2517868 - RNA, 21 nt, Chlamydophila pneumoniae CWL029
cgaaugguuccugaagcagcu

SEQ ID NO: 2517869 - RNA, 21 nt, Chlamydophila pneumoniae CWL029
cgaauguagccaauccuucca

SEQ ID NO: 2517870 - RNA, 23 nt, Chlamydophila pneumoniae CWL029
cgaauucucagaaagccuuugcu

SEQ ID NO: 2517871 - RNA, 18 nt, Chlamydophila pneumoniae CWL029
cgaauuucaacagcuuca

SEQ ID NO: 2517872 - RNA, 20 nt, Chlamydophila pneumoniae CWL029
cgacaccgauucgcuacaua

SEQ ID NO: 2517873 - RNA, 15 nt, Chlamydophila pneumoniae CWL029
cgacacucaaaucuu

SEQ ID NO: 2517874 - RNA, 20 nt, Chlamydophila pneumoniae CWL029
cgacagcagcauuuucuaaa

SEQ ID NO: 2517875 - RNA, 14 nt, Chlamydophila pneumoniae CWL029
cgacauacaucaaa

SEQ ID NO: 2517876 - RNA, 22 nt, Chlamydophila pneumoniae CWL029
cgacauacaucaaaaugcugcu

SEQ ID NO: 2517877 - RNA, 21 nt, Chlamydophila pneumoniae CWL029
cgacaugccuaaauagcucag

SEQ ID NO: 2517878 - RNA, 18 nt, Chlamydophila pneumoniae CWL029
cgaccucgaauuccuccc

SEQ ID NO: 2517879 - RNA, 23 nt, Chlamydophila pneumoniae CWL029
cgaccugagguaucaauaaugac

SEQ ID NO: 2517880 - RNA, 19 nt, Chlamydophila pneumoniae CWL029
cgaccugcaaacuccccag

SEQ ID NO: 2517881 - RNA, 22 nt, Chlamydophila pneumoniae CWL029
cgacgacgucuucuuagaagag

SEQ ID NO: 2517882 - RNA, 18 nt, Chlamydophila pneumoniae CWL029
cgacuacaucuuguucug

SEQ ID NO: 2517883 - RNA, 18 nt, Chlamydophila pneumoniae CWL029
cgacuguacaaaugcauc

SEQ ID NO: 2517884 - RNA, 13 nt, Chlamydophila pneumoniae CWL029
cgacuugccaauc

SEQ ID NO: 2517885 - RNA, 22 nt, Chlamydophila pneumoniae CWL029
cgagaaaauccguauuuggcuu

SEQ ID NO: 2517886 - RNA, 13 nt, Chlamydophila pneumoniae CWL029
cgagaaccuccac

SEQ ID NO: 2517887 - RNA, 21 nt, Chlamydophila pneumoniae CWL029
cgagaaccuccaccaggagcu

SEQ ID NO: 2517888 - RNA, 18 nt, Chlamydophila pneumoniae CWL029
cgagaacguagcagaggc

SEQ ID NO: 2517889 - RNA, 15 nt, Chlamydophila pneumoniae CWL029
cgagacuauuuugga

SEQ ID NO: 2517890 - RNA, 18 nt, Chlamydophila pneumoniae CWL029
cgagaguugccaggaaac

SEQ ID NO: 2517891 - RNA, 19 nt, Chlamydophila pneumoniae CWL029
cgagaucauuagcaucauc

SEQ ID NO: 2517892 - RNA, 20 nt, Chlamydophila pneumoniae CWL029
cgagaucauuagcaucaucu

SEQ ID NO: 2517893 - RNA, 22 nt, Chlamydophila pneumoniae CWL029
cgagaucauuagcaucaucucc

SEQ ID NO: 2517894 - RNA, 16 nt, Chlamydophila pneumoniae CWL029
cgagaucuuugagauc

SEQ ID NO: 2517895 - RNA, 22 nt, Chlamydophila pneumoniae CWL029
cgagcgggagaaucaauaaaag

SEQ ID NO: 2517896 - RNA, 20 nt, Chlamydophila pneumoniae CWL029
cgagcuaccagaacaccauc

SEQ ID NO: 2517897 - RNA, 17 nt, Chlamydophila pneumoniae CWL029
cgagcucgcaaaagcug

SEQ ID NO: 2517898 - RNA, 17 nt, Chlamydophila pneumoniae CWL029
cgagcugaucuucuaaa

SEQ ID NO: 2517899 - RNA, 10 nt, Chlamydophila pneumoniae CWL029
cgagcuucca

SEQ ID NO: 2517900 - RNA, 23 nt, Chlamydophila pneumoniae CWL029
cgaggagcgauagcucagcucua

SEQ ID NO: 2517901 - RNA, 15 nt, Chlamydophila pneumoniae CWL029
cgaguaguccugacg

SEQ ID NO: 2517902 - RNA, 22 nt, Chlamydophila pneumoniae CWL029
cgagucccuucuuucaauagcu

SEQ ID NO: 2517903 - RNA, 22 nt, Chlamydophila pneumoniae CWL029
cgaguucgcggaucuucuucug

SEQ ID NO: 2517904 - RNA, 13 nt, Chlamydophila pneumoniae CWL029
cgaguuucgauau

SEQ ID NO: 2517905 - RNA, 19 nt, Chlamydophila pneumoniae CWL029
cgauaacacuucuuucuug

SEQ ID NO: 2517906 - RNA, 20 nt, Chlamydophila pneumoniae CWL029
cgauaaucaaagguuuuuga

SEQ ID NO: 2517907 - RNA, 20 nt, Chlamydophila pneumoniae CWL029
cgauacccaucuagaaacau

SEQ ID NO: 2517908 - RNA, 20 nt, Chlamydophila pneumoniae CWL029
cgauagaucacaucaagaua

SEQ ID NO: 2517909 - RNA, 22 nt, Chlamydophila pneumoniae CWL029
cggcauuucuccacaugccugc

SEQ ID NO: 2517910 - RNA, 14 nt, Chlamydophila pneumoniae CWL029
cggcucucuucauu

SEQ ID NO: 2517911 - RNA, 21 nt, Chlamydophila pneumoniae CWL029
cggcugcgguagccuggaggc

SEQ ID NO: 2517912 - RNA, 21 nt, Chlamydophila pneumoniae CWL029
cgggaauaauaggauaagaaa

SEQ ID NO: 2517913 - RNA, 14 nt, Chlamydophila pneumoniae CWL029
cgggagucuucagc

SEQ ID NO: 2517914 - RNA, 16 nt, Chlamydophila pneumoniae CWL029
cgggguuguauuuccu

SEQ ID NO: 2517915 - RNA, 21 nt, Chlamydophila pneumoniae CWL029
cgggucaggaggugguggagc

SEQ ID NO: 2517916 - RNA, 21 nt, Chlamydophila pneumoniae CWL029
cggucacguucuuagaaagcg

SEQ ID NO: 2517917 - RNA, 16 nt, Chlamydophila pneumoniae CWL029
cggugggccucuuccc

SEQ ID NO: 2517918 - RNA, 17 nt, Chlamydophila pneumoniae CWL029
cgguucggucucuucuc

SEQ ID NO: 2517919 - RNA, 17 nt, Chlamydophila pneumoniae CWL029
cgguuuaaacagaucuu

SEQ ID NO: 2517920 - RNA, 21 nt, Chlamydophila pneumoniae CWL029
cgguuuaaacagaucuuuauc

SEQ ID NO: 2517921 - RNA, 13 nt, Chlamydophila pneumoniae CWL029
cgguuucugggau

SEQ ID NO: 2517922 - RNA, 14 nt, Chlamydophila pneumoniae CWL029
cguaaaaagaaaga

SEQ ID NO: 2517923 - RNA, 12 nt, Chlamydophila pneumoniae CWL029
cguaaagaaaag

SEQ ID NO: 2517924 - RNA, 14 nt, Chlamydophila pneumoniae CWL029
cguaaagaaaagca

SEQ ID NO: 2517925 - RNA, 14 nt, Chlamydophila pneumoniae CWL029
cguaaccacaggau

SEQ ID NO: 2517926 - RNA, 18 nt, Chlamydophila pneumoniae CWL029
cguaacugaggcaaagau

SEQ ID NO: 2517927 - RNA, 19 nt, Chlamydophila pneumoniae CWL029
cguaagcugcaaucucaaa

SEQ ID NO: 2517928 - RNA, 23 nt, Chlamydophila pneumoniae CWL029
cguaauagcgacaugagaaaucu

SEQ ID NO: 2517929 - RNA, 18 nt, Chlamydophila pneumoniae CWL029
cguaauccuucuuucugc

SEQ ID NO: 2517930 - RNA, 17 nt, Chlamydophila pneumoniae CWL029
cguaaucuuuuuuaaag

SEQ ID NO: 2517931 - RNA, 23 nt, Chlamydophila pneumoniae CWL029
cguaaugcccgauauccucgaga

SEQ ID NO: 2517932 - RNA, 19 nt, Chlamydophila pneumoniae CWL029
cguaaugcuccacggaaau

SEQ ID NO: 2517933 - RNA, 18 nt, Chlamydophila pneumoniae CWL029
cguaaugcuuagccaugg

SEQ ID NO: 2517934 - RNA, 19 nt, Chlamydophila pneumoniae CWL029
cguaccagcugauauccuu

SEQ ID NO: 2517935 - RNA, 12 nt, Chlamydophila pneumoniae CWL029
cguacucuucuu

SEQ ID NO: 2517936 - RNA, 21 nt, Chlamydophila pneumoniae CWL029
cguagacgcucuaaacucucu

SEQ ID NO: 2517937 - RNA, 19 nt, Chlamydophila pneumoniae CWL029
cguagaggacgugcuccca

SEQ ID NO: 2517938 - RNA, 23 nt, Chlamydophila pneumoniae CWL029
cguagcuacaaaauuauuaaacu

SEQ ID NO: 2517939 - RNA, 20 nt, Chlamydophila pneumoniae CWL029
cguaggguagccauccacga

SEQ ID NO: 2517940 - RNA, 16 nt, Chlamydophila pneumoniae CWL029
cguaggguauccugcu

SEQ ID NO: 2517941 - RNA, 16 nt, Chlamydophila pneumoniae CWL029
cguagguuugcugcuc

SEQ ID NO: 2517942 - RNA, 17 nt, Chlamydophila pneumoniae CWL029
cguauacgucccacaaa

SEQ ID NO: 2517943 - RNA, 14 nt, Chlamydophila pneumoniae CWL029
cguauagaauagaa

SEQ ID NO: 2517944 - RNA, 22 nt, Chlamydophila pneumoniae CWL029
cguauagguacgcuuuuucuug

SEQ ID NO: 2517945 - RNA, 14 nt, Chlamydophila pneumoniae CWL029
cguauccuugauuu

SEQ ID NO: 2517946 - RNA, 16 nt, Chlamydophila pneumoniae CWL029
cguaugcaucaaugaa

SEQ ID NO: 2517947 - RNA, 21 nt, Chlamydophila pneumoniae CWL029
cucuacaguaguaaauaauaa

SEQ ID NO: 2517948 - RNA, 24 nt, Chlamydophila pneumoniae CWL029
cucuacaguaguaaauaauaaccu

SEQ ID NO: 2517949 - RNA, 13 nt, Chlamydophila pneumoniae CWL029
cucuaccaacuga

SEQ ID NO: 2517950 - RNA, 20 nt, Chlamydophila pneumoniae CWL029
cucuacccccagcuucuuca

SEQ ID NO: 2517951 - RNA, 18 nt, Chlamydophila pneumoniae CWL029
cucuacuaaaaucucauu

SEQ ID NO: 2517952 - RNA, 12 nt, Chlamydophila pneumoniae CWL029
cucuacucuaca

SEQ ID NO: 2517953 - RNA, 20 nt, Chlamydophila pneumoniae CWL029
cucuagcaccuaauaaagaa

SEQ ID NO: 2517954 - RNA, 23 nt, Chlamydophila pneumoniae CWL029
cucuagccaauauagaagcugcu

SEQ ID NO: 2517955 - RNA, 14 nt, Chlamydophila pneumoniae CWL029
cucuagccaccaac

SEQ ID NO: 2517956 - RNA, 15 nt, Chlamydophila pneumoniae CWL029
cucuagccaccaaca

SEQ ID NO: 2517957 - RNA, 21 nt, Chlamydophila pneumoniae CWL029
cucuaggaacucuuuaaaagg

SEQ ID NO: 2517958 - RNA, 19 nt, Chlamydophila pneumoniae CWL029
cucuagggauaauuaaacu

SEQ ID NO: 2517959 - RNA, 15 nt, Chlamydophila pneumoniae CWL029
cucuagggguuuccc

SEQ ID NO: 2517960 - RNA, 19 nt, Chlamydophila pneumoniae CWL029
cucuagucuuucaaccucc

SEQ ID NO: 2517961 - RNA, 13 nt, Chlamydophila pneumoniae CWL029
cucuauaaaaaaa

SEQ ID NO: 2517962 - RNA, 17 nt, Chlamydophila pneumoniae CWL029
cucuauauauccugagu

SEQ ID NO: 2517963 - RNA, 19 nt, Chlamydophila pneumoniae CWL029
cucuauauauccugaguga

SEQ ID NO: 2517964 - RNA, 12 nt, Chlamydophila pneumoniae CWL029
cucuauauuuuu

SEQ ID NO: 2517965 - RNA, 19 nt, Chlamydophila pneumoniae CWL029
cucuauauuuuuucccaca

SEQ ID NO: 2517966 - RNA, 21 nt, Chlamydophila pneumoniae CWL029
cucuaugguuuucauugcagu

SEQ ID NO: 2517967 - RNA, 13 nt, Chlamydophila pneumoniae CWL029
cucucacugagug

SEQ ID NO: 2517968 - RNA, 14 nt, Chlamydophila pneumoniae CWL029
cucucacugagugu

SEQ ID NO: 2517969 - RNA, 22 nt, Chlamydophila pneumoniae CWL029
cucucaggagauaauccuuuag

SEQ ID NO: 2517970 - RNA, 22 nt, Chlamydophila pneumoniae CWL029
cucucaucaaagcaaagagcaa

SEQ ID NO: 2517971 - RNA, 11 nt, Chlamydophila pneumoniae CWL029
cucuccaaaag

SEQ ID NO: 2517972 - RNA, 18 nt, Chlamydophila pneumoniae CWL029
cucuccagaagucgcagu

SEQ ID NO: 2517973 - RNA, 20 nt, Chlamydophila pneumoniae CWL029
cucuccagcuguggugguga

SEQ ID NO: 2517974 - RNA, 19 nt, Chlamydophila pneumoniae CWL029
cucuccagcuugaucagga

SEQ ID NO: 2517975 - RNA, 12 nt, Chlamydophila pneumoniae CWL029
cucuccauggcu

SEQ ID NO: 2517976 - RNA, 13 nt, Chlamydophila pneumoniae CWL029
cucuccauggcuu

SEQ ID NO: 2517977 - RNA, 15 nt, Chlamydophila pneumoniae CWL029
cucucccauguagua

SEQ ID NO: 2517978 - RNA, 15 nt, Chlamydophila pneumoniae CWL029
cucucccgaccaaga

SEQ ID NO: 2517979 - RNA, 19 nt, Chlamydophila pneumoniae CWL029
cucuccgauaugggcuuug

SEQ ID NO: 2517980 - RNA, 14 nt, Chlamydophila pneumoniae CWL029
cucuccuaaaccau

SEQ ID NO: 2517981 - RNA, 16 nt, Chlamydophila pneumoniae CWL029
cucuccuaaaccauca

SEQ ID NO: 2517982 - RNA, 23 nt, Chlamydophila pneumoniae CWL029
cucuccuaaugccgagaauacag

SEQ ID NO: 2517983 - RNA, 14 nt, Chlamydophila pneumoniae CWL029
cucuccuccccacu

SEQ ID NO: 2517984 - RNA, 15 nt, Chlamydophila pneumoniae CWL029
cucuccugcaaaaag

SEQ ID NO: 2517985 - RNA, 24 nt, Chlamydophila pneumoniae CWL029
cucuccuugacaaauaaguccugu

SEQ ID NO: 2517986 - RNA, 20 nt, Chlamydophila pneumoniae CWL029
cucucuaucuacacacauga

SEQ ID NO: 2517987 - RNA, 23 nt, Chlamydophila pneumoniae CWL029
cucucucaagucuauuugaaaag

SEQ ID NO: 2517988 - RNA, 12 nt, Chlamydophila pneumoniae CWL029
cucucucugcag

SEQ ID NO: 2517989 - RNA, 18 nt, Chlamydophila pneumoniae CWL029
cucucugaagcuaaaaaa

SEQ ID NO: 2517990 - RNA, 19 nt, Chlamydophila pneumoniae CWL029
cucucuguagcacuucuca

SEQ ID NO: 2517991 - RNA, 21 nt, Chlamydophila pneumoniae CWL029
cucucuguagcacuucucagc

SEQ ID NO: 2517992 - RNA, 13 nt, Chlamydophila pneumoniae CWL029
cucucuuccugcu

SEQ ID NO: 2517993 - RNA, 13 nt, Chlamydophila pneumoniae CWL029
cucucuuccuucu

SEQ ID NO: 2517994 - RNA, 11 nt, Chlamydophila pneumoniae CWL029
cucucuucuuc

SEQ ID NO: 2517995 - RNA, 15 nt, Chlamydophila pneumoniae CWL029
cucucuugcuauacc

SEQ ID NO: 2517996 - RNA, 21 nt, Chlamydophila pneumoniae CWL029
cucucuuuaaaccuggcauug

SEQ ID NO: 2517997 - RNA, 18 nt, Chlamydophila pneumoniae CWL029
cucucuuuauauuuuuug

SEQ ID NO: 2517998 - RNA, 16 nt, Chlamydophila pneumoniae CWL029
cucugaagcuaaaaaa

SEQ ID NO: 2517999 - RNA, 18 nt, Chlamydophila pneumoniae CWL029
cucugacaaguguguuuc

SEQ ID NO: 2518000 - RNA, 20 nt, Chlamydophila pneumoniae CWL029
cucugacacuccucagaauc

SEQ ID NO: 2518001 - RNA, 18 nt, Chlamydophila pneumoniae CWL029
cucugaucccucaaaauc

SEQ ID NO: 2518002 - RNA, 19 nt, Chlamydophila pneumoniae CWL029
cucugaucccucaaaauca

SEQ ID NO: 2518003 - RNA, 23 nt, Chlamydophila pneumoniae CWL029
cucugccuaccaaaguuuguagc

SEQ ID NO: 2518004 - RNA, 15 nt, Chlamydophila pneumoniae CWL029
cucuggaauacauuc

SEQ ID NO: 2518005 - RNA, 21 nt, Chlamydophila pneumoniae CWL029
cucugggaagacucucaucag

SEQ ID NO: 2518006 - RNA, 15 nt, Chlamydophila pneumoniae CWL029
cucugggaauuguuc

SEQ ID NO: 2518007 - RNA, 19 nt, Chlamydophila pneumoniae CWL029
cucugguauagaaacaccg

SEQ ID NO: 2518008 - RNA, 20 nt, Chlamydophila pneumoniae CWL029
cucugguauagaaacaccgu

SEQ ID NO: 2518009 - RNA, 22 nt, Chlamydophila pneumoniae CWL029
cucuguaauauucaacauguua

SEQ ID NO: 2518010 - RNA, 23 nt, Chlamydophila pneumoniae CWL029
cucuguagguuuuuccaacuuca

SEQ ID NO: 2518011 - RNA, 11 nt, Chlamydophila pneumoniae CWL029
cucuguaguaa

SEQ ID NO: 2518012 - RNA, 17 nt, Chlamydophila pneumoniae CWL029
cucugugguuccuggau

SEQ ID NO: 2518013 - RNA, 20 nt, Chlamydophila pneumoniae CWL029
cucuguguuuugaggaacuu

SEQ ID NO: 2518014 - RNA, 20 nt, Chlamydophila pneumoniae CWL029
cucuguugggagcuuccucc

SEQ ID NO: 2518015 - RNA, 14 nt, Chlamydophila pneumoniae CWL029
cucuuaaaauauua

SEQ ID NO: 2518016 - RNA, 20 nt, Chlamydophila pneumoniae CWL029
cucuuaaaugugaaaucgua

SEQ ID NO: 2518017 - RNA, 12 nt, Chlamydophila pneumoniae CWL029
cucuuaacuggc

SEQ ID NO: 2518018 - RNA, 14 nt, Chlamydophila pneumoniae CWL029
cucuuaagaauaaa

SEQ ID NO: 2518019 - RNA, 21 nt, Chlamydophila pneumoniae CWL029
cucuuaucuggagaugcgcuc

SEQ ID NO: 2518020 - RNA, 16 nt, Chlamydophila pneumoniae CWL029
cucuuauugcagaauc

SEQ ID NO: 2518021 - RNA, 15 nt, Chlamydophila pneumoniae CWL029
cucuucaaaagaccg

SEQ ID NO: 2518022 - RNA, 21 nt, Chlamydophila pneumoniae CWL029
cucuucaauuucuucaucaau

SEQ ID NO: 2518023 - RNA, 19 nt, Chlamydophila pneumoniae CWL029
cucuucacuuauaagcugc

SEQ ID NO: 2518024 - RNA, 20 nt, Chlamydophila pneumoniae CWL029
cucuucauugcaaaaaugaa

SEQ ID NO: 2518025 - RNA, 15 nt, Chlamydophila pneumoniae CWL029
cucuucauuuucuuu

SEQ ID NO: 2518026 - RNA, 14 nt, Chlamydophila pneumoniae CWL029
cucuuccugcugcu

SEQ ID NO: 2518027 - RNA, 18 nt, Chlamydophila pneumoniae CWL029
cucuuccuucuacagauu

SEQ ID NO: 2518028 - RNA, 13 nt, Chlamydophila pneumoniae CWL029
cucuuccuucucc

SEQ ID NO: 2518029 - RNA, 15 nt, Chlamydophila pneumoniae CWL029
cucuucuuuggaugc

SEQ ID NO: 2518030 - RNA, 16 nt, Chlamydophila pneumoniae CWL029
cucuugaauauuuaaa

SEQ ID NO: 2518031 - RNA, 20 nt, Chlamydophila pneumoniae CWL029
cucuugauugcuaucaaaga

SEQ ID NO: 2518032 - RNA, 18 nt, Chlamydophila pneumoniae CWL029
cucuugcgaacuauccua

SEQ ID NO: 2518033 - RNA, 16 nt, Chlamydophila pneumoniae CWL029
cucuugcucuagucuu

SEQ ID NO: 2518034 - RNA, 13 nt, Chlamydophila pneumoniae CWL029
cucuuuaaaaaau

SEQ ID NO: 2518035 - RNA, 18 nt, Chlamydophila pneumoniae CWL029
cucuuuaaaaauagaaau

SEQ ID NO: 2518036 - RNA, 21 nt, Chlamydophila pneumoniae CWL029
cucuuuaacuucuaaaagcaa

SEQ ID NO: 2518037 - RNA, 14 nt, Chlamydophila pneumoniae CWL029
cucuuuaagaacuu

SEQ ID NO: 2518038 - RNA, 22 nt, Chlamydophila pneumoniae CWL029
cucuuuaauccaguuuuuuaaa

SEQ ID NO: 2518039 - RNA, 19 nt, Chlamydophila pneumoniae CWL029
cucuuuagcaaacauuuuu

SEQ ID NO: 2518040 - RNA, 23 nt, Chlamydophila pneumoniae CWL029
cucuuuauauuuuuugagaaaua

SEQ ID NO: 2518041 - RNA, 18 nt, Chlamydophila pneumoniae CWL029
cuucuuucaauagcuucc

SEQ ID NO: 2518042 - RNA, 20 nt, Chlamydophila pneumoniae CWL029
cuucuuuccauaaagcccca

SEQ ID NO: 2518043 - RNA, 15 nt, Chlamydophila pneumoniae CWL029
cuucuuuccauagau

SEQ ID NO: 2518044 - RNA, 23 nt, Chlamydophila pneumoniae CWL029
cuucuuucuaggccgggauuuua

SEQ ID NO: 2518045 - RNA, 18 nt, Chlamydophila pneumoniae CWL029
cuucuuucugcucuucua

SEQ ID NO: 2518046 - RNA, 14 nt, Chlamydophila pneumoniae CWL029
cuucuuucuugcuc

SEQ ID NO: 2518047 - RNA, 15 nt, Chlamydophila pneumoniae CWL029
cuucuuuggaugcua

SEQ ID NO: 2518048 - RNA, 23 nt, Chlamydophila pneumoniae CWL029
cuucuuuuaaaaacucuuucaua

SEQ ID NO: 2518049 - RNA, 22 nt, Chlamydophila pneumoniae CWL029
cuucuuuuagacgugcucucuu

SEQ ID NO: 2518050 - RNA, 17 nt, Chlamydophila pneumoniae CWL029
cuucuuuuuuuuucuua

SEQ ID NO: 2518051 - RNA, 15 nt, Chlamydophila pneumoniae CWL029
cuugaaauugcucuu

SEQ ID NO: 2518052 - RNA, 19 nt, Chlamydophila pneumoniae CWL029
cuugaaauugcucuugcuc

SEQ ID NO: 2518053 - RNA, 11 nt, Chlamydophila pneumoniae CWL029
cuugaacagag

SEQ ID NO: 2518054 - RNA, 18 nt, Chlamydophila pneumoniae CWL029
cuugaacagagacuuccu

SEQ ID NO: 2518055 - RNA, 16 nt, Chlamydophila pneumoniae CWL029
cuugaaguuuugguuu

SEQ ID NO: 2518056 - RNA, 14 nt, Chlamydophila pneumoniae CWL029
cuugaaguuuuuuc

SEQ ID NO: 2518057 - RNA, 15 nt, Chlamydophila pneumoniae CWL029
cuugaaguuuuuucu

SEQ ID NO: 2518058 - RNA, 16 nt, Chlamydophila pneumoniae CWL029
cuugaaguuuuuucuc

SEQ ID NO: 2518059 - RNA, 15 nt, Chlamydophila pneumoniae CWL029
cuugacaaauaaguc

SEQ ID NO: 2518060 - RNA, 19 nt, Chlamydophila pneumoniae CWL029
cuugaccucaucagaagug

SEQ ID NO: 2518061 - RNA, 20 nt, Chlamydophila pneumoniae CWL029
cuugacggcaggacucuuua

SEQ ID NO: 2518062 - RNA, 22 nt, Chlamydophila pneumoniae CWL029
cuugacuaaauccaccaaugau

SEQ ID NO: 2518063 - RNA, 14 nt, Chlamydophila pneumoniae CWL029
cuugacucuaauuc

SEQ ID NO: 2518064 - RNA, 16 nt, Chlamydophila pneumoniae CWL029
cuugacucuaauucag

SEQ ID NO: 2518065 - RNA, 17 nt, Chlamydophila pneumoniae CWL029
cuugagaaaagaacagg

SEQ ID NO: 2518066 - RNA, 18 nt, Chlamydophila pneumoniae CWL029
cuugagaaaagaacaggg

SEQ ID NO: 2518067 - RNA, 21 nt, Chlamydophila pneumoniae CWL029
cuugagagauauagcguacag

SEQ ID NO: 2518068 - RNA, 15 nt, Chlamydophila pneumoniae CWL029
cuugagcauccaaaa

SEQ ID NO: 2518069 - RNA, 15 nt, Chlamydophila pneumoniae CWL029
cuugagguauuccua

SEQ ID NO: 2518070 - RNA, 18 nt, Chlamydophila pneumoniae CWL029
cuugauauuguucuucca

SEQ ID NO: 2518071 - RNA, 14 nt, Chlamydophila pneumoniae CWL029
cuugauauuugucu

SEQ ID NO: 2518072 - RNA, 12 nt, Chlamydophila pneumoniae CWL029
cuugaucaggau

SEQ ID NO: 2518073 - RNA, 18 nt, Chlamydophila pneumoniae CWL029
cuugauccuuuccaagaa

SEQ ID NO: 2518074 - RNA, 15 nt, Chlamydophila pneumoniae CWL029
cuugaucuacaaaaa

SEQ ID NO: 2518075 - RNA, 21 nt, Chlamydophila pneumoniae CWL029
cuugaucuacaaaaacuagaa

SEQ ID NO: 2518076 - RNA, 15 nt, Chlamydophila pneumoniae CWL029
cuugauuccuuaagu

SEQ ID NO: 2518077 - RNA, 19 nt, Chlamydophila pneumoniae CWL029
cuugauuuuaaaaugaccg

SEQ ID NO: 2518078 - RNA, 21 nt, Chlamydophila pneumoniae CWL029
cuugcaaaacagcaucaggau

SEQ ID NO: 2518079 - RNA, 17 nt, Chlamydophila pneumoniae CWL029
cuugcaaggagcuuuuc

SEQ ID NO: 2518080 - RNA, 16 nt, Chlamydophila pneumoniae CWL029
cuugcaaucuuugaag

SEQ ID NO: 2518081 - RNA, 18 nt, Chlamydophila pneumoniae CWL029
cuugcaaucuuugaagcu

SEQ ID NO: 2518082 - RNA, 18 nt, Chlamydophila pneumoniae CWL029
cuugcagcccugcauagu

SEQ ID NO: 2518083 - RNA, 18 nt, Chlamydophila pneumoniae CWL029
cuugcauuuuuuggaaua

SEQ ID NO: 2518084 - RNA, 16 nt, Chlamydophila pneumoniae CWL029
cuugccagcagaaguu

SEQ ID NO: 2518085 - RNA, 18 nt, Chlamydophila pneumoniae CWL029
cuugccaguauugauaau

SEQ ID NO: 2518086 - RNA, 18 nt, Chlamydophila pneumoniae CWL029
cuugcucaggagauacaa

SEQ ID NO: 2518087 - RNA, 17 nt, Chlamydophila pneumoniae CWL029
cuugcucugaagcucgg

SEQ ID NO: 2518088 - RNA, 17 nt, Chlamydophila pneumoniae CWL029
cuugcucuuuaauaagg

SEQ ID NO: 2518089 - RNA, 22 nt, Chlamydophila pneumoniae CWL029
cuugcugauccucggcaucuuu

SEQ ID NO: 2518090 - RNA, 17 nt, Chlamydophila pneumoniae CWL029
cuugcugauuucuuuuu

SEQ ID NO: 2518091 - RNA, 18 nt, Chlamydophila pneumoniae CWL029
cuugcugauuucuuuuuc

SEQ ID NO: 2518092 - RNA, 20 nt, Chlamydophila pneumoniae CWL029
cuugcugauuucuuuuucag

SEQ ID NO: 2518093 - RNA, 21 nt, Chlamydophila pneumoniae CWL029
cuugcugcccaaauugagaaa

SEQ ID NO: 2518094 - RNA, 18 nt, Chlamydophila pneumoniae CWL029
cuugcuuauccaaguguu

SEQ ID NO: 2518095 - RNA, 16 nt, Chlamydophila pneumoniae CWL029
cuugcuuuuaacgcua

SEQ ID NO: 2518096 - RNA, 18 nt, Chlamydophila pneumoniae CWL029
cuugcuuuuuugaaagcu

SEQ ID NO: 2518097 - RNA, 16 nt, Chlamydophila pneumoniae CWL029
cuuggauuucuucuuc

SEQ ID NO: 2518098 - RNA, 18 nt, Chlamydophila pneumoniae CWL029
cuuggauuucuucuucua

SEQ ID NO: 2518099 - RNA, 20 nt, Chlamydophila pneumoniae CWL029
cuuggcguacucuauuaagg

SEQ ID NO: 2518100 - RNA, 19 nt, Chlamydophila pneumoniae CWL029
cuugggcaaauaggagagc

SEQ ID NO: 2518101 - RNA, 19 nt, Chlamydophila pneumoniae CWL029
cuuggucgaucaagguguu

SEQ ID NO: 2518102 - RNA, 13 nt, Chlamydophila pneumoniae CWL029
cuuggucgcaagg

SEQ ID NO: 2518103 - RNA, 23 nt, Chlamydophila pneumoniae CWL029
cuugguguauaguauuuuuaaau

SEQ ID NO: 2518104 - RNA, 21 nt, Chlamydophila pneumoniae CWL029
cuuguaagacuaaaaaagaga

SEQ ID NO: 2518105 - RNA, 19 nt, Chlamydophila pneumoniae CWL029
cuuguaaguuacggaacuc

SEQ ID NO: 2518106 - RNA, 14 nt, Chlamydophila pneumoniae CWL029
cuuguacauccuug

SEQ ID NO: 2518107 - RNA, 14 nt, Chlamydophila pneumoniae CWL029
cuuguagaacuucu

SEQ ID NO: 2518108 - RNA, 13 nt, Chlamydophila pneumoniae CWL029
cuuguagcaauua

SEQ ID NO: 2518109 - RNA, 16 nt, Chlamydophila pneumoniae CWL029
cuuguauaagagcaag

SEQ ID NO: 2518110 - RNA, 18 nt, Chlamydophila pneumoniae CWL029
cuuguauuguacuuuuug

SEQ ID NO: 2518111 - RNA, 20 nt, Chlamydophila pneumoniae CWL029
cuugucacacugcgagagaa

SEQ ID NO: 2518112 - RNA, 18 nt, Chlamydophila pneumoniae CWL029
cuugucgcgacaagacaa

SEQ ID NO: 2518113 - RNA, 15 nt, Chlamydophila pneumoniae CWL029
cuugucuaggagcuu

SEQ ID NO: 2518114 - RNA, 13 nt, Chlamydophila pneumoniae CWL029
cuugugagaugaa

SEQ ID NO: 2518115 - RNA, 14 nt, Chlamydophila pneumoniae CWL029
cuugugagaugaac

SEQ ID NO: 2518116 - RNA, 22 nt, Chlamydophila pneumoniae CWL029
cuugugcaucuauaauuaaucc

SEQ ID NO: 2518117 - RNA, 17 nt, Chlamydophila pneumoniae CWL029
cuugugcuaaagcagga

SEQ ID NO: 2518118 - RNA, 19 nt, Chlamydophila pneumoniae CWL029
cuugugcuaaagcaggagc

SEQ ID NO: 2518119 - RNA, 22 nt, Chlamydophila pneumoniae CWL029
cuuguuaugaugauccacugcu

SEQ ID NO: 2518120 - RNA, 18 nt, Chlamydophila pneumoniae CWL029
cuuguucuaaaaugaaau

SEQ ID NO: 2518121 - RNA, 13 nt, Chlamydophila pneumoniae CWL029
cuuguucuguaac

SEQ ID NO: 2518122 - RNA, 19 nt, Chlamydophila pneumoniae CWL029
cuuguucuucuugauuaag

SEQ ID NO: 2518123 - RNA, 15 nt, Chlamydophila pneumoniae CWL029
cuuguugcaauugcc

SEQ ID NO: 2518124 - RNA, 16 nt, Chlamydophila pneumoniae CWL029
cuuguugcaugggaau

SEQ ID NO: 2518125 - RNA, 16 nt, Chlamydophila pneumoniae CWL029
cuuguuggcauagcga

SEQ ID NO: 2518126 - RNA, 23 nt, Chlamydophila pneumoniae CWL029
cuuguuucguaagagaauuauua

SEQ ID NO: 2518127 - RNA, 15 nt, Chlamydophila pneumoniae CWL029
cuuguuucuguuuuc

SEQ ID NO: 2518128 - RNA, 18 nt, Chlamydophila pneumoniae CWL029
cuuuaaaaauauaucuuc

SEQ ID NO: 2518129 - RNA, 21 nt, Chlamydophila pneumoniae CWL029
cuuuaaaaauauaucuucaga

SEQ ID NO: 2518130 - RNA, 17 nt, Chlamydophila pneumoniae CWL029
cuuuaaaagcauagugu

SEQ ID NO: 2518131 - RNA, 17 nt, Chlamydophila pneumoniae CWL029
cuuuaaagauuccccau

SEQ ID NO: 2518132 - RNA, 14 nt, Chlamydophila pneumoniae CWL029
cuuuaaauaaaauc

SEQ ID NO: 2518133 - RNA, 15 nt, Chlamydophila pneumoniae CWL029
cuuuaacaaaguuua

SEQ ID NO: 2518134 - RNA, 20 nt, Chlamydophila pneumoniae CWL029
cuuuaagaagcacuucuuua

SEQ ID NO: 2518135 - RNA, 19 nt, Chlamydophila pneumoniae CWL029
cuuuaagguugcuuuucua

SEQ ID NO: 2518136 - RNA, 21 nt, Chlamydophila pneumoniae CWL029
cuuuaagguugcuuuucuagg

SEQ ID NO: 2518137 - RNA, 19 nt, Chlamydophila pneumoniae CWL029
cuuuaaguguuucuucaua

SEQ ID NO: 2518138 - RNA, 13 nt, Chlamydophila pneumoniae CWL029
cuuuaaucaagcc

SEQ ID NO: 2518139 - RNA, 20 nt, Chlamydophila pneumoniae CWL029
cuuccaucucuuuaaauguu

SEQ ID NO: 2518140 - RNA, 14 nt, Chlamydophila pneumoniae CWL029
cuucccagccuuga

SEQ ID NO: 2518141 - RNA, 16 nt, Chlamydophila pneumoniae CWL029
cuucccaucuuguucu

SEQ ID NO: 2518142 - RNA, 21 nt, Chlamydophila pneumoniae CWL029
cuucccauuucuucuuagaaa

SEQ ID NO: 2518143 - RNA, 16 nt, Chlamydophila pneumoniae CWL029
cuuccccaaacaugga

SEQ ID NO: 2518144 - RNA, 20 nt, Chlamydophila pneumoniae CWL029
cuuccccaagcucucuccau

SEQ ID NO: 2518145 - RNA, 15 nt, Chlamydophila pneumoniae CWL029
cuucccccagaccua

SEQ ID NO: 2518146 - RNA, 18 nt, Chlamydophila pneumoniae CWL029
cuucccucaugaagaauu

SEQ ID NO: 2518147 - RNA, 14 nt, Chlamydophila pneumoniae CWL029
cuucccucuccuug

SEQ ID NO: 2518148 - RNA, 14 nt, Chlamydophila pneumoniae CWL029
cuuccgucugaaug

SEQ ID NO: 2518149 - RNA, 21 nt, Chlamydophila pneumoniae CWL029
cuuccuacggcaagaaucgcc

SEQ ID NO: 2518150 - RNA, 13 nt, Chlamydophila pneumoniae CWL029
cuuccuauaaaaa

SEQ ID NO: 2518151 - RNA, 20 nt, Chlamydophila pneumoniae CWL029
cuuccucacguucugcaaca

SEQ ID NO: 2518152 - RNA, 14 nt, Chlamydophila pneumoniae CWL029
cuuccuccaaaauu

SEQ ID NO: 2518153 - RNA, 18 nt, Chlamydophila pneumoniae CWL029
cuuccucuucaauuucuu

SEQ ID NO: 2518154 - RNA, 23 nt, Chlamydophila pneumoniae CWL029
cuuccucuucaauuucuucauca

SEQ ID NO: 2518155 - RNA, 20 nt, Chlamydophila pneumoniae CWL029
cuuccugaaucagcuuaucu

SEQ ID NO: 2518156 - RNA, 16 nt, Chlamydophila pneumoniae CWL029
cuuccugcuccucuuc

SEQ ID NO: 2518157 - RNA, 13 nt, Chlamydophila pneumoniae CWL029
cuuccugcugcuu

SEQ ID NO: 2518158 - RNA, 20 nt, Chlamydophila pneumoniae CWL029
cuuccuuaaccuccucaaga

SEQ ID NO: 2518159 - RNA, 17 nt, Chlamydophila pneumoniae CWL029
cuuccuucuccuguaaa

SEQ ID NO: 2518160 - RNA, 14 nt, Chlamydophila pneumoniae CWL029
cuuccuucuucuuc

SEQ ID NO: 2518161 - RNA, 17 nt, Chlamydophila pneumoniae CWL029
cuuccuucuucuucaaa

SEQ ID NO: 2518162 - RNA, 11 nt, Chlamydophila pneumoniae CWL029
cuuccuuguug

SEQ ID NO: 2518163 - RNA, 13 nt, Chlamydophila pneumoniae CWL029
cuuccuuuuucug

SEQ ID NO: 2518164 - RNA, 20 nt, Chlamydophila pneumoniae CWL029
cuuccuuuuucugcuucucc

SEQ ID NO: 2518165 - RNA, 22 nt, Chlamydophila pneumoniae CWL029
cuucgaagcggagcaucuuuuc

SEQ ID NO: 2518166 - RNA, 18 nt, Chlamydophila pneumoniae CWL029
cuucgaccuauuugcaac

SEQ ID NO: 2518167 - RNA, 21 nt, Chlamydophila pneumoniae CWL029
cuucgaugucuuuccaggcaa

SEQ ID NO: 2518168 - RNA, 14 nt, Chlamydophila pneumoniae CWL029
cuucgauuucuagu

SEQ ID NO: 2518169 - RNA, 17 nt, Chlamydophila pneumoniae CWL029
cuucgcaaauauaguuu

SEQ ID NO: 2518170 - RNA, 15 nt, Chlamydophila pneumoniae CWL029
cuucgcaaauuuuuc

SEQ ID NO: 2518171 - RNA, 23 nt, Chlamydophila pneumoniae CWL029
cuucgcccauuaacuaagauaug

SEQ ID NO: 2518172 - RNA, 22 nt, Chlamydophila pneumoniae CWL029
cuucgccuuggguuugucucca

SEQ ID NO: 2518173 - RNA, 17 nt, Chlamydophila pneumoniae CWL029
cuucguaucuucgaggc

SEQ ID NO: 2518174 - RNA, 16 nt, Chlamydophila pneumoniae CWL029
cuucguuagaaaccau

SEQ ID NO: 2518175 - RNA, 22 nt, Chlamydophila pneumoniae CWL029
cuucguuucuuugaguuaagca

SEQ ID NO: 2518176 - RNA, 12 nt, Chlamydophila pneumoniae CWL029
cuucuaaaacca

SEQ ID NO: 2518177 - RNA, 12 nt, Chlamydophila pneumoniae CWL029
cuucuaaacaau

SEQ ID NO: 2518178 - RNA, 20 nt, Chlamydophila pneumoniae CWL029
cuucuaaagcugcuuuuucu

SEQ ID NO: 2518179 - RNA, 16 nt, Chlamydophila pneumoniae CWL029
cuucuaaggaaauuac

SEQ ID NO: 2518180 - RNA, 21 nt, Chlamydophila pneumoniae CWL029
cuucuacagaauaggaacaaa

SEQ ID NO: 2518181 - RNA, 17 nt, Chlamydophila pneumoniae CWL029
cuucuagguauuuguuu

SEQ ID NO: 2518182 - RNA, 22 nt, Chlamydophila pneumoniae CWL029
cuucuaugaauugacugcuaga

SEQ ID NO: 2518183 - RNA, 16 nt, Chlamydophila pneumoniae CWL029
cuucuaugguaaucac

SEQ ID NO: 2518184 - RNA, 16 nt, Chlamydophila pneumoniae CWL029
cuucuauuuuuuugga

SEQ ID NO: 2518185 - RNA, 19 nt, Chlamydophila pneumoniae CWL029
cuucucaagaucuucauca

SEQ ID NO: 2518186 - RNA, 14 nt, Chlamydophila pneumoniae CWL029
cuucuccaacccca

SEQ ID NO: 2518187 - RNA, 17 nt, Chlamydophila pneumoniae CWL029
cuucuccagagcaagau

SEQ ID NO: 2518188 - RNA, 16 nt, Chlamydophila pneumoniae CWL029
cuucucccgcuaauua

SEQ ID NO: 2518189 - RNA, 19 nt, Chlamydophila pneumoniae CWL029
cuucucccucuaaacauaa

SEQ ID NO: 2518190 - RNA, 14 nt, Chlamydophila pneumoniae CWL029
cuucucccuguauu

SEQ ID NO: 2518191 - RNA, 13 nt, Chlamydophila pneumoniae CWL029
cuucuccucgcaa

SEQ ID NO: 2518192 - RNA, 23 nt, Chlamydophila pneumoniae CWL029
cuucuccugaaccgcaaaaagcu

SEQ ID NO: 2518193 - RNA, 22 nt, Chlamydophila pneumoniae CWL029
cuucucgguuuaaggcaauaga

SEQ ID NO: 2518194 - RNA, 19 nt, Chlamydophila pneumoniae CWL029
cuucucgucauucugcaag

SEQ ID NO: 2518195 - RNA, 14 nt, Chlamydophila pneumoniae CWL029
cuucucuaagaaau

SEQ ID NO: 2518196 - RNA, 15 nt, Chlamydophila pneumoniae CWL029
cuucucuaagaaauu

SEQ ID NO: 2518197 - RNA, 18 nt, Chlamydophila pneumoniae CWL029
cuucucuaagaaauuuuc

SEQ ID NO: 2518198 - RNA, 19 nt, Chlamydophila pneumoniae CWL029
cuucucuaagaaauuuucu

SEQ ID NO: 2518199 - RNA, 18 nt, Chlamydophila pneumoniae CWL029
cuucucuaguuguaauuu

SEQ ID NO: 2518200 - RNA, 22 nt, Chlamydophila pneumoniae CWL029
cuucucuaguuguaauuucuug

SEQ ID NO: 2518201 - RNA, 13 nt, Chlamydophila pneumoniae CWL029
cuucucuguaucg

SEQ ID NO: 2518202 - RNA, 19 nt, Chlamydophila pneumoniae CWL029
cuucucuguugggagcuuc

SEQ ID NO: 2518203 - RNA, 20 nt, Chlamydophila pneumoniae CWL029
cuucucuguugggagcuucc

SEQ ID NO: 2518204 - RNA, 22 nt, Chlamydophila pneumoniae CWL029
cuucucuguugggagcuuccuc

SEQ ID NO: 2518205 - RNA, 21 nt, Chlamydophila pneumoniae CWL029
cuucucuuaugaaguccagac

SEQ ID NO: 2518206 - RNA, 15 nt, Chlamydophila pneumoniae CWL029
cuucugaauagcucu

SEQ ID NO: 2518207 - RNA, 14 nt, Chlamydophila pneumoniae CWL029
cuucugacaauaac

SEQ ID NO: 2518208 - RNA, 15 nt, Chlamydophila pneumoniae CWL029
cuucugacaauaaca

SEQ ID NO: 2518209 - RNA, 18 nt, Chlamydophila pneumoniae CWL029
cuucuggauacguuuuuc

SEQ ID NO: 2518210 - RNA, 14 nt, Chlamydophila pneumoniae CWL029
cuuuaccagaaaug

SEQ ID NO: 2518211 - RNA, 14 nt, Chlamydophila pneumoniae CWL029
cuuuacuaacaaaa

SEQ ID NO: 2518212 - RNA, 12 nt, Chlamydophila pneumoniae CWL029
cuuuacuacaug

SEQ ID NO: 2518213 - RNA, 16 nt, Chlamydophila pneumoniae CWL029
cuuuagaauccugacc

SEQ ID NO: 2518214 - RNA, 16 nt, Chlamydophila pneumoniae CWL029
cuuuagcaaucucuuu

SEQ ID NO: 2518215 - RNA, 22 nt, Chlamydophila pneumoniae CWL029
cuuuagcaaucucuuucacaaa

SEQ ID NO: 2518216 - RNA, 14 nt, Chlamydophila pneumoniae CWL029
cuuuagcugcugaa

SEQ ID NO: 2518217 - RNA, 20 nt, Chlamydophila pneumoniae CWL029
cuuuagcuuuauugauagcu

SEQ ID NO: 2518218 - RNA, 17 nt, Chlamydophila pneumoniae CWL029
cuuuagggaauccccaa

SEQ ID NO: 2518219 - RNA, 15 nt, Chlamydophila pneumoniae CWL029
cuuuaggucacuacc

SEQ ID NO: 2518220 - RNA, 16 nt, Chlamydophila pneumoniae CWL029
cuuuaguuaacuccuu

SEQ ID NO: 2518221 - RNA, 17 nt, Chlamydophila pneumoniae CWL029
cuuuaguuaacuccuuc

SEQ ID NO: 2518222 - RNA, 15 nt, Chlamydophila pneumoniae CWL029
cuuuauagaaaguac

SEQ ID NO: 2518223 - RNA, 13 nt, Chlamydophila pneumoniae CWL029
cuuuauagauaug

SEQ ID NO: 2518224 - RNA, 19 nt, Chlamydophila pneumoniae CWL029
cuuuaugaucucccgugag

SEQ ID NO: 2518225 - RNA, 18 nt, Chlamydophila pneumoniae CWL029
cuuuauggcucaacuuaa

SEQ ID NO: 2518226 - RNA, 16 nt, Chlamydophila pneumoniae CWL029
cuuuauugauagcuga

SEQ ID NO: 2518227 - RNA, 15 nt, Chlamydophila pneumoniae CWL029
cuuuauuuaaauaaa

SEQ ID NO: 2518228 - RNA, 22 nt, Chlamydophila pneumoniae CWL029
cuuuauuuugaugcuucuuuca

SEQ ID NO: 2518229 - RNA, 22 nt, Chlamydophila pneumoniae CWL029
cuuucaaaagaaaucaaacauu

SEQ ID NO: 2518230 - RNA, 16 nt, Chlamydophila pneumoniae CWL029
cuuucaaaccacggau

SEQ ID NO: 2518231 - RNA, 17 nt, Chlamydophila pneumoniae CWL029
cuuucaaccuccgcucu

SEQ ID NO: 2518232 - RNA, 22 nt, Chlamydophila pneumoniae CWL029
cuuucaagagcagugaaauuuu

SEQ ID NO: 2518233 - RNA, 11 nt, Chlamydophila pneumoniae CWL029
cuuucaaggaa

SEQ ID NO: 2518234 - RNA, 20 nt, Chlamydophila pneumoniae CWL029
cuuucacgauaucuaccaaa

SEQ ID NO: 2518235 - RNA, 12 nt, Chlamydophila pneumoniae CWL029
cuuucacuuccc

SEQ ID NO: 2518236 - RNA, 20 nt, Chlamydophila pneumoniae CWL029
cuuucauaagauagagcgac

SEQ ID NO: 2518237 - RNA, 12 nt, Chlamydophila pneumoniae CWL029
cuuucauucccu

SEQ ID NO: 2518238 - RNA, 20 nt, Chlamydophila pneumoniae CWL029
cuuuccacguacgagaucag

SEQ ID NO: 2518239 - RNA, 21 nt, Chlamydophila pneumoniae CWL029
cuuuccggguaaguacacauu

SEQ ID NO: 2518240 - RNA, 16 nt, Chlamydophila pneumoniae CWL029
cuuuccuaaaauaauu

SEQ ID NO: 2518241 - RNA, 21 nt, Chlamydophila pneumoniae CWL029
cuuuccucucuuuauauuuuu

SEQ ID NO: 2518242 - RNA, 18 nt, Chlamydophila pneumoniae CWL029
cuuucguuuucuagcaua

SEQ ID NO: 2518243 - RNA, 19 nt, Chlamydophila pneumoniae CWL029
cuuucuaagaauucuuugc

SEQ ID NO: 2518244 - RNA, 23 nt, Chlamydophila pneumoniae CWL029
cuuucuagaaugaugcaagcaga

SEQ ID NO: 2518245 - RNA, 22 nt, Chlamydophila pneumoniae CWL029
cuuucuaggccgggauuuuaau

SEQ ID NO: 2518246 - RNA, 20 nt, Chlamydophila pneumoniae CWL029
cuuucuauuucgucgucauc

SEQ ID NO: 2518247 - RNA, 21 nt, Chlamydophila pneumoniae CWL029
cuuucuccagcauuuuugggg

SEQ ID NO: 2518248 - RNA, 21 nt, Chlamydophila pneumoniae CWL029
cuuucucggucuuucuuuuuu

SEQ ID NO: 2518249 - RNA, 16 nt, Chlamydophila pneumoniae CWL029
cuuucugauugagaau

SEQ ID NO: 2518250 - RNA, 17 nt, Chlamydophila pneumoniae CWL029
cuuucuuauuacagaaa

SEQ ID NO: 2518251 - RNA, 21 nt, Chlamydophila pneumoniae CWL029
cuuucuucuagagcuucaagu

SEQ ID NO: 2518252 - RNA, 11 nt, Chlamydophila pneumoniae CWL029
cuuucuucucu

SEQ ID NO: 2518253 - RNA, 13 nt, Chlamydophila pneumoniae CWL029
cuuucuuggauug

SEQ ID NO: 2518254 - RNA, 14 nt, Chlamydophila pneumoniae CWL029
cuuucuuuuugaga

SEQ ID NO: 2518255 - RNA, 17 nt, Chlamydophila pneumoniae CWL029
cuuucuuuuugagauaa

SEQ ID NO: 2518256 - RNA, 20 nt, Chlamydophila pneumoniae CWL029
cuuugaagagcauuuaaaac

SEQ ID NO: 2518257 - RNA, 19 nt, Chlamydophila pneumoniae CWL029
gaauaaagcccuuuugaau

SEQ ID NO: 2518258 - RNA, 16 nt, Chlamydophila pneumoniae CWL029
gaauaaaggacauaga

SEQ ID NO: 2518259 - RNA, 19 nt, Chlamydophila pneumoniae CWL029
gaauaagagcuacaauccc

SEQ ID NO: 2518260 - RNA, 14 nt, Chlamydophila pneumoniae CWL029
gaauaagauuuuga

SEQ ID NO: 2518261 - RNA, 22 nt, Chlamydophila pneumoniae CWL029
gaauaagauuuugaaaauugca

SEQ ID NO: 2518262 - RNA, 20 nt, Chlamydophila pneumoniae CWL029
gaauaaguuuugauuuugca

SEQ ID NO: 2518263 - RNA, 21 nt, Chlamydophila pneumoniae CWL029
gaauaaguuuugauuuugcag

SEQ ID NO: 2518264 - RNA, 12 nt, Chlamydophila pneumoniae CWL029
gaauaaucaacc

SEQ ID NO: 2518265 - RNA, 23 nt, Chlamydophila pneumoniae CWL029
gaauaaucucuuucauaaauuca

SEQ ID NO: 2518266 - RNA, 15 nt, Chlamydophila pneumoniae CWL029
gaauaauuaaaucgu

SEQ ID NO: 2518267 - RNA, 15 nt, Chlamydophila pneumoniae CWL029
gaauacauuccuagc

SEQ ID NO: 2518268 - RNA, 18 nt, Chlamydophila pneumoniae CWL029
gaauaccguuucaggaaa

SEQ ID NO: 2518269 - RNA, 20 nt, Chlamydophila pneumoniae CWL029
gaauaccguuucaggaaacu

SEQ ID NO: 2518270 - RNA, 14 nt, Chlamydophila pneumoniae CWL029
gaauacucuagguu

SEQ ID NO: 2518271 - RNA, 21 nt, Chlamydophila pneumoniae CWL029
gaauacucuagguuuucucuu

SEQ ID NO: 2518272 - RNA, 21 nt, Chlamydophila pneumoniae CWL029
gaauagaaagacauccuucuu

SEQ ID NO: 2518273 - RNA, 12 nt, Chlamydophila pneumoniae CWL029
gaauagcucugg

SEQ ID NO: 2518274 - RNA, 15 nt, Chlamydophila pneumoniae CWL029
gaauagcucuuuuca

SEQ ID NO: 2518275 - RNA, 12 nt, Chlamydophila pneumoniae CWL029
gaauauaauucc

SEQ ID NO: 2518276 - RNA, 22 nt, Chlamydophila pneumoniae CWL029
gaauauaauuccaauugccaug

SEQ ID NO: 2518277 - RNA, 22 nt, Chlamydophila pneumoniae CWL029
gaauaucgaguucuuuuugcag

SEQ ID NO: 2518278 - RNA, 16 nt, Chlamydophila pneumoniae CWL029
gaauauguacugaugu

SEQ ID NO: 2518279 - RNA, 16 nt, Chlamydophila pneumoniae CWL029
gaaucacguccacaag

SEQ ID NO: 2518280 - RNA, 18 nt, Chlamydophila pneumoniae CWL029
gaaucacguccacaagcu

SEQ ID NO: 2518281 - RNA, 16 nt, Chlamydophila pneumoniae CWL029
gaaucacguucccacg

SEQ ID NO: 2518282 - RNA, 15 nt, Chlamydophila pneumoniae CWL029
gaaucagauuagagu

SEQ ID NO: 2518283 - RNA, 17 nt, Chlamydophila pneumoniae CWL029
gaaucagcuuaucuaua

SEQ ID NO: 2518284 - RNA, 16 nt, Chlamydophila pneumoniae CWL029
gaauccaaaaaagagc

SEQ ID NO: 2518285 - RNA, 21 nt, Chlamydophila pneumoniae CWL029
gaauccccccuucuaauacuu

SEQ ID NO: 2518286 - RNA, 18 nt, Chlamydophila pneumoniae CWL029
gaauccucggaagauaaa

SEQ ID NO: 2518287 - RNA, 14 nt, Chlamydophila pneumoniae CWL029
gaauccuucucccu

SEQ ID NO: 2518288 - RNA, 16 nt, Chlamydophila pneumoniae CWL029
gaaucgaagaacagag

SEQ ID NO: 2518289 - RNA, 14 nt, Chlamydophila pneumoniae CWL029
gaaucguucccauc

SEQ ID NO: 2518290 - RNA, 19 nt, Chlamydophila pneumoniae CWL029
gaaucuauccauagcgaua

SEQ ID NO: 2518291 - RNA, 23 nt, Chlamydophila pneumoniae CWL029
gaaucuccauuuagaaugaccgc

SEQ ID NO: 2518292 - RNA, 17 nt, Chlamydophila pneumoniae CWL029
gaaucucgggagaacau

SEQ ID NO: 2518293 - RNA, 19 nt, Chlamydophila pneumoniae CWL029
gaaucuuaugggagaagcu

SEQ ID NO: 2518294 - RNA, 14 nt, Chlamydophila pneumoniae CWL029
gaaucuuuauuucu

SEQ ID NO: 2518295 - RNA, 19 nt, Chlamydophila pneumoniae CWL029
gaaucuuuucuagaaaacg

SEQ ID NO: 2518296 - RNA, 17 nt, Chlamydophila pneumoniae CWL029
gaaucuuuuguuuuagc

SEQ ID NO: 2518297 - RNA, 13 nt, Chlamydophila pneumoniae CWL029
gaaucuuuuucau

SEQ ID NO: 2518298 - RNA, 19 nt, Chlamydophila pneumoniae CWL029
gaaugaaucgaagaacaga

SEQ ID NO: 2518299 - RNA, 20 nt, Chlamydophila pneumoniae CWL029
gaaugacacagagaacaaua

SEQ ID NO: 2518300 - RNA, 14 nt, Chlamydophila pneumoniae CWL029
gaaugagaacgucu

SEQ ID NO: 2518301 - RNA, 19 nt, Chlamydophila pneumoniae CWL029
gaaugccaaaccucuuagc

SEQ ID NO: 2518302 - RNA, 17 nt, Chlamydophila pneumoniae CWL029
gaaugcccuuuagggaa

SEQ ID NO: 2518303 - RNA, 18 nt, Chlamydophila pneumoniae CWL029
gaaugcccuuuagggaau

SEQ ID NO: 2518304 - RNA, 15 nt, Chlamydophila pneumoniae CWL029
gaaugcggcuaauuu

SEQ ID NO: 2518305 - RNA, 19 nt, Chlamydophila pneumoniae CWL029
gaauggucucgaaauccua

SEQ ID NO: 2518306 - RNA, 23 nt, Chlamydophila pneumoniae CWL029
gaauguugggggagcucgcuaaa

SEQ ID NO: 2518307 - RNA, 12 nt, Chlamydophila pneumoniae CWL029
gaauuaaaaguu

SEQ ID NO: 2518308 - RNA, 20 nt, Chlamydophila pneumoniae CWL029
gaauuaaacuuucuucucua

SEQ ID NO: 2518309 - RNA, 17 nt, Chlamydophila pneumoniae CWL029
gaauuagagaaauuuuu

SEQ ID NO: 2518310 - RNA, 20 nt, Chlamydophila pneumoniae CWL029
gaauucauccagauuagaaa

SEQ ID NO: 2518311 - RNA, 17 nt, Chlamydophila pneumoniae CWL029
gaauucauuaagauccu

SEQ ID NO: 2518312 - RNA, 20 nt, Chlamydophila pneumoniae CWL029
gaauuccucccagcccuaua

SEQ ID NO: 2518313 - RNA, 10 nt, Chlamydophila pneumoniae CWL029
gaauuccucu

SEQ ID NO: 2518314 - RNA, 14 nt, Chlamydophila pneumoniae CWL029
gaauucucaaguaa

SEQ ID NO: 2518315 - RNA, 17 nt, Chlamydophila pneumoniae CWL029
gaauucuuuaaaaucuu

SEQ ID NO: 2518316 - RNA, 15 nt, Chlamydophila pneumoniae CWL029
gaauucuuuuccugc

SEQ ID NO: 2518317 - RNA, 23 nt, Chlamydophila pneumoniae CWL029
gaauugcuugcgcaucagcagcu

SEQ ID NO: 2518318 - RNA, 14 nt, Chlamydophila pneumoniae CWL029
gaauuguaguucuu

SEQ ID NO: 2518319 - RNA, 18 nt, Chlamydophila pneumoniae CWL029
gaauuguaguucuuugaa

SEQ ID NO: 2518320 - RNA, 23 nt, Chlamydophila pneumoniae CWL029
gaauuguuuuguuuguuuucuau

SEQ ID NO: 2518321 - RNA, 21 nt, Chlamydophila pneumoniae CWL029
gaauuucuccaguaucuucuc

SEQ ID NO: 2518322 - RNA, 17 nt, Chlamydophila pneumoniae CWL029
gaauuugccugaaaucc

SEQ ID NO: 2518323 - RNA, 18 nt, Chlamydophila pneumoniae CWL029
gaauuugccugaaauccu

SEQ ID NO: 2518324 - RNA, 19 nt, Chlamydophila pneumoniae CWL029
gaauuuucagccugucuau

SEQ ID NO: 2518325 - RNA, 12 nt, Chlamydophila pneumoniae CWL029
gaauuuuccuga

SEQ ID NO: 2518326 - RNA, 13 nt, Chlamydophila pneumoniae CWL029
gaauuuuuguuuu

SEQ ID NO: 2518327 - RNA, 21 nt, Chlamydophila pneumoniae CWL029
gacaaaaaagggaucuccuuc

SEQ ID NO: 2518328 - RNA, 22 nt, Chlamydophila pneumoniae CWL029
gacaaaaaagggaucuccuuca

SEQ ID NO: 2518329 - RNA, 19 nt, Chlamydophila pneumoniae CWL029
gacaaaaaaucugaucuuc

SEQ ID NO: 2518330 - RNA, 11 nt, Chlamydophila pneumoniae CWL029
gacaaaaaugc

SEQ ID NO: 2518331 - RNA, 17 nt, Chlamydophila pneumoniae CWL029
gacaaaggguuucuuuc

SEQ ID NO: 2518332 - RNA, 17 nt, Chlamydophila pneumoniae CWL029
gacaaauaaguccuguu

SEQ ID NO: 2518333 - RNA, 15 nt, Chlamydophila pneumoniae CWL029
gacaaauagaaagga

SEQ ID NO: 2518334 - RNA, 20 nt, Chlamydophila pneumoniae CWL029
gacaaaucacgacgucauca

SEQ ID NO: 2518335 - RNA, 18 nt, Chlamydophila pneumoniae CWL029
gacaacaacauaaagaag

SEQ ID NO: 2518336 - RNA, 17 nt, Chlamydophila pneumoniae CWL029
gacaacaagucuucccu

SEQ ID NO: 2518337 - RNA, 20 nt, Chlamydophila pneumoniae CWL029
gacaagauggugagauuucu

SEQ ID NO: 2518338 - RNA, 15 nt, Chlamydophila pneumoniae CWL029
gacaagcaaggaaaa

SEQ ID NO: 2518339 - RNA, 17 nt, Chlamydophila pneumoniae CWL029
gacaagcaaggaaaaaa

SEQ ID NO: 2518340 - RNA, 21 nt, Chlamydophila pneumoniae CWL029
gacaaggagucgugcaggaga

SEQ ID NO: 2518341 - RNA, 22 nt, Chlamydophila pneumoniae CWL029
gacaaggagucgugcaggagaa

SEQ ID NO: 2518342 - RNA, 16 nt, Chlamydophila pneumoniae CWL029
gacaauaaaaaagaga

SEQ ID NO: 2518343 - RNA, 18 nt, Chlamydophila pneumoniae CWL029
gacaauaagaaaauccua

SEQ ID NO: 2518344 - RNA, 21 nt, Chlamydophila pneumoniae CWL029
gacaauaccagauaaagcaaa

SEQ ID NO: 2518345 - RNA, 16 nt, Chlamydophila pneumoniae CWL029
gacaauauaagcacca

SEQ ID NO: 2518346 - RNA, 17 nt, Chlamydophila pneumoniae CWL029
gacaauggaaauagaga

SEQ ID NO: 2518347 - RNA, 23 nt, Chlamydophila pneumoniae CWL029
gacacaaaaagcuuuuuucucuu

SEQ ID NO: 2518348 - RNA, 16 nt, Chlamydophila pneumoniae CWL029
gacacaacucuuuaau

SEQ ID NO: 2518349 - RNA, 12 nt, Chlamydophila pneumoniae CWL029
gacacagagaac

SEQ ID NO: 2518350 - RNA, 19 nt, Chlamydophila pneumoniae CWL029
gacacagcuaaucaaucca

SEQ ID NO: 2518351 - RNA, 18 nt, Chlamydophila pneumoniae CWL029
gacaccaacaacaauaau

SEQ ID NO: 2518352 - RNA, 20 nt, Chlamydophila pneumoniae CWL029
gacacgaccacuacuuaaag

SEQ ID NO: 2518353 - RNA, 14 nt, Chlamydophila pneumoniae CWL029
gacacgcuuuccua

SEQ ID NO: 2518354 - RNA, 11 nt, Chlamydophila pneumoniae CWL029
gacacuaugug

SEQ ID NO: 2518355 - RNA, 19 nt, Chlamydophila pneumoniae CWL029
gacacuauguguuuccuuu

SEQ ID NO: 2518356 - RNA, 23 nt, Chlamydophila pneumoniae CWL029
gacacuauguguuuccuuuucuc

SEQ ID NO: 2518357 - RNA, 17 nt, Chlamydophila pneumoniae CWL029
gacacucagcucccaug

SEQ ID NO: 2518358 - RNA, 15 nt, Chlamydophila pneumoniae CWL029
gacacuccucagaau

SEQ ID NO: 2518359 - RNA, 23 nt, Chlamydophila pneumoniae CWL029
gacacuugcuuaaggaaacagug

SEQ ID NO: 2518360 - RNA, 15 nt, Chlamydophila pneumoniae CWL029
gacagcagcauuuuc

SEQ ID NO: 2518361 - RNA, 17 nt, Chlamydophila pneumoniae CWL029
gacagcagcauuuucua

SEQ ID NO: 2518362 - RNA, 20 nt, Chlamydophila pneumoniae CWL029
gacagccggagcuucuaaga

SEQ ID NO: 2518363 - RNA, 14 nt, Chlamydophila pneumoniae CWL029
gacaggagcuacug

SEQ ID NO: 2518364 - RNA, 16 nt, Chlamydophila pneumoniae CWL029
gacagggaaagaacag

SEQ ID NO: 2518365 - RNA, 13 nt, Chlamydophila pneumoniae CWL029
gacaguauucccu

SEQ ID NO: 2518366 - RNA, 14 nt, Chlamydophila pneumoniae CWL029
gacagucucaugga

SEQ ID NO: 2518367 - RNA, 18 nt, Chlamydophila pneumoniae CWL029
gacauacucgucaaauuc

SEQ ID NO: 2518368 - RNA, 19 nt, Chlamydophila pneumoniae CWL029
gacauacucgucaaauuca

SEQ ID NO: 2518369 - RNA, 22 nt, Chlamydophila pneumoniae CWL029
gacauacucgucaaauucauua

SEQ ID NO: 2518370 - RNA, 15 nt, Chlamydophila pneumoniae CWL029
gacaucuaauuuuaa

SEQ ID NO: 2518371 - RNA, 17 nt, Chlamydophila pneumoniae CWL029
gacaucuccaagauaau

SEQ ID NO: 2518372 - RNA, 20 nt, Chlamydophila pneumoniae CWL029
gacaugccuaaauagcucag

SEQ ID NO: 2518373 - RNA, 21 nt, Chlamydophila pneumoniae CWL029
gacaugccuaaauagcucagu

SEQ ID NO: 2518374 - RNA, 23 nt, Chlamydophila pneumoniae CWL029
gacaugccuugguacuuaagcac

SEQ ID NO: 2518375 - RNA, 15 nt, Chlamydophila pneumoniae CWL029
gacaugcuuuccuuc

SEQ ID NO: 2518376 - RNA, 18 nt, Chlamydophila pneumoniae CWL029
gacauuauagaggucuuu

SEQ ID NO: 2518377 - RNA, 14 nt, Chlamydophila pneumoniae CWL029
gacauuccuuaauu

SEQ ID NO: 2518378 - RNA, 20 nt, Chlamydophila pneumoniae CWL029
gacauugaauccagcaccuu

SEQ ID NO: 2518379 - RNA, 16 nt, Chlamydophila pneumoniae CWL029
gacauugcaauacauc

SEQ ID NO: 2518380 - RNA, 21 nt, Chlamydophila pneumoniae CWL029
gacauuuucaagcuuucguuu

SEQ ID NO: 2518381 - RNA, 18 nt, Chlamydophila pneumoniae CWL029
gaccaacuccucaaaaga

SEQ ID NO: 2518382 - RNA, 22 nt, Chlamydophila pneumoniae CWL029
gaccacuacuuaaagcuugaga

SEQ ID NO: 2518383 - RNA, 14 nt, Chlamydophila pneumoniae CWL029
gaccauaacagcac

SEQ ID NO: 2518384 - RNA, 15 nt, Chlamydophila pneumoniae CWL029
gaccauccuguagcu

SEQ ID NO: 2518385 - RNA, 16 nt, Chlamydophila pneumoniae CWL029
gaccaucgagcuacgu

SEQ ID NO: 2518386 - RNA, 22 nt, Chlamydophila pneumoniae CWL029
gacccuagguagcucgagauuu

SEQ ID NO: 2518387 - RNA, 19 nt, Chlamydophila pneumoniae CWL029
gaccgagaagcuucaauga

SEQ ID NO: 2518388 - RNA, 19 nt, Chlamydophila pneumoniae CWL029
gaccgcgagugugacugca

SEQ ID NO: 2518389 - RNA, 20 nt, Chlamydophila pneumoniae CWL029
gaccguccuccccauacaua

SEQ ID NO: 2518390 - RNA, 19 nt, Chlamydophila pneumoniae CWL029
gaccuaagggcucuccuaa

SEQ ID NO: 2518391 - RNA, 19 nt, Chlamydophila pneumoniae CWL029
gaccucuagcucaaaucuc

SEQ ID NO: 2518392 - RNA, 21 nt, Chlamydophila pneumoniae CWL029
gaccucuguagguuuuuccaa

SEQ ID NO: 2518393 - RNA, 19 nt, Chlamydophila pneumoniae CWL029
gaccugcaaacuccccagu

SEQ ID NO: 2518394 - RNA, 16 nt, Chlamydophila pneumoniae CWL029
gaccugugaguaaaau

SEQ ID NO: 2518395 - RNA, 14 nt, Chlamydophila pneumoniae CWL029
gaccuguuuucuuu

SEQ ID NO: 2518396 - RNA, 21 nt, Chlamydophila pneumoniae CWL029
gaccuguuuucuuuucugaag

SEQ ID NO: 2518397 - RNA, 20 nt, Chlamydophila pneumoniae CWL029
gaccuucucaagaucuucau

SEQ ID NO: 2518398 - RNA, 16 nt, Chlamydophila pneumoniae CWL029
gacgaacgaagaaaac

SEQ ID NO: 2518399 - RNA, 12 nt, Chlamydophila pneumoniae CWL029
gacgacaaauca

SEQ ID NO: 2518400 - RNA, 14 nt, Chlamydophila pneumoniae CWL029
gacgacaaaucacg

SEQ ID NO: 2518401 - RNA, 23 nt, Chlamydophila pneumoniae CWL029
gacgacguuuugcuguggaauuu

SEQ ID NO: 2518402 - RNA, 18 nt, Chlamydophila pneumoniae CWL029
gacgaguugaaguuuugc

SEQ ID NO: 2518403 - RNA, 18 nt, Chlamydophila pneumoniae CWL029
gacgcaagagacaagaaa

SEQ ID NO: 2518404 - RNA, 23 nt, Chlamydophila pneumoniae CWL029
gacgcuuuuaucuguuaaaaaca

SEQ ID NO: 2518405 - RNA, 12 nt, Chlamydophila pneumoniae CWL029
gacggauaaaug

SEQ ID NO: 2518406 - RNA, 13 nt, Chlamydophila pneumoniae CWL029
gacggauaggauc

SEQ ID NO: 2518407 - RNA, 15 nt, Chlamydophila pneumoniae CWL029
gacguaaaaagaaag

SEQ ID NO: 2518408 - RNA, 21 nt, Chlamydophila pneumoniae CWL029
gacgucaucauaggaaacgcc

SEQ ID NO: 2518409 - RNA, 17 nt, Chlamydophila pneumoniae CWL029
gacgugggagacauucc

SEQ ID NO: 2518410 - RNA, 18 nt, Chlamydophila pneumoniae CWL029
gacgugggagacauucca

SEQ ID NO: 2518411 - RNA, 22 nt, Chlamydophila pneumoniae CWL029
gacguuaauaaagaggcuccca

SEQ ID NO: 2518412 - RNA, 16 nt, Chlamydophila pneumoniae CWL029
gacguuguaucccugu

SEQ ID NO: 2518413 - RNA, 23 nt, Chlamydophila pneumoniae CWL029
gacuaaacaagaaaaagcaucua

SEQ ID NO: 2518414 - RNA, 17 nt, Chlamydophila pneumoniae CWL029
gacuaaaugcgaggccc

SEQ ID NO: 2518415 - RNA, 13 nt, Chlamydophila pneumoniae CWL029
gacuauaaaaugc

SEQ ID NO: 2518416 - RNA, 14 nt, Chlamydophila pneumoniae CWL029
gacuauagaugcca

SEQ ID NO: 2518417 - RNA, 21 nt, Chlamydophila pneumoniae CWL029
gacuauagggagacucuugag

SEQ ID NO: 2518418 - RNA, 18 nt, Chlamydophila pneumoniae CWL029
gacuaucgcaaauuucca

SEQ ID NO: 2518419 - RNA, 21 nt, Chlamydophila pneumoniae CWL029
gacuaucgcaaauuuccauag

SEQ ID NO: 2518420 - RNA, 20 nt, Chlamydophila pneumoniae CWL029
cugcagcaaaacuaggaaaa

SEQ ID NO: 2518421 - RNA, 16 nt, Chlamydophila pneumoniae CWL029
cugcagcagaugaaac

SEQ ID NO: 2518422 - RNA, 16 nt, Chlamydophila pneumoniae CWL029
cugcagcguuucuagg

SEQ ID NO: 2518423 - RNA, 17 nt, Chlamydophila pneumoniae CWL029
cugcagguaagggaugc

SEQ ID NO: 2518424 - RNA, 19 nt, Chlamydophila pneumoniae CWL029
cugcaguauuauaaauaga

SEQ ID NO: 2518425 - RNA, 20 nt, Chlamydophila pneumoniae CWL029
cugcaguauuauaaauagaa

SEQ ID NO: 2518426 - RNA, 21 nt, Chlamydophila pneumoniae CWL029
cugcaguauuauaaauagaaa

SEQ ID NO: 2518427 - RNA, 16 nt, Chlamydophila pneumoniae CWL029
cugcauaaucucacca

SEQ ID NO: 2518428 - RNA, 20 nt, Chlamydophila pneumoniae CWL029
cugcauacccuucuucuuca

SEQ ID NO: 2518429 - RNA, 14 nt, Chlamydophila pneumoniae CWL029
cugcauauaaagac

SEQ ID NO: 2518430 - RNA, 18 nt, Chlamydophila pneumoniae CWL029
cugcauauugcucuugua

SEQ ID NO: 2518431 - RNA, 19 nt, Chlamydophila pneumoniae CWL029
cugcaucccaccgacaaga

SEQ ID NO: 2518432 - RNA, 11 nt, Chlamydophila pneumoniae CWL029
cugcauggcuu

SEQ ID NO: 2518433 - RNA, 21 nt, Chlamydophila pneumoniae CWL029
cugccagagauucuucacaau

SEQ ID NO: 2518434 - RNA, 16 nt, Chlamydophila pneumoniae CWL029
cugcccccuguuugaa

SEQ ID NO: 2518435 - RNA, 14 nt, Chlamydophila pneumoniae CWL029
cugcccuucggacu

SEQ ID NO: 2518436 - RNA, 15 nt, Chlamydophila pneumoniae CWL029
cugccuuaugcucau

SEQ ID NO: 2518437 - RNA, 20 nt, Chlamydophila pneumoniae CWL029
cugccuuaugcucauuaaua

SEQ ID NO: 2518438 - RNA, 23 nt, Chlamydophila pneumoniae CWL029
cugcgacacgaauuucuaacuua

SEQ ID NO: 2518439 - RNA, 19 nt, Chlamydophila pneumoniae CWL029
cugcgacuacaagauagug

SEQ ID NO: 2518440 - RNA, 16 nt, Chlamydophila pneumoniae CWL029
cugcgcaaagaacuca

SEQ ID NO: 2518441 - RNA, 16 nt, Chlamydophila pneumoniae CWL029
cugcgcuagcuccagc

SEQ ID NO: 2518442 - RNA, 16 nt, Chlamydophila pneumoniae CWL029
cugcgcuaucaucauu

SEQ ID NO: 2518443 - RNA, 18 nt, Chlamydophila pneumoniae CWL029
cugcgcuaucaucauuuc

SEQ ID NO: 2518444 - RNA, 21 nt, Chlamydophila pneumoniae CWL029
cugcggccacauuaagcaauc

SEQ ID NO: 2518445 - RNA, 19 nt, Chlamydophila pneumoniae CWL029
cugcgucaauaagcuugcc

SEQ ID NO: 2518446 - RNA, 22 nt, Chlamydophila pneumoniae CWL029
cugcgugauuauuuaagaccaa

SEQ ID NO: 2518447 - RNA, 17 nt, Chlamydophila pneumoniae CWL029
cugcguuaaacccuuca

SEQ ID NO: 2518448 - RNA, 15 nt, Chlamydophila pneumoniae CWL029
cugcguuucuuucug

SEQ ID NO: 2518449 - RNA, 13 nt, Chlamydophila pneumoniae CWL029
cugcuaccugugu

SEQ ID NO: 2518450 - RNA, 23 nt, Chlamydophila pneumoniae CWL029
cugcuacgugaucaaaauuaucc

SEQ ID NO: 2518451 - RNA, 17 nt, Chlamydophila pneumoniae CWL029
cugcuacuuuaaagugg

SEQ ID NO: 2518452 - RNA, 15 nt, Chlamydophila pneumoniae CWL029
cugcuauaaccaacu

SEQ ID NO: 2518453 - RNA, 19 nt, Chlamydophila pneumoniae CWL029
cugcuauaaccaacuuccu

SEQ ID NO: 2518454 - RNA, 19 nt, Chlamydophila pneumoniae CWL029
cugcuauacaaccacuucc

SEQ ID NO: 2518455 - RNA, 17 nt, Chlamydophila pneumoniae CWL029
cugcucccuccuccucg

SEQ ID NO: 2518456 - RNA, 13 nt, Chlamydophila pneumoniae CWL029
cugcuccugaagc

SEQ ID NO: 2518457 - RNA, 15 nt, Chlamydophila pneumoniae CWL029
cugcuccugaagcug

SEQ ID NO: 2518458 - RNA, 21 nt, Chlamydophila pneumoniae CWL029
cugcucuauauauccugagug

SEQ ID NO: 2518459 - RNA, 20 nt, Chlamydophila pneumoniae CWL029
cugcucucugaagcuaaaaa

SEQ ID NO: 2518460 - RNA, 16 nt, Chlamydophila pneumoniae CWL029
cugcugacaucuccaa

SEQ ID NO: 2518461 - RNA, 13 nt, Chlamydophila pneumoniae CWL029
cugcugaggagag

SEQ ID NO: 2518462 - RNA, 23 nt, Chlamydophila pneumoniae CWL029
cugcugaggagaguaaggucauu

SEQ ID NO: 2518463 - RNA, 15 nt, Chlamydophila pneumoniae CWL029
cugcugauccaaaag

SEQ ID NO: 2518464 - RNA, 17 nt, Chlamydophila pneumoniae CWL029
cugcugccaugcagccu

SEQ ID NO: 2518465 - RNA, 12 nt, Chlamydophila pneumoniae CWL029
cugcugcuacga

SEQ ID NO: 2518466 - RNA, 18 nt, Chlamydophila pneumoniae CWL029
cugcuggaguagcucaau

SEQ ID NO: 2518467 - RNA, 21 nt, Chlamydophila pneumoniae CWL029
cugcuguguuauggaaaucac

SEQ ID NO: 2518468 - RNA, 15 nt, Chlamydophila pneumoniae CWL029
cugcuucaaaacaua

SEQ ID NO: 2518469 - RNA, 15 nt, Chlamydophila pneumoniae CWL029
cugcuucgaccauaa

SEQ ID NO: 2518470 - RNA, 15 nt, Chlamydophila pneumoniae CWL029
cugcuugucuacaga

SEQ ID NO: 2518471 - RNA, 14 nt, Chlamydophila pneumoniae CWL029
cugcuuuuguuguu

SEQ ID NO: 2518472 - RNA, 18 nt, Chlamydophila pneumoniae CWL029
cugcuuuuguuguuuuug

SEQ ID NO: 2518473 - RNA, 14 nt, Chlamydophila pneumoniae CWL029
cugcuuuuuuucua

SEQ ID NO: 2518474 - RNA, 20 nt, Chlamydophila pneumoniae CWL029
cugcuuuuuuucuagaguuc

SEQ ID NO: 2518475 - RNA, 12 nt, Chlamydophila pneumoniae CWL029
cuggaaagccaa

SEQ ID NO: 2518476 - RNA, 22 nt, Chlamydophila pneumoniae CWL029
cuggaaaugaauauaauuccaa

SEQ ID NO: 2518477 - RNA, 18 nt, Chlamydophila pneumoniae CWL029
cuggaagaauuucauaag

SEQ ID NO: 2518478 - RNA, 20 nt, Chlamydophila pneumoniae CWL029
cuggaaggucgcugauaaaa

SEQ ID NO: 2518479 - RNA, 19 nt, Chlamydophila pneumoniae CWL029
cuggaaugacauaagcacu

SEQ ID NO: 2518480 - RNA, 15 nt, Chlamydophila pneumoniae CWL029
cuggaaugacuaaau

SEQ ID NO: 2518481 - RNA, 13 nt, Chlamydophila pneumoniae CWL029
cuggaauuuccca

SEQ ID NO: 2518482 - RNA, 17 nt, Chlamydophila pneumoniae CWL029
cuggagagguaaccaga

SEQ ID NO: 2518483 - RNA, 24 nt, Chlamydophila pneumoniae CWL029
cuggaggcgguggcaugccauaau

SEQ ID NO: 2518484 - RNA, 17 nt, Chlamydophila pneumoniae CWL029
cuggauacguuuuuccc

SEQ ID NO: 2518485 - RNA, 19 nt, Chlamydophila pneumoniae CWL029
cuggauuucuucuguuuuc

SEQ ID NO: 2518486 - RNA, 16 nt, Chlamydophila pneumoniae CWL029
cuggauuuuaaagcaa

SEQ ID NO: 2518487 - RNA, 14 nt, Chlamydophila pneumoniae CWL029
cuggcgacuugcca

SEQ ID NO: 2518488 - RNA, 21 nt, Chlamydophila pneumoniae CWL029
cuggcuaaaggaucauuaaag

SEQ ID NO: 2518489 - RNA, 14 nt, Chlamydophila pneumoniae CWL029
cuggcuauggaaga

SEQ ID NO: 2518490 - RNA, 14 nt, Chlamydophila pneumoniae CWL029
cuggcugagagaag

SEQ ID NO: 2518491 - RNA, 15 nt, Chlamydophila pneumoniae CWL029
gaaaaaauagauccu

SEQ ID NO: 2518492 - RNA, 13 nt, Chlamydophila pneumoniae CWL029
gaaaaaauaucuc

SEQ ID NO: 2518493 - RNA, 23 nt, Chlamydophila pneumoniae CWL029
gaaaaaccccuagaacuuuacaa

SEQ ID NO: 2518494 - RNA, 16 nt, Chlamydophila pneumoniae CWL029
gaaaaaccuucuccaa

SEQ ID NO: 2518495 - RNA, 16 nt, Chlamydophila pneumoniae CWL029
gaaaaagaaucucuga

SEQ ID NO: 2518496 - RNA, 16 nt, Chlamydophila pneumoniae CWL029
gaaaaagcccauuccu

SEQ ID NO: 2518497 - RNA, 18 nt, Chlamydophila pneumoniae CWL029
gaaaaagccuuucuuauu

SEQ ID NO: 2518498 - RNA, 18 nt, Chlamydophila pneumoniae CWL029
gaaaaauaucggaagaga

SEQ ID NO: 2518499 - RNA, 13 nt, Chlamydophila pneumoniae CWL029
gaaaaaucccugu

SEQ ID NO: 2518500 - RNA, 11 nt, Chlamydophila pneumoniae CWL029
gaaaaauccug

SEQ ID NO: 2518501 - RNA, 18 nt, Chlamydophila pneumoniae CWL029
gaaaaaucuacauguaaa

SEQ ID NO: 2518502 - RNA, 23 nt, Chlamydophila pneumoniae CWL029
gaaaaaucuacauguaaagcaag

SEQ ID NO: 2518503 - RNA, 14 nt, Chlamydophila pneumoniae CWL029
gaaaacaaggcaaa

SEQ ID NO: 2518504 - RNA, 19 nt, Chlamydophila pneumoniae CWL029
gaaaacaaggcaaaaaguu

SEQ ID NO: 2518505 - RNA, 13 nt, Chlamydophila pneumoniae CWL029
gaaaacauagaga

SEQ ID NO: 2518506 - RNA, 19 nt, Chlamydophila pneumoniae CWL029
gaaaacaucuguauauucu

SEQ ID NO: 2518507 - RNA, 19 nt, Chlamydophila pneumoniae CWL029
gaaaaccaugaguuuuuca

SEQ ID NO: 2518508 - RNA, 13 nt, Chlamydophila pneumoniae CWL029
gaaaacgcccucu

SEQ ID NO: 2518509 - RNA, 17 nt, Chlamydophila pneumoniae CWL029
gaaaacgcccucuagaa

SEQ ID NO: 2518510 - RNA, 10 nt, Chlamydophila pneumoniae CWL029
gaaaacuuca

SEQ ID NO: 2518511 - RNA, 14 nt, Chlamydophila pneumoniae CWL029
gaaaacuucaaaag

SEQ ID NO: 2518512 - RNA, 14 nt, Chlamydophila pneumoniae CWL029
gaaaagaaagaaua

SEQ ID NO: 2518513 - RNA, 15 nt, Chlamydophila pneumoniae CWL029
gaaaagaacagggga

SEQ ID NO: 2518514 - RNA, 14 nt, Chlamydophila pneumoniae CWL029
gaaaagaaccuagg

SEQ ID NO: 2518515 - RNA, 13 nt, Chlamydophila pneumoniae CWL029
gaaaagaaugugc

SEQ ID NO: 2518516 - RNA, 19 nt, Chlamydophila pneumoniae CWL029
gaaaagauucuaaaucaac

SEQ ID NO: 2518517 - RNA, 20 nt, Chlamydophila pneumoniae CWL029
gaaaaggauugcacucaucu

SEQ ID NO: 2518518 - RNA, 21 nt, Chlamydophila pneumoniae CWL029
gaaaaggcccccuacagcaga

SEQ ID NO: 2518519 - RNA, 22 nt, Chlamydophila pneumoniae CWL029
gaaaaggcccccuacagcagaa

SEQ ID NO: 2518520 - RNA, 16 nt, Chlamydophila pneumoniae CWL029
gaaaagugugaggaga

SEQ ID NO: 2518521 - RNA, 12 nt, Chlamydophila pneumoniae CWL029
gaaaauaaucuu

SEQ ID NO: 2518522 - RNA, 16 nt, Chlamydophila pneumoniae CWL029
gaaaauacagccagca

SEQ ID NO: 2518523 - RNA, 14 nt, Chlamydophila pneumoniae CWL029
gaaaaucaacucuc

SEQ ID NO: 2518524 - RNA, 16 nt, Chlamydophila pneumoniae CWL029
gaaaaucaacucucca

SEQ ID NO: 2518525 - RNA, 23 nt, Chlamydophila pneumoniae CWL029
gaaaaucaacucuccauccucag

SEQ ID NO: 2518526 - RNA, 16 nt, Chlamydophila pneumoniae CWL029
gaaaaucaagaagaga

SEQ ID NO: 2518527 - RNA, 24 nt, Chlamydophila pneumoniae CWL029
gaaaaucuacacgcuauagcaaca

SEQ ID NO: 2518528 - RNA, 20 nt, Chlamydophila pneumoniae CWL029
gaaaaucucuaagaaucuau

SEQ ID NO: 2518529 - RNA, 21 nt, Chlamydophila pneumoniae CWL029
gaaaaucucuaagaaucuaua

SEQ ID NO: 2518530 - RNA, 14 nt, Chlamydophila pneumoniae CWL029
gaaaaucugcagca

SEQ ID NO: 2518531 - RNA, 16 nt, Chlamydophila pneumoniae CWL029
gaaaaucugcagcaga

SEQ ID NO: 2518532 - RNA, 12 nt, Chlamydophila pneumoniae CWL029
gaaaaucugcuc

SEQ ID NO: 2518533 - RNA, 19 nt, Chlamydophila pneumoniae CWL029
gaaaaugauucauaacauu

SEQ ID NO: 2518534 - RNA, 14 nt, Chlamydophila pneumoniae CWL029
gaaaauuguuggaa

SEQ ID NO: 2518535 - RNA, 20 nt, Chlamydophila pneumoniae CWL029
gaaacacaguuugagaaaga

SEQ ID NO: 2518536 - RNA, 19 nt, Chlamydophila pneumoniae CWL029
gaaacaccguuaauuuuug

SEQ ID NO: 2518537 - RNA, 15 nt, Chlamydophila pneumoniae CWL029
gaaacagugguaugc

SEQ ID NO: 2518538 - RNA, 19 nt, Chlamydophila pneumoniae CWL029
gaaacauagaaucauugag

SEQ ID NO: 2518539 - RNA, 17 nt, Chlamydophila pneumoniae CWL029
gaaacaugaaguuguug

SEQ ID NO: 2518540 - RNA, 23 nt, Chlamydophila pneumoniae CWL029
gaaacauggcgguguuuccuucg

SEQ ID NO: 2518541 - RNA, 23 nt, Chlamydophila pneumoniae CWL029
gaaaccauuuaccccaggaauca

SEQ ID NO: 2518542 - RNA, 22 nt, Chlamydophila pneumoniae CWL029
gaaacccauaaugguacaauac

SEQ ID NO: 2518543 - RNA, 17 nt, Chlamydophila pneumoniae CWL029
gaaacccgcaacucuuu

SEQ ID NO: 2518544 - RNA, 20 nt, Chlamydophila pneumoniae CWL029
gaaaccggacugacuucuau

SEQ ID NO: 2518545 - RNA, 13 nt, Chlamydophila pneumoniae CWL029
gaaaccuucagau

SEQ ID NO: 2518546 - RNA, 16 nt, Chlamydophila pneumoniae CWL029
gaaaccuucagaucga

SEQ ID NO: 2518547 - RNA, 13 nt, Chlamydophila pneumoniae CWL029
gaaaccuucucuc

SEQ ID NO: 2518548 - RNA, 16 nt, Chlamydophila pneumoniae CWL029
gaaaccuucucucuua

SEQ ID NO: 2518549 - RNA, 17 nt, Chlamydophila pneumoniae CWL029
gaaaccuucucucuuaa

SEQ ID NO: 2518550 - RNA, 13 nt, Chlamydophila pneumoniae CWL029
gaaacgauuucuu

SEQ ID NO: 2518551 - RNA, 16 nt, Chlamydophila pneumoniae CWL029
gaaacugcuccugaag

SEQ ID NO: 2518552 - RNA, 21 nt, Chlamydophila pneumoniae CWL029
gaaacuuaguuuugaaaagau

SEQ ID NO: 2518553 - RNA, 12 nt, Chlamydophila pneumoniae CWL029
gaaacuucugac

SEQ ID NO: 2518554 - RNA, 23 nt, Chlamydophila pneumoniae CWL029
gaaacuucugacccuguagcgaa

SEQ ID NO: 2518555 - RNA, 15 nt, Chlamydophila pneumoniae CWL029
gaaacuuuaggauuc

SEQ ID NO: 2518556 - RNA, 22 nt, Chlamydophila pneumoniae CWL029
gaaacuuuuccaaauuccuuca

SEQ ID NO: 2518557 - RNA, 20 nt, Chlamydophila pneumoniae CWL029
gaaacuuuuuuucuucucua

SEQ ID NO: 2518558 - RNA, 19 nt, Chlamydophila pneumoniae CWL029
gaaagaagccuuccuuguu

SEQ ID NO: 2518559 - RNA, 19 nt, Chlamydophila pneumoniae CWL029
gaaagaagggaauacgauc

SEQ ID NO: 2518560 - RNA, 17 nt, Chlamydophila pneumoniae CWL029
gaaagagcuaaagaaac

SEQ ID NO: 2518561 - RNA, 23 nt, Chlamydophila pneumoniae CWL029
gaaaguauagacgggcuuauaaa

SEQ ID NO: 2518562 - RNA, 14 nt, Chlamydophila pneumoniae CWL029
gaaaguaucuucag

SEQ ID NO: 2518563 - RNA, 15 nt, Chlamydophila pneumoniae CWL029
gaaaguauuccucuu

SEQ ID NO: 2518564 - RNA, 22 nt, Chlamydophila pneumoniae CWL029
gaaauaauuuguuuagaaaaag

SEQ ID NO: 2518565 - RNA, 20 nt, Chlamydophila pneumoniae CWL029
gaaauaauuuucagucuucc

SEQ ID NO: 2518566 - RNA, 15 nt, Chlamydophila pneumoniae CWL029
gaaauacgcuuuucu

SEQ ID NO: 2518567 - RNA, 21 nt, Chlamydophila pneumoniae CWL029
gaaauacgcuuuucuucuuua

SEQ ID NO: 2518568 - RNA, 22 nt, Chlamydophila pneumoniae CWL029
gaaauacguccagccugcacca

SEQ ID NO: 2518569 - RNA, 14 nt, Chlamydophila pneumoniae CWL029
gaaauauacugcca

SEQ ID NO: 2518570 - RNA, 15 nt, Chlamydophila pneumoniae CWL029
gaaaucacacuuaaa

SEQ ID NO: 2518571 - RNA, 14 nt, Chlamydophila pneumoniae CWL029
gaaauccacagaua

SEQ ID NO: 2518572 - RNA, 12 nt, Chlamydophila pneumoniae CWL029
gaaauccuccua

SEQ ID NO: 2518573 - RNA, 20 nt, Chlamydophila pneumoniae CWL029
gaaauccugggcaaugauca

SEQ ID NO: 2518574 - RNA, 23 nt, Chlamydophila pneumoniae CWL029
gaaaucgacaggggaguuuucaa

SEQ ID NO: 2518575 - RNA, 16 nt, Chlamydophila pneumoniae CWL029
gaaaucgcauuacaaa

SEQ ID NO: 2518576 - RNA, 18 nt, Chlamydophila pneumoniae CWL029
gaaaucguaucuuuuugc

SEQ ID NO: 2518577 - RNA, 16 nt, Chlamydophila pneumoniae CWL029
gaaaucugcucuacuu

SEQ ID NO: 2518578 - RNA, 22 nt, Chlamydophila pneumoniae CWL029
gaaaucuuuagaauuaacaacu

SEQ ID NO: 2518579 - RNA, 22 nt, Chlamydophila pneumoniae CWL029
gaaaugcaaaccaaaaaaguaa

SEQ ID NO: 2518580 - RNA, 22 nt, Chlamydophila pneumoniae CWL029
gaaaugcaguucuuguuaaagu

SEQ ID NO: 2518581 - RNA, 17 nt, Chlamydophila pneumoniae CWL029
gaaaugcucuucugcag

SEQ ID NO: 2518582 - RNA, 22 nt, Chlamydophila pneumoniae CWL029
gaaauguaagaaggcagagaac

SEQ ID NO: 2518583 - RNA, 21 nt, Chlamydophila pneumoniae CWL029
gaaaugucacucuagaaaaua

SEQ ID NO: 2518584 - RNA, 12 nt, Chlamydophila pneumoniae CWL029
gaaauuaacaga

SEQ ID NO: 2518585 - RNA, 21 nt, Chlamydophila pneumoniae CWL029
gaaauuaacagagcgccucca

SEQ ID NO: 2518586 - RNA, 23 nt, Chlamydophila pneumoniae CWL029
gaaauuagagggauuuguaggaa

SEQ ID NO: 2518587 - RNA, 23 nt, Chlamydophila pneumoniae CWL029
gaaauuauagaugaucacaggcu

SEQ ID NO: 2518588 - RNA, 19 nt, Chlamydophila pneumoniae CWL029
gaaauuccgacccagucaa

SEQ ID NO: 2518589 - RNA, 11 nt, Chlamydophila pneumoniae CWL029
gaaauucuucc

SEQ ID NO: 2518590 - RNA, 21 nt, Chlamydophila pneumoniae CWL029
gaaauugaacucucaguuaaa

SEQ ID NO: 2518591 - RNA, 22 nt, Chlamydophila pneumoniae CWL029
gaaauugucuucagugcaaugu

SEQ ID NO: 2518592 - RNA, 15 nt, Chlamydophila pneumoniae CWL029
gaacaacugugguuu

SEQ ID NO: 2518593 - RNA, 22 nt, Chlamydophila pneumoniae CWL029
gaacaagucggcaggagaggua

SEQ ID NO: 2518594 - RNA, 19 nt, Chlamydophila pneumoniae CWL029
gaacaaguuuuuucaaucc

SEQ ID NO: 2518595 - RNA, 15 nt, Chlamydophila pneumoniae CWL029
gaacaauacucucug

SEQ ID NO: 2518596 - RNA, 19 nt, Chlamydophila pneumoniae CWL029
gaacaauacucucugcuuc

SEQ ID NO: 2518597 - RNA, 17 nt, Chlamydophila pneumoniae CWL029
gaacaauagaaagacca

SEQ ID NO: 2518598 - RNA, 14 nt, Chlamydophila pneumoniae CWL029
gaacaaucaacacc

SEQ ID NO: 2518599 - RNA, 21 nt, Chlamydophila pneumoniae CWL029
gaacaauguaaauugaguauc

SEQ ID NO: 2518600 - RNA, 22 nt, Chlamydophila pneumoniae CWL029
gaacacccccgcagcuucucua

SEQ ID NO: 2518601 - RNA, 23 nt, Chlamydophila pneumoniae CWL029
gaacacccccgcagcuucucuag

SEQ ID NO: 2518602 - RNA, 16 nt, Chlamydophila pneumoniae CWL029
gaacaccucuucucua

SEQ ID NO: 2518603 - RNA, 12 nt, Chlamydophila pneumoniae CWL029
gaacacucucua

SEQ ID NO: 2518604 - RNA, 15 nt, Chlamydophila pneumoniae CWL029
gaacagcacucucug

SEQ ID NO: 2518605 - RNA, 17 nt, Chlamydophila pneumoniae CWL029
gaacagcacucucugca

SEQ ID NO: 2518606 - RNA, 22 nt, Chlamydophila pneumoniae CWL029
gaacagcauggacuccaagaau

SEQ ID NO: 2518607 - RNA, 23 nt, Chlamydophila pneumoniae CWL029
gaacagcauggacuccaagaaua

SEQ ID NO: 2518608 - RNA, 18 nt, Chlamydophila pneumoniae CWL029
gaacagccucugugguuu

SEQ ID NO: 2518609 - RNA, 23 nt, Chlamydophila pneumoniae CWL029
gaacagccucugugguuuuuauu

SEQ ID NO: 2518610 - RNA, 18 nt, Chlamydophila pneumoniae CWL029
gaacaggagagagaaggc

SEQ ID NO: 2518611 - RNA, 20 nt, Chlamydophila pneumoniae CWL029
gaacaggagagagaaggcuc

SEQ ID NO: 2518612 - RNA, 23 nt, Chlamydophila pneumoniae CWL029
gaacaggauugauaaauacccuc

SEQ ID NO: 2518613 - RNA, 15 nt, Chlamydophila pneumoniae CWL029
gaacaggggauguga

SEQ ID NO: 2518614 - RNA, 22 nt, Chlamydophila pneumoniae CWL029
gaacaguuugcucuggauguag

SEQ ID NO: 2518615 - RNA, 15 nt, Chlamydophila pneumoniae CWL029
gaacauccuucacuc

SEQ ID NO: 2518616 - RNA, 16 nt, Chlamydophila pneumoniae CWL029
gaacaucuucccaccc

SEQ ID NO: 2518617 - RNA, 15 nt, Chlamydophila pneumoniae CWL029
gaacaugccaaauau

SEQ ID NO: 2518618 - RNA, 16 nt, Chlamydophila pneumoniae CWL029
gaaccaaaaugaguuc

SEQ ID NO: 2518619 - RNA, 19 nt, Chlamydophila pneumoniae CWL029
gaaccccccccccucucuc

SEQ ID NO: 2518620 - RNA, 13 nt, Chlamydophila pneumoniae CWL029
gaacccuggauga

SEQ ID NO: 2518621 - RNA, 14 nt, Chlamydophila pneumoniae CWL029
gaaccuaggaggau

SEQ ID NO: 2518622 - RNA, 21 nt, Chlamydophila pneumoniae CWL029
gaaccuaggaggauuuccuag

SEQ ID NO: 2518623 - RNA, 20 nt, Chlamydophila pneumoniae CWL029
gaaccuccaccaggagcucc

SEQ ID NO: 2518624 - RNA, 18 nt, Chlamydophila pneumoniae CWL029
gaacgaagacuuguucuu

SEQ ID NO: 2518625 - RNA, 19 nt, Chlamydophila pneumoniae CWL029
gaacgccaucuccacagcc

SEQ ID NO: 2518626 - RNA, 23 nt, Chlamydophila pneumoniae CWL029
gaacgguugaggguucaauuccu

SEQ ID NO: 2518627 - RNA, 17 nt, Chlamydophila pneumoniae CWL029
gaacguacucuucuuuu

SEQ ID NO: 2518628 - RNA, 21 nt, Chlamydophila pneumoniae CWL029
gaacguauacgucccacaaaa

SEQ ID NO: 2518629 - RNA, 17 nt, Chlamydophila pneumoniae CWL029
gaacgugcaucucuuca

SEQ ID NO: 2518630 - RNA, 13 nt, Chlamydophila pneumoniae CWL029
gaacgugcugcga

SEQ ID NO: 2518631 - RNA, 16 nt, Chlamydophila pneumoniae CWL029
gaacguuacgucuuag

SEQ ID NO: 2518632 - RNA, 15 nt, Chlamydophila pneumoniae CWL029
gaacuaaaaguuuuu

SEQ ID NO: 2518633 - RNA, 21 nt, Chlamydophila pneumoniae CWL029
gaacuacgggcaauauaucca

SEQ ID NO: 2518634 - RNA, 14 nt, Chlamydophila pneumoniae CWL029
gaacuauaggaagc

SEQ ID NO: 2518635 - RNA, 19 nt, Chlamydophila pneumoniae CWL029
gaacuauaggaagcucuuc

SEQ ID NO: 2518636 - RNA, 21 nt, Chlamydophila pneumoniae CWL029
gaacuauccuguuucaacaua

SEQ ID NO: 2518637 - RNA, 21 nt, Chlamydophila pneumoniae CWL029
gaacucacaaacaacagaaau

SEQ ID NO: 2518638 - RNA, 14 nt, Chlamydophila pneumoniae CWL029
gaacucaucacaau

SEQ ID NO: 2518639 - RNA, 16 nt, Chlamydophila pneumoniae CWL029
gaacuccauucagaug

SEQ ID NO: 2518640 - RNA, 12 nt, Chlamydophila pneumoniae CWL029
gaacucugaagu

SEQ ID NO: 2518641 - RNA, 23 nt, Chlamydophila pneumoniae CWL029
gaacucuuaaagguaaagcuucu

SEQ ID NO: 2518642 - RNA, 13 nt, Chlamydophila pneumoniae CWL029
gaagaagggacuu

SEQ ID NO: 2518643 - RNA, 20 nt, Chlamydophila pneumoniae CWL029
gaagaauuucauaagagaac

SEQ ID NO: 2518644 - RNA, 14 nt, Chlamydophila pneumoniae CWL029
gaagacaaguaaac

SEQ ID NO: 2518645 - RNA, 17 nt, Chlamydophila pneumoniae CWL029
gaagacaggagcuacug

SEQ ID NO: 2518646 - RNA, 18 nt, Chlamydophila pneumoniae CWL029
gaagacccucgaaccacu

SEQ ID NO: 2518647 - RNA, 14 nt, Chlamydophila pneumoniae CWL029
gaagacucucauca

SEQ ID NO: 2518648 - RNA, 16 nt, Chlamydophila pneumoniae CWL029
gaagacuuguucuuca

SEQ ID NO: 2518649 - RNA, 19 nt, Chlamydophila pneumoniae CWL029
gaagagcaauuaagaaacu

SEQ ID NO: 2518650 - RNA, 20 nt, Chlamydophila pneumoniae CWL029
gaagagcauuuaaaacggcu

SEQ ID NO: 2518651 - RNA, 18 nt, Chlamydophila pneumoniae CWL029
gaagagguguccauaaug

SEQ ID NO: 2518652 - RNA, 15 nt, Chlamydophila pneumoniae CWL029
gaagaguuguugugg

SEQ ID NO: 2518653 - RNA, 13 nt, Chlamydophila pneumoniae CWL029
gaagauaaauccg

SEQ ID NO: 2518654 - RNA, 16 nt, Chlamydophila pneumoniae CWL029
gaagaucccugagccu

SEQ ID NO: 2518655 - RNA, 18 nt, Chlamydophila pneumoniae CWL029
gaagaucucccgaugagg

SEQ ID NO: 2518656 - RNA, 13 nt, Chlamydophila pneumoniae CWL029
gaagaugauugga

SEQ ID NO: 2518657 - RNA, 18 nt, Chlamydophila pneumoniae CWL029
gaagauggcaaggaaaau

SEQ ID NO: 2518658 - RNA, 23 nt, Chlamydophila pneumoniae CWL029
gaagauguauaaggauaucuucu

SEQ ID NO: 2518659 - RNA, 14 nt, Chlamydophila pneumoniae CWL029
gaagauucaaagaa

SEQ ID NO: 2518660 - RNA, 15 nt, Chlamydophila pneumoniae CWL029
gaagauucaaagaag

SEQ ID NO: 2518661 - RNA, 14 nt, Chlamydophila pneumoniae CWL029
gaagauucuuuaau

SEQ ID NO: 2518662 - RNA, 16 nt, Chlamydophila pneumoniae CWL029
gaagauuuagggaaga

SEQ ID NO: 2518663 - RNA, 18 nt, Chlamydophila pneumoniae CWL029
gaagcaacuaaacucucc

SEQ ID NO: 2518664 - RNA, 20 nt, Chlamydophila pneumoniae CWL029
gaagcaacuaaacucuccaa

SEQ ID NO: 2518665 - RNA, 14 nt, Chlamydophila pneumoniae CWL029
gaagcaagaaucac

SEQ ID NO: 2518666 - RNA, 22 nt, Chlamydophila pneumoniae CWL029
gaagcacaccaaguacaguauc

SEQ ID NO: 2518667 - RNA, 17 nt, Chlamydophila pneumoniae CWL029
gaagcagggaaaaugcg

SEQ ID NO: 2518668 - RNA, 18 nt, Chlamydophila pneumoniae CWL029
gaagccauuuucuaagag

SEQ ID NO: 2518669 - RNA, 21 nt, Chlamydophila pneumoniae CWL029
gaagcccgcaguuuaucucua

SEQ ID NO: 2518670 - RNA, 16 nt, Chlamydophila pneumoniae CWL029
gaagccuucauuccau

SEQ ID NO: 2518671 - RNA, 19 nt, Chlamydophila pneumoniae CWL029
gaagcgccgcauuacaggg

SEQ ID NO: 2518672 - RNA, 14 nt, Chlamydophila pneumoniae CWL029
gaagcguagcaaag

SEQ ID NO: 2518673 - RNA, 14 nt, Chlamydophila pneumoniae CWL029
gaagcguuaacaac

SEQ ID NO: 2518674 - RNA, 22 nt, Chlamydophila pneumoniae CWL029
gaagcuauuccacggcggagaa

SEQ ID NO: 2518675 - RNA, 22 nt, Chlamydophila pneumoniae CWL029
gaagcucacucuuuaaaaaccc

SEQ ID NO: 2518676 - RNA, 19 nt, Chlamydophila pneumoniae CWL029
gaagcuccucacaucuccu

SEQ ID NO: 2518677 - RNA, 15 nt, Chlamydophila pneumoniae CWL029
gaagcucuaucuuug

SEQ ID NO: 2518678 - RNA, 15 nt, Chlamydophila pneumoniae CWL029
gaagcugacaaauag

SEQ ID NO: 2518679 - RNA, 20 nt, Chlamydophila pneumoniae CWL029
gaagcugagaauacaacccu

SEQ ID NO: 2518680 - RNA, 18 nt, Chlamydophila pneumoniae CWL029
gaagcugcucguuuuagc

SEQ ID NO: 2518681 - RNA, 12 nt, Chlamydophila pneumoniae CWL029
gaagcugcuucu

SEQ ID NO: 2518682 - RNA, 21 nt, Chlamydophila pneumoniae CWL029
gaagcuguaaaugaggcuccu

SEQ ID NO: 2518683 - RNA, 21 nt, Chlamydophila pneumoniae CWL029
gaagcuuccaucguuagauuu

SEQ ID NO: 2518684 - RNA, 18 nt, Chlamydophila pneumoniae CWL029
gaagcuugcugauuucuu

SEQ ID NO: 2518685 - RNA, 12 nt, Chlamydophila pneumoniae CWL029
gaaggaagaucu

SEQ ID NO: 2518686 - RNA, 20 nt, Chlamydophila pneumoniae CWL029
gaaggaagaucuugaacaga

SEQ ID NO: 2518687 - RNA, 13 nt, Chlamydophila pneumoniae CWL029
gaaggaauuugcu

SEQ ID NO: 2518688 - RNA, 15 nt, Chlamydophila pneumoniae CWL029
gaaggacaacuagac

SEQ ID NO: 2518689 - RNA, 20 nt, Chlamydophila pneumoniae CWL029
gaaggauaguuugagcagua

SEQ ID NO: 2518690 - RNA, 21 nt, Chlamydophila pneumoniae CWL029
gaaggaucauaccgacaagca

SEQ ID NO: 2518691 - RNA, 18 nt, Chlamydophila pneumoniae CWL029
gaaggaucugaugcacca

SEQ ID NO: 2518692 - RNA, 15 nt, Chlamydophila pneumoniae CWL029
gaaggcaccaacacu

SEQ ID NO: 2518693 - RNA, 23 nt, Chlamydophila pneumoniae CWL029
gaaggcaccaacacuuuuaaaga

SEQ ID NO: 2518694 - RNA, 12 nt, Chlamydophila pneumoniae CWL029
gaaggcagagaa

SEQ ID NO: 2518695 - RNA, 21 nt, Chlamydophila pneumoniae CWL029
gaaggccaagauucucacucu

SEQ ID NO: 2518696 - RNA, 21 nt, Chlamydophila pneumoniae CWL029
gaaggcggcuuuuugcaagcu

SEQ ID NO: 2518697 - RNA, 14 nt, Chlamydophila pneumoniae CWL029
gaaggggaagagga

SEQ ID NO: 2518698 - RNA, 18 nt, Chlamydophila pneumoniae CWL029
gaaggggaagaggaaugc

SEQ ID NO: 2518699 - RNA, 23 nt, Chlamydophila pneumoniae CWL029
gaaggggagauuccccagggaga

SEQ ID NO: 2518700 - RNA, 22 nt, Chlamydophila pneumoniae CWL029
gaagguaaauuuuuaaaacucc

SEQ ID NO: 2518701 - RNA, 18 nt, Chlamydophila pneumoniae CWL029
gaagguguggguacaggg

SEQ ID NO: 2518702 - RNA, 21 nt, Chlamydophila pneumoniae CWL029
gaagguguuuuggcugcuuuu

SEQ ID NO: 2518703 - RNA, 20 nt, Chlamydophila pneumoniae CWL029
gaaguaaucgucacugcgca

SEQ ID NO: 2518704 - RNA, 16 nt, Chlamydophila pneumoniae CWL029
gaaguacaagugaaga

SEQ ID NO: 2518705 - RNA, 15 nt, Chlamydophila pneumoniae CWL029
gaaguagggucccuu

SEQ ID NO: 2518706 - RNA, 23 nt, Chlamydophila pneumoniae CWL029
gaaguaguggacuauagaugcca

SEQ ID NO: 2518707 - RNA, 18 nt, Chlamydophila pneumoniae CWL029
gaagucacaaauuuuugc

SEQ ID NO: 2518708 - RNA, 15 nt, Chlamydophila pneumoniae CWL029
gaagucagugcuucu

SEQ ID NO: 2518709 - RNA, 17 nt, Chlamydophila pneumoniae CWL029
gaaguccagacuuuccu

SEQ ID NO: 2518710 - RNA, 17 nt, Chlamydophila pneumoniae CWL029
gaaguccuaucaaagca

SEQ ID NO: 2518711 - RNA, 15 nt, Chlamydophila pneumoniae CWL029
gaagucgaaagauca

SEQ ID NO: 2518712 - RNA, 21 nt, Chlamydophila pneumoniae CWL029
gaagucguuuagauuuuucuu

SEQ ID NO: 2518713 - RNA, 20 nt, Chlamydophila pneumoniae CWL029
gaagucuucuugcugauccu

SEQ ID NO: 2518714 - RNA, 18 nt, Chlamydophila pneumoniae CWL029
gaagugaggagaauagca

SEQ ID NO: 2518715 - RNA, 23 nt, Chlamydophila pneumoniae CWL029
gaagugaucuugagaaaagaaca

SEQ ID NO: 2518716 - RNA, 13 nt, Chlamydophila pneumoniae CWL029
gaagugcuuugag

SEQ ID NO: 2518717 - RNA, 16 nt, Chlamydophila pneumoniae CWL029
gaaguuacgugagaac

SEQ ID NO: 2518718 - RNA, 21 nt, Chlamydophila pneumoniae CWL029
gaaguuccuacuucugcagga

SEQ ID NO: 2518719 - RNA, 14 nt, Chlamydophila pneumoniae CWL029
gaaguuccuucagg

SEQ ID NO: 2518720 - RNA, 19 nt, Chlamydophila pneumoniae CWL029
gaaguugaaaugagugaga

SEQ ID NO: 2518721 - RNA, 21 nt, Chlamydophila pneumoniae CWL029
gaaguugaaaugagugagaau

SEQ ID NO: 2518722 - RNA, 23 nt, Chlamydophila pneumoniae CWL029
gaaguugaaaugagugagaaugc

SEQ ID NO: 2518723 - RNA, 15 nt, Chlamydophila pneumoniae CWL029
gaaguuuaaacgucu

SEQ ID NO: 2518724 - RNA, 12 nt, Chlamydophila pneumoniae CWL029
gaaguuuugcuc

SEQ ID NO: 2518725 - RNA, 15 nt, Chlamydophila pneumoniae CWL029
gaaguuuugcucucu

SEQ ID NO: 2518726 - RNA, 22 nt, Chlamydophila pneumoniae CWL029
gaaguuuuuuaagugcuuuuag

SEQ ID NO: 2518727 - RNA, 20 nt, Chlamydophila pneumoniae CWL029
gagaaaguagagacaucgua

SEQ ID NO: 2518728 - RNA, 19 nt, Chlamydophila pneumoniae CWL029
gagaaagucgauuuccuuu

SEQ ID NO: 2518729 - RNA, 20 nt, Chlamydophila pneumoniae CWL029
gagaaauacgcuuuucuucu

SEQ ID NO: 2518730 - RNA, 13 nt, Chlamydophila pneumoniae CWL029
gagaaaucacacu

SEQ ID NO: 2518731 - RNA, 21 nt, Chlamydophila pneumoniae CWL029
gagaacaugcccccacaaaac

SEQ ID NO: 2518732 - RNA, 14 nt, Chlamydophila pneumoniae CWL029
gagaacauguuucu

SEQ ID NO: 2518733 - RNA, 18 nt, Chlamydophila pneumoniae CWL029
gagaaccuccaccaggag

SEQ ID NO: 2518734 - RNA, 12 nt, Chlamydophila pneumoniae CWL029
gagaacuucaac

SEQ ID NO: 2518735 - RNA, 17 nt, Chlamydophila pneumoniae CWL029
gagaacuucaacaaagg

SEQ ID NO: 2518736 - RNA, 17 nt, Chlamydophila pneumoniae CWL029
gagaagagguaauaaua

SEQ ID NO: 2518737 - RNA, 23 nt, Chlamydophila pneumoniae CWL029
gagaagcaucuucgauuucuagu

SEQ ID NO: 2518738 - RNA, 14 nt, Chlamydophila pneumoniae CWL029
gagaaguuugauaa

SEQ ID NO: 2518739 - RNA, 13 nt, Chlamydophila pneumoniae CWL029
gagaauaaaacuu

SEQ ID NO: 2518740 - RNA, 21 nt, Chlamydophila pneumoniae CWL029
gagaauacucuagguuuucuc

SEQ ID NO: 2518741 - RNA, 23 nt, Chlamydophila pneumoniae CWL029
gagaauauggccuagcuuucuug

SEQ ID NO: 2518742 - RNA, 18 nt, Chlamydophila pneumoniae CWL029
gagaauccuuuuuaggaa

SEQ ID NO: 2518743 - RNA, 15 nt, Chlamydophila pneumoniae CWL029
gagaaugacuuuaga

SEQ ID NO: 2518744 - RNA, 19 nt, Chlamydophila pneumoniae CWL029
gagaaugacuuuagaaauu

SEQ ID NO: 2518745 - RNA, 17 nt, Chlamydophila pneumoniae CWL029
gagaauguuccuguaaa

SEQ ID NO: 2518746 - RNA, 22 nt, Chlamydophila pneumoniae CWL029
gagaauugaaaauugcccauug

SEQ ID NO: 2518747 - RNA, 17 nt, Chlamydophila pneumoniae CWL029
gagacaaagccacagcc

SEQ ID NO: 2518748 - RNA, 23 nt, Chlamydophila pneumoniae CWL029
gagacaguuuuggauucaagugc

SEQ ID NO: 2518749 - RNA, 20 nt, Chlamydophila pneumoniae CWL029
gagacccaacaguucuuucu

SEQ ID NO: 2518750 - RNA, 17 nt, Chlamydophila pneumoniae CWL029
gagacucagagaaaauc

SEQ ID NO: 2518751 - RNA, 16 nt, Chlamydophila pneumoniae CWL029
gagacucuaguuuuuc

SEQ ID NO: 2518752 - RNA, 19 nt, Chlamydophila pneumoniae CWL029
gagacucuaguuuuucuuu

SEQ ID NO: 2518753 - RNA, 16 nt, Chlamydophila pneumoniae CWL029
gagacugcaaaggaag

SEQ ID NO: 2518754 - RNA, 17 nt, Chlamydophila pneumoniae CWL029
gagacugcaaaggaagg

SEQ ID NO: 2518755 - RNA, 22 nt, Chlamydophila pneumoniae CWL029
gagacuguguuuuuaggaguug

SEQ ID NO: 2518756 - RNA, 19 nt, Chlamydophila pneumoniae CWL029
gagacuugaucuacaaaaa

SEQ ID NO: 2518757 - RNA, 19 nt, Chlamydophila pneumoniae CWL029
gagacuuugccauuucuau

SEQ ID NO: 2518758 - RNA, 14 nt, Chlamydophila pneumoniae CWL029
gagagaaucgagaa

SEQ ID NO: 2518759 - RNA, 17 nt, Chlamydophila pneumoniae CWL029
gagagacuguguuuuua

SEQ ID NO: 2518760 - RNA, 13 nt, Chlamydophila pneumoniae CWL029
gagagagacccgu

SEQ ID NO: 2518761 - RNA, 19 nt, Chlamydophila pneumoniae CWL029
gagagagucggcuuuagaa

SEQ ID NO: 2518762 - RNA, 14 nt, Chlamydophila pneumoniae CWL029
gagagcaagauaau

SEQ ID NO: 2518763 - RNA, 15 nt, Chlamydophila pneumoniae CWL029
gagagcgaacgcuga

SEQ ID NO: 2518764 - RNA, 18 nt, Chlamydophila pneumoniae CWL029
gagagcuugguuuucucc

SEQ ID NO: 2518765 - RNA, 21 nt, Chlamydophila pneumoniae CWL029
gagaggaaaucccgagauaug

SEQ ID NO: 2518766 - RNA, 22 nt, Chlamydophila pneumoniae CWL029
gagaggaaaucccgagauauga

SEQ ID NO: 2518767 - RNA, 17 nt, Chlamydophila pneumoniae CWL029
gagaggagagaauccuu

SEQ ID NO: 2518768 - RNA, 22 nt, Chlamydophila pneumoniae CWL029
gagaggauuugaaccuccgccc

SEQ ID NO: 2518769 - RNA, 15 nt, Chlamydophila pneumoniae CWL029
gagagguaggcagug

SEQ ID NO: 2518770 - RNA, 14 nt, Chlamydophila pneumoniae CWL029
gagagguucccuca

SEQ ID NO: 2518771 - RNA, 20 nt, Chlamydophila pneumoniae CWL029
gagaguguuguuggagcaga

SEQ ID NO: 2518772 - RNA, 19 nt, Chlamydophila pneumoniae CWL029
gagauacguuccagccugu

SEQ ID NO: 2518773 - RNA, 21 nt, Chlamydophila pneumoniae CWL029
gagauaucaucaaaagauaug

SEQ ID NO: 2518774 - RNA, 20 nt, Chlamydophila pneumoniae CWL029
gagauauugugaggggauga

SEQ ID NO: 2518775 - RNA, 15 nt, Chlamydophila pneumoniae CWL029
gagaucacagggaca

SEQ ID NO: 2518776 - RNA, 16 nt, Chlamydophila pneumoniae CWL029
gagauccaaagccuga

SEQ ID NO: 2518777 - RNA, 17 nt, Chlamydophila pneumoniae CWL029
gagauccuccuggaaga

SEQ ID NO: 2518778 - RNA, 22 nt, Chlamydophila pneumoniae CWL029
gagaucuuauagacagguacau

SEQ ID NO: 2518779 - RNA, 21 nt, Chlamydophila pneumoniae CWL029
gagaucuuugagaucuugaau

SEQ ID NO: 2518780 - RNA, 21 nt, Chlamydophila pneumoniae CWL029
gagaucuuuuugccaguucuu

SEQ ID NO: 2518781 - RNA, 21 nt, Chlamydophila pneumoniae CWL029
gagaugaaaggcucguagaua

SEQ ID NO: 2518782 - RNA, 20 nt, Chlamydophila pneumoniae CWL029
gagaugcaaauccuguagaa

SEQ ID NO: 2518783 - RNA, 14 nt, Chlamydophila pneumoniae CWL029
gagaugcuaacaac

SEQ ID NO: 2518784 - RNA, 17 nt, Chlamydophila pneumoniae CWL029
gagaugcuucuaaacaa

SEQ ID NO: 2518785 - RNA, 15 nt, Chlamydophila pneumoniae CWL029
gagauucauaaaacu

SEQ ID NO: 2518786 - RNA, 16 nt, Chlamydophila pneumoniae CWL029
gagauucuugaggacc

SEQ ID NO: 2518787 - RNA, 15 nt, Chlamydophila pneumoniae CWL029
gagauugccaggaga

SEQ ID NO: 2518788 - RNA, 12 nt, Chlamydophila pneumoniae CWL029
gagauuuuccau

SEQ ID NO: 2518789 - RNA, 21 nt, Chlamydophila pneumoniae CWL029
gagauuuuccauaggaacaaa

SEQ ID NO: 2518790 - RNA, 12 nt, Chlamydophila pneumoniae CWL029
gagauuuuucua

SEQ ID NO: 2518791 - RNA, 17 nt, Chlamydophila pneumoniae CWL029
gagauuuuuucauacuu

SEQ ID NO: 2518792 - RNA, 11 nt, Chlamydophila pneumoniae CWL029
gagcaaacauc

SEQ ID NO: 2518793 - RNA, 20 nt, Chlamydophila pneumoniae CWL029
gagcaagauaaucauuaaga

SEQ ID NO: 2518794 - RNA, 17 nt, Chlamydophila pneumoniae CWL029
gagcaauuaagaaacua

SEQ ID NO: 2518795 - RNA, 15 nt, Chlamydophila pneumoniae CWL029
gagcacaaggagaga

SEQ ID NO: 2518796 - RNA, 16 nt, Chlamydophila pneumoniae CWL029
gagcacauagaaacag

SEQ ID NO: 2518797 - RNA, 22 nt, Chlamydophila pneumoniae CWL029
gagcacuuuuaauauuugagaa

SEQ ID NO: 2518798 - RNA, 12 nt, Chlamydophila pneumoniae CWL029
gagcagaaacuc

SEQ ID NO: 2518799 - RNA, 15 nt, Chlamydophila pneumoniae CWL029
gagcagaaacuccag

SEQ ID NO: 2518800 - RNA, 17 nt, Chlamydophila pneumoniae CWL029
gagcagcuguagugaua

SEQ ID NO: 2518801 - RNA, 16 nt, Chlamydophila pneumoniae CWL029
gagcauagacucuucc

SEQ ID NO: 2518802 - RNA, 21 nt, Chlamydophila pneumoniae CWL029
gagcauccuguagccacuaag

SEQ ID NO: 2518803 - RNA, 20 nt, Chlamydophila pneumoniae CWL029
gagcaucuuuucaaaagaaa

SEQ ID NO: 2518804 - RNA, 22 nt, Chlamydophila pneumoniae CWL029
gagcaucuuuucaaaagaaaag

SEQ ID NO: 2518805 - RNA, 17 nt, Chlamydophila pneumoniae CWL029
gagcaugagagucgaaa

SEQ ID NO: 2518806 - RNA, 17 nt, Chlamydophila pneumoniae CWL029
gagccgucuacuuuugu

SEQ ID NO: 2518807 - RNA, 14 nt, Chlamydophila pneumoniae CWL029
gagccuccauaaug

SEQ ID NO: 2518808 - RNA, 21 nt, Chlamydophila pneumoniae CWL029
gagcgaucgcaaucagcaaca

SEQ ID NO: 2518809 - RNA, 19 nt, Chlamydophila pneumoniae CWL029
gagcgcguuucaaauagga

SEQ ID NO: 2518810 - RNA, 16 nt, Chlamydophila pneumoniae CWL029
gagcgcuuucuuuuau

SEQ ID NO: 2518811 - RNA, 12 nt, Chlamydophila pneumoniae CWL029
gagcggaauuuc

SEQ ID NO: 2518812 - RNA, 15 nt, Chlamydophila pneumoniae CWL029
gagcgggagaaucaa

SEQ ID NO: 2518813 - RNA, 12 nt, Chlamydophila pneumoniae CWL029
gagcuaccagaa

SEQ ID NO: 2518814 - RNA, 23 nt, Chlamydophila pneumoniae CWL029
gagcuaugaugagaacguccuca

SEQ ID NO: 2518815 - RNA, 18 nt, Chlamydophila pneumoniae CWL029
gagcuauuuuacuuacua

SEQ ID NO: 2518816 - RNA, 13 nt, Chlamydophila pneumoniae CWL029
gagcucacaaccc

SEQ ID NO: 2518817 - RNA, 20 nt, Chlamydophila pneumoniae CWL029
gagcucccucuagagcuuug

SEQ ID NO: 2518818 - RNA, 19 nt, Chlamydophila pneumoniae CWL029
gagcuccgcuagaggaucu

SEQ ID NO: 2518819 - RNA, 23 nt, Chlamydophila pneumoniae CWL029
gagcuccgcuagaggaucuucaa

SEQ ID NO: 2518820 - RNA, 12 nt, Chlamydophila pneumoniae CWL029
gagcucuaaaaa

SEQ ID NO: 2518821 - RNA, 23 nt, Chlamydophila pneumoniae CWL029
gagcucuaaaaaagauaaagcua

SEQ ID NO: 2518822 - RNA, 22 nt, Chlamydophila pneumoniae CWL029
gagcugcugguccuaaaaaaag

SEQ ID NO: 2518823 - RNA, 17 nt, Chlamydophila pneumoniae CWL029
gagcuggacuucugguu

SEQ ID NO: 2518824 - RNA, 18 nt, Chlamydophila pneumoniae CWL029
gagcuucacaucuuucuc

SEQ ID NO: 2518825 - RNA, 21 nt, Chlamydophila pneumoniae CWL029
gcucaaaaaguuccauagagu

SEQ ID NO: 2518826 - RNA, 20 nt, Chlamydophila pneumoniae CWL029
gcucaaaucucauuccagca

SEQ ID NO: 2518827 - RNA, 19 nt, Chlamydophila pneumoniae CWL029
gcucagaaaauguaaaaaa

SEQ ID NO: 2518828 - RNA, 22 nt, Chlamydophila pneumoniae CWL029
gcucagcuaauuuaaaugccuu

SEQ ID NO: 2518829 - RNA, 14 nt, Chlamydophila pneumoniae CWL029
gcucauaacccaaa

SEQ ID NO: 2518830 - RNA, 14 nt, Chlamydophila pneumoniae CWL029
gcucauaagaaauu

SEQ ID NO: 2518831 - RNA, 13 nt, Chlamydophila pneumoniae CWL029
gcucaucuagaaa

SEQ ID NO: 2518832 - RNA, 14 nt, Chlamydophila pneumoniae CWL029
gcuccaaaauaauc

SEQ ID NO: 2518833 - RNA, 17 nt, Chlamydophila pneumoniae CWL029
gcuccaauuuucuucag

SEQ ID NO: 2518834 - RNA, 20 nt, Chlamydophila pneumoniae CWL029
gcuccagaaacgcagcuuuc

SEQ ID NO: 2518835 - RNA, 22 nt, Chlamydophila pneumoniae CWL029
gcucccuccuccucgucuaaag

SEQ ID NO: 2518836 - RNA, 17 nt, Chlamydophila pneumoniae CWL029
gcuccuacaguccuggg

SEQ ID NO: 2518837 - RNA, 13 nt, Chlamydophila pneumoniae CWL029
gcuccugaagcug

SEQ ID NO: 2518838 - RNA, 14 nt, Chlamydophila pneumoniae CWL029
gcuccuugacuaaa

SEQ ID NO: 2518839 - RNA, 21 nt, Chlamydophila pneumoniae CWL029
gcuccuuggcuauggaaagag

SEQ ID NO: 2518840 - RNA, 18 nt, Chlamydophila pneumoniae CWL029
gcucgacguauuugccaa

SEQ ID NO: 2518841 - RNA, 15 nt, Chlamydophila pneumoniae CWL029
gcucgagaucuuuuu

SEQ ID NO: 2518842 - RNA, 20 nt, Chlamydophila pneumoniae CWL029
gcucgagaucuuuuugccag

SEQ ID NO: 2518843 - RNA, 20 nt, Chlamydophila pneumoniae CWL029
gcucgaggucuuuucuuuuu

SEQ ID NO: 2518844 - RNA, 21 nt, Chlamydophila pneumoniae CWL029
gcucgguacgucuuucaccaa

SEQ ID NO: 2518845 - RNA, 12 nt, Chlamydophila pneumoniae CWL029
gcucguacuguu

SEQ ID NO: 2518846 - RNA, 19 nt, Chlamydophila pneumoniae CWL029
gcucguacuguuccuacag

SEQ ID NO: 2518847 - RNA, 15 nt, Chlamydophila pneumoniae CWL029
gcucguauugauauu

SEQ ID NO: 2518848 - RNA, 19 nt, Chlamydophila pneumoniae CWL029
gcucuaaacucucuuccuu

SEQ ID NO: 2518849 - RNA, 20 nt, Chlamydophila pneumoniae CWL029
gcucuaaacucucuuccuuc

SEQ ID NO: 2518850 - RNA, 23 nt, Chlamydophila pneumoniae CWL029
gcucuaaacucucuuccuucucc

SEQ ID NO: 2518851 - RNA, 15 nt, Chlamydophila pneumoniae CWL029
gcucuaagagcccuu

SEQ ID NO: 2518852 - RNA, 15 nt, Chlamydophila pneumoniae CWL029
gcucuacaggagaag

SEQ ID NO: 2518853 - RNA, 17 nt, Chlamydophila pneumoniae CWL029
gcucuaccaacugagcu

SEQ ID NO: 2518854 - RNA, 23 nt, Chlamydophila pneumoniae CWL029
gcucuaccccacgcuaaacuaaa

SEQ ID NO: 2518855 - RNA, 14 nt, Chlamydophila pneumoniae CWL029
gcucuccauggcuu

SEQ ID NO: 2518856 - RNA, 18 nt, Chlamydophila pneumoniae CWL029
gcucuccugcaaaaaguu

SEQ ID NO: 2518857 - RNA, 16 nt, Chlamydophila pneumoniae CWL029
gcucucgcuaagcaaa

SEQ ID NO: 2518858 - RNA, 12 nt, Chlamydophila pneumoniae CWL029
gcucucuagauu

SEQ ID NO: 2518859 - RNA, 16 nt, Chlamydophila pneumoniae CWL029
gcucucugaagcuaaa

SEQ ID NO: 2518860 - RNA, 13 nt, Chlamydophila pneumoniae CWL029
gcucucuucuucu

SEQ ID NO: 2518861 - RNA, 16 nt, Chlamydophila pneumoniae CWL029
gcucucuucuucucag

SEQ ID NO: 2518862 - RNA, 23 nt, Chlamydophila pneumoniae CWL029
gcucucuucuucucaggauccca

SEQ ID NO: 2518863 - RNA, 18 nt, Chlamydophila pneumoniae CWL029
gcucucuuuaaaaaauuc

SEQ ID NO: 2518864 - RNA, 15 nt, Chlamydophila pneumoniae CWL029
gcucuggagauugcu

SEQ ID NO: 2518865 - RNA, 17 nt, Chlamydophila pneumoniae CWL029
gcucuuacuucuggucc

SEQ ID NO: 2518866 - RNA, 19 nt, Chlamydophila pneumoniae CWL029
gcucuucuaugguaaucac

SEQ ID NO: 2518867 - RNA, 19 nt, Chlamydophila pneumoniae CWL029
gcucuucuauguguucucg

SEQ ID NO: 2518868 - RNA, 21 nt, Chlamydophila pneumoniae CWL029
gcucuuuaauaaggcuuuucu

SEQ ID NO: 2518869 - RNA, 21 nt, Chlamydophila pneumoniae CWL029
gcucuuuagcaaacauuuuua

SEQ ID NO: 2518870 - RNA, 23 nt, Chlamydophila pneumoniae CWL029
gcucuuugggauaaaaaguuuuu

SEQ ID NO: 2518871 - RNA, 22 nt, Chlamydophila pneumoniae CWL029
gcugaaagaaugccauucuuau

SEQ ID NO: 2518872 - RNA, 22 nt, Chlamydophila pneumoniae CWL029
gcugaaccuuugguagaaagac

SEQ ID NO: 2518873 - RNA, 11 nt, Chlamydophila pneumoniae CWL029
gcugaagauuu

SEQ ID NO: 2518874 - RNA, 17 nt, Chlamydophila pneumoniae CWL029
gcugacacucagcuccc

SEQ ID NO: 2518875 - RNA, 17 nt, Chlamydophila pneumoniae CWL029
gcugacaucuccaagau

SEQ ID NO: 2518876 - RNA, 20 nt, Chlamydophila pneumoniae CWL029
gcugagacauauugaagaua

SEQ ID NO: 2518877 - RNA, 13 nt, Chlamydophila pneumoniae CWL029
gcugagagaagca

SEQ ID NO: 2518878 - RNA, 15 nt, Chlamydophila pneumoniae CWL029
gcugaggacgcagag

SEQ ID NO: 2518879 - RNA, 14 nt, Chlamydophila pneumoniae CWL029
gcugauccaaaagc

SEQ ID NO: 2518880 - RNA, 21 nt, Chlamydophila pneumoniae CWL029
gcugauccucggcaucuuugg

SEQ ID NO: 2518881 - RNA, 14 nt, Chlamydophila pneumoniae CWL029
gcugauucucccaa

SEQ ID NO: 2518882 - RNA, 14 nt, Chlamydophila pneumoniae CWL029
gcugauuucuuuuu

SEQ ID NO: 2518883 - RNA, 22 nt, Chlamydophila pneumoniae CWL029
gcugcaaucucaaaaucaaaua

SEQ ID NO: 2518884 - RNA, 19 nt, Chlamydophila pneumoniae CWL029
gcugcagcaaaacuaggaa

SEQ ID NO: 2518885 - RNA, 14 nt, Chlamydophila pneumoniae CWL029
gcugcuagagcagc

SEQ ID NO: 2518886 - RNA, 16 nt, Chlamydophila pneumoniae CWL029
gcugcucuuuuagaau

SEQ ID NO: 2518887 - RNA, 18 nt, Chlamydophila pneumoniae CWL029
gcugcugauccaaaagcg

SEQ ID NO: 2518888 - RNA, 13 nt, Chlamydophila pneumoniae CWL029
gcugcuucagaaa

SEQ ID NO: 2518889 - RNA, 14 nt, Chlamydophila pneumoniae CWL029
gcugcuucucuacu

SEQ ID NO: 2518890 - RNA, 19 nt, Chlamydophila pneumoniae CWL029
gcugcuuuuguuguuuuug

SEQ ID NO: 2518891 - RNA, 22 nt, Chlamydophila pneumoniae CWL029
gcuggaggccaaagaacagcac

SEQ ID NO: 2518892 - RNA, 22 nt, Chlamydophila pneumoniae CWL029
gcuguaaucgagagaagaaauu

SEQ ID NO: 2518893 - RNA, 15 nt, Chlamydophila pneumoniae CWL029
gcuguacagaacaau

SEQ ID NO: 2518894 - RNA, 21 nt, Chlamydophila pneumoniae CWL029
gcuguacuugauauuguucuu

SEQ ID NO: 2518895 - RNA, 18 nt, Chlamydophila pneumoniae CWL029
gcuguauuuucagcacug

SEQ ID NO: 2518896 - RNA, 17 nt, Chlamydophila pneumoniae CWL029
gcugucuugaccaauac

SEQ ID NO: 2518897 - RNA, 13 nt, Chlamydophila pneumoniae CWL029
gcugugcauuuuc

SEQ ID NO: 2518898 - RNA, 19 nt, Chlamydophila pneumoniae CWL029
gcugugcauuuucuucuug

SEQ ID NO: 2518899 - RNA, 15 nt, Chlamydophila pneumoniae CWL029
gcuguggaauuuucc

SEQ ID NO: 2518900 - RNA, 14 nt, Chlamydophila pneumoniae CWL029
gcuguguaaaaguu

SEQ ID NO: 2518901 - RNA, 13 nt, Chlamydophila pneumoniae CWL029
gcuguuccaagag

SEQ ID NO: 2518902 - RNA, 13 nt, Chlamydophila pneumoniae CWL029
gcuguuucucugu

SEQ ID NO: 2518903 - RNA, 15 nt, Chlamydophila pneumoniae CWL029
gcuguuucuucugaa

SEQ ID NO: 2518904 - RNA, 14 nt, Chlamydophila pneumoniae CWL029
gcuuagccauggca

SEQ ID NO: 2518905 - RNA, 20 nt, Chlamydophila pneumoniae CWL029
gcuuagccauggcaucuaag

SEQ ID NO: 2518906 - RNA, 21 nt, Chlamydophila pneumoniae CWL029
gcuuagcgaucucucuuccug

SEQ ID NO: 2518907 - RNA, 14 nt, Chlamydophila pneumoniae CWL029
gcuuauagagagaa

SEQ ID NO: 2518908 - RNA, 17 nt, Chlamydophila pneumoniae CWL029
gcuuauagagagaauga

SEQ ID NO: 2518909 - RNA, 21 nt, Chlamydophila pneumoniae CWL029
gcuuauagagagaaugacuuu

SEQ ID NO: 2518910 - RNA, 20 nt, Chlamydophila pneumoniae CWL029
gcuuauccaaguguucgagu

SEQ ID NO: 2518911 - RNA, 13 nt, Chlamydophila pneumoniae CWL029
gcuuauccguggg

SEQ ID NO: 2518912 - RNA, 14 nt, Chlamydophila pneumoniae CWL029
gcuuauuauugaau

SEQ ID NO: 2518913 - RNA, 16 nt, Chlamydophila pneumoniae CWL029
gcuucaaaaagcuccc

SEQ ID NO: 2518914 - RNA, 18 nt, Chlamydophila pneumoniae CWL029
gcuucaaggcaucuucuu

SEQ ID NO: 2518915 - RNA, 16 nt, Chlamydophila pneumoniae CWL029
gcuucacaucuuucuc

SEQ ID NO: 2518916 - RNA, 19 nt, Chlamydophila pneumoniae CWL029
gcuucaccauuaagauauc

SEQ ID NO: 2518917 - RNA, 21 nt, Chlamydophila pneumoniae CWL029
gcuucagaguggucauugccu

SEQ ID NO: 2518918 - RNA, 16 nt, Chlamydophila pneumoniae CWL029
gcuucaucaaaacaua

SEQ ID NO: 2518919 - RNA, 17 nt, Chlamydophila pneumoniae CWL029
gcuucaucaaaacauaa

SEQ ID NO: 2518920 - RNA, 20 nt, Chlamydophila pneumoniae CWL029
gcuucauuccuacaucugug

SEQ ID NO: 2518921 - RNA, 21 nt, Chlamydophila pneumoniae CWL029
gcuuccaacuuuugaagaucc

SEQ ID NO: 2518922 - RNA, 15 nt, Chlamydophila pneumoniae CWL029
gcuuccagcuucucc

SEQ ID NO: 2518923 - RNA, 14 nt, Chlamydophila pneumoniae CWL029
ggcucaaagaaagu

SEQ ID NO: 2518924 - RNA, 12 nt, Chlamydophila pneumoniae CWL029
ggcuccagcaua

SEQ ID NO: 2518925 - RNA, 23 nt, Chlamydophila pneumoniae CWL029
ggcuccucguuaauaagaaccuc

SEQ ID NO: 2518926 - RNA, 22 nt, Chlamydophila pneumoniae CWL029
ggcucuaggacccguagccccu

SEQ ID NO: 2518927 - RNA, 21 nt, Chlamydophila pneumoniae CWL029
ggcucucaaggucacagcauu

SEQ ID NO: 2518928 - RNA, 18 nt, Chlamydophila pneumoniae CWL029
ggcucuccuaaaccauca

SEQ ID NO: 2518929 - RNA, 23 nt, Chlamydophila pneumoniae CWL029
ggcucucgacacuauguguuucc

SEQ ID NO: 2518930 - RNA, 15 nt, Chlamydophila pneumoniae CWL029
ggcucuuuuagagcc

SEQ ID NO: 2518931 - RNA, 22 nt, Chlamydophila pneumoniae CWL029
ggcugcuuuuguuguuuuugcu

SEQ ID NO: 2518932 - RNA, 21 nt, Chlamydophila pneumoniae CWL029
ggcuggaaagccaagcuucca

SEQ ID NO: 2518933 - RNA, 14 nt, Chlamydophila pneumoniae CWL029
ggcuuaggaggagg

SEQ ID NO: 2518934 - RNA, 22 nt, Chlamydophila pneumoniae CWL029
ggcuucugagcuugccuaccca

SEQ ID NO: 2518935 - RNA, 19 nt, Chlamydophila pneumoniae CWL029
ggcuuuaaguguuucuuca

SEQ ID NO: 2518936 - RNA, 20 nt, Chlamydophila pneumoniae CWL029
ggcuuuaaguguuucuucau

SEQ ID NO: 2518937 - RNA, 20 nt, Chlamydophila pneumoniae CWL029
ggcuuugggcaucucucuuu

SEQ ID NO: 2518938 - RNA, 15 nt, Chlamydophila pneumoniae CWL029
ggcuuuucuaaagcg

SEQ ID NO: 2518939 - RNA, 18 nt, Chlamydophila pneumoniae CWL029
ggcuuuucuuuuucuagg

SEQ ID NO: 2518940 - RNA, 14 nt, Chlamydophila pneumoniae CWL029
ggcuuuuuccaaaa

SEQ ID NO: 2518941 - RNA, 13 nt, Chlamydophila pneumoniae CWL029
gggaaaagaaaag

SEQ ID NO: 2518942 - RNA, 11 nt, Chlamydophila pneumoniae CWL029
gggaaaaugcg

SEQ ID NO: 2518943 - RNA, 16 nt, Chlamydophila pneumoniae CWL029
gggaaagacucaucuu

SEQ ID NO: 2518944 - RNA, 17 nt, Chlamydophila pneumoniae CWL029
gggaaaguaccuuuaac

SEQ ID NO: 2518945 - RNA, 18 nt, Chlamydophila pneumoniae CWL029
gggaaauaccccaucuaa

SEQ ID NO: 2518946 - RNA, 19 nt, Chlamydophila pneumoniae CWL029
gggaagaaacuucucuagg

SEQ ID NO: 2518947 - RNA, 14 nt, Chlamydophila pneumoniae CWL029
gggaagaggaaugc

SEQ ID NO: 2518948 - RNA, 20 nt, Chlamydophila pneumoniae CWL029
gggaagccuggaaaugaaua

SEQ ID NO: 2518949 - RNA, 16 nt, Chlamydophila pneumoniae CWL029
gggaaggggagauucc

SEQ ID NO: 2518950 - RNA, 18 nt, Chlamydophila pneumoniae CWL029
gggaauaaaaaugguaau

SEQ ID NO: 2518951 - RNA, 20 nt, Chlamydophila pneumoniae CWL029
gggaauuaaacuuucuucuc

SEQ ID NO: 2518952 - RNA, 23 nt, Chlamydophila pneumoniae CWL029
gggaauuaaacuuucuucucuag

SEQ ID NO: 2518953 - RNA, 23 nt, Chlamydophila pneumoniae CWL029
gggaauuugauuuuucaaauucu

SEQ ID NO: 2518954 - RNA, 15 nt, Chlamydophila pneumoniae CWL029
gggacauuuccccau

SEQ ID NO: 2518955 - RNA, 12 nt, Chlamydophila pneumoniae CWL029
gggagaugcuau

SEQ ID NO: 2518956 - RNA, 19 nt, Chlamydophila pneumoniae CWL029
gggauaggcaagauuauga

SEQ ID NO: 2518957 - RNA, 16 nt, Chlamydophila pneumoniae CWL029
gggaucuucagagaga

SEQ ID NO: 2518958 - RNA, 17 nt, Chlamydophila pneumoniae CWL029
gggaucuucagagagaa

SEQ ID NO: 2518959 - RNA, 14 nt, Chlamydophila pneumoniae CWL029
gggauggucaggaa

SEQ ID NO: 2518960 - RNA, 15 nt, Chlamydophila pneumoniae CWL029
gggauugauaacaau

SEQ ID NO: 2518961 - RNA, 18 nt, Chlamydophila pneumoniae CWL029
gggcaauauauccaggau

SEQ ID NO: 2518962 - RNA, 22 nt, Chlamydophila pneumoniae CWL029
gggcacucuuccacaauguuua

SEQ ID NO: 2518963 - RNA, 15 nt, Chlamydophila pneumoniae CWL029
gggcaggggauaggc

SEQ ID NO: 2518964 - RNA, 22 nt, Chlamydophila pneumoniae CWL029
gggccagcgcauuaacgucauc

SEQ ID NO: 2518965 - RNA, 14 nt, Chlamydophila pneumoniae CWL029
gggccucuucccaa

SEQ ID NO: 2518966 - RNA, 21 nt, Chlamydophila pneumoniae CWL029
gggccugccaugaauccaugg

SEQ ID NO: 2518967 - RNA, 22 nt, Chlamydophila pneumoniae CWL029
ggggaucuuaggaaauuuggau

SEQ ID NO: 2518968 - RNA, 21 nt, Chlamydophila pneumoniae CWL029
ggggaucuucagagagaacag

SEQ ID NO: 2518969 - RNA, 15 nt, Chlamydophila pneumoniae CWL029
ggggcaguuccuaaa

SEQ ID NO: 2518970 - RNA, 19 nt, Chlamydophila pneumoniae CWL029
gggguccauucugaccaaa

SEQ ID NO: 2518971 - RNA, 22 nt, Chlamydophila pneumoniae CWL029
gggguucccucuccuugaaaau

SEQ ID NO: 2518972 - RNA, 12 nt, Chlamydophila pneumoniae CWL029
ggguaaguccac

SEQ ID NO: 2518973 - RNA, 18 nt, Chlamydophila pneumoniae CWL029
ggguaaguccacaagccu

SEQ ID NO: 2518974 - RNA, 13 nt, Chlamydophila pneumoniae CWL029
ggguguggcaaag

SEQ ID NO: 2518975 - RNA, 16 nt, Chlamydophila pneumoniae CWL029
ggguucaauuccuuuc

SEQ ID NO: 2518976 - RNA, 21 nt, Chlamydophila pneumoniae CWL029
ggguuguauuuccuucuuuua

SEQ ID NO: 2518977 - RNA, 14 nt, Chlamydophila pneumoniae CWL029
gguaaaacuacagg

SEQ ID NO: 2518978 - RNA, 13 nt, Chlamydophila pneumoniae CWL029
gguaauuuuucag

SEQ ID NO: 2518979 - RNA, 19 nt, Chlamydophila pneumoniae CWL029
gguacgcuuuuucuugaaa

SEQ ID NO: 2518980 - RNA, 20 nt, Chlamydophila pneumoniae CWL029
gguagcagaguuuuucccuc

SEQ ID NO: 2518981 - RNA, 14 nt, Chlamydophila pneumoniae CWL029
gguagcuuaagaau

SEQ ID NO: 2518982 - RNA, 20 nt, Chlamydophila pneumoniae CWL029
gguagucccuuucuauuuca

SEQ ID NO: 2518983 - RNA, 12 nt, Chlamydophila pneumoniae CWL029
gguagugaucug

SEQ ID NO: 2518984 - RNA, 15 nt, Chlamydophila pneumoniae CWL029
gguauuucucuccac

SEQ ID NO: 2518985 - RNA, 15 nt, Chlamydophila pneumoniae CWL029
ggucacagcauuuuc

SEQ ID NO: 2518986 - RNA, 22 nt, Chlamydophila pneumoniae CWL029
ggucacuauagaucucuugaag

SEQ ID NO: 2518987 - RNA, 17 nt, Chlamydophila pneumoniae CWL029
ggucaggagguggugga

SEQ ID NO: 2518988 - RNA, 18 nt, Chlamydophila pneumoniae CWL029
ggucgagaaccuccacca

SEQ ID NO: 2518989 - RNA, 18 nt, Chlamydophila pneumoniae CWL029
ggucgauaucccacagaa

SEQ ID NO: 2518990 - RNA, 19 nt, Chlamydophila pneumoniae CWL029
ggucgauaucccacagaaa

SEQ ID NO: 2518991 - RNA, 18 nt, Chlamydophila pneumoniae CWL029
ggucgcaucaaugacugu

SEQ ID NO: 2518992 - RNA, 17 nt, Chlamydophila pneumoniae CWL029
ggucuaacuuagagcga

SEQ ID NO: 2518993 - RNA, 16 nt, Chlamydophila pneumoniae CWL029
ggugaaaguacaggag

SEQ ID NO: 2518994 - RNA, 18 nt, Chlamydophila pneumoniae CWL029
ggugagaucgaaaaauac

SEQ ID NO: 2518995 - RNA, 17 nt, Chlamydophila pneumoniae CWL029
ggugccuaggcuaagag

SEQ ID NO: 2518996 - RNA, 12 nt, Chlamydophila pneumoniae CWL029
ggugcuauuuua

SEQ ID NO: 2518997 - RNA, 18 nt, Chlamydophila pneumoniae CWL029
ggugcuguuguaauaaaa

SEQ ID NO: 2518998 - RNA, 16 nt, Chlamydophila pneumoniae CWL029
gguggaacuauccugu

SEQ ID NO: 2518999 - RNA, 18 nt, Chlamydophila pneumoniae CWL029
ggugggaagccuggaaau

SEQ ID NO: 2519000 - RNA, 17 nt, Chlamydophila pneumoniae CWL029
gguggguagccaggaug

SEQ ID NO: 2519001 - RNA, 23 nt, Chlamydophila pneumoniae CWL029
gguuaaaacccauguuucuuccu

SEQ ID NO: 2519002 - RNA, 12 nt, Chlamydophila pneumoniae CWL029
gguuaucuuuuu

SEQ ID NO: 2519003 - RNA, 11 nt, Chlamydophila pneumoniae CWL029
gguucaaaucc

SEQ ID NO: 2519004 - RNA, 22 nt, Chlamydophila pneumoniae CWL029
gguucauuuccaaauucuugca

SEQ ID NO: 2519005 - RNA, 19 nt, Chlamydophila pneumoniae CWL029
gguuccuggauuuaggaug

SEQ ID NO: 2519006 - RNA, 19 nt, Chlamydophila pneumoniae CWL029
gguuccuuaaagaguuugu

SEQ ID NO: 2519007 - RNA, 15 nt, Chlamydophila pneumoniae CWL029
gguucuaagaaaucc

SEQ ID NO: 2519008 - RNA, 22 nt, Chlamydophila pneumoniae CWL029
gguucuccacaugcccaaacau

SEQ ID NO: 2519009 - RNA, 21 nt, Chlamydophila pneumoniae CWL029
gguucuuccauaagaucaaua

SEQ ID NO: 2519010 - RNA, 13 nt, Chlamydophila pneumoniae CWL029
gguucuuucuaga

SEQ ID NO: 2519011 - RNA, 18 nt, Chlamydophila pneumoniae CWL029
gguuggcagcaaauccuu

SEQ ID NO: 2519012 - RNA, 17 nt, Chlamydophila pneumoniae CWL029
gguuucuuuccaucaua

SEQ ID NO: 2519013 - RNA, 23 nt, Chlamydophila pneumoniae CWL029
gguuucuuuuuuuugaagugcuu

SEQ ID NO: 2519014 - RNA, 15 nt, Chlamydophila pneumoniae CWL029
gguuuucuccuucuc

SEQ ID NO: 2519015 - RNA, 22 nt, Chlamydophila pneumoniae CWL029
guaaaaaauacaggaaucuccu

SEQ ID NO: 2519016 - RNA, 13 nt, Chlamydophila pneumoniae CWL029
guaaaaagaaaga

SEQ ID NO: 2519017 - RNA, 11 nt, Chlamydophila pneumoniae CWL029
guaaaacacaa

SEQ ID NO: 2519018 - RNA, 22 nt, Chlamydophila pneumoniae CWL029
guaaacaaaagcagacgaauaa

SEQ ID NO: 2519019 - RNA, 11 nt, Chlamydophila pneumoniae CWL029
guaaacaacaa

SEQ ID NO: 2519020 - RNA, 20 nt, Chlamydophila pneumoniae CWL029
guaaaccaauugagcucucu

SEQ ID NO: 2519021 - RNA, 12 nt, Chlamydophila pneumoniae CWL029
gcuuuaucucua

SEQ ID NO: 2519022 - RNA, 18 nt, Chlamydophila pneumoniae CWL029
gcuuuauguuuuguccuu

SEQ ID NO: 2519023 - RNA, 12 nt, Chlamydophila pneumoniae CWL029
gcuuucccccuc

SEQ ID NO: 2519024 - RNA, 15 nt, Chlamydophila pneumoniae CWL029
gcuuucgucuaaaau

SEQ ID NO: 2519025 - RNA, 20 nt, Chlamydophila pneumoniae CWL029
gcuuucuagggcaucuuuua

SEQ ID NO: 2519026 - RNA, 23 nt, Chlamydophila pneumoniae CWL029
gcuuugggcaucucucuuuaaaa

SEQ ID NO: 2519027 - RNA, 21 nt, Chlamydophila pneumoniae CWL029
gcuuugugagcugcugguccu

SEQ ID NO: 2519028 - RNA, 18 nt, Chlamydophila pneumoniae CWL029
gcuuugugaguucuuccu

SEQ ID NO: 2519029 - RNA, 19 nt, Chlamydophila pneumoniae CWL029
gcuuugugaguucuuccuu

SEQ ID NO: 2519030 - RNA, 20 nt, Chlamydophila pneumoniae CWL029
gcuuugugaguucuuccuuc

SEQ ID NO: 2519031 - RNA, 14 nt, Chlamydophila pneumoniae CWL029
gcuuuucauuuuua

SEQ ID NO: 2519032 - RNA, 13 nt, Chlamydophila pneumoniae CWL029
gcuuuuccuucug

SEQ ID NO: 2519033 - RNA, 21 nt, Chlamydophila pneumoniae CWL029
gcuuuucucuucaaaagaccg

SEQ ID NO: 2519034 - RNA, 16 nt, Chlamydophila pneumoniae CWL029
gcuuuucugcuccuga

SEQ ID NO: 2519035 - RNA, 12 nt, Chlamydophila pneumoniae CWL029
gcuuuucuucuu

SEQ ID NO: 2519036 - RNA, 15 nt, Chlamydophila pneumoniae CWL029
gcuuuucuucuuuag

SEQ ID NO: 2519037 - RNA, 19 nt, Chlamydophila pneumoniae CWL029
gcuuuucuuuuucuaggga

SEQ ID NO: 2519038 - RNA, 22 nt, Chlamydophila pneumoniae CWL029
gcuuuuuuaaaguguguaaaug

SEQ ID NO: 2519039 - RNA, 14 nt, Chlamydophila pneumoniae CWL029
gcuuuuuucucuug

SEQ ID NO: 2519040 - RNA, 18 nt, Chlamydophila pneumoniae CWL029
gcuuuuuugaaagcugga

SEQ ID NO: 2519041 - RNA, 15 nt, Chlamydophila pneumoniae CWL029
gcuuuuuuucuagag

SEQ ID NO: 2519042 - RNA, 12 nt, Chlamydophila pneumoniae CWL029
ggaaaaaauaga

SEQ ID NO: 2519043 - RNA, 12 nt, Chlamydophila pneumoniae CWL029
ggaaaaagccuu

SEQ ID NO: 2519044 - RNA, 18 nt, Chlamydophila pneumoniae CWL029
ggaaaaagccuuucuuau

SEQ ID NO: 2519045 - RNA, 16 nt, Chlamydophila pneumoniae CWL029
ggaaaaaggaggaugu

SEQ ID NO: 2519046 - RNA, 12 nt, Chlamydophila pneumoniae CWL029
ggaaaagaaaag

SEQ ID NO: 2519047 - RNA, 13 nt, Chlamydophila pneumoniae CWL029
ggaaaaggaggag

SEQ ID NO: 2519048 - RNA, 22 nt, Chlamydophila pneumoniae CWL029
ggaaacagugguaugcuuuucc

SEQ ID NO: 2519049 - RNA, 16 nt, Chlamydophila pneumoniae CWL029
ggaaacguucuuucaa

SEQ ID NO: 2519050 - RNA, 14 nt, Chlamydophila pneumoniae CWL029
ggaaagcacauaca

SEQ ID NO: 2519051 - RNA, 16 nt, Chlamydophila pneumoniae CWL029
ggaaaggucggggaga

SEQ ID NO: 2519052 - RNA, 22 nt, Chlamydophila pneumoniae CWL029
ggaaaguugcaacucucuuuaa

SEQ ID NO: 2519053 - RNA, 23 nt, Chlamydophila pneumoniae CWL029
ggaaaguugcaacucucuuuaaa

SEQ ID NO: 2519054 - RNA, 21 nt, Chlamydophila pneumoniae CWL029
ggaaaucuaaacaguaggcga

SEQ ID NO: 2519055 - RNA, 15 nt, Chlamydophila pneumoniae CWL029
ggaaaugagagggau

SEQ ID NO: 2519056 - RNA, 21 nt, Chlamydophila pneumoniae CWL029
ggaacaaagcucuccuucaga

SEQ ID NO: 2519057 - RNA, 14 nt, Chlamydophila pneumoniae CWL029
ggaacgcucucuag

SEQ ID NO: 2519058 - RNA, 21 nt, Chlamydophila pneumoniae CWL029
ggaacuaaaaguuuuuuauuu

SEQ ID NO: 2519059 - RNA, 22 nt, Chlamydophila pneumoniae CWL029
ggaacuaaagagaucacaggga

SEQ ID NO: 2519060 - RNA, 19 nt, Chlamydophila pneumoniae CWL029
ggaacuacaggaauucuca

SEQ ID NO: 2519061 - RNA, 13 nt, Chlamydophila pneumoniae CWL029
ggaagaagaagaa

SEQ ID NO: 2519062 - RNA, 14 nt, Chlamydophila pneumoniae CWL029
ggaagacuuuuuaa

SEQ ID NO: 2519063 - RNA, 15 nt, Chlamydophila pneumoniae CWL029
ggaagauaaauccgc

SEQ ID NO: 2519064 - RNA, 16 nt, Chlamydophila pneumoniae CWL029
ggaagcaaagaaaauu

SEQ ID NO: 2519065 - RNA, 14 nt, Chlamydophila pneumoniae CWL029
ggaagcucuucuac

SEQ ID NO: 2519066 - RNA, 21 nt, Chlamydophila pneumoniae CWL029
ggaagcuuaucaagaagcuga

SEQ ID NO: 2519067 - RNA, 15 nt, Chlamydophila pneumoniae CWL029
ggaagcuuuuacgag

SEQ ID NO: 2519068 - RNA, 14 nt, Chlamydophila pneumoniae CWL029
ggaagguucucaaa

SEQ ID NO: 2519069 - RNA, 19 nt, Chlamydophila pneumoniae CWL029
ggaauaacaccaaaagaau

SEQ ID NO: 2519070 - RNA, 18 nt, Chlamydophila pneumoniae CWL029
ggaauaauaggauaagaa

SEQ ID NO: 2519071 - RNA, 20 nt, Chlamydophila pneumoniae CWL029
ggaauaaucaaccaaaaugc

SEQ ID NO: 2519072 - RNA, 18 nt, Chlamydophila pneumoniae CWL029
ggaaucauaaccaaaaga

SEQ ID NO: 2519073 - RNA, 22 nt, Chlamydophila pneumoniae CWL029
ggaaucccugcacucuuucaga

SEQ ID NO: 2519074 - RNA, 22 nt, Chlamydophila pneumoniae CWL029
ggaauccuuuggaagcuaucau

SEQ ID NO: 2519075 - RNA, 20 nt, Chlamydophila pneumoniae CWL029
ggaaucuaagaacuagaaaa

SEQ ID NO: 2519076 - RNA, 19 nt, Chlamydophila pneumoniae CWL029
ggaauggcuuuuguuuugu

SEQ ID NO: 2519077 - RNA, 22 nt, Chlamydophila pneumoniae CWL029
ggaauuucccauauagcucguu

SEQ ID NO: 2519078 - RNA, 13 nt, Chlamydophila pneumoniae CWL029
ggacaacagcaac

SEQ ID NO: 2519079 - RNA, 9 nt, Chlamydophila pneumoniae CWL029
ggacaacua

SEQ ID NO: 2519080 - RNA, 14 nt, Chlamydophila pneumoniae CWL029
ggacaaucaacauu

SEQ ID NO: 2519081 - RNA, 15 nt, Chlamydophila pneumoniae CWL029
ggacaaugaagaacu

SEQ ID NO: 2519082 - RNA, 16 nt, Chlamydophila pneumoniae CWL029
ggacaaugcuaucucc

SEQ ID NO: 2519083 - RNA, 17 nt, Chlamydophila pneumoniae CWL029
ggacacaacucuuuaau

SEQ ID NO: 2519084 - RNA, 14 nt, Chlamydophila pneumoniae CWL029
ggacacuagaauac

SEQ ID NO: 2519085 - RNA, 19 nt, Chlamydophila pneumoniae CWL029
ggacacuauuaucugcaga

SEQ ID NO: 2519086 - RNA, 13 nt, Chlamydophila pneumoniae CWL029
ggacaugccuuag

SEQ ID NO: 2519087 - RNA, 23 nt, Chlamydophila pneumoniae CWL029
ggaccagguguagguuccugcuu

SEQ ID NO: 2519088 - RNA, 18 nt, Chlamydophila pneumoniae CWL029
ggaccuaagggcucuccu

SEQ ID NO: 2519089 - RNA, 23 nt, Chlamydophila pneumoniae CWL029
ggaccuccucacauguuucacuu

SEQ ID NO: 2519090 - RNA, 13 nt, Chlamydophila pneumoniae CWL029
ggaccuguuuucu

SEQ ID NO: 2519091 - RNA, 17 nt, Chlamydophila pneumoniae CWL029
ggaccuguuuucuuuuc

SEQ ID NO: 2519092 - RNA, 21 nt, Chlamydophila pneumoniae CWL029
ggaccuguuuucuuuucugaa

SEQ ID NO: 2519093 - RNA, 17 nt, Chlamydophila pneumoniae CWL029
ggaccuuaagaugaggu

SEQ ID NO: 2519094 - RNA, 19 nt, Chlamydophila pneumoniae CWL029
ggaccuuggacucuagggu

SEQ ID NO: 2519095 - RNA, 18 nt, Chlamydophila pneumoniae CWL029
ggacgcuaauccuccucg

SEQ ID NO: 2519096 - RNA, 12 nt, Chlamydophila pneumoniae CWL029
ggacgugggaga

SEQ ID NO: 2519097 - RNA, 14 nt, Chlamydophila pneumoniae CWL029
ggacuacugaaaca

SEQ ID NO: 2519098 - RNA, 13 nt, Chlamydophila pneumoniae CWL029
ggacugcugacau

SEQ ID NO: 2519099 - RNA, 16 nt, Chlamydophila pneumoniae CWL029
ggacuuguguauuugc

SEQ ID NO: 2519100 - RNA, 14 nt, Chlamydophila pneumoniae CWL029
ggacuuuauucucu

SEQ ID NO: 2519101 - RNA, 23 nt, Chlamydophila pneumoniae CWL029
ggagaacaauaucagcagcuucu

SEQ ID NO: 2519102 - RNA, 18 nt, Chlamydophila pneumoniae CWL029
ggagaagucgaaagauca

SEQ ID NO: 2519103 - RNA, 23 nt, Chlamydophila pneumoniae CWL029
ggagaaguuguuuauuuagcauu

SEQ ID NO: 2519104 - RNA, 14 nt, Chlamydophila pneumoniae CWL029
ggagaauagcaagc

SEQ ID NO: 2519105 - RNA, 19 nt, Chlamydophila pneumoniae CWL029
ggagaccuuuauagauaug

SEQ ID NO: 2519106 - RNA, 21 nt, Chlamydophila pneumoniae CWL029
ggagaccuuuauagauaugcc

SEQ ID NO: 2519107 - RNA, 17 nt, Chlamydophila pneumoniae CWL029
ggagagaacuuuugaau

SEQ ID NO: 2519108 - RNA, 15 nt, Chlamydophila pneumoniae CWL029
ggagagcgaaauaga

SEQ ID NO: 2519109 - RNA, 19 nt, Chlamydophila pneumoniae CWL029
ggagagguaaccagagagc

SEQ ID NO: 2519110 - RNA, 13 nt, Chlamydophila pneumoniae CWL029
ggagauacaagca

SEQ ID NO: 2519111 - RNA, 22 nt, Chlamydophila pneumoniae CWL029
ggagaugcuauuuacugaaaca

SEQ ID NO: 2519112 - RNA, 16 nt, Chlamydophila pneumoniae CWL029
ggagcuacugaaagau

SEQ ID NO: 2519113 - RNA, 15 nt, Chlamydophila pneumoniae CWL029
ggagcucgcuaaaca

SEQ ID NO: 2519114 - RNA, 19 nt, Chlamydophila pneumoniae CWL029
ggagcucuuucuuggauug

SEQ ID NO: 2519115 - RNA, 16 nt, Chlamydophila pneumoniae CWL029
ggaggaacaauacucu

SEQ ID NO: 2519116 - RNA, 13 nt, Chlamydophila pneumoniae CWL029
ggaggaggcagua

SEQ ID NO: 2519117 - RNA, 13 nt, Chlamydophila pneumoniae CWL029
ggagggaaacacc

SEQ ID NO: 2519118 - RNA, 18 nt, Chlamydophila pneumoniae CWL029
ggaguacuucuuacccua

SEQ ID NO: 2519119 - RNA, 13 nt, Chlamydophila pneumoniae CWL029
guauaacaucuaa

SEQ ID NO: 2519120 - RNA, 22 nt, Chlamydophila pneumoniae CWL029
guauaacaucuaaaaaugcacu

SEQ ID NO: 2519121 - RNA, 15 nt, Chlamydophila pneumoniae CWL029
guauacaucccauuc

SEQ ID NO: 2519122 - RNA, 20 nt, Chlamydophila pneumoniae CWL029
guauaccauguuaucaagac

SEQ ID NO: 2519123 - RNA, 16 nt, Chlamydophila pneumoniae CWL029
guauacgguaaugcca

SEQ ID NO: 2519124 - RNA, 17 nt, Chlamydophila pneumoniae CWL029
guauagcuggcaaugau

SEQ ID NO: 2519125 - RNA, 13 nt, Chlamydophila pneumoniae CWL029
guauaguauuuuu

SEQ ID NO: 2519126 - RNA, 19 nt, Chlamydophila pneumoniae CWL029
guauauaagauaauagaga

SEQ ID NO: 2519127 - RNA, 18 nt, Chlamydophila pneumoniae CWL029
guauauccacgaucuaga

SEQ ID NO: 2519128 - RNA, 21 nt, Chlamydophila pneumoniae CWL029
guauauccacgaucuagaaga

SEQ ID NO: 2519129 - RNA, 18 nt, Chlamydophila pneumoniae CWL029
guauauucugaaauuucu

SEQ ID NO: 2519130 - RNA, 23 nt, Chlamydophila pneumoniae CWL029
guauccgcugcccaugcuuaucu

SEQ ID NO: 2519131 - RNA, 19 nt, Chlamydophila pneumoniae CWL029
guauccuccuucugcauga

SEQ ID NO: 2519132 - RNA, 13 nt, Chlamydophila pneumoniae CWL029
guauccuugauuu

SEQ ID NO: 2519133 - RNA, 23 nt, Chlamydophila pneumoniae CWL029
guaucgacuuuuuuaagaguguc

SEQ ID NO: 2519134 - RNA, 19 nt, Chlamydophila pneumoniae CWL029
guaucgagcucuuuaagaa

SEQ ID NO: 2519135 - RNA, 21 nt, Chlamydophila pneumoniae CWL029
guaucgagcucuuuaagaacu

SEQ ID NO: 2519136 - RNA, 12 nt, Chlamydophila pneumoniae CWL029
guaucuucagua

SEQ ID NO: 2519137 - RNA, 22 nt, Chlamydophila pneumoniae CWL029
guaucuucuucgguguagaucu

SEQ ID NO: 2519138 - RNA, 13 nt, Chlamydophila pneumoniae CWL029
guaucuuuuugca

SEQ ID NO: 2519139 - RNA, 19 nt, Chlamydophila pneumoniae CWL029
guaucuuuuugcagauccc

SEQ ID NO: 2519140 - RNA, 19 nt, Chlamydophila pneumoniae CWL029
guaugagcuccaaaauaau

SEQ ID NO: 2519141 - RNA, 16 nt, Chlamydophila pneumoniae CWL029
guaugaucaagaggag

SEQ ID NO: 2519142 - RNA, 22 nt, Chlamydophila pneumoniae CWL029
guauuccuuggauuucuucuuc

SEQ ID NO: 2519143 - RNA, 20 nt, Chlamydophila pneumoniae CWL029
guuccugcuugauuuccuga

SEQ ID NO: 2519144 - RNA, 21 nt, Chlamydophila pneumoniae CWL029
guuccuguaguuugcagagag

SEQ ID NO: 2519145 - RNA, 22 nt, Chlamydophila pneumoniae CWL029
guuccuguaguuugcagagagu

SEQ ID NO: 2519146 - RNA, 17 nt, Chlamydophila pneumoniae CWL029
guuccuuaucaggaaau

SEQ ID NO: 2519147 - RNA, 14 nt, Chlamydophila pneumoniae CWL029
guucgaauccuucu

SEQ ID NO: 2519148 - RNA, 20 nt, Chlamydophila pneumoniae CWL029
guucgacaacaacauaaaga

SEQ ID NO: 2519149 - RNA, 14 nt, Chlamydophila pneumoniae CWL029
guucgcacuaauuu

SEQ ID NO: 2519150 - RNA, 18 nt, Chlamydophila pneumoniae CWL029
guucgcggaucuucuucu

SEQ ID NO: 2519151 - RNA, 14 nt, Chlamydophila pneumoniae CWL029
guucggucucuucu

SEQ ID NO: 2519152 - RNA, 16 nt, Chlamydophila pneumoniae CWL029
guucggucucuucucu

SEQ ID NO: 2519153 - RNA, 18 nt, Chlamydophila pneumoniae CWL029
guucggucucuucucugu

SEQ ID NO: 2519154 - RNA, 16 nt, Chlamydophila pneumoniae CWL029
guucuccacaugccca

SEQ ID NO: 2519155 - RNA, 17 nt, Chlamydophila pneumoniae CWL029
guucucuaagacugugu

SEQ ID NO: 2519156 - RNA, 17 nt, Chlamydophila pneumoniae CWL029
guucucuaugacuucuu

SEQ ID NO: 2519157 - RNA, 19 nt, Chlamydophila pneumoniae CWL029
guucucuaugacuucuugu

SEQ ID NO: 2519158 - RNA, 18 nt, Chlamydophila pneumoniae CWL029
guucucuccagcuguggu

SEQ ID NO: 2519159 - RNA, 16 nt, Chlamydophila pneumoniae CWL029
guucuuagaaagcgca

SEQ ID NO: 2519160 - RNA, 17 nt, Chlamydophila pneumoniae CWL029
guucuuguaauaaaaga

SEQ ID NO: 2519161 - RNA, 16 nt, Chlamydophila pneumoniae CWL029
guucuuuacuacauga

SEQ ID NO: 2519162 - RNA, 13 nt, Chlamydophila pneumoniae CWL029
guucuuucuuucu

SEQ ID NO: 2519163 - RNA, 20 nt, Chlamydophila pneumoniae CWL029
guucuuuuguuugucuucca

SEQ ID NO: 2519164 - RNA, 17 nt, Chlamydophila pneumoniae CWL029
guugaaaugagugagaa

SEQ ID NO: 2519165 - RNA, 15 nt, Chlamydophila pneumoniae CWL029
guugaccuuuuucau

SEQ ID NO: 2519166 - RNA, 16 nt, Chlamydophila pneumoniae CWL029
guugaggaaaggaggg

SEQ ID NO: 2519167 - RNA, 20 nt, Chlamydophila pneumoniae CWL029
guugcacucgauuauuucuu

SEQ ID NO: 2519168 - RNA, 16 nt, Chlamydophila pneumoniae CWL029
guugccaaucuuucau

SEQ ID NO: 2519169 - RNA, 15 nt, Chlamydophila pneumoniae CWL029
guugccuuucucuuc

SEQ ID NO: 2519170 - RNA, 16 nt, Chlamydophila pneumoniae CWL029
guugccuuucucuucc

SEQ ID NO: 2519171 - RNA, 23 nt, Chlamydophila pneumoniae CWL029
guugcgaacagcuccuggauauu

SEQ ID NO: 2519172 - RNA, 12 nt, Chlamydophila pneumoniae CWL029
guugcuaagauc

SEQ ID NO: 2519173 - RNA, 16 nt, Chlamydophila pneumoniae CWL029
guugcuaagaucuuua

SEQ ID NO: 2519174 - RNA, 20 nt, Chlamydophila pneumoniae CWL029
guugcuaagaucuuuagaau

SEQ ID NO: 2519175 - RNA, 16 nt, Chlamydophila pneumoniae CWL029
guugcucauccuuuag

SEQ ID NO: 2519176 - RNA, 17 nt, Chlamydophila pneumoniae CWL029
guugcuucuaagaaacu

SEQ ID NO: 2519177 - RNA, 14 nt, Chlamydophila pneumoniae CWL029
guuggacugcaaga

SEQ ID NO: 2519178 - RNA, 15 nt, Chlamydophila pneumoniae CWL029
guuggaggaacaaua

SEQ ID NO: 2519179 - RNA, 23 nt, Chlamydophila pneumoniae CWL029
guuggauccaucggcauuucucc

SEQ ID NO: 2519180 - RNA, 18 nt, Chlamydophila pneumoniae CWL029
guugggagcuuccuccaa

SEQ ID NO: 2519181 - RNA, 14 nt, Chlamydophila pneumoniae CWL029
guuguaauaaaaga

SEQ ID NO: 2519182 - RNA, 12 nt, Chlamydophila pneumoniae CWL029
guuguacuuuua

SEQ ID NO: 2519183 - RNA, 21 nt, Chlamydophila pneumoniae CWL029
guuguagcuacaagucccccu

SEQ ID NO: 2519184 - RNA, 18 nt, Chlamydophila pneumoniae CWL029
guuguagugaaugagcuu

SEQ ID NO: 2519185 - RNA, 18 nt, Chlamydophila pneumoniae CWL029
guuguauuuccuucuuuu

SEQ ID NO: 2519186 - RNA, 22 nt, Chlamydophila pneumoniae CWL029
guugucacuaagauaucuccag

SEQ ID NO: 2519187 - RNA, 19 nt, Chlamydophila pneumoniae CWL029
guugucagcuuugcuuauu

SEQ ID NO: 2519188 - RNA, 18 nt, Chlamydophila pneumoniae CWL029
guuguugcaauucuucau

SEQ ID NO: 2519189 - RNA, 14 nt, Chlamydophila pneumoniae CWL029
guuguuuuuugaga

SEQ ID NO: 2519190 - RNA, 18 nt, Chlamydophila pneumoniae CWL029
guuuaaguccuucuuccc

SEQ ID NO: 2519191 - RNA, 14 nt, Chlamydophila pneumoniae CWL029
guuuaauacaaaaa

SEQ ID NO: 2519192 - RNA, 13 nt, Chlamydophila pneumoniae CWL029
guuuaauuccuug

SEQ ID NO: 2519193 - RNA, 21 nt, Chlamydophila pneumoniae CWL029
guuuacagaugcaugauccua

SEQ ID NO: 2519194 - RNA, 16 nt, Chlamydophila pneumoniae CWL029
guuuaccugaaaaaac

SEQ ID NO: 2519195 - RNA, 20 nt, Chlamydophila pneumoniae CWL029
guuuagacgaggagaagucg

SEQ ID NO: 2519196 - RNA, 14 nt, Chlamydophila pneumoniae CWL029
guuuagauuuuucu

SEQ ID NO: 2519197 - RNA, 12 nt, Chlamydophila pneumoniae CWL029
guuuagguaggc

SEQ ID NO: 2519198 - RNA, 19 nt, Chlamydophila pneumoniae CWL029
guuucaaucucuccuugac

SEQ ID NO: 2519199 - RNA, 19 nt, Chlamydophila pneumoniae CWL029
guuucacaggcuacauagu

SEQ ID NO: 2519200 - RNA, 15 nt, Chlamydophila pneumoniae CWL029
guuucagaaggaucu

SEQ ID NO: 2519201 - RNA, 23 nt, Chlamydophila pneumoniae CWL029
guuucagaagucacaaauuuuug

SEQ ID NO: 2519202 - RNA, 21 nt, Chlamydophila pneumoniae CWL029
guuucaggaaacucaaucucu

SEQ ID NO: 2519203 - RNA, 14 nt, Chlamydophila pneumoniae CWL029
guuucaguuuuauc

SEQ ID NO: 2519204 - RNA, 13 nt, Chlamydophila pneumoniae CWL029
guuuccuccucuu

SEQ ID NO: 2519205 - RNA, 16 nt, Chlamydophila pneumoniae CWL029
guuuccuuuucuccuu

SEQ ID NO: 2519206 - RNA, 20 nt, Chlamydophila pneumoniae CWL029
guuucgauaauuuucacgag

SEQ ID NO: 2519207 - RNA, 21 nt, Chlamydophila pneumoniae CWL029
guuucgcuuugauaauagucu

SEQ ID NO: 2519208 - RNA, 15 nt, Chlamydophila pneumoniae CWL029
guuucguacaguuuu

SEQ ID NO: 2519209 - RNA, 21 nt, Chlamydophila pneumoniae CWL029
guuucuaaaacagaaauugcu

SEQ ID NO: 2519210 - RNA, 23 nt, Chlamydophila pneumoniae CWL029
guuucuaaauacuuaggaauuuu

SEQ ID NO: 2519211 - RNA, 19 nt, Chlamydophila pneumoniae CWL029
guuucuagaaaaucucuaa

SEQ ID NO: 2519212 - RNA, 24 nt, Chlamydophila pneumoniae CWL029
guuucuagaaaaucucuaagaauc

SEQ ID NO: 2519213 - RNA, 13 nt, Chlamydophila pneumoniae CWL029
guuucuagguucu

SEQ ID NO: 2519214 - RNA, 16 nt, Chlamydophila pneumoniae CWL029
guuucucuggcaauga

SEQ ID NO: 2519215 - RNA, 22 nt, Chlamydophila pneumoniae CWL029
guuucuuccugaaucagcuuau

SEQ ID NO: 2519216 - RNA, 11 nt, Chlamydophila pneumoniae CWL029
guuucuuucca

SEQ ID NO: 2519217 - RNA, 14 nt, Chlamydophila pneumoniae CWL029
guuucuuuugcaaa

SEQ ID NO: 2519218 - RNA, 15 nt, Chlamydophila pneumoniae CWL029
guuugaucuucucua

SEQ ID NO: 2519219 - RNA, 15 nt, Chlamydophila pneumoniae CWL029
guuuggagaagcuca

SEQ ID NO: 2519220 - RNA, 14 nt, Chlamydophila pneumoniae CWL029
uaaauuuaagucac

SEQ ID NO: 2519221 - RNA, 17 nt, Chlamydophila pneumoniae CWL029
uaaauuuaagucacuaa

SEQ ID NO: 2519222 - RNA, 16 nt, Chlamydophila pneumoniae CWL029
uaaauuugucaucaca

SEQ ID NO: 2519223 - RNA, 14 nt, Chlamydophila pneumoniae CWL029
uaaauuuuuccuuc

SEQ ID NO: 2519224 - RNA, 23 nt, Chlamydophila pneumoniae CWL029
uaacaaaaggauucuaugaggac

SEQ ID NO: 2519225 - RNA, 20 nt, Chlamydophila pneumoniae CWL029
uaacaaaauuucuuauaaaa

SEQ ID NO: 2519226 - RNA, 22 nt, Chlamydophila pneumoniae CWL029
uaacaaaauuucuuauaaaaaa

SEQ ID NO: 2519227 - RNA, 20 nt, Chlamydophila pneumoniae CWL029
uaacaaccgccuuuauauaa

SEQ ID NO: 2519228 - RNA, 19 nt, Chlamydophila pneumoniae CWL029
uaacaacuucugacaauaa

SEQ ID NO: 2519229 - RNA, 19 nt, Chlamydophila pneumoniae CWL029
uaacaaguaccaagaaaau

SEQ ID NO: 2519230 - RNA, 22 nt, Chlamydophila pneumoniae CWL029
uaacaaguaccaagaaaauagu

SEQ ID NO: 2519231 - RNA, 15 nt, Chlamydophila pneumoniae CWL029
uaacaccaaaagaau

SEQ ID NO: 2519232 - RNA, 16 nt, Chlamydophila pneumoniae CWL029
uaacaccaaaagaaua

SEQ ID NO: 2519233 - RNA, 14 nt, Chlamydophila pneumoniae CWL029
uaacaccucuucaa

SEQ ID NO: 2519234 - RNA, 21 nt, Chlamydophila pneumoniae CWL029
uaacacuuccuacggcaagaa

SEQ ID NO: 2519235 - RNA, 17 nt, Chlamydophila pneumoniae CWL029
uaacacuuuguuuuuca

SEQ ID NO: 2519236 - RNA, 15 nt, Chlamydophila pneumoniae CWL029
uaaagaaacuucuga

SEQ ID NO: 2519237 - RNA, 16 nt, Chlamydophila pneumoniae CWL029
uaaagaaacuucugac

SEQ ID NO: 2519238 - RNA, 18 nt, Chlamydophila pneumoniae CWL029
uaaagaaagagucucacu

SEQ ID NO: 2519239 - RNA, 14 nt, Chlamydophila pneumoniae CWL029
uaaagaaauucugg

SEQ ID NO: 2519240 - RNA, 13 nt, Chlamydophila pneumoniae CWL029
uaaagaagguuuc

SEQ ID NO: 2519241 - RNA, 15 nt, Chlamydophila pneumoniae CWL029
uaaagaaucacucuc

SEQ ID NO: 2519242 - RNA, 19 nt, Chlamydophila pneumoniae CWL029
uaaagaauuuguaacucuu

SEQ ID NO: 2519243 - RNA, 15 nt, Chlamydophila pneumoniae CWL029
uaaagacaucucuuu

SEQ ID NO: 2519244 - RNA, 17 nt, Chlamydophila pneumoniae CWL029
uaaagacaucucuuuaa

SEQ ID NO: 2519245 - RNA, 16 nt, Chlamydophila pneumoniae CWL029
uaaagaccaaauagag

SEQ ID NO: 2519246 - RNA, 16 nt, Chlamydophila pneumoniae CWL029
uaaagacucucuucca

SEQ ID NO: 2519247 - RNA, 17 nt, Chlamydophila pneumoniae CWL029
uaaagacucucuuccaa

SEQ ID NO: 2519248 - RNA, 15 nt, Chlamydophila pneumoniae CWL029
uaaagagaaucuccu

SEQ ID NO: 2519249 - RNA, 21 nt, Chlamydophila pneumoniae CWL029
uaaagagcugauccagcucca

SEQ ID NO: 2519250 - RNA, 23 nt, Chlamydophila pneumoniae CWL029
uaaagaguuuguucacauuuuca

SEQ ID NO: 2519251 - RNA, 17 nt, Chlamydophila pneumoniae CWL029
uaaagauaaucuguaag

SEQ ID NO: 2519252 - RNA, 21 nt, Chlamydophila pneumoniae CWL029
uaaagauagcgacgucaucau

SEQ ID NO: 2519253 - RNA, 22 nt, Chlamydophila pneumoniae CWL029
uaaagauagcgacgucaucaua

SEQ ID NO: 2519254 - RNA, 23 nt, Chlamydophila pneumoniae CWL029
uaaagaucgggucuacaacaguu

SEQ ID NO: 2519255 - RNA, 18 nt, Chlamydophila pneumoniae CWL029
uaaagaucgugaucaaag

SEQ ID NO: 2519256 - RNA, 14 nt, Chlamydophila pneumoniae CWL029
uaaagaucuucaua

SEQ ID NO: 2519257 - RNA, 15 nt, Chlamydophila pneumoniae CWL029
uaaagaucuucauaa

SEQ ID NO: 2519258 - RNA, 16 nt, Chlamydophila pneumoniae CWL029
uaaagaucuucauaac

SEQ ID NO: 2519259 - RNA, 19 nt, Chlamydophila pneumoniae CWL029
uaaagaucuucauaaccaa

SEQ ID NO: 2519260 - RNA, 19 nt, Chlamydophila pneumoniae CWL029
uaaagauguagaauaacgc

SEQ ID NO: 2519261 - RNA, 20 nt, Chlamydophila pneumoniae CWL029
uaaagauuucguauagcugg

SEQ ID NO: 2519262 - RNA, 15 nt, Chlamydophila pneumoniae CWL029
uaaagauuuucauaa

SEQ ID NO: 2519263 - RNA, 19 nt, Chlamydophila pneumoniae CWL029
uaaagcaaagauaaagaag

SEQ ID NO: 2519264 - RNA, 23 nt, Chlamydophila pneumoniae CWL029
uaaagcauacuuauauuggcuuu

SEQ ID NO: 2519265 - RNA, 15 nt, Chlamydophila pneumoniae CWL029
uaaagcaucacggac

SEQ ID NO: 2519266 - RNA, 22 nt, Chlamydophila pneumoniae CWL029
uaaagccccacccacuccagaa

SEQ ID NO: 2519267 - RNA, 19 nt, Chlamydophila pneumoniae CWL029
uaaagccuccucaagauaa

SEQ ID NO: 2519268 - RNA, 13 nt, Chlamydophila pneumoniae CWL029
uaaagcuaacaac

SEQ ID NO: 2519269 - RNA, 19 nt, Chlamydophila pneumoniae CWL029
uaaagcuauuguuuuucaa

SEQ ID NO: 2519270 - RNA, 18 nt, Chlamydophila pneumoniae CWL029
uaaagcuccgagaaacaa

SEQ ID NO: 2519271 - RNA, 22 nt, Chlamydophila pneumoniae CWL029
uaaagcuguaaccaacaucaaa

SEQ ID NO: 2519272 - RNA, 15 nt, Chlamydophila pneumoniae CWL029
uaaaggaacugugcc

SEQ ID NO: 2519273 - RNA, 19 nt, Chlamydophila pneumoniae CWL029
uaaaggaaucucgggagaa

SEQ ID NO: 2519274 - RNA, 13 nt, Chlamydophila pneumoniae CWL029
uaaaggacauaga

SEQ ID NO: 2519275 - RNA, 15 nt, Chlamydophila pneumoniae CWL029
uaaaggacauagacu

SEQ ID NO: 2519276 - RNA, 18 nt, Chlamydophila pneumoniae CWL029
uaaaggaccuguuuucuu

SEQ ID NO: 2519277 - RNA, 22 nt, Chlamydophila pneumoniae CWL029
uaaaggaccuguuuucuuuucu

SEQ ID NO: 2519278 - RNA, 14 nt, Chlamydophila pneumoniae CWL029
uaaaggcucuuuua

SEQ ID NO: 2519279 - RNA, 18 nt, Chlamydophila pneumoniae CWL029
uaaagguuguaaggacga

SEQ ID NO: 2519280 - RNA, 12 nt, Chlamydophila pneumoniae CWL029
uaaagguuuuaa

SEQ ID NO: 2519281 - RNA, 13 nt, Chlamydophila pneumoniae CWL029
uaaagguuuuaaa

SEQ ID NO: 2519282 - RNA, 14 nt, Chlamydophila pneumoniae CWL029
uaaagguuuuaaau

SEQ ID NO: 2519283 - RNA, 20 nt, Chlamydophila pneumoniae CWL029
uaaaguaacgauaagaagcu

SEQ ID NO: 2519284 - RNA, 17 nt, Chlamydophila pneumoniae CWL029
uaaaguagaauccuucu

SEQ ID NO: 2519285 - RNA, 13 nt, Chlamydophila pneumoniae CWL029
uaaaguccaagau

SEQ ID NO: 2519286 - RNA, 18 nt, Chlamydophila pneumoniae CWL029
uaaagugucauacgcagc

SEQ ID NO: 2519287 - RNA, 19 nt, Chlamydophila pneumoniae CWL029
uaaaguuugagcuaagcug

SEQ ID NO: 2519288 - RNA, 14 nt, Chlamydophila pneumoniae CWL029
uaaaguuuguaaaa

SEQ ID NO: 2519289 - RNA, 13 nt, Chlamydophila pneumoniae CWL029
uaaauaaaaccac

SEQ ID NO: 2519290 - RNA, 21 nt, Chlamydophila pneumoniae CWL029
uaaauacaaaacaaaagccau

SEQ ID NO: 2519291 - RNA, 18 nt, Chlamydophila pneumoniae CWL029
uaaauacaggagaaucca

SEQ ID NO: 2519292 - RNA, 14 nt, Chlamydophila pneumoniae CWL029
uaaauagaaaucuu

SEQ ID NO: 2519293 - RNA, 17 nt, Chlamydophila pneumoniae CWL029
uaaauagcucaguuggu

SEQ ID NO: 2519294 - RNA, 14 nt, Chlamydophila pneumoniae CWL029
uaaauaggcucuac

SEQ ID NO: 2519295 - RNA, 20 nt, Chlamydophila pneumoniae CWL029
uaaauauagaaaaucauuca

SEQ ID NO: 2519296 - RNA, 14 nt, Chlamydophila pneumoniae CWL029
uaaauauuuuacca

SEQ ID NO: 2519297 - RNA, 21 nt, Chlamydophila pneumoniae CWL029
uaaauauuuuaccauugagau

SEQ ID NO: 2519298 - RNA, 20 nt, Chlamydophila pneumoniae CWL029
uaaaucaacaucacaaucgu

SEQ ID NO: 2519299 - RNA, 19 nt, Chlamydophila pneumoniae CWL029
uaaauccaccaaugauaau

SEQ ID NO: 2519300 - RNA, 20 nt, Chlamydophila pneumoniae CWL029
uaaaucccacuaucuguaau

SEQ ID NO: 2519301 - RNA, 20 nt, Chlamydophila pneumoniae CWL029
uaaauccccaccaacaaugc

SEQ ID NO: 2519302 - RNA, 21 nt, Chlamydophila pneumoniae CWL029
uaaaucgcugggauucguaau

SEQ ID NO: 2519303 - RNA, 21 nt, Chlamydophila pneumoniae CWL029
uaaaucuauacccaguuguau

SEQ ID NO: 2519304 - RNA, 16 nt, Chlamydophila pneumoniae CWL029
uaaaucuauuccccuc

SEQ ID NO: 2519305 - RNA, 14 nt, Chlamydophila pneumoniae CWL029
uaaaucugcuuuua

SEQ ID NO: 2519306 - RNA, 15 nt, Chlamydophila pneumoniae CWL029
uaaaucugcuuuuau

SEQ ID NO: 2519307 - RNA, 16 nt, Chlamydophila pneumoniae CWL029
uaaaugacgcacacga

SEQ ID NO: 2519308 - RNA, 21 nt, Chlamydophila pneumoniae CWL029
uaaaugccucuuucauacuaa

SEQ ID NO: 2519309 - RNA, 17 nt, Chlamydophila pneumoniae CWL029
uaaaugccuuaaaugua

SEQ ID NO: 2519310 - RNA, 18 nt, Chlamydophila pneumoniae CWL029
uaaaugccuuaaauguau

SEQ ID NO: 2519311 - RNA, 19 nt, Chlamydophila pneumoniae CWL029
uaaaugcuauuuuccucua

SEQ ID NO: 2519312 - RNA, 20 nt, Chlamydophila pneumoniae CWL029
uaaauguauaggcauuaaua

SEQ ID NO: 2519313 - RNA, 22 nt, Chlamydophila pneumoniae CWL029
uaaauguauaggcauuaauaac

SEQ ID NO: 2519314 - RNA, 15 nt, Chlamydophila pneumoniae CWL029
uaaauguauugcaaa

SEQ ID NO: 2519315 - RNA, 17 nt, Chlamydophila pneumoniae CWL029
uaaaugugaaaucguau

SEQ ID NO: 2519316 - RNA, 16 nt, Chlamydophila pneumoniae CWL029
uaaauuaguaaaugcc

SEQ ID NO: 2519317 - RNA, 13 nt, Chlamydophila pneumoniae CWL029
uaaauucaaaauc

SEQ ID NO: 2519318 - RNA, 12 nt, Chlamydophila pneumoniae CWL029
uaaauucuggaa

SEQ ID NO: 2519319 - RNA, 12 nt, Chlamydophila pneumoniae CWL029
guaaagaaaagc

SEQ ID NO: 2519320 - RNA, 12 nt, Chlamydophila pneumoniae CWL029
guaaagaaucac

SEQ ID NO: 2519321 - RNA, 20 nt, Chlamydophila pneumoniae CWL029
guaaagaguagccccagcaa

SEQ ID NO: 2519322 - RNA, 14 nt, Chlamydophila pneumoniae CWL029
guaaagauucuauu

SEQ ID NO: 2519323 - RNA, 19 nt, Chlamydophila pneumoniae CWL029
guaaagcauuggacaacgc

SEQ ID NO: 2519324 - RNA, 18 nt, Chlamydophila pneumoniae CWL029
guaaagccacauucuucu

SEQ ID NO: 2519325 - RNA, 17 nt, Chlamydophila pneumoniae CWL029
guaaauaguauacaagc

SEQ ID NO: 2519326 - RNA, 12 nt, Chlamydophila pneumoniae CWL029
guaaauaucuua

SEQ ID NO: 2519327 - RNA, 21 nt, Chlamydophila pneumoniae CWL029
guaaauauuuuaccauugaga

SEQ ID NO: 2519328 - RNA, 16 nt, Chlamydophila pneumoniae CWL029
guaaaugaggcuccuc

SEQ ID NO: 2519329 - RNA, 21 nt, Chlamydophila pneumoniae CWL029
guaaaugccucuuucauacua

SEQ ID NO: 2519330 - RNA, 19 nt, Chlamydophila pneumoniae CWL029
guaaauuuuuccuucaaca

SEQ ID NO: 2519331 - RNA, 20 nt, Chlamydophila pneumoniae CWL029
guaaauuuuuccuucaacac

SEQ ID NO: 2519332 - RNA, 18 nt, Chlamydophila pneumoniae CWL029
guaaccaacaucaaagaa

SEQ ID NO: 2519333 - RNA, 19 nt, Chlamydophila pneumoniae CWL029
guaaccaauacagcauaaa

SEQ ID NO: 2519334 - RNA, 17 nt, Chlamydophila pneumoniae CWL029
guaaccacagugauuua

SEQ ID NO: 2519335 - RNA, 13 nt, Chlamydophila pneumoniae CWL029
guaaccagagagc

SEQ ID NO: 2519336 - RNA, 14 nt, Chlamydophila pneumoniae CWL029
guaaccugaaagcg

SEQ ID NO: 2519337 - RNA, 14 nt, Chlamydophila pneumoniae CWL029
guaacgcuuuucua

SEQ ID NO: 2519338 - RNA, 12 nt, Chlamydophila pneumoniae CWL029
guaacuaauaau

SEQ ID NO: 2519339 - RNA, 19 nt, Chlamydophila pneumoniae CWL029
guaacuaauaaucauaucu

SEQ ID NO: 2519340 - RNA, 16 nt, Chlamydophila pneumoniae CWL029
guaacuaguaacuuaa

SEQ ID NO: 2519341 - RNA, 17 nt, Chlamydophila pneumoniae CWL029
guaacucuuaagaauaa

SEQ ID NO: 2519342 - RNA, 18 nt, Chlamydophila pneumoniae CWL029
guaagaaggcagagaacu

SEQ ID NO: 2519343 - RNA, 16 nt, Chlamydophila pneumoniae CWL029
guaagacuaaaaaaga

SEQ ID NO: 2519344 - RNA, 21 nt, Chlamydophila pneumoniae CWL029
guaagcagugugcugauuuua

SEQ ID NO: 2519345 - RNA, 18 nt, Chlamydophila pneumoniae CWL029
gucuugcugauuuuugcu

SEQ ID NO: 2519346 - RNA, 23 nt, Chlamydophila pneumoniae CWL029
gucuugcuuugugaguucuuccu

SEQ ID NO: 2519347 - RNA, 19 nt, Chlamydophila pneumoniae CWL029
gucuuucuuuuuuuugccg

SEQ ID NO: 2519348 - RNA, 18 nt, Chlamydophila pneumoniae CWL029
gucuuugauuuucaggag

SEQ ID NO: 2519349 - RNA, 16 nt, Chlamydophila pneumoniae CWL029
gucuuugcuuucuagg

SEQ ID NO: 2519350 - RNA, 16 nt, Chlamydophila pneumoniae CWL029
gugaaauauugaucuu

SEQ ID NO: 2519351 - RNA, 15 nt, Chlamydophila pneumoniae CWL029
gugaacaaaaacugc

SEQ ID NO: 2519352 - RNA, 13 nt, Chlamydophila pneumoniae CWL029
gugaacacucucu

SEQ ID NO: 2519353 - RNA, 21 nt, Chlamydophila pneumoniae CWL029
gugaacuuuuguacacagaga

SEQ ID NO: 2519354 - RNA, 18 nt, Chlamydophila pneumoniae CWL029
gugaagaaauuaaguagg

SEQ ID NO: 2519355 - RNA, 21 nt, Chlamydophila pneumoniae CWL029
gugaauauguacugaugugaa

SEQ ID NO: 2519356 - RNA, 14 nt, Chlamydophila pneumoniae CWL029
gugaaugagcuuca

SEQ ID NO: 2519357 - RNA, 15 nt, Chlamydophila pneumoniae CWL029
gugaauuucuugacu

SEQ ID NO: 2519358 - RNA, 12 nt, Chlamydophila pneumoniae CWL029
gugacuccuggu

SEQ ID NO: 2519359 - RNA, 20 nt, Chlamydophila pneumoniae CWL029
gugacucuuaucuggagaug

SEQ ID NO: 2519360 - RNA, 13 nt, Chlamydophila pneumoniae CWL029
gugaguugcaauu

SEQ ID NO: 2519361 - RNA, 20 nt, Chlamydophila pneumoniae CWL029
gugauauccaccuuaccauc

SEQ ID NO: 2519362 - RNA, 19 nt, Chlamydophila pneumoniae CWL029
gugaucaaaauuauccaga

SEQ ID NO: 2519363 - RNA, 16 nt, Chlamydophila pneumoniae CWL029
gugaucaaagaacaau

SEQ ID NO: 2519364 - RNA, 14 nt, Chlamydophila pneumoniae CWL029
gugaucuugagaaa

SEQ ID NO: 2519365 - RNA, 16 nt, Chlamydophila pneumoniae CWL029
gugauugcguauagau

SEQ ID NO: 2519366 - RNA, 17 nt, Chlamydophila pneumoniae CWL029
gugcaaggccuaaucuu

SEQ ID NO: 2519367 - RNA, 15 nt, Chlamydophila pneumoniae CWL029
gugcagugaauccuu

SEQ ID NO: 2519368 - RNA, 13 nt, Chlamydophila pneumoniae CWL029
gugcaugcaucuu

SEQ ID NO: 2519369 - RNA, 14 nt, Chlamydophila pneumoniae CWL029
gugcaugcaucuua

SEQ ID NO: 2519370 - RNA, 15 nt, Chlamydophila pneumoniae CWL029
gugccaaaaaauuuu

SEQ ID NO: 2519371 - RNA, 14 nt, Chlamydophila pneumoniae CWL029
gugccaucuguaga

SEQ ID NO: 2519372 - RNA, 21 nt, Chlamydophila pneumoniae CWL029
gugccuguaauugauguuccu

SEQ ID NO: 2519373 - RNA, 23 nt, Chlamydophila pneumoniae CWL029
gugccuucuucaaagcuacuaau

SEQ ID NO: 2519374 - RNA, 20 nt, Chlamydophila pneumoniae CWL029
gugcgcgucuccuugauuug

SEQ ID NO: 2519375 - RNA, 19 nt, Chlamydophila pneumoniae CWL029
gugcucaguaaauauuuua

SEQ ID NO: 2519376 - RNA, 15 nt, Chlamydophila pneumoniae CWL029
gugcucggcacuuac

SEQ ID NO: 2519377 - RNA, 13 nt, Chlamydophila pneumoniae CWL029
gugcucuacccca

SEQ ID NO: 2519378 - RNA, 12 nt, Chlamydophila pneumoniae CWL029
gugcucucuucu

SEQ ID NO: 2519379 - RNA, 13 nt, Chlamydophila pneumoniae CWL029
gugcugccaugac

SEQ ID NO: 2519380 - RNA, 18 nt, Chlamydophila pneumoniae CWL029
guggaacgcauaagagac

SEQ ID NO: 2519381 - RNA, 16 nt, Chlamydophila pneumoniae CWL029
guggaacuuucuggga

SEQ ID NO: 2519382 - RNA, 23 nt, Chlamydophila pneumoniae CWL029
guggagcuugucuaggagcuucg

SEQ ID NO: 2519383 - RNA, 14 nt, Chlamydophila pneumoniae CWL029
guggagguuaguau

SEQ ID NO: 2519384 - RNA, 14 nt, Chlamydophila pneumoniae CWL029
gugggaggaauccu

SEQ ID NO: 2519385 - RNA, 18 nt, Chlamydophila pneumoniae CWL029
gugggauggucaggaaga

SEQ ID NO: 2519386 - RNA, 16 nt, Chlamydophila pneumoniae CWL029
guggguagccaggaug

SEQ ID NO: 2519387 - RNA, 23 nt, Chlamydophila pneumoniae CWL029
gugguaaaaauauaggcugcaca

SEQ ID NO: 2519388 - RNA, 14 nt, Chlamydophila pneumoniae CWL029
guguaaaaguuagg

SEQ ID NO: 2519389 - RNA, 20 nt, Chlamydophila pneumoniae CWL029
guguaccucucaucaaagca

SEQ ID NO: 2519390 - RNA, 15 nt, Chlamydophila pneumoniae CWL029
guguagccuuucuuu

SEQ ID NO: 2519391 - RNA, 15 nt, Chlamydophila pneumoniae CWL029
guguauaguauuuuu

SEQ ID NO: 2519392 - RNA, 23 nt, Chlamydophila pneumoniae CWL029
gugucccauggcuggaaagccaa

SEQ ID NO: 2519393 - RNA, 22 nt, Chlamydophila pneumoniae CWL029
gugucuuccuugggaggaggag

SEQ ID NO: 2519394 - RNA, 19 nt, Chlamydophila pneumoniae CWL029
guguggaucacguaagcuu

SEQ ID NO: 2519395 - RNA, 16 nt, Chlamydophila pneumoniae CWL029
gugugugguaaaaaua

SEQ ID NO: 2519396 - RNA, 23 nt, Chlamydophila pneumoniae CWL029
guguuaaguucauaaccugggca

SEQ ID NO: 2519397 - RNA, 17 nt, Chlamydophila pneumoniae CWL029
guguucaauagcaaaga

SEQ ID NO: 2519398 - RNA, 23 nt, Chlamydophila pneumoniae CWL029
guguuccagaucaaugccuugcg

SEQ ID NO: 2519399 - RNA, 12 nt, Chlamydophila pneumoniae CWL029
guguuuccuucg

SEQ ID NO: 2519400 - RNA, 12 nt, Chlamydophila pneumoniae CWL029
guguuuucuagu

SEQ ID NO: 2519401 - RNA, 19 nt, Chlamydophila pneumoniae CWL029
guguuuuuggcauaaagac

SEQ ID NO: 2519402 - RNA, 17 nt, Chlamydophila pneumoniae CWL029
guuaaacaaaguaggau

SEQ ID NO: 2519403 - RNA, 11 nt, Chlamydophila pneumoniae CWL029
guuaacaucaa

SEQ ID NO: 2519404 - RNA, 14 nt, Chlamydophila pneumoniae CWL029
guuaacgaauugcu

SEQ ID NO: 2519405 - RNA, 13 nt, Chlamydophila pneumoniae CWL029
guuaacuccuuca

SEQ ID NO: 2519406 - RNA, 22 nt, Chlamydophila pneumoniae CWL029
guuacagcguugcuaagcauag

SEQ ID NO: 2519407 - RNA, 22 nt, Chlamydophila pneumoniae CWL029
guuacggaacucauuaagaaga

SEQ ID NO: 2519408 - RNA, 16 nt, Chlamydophila pneumoniae CWL029
guuagaaaccaugaug

SEQ ID NO: 2519409 - RNA, 19 nt, Chlamydophila pneumoniae CWL029
guuagaaaccaugaugcaa

SEQ ID NO: 2519410 - RNA, 13 nt, Chlamydophila pneumoniae CWL029
guuagagaagagg

SEQ ID NO: 2519411 - RNA, 15 nt, Chlamydophila pneumoniae CWL029
guuaggucuuaaagu

SEQ ID NO: 2519412 - RNA, 13 nt, Chlamydophila pneumoniae CWL029
guuauaagugacu

SEQ ID NO: 2519413 - RNA, 20 nt, Chlamydophila pneumoniae CWL029
guuauaagugacuuuucuuc

SEQ ID NO: 2519414 - RNA, 13 nt, Chlamydophila pneumoniae CWL029
guuauauuuuucu

SEQ ID NO: 2519415 - RNA, 21 nt, Chlamydophila pneumoniae CWL029
guuaucaaaagguuuuauaaa

SEQ ID NO: 2519416 - RNA, 13 nt, Chlamydophila pneumoniae CWL029
guuaucaggaacu

SEQ ID NO: 2519417 - RNA, 20 nt, Chlamydophila pneumoniae CWL029
guuaucucccaagacgagaa

SEQ ID NO: 2519418 - RNA, 14 nt, Chlamydophila pneumoniae CWL029
guuaugaagcuucu

SEQ ID NO: 2519419 - RNA, 16 nt, Chlamydophila pneumoniae CWL029
guuauuaauaaauuua

SEQ ID NO: 2519420 - RNA, 20 nt, Chlamydophila pneumoniae CWL029
guuauuaauaaauuuaucug

SEQ ID NO: 2519421 - RNA, 15 nt, Chlamydophila pneumoniae CWL029
guuauuguuucuaug

SEQ ID NO: 2519422 - RNA, 16 nt, Chlamydophila pneumoniae CWL029
uaagauaaacauuaag

SEQ ID NO: 2519423 - RNA, 21 nt, Chlamydophila pneumoniae CWL029
uaagauaaacauuaagugaug

SEQ ID NO: 2519424 - RNA, 13 nt, Chlamydophila pneumoniae CWL029
uaagauaauagag

SEQ ID NO: 2519425 - RNA, 14 nt, Chlamydophila pneumoniae CWL029
uaagauaauagaga

SEQ ID NO: 2519426 - RNA, 20 nt, Chlamydophila pneumoniae CWL029
uaagauacuucuccacagcu

SEQ ID NO: 2519427 - RNA, 19 nt, Chlamydophila pneumoniae CWL029
uaagauagacucucacuga

SEQ ID NO: 2519428 - RNA, 21 nt, Chlamydophila pneumoniae CWL029
uaagauagacucucacugagu

SEQ ID NO: 2519429 - RNA, 14 nt, Chlamydophila pneumoniae CWL029
uaagauaucuccag

SEQ ID NO: 2519430 - RNA, 23 nt, Chlamydophila pneumoniae CWL029
uaagauauguccgugagcaacaa

SEQ ID NO: 2519431 - RNA, 17 nt, Chlamydophila pneumoniae CWL029
uaagauauucaagagga

SEQ ID NO: 2519432 - RNA, 18 nt, Chlamydophila pneumoniae CWL029
uaagaucaauauagagaa

SEQ ID NO: 2519433 - RNA, 20 nt, Chlamydophila pneumoniae CWL029
uaauccagcaacaaccaaaa

SEQ ID NO: 2519434 - RNA, 12 nt, Chlamydophila pneumoniae CWL029
uaauccuccaaa

SEQ ID NO: 2519435 - RNA, 22 nt, Chlamydophila pneumoniae CWL029
uaauccuccucgaauggagugc

SEQ ID NO: 2519436 - RNA, 21 nt, Chlamydophila pneumoniae CWL029
uaauccugaauggcucuguca

SEQ ID NO: 2519437 - RNA, 10 nt, Chlamydophila pneumoniae CWL029
uaauccugca

SEQ ID NO: 2519438 - RNA, 19 nt, Chlamydophila pneumoniae CWL029
uaauccuguugucacuaag

SEQ ID NO: 2519439 - RNA, 21 nt, Chlamydophila pneumoniae CWL029
uaauccuucuuucugcucuuc

SEQ ID NO: 2519440 - RNA, 15 nt, Chlamydophila pneumoniae CWL029
uaauccuugagggcu

SEQ ID NO: 2519441 - RNA, 14 nt, Chlamydophila pneumoniae CWL029
uaaucgcacuucua

SEQ ID NO: 2519442 - RNA, 15 nt, Chlamydophila pneumoniae CWL029
uaaucgcacuucuau

SEQ ID NO: 2519443 - RNA, 12 nt, Chlamydophila pneumoniae CWL029
uaaucucaccag

SEQ ID NO: 2519444 - RNA, 14 nt, Chlamydophila pneumoniae CWL029
uaaucucaccagaa

SEQ ID NO: 2519445 - RNA, 20 nt, Chlamydophila pneumoniae CWL029
uaaucuggaagcaaucugua

SEQ ID NO: 2519446 - RNA, 16 nt, Chlamydophila pneumoniae CWL029
uaaucuuuuuuaaagc

SEQ ID NO: 2519447 - RNA, 21 nt, Chlamydophila pneumoniae CWL029
uaaugaagcagggaaaaugcg

SEQ ID NO: 2519448 - RNA, 18 nt, Chlamydophila pneumoniae CWL029
uaaugaaguuugcaugca

SEQ ID NO: 2519449 - RNA, 15 nt, Chlamydophila pneumoniae CWL029
uaaugacagugucca

SEQ ID NO: 2519450 - RNA, 16 nt, Chlamydophila pneumoniae CWL029
uaaugacucuagagua

SEQ ID NO: 2519451 - RNA, 16 nt, Chlamydophila pneumoniae CWL029
uaaugcagccacagcc

SEQ ID NO: 2519452 - RNA, 17 nt, Chlamydophila pneumoniae CWL029
uaaugcucacuucuuug

SEQ ID NO: 2519453 - RNA, 21 nt, Chlamydophila pneumoniae CWL029
uaauggaccagaugcuaaaga

SEQ ID NO: 2519454 - RNA, 20 nt, Chlamydophila pneumoniae CWL029
uaauggagagcuuucgcucc

SEQ ID NO: 2519455 - RNA, 18 nt, Chlamydophila pneumoniae CWL029
uaaugguacaauacugga

SEQ ID NO: 2519456 - RNA, 20 nt, Chlamydophila pneumoniae CWL029
uaauggugucuuacaaaccc

SEQ ID NO: 2519457 - RNA, 21 nt, Chlamydophila pneumoniae CWL029
uaauggugucuuacaaaccca

SEQ ID NO: 2519458 - RNA, 23 nt, Chlamydophila pneumoniae CWL029
uaaugucuccaucggaauuugcc

SEQ ID NO: 2519459 - RNA, 23 nt, Chlamydophila pneumoniae CWL029
uaauguuuggccaacagcuaaua

SEQ ID NO: 2519460 - RNA, 12 nt, Chlamydophila pneumoniae CWL029
uaauuaaaaacu

SEQ ID NO: 2519461 - RNA, 22 nt, Chlamydophila pneumoniae CWL029
uaauuaaaaguucagcaaagaa

SEQ ID NO: 2519462 - RNA, 19 nt, Chlamydophila pneumoniae CWL029
uaauuaaauauauaaagaa

SEQ ID NO: 2519463 - RNA, 15 nt, Chlamydophila pneumoniae CWL029
uaauuaacguuucuu

SEQ ID NO: 2519464 - RNA, 15 nt, Chlamydophila pneumoniae CWL029
uaauuacagaucugc

SEQ ID NO: 2519465 - RNA, 18 nt, Chlamydophila pneumoniae CWL029
uaauuacagaucugcaua

SEQ ID NO: 2519466 - RNA, 15 nt, Chlamydophila pneumoniae CWL029
uaauucaaaaagaga

SEQ ID NO: 2519467 - RNA, 17 nt, Chlamydophila pneumoniae CWL029
uaauucagaaagacgau

SEQ ID NO: 2519468 - RNA, 14 nt, Chlamydophila pneumoniae CWL029
uaauuccaaaauaa

SEQ ID NO: 2519469 - RNA, 20 nt, Chlamydophila pneumoniae CWL029
uaauuccaaaauaaaaggag

SEQ ID NO: 2519470 - RNA, 20 nt, Chlamydophila pneumoniae CWL029
uaauuccaucuggaauggcc

SEQ ID NO: 2519471 - RNA, 22 nt, Chlamydophila pneumoniae CWL029
uaauugacguagacgauuuucu

SEQ ID NO: 2519472 - RNA, 21 nt, Chlamydophila pneumoniae CWL029
uaauugcuggaggccaaagaa

SEQ ID NO: 2519473 - RNA, 15 nt, Chlamydophila pneumoniae CWL029
uaauuguagagagaa

SEQ ID NO: 2519474 - RNA, 22 nt, Chlamydophila pneumoniae CWL029
uaauuuaaaugccuuaaaugua

SEQ ID NO: 2519475 - RNA, 15 nt, Chlamydophila pneumoniae CWL029
uaauuucaaagaugc

SEQ ID NO: 2519476 - RNA, 21 nt, Chlamydophila pneumoniae CWL029
uaauuuccuucaggauuuucc

SEQ ID NO: 2519477 - RNA, 22 nt, Chlamydophila pneumoniae CWL029
uaauuuccuucaggauuuucca

SEQ ID NO: 2519478 - RNA, 12 nt, Chlamydophila pneumoniae CWL029
uaauuucuuaca

SEQ ID NO: 2519479 - RNA, 22 nt, Chlamydophila pneumoniae CWL029
uaauuucuuucacaucuuuaga

SEQ ID NO: 2519480 - RNA, 17 nt, Chlamydophila pneumoniae CWL029
uaauuuuaaauuuuguu

SEQ ID NO: 2519481 - RNA, 13 nt, Chlamydophila pneumoniae CWL029
uaauuuuagcuuc

SEQ ID NO: 2519482 - RNA, 15 nt, Chlamydophila pneumoniae CWL029
uaauuuuucuuagua

SEQ ID NO: 2519483 - RNA, 19 nt, Chlamydophila pneumoniae CWL029
uaauuuuugcuaaacaaug

SEQ ID NO: 2519484 - RNA, 20 nt, Chlamydophila pneumoniae CWL029
uaauuuuugcuaaacaaugc

SEQ ID NO: 2519485 - RNA, 13 nt, Chlamydophila pneumoniae CWL029
uacaaaaaauaaa

SEQ ID NO: 2519486 - RNA, 16 nt, Chlamydophila pneumoniae CWL029
uacaaaaaauaaaauc

SEQ ID NO: 2519487 - RNA, 14 nt, Chlamydophila pneumoniae CWL029
uacaaaacaaaagc

SEQ ID NO: 2519488 - RNA, 13 nt, Chlamydophila pneumoniae CWL029
uacaaaauuauua

SEQ ID NO: 2519489 - RNA, 15 nt, Chlamydophila pneumoniae CWL029
uacaaaauuauuaaa

SEQ ID NO: 2519490 - RNA, 16 nt, Chlamydophila pneumoniae CWL029
uacaaacccauauuug

SEQ ID NO: 2519491 - RNA, 21 nt, Chlamydophila pneumoniae CWL029
uacaaacccauauuugaauaa

SEQ ID NO: 2519492 - RNA, 23 nt, Chlamydophila pneumoniae CWL029
uacaaacccauauuugaauaaag

SEQ ID NO: 2519493 - RNA, 14 nt, Chlamydophila pneumoniae CWL029
uacaaacucuucca

SEQ ID NO: 2519494 - RNA, 23 nt, Chlamydophila pneumoniae CWL029
uacaaauagcucugcgccaugca

SEQ ID NO: 2519495 - RNA, 20 nt, Chlamydophila pneumoniae CWL029
uacaagacuacgacagaagu

SEQ ID NO: 2519496 - RNA, 18 nt, Chlamydophila pneumoniae CWL029
uacaagcaauacuaagaa

SEQ ID NO: 2519497 - RNA, 19 nt, Chlamydophila pneumoniae CWL029
uacaagcaauacuaagaag

SEQ ID NO: 2519498 - RNA, 18 nt, Chlamydophila pneumoniae CWL029
uacaagugaagacaagua

SEQ ID NO: 2519499 - RNA, 22 nt, Chlamydophila pneumoniae CWL029
uacaagugucugaguuagcuuu

SEQ ID NO: 2519500 - RNA, 17 nt, Chlamydophila pneumoniae CWL029
uacaaguugagagagag

SEQ ID NO: 2519501 - RNA, 13 nt, Chlamydophila pneumoniae CWL029
uacaauaaacaac

SEQ ID NO: 2519502 - RNA, 13 nt, Chlamydophila pneumoniae CWL029
uacaauacuggag

SEQ ID NO: 2519503 - RNA, 16 nt, Chlamydophila pneumoniae CWL029
uacaauacuggagagg

SEQ ID NO: 2519504 - RNA, 18 nt, Chlamydophila pneumoniae CWL029
uacaaucccgaguccuaa

SEQ ID NO: 2519505 - RNA, 20 nt, Chlamydophila pneumoniae CWL029
uacaaucccgaguccuaaaa

SEQ ID NO: 2519506 - RNA, 17 nt, Chlamydophila pneumoniae CWL029
uacaaucgccuuacaau

SEQ ID NO: 2519507 - RNA, 18 nt, Chlamydophila pneumoniae CWL029
uacaaucucgcuauucca

SEQ ID NO: 2519508 - RNA, 17 nt, Chlamydophila pneumoniae CWL029
uacaaucucuagggaua

SEQ ID NO: 2519509 - RNA, 20 nt, Chlamydophila pneumoniae CWL029
uacaaugaagucuucuuucc

SEQ ID NO: 2519510 - RNA, 21 nt, Chlamydophila pneumoniae CWL029
uacaaugaagucuucuuuccc

SEQ ID NO: 2519511 - RNA, 17 nt, Chlamydophila pneumoniae CWL029
uacaaugauauaaaagc

SEQ ID NO: 2519512 - RNA, 13 nt, Chlamydophila pneumoniae CWL029
uacaauuaaaaaa

SEQ ID NO: 2519513 - RNA, 20 nt, Chlamydophila pneumoniae CWL029
uacaauuagagauucauaaa

SEQ ID NO: 2519514 - RNA, 22 nt, Chlamydophila pneumoniae CWL029
uacaauuagagauucauaaaac

SEQ ID NO: 2519515 - RNA, 21 nt, Chlamydophila pneumoniae CWL029
uacaauuuccuugguauccca

SEQ ID NO: 2519516 - RNA, 17 nt, Chlamydophila pneumoniae CWL029
uacaauuugcuccucca

SEQ ID NO: 2519517 - RNA, 21 nt, Chlamydophila pneumoniae CWL029
uacaauuugcuccuccaaaag

SEQ ID NO: 2519518 - RNA, 20 nt, Chlamydophila pneumoniae CWL029
uacacacacgccaaugggaa

SEQ ID NO: 2519519 - RNA, 15 nt, Chlamydophila pneumoniae CWL029
uacacagcacaagaa

SEQ ID NO: 2519520 - RNA, 19 nt, Chlamydophila pneumoniae CWL029
uacacauugucucuuuuaa

SEQ ID NO: 2519521 - RNA, 23 nt, Chlamydophila pneumoniae CWL029
uacacccaggaaacuagauuucu

SEQ ID NO: 2519522 - RNA, 17 nt, Chlamydophila pneumoniae CWL029
uacacccgcaagcacuu

SEQ ID NO: 2519523 - RNA, 19 nt, Chlamydophila pneumoniae CWL029
uacaccuacagaucaggau

SEQ ID NO: 2519524 - RNA, 16 nt, Chlamydophila pneumoniae CWL029
uacacuauaagacauu

SEQ ID NO: 2519525 - RNA, 21 nt, Chlamydophila pneumoniae CWL029
uacacugguagcuaaauuuag

SEQ ID NO: 2519526 - RNA, 19 nt, Chlamydophila pneumoniae CWL029
uacacuguuguaauaaaau

SEQ ID NO: 2519527 - RNA, 23 nt, Chlamydophila pneumoniae CWL029
uacacuguuguaauaaaaucaug

SEQ ID NO: 2519528 - RNA, 21 nt, Chlamydophila pneumoniae CWL029
uacagaaagagcuaaagaaac

SEQ ID NO: 2519529 - RNA, 22 nt, Chlamydophila pneumoniae CWL029
uacagaaagagcuaaagaaacu

SEQ ID NO: 2519530 - RNA, 18 nt, Chlamydophila pneumoniae CWL029
uagagaauuggaagcuuu

SEQ ID NO: 2519531 - RNA, 16 nt, Chlamydophila pneumoniae CWL029
uagagacagccuguuu

SEQ ID NO: 2519532 - RNA, 21 nt, Chlamydophila pneumoniae CWL029
uagagacgaacgaagaaaacg

SEQ ID NO: 2519533 - RNA, 15 nt, Chlamydophila pneumoniae CWL029
uagagagaaacaucg

SEQ ID NO: 2519534 - RNA, 22 nt, Chlamydophila pneumoniae CWL029
uagagagagucggcuuuagaaa

SEQ ID NO: 2519535 - RNA, 18 nt, Chlamydophila pneumoniae CWL029
uagagauaucaucaaaag

SEQ ID NO: 2519536 - RNA, 20 nt, Chlamydophila pneumoniae CWL029
uagagaucuuuuuauuaaaa

SEQ ID NO: 2519537 - RNA, 20 nt, Chlamydophila pneumoniae CWL029
uagagauuaccgaagagccc

SEQ ID NO: 2519538 - RNA, 22 nt, Chlamydophila pneumoniae CWL029
uagagauucauaaaacuguaau

SEQ ID NO: 2519539 - RNA, 18 nt, Chlamydophila pneumoniae CWL029
uagagauucuacaaauua

SEQ ID NO: 2519540 - RNA, 13 nt, Chlamydophila pneumoniae CWL029
uagagauuuuucu

SEQ ID NO: 2519541 - RNA, 23 nt, Chlamydophila pneumoniae CWL029
uagagcaagauucuucagaaucu

SEQ ID NO: 2519542 - RNA, 17 nt, Chlamydophila pneumoniae CWL029
uagagcacauagaaaca

SEQ ID NO: 2519543 - RNA, 22 nt, Chlamydophila pneumoniae CWL029
uagagcaucauaaagugcgagg

SEQ ID NO: 2519544 - RNA, 11 nt, Chlamydophila pneumoniae CWL029
uagagccuaga

SEQ ID NO: 2519545 - RNA, 18 nt, Chlamydophila pneumoniae CWL029
uagagccucuaagaaaau

SEQ ID NO: 2519546 - RNA, 14 nt, Chlamydophila pneumoniae CWL029
uagagccuugcagc

SEQ ID NO: 2519547 - RNA, 18 nt, Chlamydophila pneumoniae CWL029
uagagcuuucagaaaaga

SEQ ID NO: 2519548 - RNA, 19 nt, Chlamydophila pneumoniae CWL029
uagagcuuucagaaaagaa

SEQ ID NO: 2519549 - RNA, 18 nt, Chlamydophila pneumoniae CWL029
uagaggaaguguuucuuu

SEQ ID NO: 2519550 - RNA, 16 nt, Chlamydophila pneumoniae CWL029
uagaggccuuuuagag

SEQ ID NO: 2519551 - RNA, 16 nt, Chlamydophila pneumoniae CWL029
uagagggauuuguagg

SEQ ID NO: 2519552 - RNA, 17 nt, Chlamydophila pneumoniae CWL029
uagaggguccagggucu

SEQ ID NO: 2519553 - RNA, 21 nt, Chlamydophila pneumoniae CWL029
uagaguauuagcgaguacuuu

SEQ ID NO: 2519554 - RNA, 16 nt, Chlamydophila pneumoniae CWL029
uagaguccaagguucu

SEQ ID NO: 2519555 - RNA, 16 nt, Chlamydophila pneumoniae CWL029
uagaguccacagucau

SEQ ID NO: 2519556 - RNA, 19 nt, Chlamydophila pneumoniae CWL029
uagaguccacagucauaaa

SEQ ID NO: 2519557 - RNA, 21 nt, Chlamydophila pneumoniae CWL029
uagagucucuuucagcucaag

SEQ ID NO: 2519558 - RNA, 14 nt, Chlamydophila pneumoniae CWL029
uagagucugcagca

SEQ ID NO: 2519559 - RNA, 21 nt, Chlamydophila pneumoniae CWL029
uagagucuucgacaaggaagc

SEQ ID NO: 2519560 - RNA, 16 nt, Chlamydophila pneumoniae CWL029
uagaguucauuuuagu

SEQ ID NO: 2519561 - RNA, 20 nt, Chlamydophila pneumoniae CWL029
uagaguucgcacuaauuucc

SEQ ID NO: 2519562 - RNA, 16 nt, Chlamydophila pneumoniae CWL029
uagaguugacaauagg

SEQ ID NO: 2519563 - RNA, 13 nt, Chlamydophila pneumoniae CWL029
uagauaagaucuc

SEQ ID NO: 2519564 - RNA, 17 nt, Chlamydophila pneumoniae CWL029
uagauaagaucucuccg

SEQ ID NO: 2519565 - RNA, 21 nt, Chlamydophila pneumoniae CWL029
uagauacuuugcaauacacca

SEQ ID NO: 2519566 - RNA, 18 nt, Chlamydophila pneumoniae CWL029
uagauaugccucaggucu

SEQ ID NO: 2519567 - RNA, 14 nt, Chlamydophila pneumoniae CWL029
uagaucacaagaaa

SEQ ID NO: 2519568 - RNA, 18 nt, Chlamydophila pneumoniae CWL029
uagaucauaaacagcagu

SEQ ID NO: 2519569 - RNA, 15 nt, Chlamydophila pneumoniae CWL029
uagaucccagaagaa

SEQ ID NO: 2519570 - RNA, 17 nt, Chlamydophila pneumoniae CWL029
uagauccccuucauucu

SEQ ID NO: 2519571 - RNA, 17 nt, Chlamydophila pneumoniae CWL029
uagaucccgaagcaauc

SEQ ID NO: 2519572 - RNA, 18 nt, Chlamydophila pneumoniae CWL029
uagaucccucaagcgauu

SEQ ID NO: 2519573 - RNA, 22 nt, Chlamydophila pneumoniae CWL029
uagauccuauaguaauuucucc

SEQ ID NO: 2519574 - RNA, 20 nt, Chlamydophila pneumoniae CWL029
uagaucgucaagcucugaga

SEQ ID NO: 2519575 - RNA, 12 nt, Chlamydophila pneumoniae CWL029
uagaucuucaau

SEQ ID NO: 2519576 - RNA, 19 nt, Chlamydophila pneumoniae CWL029
uagaucuucugaaaucaaa

SEQ ID NO: 2519577 - RNA, 22 nt, Chlamydophila pneumoniae CWL029
uagaucuucugaaaucaaaaaa

SEQ ID NO: 2519578 - RNA, 19 nt, Chlamydophila pneumoniae CWL029
uagaucuuuucuacuucag

SEQ ID NO: 2519579 - RNA, 23 nt, Chlamydophila pneumoniae CWL029
uagaucuuuucuacuucaggaaa

SEQ ID NO: 2519580 - RNA, 23 nt, Chlamydophila pneumoniae CWL029
uagaucuuuugauaacuuugcau

SEQ ID NO: 2519581 - RNA, 14 nt, Chlamydophila pneumoniae CWL029
uagaugaucacagg

SEQ ID NO: 2519582 - RNA, 19 nt, Chlamydophila pneumoniae CWL029
uagauguaaucauaaaaaa

SEQ ID NO: 2519583 - RNA, 21 nt, Chlamydophila pneumoniae CWL029
uagauguuaugaguuuuuaau

SEQ ID NO: 2519584 - RNA, 13 nt, Chlamydophila pneumoniae CWL029
uagauuaaagaga

SEQ ID NO: 2519585 - RNA, 18 nt, Chlamydophila pneumoniae CWL029
uagauucaugaaaugcuu

SEQ ID NO: 2519586 - RNA, 24 nt, Chlamydophila pneumoniae CWL029
uagauugccuuugaucaggagucu

SEQ ID NO: 2519587 - RNA, 14 nt, Chlamydophila pneumoniae CWL029
uagauuuaaaugca

SEQ ID NO: 2519588 - RNA, 13 nt, Chlamydophila pneumoniae CWL029
uagauuuccuccg

SEQ ID NO: 2519589 - RNA, 11 nt, Chlamydophila pneumoniae CWL029
uagauuucuac

SEQ ID NO: 2519590 - RNA, 14 nt, Chlamydophila pneumoniae CWL029
uagauuuucccuaa

SEQ ID NO: 2519591 - RNA, 14 nt, Chlamydophila pneumoniae CWL029
uagauuuuccgcaa

SEQ ID NO: 2519592 - RNA, 15 nt, Chlamydophila pneumoniae CWL029
uagauuuuucuuuua

SEQ ID NO: 2519593 - RNA, 23 nt, Chlamydophila pneumoniae CWL029
uagcaaagcgauggcuauagaua

SEQ ID NO: 2519594 - RNA, 11 nt, Chlamydophila pneumoniae CWL029
uagcaaaggca

SEQ ID NO: 2519595 - RNA, 16 nt, Chlamydophila pneumoniae CWL029
uagcaaguagcucucu

SEQ ID NO: 2519596 - RNA, 20 nt, Chlamydophila pneumoniae CWL029
uagcaaucucuuucacaaag

SEQ ID NO: 2519597 - RNA, 16 nt, Chlamydophila pneumoniae CWL029
uagcaaugauguuuuu

SEQ ID NO: 2519598 - RNA, 20 nt, Chlamydophila pneumoniae CWL029
uagcaaugccuacaguagcu

SEQ ID NO: 2519599 - RNA, 15 nt, Chlamydophila pneumoniae CWL029
uagcaccuaauaaag

SEQ ID NO: 2519600 - RNA, 18 nt, Chlamydophila pneumoniae CWL029
uagcagaguuuuucccuc

SEQ ID NO: 2519601 - RNA, 13 nt, Chlamydophila pneumoniae CWL029
uagcagcaagaac

SEQ ID NO: 2519602 - RNA, 18 nt, Chlamydophila pneumoniae CWL029
uagcaggaaggaauagag

SEQ ID NO: 2519603 - RNA, 14 nt, Chlamydophila pneumoniae CWL029
uagcaguauagaga

SEQ ID NO: 2519604 - RNA, 23 nt, Chlamydophila pneumoniae CWL029
uagcaguauagagaagauuucua

SEQ ID NO: 2519605 - RNA, 20 nt, Chlamydophila pneumoniae CWL029
uagcauaaucuuuaacaaag

SEQ ID NO: 2519606 - RNA, 13 nt, Chlamydophila pneumoniae CWL029
uagcauacaucgu

SEQ ID NO: 2519607 - RNA, 14 nt, Chlamydophila pneumoniae CWL029
uagcauacaucgua

SEQ ID NO: 2519608 - RNA, 19 nt, Chlamydophila pneumoniae CWL029
uagcauacgacaguaauga

SEQ ID NO: 2519609 - RNA, 20 nt, Chlamydophila pneumoniae CWL029
uagcauagccuuccauaucu

SEQ ID NO: 2519610 - RNA, 17 nt, Chlamydophila pneumoniae CWL029
uagcauaggcuaagacu

SEQ ID NO: 2519611 - RNA, 16 nt, Chlamydophila pneumoniae CWL029
uagcaucccaaguucu

SEQ ID NO: 2519612 - RNA, 17 nt, Chlamydophila pneumoniae CWL029
uagcaucccuucuucuu

SEQ ID NO: 2519613 - RNA, 23 nt, Chlamydophila pneumoniae CWL029
uagcaucccuucuucuuuuagac

SEQ ID NO: 2519614 - RNA, 18 nt, Chlamydophila pneumoniae CWL029
uagcaugaaggauaguuu

SEQ ID NO: 2519615 - RNA, 13 nt, Chlamydophila pneumoniae CWL029
uagcauugcuugc

SEQ ID NO: 2519616 - RNA, 19 nt, Chlamydophila pneumoniae CWL029
uagcauugcuugcgcagcu

SEQ ID NO: 2519617 - RNA, 20 nt, Chlamydophila pneumoniae CWL029
uagcauugcuugcgcagcuu

SEQ ID NO: 2519618 - RNA, 14 nt, Chlamydophila pneumoniae CWL029
uagcauuucucuau

SEQ ID NO: 2519619 - RNA, 16 nt, Chlamydophila pneumoniae CWL029
uagcauuucuuucucu

SEQ ID NO: 2519620 - RNA, 14 nt, Chlamydophila pneumoniae CWL029
uagccaaagacucu

SEQ ID NO: 2519621 - RNA, 18 nt, Chlamydophila pneumoniae CWL029
uagccaaagacucuugaa

SEQ ID NO: 2519622 - RNA, 19 nt, Chlamydophila pneumoniae CWL029
uagccaauauagaagcugc

SEQ ID NO: 2519623 - RNA, 12 nt, Chlamydophila pneumoniae CWL029
uagccauagugu

SEQ ID NO: 2519624 - RNA, 20 nt, Chlamydophila pneumoniae CWL029
uacagaaaggaccuccucac

SEQ ID NO: 2519625 - RNA, 14 nt, Chlamydophila pneumoniae CWL029
uacagaacaauggu

SEQ ID NO: 2519626 - RNA, 19 nt, Chlamydophila pneumoniae CWL029
uacagacaagcaaggaaaa

SEQ ID NO: 2519627 - RNA, 20 nt, Chlamydophila pneumoniae CWL029
uacagacaagcaaggaaaaa

SEQ ID NO: 2519628 - RNA, 23 nt, Chlamydophila pneumoniae CWL029
uacagacaagcaaggaaaaaaaa

SEQ ID NO: 2519629 - RNA, 18 nt, Chlamydophila pneumoniae CWL029
uacagaccguccucccca

SEQ ID NO: 2519630 - RNA, 22 nt, Chlamydophila pneumoniae CWL029
uacagacugaagucguuuagau

SEQ ID NO: 2519631 - RNA, 18 nt, Chlamydophila pneumoniae CWL029
uacagaggaaucuauccu

SEQ ID NO: 2519632 - RNA, 22 nt, Chlamydophila pneumoniae CWL029
uacagagggaauuucauguccu

SEQ ID NO: 2519633 - RNA, 23 nt, Chlamydophila pneumoniae CWL029
uacagagggcuucauuccuacau

SEQ ID NO: 2519634 - RNA, 17 nt, Chlamydophila pneumoniae CWL029
uacagauaggguaagau

SEQ ID NO: 2519635 - RNA, 14 nt, Chlamydophila pneumoniae CWL029
uacagauaucaaag

SEQ ID NO: 2519636 - RNA, 20 nt, Chlamydophila pneumoniae CWL029
uacagaucaggauucuaaaa

SEQ ID NO: 2519637 - RNA, 18 nt, Chlamydophila pneumoniae CWL029
uacagaugcaugauccua

SEQ ID NO: 2519638 - RNA, 14 nt, Chlamydophila pneumoniae CWL029
uacagauuucagau

SEQ ID NO: 2519639 - RNA, 18 nt, Chlamydophila pneumoniae CWL029
uacagauuucuucuucag

SEQ ID NO: 2519640 - RNA, 14 nt, Chlamydophila pneumoniae CWL029
uacagcauaaaaau

SEQ ID NO: 2519641 - RNA, 22 nt, Chlamydophila pneumoniae CWL029
uacagcauaaaaauucucauaa

SEQ ID NO: 2519642 - RNA, 18 nt, Chlamydophila pneumoniae CWL029
uacagcaucggcaaccag

SEQ ID NO: 2519643 - RNA, 14 nt, Chlamydophila pneumoniae CWL029
uacagccagcagaa

SEQ ID NO: 2519644 - RNA, 17 nt, Chlamydophila pneumoniae CWL029
uacagcuucauuaucuu

SEQ ID NO: 2519645 - RNA, 17 nt, Chlamydophila pneumoniae CWL029
uacagcuucuuuuccag

SEQ ID NO: 2519646 - RNA, 16 nt, Chlamydophila pneumoniae CWL029
uacaggaaaacgcccu

SEQ ID NO: 2519647 - RNA, 15 nt, Chlamydophila pneumoniae CWL029
uacaggaaacucuau

SEQ ID NO: 2519648 - RNA, 15 nt, Chlamydophila pneumoniae CWL029
uacaggacuguuugu

SEQ ID NO: 2519649 - RNA, 19 nt, Chlamydophila pneumoniae CWL029
uacaggacuguuuguuuau

SEQ ID NO: 2519650 - RNA, 17 nt, Chlamydophila pneumoniae CWL029
uacaggagaagcggaag

SEQ ID NO: 2519651 - RNA, 13 nt, Chlamydophila pneumoniae CWL029
uacaggagaaucc

SEQ ID NO: 2519652 - RNA, 13 nt, Chlamydophila pneumoniae CWL029
uacaggccugaug

SEQ ID NO: 2519653 - RNA, 17 nt, Chlamydophila pneumoniae CWL029
uacaguagcuugugcua

SEQ ID NO: 2519654 - RNA, 18 nt, Chlamydophila pneumoniae CWL029
uacaguaguaaauaauaa

SEQ ID NO: 2519655 - RNA, 22 nt, Chlamydophila pneumoniae CWL029
uacaguuggcguuuucuagaaa

SEQ ID NO: 2519656 - RNA, 20 nt, Chlamydophila pneumoniae CWL029
uacaguuuguaaaaagccua

SEQ ID NO: 2519657 - RNA, 16 nt, Chlamydophila pneumoniae CWL029
uacaguuuuuuucuaa

SEQ ID NO: 2519658 - RNA, 18 nt, Chlamydophila pneumoniae CWL029
uacauaacacuuuguuuu

SEQ ID NO: 2519659 - RNA, 13 nt, Chlamydophila pneumoniae CWL029
uacauaguuuuua

SEQ ID NO: 2519660 - RNA, 15 nt, Chlamydophila pneumoniae CWL029
uacaucaaaaugcug

SEQ ID NO: 2519661 - RNA, 20 nt, Chlamydophila pneumoniae CWL029
uacaucaaugauaucgccuu

SEQ ID NO: 2519662 - RNA, 18 nt, Chlamydophila pneumoniae CWL029
uacauccucacuagagau

SEQ ID NO: 2519663 - RNA, 21 nt, Chlamydophila pneumoniae CWL029
uacaucguauccaaauugcaa

SEQ ID NO: 2519664 - RNA, 17 nt, Chlamydophila pneumoniae CWL029
uacaucuucuuggcuuu

SEQ ID NO: 2519665 - RNA, 11 nt, Chlamydophila pneumoniae CWL029
uacauguaaac

SEQ ID NO: 2519666 - RNA, 23 nt, Chlamydophila pneumoniae CWL029
uacauucgcaagaaugaugcaua

SEQ ID NO: 2519667 - RNA, 14 nt, Chlamydophila pneumoniae CWL029
uacauuugcuauuu

SEQ ID NO: 2519668 - RNA, 23 nt, Chlamydophila pneumoniae CWL029
uaccaaagucgauacccaaagag

SEQ ID NO: 2519669 - RNA, 21 nt, Chlamydophila pneumoniae CWL029
uaccaaccuucgauuccaggc

SEQ ID NO: 2519670 - RNA, 18 nt, Chlamydophila pneumoniae CWL029
uaccaagaugaagaaacu

SEQ ID NO: 2519671 - RNA, 20 nt, Chlamydophila pneumoniae CWL029
uaccaaggcagguaucuccu

SEQ ID NO: 2519672 - RNA, 14 nt, Chlamydophila pneumoniae CWL029
uaccaauucucucu

SEQ ID NO: 2519673 - RNA, 21 nt, Chlamydophila pneumoniae CWL029
uaccacagcuguacagaacaa

SEQ ID NO: 2519674 - RNA, 22 nt, Chlamydophila pneumoniae CWL029
uaccaccccaaagcagauccug

SEQ ID NO: 2519675 - RNA, 22 nt, Chlamydophila pneumoniae CWL029
uaccaggcugcgcuacacccag

SEQ ID NO: 2519676 - RNA, 21 nt, Chlamydophila pneumoniae CWL029
uaccauaaggagauuccuaaa

SEQ ID NO: 2519677 - RNA, 18 nt, Chlamydophila pneumoniae CWL029
uaccauugagauccauag

SEQ ID NO: 2519678 - RNA, 20 nt, Chlamydophila pneumoniae CWL029
uacccaaauuucuucuggau

SEQ ID NO: 2519679 - RNA, 12 nt, Chlamydophila pneumoniae CWL029
uacccaucuaga

SEQ ID NO: 2519680 - RNA, 16 nt, Chlamydophila pneumoniae CWL029
uacccucggagacuca

SEQ ID NO: 2519681 - RNA, 16 nt, Chlamydophila pneumoniae CWL029
uacccucugcuuaucg

SEQ ID NO: 2519682 - RNA, 13 nt, Chlamydophila pneumoniae CWL029
uacccuucuucuu

SEQ ID NO: 2519683 - RNA, 19 nt, Chlamydophila pneumoniae CWL029
uaccgaccgaaucucucca

SEQ ID NO: 2519684 - RNA, 13 nt, Chlamydophila pneumoniae CWL029
uaccguaaagaaa

SEQ ID NO: 2519685 - RNA, 15 nt, Chlamydophila pneumoniae CWL029
uaccguaaagaaaag

SEQ ID NO: 2519686 - RNA, 21 nt, Chlamydophila pneumoniae CWL029
uaccguagcguacguuuucuc

SEQ ID NO: 2519687 - RNA, 20 nt, Chlamydophila pneumoniae CWL029
uaccguuuacaucaauuuua

SEQ ID NO: 2519688 - RNA, 19 nt, Chlamydophila pneumoniae CWL029
uaccuacuaaacccugucc

SEQ ID NO: 2519689 - RNA, 21 nt, Chlamydophila pneumoniae CWL029
uaccuauauuuuuuacauaac

SEQ ID NO: 2519690 - RNA, 23 nt, Chlamydophila pneumoniae CWL029
uaccucuccgucauauuuaaaag

SEQ ID NO: 2519691 - RNA, 20 nt, Chlamydophila pneumoniae CWL029
uaccugcauucauaaaaaug

SEQ ID NO: 2519692 - RNA, 19 nt, Chlamydophila pneumoniae CWL029
uaccuguacgguaaaucca

SEQ ID NO: 2519693 - RNA, 14 nt, Chlamydophila pneumoniae CWL029
uaccuguagcuaca

SEQ ID NO: 2519694 - RNA, 16 nt, Chlamydophila pneumoniae CWL029
uaccuguagcuacaga

SEQ ID NO: 2519695 - RNA, 19 nt, Chlamydophila pneumoniae CWL029
uaccuuaguuuuuucuaag

SEQ ID NO: 2519696 - RNA, 19 nt, Chlamydophila pneumoniae CWL029
uaccuuaucgccaacggca

SEQ ID NO: 2519697 - RNA, 16 nt, Chlamydophila pneumoniae CWL029
uaccuucgacuauaag

SEQ ID NO: 2519698 - RNA, 14 nt, Chlamydophila pneumoniae CWL029
uaccuugagacaaa

SEQ ID NO: 2519699 - RNA, 14 nt, Chlamydophila pneumoniae CWL029
uaccuuguuuuccu

SEQ ID NO: 2519700 - RNA, 12 nt, Chlamydophila pneumoniae CWL029
uaccuuucuaag

SEQ ID NO: 2519701 - RNA, 13 nt, Chlamydophila pneumoniae CWL029
uacgaaaacaucu

SEQ ID NO: 2519702 - RNA, 13 nt, Chlamydophila pneumoniae CWL029
uacgaauccaaaa

SEQ ID NO: 2519703 - RNA, 17 nt, Chlamydophila pneumoniae CWL029
uacgaauccaaaaaaga

SEQ ID NO: 2519704 - RNA, 22 nt, Chlamydophila pneumoniae CWL029
uacgaugagguugagcaagaau

SEQ ID NO: 2519705 - RNA, 15 nt, Chlamydophila pneumoniae CWL029
uacgcaaaguacuaa

SEQ ID NO: 2519706 - RNA, 15 nt, Chlamydophila pneumoniae CWL029
uacgcaaguaaagaa

SEQ ID NO: 2519707 - RNA, 18 nt, Chlamydophila pneumoniae CWL029
uacgcaaguaaagaaauu

SEQ ID NO: 2519708 - RNA, 20 nt, Chlamydophila pneumoniae CWL029
uacgcuauucuuaagcuacc

SEQ ID NO: 2519709 - RNA, 20 nt, Chlamydophila pneumoniae CWL029
uacgcucguagguaugagcu

SEQ ID NO: 2519710 - RNA, 12 nt, Chlamydophila pneumoniae CWL029
uacgcucuccau

SEQ ID NO: 2519711 - RNA, 16 nt, Chlamydophila pneumoniae CWL029
uacgcuuuucuucuuu

SEQ ID NO: 2519712 - RNA, 14 nt, Chlamydophila pneumoniae CWL029
uacgcuuuuuacug

SEQ ID NO: 2519713 - RNA, 16 nt, Chlamydophila pneumoniae CWL029
uacggcuaaauaaacc

SEQ ID NO: 2519714 - RNA, 15 nt, Chlamydophila pneumoniae CWL029
uacgguuucugggau

SEQ ID NO: 2519715 - RNA, 18 nt, Chlamydophila pneumoniae CWL029
uacguaaacuauacucuc

SEQ ID NO: 2519716 - RNA, 16 nt, Chlamydophila pneumoniae CWL029
uacguagcauaccuug

SEQ ID NO: 2519717 - RNA, 19 nt, Chlamydophila pneumoniae CWL029
uacguaguccuuauuucaa

SEQ ID NO: 2519718 - RNA, 14 nt, Chlamydophila pneumoniae CWL029
uacgugaucaaaau

SEQ ID NO: 2519719 - RNA, 15 nt, Chlamydophila pneumoniae CWL029
uacgugaucaaaauu

SEQ ID NO: 2519720 - RNA, 14 nt, Chlamydophila pneumoniae CWL029
uacguucuuucuuu

SEQ ID NO: 2519721 - RNA, 22 nt, Chlamydophila pneumoniae CWL029
uagccuggaggcgguggcaugc

SEQ ID NO: 2519722 - RNA, 23 nt, Chlamydophila pneumoniae CWL029
uagccuuacggccccuggaauuu

SEQ ID NO: 2519723 - RNA, 19 nt, Chlamydophila pneumoniae CWL029
uagcgacgacgacgccuag

SEQ ID NO: 2519724 - RNA, 17 nt, Chlamydophila pneumoniae CWL029
uagcgcuuuuuuaaagu

SEQ ID NO: 2519725 - RNA, 18 nt, Chlamydophila pneumoniae CWL029
uagcgcuuuuuuaaagug

SEQ ID NO: 2519726 - RNA, 22 nt, Chlamydophila pneumoniae CWL029
uagcgguacuugcgaaagaucc

SEQ ID NO: 2519727 - RNA, 20 nt, Chlamydophila pneumoniae CWL029
uagcgucucuucuuccucua

SEQ ID NO: 2519728 - RNA, 18 nt, Chlamydophila pneumoniae CWL029
uagcuaacucggaaaaaa

SEQ ID NO: 2519729 - RNA, 16 nt, Chlamydophila pneumoniae CWL029
uagcuacagauucuug

SEQ ID NO: 2519730 - RNA, 15 nt, Chlamydophila pneumoniae CWL029
uagcuacuucuucuu

SEQ ID NO: 2519731 - RNA, 19 nt, Chlamydophila pneumoniae CWL029
uagcucaggugguuagagc

SEQ ID NO: 2519732 - RNA, 20 nt, Chlamydophila pneumoniae CWL029
uagcucaucuagaaagauuu

SEQ ID NO: 2519733 - RNA, 15 nt, Chlamydophila pneumoniae CWL029
uagcucucuccugga

SEQ ID NO: 2519734 - RNA, 17 nt, Chlamydophila pneumoniae CWL029
uagcucuggagauugcu

SEQ ID NO: 2519735 - RNA, 20 nt, Chlamydophila pneumoniae CWL029
uagcucuuugggauaaaaag

SEQ ID NO: 2519736 - RNA, 20 nt, Chlamydophila pneumoniae CWL029
uagcugagagauuuuuucau

SEQ ID NO: 2519737 - RNA, 12 nt, Chlamydophila pneumoniae CWL029
uagcugcucuuu

SEQ ID NO: 2519738 - RNA, 15 nt, Chlamydophila pneumoniae CWL029
uagcuuuagaagccc

SEQ ID NO: 2519739 - RNA, 14 nt, Chlamydophila pneumoniae CWL029
uaggaacaaagcca

SEQ ID NO: 2519740 - RNA, 23 nt, Chlamydophila pneumoniae CWL029
uaggaacaaagcucuccuucaga

SEQ ID NO: 2519741 - RNA, 16 nt, Chlamydophila pneumoniae CWL029
uaggaacaugccaaau

SEQ ID NO: 2519742 - RNA, 20 nt, Chlamydophila pneumoniae CWL029
uaggaacaugccaaauaucu

SEQ ID NO: 2519743 - RNA, 17 nt, Chlamydophila pneumoniae CWL029
uaggaacucacaaacaa

SEQ ID NO: 2519744 - RNA, 23 nt, Chlamydophila pneumoniae CWL029
uaggaagaugaauaccagaagca

SEQ ID NO: 2519745 - RNA, 15 nt, Chlamydophila pneumoniae CWL029
uaggaagcucuucua

SEQ ID NO: 2519746 - RNA, 17 nt, Chlamydophila pneumoniae CWL029
uaggaagcuuaucaaga

SEQ ID NO: 2519747 - RNA, 17 nt, Chlamydophila pneumoniae CWL029
uaggaaggucagaguau

SEQ ID NO: 2519748 - RNA, 20 nt, Chlamydophila pneumoniae CWL029
uaggaauaacaccaaaagaa

SEQ ID NO: 2519749 - RNA, 16 nt, Chlamydophila pneumoniae CWL029
uaggaaucuuuuagag

SEQ ID NO: 2519750 - RNA, 18 nt, Chlamydophila pneumoniae CWL029
uaggacccguagccccuu

SEQ ID NO: 2519751 - RNA, 21 nt, Chlamydophila pneumoniae CWL029
uaggagaaaucacacuuaaag

SEQ ID NO: 2519752 - RNA, 13 nt, Chlamydophila pneumoniae CWL029
uaggagaagcccc

SEQ ID NO: 2519753 - RNA, 18 nt, Chlamydophila pneumoniae CWL029
uaggagagcuugguuuuc

SEQ ID NO: 2519754 - RNA, 21 nt, Chlamydophila pneumoniae CWL029
uaggagagcuugguuuucucc

SEQ ID NO: 2519755 - RNA, 23 nt, Chlamydophila pneumoniae CWL029
uaggagagcuugguuuucuccuu

SEQ ID NO: 2519756 - RNA, 21 nt, Chlamydophila pneumoniae CWL029
uaggagggguaaaccaauuga

SEQ ID NO: 2519757 - RNA, 14 nt, Chlamydophila pneumoniae CWL029
uaggauaagaaauu

SEQ ID NO: 2519758 - RNA, 17 nt, Chlamydophila pneumoniae CWL029
uaggauaagaaauuaaa

SEQ ID NO: 2519759 - RNA, 12 nt, Chlamydophila pneumoniae CWL029
uaggaucccuga

SEQ ID NO: 2519760 - RNA, 20 nt, Chlamydophila pneumoniae CWL029
uaggaucccugauuccuugg

SEQ ID NO: 2519761 - RNA, 13 nt, Chlamydophila pneumoniae CWL029
uaggaucucucuu

SEQ ID NO: 2519762 - RNA, 16 nt, Chlamydophila pneumoniae CWL029
uaggaucugacuuccc

SEQ ID NO: 2519763 - RNA, 19 nt, Chlamydophila pneumoniae CWL029
uaggauucaguuccucauc

SEQ ID NO: 2519764 - RNA, 14 nt, Chlamydophila pneumoniae CWL029
uaggauuuagacua

SEQ ID NO: 2519765 - RNA, 18 nt, Chlamydophila pneumoniae CWL029
uaggauuugcauagaggg

SEQ ID NO: 2519766 - RNA, 22 nt, Chlamydophila pneumoniae CWL029
uaggcaagauuaugaugccuca

SEQ ID NO: 2519767 - RNA, 19 nt, Chlamydophila pneumoniae CWL029
uaggcacaucauuaucaua

SEQ ID NO: 2519768 - RNA, 16 nt, Chlamydophila pneumoniae CWL029
uaggcagauagacaac

SEQ ID NO: 2519769 - RNA, 22 nt, Chlamydophila pneumoniae CWL029
uaggcaguggcucuauagggga

SEQ ID NO: 2519770 - RNA, 16 nt, Chlamydophila pneumoniae CWL029
uaggcauacaguagaa

SEQ ID NO: 2519771 - RNA, 13 nt, Chlamydophila pneumoniae CWL029
uaggcauuaauaa

SEQ ID NO: 2519772 - RNA, 12 nt, Chlamydophila pneumoniae CWL029
uaggcccaagaa

SEQ ID NO: 2519773 - RNA, 20 nt, Chlamydophila pneumoniae CWL029
uaggcccugacuuagagucu

SEQ ID NO: 2519774 - RNA, 17 nt, Chlamydophila pneumoniae CWL029
uaggccgggauuuuaau

SEQ ID NO: 2519775 - RNA, 23 nt, Chlamydophila pneumoniae CWL029
uaggcuuuuuucuauuuucagga

SEQ ID NO: 2519776 - RNA, 14 nt, Chlamydophila pneumoniae CWL029
uagggaaaaaguag

SEQ ID NO: 2519777 - RNA, 19 nt, Chlamydophila pneumoniae CWL029
uagggaacaaaaaagccaa

SEQ ID NO: 2519778 - RNA, 16 nt, Chlamydophila pneumoniae CWL029
uagggaagaaauuaac

SEQ ID NO: 2519779 - RNA, 18 nt, Chlamydophila pneumoniae CWL029
uagggacuucucaaagac

SEQ ID NO: 2519780 - RNA, 21 nt, Chlamydophila pneumoniae CWL029
uagggacuucucaaagacaau

SEQ ID NO: 2519781 - RNA, 16 nt, Chlamydophila pneumoniae CWL029
uagggagugaggaauc

SEQ ID NO: 2519782 - RNA, 22 nt, Chlamydophila pneumoniae CWL029
uagggcaggcggaaaggaagga

SEQ ID NO: 2519783 - RNA, 22 nt, Chlamydophila pneumoniae CWL029
uaggggagguaaaauaaagagc

SEQ ID NO: 2519784 - RNA, 23 nt, Chlamydophila pneumoniae CWL029
uagggguagugaucugcagcaag

SEQ ID NO: 2519785 - RNA, 16 nt, Chlamydophila pneumoniae CWL029
uaggguaaagaaauau

SEQ ID NO: 2519786 - RNA, 13 nt, Chlamydophila pneumoniae CWL029
uaggguucucaaa

SEQ ID NO: 2519787 - RNA, 18 nt, Chlamydophila pneumoniae CWL029
uaggguuugcaugccuau

SEQ ID NO: 2519788 - RNA, 17 nt, Chlamydophila pneumoniae CWL029
uagguacgcuuuuucuu

SEQ ID NO: 2519789 - RNA, 17 nt, Chlamydophila pneumoniae CWL029
uagguagauagaaauuc

SEQ ID NO: 2519790 - RNA, 23 nt, Chlamydophila pneumoniae CWL029
uagguaucagcaagaucuaacuu

SEQ ID NO: 2519791 - RNA, 19 nt, Chlamydophila pneumoniae CWL029
uagguaugagcuccaaaau

SEQ ID NO: 2519792 - RNA, 22 nt, Chlamydophila pneumoniae CWL029
uagguccguuuuuucagaugau

SEQ ID NO: 2519793 - RNA, 21 nt, Chlamydophila pneumoniae CWL029
uaggucuaauccccaauuaua

SEQ ID NO: 2519794 - RNA, 14 nt, Chlamydophila pneumoniae CWL029
uaggucucuugcca

SEQ ID NO: 2519795 - RNA, 19 nt, Chlamydophila pneumoniae CWL029
uaggucuuaaaguagccau

SEQ ID NO: 2519796 - RNA, 22 nt, Chlamydophila pneumoniae CWL029
uaggugaaauauugaucuuucc

SEQ ID NO: 2519797 - RNA, 22 nt, Chlamydophila pneumoniae CWL029
uaggugauauuuucuugucucu

SEQ ID NO: 2519798 - RNA, 19 nt, Chlamydophila pneumoniae CWL029
uaggugccugaagauggca

SEQ ID NO: 2519799 - RNA, 18 nt, Chlamydophila pneumoniae CWL029
uagguuaagccaaucccu

SEQ ID NO: 2519800 - RNA, 22 nt, Chlamydophila pneumoniae CWL029
uagguucuuuucggaucagaau

SEQ ID NO: 2519801 - RNA, 13 nt, Chlamydophila pneumoniae CWL029
uagguuucaggaa

SEQ ID NO: 2519802 - RNA, 17 nt, Chlamydophila pneumoniae CWL029
uaguaaaauaagaaauc

SEQ ID NO: 2519803 - RNA, 22 nt, Chlamydophila pneumoniae CWL029
uaguaaagcauuggacaacgcu

SEQ ID NO: 2519804 - RNA, 20 nt, Chlamydophila pneumoniae CWL029
uaguaaaugccucuuucaua

SEQ ID NO: 2519805 - RNA, 15 nt, Chlamydophila pneumoniae CWL029
uaguaaggagagacu

SEQ ID NO: 2519806 - RNA, 19 nt, Chlamydophila pneumoniae CWL029
uaguaaggagagacugugu

SEQ ID NO: 2519807 - RNA, 22 nt, Chlamydophila pneumoniae CWL029
uaguaauaucuccgccauaaca

SEQ ID NO: 2519808 - RNA, 12 nt, Chlamydophila pneumoniae CWL029
guuuucuuaucc

SEQ ID NO: 2519809 - RNA, 12 nt, Chlamydophila pneumoniae CWL029
guuuucuuuucu

SEQ ID NO: 2519810 - RNA, 17 nt, Chlamydophila pneumoniae CWL029
guuuucuuuucugaaga

SEQ ID NO: 2519811 - RNA, 20 nt, Chlamydophila pneumoniae CWL029
guuuugauucccuccuuccu

SEQ ID NO: 2519812 - RNA, 23 nt, Chlamydophila pneumoniae CWL029
guuuugauucccuccuuccuuaa

SEQ ID NO: 2519813 - RNA, 22 nt, Chlamydophila pneumoniae CWL029
guuuugauuuugcagugauaaa

SEQ ID NO: 2519814 - RNA, 22 nt, Chlamydophila pneumoniae CWL029
guuuugcuuuuugaaugaucca

SEQ ID NO: 2519815 - RNA, 15 nt, Chlamydophila pneumoniae CWL029
guuuuggauagaagc

SEQ ID NO: 2519816 - RNA, 18 nt, Chlamydophila pneumoniae CWL029
guuuuguuucaucuucuu

SEQ ID NO: 2519817 - RNA, 15 nt, Chlamydophila pneumoniae CWL029
guuuuuaauuuucug

SEQ ID NO: 2519818 - RNA, 20 nt, Chlamydophila pneumoniae CWL029
guuuuuacauguaaacaaaa

SEQ ID NO: 2519819 - RNA, 16 nt, Chlamydophila pneumoniae CWL029
guuuuuauuuuuaaau

SEQ ID NO: 2519820 - RNA, 16 nt, Chlamydophila pneumoniae CWL029
guuuuugcuguuucuu

SEQ ID NO: 2519821 - RNA, 22 nt, Chlamydophila pneumoniae CWL029
guuuuuggaaaaagccuuucuu

SEQ ID NO: 2519822 - RNA, 14 nt, Chlamydophila pneumoniae CWL029
guuuuuucaauccu

SEQ ID NO: 2519823 - RNA, 16 nt, Chlamydophila pneumoniae CWL029
uaaaaaaacccucaaa

SEQ ID NO: 2519824 - RNA, 17 nt, Chlamydophila pneumoniae CWL029
uaaaaaaagacaagaga

SEQ ID NO: 2519825 - RNA, 18 nt, Chlamydophila pneumoniae CWL029
uaaaaaaagcuagucuuu

SEQ ID NO: 2519826 - RNA, 19 nt, Chlamydophila pneumoniae CWL029
uaaaaaacuuccuaacuau

SEQ ID NO: 2519827 - RNA, 11 nt, Chlamydophila pneumoniae CWL029
uaaaaaagaga

SEQ ID NO: 2519828 - RNA, 23 nt, Chlamydophila pneumoniae CWL029
uaaaaaagggaugaagauaaaau

SEQ ID NO: 2519829 - RNA, 19 nt, Chlamydophila pneumoniae CWL029
uaaaaaauacaggaaucuc

SEQ ID NO: 2519830 - RNA, 15 nt, Chlamydophila pneumoniae CWL029
uaaaaaauuaucucc

SEQ ID NO: 2519831 - RNA, 21 nt, Chlamydophila pneumoniae CWL029
uaaaaaauuaucuccaaagau

SEQ ID NO: 2519832 - RNA, 19 nt, Chlamydophila pneumoniae CWL029
uaaaaacuucccaucuugu

SEQ ID NO: 2519833 - RNA, 20 nt, Chlamydophila pneumoniae CWL029
uaaaaaguuuuuguucaucc

SEQ ID NO: 2519834 - RNA, 21 nt, Chlamydophila pneumoniae CWL029
uaaaaauaccaagaugucucc

SEQ ID NO: 2519835 - RNA, 16 nt, Chlamydophila pneumoniae CWL029
uaaaaauaggagaagc

SEQ ID NO: 2519836 - RNA, 18 nt, Chlamydophila pneumoniae CWL029
uaaaaauaggagaagccc

SEQ ID NO: 2519837 - RNA, 13 nt, Chlamydophila pneumoniae CWL029
uaaaaauauaucu

SEQ ID NO: 2519838 - RNA, 23 nt, Chlamydophila pneumoniae CWL029
uaaaaauggcacuugagcacauu

SEQ ID NO: 2519839 - RNA, 16 nt, Chlamydophila pneumoniae CWL029
uaaaacaauuuccugc

SEQ ID NO: 2519840 - RNA, 16 nt, Chlamydophila pneumoniae CWL029
uaaaacacaaauagca

SEQ ID NO: 2519841 - RNA, 19 nt, Chlamydophila pneumoniae CWL029
uaaaacacaaauagcaaga

SEQ ID NO: 2519842 - RNA, 13 nt, Chlamydophila pneumoniae CWL029
uaaaacagaaauu

SEQ ID NO: 2519843 - RNA, 20 nt, Chlamydophila pneumoniae CWL029
uaaaacagccuagcaaaacu

SEQ ID NO: 2519844 - RNA, 21 nt, Chlamydophila pneumoniae CWL029
uaaaacaucagcaacauaaag

SEQ ID NO: 2519845 - RNA, 23 nt, Chlamydophila pneumoniae CWL029
uaaaaccacagaaugauaagaaa

SEQ ID NO: 2519846 - RNA, 21 nt, Chlamydophila pneumoniae CWL029
uaaaacccauguuucuuccug

SEQ ID NO: 2519847 - RNA, 22 nt, Chlamydophila pneumoniae CWL029
uaaaagaaagaaugacacagag

SEQ ID NO: 2519848 - RNA, 24 nt, Chlamydophila pneumoniae CWL029
uaaaagaaagaaugacacagagaa

SEQ ID NO: 2519849 - RNA, 23 nt, Chlamydophila pneumoniae CWL029
uaaaagaacgucaccauuaaauu

SEQ ID NO: 2519850 - RNA, 16 nt, Chlamydophila pneumoniae CWL029
uaaaagagcucaaaaa

SEQ ID NO: 2519851 - RNA, 14 nt, Chlamydophila pneumoniae CWL029
uaaaagauuccuua

SEQ ID NO: 2519852 - RNA, 18 nt, Chlamydophila pneumoniae CWL029
uaaaagcacuuaaaaaac

SEQ ID NO: 2519853 - RNA, 20 nt, Chlamydophila pneumoniae CWL029
uaaaagcuuaucccauaaau

SEQ ID NO: 2519854 - RNA, 18 nt, Chlamydophila pneumoniae CWL029
uaaaagguauuucucucc

SEQ ID NO: 2519855 - RNA, 17 nt, Chlamydophila pneumoniae CWL029
uaaaaguagcauccugu

SEQ ID NO: 2519856 - RNA, 16 nt, Chlamydophila pneumoniae CWL029
uaaaaguuagguagau

SEQ ID NO: 2519857 - RNA, 21 nt, Chlamydophila pneumoniae CWL029
uaaaaguuagguagauagaaa

SEQ ID NO: 2519858 - RNA, 23 nt, Chlamydophila pneumoniae CWL029
uaaaaguuagguagauagaaauu

SEQ ID NO: 2519859 - RNA, 20 nt, Chlamydophila pneumoniae CWL029
uaaaaguuccaaaucucaau

SEQ ID NO: 2519860 - RNA, 23 nt, Chlamydophila pneumoniae CWL029
uaaaaguuuuuuauuuucuggug

SEQ ID NO: 2519861 - RNA, 15 nt, Chlamydophila pneumoniae CWL029
uaaaauaaagagcug

SEQ ID NO: 2519862 - RNA, 22 nt, Chlamydophila pneumoniae CWL029
uaaaauaaccccuccaaaauca

SEQ ID NO: 2519863 - RNA, 13 nt, Chlamydophila pneumoniae CWL029
uaaaauagacauu

SEQ ID NO: 2519864 - RNA, 13 nt, Chlamydophila pneumoniae CWL029
uaaaauagcccua

SEQ ID NO: 2519865 - RNA, 15 nt, Chlamydophila pneumoniae CWL029
uaaaauagcccuaga

SEQ ID NO: 2519866 - RNA, 20 nt, Chlamydophila pneumoniae CWL029
uaaaauauuaaauucaaaau

SEQ ID NO: 2519867 - RNA, 20 nt, Chlamydophila pneumoniae CWL029
uaaaaucaagccacagagaa

SEQ ID NO: 2519868 - RNA, 15 nt, Chlamydophila pneumoniae CWL029
uaaaaucauaggcua

SEQ ID NO: 2519869 - RNA, 17 nt, Chlamydophila pneumoniae CWL029
uaaaaucauaggcuaua

SEQ ID NO: 2519870 - RNA, 14 nt, Chlamydophila pneumoniae CWL029
uaaaaucuccucuc

SEQ ID NO: 2519871 - RNA, 10 nt, Chlamydophila pneumoniae CWL029
uaaaaucuuc

SEQ ID NO: 2519872 - RNA, 19 nt, Chlamydophila pneumoniae CWL029
uaaaaucuucuggagggag

SEQ ID NO: 2519873 - RNA, 14 nt, Chlamydophila pneumoniae CWL029
uaaaaucuuucaau

SEQ ID NO: 2519874 - RNA, 22 nt, Chlamydophila pneumoniae CWL029
uaaaaugauuuggccaacagug

SEQ ID NO: 2519875 - RNA, 19 nt, Chlamydophila pneumoniae CWL029
uaaaaugggaucagaaaau

SEQ ID NO: 2519876 - RNA, 23 nt, Chlamydophila pneumoniae CWL029
uaaaauggguuugcuuuucauuu

SEQ ID NO: 2519877 - RNA, 19 nt, Chlamydophila pneumoniae CWL029
uaaaauggugaagaauaau

SEQ ID NO: 2519878 - RNA, 21 nt, Chlamydophila pneumoniae CWL029
uaaaauggugaagaauaauag

SEQ ID NO: 2519879 - RNA, 18 nt, Chlamydophila pneumoniae CWL029
uaaaaugugucuugcuga

SEQ ID NO: 2519880 - RNA, 20 nt, Chlamydophila pneumoniae CWL029
uaaaauucugaagauauauu

SEQ ID NO: 2519881 - RNA, 15 nt, Chlamydophila pneumoniae CWL029
uaaaauugaaaucuu

SEQ ID NO: 2519882 - RNA, 16 nt, Chlamydophila pneumoniae CWL029
uaaaauuuaaaaaaau

SEQ ID NO: 2519883 - RNA, 23 nt, Chlamydophila pneumoniae CWL029
uaaaauuucuaggacagcacaua

SEQ ID NO: 2519884 - RNA, 20 nt, Chlamydophila pneumoniae CWL029
uaaacaaagcgucuaucuag

SEQ ID NO: 2519885 - RNA, 23 nt, Chlamydophila pneumoniae CWL029
uaaacagcacaggcauggucucc

SEQ ID NO: 2519886 - RNA, 14 nt, Chlamydophila pneumoniae CWL029
uaaacauaaagacc

SEQ ID NO: 2519887 - RNA, 17 nt, Chlamydophila pneumoniae CWL029
uaaacaucgcagcagga

SEQ ID NO: 2519888 - RNA, 18 nt, Chlamydophila pneumoniae CWL029
uaaacccuucaagcaaau

SEQ ID NO: 2519889 - RNA, 19 nt, Chlamydophila pneumoniae CWL029
uaaaccuggcauugccaua

SEQ ID NO: 2519890 - RNA, 15 nt, Chlamydophila pneumoniae CWL029
uauuccaucacaguu

SEQ ID NO: 2519891 - RNA, 21 nt, Chlamydophila pneumoniae CWL029
uauuccuauaacaacauugca

SEQ ID NO: 2519892 - RNA, 13 nt, Chlamydophila pneumoniae CWL029
uauuccucuuagg

SEQ ID NO: 2519893 - RNA, 17 nt, Chlamydophila pneumoniae CWL029
uauuccuuggauuucuu

SEQ ID NO: 2519894 - RNA, 19 nt, Chlamydophila pneumoniae CWL029
uauuccuuggauuucuucu

SEQ ID NO: 2519895 - RNA, 18 nt, Chlamydophila pneumoniae CWL029
uauucuaagcuuauuucu

SEQ ID NO: 2519896 - RNA, 21 nt, Chlamydophila pneumoniae CWL029
uauucuaaggugcuauuuuaa

SEQ ID NO: 2519897 - RNA, 23 nt, Chlamydophila pneumoniae CWL029
uauucuaaggugcuauuuuaaac

SEQ ID NO: 2519898 - RNA, 15 nt, Chlamydophila pneumoniae CWL029
uauucuagaguugcu

SEQ ID NO: 2519899 - RNA, 13 nt, Chlamydophila pneumoniae CWL029
uauucucaggaac

SEQ ID NO: 2519900 - RNA, 14 nt, Chlamydophila pneumoniae CWL029
uauucucgaaaaau

SEQ ID NO: 2519901 - RNA, 15 nt, Chlamydophila pneumoniae CWL029
uauucugaaauuucu

SEQ ID NO: 2519902 - RNA, 19 nt, Chlamydophila pneumoniae CWL029
uauucugaaauuucugaaa

SEQ ID NO: 2519903 - RNA, 17 nt, Chlamydophila pneumoniae CWL029
uauucugauaaucagag

SEQ ID NO: 2519904 - RNA, 15 nt, Chlamydophila pneumoniae CWL029
uauucuuuuguaauc

SEQ ID NO: 2519905 - RNA, 20 nt, Chlamydophila pneumoniae CWL029
uauugaaaaaucccuguucu

SEQ ID NO: 2519906 - RNA, 19 nt, Chlamydophila pneumoniae CWL029
uauugacuuuggucuucug

SEQ ID NO: 2519907 - RNA, 20 nt, Chlamydophila pneumoniae CWL029
uauugauaaugauuccuaga

SEQ ID NO: 2519908 - RNA, 13 nt, Chlamydophila pneumoniae CWL029
uauugauagcuga

SEQ ID NO: 2519909 - RNA, 19 nt, Chlamydophila pneumoniae CWL029
uauugcggaaauugaauau

SEQ ID NO: 2519910 - RNA, 13 nt, Chlamydophila pneumoniae CWL029
uauugcucuugua

SEQ ID NO: 2519911 - RNA, 14 nt, Chlamydophila pneumoniae CWL029
uauugcucuuguau

SEQ ID NO: 2519912 - RNA, 23 nt, Chlamydophila pneumoniae CWL029
uauugggaagaaacuucucuagg

SEQ ID NO: 2519913 - RNA, 19 nt, Chlamydophila pneumoniae CWL029
uauugggaaugcauuucau

SEQ ID NO: 2519914 - RNA, 19 nt, Chlamydophila pneumoniae CWL029
uauuguguucccucuucuu

SEQ ID NO: 2519915 - RNA, 20 nt, Chlamydophila pneumoniae CWL029
uauuguucuugguguauagu

SEQ ID NO: 2519916 - RNA, 14 nt, Chlamydophila pneumoniae CWL029
uauuguuuuucaau

SEQ ID NO: 2519917 - RNA, 19 nt, Chlamydophila pneumoniae CWL029
uauuuaaauauaaauuuau

SEQ ID NO: 2519918 - RNA, 20 nt, Chlamydophila pneumoniae CWL029
uauuuaccuacagauaugcu

SEQ ID NO: 2519919 - RNA, 16 nt, Chlamydophila pneumoniae CWL029
uauuuacgaaaacauc

SEQ ID NO: 2519920 - RNA, 17 nt, Chlamydophila pneumoniae CWL029
uauuuacgaaaacaucu

SEQ ID NO: 2519921 - RNA, 13 nt, Chlamydophila pneumoniae CWL029
uauuuagagagaa

SEQ ID NO: 2519922 - RNA, 20 nt, Chlamydophila pneumoniae CWL029
uauuuagcauuucucuauga

SEQ ID NO: 2519923 - RNA, 21 nt, Chlamydophila pneumoniae CWL029
uauuucauauaaaguuuccaa

SEQ ID NO: 2519924 - RNA, 12 nt, Chlamydophila pneumoniae CWL029
uauuucuaaaaa

SEQ ID NO: 2519925 - RNA, 15 nt, Chlamydophila pneumoniae CWL029
uauuucuaaaaaaua

SEQ ID NO: 2519926 - RNA, 13 nt, Chlamydophila pneumoniae CWL029
uauuucuauuauu

SEQ ID NO: 2519927 - RNA, 17 nt, Chlamydophila pneumoniae CWL029
uauuucucuaucaucaa

SEQ ID NO: 2519928 - RNA, 12 nt, Chlamydophila pneumoniae CWL029
uauuugaaauag

SEQ ID NO: 2519929 - RNA, 16 nt, Chlamydophila pneumoniae CWL029
uauuugaauaaaggac

SEQ ID NO: 2519930 - RNA, 19 nt, Chlamydophila pneumoniae CWL029
uauuugcaacaaucuuucu

SEQ ID NO: 2519931 - RNA, 21 nt, Chlamydophila pneumoniae CWL029
uauuuggacguacuaagauac

SEQ ID NO: 2519932 - RNA, 14 nt, Chlamydophila pneumoniae CWL029
uauuuuaaagucac

SEQ ID NO: 2519933 - RNA, 12 nt, Chlamydophila pneumoniae CWL029
uauuuuuaaaua

SEQ ID NO: 2519934 - RNA, 14 nt, Chlamydophila pneumoniae CWL029
uauuuuuaaauaaa

SEQ ID NO: 2519935 - RNA, 14 nt, Chlamydophila pneumoniae CWL029
uauuuuuaaauaca

SEQ ID NO: 2519936 - RNA, 20 nt, Chlamydophila pneumoniae CWL029
uauuuuuacuucacucuuuc

SEQ ID NO: 2519937 - RNA, 13 nt, Chlamydophila pneumoniae CWL029
uauuuuuccagaa

SEQ ID NO: 2519938 - RNA, 19 nt, Chlamydophila pneumoniae CWL029
uauuuuuccagaaauggca

SEQ ID NO: 2519939 - RNA, 20 nt, Chlamydophila pneumoniae CWL029
uauuuuuuaagcuaauaaga

SEQ ID NO: 2519940 - RNA, 24 nt, Chlamydophila pneumoniae CWL029
uauuuuuuacguucuuucuuucua

SEQ ID NO: 2519941 - RNA, 15 nt, Chlamydophila pneumoniae CWL029
ucaaaaaacaacgau

SEQ ID NO: 2519942 - RNA, 13 nt, Chlamydophila pneumoniae CWL029
ucaaaaaauacau

SEQ ID NO: 2519943 - RNA, 13 nt, Chlamydophila pneumoniae CWL029
ucaaaaagcuccc

SEQ ID NO: 2519944 - RNA, 11 nt, Chlamydophila pneumoniae CWL029
ucaaaaaguuc

SEQ ID NO: 2519945 - RNA, 13 nt, Chlamydophila pneumoniae CWL029
ucaaaaauucuuc

SEQ ID NO: 2519946 - RNA, 22 nt, Chlamydophila pneumoniae CWL029
ucaaaagucaugaggacugugg

SEQ ID NO: 2519947 - RNA, 16 nt, Chlamydophila pneumoniae CWL029
ucaaaauagaagccac

SEQ ID NO: 2519948 - RNA, 20 nt, Chlamydophila pneumoniae CWL029
ucaaaaucacauuuugguau

SEQ ID NO: 2519949 - RNA, 16 nt, Chlamydophila pneumoniae CWL029
ucaaaauuauccagaa

SEQ ID NO: 2519950 - RNA, 13 nt, Chlamydophila pneumoniae CWL029
ucaaaauuuaaau

SEQ ID NO: 2519951 - RNA, 15 nt, Chlamydophila pneumoniae CWL029
ucaaaauuuaaauau

SEQ ID NO: 2519952 - RNA, 16 nt, Chlamydophila pneumoniae CWL029
ucaaaauuuaaauaua

SEQ ID NO: 2519953 - RNA, 20 nt, Chlamydophila pneumoniae CWL029
ucaaaauuuaaauauagaaa

SEQ ID NO: 2519954 - RNA, 18 nt, Chlamydophila pneumoniae CWL029
ucaaaauuuuuaguaauu

SEQ ID NO: 2519955 - RNA, 24 nt, Chlamydophila pneumoniae CWL029
ucaaaauuuuuaguaauuacagcu

SEQ ID NO: 2519956 - RNA, 20 nt, Chlamydophila pneumoniae CWL029
ucaaaccacggauuuucucu

SEQ ID NO: 2519957 - RNA, 17 nt, Chlamydophila pneumoniae CWL029
ucaaacccucuccagaa

SEQ ID NO: 2519958 - RNA, 18 nt, Chlamydophila pneumoniae CWL029
ucaaacccucuccagaag

SEQ ID NO: 2519959 - RNA, 16 nt, Chlamydophila pneumoniae CWL029
ucaaacugauuaguuu

SEQ ID NO: 2519960 - RNA, 14 nt, Chlamydophila pneumoniae CWL029
ucaaagaaagugaa

SEQ ID NO: 2519961 - RNA, 20 nt, Chlamydophila pneumoniae CWL029
ucaaagaacugcauaaucuc

SEQ ID NO: 2519962 - RNA, 11 nt, Chlamydophila pneumoniae CWL029
ucaaagaaguc

SEQ ID NO: 2519963 - RNA, 16 nt, Chlamydophila pneumoniae CWL029
ucaaagaauacucuaa

SEQ ID NO: 2519964 - RNA, 14 nt, Chlamydophila pneumoniae CWL029
ucaaagacaggcuc

SEQ ID NO: 2519965 - RNA, 21 nt, Chlamydophila pneumoniae CWL029
ucaaagacucaugaaauagug

SEQ ID NO: 2519966 - RNA, 21 nt, Chlamydophila pneumoniae CWL029
ucaaagauauagauucaugaa

SEQ ID NO: 2519967 - RNA, 17 nt, Chlamydophila pneumoniae CWL029
ucaaagaugcagauacu

SEQ ID NO: 2519968 - RNA, 14 nt, Chlamydophila pneumoniae CWL029
ucaaagauuccuaa

SEQ ID NO: 2519969 - RNA, 15 nt, Chlamydophila pneumoniae CWL029
ucaaagauuccuaag

SEQ ID NO: 2519970 - RNA, 16 nt, Chlamydophila pneumoniae CWL029
ucaaagcaaagagcaa

SEQ ID NO: 2519971 - RNA, 21 nt, Chlamydophila pneumoniae CWL029
ucaaaggcaauagcagcagcg

SEQ ID NO: 2519972 - RNA, 15 nt, Chlamydophila pneumoniae CWL029
ucaaaguauauauuu

SEQ ID NO: 2519973 - RNA, 18 nt, Chlamydophila pneumoniae CWL029
ucaaauagauuuuuacuu

SEQ ID NO: 2519974 - RNA, 22 nt, Chlamydophila pneumoniae CWL029
ucaaauaggaucucucuuuccu

SEQ ID NO: 2519975 - RNA, 23 nt, Chlamydophila pneumoniae CWL029
ucaaauaggaucucucuuuccuu

SEQ ID NO: 2519976 - RNA, 13 nt, Chlamydophila pneumoniae CWL029
ucaaauaguucau

SEQ ID NO: 2519977 - RNA, 17 nt, Chlamydophila pneumoniae CWL029
ucaaauaguucaucaua

SEQ ID NO: 2519978 - RNA, 23 nt, Chlamydophila pneumoniae CWL029
ucaaauaguucaucauauuuuuc

SEQ ID NO: 2519979 - RNA, 15 nt, Chlamydophila pneumoniae CWL029
ucaaaucaucaaaaa

SEQ ID NO: 2519980 - RNA, 22 nt, Chlamydophila pneumoniae CWL029
ucaaaucucauuccagcaucuu

SEQ ID NO: 2519981 - RNA, 18 nt, Chlamydophila pneumoniae CWL029
ucaaaucuuucaaggaac

SEQ ID NO: 2519982 - RNA, 22 nt, Chlamydophila pneumoniae CWL029
ucaaaucuuucaaggaacauuu

SEQ ID NO: 2519983 - RNA, 15 nt, Chlamydophila pneumoniae CWL029
ucaaauuccuucuca

SEQ ID NO: 2519984 - RNA, 12 nt, Chlamydophila pneumoniae CWL029
ucaaauucugaa

SEQ ID NO: 2519985 - RNA, 21 nt, Chlamydophila pneumoniae CWL029
ucaaauuggaauucgcauuuu

SEQ ID NO: 2519986 - RNA, 19 nt, Chlamydophila pneumoniae CWL029
ucaacacccggcuuuucca

SEQ ID NO: 2519987 - RNA, 13 nt, Chlamydophila pneumoniae CWL029
ucaacauucuucu

SEQ ID NO: 2519988 - RNA, 23 nt, Chlamydophila pneumoniae CWL029
ucaacauucuucugucuguauuu

SEQ ID NO: 2519989 - RNA, 20 nt, Chlamydophila pneumoniae CWL029
ucaaccaaacgucaggcucc

SEQ ID NO: 2519990 - RNA, 16 nt, Chlamydophila pneumoniae CWL029
ucaaccaagguugcuc

SEQ ID NO: 2519991 - RNA, 15 nt, Chlamydophila pneumoniae CWL029
ucaaccauaaagaau

SEQ ID NO: 2519992 - RNA, 13 nt, Chlamydophila pneumoniae CWL029
ucaacccagcugc

SEQ ID NO: 2519993 - RNA, 16 nt, Chlamydophila pneumoniae CWL029
ucaacuacaucuccaa

SEQ ID NO: 2519994 - RNA, 19 nt, Chlamydophila pneumoniae CWL029
ucaacuacaucuccaagcc

SEQ ID NO: 2519995 - RNA, 16 nt, Chlamydophila pneumoniae CWL029
ucaacugguauagacu

SEQ ID NO: 2519996 - RNA, 20 nt, Chlamydophila pneumoniae CWL029
ucaacugguauagacuccuu

SEQ ID NO: 2519997 - RNA, 22 nt, Chlamydophila pneumoniae CWL029
ucaacuuuuuuacuaucuccua

SEQ ID NO: 2519998 - RNA, 11 nt, Chlamydophila pneumoniae CWL029
ucaagaaaugc

SEQ ID NO: 2519999 - RNA, 13 nt, Chlamydophila pneumoniae CWL029
ucaagaacaagag

SEQ ID NO: 2520000 - RNA, 21 nt, Chlamydophila pneumoniae CWL029
ucaagaacaagagcuuguucu

SEQ ID NO: 2520001 - RNA, 18 nt, Chlamydophila pneumoniae CWL029
ucaagaacaguuugcucu

SEQ ID NO: 2520002 - RNA, 15 nt, Chlamydophila pneumoniae CWL029
ucaagaacuccuuug

SEQ ID NO: 2520003 - RNA, 17 nt, Chlamydophila pneumoniae CWL029
ucaagaauaugaacugc

SEQ ID NO: 2520004 - RNA, 19 nt, Chlamydophila pneumoniae CWL029
ucaagaauaugaacugccu

SEQ ID NO: 2520005 - RNA, 23 nt, Chlamydophila pneumoniae CWL029
ucaagaccuaagcucauaagaaa

SEQ ID NO: 2520006 - RNA, 17 nt, Chlamydophila pneumoniae CWL029
ucaagacgacacucaaa

SEQ ID NO: 2520007 - RNA, 20 nt, Chlamydophila pneumoniae CWL029
ucaagagcucguaauccuuc

SEQ ID NO: 2520008 - RNA, 15 nt, Chlamydophila pneumoniae CWL029
ucaagagcuuuuaca

SEQ ID NO: 2520009 - RNA, 18 nt, Chlamydophila pneumoniae CWL029
ucaagaggagugaaagcu

SEQ ID NO: 2520010 - RNA, 20 nt, Chlamydophila pneumoniae CWL029
ucaagaggcuguccuugcag

SEQ ID NO: 2520011 - RNA, 18 nt, Chlamydophila pneumoniae CWL029
ucaagaguaggcaauaca

SEQ ID NO: 2520012 - RNA, 23 nt, Chlamydophila pneumoniae CWL029
ucaagaguuucgaauucaaugag

SEQ ID NO: 2520013 - RNA, 14 nt, Chlamydophila pneumoniae CWL029
ucaagccacagaga

SEQ ID NO: 2520014 - RNA, 15 nt, Chlamydophila pneumoniae CWL029
ucaagccacagagaa

SEQ ID NO: 2520015 - RNA, 16 nt, Chlamydophila pneumoniae CWL029
ucaagccacagagaau

SEQ ID NO: 2520016 - RNA, 21 nt, Chlamydophila pneumoniae CWL029
ucaagcuauagauuuuggaga

SEQ ID NO: 2520017 - RNA, 12 nt, Chlamydophila pneumoniae CWL029
ucaaggcaucua

SEQ ID NO: 2520018 - RNA, 20 nt, Chlamydophila pneumoniae CWL029
ucaaggcaucuucuuugcca

SEQ ID NO: 2520019 - RNA, 15 nt, Chlamydophila pneumoniae CWL029
ucaaggccuauagau

SEQ ID NO: 2520020 - RNA, 21 nt, Chlamydophila pneumoniae CWL029
ucaagguacuuuauagaaagu

SEQ ID NO: 2520021 - RNA, 18 nt, Chlamydophila pneumoniae CWL029
ucaagucgagaaacaaaa

SEQ ID NO: 2520022 - RNA, 14 nt, Chlamydophila pneumoniae CWL029
ucaaguuucuuuug

SEQ ID NO: 2520023 - RNA, 19 nt, Chlamydophila pneumoniae CWL029
ucaauaaccagaagacucc

SEQ ID NO: 2520024 - RNA, 14 nt, Chlamydophila pneumoniae CWL029
ucaauaagaucucg

SEQ ID NO: 2520025 - RNA, 21 nt, Chlamydophila pneumoniae CWL029
ucaauaagcuugccagcagaa

SEQ ID NO: 2520026 - RNA, 13 nt, Chlamydophila pneumoniae CWL029
ucaauaaguagau

SEQ ID NO: 2520027 - RNA, 21 nt, Chlamydophila pneumoniae CWL029
ucaauaaguagauuaaaggca

SEQ ID NO: 2520028 - RNA, 23 nt, Chlamydophila pneumoniae CWL029
ucaauaauuucaaagaugcagau

SEQ ID NO: 2520029 - RNA, 16 nt, Chlamydophila pneumoniae CWL029
ucaauacgaucuuuug

SEQ ID NO: 2520030 - RNA, 13 nt, Chlamydophila pneumoniae CWL029
ucaauagcaaaga

SEQ ID NO: 2520031 - RNA, 18 nt, Chlamydophila pneumoniae CWL029
ucaauagguaaggaaacg

SEQ ID NO: 2520032 - RNA, 14 nt, Chlamydophila pneumoniae CWL029
ucaaucaaauucaa

SEQ ID NO: 2520033 - RNA, 15 nt, Chlamydophila pneumoniae CWL029
ucaauccaacaaaga

SEQ ID NO: 2520034 - RNA, 13 nt, Chlamydophila pneumoniae CWL029
ucaauccaagaau

SEQ ID NO: 2520035 - RNA, 20 nt, Chlamydophila pneumoniae CWL029
ucaauccccugcaucucugc

SEQ ID NO: 2520036 - RNA, 15 nt, Chlamydophila pneumoniae CWL029
ucaaugaagaaaaau

SEQ ID NO: 2520037 - RNA, 18 nt, Chlamydophila pneumoniae CWL029
ucaaugaagaaaaaucua

SEQ ID NO: 2520038 - RNA, 16 nt, Chlamydophila pneumoniae CWL029
ucaaugagaucugcaa

SEQ ID NO: 2520039 - RNA, 22 nt, Chlamydophila pneumoniae CWL029
ucaaugagcaucugagucauaa

SEQ ID NO: 2520040 - RNA, 14 nt, Chlamydophila pneumoniae CWL029
ucaaugccuugcgu

SEQ ID NO: 2520041 - RNA, 18 nt, Chlamydophila pneumoniae CWL029
ucaauguuaaucuaauuu

SEQ ID NO: 2520042 - RNA, 19 nt, Chlamydophila pneumoniae CWL029
ucaauuaugcccaaggaaa

SEQ ID NO: 2520043 - RNA, 21 nt, Chlamydophila pneumoniae CWL029
ucaauuaugcccaaggaaaaa

SEQ ID NO: 2520044 - RNA, 22 nt, Chlamydophila pneumoniae CWL029
ucaauuaugcccaaggaaaaac

SEQ ID NO: 2520045 - RNA, 12 nt, Chlamydophila pneumoniae CWL029
ucaauuccuuuc

SEQ ID NO: 2520046 - RNA, 20 nt, Chlamydophila pneumoniae CWL029
ucaauucgcucagaaaaugu

SEQ ID NO: 2520047 - RNA, 19 nt, Chlamydophila pneumoniae CWL029
ucaauuuuaccacuuccag

SEQ ID NO: 2520048 - RNA, 15 nt, Chlamydophila pneumoniae CWL029
ucacaaacaacagaa

SEQ ID NO: 2520049 - RNA, 17 nt, Chlamydophila pneumoniae CWL029
ucacaaacaacagaaau

SEQ ID NO: 2520050 - RNA, 11 nt, Chlamydophila pneumoniae CWL029
ucacaaagaau

SEQ ID NO: 2520051 - RNA, 21 nt, Chlamydophila pneumoniae CWL029
ucacaaagaauucagagaaag

SEQ ID NO: 2520052 - RNA, 23 nt, Chlamydophila pneumoniae CWL029
ucacaaaucuuccccuaaaaauu

SEQ ID NO: 2520053 - RNA, 17 nt, Chlamydophila pneumoniae CWL029
ucacaagcaguaacugc

SEQ ID NO: 2520054 - RNA, 15 nt, Chlamydophila pneumoniae CWL029
ucacaagugcauuau

SEQ ID NO: 2520055 - RNA, 22 nt, Chlamydophila pneumoniae CWL029
ucacaauaccaucucuuucuau

SEQ ID NO: 2520056 - RNA, 16 nt, Chlamydophila pneumoniae CWL029
ucacaauauaaaugcu

SEQ ID NO: 2520057 - RNA, 20 nt, Chlamydophila pneumoniae CWL029
ucacaauuuuaaaaucuccu

SEQ ID NO: 2520058 - RNA, 23 nt, Chlamydophila pneumoniae CWL029
ucacaauuuuaaaaucuccucuc

SEQ ID NO: 2520059 - RNA, 17 nt, Chlamydophila pneumoniae CWL029
ucacaccaaauccugca

SEQ ID NO: 2520060 - RNA, 18 nt, Chlamydophila pneumoniae CWL029
ucacacuacauucaggau

SEQ ID NO: 2520061 - RNA, 16 nt, Chlamydophila pneumoniae CWL029
ucacacucguagccuu

SEQ ID NO: 2520062 - RNA, 16 nt, Chlamydophila pneumoniae CWL029
ucacacugcgagagaa

SEQ ID NO: 2520063 - RNA, 20 nt, Chlamydophila pneumoniae CWL029
ucacacuuaaagguaaaacu

SEQ ID NO: 2520064 - RNA, 16 nt, Chlamydophila pneumoniae CWL029
ucacagagucugggau

SEQ ID NO: 2520065 - RNA, 22 nt, Chlamydophila pneumoniae CWL029
ucacagagucugggauguucaa

SEQ ID NO: 2520066 - RNA, 19 nt, Chlamydophila pneumoniae CWL029
ucacagauaccaucaccuu

SEQ ID NO: 2520067 - RNA, 20 nt, Chlamydophila pneumoniae CWL029
ucacagauaccaucaccuuc

SEQ ID NO: 2520068 - RNA, 16 nt, Chlamydophila pneumoniae CWL029
ucacagcauuuucucu

SEQ ID NO: 2520069 - RNA, 17 nt, Chlamydophila pneumoniae CWL029
ucacagcgcugugagga

SEQ ID NO: 2520070 - RNA, 17 nt, Chlamydophila pneumoniae CWL029
ucacagggacaauggca

SEQ ID NO: 2520071 - RNA, 23 nt, Chlamydophila pneumoniae CWL029
ucacaguauuccaucacaguuaa

SEQ ID NO: 2520072 - RNA, 13 nt, Chlamydophila pneumoniae CWL029
ucacauaaaauaa

SEQ ID NO: 2520073 - RNA, 14 nt, Chlamydophila pneumoniae CWL029
ucacauaaaauaau

SEQ ID NO: 2520074 - RNA, 20 nt, Chlamydophila pneumoniae CWL029
ucacauacauucuauucuau

SEQ ID NO: 2520075 - RNA, 22 nt, Chlamydophila pneumoniae CWL029
ucacauacauucuauucuauac

SEQ ID NO: 2520076 - RNA, 13 nt, Chlamydophila pneumoniae CWL029
ucacaucuuucuc

SEQ ID NO: 2520077 - RNA, 21 nt, Chlamydophila pneumoniae CWL029
ucacaucuuucucuaaaauau

SEQ ID NO: 2520078 - RNA, 15 nt, Chlamydophila pneumoniae CWL029
ucacauguuucacuu

SEQ ID NO: 2520079 - RNA, 17 nt, Chlamydophila pneumoniae CWL029
ucacauuccaagaaaaa

SEQ ID NO: 2520080 - RNA, 18 nt, Chlamydophila pneumoniae CWL029
ucacauuccaagaaaaau

SEQ ID NO: 2520081 - RNA, 22 nt, Chlamydophila pneumoniae CWL029
ucacauuugcuuuaacagaagc

SEQ ID NO: 2520082 - RNA, 13 nt, Chlamydophila pneumoniae CWL029
ucacauuuucaug

SEQ ID NO: 2520083 - RNA, 12 nt, Chlamydophila pneumoniae CWL029
ucaccaacuccu

SEQ ID NO: 2520084 - RNA, 15 nt, Chlamydophila pneumoniae CWL029
ucaccaacuccucua

SEQ ID NO: 2520085 - RNA, 20 nt, Chlamydophila pneumoniae CWL029
ucaccacaaaccucuaaaaa

SEQ ID NO: 2520086 - RNA, 18 nt, Chlamydophila pneumoniae CWL029
ucaccgcgcauagcaacu

SEQ ID NO: 2520087 - RNA, 16 nt, Chlamydophila pneumoniae CWL029
ucaccuacaucagacu

SEQ ID NO: 2520088 - RNA, 19 nt, Chlamydophila pneumoniae CWL029
ucaccugagcuauaaucua

SEQ ID NO: 2520089 - RNA, 13 nt, Chlamydophila pneumoniae CWL029
ucaccuuacaucc

SEQ ID NO: 2520090 - RNA, 22 nt, Chlamydophila pneumoniae CWL029
ucaccuuacauccaauuuuguu

SEQ ID NO: 2520091 - RNA, 13 nt, Chlamydophila pneumoniae CWL029
ucaccuuaggcuu

SEQ ID NO: 2520092 - RNA, 13 nt, Chlamydophila pneumoniae CWL029
ucaccuugugaga

SEQ ID NO: 2520093 - RNA, 17 nt, Chlamydophila pneumoniae CWL029
ucacgaggagcuuuuac

SEQ ID NO: 2520094 - RNA, 20 nt, Chlamydophila pneumoniae CWL029
ucacgaggagcuuuuaccuu

SEQ ID NO: 2520095 - RNA, 21 nt, Chlamydophila pneumoniae CWL029
ucacgagucccuucuuucaau

SEQ ID NO: 2520096 - RNA, 16 nt, Chlamydophila pneumoniae CWL029
ucacgcaccauuccuu

SEQ ID NO: 2520097 - RNA, 15 nt, Chlamydophila pneumoniae CWL029
ucacgcucucgcuaa

SEQ ID NO: 2520098 - RNA, 14 nt, Chlamydophila pneumoniae CWL029
ucacguaagguguc

SEQ ID NO: 2520099 - RNA, 21 nt, Chlamydophila pneumoniae CWL029
ucacguucugcaacaaguugc

SEQ ID NO: 2520100 - RNA, 15 nt, Chlamydophila pneumoniae CWL029
ucacuaagauaucuc

SEQ ID NO: 2520101 - RNA, 13 nt, Chlamydophila pneumoniae CWL029
ucacuacccugcc

SEQ ID NO: 2520102 - RNA, 17 nt, Chlamydophila pneumoniae CWL029
ucacuagagaaaaagcc

SEQ ID NO: 2520103 - RNA, 16 nt, Chlamydophila pneumoniae CWL029
ucacuaucuucuaaaa

SEQ ID NO: 2520104 - RNA, 17 nt, Chlamydophila pneumoniae CWL029
ucacuaucuucuaaaac

SEQ ID NO: 2520105 - RNA, 13 nt, Chlamydophila pneumoniae CWL029
ucacuauuaauac

SEQ ID NO: 2520106 - RNA, 19 nt, Chlamydophila pneumoniae CWL029
ucacucguugccaaucuuu

SEQ ID NO: 2520107 - RNA, 18 nt, Chlamydophila pneumoniae CWL029
ucacucuagaaaauauuc

SEQ ID NO: 2520108 - RNA, 13 nt, Chlamydophila pneumoniae CWL029
ucacucuuuaaaa

SEQ ID NO: 2520109 - RNA, 14 nt, Chlamydophila pneumoniae CWL029
ucacucuuuaaaaa

SEQ ID NO: 2520110 - RNA, 12 nt, Chlamydophila pneumoniae CWL029
ucacucuuuuau

SEQ ID NO: 2520111 - RNA, 13 nt, Chlamydophila pneumoniae CWL029
ucacucuuuuauu

SEQ ID NO: 2520112 - RNA, 18 nt, Chlamydophila pneumoniae CWL029
ucacuguuuuucguaagc

SEQ ID NO: 2520113 - RNA, 22 nt, Chlamydophila pneumoniae CWL029
ucacuguuuuucguaagcugag

SEQ ID NO: 2520114 - RNA, 18 nt, Chlamydophila pneumoniae CWL029
ucacuuaauaauguuuua

SEQ ID NO: 2520115 - RNA, 17 nt, Chlamydophila pneumoniae CWL029
ucacuuauaagcugcuu

SEQ ID NO: 2520116 - RNA, 16 nt, Chlamydophila pneumoniae CWL029
ucacuucaucgacagu

SEQ ID NO: 2520117 - RNA, 16 nt, Chlamydophila pneumoniae CWL029
ucacuucugaugacgu

SEQ ID NO: 2520118 - RNA, 16 nt, Chlamydophila pneumoniae CWL029
ucagaaagccuuugcu

SEQ ID NO: 2520119 - RNA, 21 nt, Chlamydophila pneumoniae CWL029
ucagaaauuccuaaaauuucc

SEQ ID NO: 2520120 - RNA, 18 nt, Chlamydophila pneumoniae CWL029
ucagaacaacgcugcuuc

SEQ ID NO: 2520121 - RNA, 23 nt, Chlamydophila pneumoniae CWL029
ucagaacaacgcugcuucucuac

SEQ ID NO: 2520122 - RNA, 13 nt, Chlamydophila pneumoniae CWL029
ucagaacaagaag

SEQ ID NO: 2520123 - RNA, 19 nt, Chlamydophila pneumoniae CWL029
ucagaacaagaaguaggaa

SEQ ID NO: 2520124 - RNA, 13 nt, Chlamydophila pneumoniae CWL029
ucagaagcuauuc

SEQ ID NO: 2520125 - RNA, 17 nt, Chlamydophila pneumoniae CWL029
ucagaagcuccugagua

SEQ ID NO: 2520126 - RNA, 16 nt, Chlamydophila pneumoniae CWL029
ucagaagugaucuuga

SEQ ID NO: 2520127 - RNA, 19 nt, Chlamydophila pneumoniae CWL029
ucagaauccauuuugccca

SEQ ID NO: 2520128 - RNA, 20 nt, Chlamydophila pneumoniae CWL029
ucagaauccauuuugcccac

SEQ ID NO: 2520129 - RNA, 20 nt, Chlamydophila pneumoniae CWL029
ucagaauccugaguaaaauc

SEQ ID NO: 2520130 - RNA, 21 nt, Chlamydophila pneumoniae CWL029
ucagaaugcccuuuagggaau

SEQ ID NO: 2520131 - RNA, 15 nt, Chlamydophila pneumoniae CWL029
ucagacuuaaaguac

SEQ ID NO: 2520132 - RNA, 17 nt, Chlamydophila pneumoniae CWL029
ucagagacaaguucauc

SEQ ID NO: 2520133 - RNA, 20 nt, Chlamydophila pneumoniae CWL029
ucagagacaaguucaucaaa

SEQ ID NO: 2520134 - RNA, 16 nt, Chlamydophila pneumoniae CWL029
ucagagauugccagga

SEQ ID NO: 2520135 - RNA, 21 nt, Chlamydophila pneumoniae CWL029
ucagaggaaucuaagaacuag

SEQ ID NO: 2520136 - RNA, 20 nt, Chlamydophila pneumoniae CWL029
ucagaggagccuccauaaug

SEQ ID NO: 2520137 - RNA, 15 nt, Chlamydophila pneumoniae CWL029
ucagaggcuagaaaa

SEQ ID NO: 2520138 - RNA, 17 nt, Chlamydophila pneumoniae CWL029
ucagaguugucaaguaa

SEQ ID NO: 2520139 - RNA, 16 nt, Chlamydophila pneumoniae CWL029
ucagauaaaaagaagu

SEQ ID NO: 2520140 - RNA, 16 nt, Chlamydophila pneumoniae CWL029
ucagauaaucuucgau

SEQ ID NO: 2520141 - RNA, 15 nt, Chlamydophila pneumoniae CWL029
ucagauccaugaaca

SEQ ID NO: 2520142 - RNA, 17 nt, Chlamydophila pneumoniae CWL029
ucagaugucuagaaaag

SEQ ID NO: 2520143 - RNA, 14 nt, Chlamydophila pneumoniae CWL029
ucagauuagaguua

SEQ ID NO: 2520144 - RNA, 18 nt, Chlamydophila pneumoniae CWL029
ucagcaaaaaacugcaaa

SEQ ID NO: 2520145 - RNA, 17 nt, Chlamydophila pneumoniae CWL029
ucagcaaacggagagca

SEQ ID NO: 2520146 - RNA, 14 nt, Chlamydophila pneumoniae CWL029
ucagcaaagaaguu

SEQ ID NO: 2520147 - RNA, 21 nt, Chlamydophila pneumoniae CWL029
ucagcaaccuuuccuaaaaua

SEQ ID NO: 2520148 - RNA, 14 nt, Chlamydophila pneumoniae CWL029
ucagcaagcccucc

SEQ ID NO: 2520149 - RNA, 15 nt, Chlamydophila pneumoniae CWL029
ucagcaagucgguaa

SEQ ID NO: 2520150 - RNA, 23 nt, Chlamydophila pneumoniae CWL029
ucagcacccaccauucuugaaga

SEQ ID NO: 2520151 - RNA, 19 nt, Chlamydophila pneumoniae CWL029
ucagcaccuuguauaagag

SEQ ID NO: 2520152 - RNA, 21 nt, Chlamydophila pneumoniae CWL029
ucagcaccuuguauaagagca

SEQ ID NO: 2520153 - RNA, 12 nt, Chlamydophila pneumoniae CWL029
ucagcagcuucu

SEQ ID NO: 2520154 - RNA, 17 nt, Chlamydophila pneumoniae CWL029
ucagcagcuucuauugc

SEQ ID NO: 2520155 - RNA, 15 nt, Chlamydophila pneumoniae CWL029
ucagcauagagagaa

SEQ ID NO: 2520156 - RNA, 17 nt, Chlamydophila pneumoniae CWL029
ucagccaagacaaaaaa

SEQ ID NO: 2520157 - RNA, 13 nt, Chlamydophila pneumoniae CWL029
ucagccugucuau

SEQ ID NO: 2520158 - RNA, 19 nt, Chlamydophila pneumoniae CWL029
ucagccugucuauaaaaua

SEQ ID NO: 2520159 - RNA, 20 nt, Chlamydophila pneumoniae CWL029
ucagcgcaucacgaaaagga

SEQ ID NO: 2520160 - RNA, 21 nt, Chlamydophila pneumoniae CWL029
ucagcgcaucacgaaaaggag

SEQ ID NO: 2520161 - RNA, 22 nt, Chlamydophila pneumoniae CWL029
ucagcgcaucacgaaaaggaga

SEQ ID NO: 2520162 - RNA, 16 nt, Chlamydophila pneumoniae CWL029
ucagcucaaguuggca

SEQ ID NO: 2520163 - RNA, 16 nt, Chlamydophila pneumoniae CWL029
ucagcuggguaagucc

SEQ ID NO: 2520164 - RNA, 20 nt, Chlamydophila pneumoniae CWL029
ucagcuuaucuauagcauug

SEQ ID NO: 2520165 - RNA, 18 nt, Chlamydophila pneumoniae CWL029
ucagcuucuacagcaucg

SEQ ID NO: 2520166 - RNA, 19 nt, Chlamydophila pneumoniae CWL029
ucagcuucuugauguacag

SEQ ID NO: 2520167 - RNA, 23 nt, Chlamydophila pneumoniae CWL029
ucaggaaagguaguuuucuucuu

SEQ ID NO: 2520168 - RNA, 16 nt, Chlamydophila pneumoniae CWL029
ucaggaagaugcugga

SEQ ID NO: 2520169 - RNA, 15 nt, Chlamydophila pneumoniae CWL029
ucaggacaaugaaga

SEQ ID NO: 2520170 - RNA, 17 nt, Chlamydophila pneumoniae CWL029
ucaggacaaugaagaac

SEQ ID NO: 2520171 - RNA, 15 nt, Chlamydophila pneumoniae CWL029
ucaggacaugccuua

SEQ ID NO: 2520172 - RNA, 16 nt, Chlamydophila pneumoniae CWL029
ucaggacccuuuuccu

SEQ ID NO: 2520173 - RNA, 20 nt, Chlamydophila pneumoniae CWL029
ucaggagaccagggaucuuc

SEQ ID NO: 2520174 - RNA, 12 nt, Chlamydophila pneumoniae CWL029
ucaggagauaau

SEQ ID NO: 2520175 - RNA, 19 nt, Chlamydophila pneumoniae CWL029
ucaggagauacaagcaauu

SEQ ID NO: 2520176 - RNA, 20 nt, Chlamydophila pneumoniae CWL029
ucaggaggugguggagcuug

SEQ ID NO: 2520177 - RNA, 22 nt, Chlamydophila pneumoniae CWL029
ucaggauucuaaaaagaaaaga

SEQ ID NO: 2520178 - RNA, 15 nt, Chlamydophila pneumoniae CWL029
ucaggauuuuccauu

SEQ ID NO: 2520179 - RNA, 15 nt, Chlamydophila pneumoniae CWL029
ucaggcauucuucau

SEQ ID NO: 2520180 - RNA, 21 nt, Chlamydophila pneumoniae CWL029
ucaggcuuuaaguguuucuuc

SEQ ID NO: 2520181 - RNA, 22 nt, Chlamydophila pneumoniae CWL029
ucaggcuuuaaguguuucuuca

SEQ ID NO: 2520182 - RNA, 16 nt, Chlamydophila pneumoniae CWL029
ucagguaaagagcuuc

SEQ ID NO: 2520183 - RNA, 15 nt, Chlamydophila pneumoniae CWL029
ucaguaggagcagcg

SEQ ID NO: 2520184 - RNA, 16 nt, Chlamydophila pneumoniae CWL029
ucaguaucaauaaucg

SEQ ID NO: 2520185 - RNA, 16 nt, Chlamydophila pneumoniae CWL029
ucaguauggcguuuuu

SEQ ID NO: 2520186 - RNA, 20 nt, Chlamydophila pneumoniae CWL029
ucagucucgugcauaaugau

SEQ ID NO: 2520187 - RNA, 15 nt, Chlamydophila pneumoniae CWL029
ucagucucucuaucu

SEQ ID NO: 2520188 - RNA, 15 nt, Chlamydophila pneumoniae CWL029
ucaguggauucgugc

SEQ ID NO: 2520189 - RNA, 15 nt, Chlamydophila pneumoniae CWL029
ucaguuaaagagcau

SEQ ID NO: 2520190 - RNA, 21 nt, Chlamydophila pneumoniae CWL029
ucaguuccucauccucaucau

SEQ ID NO: 2520191 - RNA, 22 nt, Chlamydophila pneumoniae CWL029
ucaguuguuucuagaaaaucuc

SEQ ID NO: 2520192 - RNA, 15 nt, Chlamydophila pneumoniae CWL029
ucauaaaaauuucau

SEQ ID NO: 2520193 - RNA, 13 nt, Chlamydophila pneumoniae CWL029
ucauaaagaggaa

SEQ ID NO: 2520194 - RNA, 18 nt, Chlamydophila pneumoniae CWL029
ucauaaagaggaaugaag

SEQ ID NO: 2520195 - RNA, 19 nt, Chlamydophila pneumoniae CWL029
ucauaaagaggaaugaaga

SEQ ID NO: 2520196 - RNA, 20 nt, Chlamydophila pneumoniae CWL029
ucuaaaauaaccccuccaaa

SEQ ID NO: 2520197 - RNA, 12 nt, Chlamydophila pneumoniae CWL029
ucuaaacauaaa

SEQ ID NO: 2520198 - RNA, 19 nt, Chlamydophila pneumoniae CWL029
ucuaaacauaaagacccuu

SEQ ID NO: 2520199 - RNA, 15 nt, Chlamydophila pneumoniae CWL029
ucuaaagaaauguaa

SEQ ID NO: 2520200 - RNA, 20 nt, Chlamydophila pneumoniae CWL029
ucuaaagaaauguaagaagg

SEQ ID NO: 2520201 - RNA, 16 nt, Chlamydophila pneumoniae CWL029
ucuaaagauuucguau

SEQ ID NO: 2520202 - RNA, 18 nt, Chlamydophila pneumoniae CWL029
ucuaaagcugcuuuuucu

SEQ ID NO: 2520203 - RNA, 21 nt, Chlamydophila pneumoniae CWL029
ucuaaaggaagauauccuuuu

SEQ ID NO: 2520204 - RNA, 16 nt, Chlamydophila pneumoniae CWL029
ucuaaagguuuuaaau

SEQ ID NO: 2520205 - RNA, 21 nt, Chlamydophila pneumoniae CWL029
ucuaaauagaaaacauagaga

SEQ ID NO: 2520206 - RNA, 21 nt, Chlamydophila pneumoniae CWL029
ucuaacgcuuuuucaaacugu

SEQ ID NO: 2520207 - RNA, 14 nt, Chlamydophila pneumoniae CWL029
ucuaacucuuguag

SEQ ID NO: 2520208 - RNA, 22 nt, Chlamydophila pneumoniae CWL029
ucuaagaaacuuccaaaacgau

SEQ ID NO: 2520209 - RNA, 15 nt, Chlamydophila pneumoniae CWL029
ucuaagaauauggac

SEQ ID NO: 2520210 - RNA, 15 nt, Chlamydophila pneumoniae CWL029
ucuaagaaucguucu

SEQ ID NO: 2520211 - RNA, 18 nt, Chlamydophila pneumoniae CWL029
ucuaagaaucguucuuag

SEQ ID NO: 2520212 - RNA, 16 nt, Chlamydophila pneumoniae CWL029
ucuaagacuucuggaa

SEQ ID NO: 2520213 - RNA, 19 nt, Chlamydophila pneumoniae CWL029
ucuaagagaucuacaaaca

SEQ ID NO: 2520214 - RNA, 14 nt, Chlamydophila pneumoniae CWL029
ucuaagauauagag

SEQ ID NO: 2520215 - RNA, 14 nt, Chlamydophila pneumoniae CWL029
ucuaagaucuuuug

SEQ ID NO: 2520216 - RNA, 21 nt, Chlamydophila pneumoniae CWL029
ucuaagcugaaagaacacucc

SEQ ID NO: 2520217 - RNA, 20 nt, Chlamydophila pneumoniae CWL029
ucuaagcugugcauuuucuu

SEQ ID NO: 2520218 - RNA, 16 nt, Chlamydophila pneumoniae CWL029
ucuaagcuuauuucug

SEQ ID NO: 2520219 - RNA, 19 nt, Chlamydophila pneumoniae CWL029
ucuaagcuuauuucuguag

SEQ ID NO: 2520220 - RNA, 12 nt, Chlamydophila pneumoniae CWL029
ucuaaggaaauu

SEQ ID NO: 2520221 - RNA, 18 nt, Chlamydophila pneumoniae CWL029
ucuaaggacaaaucuccc

SEQ ID NO: 2520222 - RNA, 20 nt, Chlamydophila pneumoniae CWL029
ucuaaggacaaaucucccaa

SEQ ID NO: 2520223 - RNA, 16 nt, Chlamydophila pneumoniae CWL029
ucuaaggcuuugccuu

SEQ ID NO: 2520224 - RNA, 15 nt, Chlamydophila pneumoniae CWL029
ucuaauacguuuuua

SEQ ID NO: 2520225 - RNA, 19 nt, Chlamydophila pneumoniae CWL029
ucuaaugacagcugagaaa

SEQ ID NO: 2520226 - RNA, 16 nt, Chlamydophila pneumoniae CWL029
ucuaaugguuucccac

SEQ ID NO: 2520227 - RNA, 22 nt, Chlamydophila pneumoniae CWL029
ucuaauuucaggagcuccugcg

SEQ ID NO: 2520228 - RNA, 20 nt, Chlamydophila pneumoniae CWL029
ucuaauuugaugaucgaucc

SEQ ID NO: 2520229 - RNA, 16 nt, Chlamydophila pneumoniae CWL029
ucuacaaaaacuagaa

SEQ ID NO: 2520230 - RNA, 19 nt, Chlamydophila pneumoniae CWL029
ucuacaaacagauuuuuca

SEQ ID NO: 2520231 - RNA, 20 nt, Chlamydophila pneumoniae CWL029
ucuacaaacagauuuuucaa

SEQ ID NO: 2520232 - RNA, 23 nt, Chlamydophila pneumoniae CWL029
ucuacaaugauauaaaagcugaa

SEQ ID NO: 2520233 - RNA, 20 nt, Chlamydophila pneumoniae CWL029
ucuacacuguuguaauaaaa

SEQ ID NO: 2520234 - RNA, 12 nt, Chlamydophila pneumoniae CWL029
ucuacagaauag

SEQ ID NO: 2520235 - RNA, 17 nt, Chlamydophila pneumoniae CWL029
ucuacagaggaaucuau

SEQ ID NO: 2520236 - RNA, 19 nt, Chlamydophila pneumoniae CWL029
ucuacagcuauagaagcug

SEQ ID NO: 2520237 - RNA, 17 nt, Chlamydophila pneumoniae CWL029
ucuacauagauccccuu

SEQ ID NO: 2520238 - RNA, 17 nt, Chlamydophila pneumoniae CWL029
ucuacaucccaagggcc

SEQ ID NO: 2520239 - RNA, 20 nt, Chlamydophila pneumoniae CWL029
ucuacaucccaagggccaga

SEQ ID NO: 2520240 - RNA, 21 nt, Chlamydophila pneumoniae CWL029
ucuacauuugcuauuuucccu

SEQ ID NO: 2520241 - RNA, 22 nt, Chlamydophila pneumoniae CWL029
ucuacauuugcuauuuucccuu

SEQ ID NO: 2520242 - RNA, 18 nt, Chlamydophila pneumoniae CWL029
ucuaccaauucucucucu

SEQ ID NO: 2520243 - RNA, 16 nt, Chlamydophila pneumoniae CWL029
ucuacccccagcuucu

SEQ ID NO: 2520244 - RNA, 21 nt, Chlamydophila pneumoniae CWL029
ucuacccuucagaauucucaa

SEQ ID NO: 2520245 - RNA, 15 nt, Chlamydophila pneumoniae CWL029
ucuacgccaucccau

SEQ ID NO: 2520246 - RNA, 15 nt, Chlamydophila pneumoniae CWL029
ucuacuaaaaucuca

SEQ ID NO: 2520247 - RNA, 17 nt, Chlamydophila pneumoniae CWL029
ucuacuaaaaucucauu

SEQ ID NO: 2520248 - RNA, 22 nt, Chlamydophila pneumoniae CWL029
ucuacucuacaguaguaaauaa

SEQ ID NO: 2520249 - RNA, 23 nt, Chlamydophila pneumoniae CWL029
ucuacugaaaccuucucucuuaa

SEQ ID NO: 2520250 - RNA, 21 nt, Chlamydophila pneumoniae CWL029
ucuagaaaaauucuuuaggga

SEQ ID NO: 2520251 - RNA, 18 nt, Chlamydophila pneumoniae CWL029
ucuagaaaagauucuaaa

SEQ ID NO: 2520252 - RNA, 22 nt, Chlamydophila pneumoniae CWL029
ucuagaaaagauucuaaaucaa

SEQ ID NO: 2520253 - RNA, 19 nt, Chlamydophila pneumoniae CWL029
ucuagaaaauauuccugga

SEQ ID NO: 2520254 - RNA, 17 nt, Chlamydophila pneumoniae CWL029
ucuagaaacaacugaaa

SEQ ID NO: 2520255 - RNA, 23 nt, Chlamydophila pneumoniae CWL029
ucuagaaacaacugaaaaaccau

SEQ ID NO: 2520256 - RNA, 17 nt, Chlamydophila pneumoniae CWL029
ucuagaacacucagaga

SEQ ID NO: 2520257 - RNA, 12 nt, Chlamydophila pneumoniae CWL029
ucuagaagauga

SEQ ID NO: 2520258 - RNA, 14 nt, Chlamydophila pneumoniae CWL029
ucuagaaguuuaaa

SEQ ID NO: 2520259 - RNA, 17 nt, Chlamydophila pneumoniae CWL029
ucuagaaugaugcaagc

SEQ ID NO: 2520260 - RNA, 15 nt, Chlamydophila pneumoniae CWL029
ucuagagauuuuucu

SEQ ID NO: 2520261 - RNA, 20 nt, Chlamydophila pneumoniae CWL029
ucuagauauucugauucucc

SEQ ID NO: 2520262 - RNA, 14 nt, Chlamydophila pneumoniae CWL029
ucuagaucuucaau

SEQ ID NO: 2520263 - RNA, 13 nt, Chlamydophila pneumoniae CWL029
ucuagauuuugag

SEQ ID NO: 2520264 - RNA, 13 nt, Chlamydophila pneumoniae CWL029
ucuagcaaaucua

SEQ ID NO: 2520265 - RNA, 17 nt, Chlamydophila pneumoniae CWL029
ucuagcaaaucuaaaac

SEQ ID NO: 2520266 - RNA, 22 nt, Chlamydophila pneumoniae CWL029
ucuagcaguugcaauaccaauu

SEQ ID NO: 2520267 - RNA, 15 nt, Chlamydophila pneumoniae CWL029
ucuagcuaauaauga

SEQ ID NO: 2520268 - RNA, 13 nt, Chlamydophila pneumoniae CWL029
ucuagcugcucuu

SEQ ID NO: 2520269 - RNA, 19 nt, Chlamydophila pneumoniae CWL029
ucuagcuguuaauucccgu

SEQ ID NO: 2520270 - RNA, 15 nt, Chlamydophila pneumoniae CWL029
ucuagcuuugucucu

SEQ ID NO: 2520271 - RNA, 18 nt, Chlamydophila pneumoniae CWL029
ucuaggacagcacauaga

SEQ ID NO: 2520272 - RNA, 12 nt, Chlamydophila pneumoniae CWL029
ucuaggagcuuc

SEQ ID NO: 2520273 - RNA, 16 nt, Chlamydophila pneumoniae CWL029
ucuaggaucucuagua

SEQ ID NO: 2520274 - RNA, 15 nt, Chlamydophila pneumoniae CWL029
ucuagggucaagaac

SEQ ID NO: 2520275 - RNA, 13 nt, Chlamydophila pneumoniae CWL029
ucuggaaugacua

SEQ ID NO: 2520276 - RNA, 17 nt, Chlamydophila pneumoniae CWL029
ucuggaccuuauaccca

SEQ ID NO: 2520277 - RNA, 17 nt, Chlamydophila pneumoniae CWL029
ucuggauacguuuuucc

SEQ ID NO: 2520278 - RNA, 18 nt, Chlamydophila pneumoniae CWL029
ucuggauacguuuuuccc

SEQ ID NO: 2520279 - RNA, 18 nt, Chlamydophila pneumoniae CWL029
ucuggcugagagaagcag

SEQ ID NO: 2520280 - RNA, 19 nt, Chlamydophila pneumoniae CWL029
ucuggggcuuccagaaaca

SEQ ID NO: 2520281 - RNA, 16 nt, Chlamydophila pneumoniae CWL029
ucugguauagaaacac

SEQ ID NO: 2520282 - RNA, 20 nt, Chlamydophila pneumoniae CWL029
ucuguaagaaaaugaggaca

SEQ ID NO: 2520283 - RNA, 20 nt, Chlamydophila pneumoniae CWL029
ucuguaagaacguggggaaa

SEQ ID NO: 2520284 - RNA, 17 nt, Chlamydophila pneumoniae CWL029
ucuguacaacaaaauuu

SEQ ID NO: 2520285 - RNA, 16 nt, Chlamydophila pneumoniae CWL029
ucuguagguuuuucca

SEQ ID NO: 2520286 - RNA, 14 nt, Chlamydophila pneumoniae CWL029
ucuguaguaaagcc

SEQ ID NO: 2520287 - RNA, 16 nt, Chlamydophila pneumoniae CWL029
ucuguaguuuguucac

SEQ ID NO: 2520288 - RNA, 13 nt, Chlamydophila pneumoniae CWL029
ucuguauccgacu

SEQ ID NO: 2520289 - RNA, 23 nt, Chlamydophila pneumoniae CWL029
ucuguauccuuccuuauugguaa

SEQ ID NO: 2520290 - RNA, 22 nt, Chlamydophila pneumoniae CWL029
ucuguaucgauaacgauuucuu

SEQ ID NO: 2520291 - RNA, 14 nt, Chlamydophila pneumoniae CWL029
ucugucacuagaga

SEQ ID NO: 2520292 - RNA, 22 nt, Chlamydophila pneumoniae CWL029
ucugucauuaaaaauuuaaaag

SEQ ID NO: 2520293 - RNA, 14 nt, Chlamydophila pneumoniae CWL029
ucugugagaaauag

SEQ ID NO: 2520294 - RNA, 16 nt, Chlamydophila pneumoniae CWL029
ucugugcaucagucag

SEQ ID NO: 2520295 - RNA, 18 nt, Chlamydophila pneumoniae CWL029
ugaauagcucuuuucaug

SEQ ID NO: 2520296 - RNA, 13 nt, Chlamydophila pneumoniae CWL029
ugaauauaauucc

SEQ ID NO: 2520297 - RNA, 14 nt, Chlamydophila pneumoniae CWL029
ugaauaucaucacu

SEQ ID NO: 2520298 - RNA, 17 nt, Chlamydophila pneumoniae CWL029
ugaauaugcuuuucaaa

SEQ ID NO: 2520299 - RNA, 12 nt, Chlamydophila pneumoniae CWL029
ugaauauguacu

SEQ ID NO: 2520300 - RNA, 15 nt, Chlamydophila pneumoniae CWL029
ugaaucacaucuaaa

SEQ ID NO: 2520301 - RNA, 21 nt, Chlamydophila pneumoniae CWL029
ugaauccaugggaucucauca

SEQ ID NO: 2520302 - RNA, 23 nt, Chlamydophila pneumoniae CWL029
ugaauccaugggaucucaucaua

SEQ ID NO: 2520303 - RNA, 14 nt, Chlamydophila pneumoniae CWL029
ugaauccuucuaua

SEQ ID NO: 2520304 - RNA, 21 nt, Chlamydophila pneumoniae CWL029
ugaauccuugaaagacucgcu

SEQ ID NO: 2520305 - RNA, 22 nt, Chlamydophila pneumoniae CWL029
ugaaucgaagaacagaggaucu

SEQ ID NO: 2520306 - RNA, 15 nt, Chlamydophila pneumoniae CWL029
ugaaucucuucugua

SEQ ID NO: 2520307 - RNA, 20 nt, Chlamydophila pneumoniae CWL029
ugaaucucuucuguaggaac

SEQ ID NO: 2520308 - RNA, 22 nt, Chlamydophila pneumoniae CWL029
ugaaugaggguggaacuauccu

SEQ ID NO: 2520309 - RNA, 12 nt, Chlamydophila pneumoniae CWL029
ugaaugauuucc

SEQ ID NO: 2520310 - RNA, 15 nt, Chlamydophila pneumoniae CWL029
ugaaugauuuccaua

SEQ ID NO: 2520311 - RNA, 18 nt, Chlamydophila pneumoniae CWL029
ugaaugcaacagagucag

SEQ ID NO: 2520312 - RNA, 19 nt, Chlamydophila pneumoniae CWL029
ugaaugccugccaauccaa

SEQ ID NO: 2520313 - RNA, 17 nt, Chlamydophila pneumoniae CWL029
ugaauggcucugucacu

SEQ ID NO: 2520314 - RNA, 13 nt, Chlamydophila pneumoniae CWL029
ugaauuaaaaguu

SEQ ID NO: 2520315 - RNA, 15 nt, Chlamydophila pneumoniae CWL029
ugaauuaauaaaaga

SEQ ID NO: 2520316 - RNA, 16 nt, Chlamydophila pneumoniae CWL029
ugaauuaauaaaagag

SEQ ID NO: 2520317 - RNA, 19 nt, Chlamydophila pneumoniae CWL029
ugaauuaauaaaagagcuc

SEQ ID NO: 2520318 - RNA, 23 nt, Chlamydophila pneumoniae CWL029
ugaauuacaggcccuaggacgua

SEQ ID NO: 2520319 - RNA, 22 nt, Chlamydophila pneumoniae CWL029
ugaauucucaaggaucuuauau

SEQ ID NO: 2520320 - RNA, 18 nt, Chlamydophila pneumoniae CWL029
ugaauuuccaaaggaaaa

SEQ ID NO: 2520321 - RNA, 19 nt, Chlamydophila pneumoniae CWL029
ugaauuuuagcuccgaggc

SEQ ID NO: 2520322 - RNA, 13 nt, Chlamydophila pneumoniae CWL029
ugacaaacucuau

SEQ ID NO: 2520323 - RNA, 13 nt, Chlamydophila pneumoniae CWL029
ugacaaauuuauc

SEQ ID NO: 2520324 - RNA, 13 nt, Chlamydophila pneumoniae CWL029
uggguucacuccu

SEQ ID NO: 2520325 - RNA, 15 nt, Chlamydophila pneumoniae CWL029
ugguaaggagagucu

SEQ ID NO: 2520326 - RNA, 22 nt, Chlamydophila pneumoniae CWL029
ugguacaauacuggagagguaa

SEQ ID NO: 2520327 - RNA, 17 nt, Chlamydophila pneumoniae CWL029
ugguacggcuaaauaaa

SEQ ID NO: 2520328 - RNA, 19 nt, Chlamydophila pneumoniae CWL029
ugguacggcuaaauaaacc

SEQ ID NO: 2520329 - RNA, 19 nt, Chlamydophila pneumoniae CWL029
ugguagcgucucuucuucc

SEQ ID NO: 2520330 - RNA, 16 nt, Chlamydophila pneumoniae CWL029
ugguagcuaaauuuag

SEQ ID NO: 2520331 - RNA, 21 nt, Chlamydophila pneumoniae CWL029
ugguaggaugucgcuuuugcu

SEQ ID NO: 2520332 - RNA, 20 nt, Chlamydophila pneumoniae CWL029
ugguaguuugccuucuuauc

SEQ ID NO: 2520333 - RNA, 15 nt, Chlamydophila pneumoniae CWL029
ugguaucccaaucga

SEQ ID NO: 2520334 - RNA, 12 nt, Chlamydophila pneumoniae CWL029
ugguaucccuga

SEQ ID NO: 2520335 - RNA, 23 nt, Chlamydophila pneumoniae CWL029
uggucauugccuugcugcauacu

SEQ ID NO: 2520336 - RNA, 18 nt, Chlamydophila pneumoniae CWL029
ugguccauaauuucuuuc

SEQ ID NO: 2520337 - RNA, 19 nt, Chlamydophila pneumoniae CWL029
ugguccauaauuucuuuca

SEQ ID NO: 2520338 - RNA, 23 nt, Chlamydophila pneumoniae CWL029
ugguccauaauuucuuucacauc

SEQ ID NO: 2520339 - RNA, 19 nt, Chlamydophila pneumoniae CWL029
uggucuagagauuuuucua

SEQ ID NO: 2520340 - RNA, 19 nt, Chlamydophila pneumoniae CWL029
uggucucuauuuagaccaa

SEQ ID NO: 2520341 - RNA, 18 nt, Chlamydophila pneumoniae CWL029
uggucuguauuuucuuca

SEQ ID NO: 2520342 - RNA, 19 nt, Chlamydophila pneumoniae CWL029
uggucuguauuuucuucaa

SEQ ID NO: 2520343 - RNA, 21 nt, Chlamydophila pneumoniae CWL029
uggucuucuguaauuuuuuuc

SEQ ID NO: 2520344 - RNA, 17 nt, Chlamydophila pneumoniae CWL029
uggucuuggguuuuaaa

SEQ ID NO: 2520345 - RNA, 15 nt, Chlamydophila pneumoniae CWL029
uggugaagaauaaua

SEQ ID NO: 2520346 - RNA, 17 nt, Chlamydophila pneumoniae CWL029
uggugacucuagccacc

SEQ ID NO: 2520347 - RNA, 15 nt, Chlamydophila pneumoniae CWL029
uggugagaucaucuc

SEQ ID NO: 2520348 - RNA, 20 nt, Chlamydophila pneumoniae CWL029
ugguguauaguauuuuuaaa

SEQ ID NO: 2520349 - RNA, 21 nt, Chlamydophila pneumoniae CWL029
ugguguauaguauuuuuaaau

SEQ ID NO: 2520350 - RNA, 18 nt, Chlamydophila pneumoniae CWL029
ugguuaggguaaggcuua

SEQ ID NO: 2520351 - RNA, 13 nt, Chlamydophila pneumoniae CWL029
ugguuccuggauu

SEQ ID NO: 2520352 - RNA, 21 nt, Chlamydophila pneumoniae CWL029
ugguugcuucuaagaaacuuc

SEQ ID NO: 2520353 - RNA, 18 nt, Chlamydophila pneumoniae CWL029
ugguuuaccuuguuuucc

SEQ ID NO: 2520354 - RNA, 15 nt, Chlamydophila pneumoniae CWL029
ugguuuucuccuucu

SEQ ID NO: 2520355 - RNA, 21 nt, Chlamydophila pneumoniae CWL029
ugguuuuucgauuuggaagau

SEQ ID NO: 2520356 - RNA, 16 nt, Chlamydophila pneumoniae CWL029
ugguuuuucuccucuu

SEQ ID NO: 2520357 - RNA, 14 nt, Chlamydophila pneumoniae CWL029
uguaaaaguagcau

SEQ ID NO: 2520358 - RNA, 23 nt, Chlamydophila pneumoniae CWL029
uguaaagagcaacaguaauuauu

SEQ ID NO: 2520359 - RNA, 23 nt, Chlamydophila pneumoniae CWL029
uguaaagugaaauugaacucuca

SEQ ID NO: 2520360 - RNA, 21 nt, Chlamydophila pneumoniae CWL029
uguaaauacaaaacaaaagcc

SEQ ID NO: 2520361 - RNA, 20 nt, Chlamydophila pneumoniae CWL029
uguaaauaguauacaagcga

SEQ ID NO: 2520362 - RNA, 17 nt, Chlamydophila pneumoniae CWL029
uguaaauccggcuccuu

SEQ ID NO: 2520363 - RNA, 20 nt, Chlamydophila pneumoniae CWL029
uguaaaugaggcuccuccuu

SEQ ID NO: 2520364 - RNA, 17 nt, Chlamydophila pneumoniae CWL029
uguaaaugucgguuugu

SEQ ID NO: 2520365 - RNA, 14 nt, Chlamydophila pneumoniae CWL029
uguaaauuucauuu

SEQ ID NO: 2520366 - RNA, 21 nt, Chlamydophila pneumoniae CWL029
uguaaccaacaucaaagaauu

SEQ ID NO: 2520367 - RNA, 17 nt, Chlamydophila pneumoniae CWL029
uguaagacuaaaaaaga

SEQ ID NO: 2520368 - RNA, 16 nt, Chlamydophila pneumoniae CWL029
uguaagcgugcaaguu

SEQ ID NO: 2520369 - RNA, 21 nt, Chlamydophila pneumoniae CWL029
uguaauaaaagaaagaaugac

SEQ ID NO: 2520370 - RNA, 18 nt, Chlamydophila pneumoniae CWL029
uguaauaaaagaacauua

SEQ ID NO: 2520371 - RNA, 17 nt, Chlamydophila pneumoniae CWL029
uguaauagcaggaguuu

SEQ ID NO: 2520372 - RNA, 21 nt, Chlamydophila pneumoniae CWL029
uguaaucauaaaaaaagcuag

SEQ ID NO: 2520373 - RNA, 17 nt, Chlamydophila pneumoniae CWL029
uguaaucuugaucagca

SEQ ID NO: 2520374 - RNA, 22 nt, Chlamydophila pneumoniae CWL029
uguaauuuccuuagaagggaaa

SEQ ID NO: 2520375 - RNA, 14 nt, Chlamydophila pneumoniae CWL029
uguaauuuuuucau

SEQ ID NO: 2520376 - RNA, 15 nt, Chlamydophila pneumoniae CWL029
uguacaaaugcaucu

SEQ ID NO: 2520377 - RNA, 19 nt, Chlamydophila pneumoniae CWL029
uguacaauuugcuccucca

SEQ ID NO: 2520378 - RNA, 12 nt, Chlamydophila pneumoniae CWL029
uguacacagaga

SEQ ID NO: 2520379 - RNA, 13 nt, Chlamydophila pneumoniae CWL029
uguacagaaaaua

SEQ ID NO: 2520380 - RNA, 20 nt, Chlamydophila pneumoniae CWL029
uguacaguaaaguaugcaua

SEQ ID NO: 2520381 - RNA, 15 nt, Chlamydophila pneumoniae CWL029
uguaccguaaagaaa

SEQ ID NO: 2520382 - RNA, 18 nt, Chlamydophila pneumoniae CWL029
uguaccugcauucauaaa

SEQ ID NO: 2520383 - RNA, 15 nt, Chlamydophila pneumoniae CWL029
uguacgguaaaucca

SEQ ID NO: 2520384 - RNA, 21 nt, Chlamydophila pneumoniae CWL029
uguacgguaaauccauuuggg

SEQ ID NO: 2520385 - RNA, 22 nt, Chlamydophila pneumoniae CWL029
uguacuuccccaaacauggaca

SEQ ID NO: 2520386 - RNA, 18 nt, Chlamydophila pneumoniae CWL029
uguacuugauauuguucu

SEQ ID NO: 2520387 - RNA, 16 nt, Chlamydophila pneumoniae CWL029
uguacuuuuugccaca

SEQ ID NO: 2520388 - RNA, 19 nt, Chlamydophila pneumoniae CWL029
uguagagguacuugggaga

SEQ ID NO: 2520389 - RNA, 24 nt, Chlamydophila pneumoniae CWL029
uguagaggucacuauagaucucuu

SEQ ID NO: 2520390 - RNA, 21 nt, Chlamydophila pneumoniae CWL029
uccaaacccugggcucacucu

SEQ ID NO: 2520391 - RNA, 21 nt, Chlamydophila pneumoniae CWL029
uccaaacgguuaaugaacuca

SEQ ID NO: 2520392 - RNA, 12 nt, Chlamydophila pneumoniae CWL029
uccaaagacuga

SEQ ID NO: 2520393 - RNA, 15 nt, Chlamydophila pneumoniae CWL029
uccaaagauacauua

SEQ ID NO: 2520394 - RNA, 23 nt, Chlamydophila pneumoniae CWL029
uccaaaggaaaauaaucuucaaa

SEQ ID NO: 2520395 - RNA, 19 nt, Chlamydophila pneumoniae CWL029
uccaaauagagugaccaua

SEQ ID NO: 2520396 - RNA, 22 nt, Chlamydophila pneumoniae CWL029
uccaaauugcaauuuucuaaag

SEQ ID NO: 2520397 - RNA, 23 nt, Chlamydophila pneumoniae CWL029
uccaacaaacaauuccguacgcu

SEQ ID NO: 2520398 - RNA, 22 nt, Chlamydophila pneumoniae CWL029
uccaacagucugcuuuuuugau

SEQ ID NO: 2520399 - RNA, 18 nt, Chlamydophila pneumoniae CWL029
uccaaccucgagauccuc

SEQ ID NO: 2520400 - RNA, 16 nt, Chlamydophila pneumoniae CWL029
uccaacggacauuuuc

SEQ ID NO: 2520401 - RNA, 21 nt, Chlamydophila pneumoniae CWL029
uccaacuaaaccuucaaugau

SEQ ID NO: 2520402 - RNA, 12 nt, Chlamydophila pneumoniae CWL029
uccaacuucaac

SEQ ID NO: 2520403 - RNA, 13 nt, Chlamydophila pneumoniae CWL029
uccaacuucaacu

SEQ ID NO: 2520404 - RNA, 22 nt, Chlamydophila pneumoniae CWL029
ucgaaagaucagaggaaucuaa

SEQ ID NO: 2520405 - RNA, 15 nt, Chlamydophila pneumoniae CWL029
ucgaaauccuaaaaa

SEQ ID NO: 2520406 - RNA, 14 nt, Chlamydophila pneumoniae CWL029
ucgaaauuuucaga

SEQ ID NO: 2520407 - RNA, 15 nt, Chlamydophila pneumoniae CWL029
ucgaacucugaagua

SEQ ID NO: 2520408 - RNA, 18 nt, Chlamydophila pneumoniae CWL029
ucgaagaaaauaaagauc

SEQ ID NO: 2520409 - RNA, 16 nt, Chlamydophila pneumoniae CWL029
ucgaagcggagcaucu

SEQ ID NO: 2520410 - RNA, 23 nt, Chlamydophila pneumoniae CWL029
ucgaauccgauagaucacaucaa

SEQ ID NO: 2520411 - RNA, 19 nt, Chlamydophila pneumoniae CWL029
ucgaaucuaaaaacuuccc

SEQ ID NO: 2520412 - RNA, 14 nt, Chlamydophila pneumoniae CWL029
ucgaaucuuuauuu

SEQ ID NO: 2520413 - RNA, 16 nt, Chlamydophila pneumoniae CWL029
ucgaaucuuuauuucu

SEQ ID NO: 2520414 - RNA, 14 nt, Chlamydophila pneumoniae CWL029
ucgaaugcugcaca

SEQ ID NO: 2520415 - RNA, 20 nt, Chlamydophila pneumoniae CWL029
ucgaauuguguguuuucaua

SEQ ID NO: 2520416 - RNA, 15 nt, Chlamydophila pneumoniae CWL029
ucgaauuuuuguuuu

SEQ ID NO: 2520417 - RNA, 23 nt, Chlamydophila pneumoniae CWL029
ucgaauuuuuguuuuaacucuag

SEQ ID NO: 2520418 - RNA, 21 nt, Chlamydophila pneumoniae CWL029
ucgacacuauguguuuccuuu

SEQ ID NO: 2520419 - RNA, 22 nt, Chlamydophila pneumoniae CWL029
ucgacagcagcauuuucuaaag

SEQ ID NO: 2520420 - RNA, 11 nt, Chlamydophila pneumoniae CWL029
ucucuaagaaa

SEQ ID NO: 2520421 - RNA, 15 nt, Chlamydophila pneumoniae CWL029
ucucuaagaaauuuu

SEQ ID NO: 2520422 - RNA, 18 nt, Chlamydophila pneumoniae CWL029
ucucuaagaaauuuucuc

SEQ ID NO: 2520423 - RNA, 16 nt, Chlamydophila pneumoniae CWL029
ucucuaagacuguguu

SEQ ID NO: 2520424 - RNA, 20 nt, Chlamydophila pneumoniae CWL029
ucucuaagacuguguuuuau

SEQ ID NO: 2520425 - RNA, 16 nt, Chlamydophila pneumoniae CWL029
ucucuaagcagccucu

SEQ ID NO: 2520426 - RNA, 18 nt, Chlamydophila pneumoniae CWL029
ucucuaagcagccucuuc

SEQ ID NO: 2520427 - RNA, 21 nt, Chlamydophila pneumoniae CWL029
ucucuaagcagccucuucucu

SEQ ID NO: 2520428 - RNA, 23 nt, Chlamydophila pneumoniae CWL029
ucucuaagcagccucuucucuac

SEQ ID NO: 2520429 - RNA, 22 nt, Chlamydophila pneumoniae CWL029
ucucuagccaauauagaagcug

SEQ ID NO: 2520430 - RNA, 17 nt, Chlamydophila pneumoniae CWL029
ucucuaggaagauuuau

SEQ ID NO: 2520431 - RNA, 15 nt, Chlamydophila pneumoniae CWL029
ucucuaguucuagaa

SEQ ID NO: 2520432 - RNA, 16 nt, Chlamydophila pneumoniae CWL029
ucucuaguuuuuacau

SEQ ID NO: 2520433 - RNA, 14 nt, Chlamydophila pneumoniae CWL029
ucucuauaaaaaaa

SEQ ID NO: 2520434 - RNA, 17 nt, Chlamydophila pneumoniae CWL029
ucucuaugcacaaaaua

SEQ ID NO: 2520435 - RNA, 21 nt, Chlamydophila pneumoniae CWL029
ucucuaugcacaaaauaaaac

SEQ ID NO: 2520436 - RNA, 15 nt, Chlamydophila pneumoniae CWL029
ucucuaugcgcucua

SEQ ID NO: 2520437 - RNA, 18 nt, Chlamydophila pneumoniae CWL029
ucucuaugcgcucuaaga

SEQ ID NO: 2520438 - RNA, 18 nt, Chlamydophila pneumoniae CWL029
ucucucaagucuauuuga

SEQ ID NO: 2520439 - RNA, 15 nt, Chlamydophila pneumoniae CWL029
ugacaacagagacaa

SEQ ID NO: 2520440 - RNA, 16 nt, Chlamydophila pneumoniae CWL029
ugacaauaacaugcgc

SEQ ID NO: 2520441 - RNA, 14 nt, Chlamydophila pneumoniae CWL029
ugacaauaagaaaa

SEQ ID NO: 2520442 - RNA, 23 nt, Chlamydophila pneumoniae CWL029
ugacaaucgcuguaaauucagug

SEQ ID NO: 2520443 - RNA, 11 nt, Chlamydophila pneumoniae CWL029
ugacacagaga

SEQ ID NO: 2520444 - RNA, 13 nt, Chlamydophila pneumoniae CWL029
ugacacagagaac

SEQ ID NO: 2520445 - RNA, 17 nt, Chlamydophila pneumoniae CWL029
ugacacagagaacaaua

SEQ ID NO: 2520446 - RNA, 18 nt, Chlamydophila pneumoniae CWL029
ugacacagcuaaucaauc

SEQ ID NO: 2520447 - RNA, 16 nt, Chlamydophila pneumoniae CWL029
ugacacucagcuccca

SEQ ID NO: 2520448 - RNA, 23 nt, Chlamydophila pneumoniae CWL029
ugacacucuaucauaucuucaaa

SEQ ID NO: 2520449 - RNA, 18 nt, Chlamydophila pneumoniae CWL029
ugacagaccuugcauuag

SEQ ID NO: 2520450 - RNA, 23 nt, Chlamydophila pneumoniae CWL029
ugacagaccuugcauuagauuca

SEQ ID NO: 2520451 - RNA, 18 nt, Chlamydophila pneumoniae CWL029
ugacauaagcacucuuaa

SEQ ID NO: 2520452 - RNA, 11 nt, Chlamydophila pneumoniae CWL029
ugaccaagaac

SEQ ID NO: 2520453 - RNA, 15 nt, Chlamydophila pneumoniae CWL029
ugaccaguggcagga

SEQ ID NO: 2520454 - RNA, 21 nt, Chlamydophila pneumoniae CWL029
ugaccaucaaugagaucugca

SEQ ID NO: 2520455 - RNA, 23 nt, Chlamydophila pneumoniae CWL029
ugaccaucaaugagaucugcaaa

SEQ ID NO: 2520456 - RNA, 16 nt, Chlamydophila pneumoniae CWL029
ugaccucaucucgcag

SEQ ID NO: 2520457 - RNA, 20 nt, Chlamydophila pneumoniae CWL029
ugaccucaucucgcagucca

SEQ ID NO: 2520458 - RNA, 16 nt, Chlamydophila pneumoniae CWL029
ugaccugcuuuuuuuc

SEQ ID NO: 2520459 - RNA, 23 nt, Chlamydophila pneumoniae CWL029
ugaccuuauaguccauaugggac

SEQ ID NO: 2520460 - RNA, 20 nt, Chlamydophila pneumoniae CWL029
ugaccuucucaagaucuuca

SEQ ID NO: 2520461 - RNA, 13 nt, Chlamydophila pneumoniae CWL029
ugaccuuuuucau

SEQ ID NO: 2520462 - RNA, 14 nt, Chlamydophila pneumoniae CWL029
ugaccuuuuucauu

SEQ ID NO: 2520463 - RNA, 22 nt, Chlamydophila pneumoniae CWL029
ugacgcaagagacaagaaaaua

SEQ ID NO: 2520464 - RNA, 15 nt, Chlamydophila pneumoniae CWL029
ugacgcgcuucuuca

SEQ ID NO: 2520465 - RNA, 19 nt, Chlamydophila pneumoniae CWL029
ugacgcgcuucuucaagaa

SEQ ID NO: 2520466 - RNA, 21 nt, Chlamydophila pneumoniae CWL029
ugacggcaggacucuuuaagc

SEQ ID NO: 2520467 - RNA, 18 nt, Chlamydophila pneumoniae CWL029
ugacgucuccaacagucu

SEQ ID NO: 2520468 - RNA, 20 nt, Chlamydophila pneumoniae CWL029
ugacguuaauaaagaggcuc

SEQ ID NO: 2520469 - RNA, 22 nt, Chlamydophila pneumoniae CWL029
ugacguuaauaaagaggcuccc

SEQ ID NO: 2520470 - RNA, 22 nt, Chlamydophila pneumoniae CWL029
ugacguugcgaacagcuccugg

SEQ ID NO: 2520471 - RNA, 22 nt, Chlamydophila pneumoniae CWL029
ugacuaauaccuuucuaagaau

SEQ ID NO: 2520472 - RNA, 13 nt, Chlamydophila pneumoniae CWL029
ugacuauaaaaug

SEQ ID NO: 2520473 - RNA, 21 nt, Chlamydophila pneumoniae CWL029
ugacuauagggagacucuuga

SEQ ID NO: 2520474 - RNA, 23 nt, Chlamydophila pneumoniae CWL029
ugacuaugguaagcauuucuguu

SEQ ID NO: 2520475 - RNA, 14 nt, Chlamydophila pneumoniae CWL029
ugacuauuuucauu

SEQ ID NO: 2520476 - RNA, 17 nt, Chlamydophila pneumoniae CWL029
ugacuccagaaggugug

SEQ ID NO: 2520477 - RNA, 12 nt, Chlamydophila pneumoniae CWL029
ugacucuagagu

SEQ ID NO: 2520478 - RNA, 14 nt, Chlamydophila pneumoniae CWL029
ugacucuagccacc

SEQ ID NO: 2520479 - RNA, 12 nt, Chlamydophila pneumoniae CWL029
ugacugaaacuc

SEQ ID NO: 2520480 - RNA, 13 nt, Chlamydophila pneumoniae CWL029
ugacugcagagaa

SEQ ID NO: 2520481 - RNA, 19 nt, Chlamydophila pneumoniae CWL029
ugacugcagauugcacuug

SEQ ID NO: 2520482 - RNA, 15 nt, Chlamydophila pneumoniae CWL029
ugacugcuagagucc

SEQ ID NO: 2520483 - RNA, 13 nt, Chlamydophila pneumoniae CWL029
ugacuucccgaag

SEQ ID NO: 2520484 - RNA, 17 nt, Chlamydophila pneumoniae CWL029
ugacuucuuguccuguu

SEQ ID NO: 2520485 - RNA, 16 nt, Chlamydophila pneumoniae CWL029
ugacuuggcuggcauc

SEQ ID NO: 2520486 - RNA, 14 nt, Chlamydophila pneumoniae CWL029
ugacuuguuucucc

SEQ ID NO: 2520487 - RNA, 18 nt, Chlamydophila pneumoniae CWL029
ugacuuguuucuccuauu

SEQ ID NO: 2520488 - RNA, 18 nt, Chlamydophila pneumoniae CWL029
ugacuuuagaaauuccaa

SEQ ID NO: 2520489 - RNA, 17 nt, Chlamydophila pneumoniae CWL029
ugacuuuaugaucuccc

SEQ ID NO: 2520490 - RNA, 21 nt, Chlamydophila pneumoniae CWL029
ugacuuuauguuagcuagagc

SEQ ID NO: 2520491 - RNA, 19 nt, Chlamydophila pneumoniae CWL029
ugacuuuggucuucuguaa

SEQ ID NO: 2520492 - RNA, 12 nt, Chlamydophila pneumoniae CWL029
ugacuuuucuuc

SEQ ID NO: 2520493 - RNA, 23 nt, Chlamydophila pneumoniae CWL029
ugacuuuuucaagguucucuaug

SEQ ID NO: 2520494 - RNA, 13 nt, Chlamydophila pneumoniae CWL029
ugagaaaaagaau

SEQ ID NO: 2520495 - RNA, 19 nt, Chlamydophila pneumoniae CWL029
ugagaaaaagaaucucuga

SEQ ID NO: 2520496 - RNA, 15 nt, Chlamydophila pneumoniae CWL029
ugagaaaaguugccu

SEQ ID NO: 2520497 - RNA, 21 nt, Chlamydophila pneumoniae CWL029
ugagaaaaguugccuaaagag

SEQ ID NO: 2520498 - RNA, 17 nt, Chlamydophila pneumoniae CWL029
ugagaaaaucugcagca

SEQ ID NO: 2520499 - RNA, 15 nt, Chlamydophila pneumoniae CWL029
ugagaaagaaguccu

SEQ ID NO: 2520500 - RNA, 11 nt, Chlamydophila pneumoniae CWL029
ugagaaagacc

SEQ ID NO: 2520501 - RNA, 17 nt, Chlamydophila pneumoniae CWL029
ugagaaagaccaccuuc

SEQ ID NO: 2520502 - RNA, 18 nt, Chlamydophila pneumoniae CWL029
ugagaaagaccaccuucc

SEQ ID NO: 2520503 - RNA, 13 nt, Chlamydophila pneumoniae CWL029
ugagaaauauaaa

SEQ ID NO: 2520504 - RNA, 18 nt, Chlamydophila pneumoniae CWL029
ugagaaccuucacaagaa

SEQ ID NO: 2520505 - RNA, 14 nt, Chlamydophila pneumoniae CWL029
ugagaauaaaacuu

SEQ ID NO: 2520506 - RNA, 20 nt, Chlamydophila pneumoniae CWL029
ugagaauacaacccuuuaua

SEQ ID NO: 2520507 - RNA, 14 nt, Chlamydophila pneumoniae CWL029
ugagaauuuucaug

SEQ ID NO: 2520508 - RNA, 16 nt, Chlamydophila pneumoniae CWL029
ugauuauuucuaaaaa

SEQ ID NO: 2520509 - RNA, 21 nt, Chlamydophila pneumoniae CWL029
ugauucauaaagaggaaugaa

SEQ ID NO: 2520510 - RNA, 23 nt, Chlamydophila pneumoniae CWL029
ugauucccggaggcaaagaucag

SEQ ID NO: 2520511 - RNA, 15 nt, Chlamydophila pneumoniae CWL029
ugauucccuccuucc

SEQ ID NO: 2520512 - RNA, 15 nt, Chlamydophila pneumoniae CWL029
ugauuccgcaaguaa

SEQ ID NO: 2520513 - RNA, 13 nt, Chlamydophila pneumoniae CWL029
ugauucuguauaa

SEQ ID NO: 2520514 - RNA, 23 nt, Chlamydophila pneumoniae CWL029
ugauugaaacuuuuuuucuucuc

SEQ ID NO: 2520515 - RNA, 21 nt, Chlamydophila pneumoniae CWL029
ugauugaaagucagcaaguca

SEQ ID NO: 2520516 - RNA, 17 nt, Chlamydophila pneumoniae CWL029
ugauugaacagucuugc

SEQ ID NO: 2520517 - RNA, 18 nt, Chlamydophila pneumoniae CWL029
ugauugagaauaaaacuu

SEQ ID NO: 2520518 - RNA, 15 nt, Chlamydophila pneumoniae CWL029
ugauugcugucagaa

SEQ ID NO: 2520519 - RNA, 14 nt, Chlamydophila pneumoniae CWL029
ugauuuuaaaauga

SEQ ID NO: 2520520 - RNA, 13 nt, Chlamydophila pneumoniae CWL029
ugauuuuucaaau

SEQ ID NO: 2520521 - RNA, 21 nt, Chlamydophila pneumoniae CWL029
ugauuuuugcuaagagcucuu

SEQ ID NO: 2520522 - RNA, 19 nt, Chlamydophila pneumoniae CWL029
ugauuuuuugaauccuguu

SEQ ID NO: 2520523 - RNA, 13 nt, Chlamydophila pneumoniae CWL029
ugcaaaaaaccag

SEQ ID NO: 2520524 - RNA, 16 nt, Chlamydophila pneumoniae CWL029
ugcaaaaaugaaagaa

SEQ ID NO: 2520525 - RNA, 15 nt, Chlamydophila pneumoniae CWL029
ugcaaaccaaaaaag

SEQ ID NO: 2520526 - RNA, 15 nt, Chlamydophila pneumoniae CWL029
ugcaaacgcaaugau

SEQ ID NO: 2520527 - RNA, 12 nt, Chlamydophila pneumoniae CWL029
ugcaaagagaau

SEQ ID NO: 2520528 - RNA, 14 nt, Chlamydophila pneumoniae CWL029
ugcaaaggaaggga

SEQ ID NO: 2520529 - RNA, 11 nt, Chlamydophila pneumoniae CWL029
ugcaaaguacu

SEQ ID NO: 2520530 - RNA, 17 nt, Chlamydophila pneumoniae CWL029
ugcaaaguacuacaaua

SEQ ID NO: 2520531 - RNA, 14 nt, Chlamydophila pneumoniae CWL029
ugcaaauaagccag

SEQ ID NO: 2520532 - RNA, 18 nt, Chlamydophila pneumoniae CWL029
ugcaaauccuguagaaac

SEQ ID NO: 2520533 - RNA, 18 nt, Chlamydophila pneumoniae CWL029
ugcaaaugaagggauggg

SEQ ID NO: 2520534 - RNA, 14 nt, Chlamydophila pneumoniae CWL029
ugcaaauuccagaa

SEQ ID NO: 2520535 - RNA, 12 nt, Chlamydophila pneumoniae CWL029
ugcaaauuucau

SEQ ID NO: 2520536 - RNA, 12 nt, Chlamydophila pneumoniae CWL029
ugcaacaaaagg

SEQ ID NO: 2520537 - RNA, 19 nt, Chlamydophila pneumoniae CWL029
ugcaacagagucagaagcu

SEQ ID NO: 2520538 - RNA, 18 nt, Chlamydophila pneumoniae CWL029
ugcaaccuguaaagacca

SEQ ID NO: 2520539 - RNA, 20 nt, Chlamydophila pneumoniae CWL029
ugcaagagcccuugugcauc

SEQ ID NO: 2520540 - RNA, 23 nt, Chlamydophila pneumoniae CWL029
ugcaagauuaucuuuacgaauca

SEQ ID NO: 2520541 - RNA, 19 nt, Chlamydophila pneumoniae CWL029
ugcaagcagauagagcuuc

SEQ ID NO: 2520542 - RNA, 18 nt, Chlamydophila pneumoniae CWL029
ugcaagcuucaucaggag

SEQ ID NO: 2520543 - RNA, 19 nt, Chlamydophila pneumoniae CWL029
ugcaaggccuaaucuugua

SEQ ID NO: 2520544 - RNA, 16 nt, Chlamydophila pneumoniae CWL029
ugcaagugcuuucagg

SEQ ID NO: 2520545 - RNA, 17 nt, Chlamydophila pneumoniae CWL029
ugcaagugcuuucagga

SEQ ID NO: 2520546 - RNA, 16 nt, Chlamydophila pneumoniae CWL029
ugcaaguucacacgua

SEQ ID NO: 2520547 - RNA, 19 nt, Chlamydophila pneumoniae CWL029
ugcaaguuugaaugcagca

SEQ ID NO: 2520548 - RNA, 13 nt, Chlamydophila pneumoniae CWL029
ugcaauacuuuuc

SEQ ID NO: 2520549 - RNA, 13 nt, Chlamydophila pneumoniae CWL029
ugcaaucagugcu

SEQ ID NO: 2520550 - RNA, 16 nt, Chlamydophila pneumoniae CWL029
ugcaaucagugcugcc

SEQ ID NO: 2520551 - RNA, 14 nt, Chlamydophila pneumoniae CWL029
ugcaaucucaaaau

SEQ ID NO: 2520552 - RNA, 17 nt, Chlamydophila pneumoniae CWL029
ugcaauuccgaagaaga

SEQ ID NO: 2520553 - RNA, 20 nt, Chlamydophila pneumoniae CWL029
ugcaauucuucaugcugcuu

SEQ ID NO: 2520554 - RNA, 17 nt, Chlamydophila pneumoniae CWL029
ugcaauugccauaucau

SEQ ID NO: 2520555 - RNA, 21 nt, Chlamydophila pneumoniae CWL029
ugcacaaucgcaucaaaaaau

SEQ ID NO: 2520556 - RNA, 14 nt, Chlamydophila pneumoniae CWL029
ugcacgagagccuc

SEQ ID NO: 2520557 - RNA, 20 nt, Chlamydophila pneumoniae CWL029
ugcacgaucgcgauaagaag

SEQ ID NO: 2520558 - RNA, 20 nt, Chlamydophila pneumoniae CWL029
ugcacguuugacaaauuuau

SEQ ID NO: 2520559 - RNA, 18 nt, Chlamydophila pneumoniae CWL029
ugcagacggggaucuaaa

SEQ ID NO: 2520560 - RNA, 21 nt, Chlamydophila pneumoniae CWL029
ugcagaguuggaucauucuuu

SEQ ID NO: 2520561 - RNA, 13 nt, Chlamydophila pneumoniae CWL029
ugcagauacuaaa

SEQ ID NO: 2520562 - RNA, 20 nt, Chlamydophila pneumoniae CWL029
ugcagauagcuuacagagaa

SEQ ID NO: 2520563 - RNA, 13 nt, Chlamydophila pneumoniae CWL029
ugcagaucuuuua

SEQ ID NO: 2520564 - RNA, 22 nt, Chlamydophila pneumoniae CWL029
ugcagcagauaccaaaauacca

SEQ ID NO: 2520565 - RNA, 16 nt, Chlamydophila pneumoniae CWL029
ugcagcagccuuggcu

SEQ ID NO: 2520566 - RNA, 22 nt, Chlamydophila pneumoniae CWL029
ugcagcagccuuggcucuagaa

SEQ ID NO: 2520567 - RNA, 14 nt, Chlamydophila pneumoniae CWL029
ugcagcgcagcacc

SEQ ID NO: 2520568 - RNA, 21 nt, Chlamydophila pneumoniae CWL029
ugcaggacugucuagcaguug

SEQ ID NO: 2520569 - RNA, 15 nt, Chlamydophila pneumoniae CWL029
ugcaggccaggagac

SEQ ID NO: 2520570 - RNA, 16 nt, Chlamydophila pneumoniae CWL029
ugcaggccaggagacu

SEQ ID NO: 2520571 - RNA, 22 nt, Chlamydophila pneumoniae CWL029
ugcagucguauucagguucuga

SEQ ID NO: 2520572 - RNA, 19 nt, Chlamydophila pneumoniae CWL029
ugcaguuccgauaaagaua

SEQ ID NO: 2520573 - RNA, 18 nt, Chlamydophila pneumoniae CWL029
ugcaguugcuguggcaua

SEQ ID NO: 2520574 - RNA, 17 nt, Chlamydophila pneumoniae CWL029
ugcauaauuuuucuuag

SEQ ID NO: 2520575 - RNA, 13 nt, Chlamydophila pneumoniae CWL029
ugcauacccuucu

SEQ ID NO: 2520576 - RNA, 20 nt, Chlamydophila pneumoniae CWL029
ugcauacccuucuucuucag

SEQ ID NO: 2520577 - RNA, 20 nt, Chlamydophila pneumoniae CWL029
ugcauacuggcccagauucu

SEQ ID NO: 2520578 - RNA, 23 nt, Chlamydophila pneumoniae CWL029
ugcauaguauggcauucuuuuuc

SEQ ID NO: 2520579 - RNA, 15 nt, Chlamydophila pneumoniae CWL029
ugcauauugccuucu

SEQ ID NO: 2520580 - RNA, 23 nt, Chlamydophila pneumoniae CWL029
ugcauauugcucuuguauuccuu

SEQ ID NO: 2520581 - RNA, 21 nt, Chlamydophila pneumoniae CWL029
ugcaucauuuucauagcagcu

SEQ ID NO: 2520582 - RNA, 23 nt, Chlamydophila pneumoniae CWL029
ugcaucccccgcgccacaucaaa

SEQ ID NO: 2520583 - RNA, 14 nt, Chlamydophila pneumoniae CWL029
ugcaucucugcaua

SEQ ID NO: 2520584 - RNA, 16 nt, Chlamydophila pneumoniae CWL029
ugcaucucuuaaaaca

SEQ ID NO: 2520585 - RNA, 12 nt, Chlamydophila pneumoniae CWL029
ugcaucuuauca

SEQ ID NO: 2520586 - RNA, 22 nt, Chlamydophila pneumoniae CWL029
ugcaucuugagguauuccuacc

SEQ ID NO: 2520587 - RNA, 16 nt, Chlamydophila pneumoniae CWL029
ugcaugaaucucuucu

SEQ ID NO: 2520588 - RNA, 17 nt, Chlamydophila pneumoniae CWL029
ugcaugaaucucuucug

SEQ ID NO: 2520589 - RNA, 13 nt, Chlamydophila pneumoniae CWL029
ugcaugaggagac

SEQ ID NO: 2520590 - RNA, 17 nt, Chlamydophila pneumoniae CWL029
ugcaugauccuauuuuu

SEQ ID NO: 2520591 - RNA, 17 nt, Chlamydophila pneumoniae CWL029
ugcaugcaucuuaucaa

SEQ ID NO: 2520592 - RNA, 22 nt, Chlamydophila pneumoniae CWL029
ugcaugccuggccaucaucacc

SEQ ID NO: 2520593 - RNA, 16 nt, Chlamydophila pneumoniae CWL029
ugcauggauccuucau

SEQ ID NO: 2520594 - RNA, 22 nt, Chlamydophila pneumoniae CWL029
ugcauggauccuucaucagcuu

SEQ ID NO: 2520595 - RNA, 18 nt, Chlamydophila pneumoniae CWL029
ugcauuuucuucuugcaa

SEQ ID NO: 2520596 - RNA, 12 nt, Chlamydophila pneumoniae CWL029
ugccaaaaaauu

SEQ ID NO: 2520597 - RNA, 21 nt, Chlamydophila pneumoniae CWL029
ugccaaaaguuuugaggauuu

SEQ ID NO: 2520598 - RNA, 14 nt, Chlamydophila pneumoniae CWL029
ugccaaauaucucu

SEQ ID NO: 2520599 - RNA, 13 nt, Chlamydophila pneumoniae CWL029
ugccaaauccucc

SEQ ID NO: 2520600 - RNA, 16 nt, Chlamydophila pneumoniae CWL029
ugccaaucuuccuuaa

SEQ ID NO: 2520601 - RNA, 12 nt, Chlamydophila pneumoniae CWL029
ugccaaugugca

SEQ ID NO: 2520602 - RNA, 15 nt, Chlamydophila pneumoniae CWL029
ugccaaugugcaaua

SEQ ID NO: 2520603 - RNA, 20 nt, Chlamydophila pneumoniae CWL029
ugccaauguggugauuucuu

SEQ ID NO: 2520604 - RNA, 21 nt, Chlamydophila pneumoniae CWL029
ugccaauguggugauuucuuu

SEQ ID NO: 2520605 - RNA, 16 nt, Chlamydophila pneumoniae CWL029
ugccaauuuuuguaga

SEQ ID NO: 2520606 - RNA, 22 nt, Chlamydophila pneumoniae CWL029
ugccuugauccuuuccaagaag

SEQ ID NO: 2520607 - RNA, 14 nt, Chlamydophila pneumoniae CWL029
ugccuuuagggaaa

SEQ ID NO: 2520608 - RNA, 16 nt, Chlamydophila pneumoniae CWL029
ugccuuuagggaaaaa

SEQ ID NO: 2520609 - RNA, 12 nt, Chlamydophila pneumoniae CWL029
ugccuuucucuu

SEQ ID NO: 2520610 - RNA, 15 nt, Chlamydophila pneumoniae CWL029
ugcgaacgaagacuu

SEQ ID NO: 2520611 - RNA, 22 nt, Chlamydophila pneumoniae CWL029
ugcgagguaugaauaggaauga

SEQ ID NO: 2520612 - RNA, 22 nt, Chlamydophila pneumoniae CWL029
ugcgauugccggcuaugaggaa

SEQ ID NO: 2520613 - RNA, 19 nt, Chlamydophila pneumoniae CWL029
ugcgcaaagaacucaacuu

SEQ ID NO: 2520614 - RNA, 22 nt, Chlamydophila pneumoniae CWL029
ugcgcaaagaacucaacuuuuu

SEQ ID NO: 2520615 - RNA, 17 nt, Chlamydophila pneumoniae CWL029
ugcgcacggauucuaaa

SEQ ID NO: 2520616 - RNA, 18 nt, Chlamydophila pneumoniae CWL029
ugcgcagcucggauggac

SEQ ID NO: 2520617 - RNA, 18 nt, Chlamydophila pneumoniae CWL029
ugcgcagcuucuggagaa

SEQ ID NO: 2520618 - RNA, 18 nt, Chlamydophila pneumoniae CWL029
ugcgcaguggacggggag

SEQ ID NO: 2520619 - RNA, 14 nt, Chlamydophila pneumoniae CWL029
ugcgcccgagcuuc

SEQ ID NO: 2520620 - RNA, 13 nt, Chlamydophila pneumoniae CWL029
ugcgcuagcucca

SEQ ID NO: 2520621 - RNA, 14 nt, Chlamydophila pneumoniae CWL029
ugcgcuaucaucau

SEQ ID NO: 2520622 - RNA, 14 nt, Chlamydophila pneumoniae CWL029
ugcggaacucauca

SEQ ID NO: 2520623 - RNA, 16 nt, Chlamydophila pneumoniae CWL029
ugcggaaggcuaaaac

SEQ ID NO: 2520624 - RNA, 17 nt, Chlamydophila pneumoniae CWL029
ugcggaccuuaagauga

SEQ ID NO: 2520625 - RNA, 15 nt, Chlamydophila pneumoniae CWL029
ugcggccacauuaag

SEQ ID NO: 2520626 - RNA, 18 nt, Chlamydophila pneumoniae CWL029
ugcggcuccuacaguccu

SEQ ID NO: 2520627 - RNA, 15 nt, Chlamydophila pneumoniae CWL029
ugcgggcucaaagaa

SEQ ID NO: 2520628 - RNA, 21 nt, Chlamydophila pneumoniae CWL029
ugcguauagauccaagaauga

SEQ ID NO: 2520629 - RNA, 18 nt, Chlamydophila pneumoniae CWL029
ugcgucuuuaauuaaaag

SEQ ID NO: 2520630 - RNA, 12 nt, Chlamydophila pneumoniae CWL029
ugcguuuccaug

SEQ ID NO: 2520631 - RNA, 16 nt, Chlamydophila pneumoniae CWL029
ugcuaaaacuaaaguu

SEQ ID NO: 2520632 - RNA, 20 nt, Chlamydophila pneumoniae CWL029
ugcuaaacaaugcaaaauaa

SEQ ID NO: 2520633 - RNA, 17 nt, Chlamydophila pneumoniae CWL029
ugcuaaacuuuuuuuca

SEQ ID NO: 2520634 - RNA, 20 nt, Chlamydophila pneumoniae CWL029
ugcuaaacuuuuuuucaaau

SEQ ID NO: 2520635 - RNA, 19 nt, Chlamydophila pneumoniae CWL029
ugcuaaagagucuuccuag

SEQ ID NO: 2520636 - RNA, 13 nt, Chlamydophila pneumoniae CWL029
ugcuaaauuuguc

SEQ ID NO: 2520637 - RNA, 13 nt, Chlamydophila pneumoniae CWL029
ugcuaacaacucc

SEQ ID NO: 2520638 - RNA, 19 nt, Chlamydophila pneumoniae CWL029
ugcuaagaucuuuagaaua

SEQ ID NO: 2520639 - RNA, 20 nt, Chlamydophila pneumoniae CWL029
ugcuaagcgaaccaaaguca

SEQ ID NO: 2520640 - RNA, 12 nt, Chlamydophila pneumoniae CWL029
ugcuaauaauuc

SEQ ID NO: 2520641 - RNA, 15 nt, Chlamydophila pneumoniae CWL029
ugcuaauaccucaaa

SEQ ID NO: 2520642 - RNA, 22 nt, Chlamydophila pneumoniae CWL029
ugcuaauccagcaacaaccaaa

SEQ ID NO: 2520643 - RNA, 13 nt, Chlamydophila pneumoniae CWL029
ugcuacaaacucu

SEQ ID NO: 2520644 - RNA, 21 nt, Chlamydophila pneumoniae CWL029
ugcuacagcuucuuuuccagc

SEQ ID NO: 2520645 - RNA, 19 nt, Chlamydophila pneumoniae CWL029
ugcuacgacuacaucuugu

SEQ ID NO: 2520646 - RNA, 20 nt, Chlamydophila pneumoniae CWL029
ugcuacuuuaaaguggcaau

SEQ ID NO: 2520647 - RNA, 18 nt, Chlamydophila pneumoniae CWL029
ugcuagagcuuucagaaa

SEQ ID NO: 2520648 - RNA, 14 nt, Chlamydophila pneumoniae CWL029
ugcuaggaagauga

SEQ ID NO: 2520649 - RNA, 21 nt, Chlamydophila pneumoniae CWL029
ugcuauagcuggaucuucuga

SEQ ID NO: 2520650 - RNA, 17 nt, Chlamydophila pneumoniae CWL029
ugcuauagggaucuccu

SEQ ID NO: 2520651 - RNA, 21 nt, Chlamydophila pneumoniae CWL029
ugcuaucaaagacucaugaaa

SEQ ID NO: 2520652 - RNA, 12 nt, Chlamydophila pneumoniae CWL029
ugcuaucuccag

SEQ ID NO: 2520653 - RNA, 14 nt, Chlamydophila pneumoniae CWL029
ugcuaucuccagaa

SEQ ID NO: 2520654 - RNA, 18 nt, Chlamydophila pneumoniae CWL029
ugcuaucuccagaaauuu

SEQ ID NO: 2520655 - RNA, 13 nt, Chlamydophila pneumoniae CWL029
ugcuauuuuucca

SEQ ID NO: 2520656 - RNA, 15 nt, Chlamydophila pneumoniae CWL029
ugcucacuucuuugc

SEQ ID NO: 2520657 - RNA, 18 nt, Chlamydophila pneumoniae CWL029
ugcucaggagauacaagc

SEQ ID NO: 2520658 - RNA, 15 nt, Chlamydophila pneumoniae CWL029
ugcucaguaaauauu

SEQ ID NO: 2520659 - RNA, 22 nt, Chlamydophila pneumoniae CWL029
ugcuccaauuuucuucagcacu

SEQ ID NO: 2520660 - RNA, 18 nt, Chlamydophila pneumoniae CWL029
ugcuccagaaacgcagcu

SEQ ID NO: 2520661 - RNA, 21 nt, Chlamydophila pneumoniae CWL029
ugcucccuccuccucgucuaa

SEQ ID NO: 2520662 - RNA, 23 nt, Chlamydophila pneumoniae CWL029
ugcuccuaagugauaaggaagaa

SEQ ID NO: 2520663 - RNA, 11 nt, Chlamydophila pneumoniae CWL029
ugcuccugaag

SEQ ID NO: 2520664 - RNA, 23 nt, Chlamydophila pneumoniae CWL029
ugcucguauuagaguuucuuuug

SEQ ID NO: 2520665 - RNA, 17 nt, Chlamydophila pneumoniae CWL029
ugcucuaccaacugagc

SEQ ID NO: 2520666 - RNA, 22 nt, Chlamydophila pneumoniae CWL029
ugcucuagucuuucaaccuccg

SEQ ID NO: 2520667 - RNA, 15 nt, Chlamydophila pneumoniae CWL029
ugcucucuaaagcuu

SEQ ID NO: 2520668 - RNA, 17 nt, Chlamydophila pneumoniae CWL029
ugcucucuacuucugua

SEQ ID NO: 2520669 - RNA, 15 nt, Chlamydophila pneumoniae CWL029
ugcucucuucuucuc

SEQ ID NO: 2520670 - RNA, 16 nt, Chlamydophila pneumoniae CWL029
ugcucucuucuucuca

SEQ ID NO: 2520671 - RNA, 16 nt, Chlamydophila pneumoniae CWL029
ugcucuguauuggaaa

SEQ ID NO: 2520672 - RNA, 22 nt, Chlamydophila pneumoniae CWL029
ugcucuuuuaacuuaaagacuu

SEQ ID NO: 2520673 - RNA, 22 nt, Chlamydophila pneumoniae CWL029
ugcugaaccuuugguagaaaga

SEQ ID NO: 2520674 - RNA, 13 nt, Chlamydophila pneumoniae CWL029
uggcauucuuuuu

SEQ ID NO: 2520675 - RNA, 17 nt, Chlamydophila pneumoniae CWL029
uggcauucuuuuucuau

SEQ ID NO: 2520676 - RNA, 18 nt, Chlamydophila pneumoniae CWL029
uggcauugccauaauaaa

SEQ ID NO: 2520677 - RNA, 17 nt, Chlamydophila pneumoniae CWL029
uggcauugggaaggauc

SEQ ID NO: 2520678 - RNA, 11 nt, Chlamydophila pneumoniae CWL029
uggccaaaaau

SEQ ID NO: 2520679 - RNA, 20 nt, Chlamydophila pneumoniae CWL029
uggccaacaguguagccuuu

SEQ ID NO: 2520680 - RNA, 18 nt, Chlamydophila pneumoniae CWL029
uggccaucaucaccagaa

SEQ ID NO: 2520681 - RNA, 12 nt, Chlamydophila pneumoniae CWL029
uggccucaacac

SEQ ID NO: 2520682 - RNA, 20 nt, Chlamydophila pneumoniae CWL029
uggcgaggggccacuugcau

SEQ ID NO: 2520683 - RNA, 13 nt, Chlamydophila pneumoniae CWL029
uggcguucaggau

SEQ ID NO: 2520684 - RNA, 14 nt, Chlamydophila pneumoniae CWL029
uggcuaaaggauca

SEQ ID NO: 2520685 - RNA, 20 nt, Chlamydophila pneumoniae CWL029
uggcuauagauacuuugcaa

SEQ ID NO: 2520686 - RNA, 14 nt, Chlamydophila pneumoniae CWL029
uggcuauggaagau

SEQ ID NO: 2520687 - RNA, 18 nt, Chlamydophila pneumoniae CWL029
uggcucaguguauuguuu

SEQ ID NO: 2520688 - RNA, 16 nt, Chlamydophila pneumoniae CWL029
uggcuccuaaacucaa

SEQ ID NO: 2520689 - RNA, 17 nt, Chlamydophila pneumoniae CWL029
uggcuccuaaacucaau

SEQ ID NO: 2520690 - RNA, 14 nt, Chlamydophila pneumoniae CWL029
uggcucuauagggg

SEQ ID NO: 2520691 - RNA, 16 nt, Chlamydophila pneumoniae CWL029
uggcugucuugaccaa

SEQ ID NO: 2520692 - RNA, 19 nt, Chlamydophila pneumoniae CWL029
ugggaagacucucaucagc

SEQ ID NO: 2520693 - RNA, 18 nt, Chlamydophila pneumoniae CWL029
ugggaagccuggaaauga

SEQ ID NO: 2520694 - RNA, 21 nt, Chlamydophila pneumoniae CWL029
ugggaagccuggaaaugaaua

SEQ ID NO: 2520695 - RNA, 22 nt, Chlamydophila pneumoniae CWL029
ugggaaugcgcaggcaauuuuu

SEQ ID NO: 2520696 - RNA, 22 nt, Chlamydophila pneumoniae CWL029
ugggaauucuuuuccugcagca

SEQ ID NO: 2520697 - RNA, 22 nt, Chlamydophila pneumoniae CWL029
ugggaauuugauuuuucaaauu

SEQ ID NO: 2520698 - RNA, 23 nt, Chlamydophila pneumoniae CWL029
ugggaauuugauuuuucaaauuc

SEQ ID NO: 2520699 - RNA, 21 nt, Chlamydophila pneumoniae CWL029
ugggcagcgauauaagacucc

SEQ ID NO: 2520700 - RNA, 23 nt, Chlamydophila pneumoniae CWL029
uggggaaauuaaauucuuuucua

SEQ ID NO: 2520701 - RNA, 18 nt, Chlamydophila pneumoniae CWL029
uggggaucuuaggaaauu

SEQ ID NO: 2520702 - RNA, 18 nt, Chlamydophila pneumoniae CWL029
uggggcaguagguaagaa

SEQ ID NO: 2520703 - RNA, 17 nt, Chlamydophila pneumoniae CWL029
uggggcauaagaacucu

SEQ ID NO: 2520704 - RNA, 18 nt, Chlamydophila pneumoniae CWL029
uggguaaggcgaaaucuu

SEQ ID NO: 2520705 - RNA, 15 nt, Chlamydophila pneumoniae CWL029
uuacaggaaacucua

SEQ ID NO: 2520706 - RNA, 17 nt, Chlamydophila pneumoniae CWL029
uuacauaacacuuuguu

SEQ ID NO: 2520707 - RNA, 21 nt, Chlamydophila pneumoniae CWL029
uuaccaucgucuccaaaaauu

SEQ ID NO: 2520708 - RNA, 20 nt, Chlamydophila pneumoniae CWL029
uuaccaucguuuucauaggg

SEQ ID NO: 2520709 - RNA, 19 nt, Chlamydophila pneumoniae CWL029
uuacccuaauuugaauagu

SEQ ID NO: 2520710 - RNA, 13 nt, Chlamydophila pneumoniae CWL029
uuaccgaagagcc

SEQ ID NO: 2520711 - RNA, 15 nt, Chlamydophila pneumoniae CWL029
uuacgaaaacaucug

SEQ ID NO: 2520712 - RNA, 19 nt, Chlamydophila pneumoniae CWL029
uuacgaaaacaucuguaua

SEQ ID NO: 2520713 - RNA, 21 nt, Chlamydophila pneumoniae CWL029
uuacgaacaagacgaaagcac

SEQ ID NO: 2520714 - RNA, 15 nt, Chlamydophila pneumoniae CWL029
uuacgguuucuggga

SEQ ID NO: 2520715 - RNA, 18 nt, Chlamydophila pneumoniae CWL029
uuacucccugaaguugag

SEQ ID NO: 2520716 - RNA, 21 nt, Chlamydophila pneumoniae CWL029
uuacugaagaaguaagcgauu

SEQ ID NO: 2520717 - RNA, 12 nt, Chlamydophila pneumoniae CWL029
uuacugaggaaa

SEQ ID NO: 2520718 - RNA, 17 nt, Chlamydophila pneumoniae CWL029
uuacugaggaaaucgca

SEQ ID NO: 2520719 - RNA, 18 nt, Chlamydophila pneumoniae CWL029
uuacugaggaaaucgcau

SEQ ID NO: 2520720 - RNA, 20 nt, Chlamydophila pneumoniae CWL029
uuacugugguauacauccca

SEQ ID NO: 2520721 - RNA, 21 nt, Chlamydophila pneumoniae CWL029
uuacugugguauacaucccau

SEQ ID NO: 2520722 - RNA, 16 nt, Chlamydophila pneumoniae CWL029
uuacuucaagaaaaac

SEQ ID NO: 2520723 - RNA, 22 nt, Chlamydophila pneumoniae CWL029
uuacuugcgauacaauaaacaa

SEQ ID NO: 2520724 - RNA, 15 nt, Chlamydophila pneumoniae CWL029
uuagaaaagauaaaa

SEQ ID NO: 2520725 - RNA, 20 nt, Chlamydophila pneumoniae CWL029
uuagaaaagauaaaacauuc

SEQ ID NO: 2520726 - RNA, 12 nt, Chlamydophila pneumoniae CWL029
uuagaaagcgca

SEQ ID NO: 2520727 - RNA, 14 nt, Chlamydophila pneumoniae CWL029
uuagaacuauagga

SEQ ID NO: 2520728 - RNA, 23 nt, Chlamydophila pneumoniae CWL029
uuagaacuucaaugaaagcugua

SEQ ID NO: 2520729 - RNA, 12 nt, Chlamydophila pneumoniae CWL029
uuagaagagaaa

SEQ ID NO: 2520730 - RNA, 20 nt, Chlamydophila pneumoniae CWL029
uuagaagggaaaguaccuuu

SEQ ID NO: 2520731 - RNA, 23 nt, Chlamydophila pneumoniae CWL029
uuagaaguaauccuaauuccuuc

SEQ ID NO: 2520732 - RNA, 17 nt, Chlamydophila pneumoniae CWL029
uuagaauaagagcuaca

SEQ ID NO: 2520733 - RNA, 20 nt, Chlamydophila pneumoniae CWL029
uuagaauagaagauccucaa

SEQ ID NO: 2520734 - RNA, 21 nt, Chlamydophila pneumoniae CWL029
uuagaauagaagauccucaaa

SEQ ID NO: 2520735 - RNA, 22 nt, Chlamydophila pneumoniae CWL029
uuagaaucaaaagucaugagga

SEQ ID NO: 2520736 - RNA, 12 nt, Chlamydophila pneumoniae CWL029
uuagaauccucu

SEQ ID NO: 2520737 - RNA, 19 nt, Chlamydophila pneumoniae CWL029
uuagaauccugaucuguag

SEQ ID NO: 2520738 - RNA, 16 nt, Chlamydophila pneumoniae CWL029
uuagaaucuaagaucc

SEQ ID NO: 2520739 - RNA, 14 nt, Chlamydophila pneumoniae CWL029
uuagaaucuuuucu

SEQ ID NO: 2520740 - RNA, 21 nt, Chlamydophila pneumoniae CWL029
uuagacaagacaccgaaagaa

SEQ ID NO: 2520741 - RNA, 22 nt, Chlamydophila pneumoniae CWL029
uuagacaagacaccgaaagaaa

SEQ ID NO: 2520742 - RNA, 17 nt, Chlamydophila pneumoniae CWL029
uuagagaaauuuuuaau

SEQ ID NO: 2520743 - RNA, 23 nt, Chlamydophila pneumoniae CWL029
uuagagaaauuuuuaauuuuucu

SEQ ID NO: 2520744 - RNA, 23 nt, Chlamydophila pneumoniae CWL029
uuagagaagagguguccauaaug

SEQ ID NO: 2520745 - RNA, 21 nt, Chlamydophila pneumoniae CWL029
uuagagaucguaauguauccu

SEQ ID NO: 2520746 - RNA, 16 nt, Chlamydophila pneumoniae CWL029
uuagaguuuucuguag

SEQ ID NO: 2520747 - RNA, 16 nt, Chlamydophila pneumoniae CWL029
uuagcaaacauuuuua

SEQ ID NO: 2520748 - RNA, 15 nt, Chlamydophila pneumoniae CWL029
uuagcaagagcucuu

SEQ ID NO: 2520749 - RNA, 22 nt, Chlamydophila pneumoniae CWL029
uuagcauaaggggagucuugga

SEQ ID NO: 2520750 - RNA, 20 nt, Chlamydophila pneumoniae CWL029
uuagcauagagcucuaaaaa

SEQ ID NO: 2520751 - RNA, 14 nt, Chlamydophila pneumoniae CWL029
uuagcaucaucucc

SEQ ID NO: 2520752 - RNA, 15 nt, Chlamydophila pneumoniae CWL029
uuagcauuaggaaag

SEQ ID NO: 2520753 - RNA, 20 nt, Chlamydophila pneumoniae CWL029
uuagccauggcaucuaagcc

SEQ ID NO: 2520754 - RNA, 18 nt, Chlamydophila pneumoniae CWL029
uuagccuggcuaaaggau

SEQ ID NO: 2520755 - RNA, 14 nt, Chlamydophila pneumoniae CWL029
uuagcgaucucucu

SEQ ID NO: 2520756 - RNA, 14 nt, Chlamydophila pneumoniae CWL029
uuagcuucuuuuuu

SEQ ID NO: 2520757 - RNA, 20 nt, Chlamydophila pneumoniae CWL029
uuagcuucuuuuuuuuucuu

SEQ ID NO: 2520758 - RNA, 22 nt, Chlamydophila pneumoniae CWL029
uuaggaucccugauuccuuggc

SEQ ID NO: 2520759 - RNA, 16 nt, Chlamydophila pneumoniae CWL029
uuaggauucaguuccu

SEQ ID NO: 2520760 - RNA, 14 nt, Chlamydophila pneumoniae CWL029
uuaggcuuaauaaa

SEQ ID NO: 2520761 - RNA, 19 nt, Chlamydophila pneumoniae CWL029
uuagggaagacgauaccgc

SEQ ID NO: 2520762 - RNA, 14 nt, Chlamydophila pneumoniae CWL029
uuaggugaaauauu

SEQ ID NO: 2520763 - RNA, 23 nt, Chlamydophila pneumoniae CWL029
uuaguaaaugccucuuucauacu

SEQ ID NO: 2520764 - RNA, 13 nt, Chlamydophila pneumoniae CWL029
uuaguagcuauuc

SEQ ID NO: 2520765 - RNA, 18 nt, Chlamydophila pneumoniae CWL029
uuaguagcuauucucaaa

SEQ ID NO: 2520766 - RNA, 21 nt, Chlamydophila pneumoniae CWL029
uuagucccgccguaugcauca

SEQ ID NO: 2520767 - RNA, 13 nt, Chlamydophila pneumoniae CWL029
uuagugcuucaga

SEQ ID NO: 2520768 - RNA, 19 nt, Chlamydophila pneumoniae CWL029
uucacaaagaauucagaga

SEQ ID NO: 2520769 - RNA, 15 nt, Chlamydophila pneumoniae CWL029
uucacaagaaaacaa

SEQ ID NO: 2520770 - RNA, 21 nt, Chlamydophila pneumoniae CWL029
uucacaagcugguagacuucu

SEQ ID NO: 2520771 - RNA, 16 nt, Chlamydophila pneumoniae CWL029
uucacaagugcauuau

SEQ ID NO: 2520772 - RNA, 16 nt, Chlamydophila pneumoniae CWL029
uucacaaucuaaauaa

SEQ ID NO: 2520773 - RNA, 17 nt, Chlamydophila pneumoniae CWL029
uucacauacauucuauu

SEQ ID NO: 2520774 - RNA, 16 nt, Chlamydophila pneumoniae CWL029
uucacaucuuaaaaac

SEQ ID NO: 2520775 - RNA, 22 nt, Chlamydophila pneumoniae CWL029
uucacaucuuuagaaucaagag

SEQ ID NO: 2520776 - RNA, 21 nt, Chlamydophila pneumoniae CWL029
uucacaucuuucucuaaaaua

SEQ ID NO: 2520777 - RNA, 13 nt, Chlamydophila pneumoniae CWL029
uucaccagaagca

SEQ ID NO: 2520778 - RNA, 20 nt, Chlamydophila pneumoniae CWL029
uucaccagaagcauugagga

SEQ ID NO: 2520779 - RNA, 17 nt, Chlamydophila pneumoniae CWL029
uucaccauauaauagau

SEQ ID NO: 2520780 - RNA, 16 nt, Chlamydophila pneumoniae CWL029
uucaccuugaaguuuu

SEQ ID NO: 2520781 - RNA, 15 nt, Chlamydophila pneumoniae CWL029
uucacgacauacauc

SEQ ID NO: 2520782 - RNA, 16 nt, Chlamydophila pneumoniae CWL029
uucacgauaucuacca

SEQ ID NO: 2520783 - RNA, 19 nt, Chlamydophila pneumoniae CWL029
uucacuauuaggcuuuuuu

SEQ ID NO: 2520784 - RNA, 13 nt, Chlamydophila pneumoniae CWL029
uucacuccugaag

SEQ ID NO: 2520785 - RNA, 11 nt, Chlamydophila pneumoniae CWL029
uucacuucauc

SEQ ID NO: 2520786 - RNA, 16 nt, Chlamydophila pneumoniae CWL029
uucagaaggaucugau

SEQ ID NO: 2520787 - RNA, 19 nt, Chlamydophila pneumoniae CWL029
uucagaaugcccuuuaggg

SEQ ID NO: 2520788 - RNA, 15 nt, Chlamydophila pneumoniae CWL029
uucagaauucucaag

SEQ ID NO: 2520789 - RNA, 23 nt, Chlamydophila pneumoniae CWL029
uucagagagaacaggagguguau

SEQ ID NO: 2520790 - RNA, 16 nt, Chlamydophila pneumoniae CWL029
uucagaguugauuguc

SEQ ID NO: 2520791 - RNA, 21 nt, Chlamydophila pneumoniae CWL029
uucagaguugauugucucaac

SEQ ID NO: 2520792 - RNA, 19 nt, Chlamydophila pneumoniae CWL029
uucagaugauuuuaucugc

SEQ ID NO: 2520793 - RNA, 20 nt, Chlamydophila pneumoniae CWL029
uucagaugauuuuaucugcg

SEQ ID NO: 2520794 - RNA, 17 nt, Chlamydophila pneumoniae CWL029
uucagauggucagucuc

SEQ ID NO: 2520795 - RNA, 18 nt, Chlamydophila pneumoniae CWL029
uucagcaaacggagagca

SEQ ID NO: 2520796 - RNA, 21 nt, Chlamydophila pneumoniae CWL029
uucagcaaagaaguuauaauu

SEQ ID NO: 2520797 - RNA, 15 nt, Chlamydophila pneumoniae CWL029
uucagcaagaaaaua

SEQ ID NO: 2520798 - RNA, 13 nt, Chlamydophila pneumoniae CWL029
uucagcacugacu

SEQ ID NO: 2520799 - RNA, 12 nt, Chlamydophila pneumoniae CWL029
uucagcacuuuu

SEQ ID NO: 2520800 - RNA, 15 nt, Chlamydophila pneumoniae CWL029
uucagccgcaucaug

SEQ ID NO: 2520801 - RNA, 13 nt, Chlamydophila pneumoniae CWL029
uucagcuuugcuu

SEQ ID NO: 2520802 - RNA, 16 nt, Chlamydophila pneumoniae CWL029
uucaggacaugccuua

SEQ ID NO: 2520803 - RNA, 17 nt, Chlamydophila pneumoniae CWL029
uucaggacaugccuuag

SEQ ID NO: 2520804 - RNA, 14 nt, Chlamydophila pneumoniae CWL029
uucaggauuuagag

SEQ ID NO: 2520805 - RNA, 15 nt, Chlamydophila pneumoniae CWL029
uucaggauuuuccau

SEQ ID NO: 2520806 - RNA, 21 nt, Chlamydophila pneumoniae CWL029
uucaguauugcaagccgcaaa

SEQ ID NO: 2520807 - RNA, 13 nt, Chlamydophila pneumoniae CWL029
uucauacguuuuu

SEQ ID NO: 2520808 - RNA, 20 nt, Chlamydophila pneumoniae CWL029
uucauacuaaaaucuuucaa

SEQ ID NO: 2520809 - RNA, 16 nt, Chlamydophila pneumoniae CWL029
uucauagcauguucga

SEQ ID NO: 2520810 - RNA, 20 nt, Chlamydophila pneumoniae CWL029
uucauaugaaugacugcaga

SEQ ID NO: 2520811 - RNA, 16 nt, Chlamydophila pneumoniae CWL029
uucauauuuacgaaaa

SEQ ID NO: 2520812 - RNA, 15 nt, Chlamydophila pneumoniae CWL029
uucaucaaaacauaa

SEQ ID NO: 2520813 - RNA, 17 nt, Chlamydophila pneumoniae CWL029
uucaucaggagaacggu

SEQ ID NO: 2520814 - RNA, 22 nt, Chlamydophila pneumoniae CWL029
uucauccccgagagagaucugg

SEQ ID NO: 2520815 - RNA, 19 nt, Chlamydophila pneumoniae CWL029
uucaucccuacccucauca

SEQ ID NO: 2520816 - RNA, 14 nt, Chlamydophila pneumoniae CWL029
uucaucgauaggau

SEQ ID NO: 2520817 - RNA, 14 nt, Chlamydophila pneumoniae CWL029
uucaucuagaugau

SEQ ID NO: 2520818 - RNA, 16 nt, Chlamydophila pneumoniae CWL029
uucaucuucuuucuau

SEQ ID NO: 2520819 - RNA, 15 nt, Chlamydophila pneumoniae CWL029
uucaugaaaaaagaa

SEQ ID NO: 2520820 - RNA, 19 nt, Chlamydophila pneumoniae CWL029
uucaugauuccgcaaguaa

SEQ ID NO: 2520821 - RNA, 22 nt, Chlamydophila pneumoniae CWL029
uucaugauuccgcaaguaauca

SEQ ID NO: 2520822 - RNA, 14 nt, Chlamydophila pneumoniae CWL029
uucauguccuccau

SEQ ID NO: 2520823 - RNA, 22 nt, Chlamydophila pneumoniae CWL029
uucauguccuccauggaaagaa

SEQ ID NO: 2520824 - RNA, 16 nt, Chlamydophila pneumoniae CWL029
uucauuaagaacaucu

SEQ ID NO: 2520825 - RNA, 13 nt, Chlamydophila pneumoniae CWL029
uucauuaagaucc

SEQ ID NO: 2520826 - RNA, 18 nt, Chlamydophila pneumoniae CWL029
uucauuccaggauucuau

SEQ ID NO: 2520827 - RNA, 22 nt, Chlamydophila pneumoniae CWL029
uucauuucgauaacacuucuuu

SEQ ID NO: 2520828 - RNA, 16 nt, Chlamydophila pneumoniae CWL029
uuccaaaauaaaagga

SEQ ID NO: 2520829 - RNA, 17 nt, Chlamydophila pneumoniae CWL029
uuccaaaauaaaaggag

SEQ ID NO: 2520830 - RNA, 23 nt, Chlamydophila pneumoniae CWL029
uuccaaagcuaggcgauaguaaa

SEQ ID NO: 2520831 - RNA, 14 nt, Chlamydophila pneumoniae CWL029
uuccaaaggaaaau

SEQ ID NO: 2520832 - RNA, 13 nt, Chlamydophila pneumoniae CWL029
uuccaacuucaac

SEQ ID NO: 2520833 - RNA, 21 nt, Chlamydophila pneumoniae CWL029
uuccaacuuuugaagauccug

SEQ ID NO: 2520834 - RNA, 20 nt, Chlamydophila pneumoniae CWL029
uuccaagacaacaccuccca

SEQ ID NO: 2520835 - RNA, 18 nt, Chlamydophila pneumoniae CWL029
uuccaagacaauaaaaaa

SEQ ID NO: 2520836 - RNA, 21 nt, Chlamydophila pneumoniae CWL029
uuccaagacaauaaaaaagag

SEQ ID NO: 2520837 - RNA, 13 nt, Chlamydophila pneumoniae CWL029
uuccaagagucuu

SEQ ID NO: 2520838 - RNA, 12 nt, Chlamydophila pneumoniae CWL029
uuccaagugauc

SEQ ID NO: 2520839 - RNA, 17 nt, Chlamydophila pneumoniae CWL029
uuccaauccauucugag

SEQ ID NO: 2520840 - RNA, 19 nt, Chlamydophila pneumoniae CWL029
uuccaaugcaugaaucucu

SEQ ID NO: 2520841 - RNA, 20 nt, Chlamydophila pneumoniae CWL029
uuccaggacguaaaaagaaa

SEQ ID NO: 2520842 - RNA, 23 nt, Chlamydophila pneumoniae CWL029
uuccauaauuuuagcuucuuuuu

SEQ ID NO: 2520843 - RNA, 18 nt, Chlamydophila pneumoniae CWL029
uuccauacccaaauuucu

SEQ ID NO: 2520844 - RNA, 22 nt, Chlamydophila pneumoniae CWL029
uuccauagaguaucuaaaacuu

SEQ ID NO: 2520845 - RNA, 20 nt, Chlamydophila pneumoniae CWL029
uuccauagccaaggagcuau

SEQ ID NO: 2520846 - RNA, 21 nt, Chlamydophila pneumoniae CWL029
uuccauagguuagaaaugaaa

SEQ ID NO: 2520847 - RNA, 18 nt, Chlamydophila pneumoniae CWL029
uuccauaucaaagaucug

SEQ ID NO: 2520848 - RNA, 20 nt, Chlamydophila pneumoniae CWL029
uuccauccugucuauuucuu

SEQ ID NO: 2520849 - RNA, 19 nt, Chlamydophila pneumoniae CWL029
uuccauggauauggaaugg

SEQ ID NO: 2520850 - RNA, 19 nt, Chlamydophila pneumoniae CWL029
uuccauuagggcauucugu

SEQ ID NO: 2520851 - RNA, 17 nt, Chlamydophila pneumoniae CWL029
uuccauuauacuuuuuu

SEQ ID NO: 2520852 - RNA, 23 nt, Chlamydophila pneumoniae CWL029
uucccaagcugaaagaaugccau

SEQ ID NO: 2520853 - RNA, 18 nt, Chlamydophila pneumoniae CWL029
uucccccgcguaauagca

SEQ ID NO: 2520854 - RNA, 16 nt, Chlamydophila pneumoniae CWL029
uuccccuaauagggga

SEQ ID NO: 2520855 - RNA, 21 nt, Chlamydophila pneumoniae CWL029
uuccccuucagaggcuagaaa

SEQ ID NO: 2520856 - RNA, 15 nt, Chlamydophila pneumoniae CWL029
uuccccuuuaaagcc

SEQ ID NO: 2520857 - RNA, 18 nt, Chlamydophila pneumoniae CWL029
uucccgacucaaucaaau

SEQ ID NO: 2520858 - RNA, 17 nt, Chlamydophila pneumoniae CWL029
uucccuaagaguuccaa

SEQ ID NO: 2520859 - RNA, 15 nt, Chlamydophila pneumoniae CWL029
uucccuaccugagga

SEQ ID NO: 2520860 - RNA, 15 nt, Chlamydophila pneumoniae CWL029
uucccuauaaagcaa

SEQ ID NO: 2520861 - RNA, 14 nt, Chlamydophila pneumoniae CWL029
uucccucuucuucc

SEQ ID NO: 2520862 - RNA, 22 nt, Chlamydophila pneumoniae CWL029
uucccucuucuuccaauaauuu

SEQ ID NO: 2520863 - RNA, 15 nt, Chlamydophila pneumoniae CWL029
uucccugacacagag

SEQ ID NO: 2520864 - RNA, 17 nt, Chlamydophila pneumoniae CWL029
uucccuggaugaacucc

SEQ ID NO: 2520865 - RNA, 17 nt, Chlamydophila pneumoniae CWL029
uucuauauguaauuucc

SEQ ID NO: 2520866 - RNA, 12 nt, Chlamydophila pneumoniae CWL029
uucuauuaaaaa

SEQ ID NO: 2520867 - RNA, 22 nt, Chlamydophila pneumoniae CWL029
uucuauucgcugucuagaacac

SEQ ID NO: 2520868 - RNA, 14 nt, Chlamydophila pneumoniae CWL029
uucuauuucugcug

SEQ ID NO: 2520869 - RNA, 17 nt, Chlamydophila pneumoniae CWL029
uucuauuuucaggaggc

SEQ ID NO: 2520870 - RNA, 18 nt, Chlamydophila pneumoniae CWL029
uucucaagaucuucauca

SEQ ID NO: 2520871 - RNA, 18 nt, Chlamydophila pneumoniae CWL029
uucucauagcuuccugua

SEQ ID NO: 2520872 - RNA, 21 nt, Chlamydophila pneumoniae CWL029
uucucauccagacaagacacu

SEQ ID NO: 2520873 - RNA, 20 nt, Chlamydophila pneumoniae CWL029
uucuccaaccucgagauccu

SEQ ID NO: 2520874 - RNA, 19 nt, Chlamydophila pneumoniae CWL029
uucuccaacuuccauauga

SEQ ID NO: 2520875 - RNA, 15 nt, Chlamydophila pneumoniae CWL029
uucucccauagcaau

SEQ ID NO: 2520876 - RNA, 16 nt, Chlamydophila pneumoniae CWL029
uucucccauagcaaug

SEQ ID NO: 2520877 - RNA, 11 nt, Chlamydophila pneumoniae CWL029
uucuccuauug

SEQ ID NO: 2520878 - RNA, 20 nt, Chlamydophila pneumoniae CWL029
uucuccucgcaauccaggaa

SEQ ID NO: 2520879 - RNA, 15 nt, Chlamydophila pneumoniae CWL029
uucuccucuuucuua

SEQ ID NO: 2520880 - RNA, 22 nt, Chlamydophila pneumoniae CWL029
uucuccugacucuuuuaagaca

SEQ ID NO: 2520881 - RNA, 22 nt, Chlamydophila pneumoniae CWL029
uucucgaacaggagagagaagg

SEQ ID NO: 2520882 - RNA, 17 nt, Chlamydophila pneumoniae CWL029
uucucuaagcagccucu

SEQ ID NO: 2520883 - RNA, 18 nt, Chlamydophila pneumoniae CWL029
uucucuaagcagccucuu

SEQ ID NO: 2520884 - RNA, 18 nt, Chlamydophila pneumoniae CWL029
uucucuacuaaaaucuca

SEQ ID NO: 2520885 - RNA, 22 nt, Chlamydophila pneumoniae CWL029
uucucuccacaggaaugaaacc

SEQ ID NO: 2520886 - RNA, 14 nt, Chlamydophila pneumoniae CWL029
uucucucucugcag

SEQ ID NO: 2520887 - RNA, 21 nt, Chlamydophila pneumoniae CWL029
uucucugaacuugauuuguuu

SEQ ID NO: 2520888 - RNA, 14 nt, Chlamydophila pneumoniae CWL029
uucucugagcagcu

SEQ ID NO: 2520889 - RNA, 21 nt, Chlamydophila pneumoniae CWL029
uucucugagcagcuucgcaau

SEQ ID NO: 2520890 - RNA, 18 nt, Chlamydophila pneumoniae CWL029
uucucugauucucauaaa

SEQ ID NO: 2520891 - RNA, 22 nt, Chlamydophila pneumoniae CWL029
uucucugguauagaaacaccgu

SEQ ID NO: 2520892 - RNA, 22 nt, Chlamydophila pneumoniae CWL029
uucucuguaucgauaacgauuu

SEQ ID NO: 2520893 - RNA, 14 nt, Chlamydophila pneumoniae CWL029
uucugaaacaaugc

SEQ ID NO: 2520894 - RNA, 15 nt, Chlamydophila pneumoniae CWL029
uucugaaacaaugca

SEQ ID NO: 2520895 - RNA, 16 nt, Chlamydophila pneumoniae CWL029
uucugaaaucaaaaaa

SEQ ID NO: 2520896 - RNA, 19 nt, Chlamydophila pneumoniae CWL029
uucugaaauugucuucagu

SEQ ID NO: 2520897 - RNA, 20 nt, Chlamydophila pneumoniae CWL029
uucugaaauugucuucagug

SEQ ID NO: 2520898 - RNA, 23 nt, Chlamydophila pneumoniae CWL029
uucugaaggaaaucccgaaugug

SEQ ID NO: 2520899 - RNA, 14 nt, Chlamydophila pneumoniae CWL029
uucugaauagcucu

SEQ ID NO: 2520900 - RNA, 14 nt, Chlamydophila pneumoniae CWL029
uucugagcuugccu

SEQ ID NO: 2520901 - RNA, 19 nt, Chlamydophila pneumoniae CWL029
uucugauccgaaaagaacc

SEQ ID NO: 2520902 - RNA, 22 nt, Chlamydophila pneumoniae CWL029
uucugauuagagccccaacccu

SEQ ID NO: 2520903 - RNA, 15 nt, Chlamydophila pneumoniae CWL029
uucugauugagaaua

SEQ ID NO: 2520904 - RNA, 20 nt, Chlamydophila pneumoniae CWL029
ucugugguuuuuauucuuaa

SEQ ID NO: 2520905 - RNA, 22 nt, Chlamydophila pneumoniae CWL029
ucugugugacgacaaaucacga

SEQ ID NO: 2520906 - RNA, 14 nt, Chlamydophila pneumoniae CWL029
ucuguuaaaaacaa

SEQ ID NO: 2520907 - RNA, 17 nt, Chlamydophila pneumoniae CWL029
ucuguuaaaaacaagau

SEQ ID NO: 2520908 - RNA, 19 nt, Chlamydophila pneumoniae CWL029
ucuguucugcuucuguaaa

SEQ ID NO: 2520909 - RNA, 13 nt, Chlamydophila pneumoniae CWL029
ucuguugggagcu

SEQ ID NO: 2520910 - RNA, 12 nt, Chlamydophila pneumoniae CWL029
ucuguuuucucu

SEQ ID NO: 2520911 - RNA, 13 nt, Chlamydophila pneumoniae CWL029
ucuguuuuuugaa

SEQ ID NO: 2520912 - RNA, 21 nt, Chlamydophila pneumoniae CWL029
ucuguuuuuugaaaacuucaa

SEQ ID NO: 2520913 - RNA, 12 nt, Chlamydophila pneumoniae CWL029
ucuuaacaauau

SEQ ID NO: 2520914 - RNA, 15 nt, Chlamydophila pneumoniae CWL029
ucuuaacuggcaauc

SEQ ID NO: 2520915 - RNA, 18 nt, Chlamydophila pneumoniae CWL029
ucuuaacuggcaaucuaa

SEQ ID NO: 2520916 - RNA, 21 nt, Chlamydophila pneumoniae CWL029
ucuuaacuggcaaucuaaaau

SEQ ID NO: 2520917 - RNA, 14 nt, Chlamydophila pneumoniae CWL029
ucuuaagaauaaaa

SEQ ID NO: 2520918 - RNA, 16 nt, Chlamydophila pneumoniae CWL029
ucuuaagaauaaaaua

SEQ ID NO: 2520919 - RNA, 22 nt, Chlamydophila pneumoniae CWL029
ucuuaagagaaaggcgcucuua

SEQ ID NO: 2520920 - RNA, 17 nt, Chlamydophila pneumoniae CWL029
ucuuaagagcaaacauc

SEQ ID NO: 2520921 - RNA, 24 nt, Chlamydophila pneumoniae CWL029
ucuuaagcuaccauuaaggaaucc

SEQ ID NO: 2520922 - RNA, 23 nt, Chlamydophila pneumoniae CWL029
ucuuaaugcgaugcggucagaaa

SEQ ID NO: 2520923 - RNA, 23 nt, Chlamydophila pneumoniae CWL029
ucuuaccuaguagagguugagug

SEQ ID NO: 2520924 - RNA, 16 nt, Chlamydophila pneumoniae CWL029
ucuuagaaacacaguu

SEQ ID NO: 2520925 - RNA, 19 nt, Chlamydophila pneumoniae CWL029
ucuuagaauccaaagacuu

SEQ ID NO: 2520926 - RNA, 14 nt, Chlamydophila pneumoniae CWL029
ucuuagaauccucu

SEQ ID NO: 2520927 - RNA, 16 nt, Chlamydophila pneumoniae CWL029
ucuuagccaaaauuuc

SEQ ID NO: 2520928 - RNA, 20 nt, Chlamydophila pneumoniae CWL029
ucuuagcguauccgcugccc

SEQ ID NO: 2520929 - RNA, 16 nt, Chlamydophila pneumoniae CWL029
ucuuaguaaagaauca

SEQ ID NO: 2520930 - RNA, 15 nt, Chlamydophila pneumoniae CWL029
ucuuaucaagagcuc

SEQ ID NO: 2520931 - RNA, 17 nt, Chlamydophila pneumoniae CWL029
ucuuaucaugaaaagga

SEQ ID NO: 2520932 - RNA, 16 nt, Chlamydophila pneumoniae CWL029
ucuuaucuaaagaaau

SEQ ID NO: 2520933 - RNA, 17 nt, Chlamydophila pneumoniae CWL029
ucuuaucugcuauguag

SEQ ID NO: 2520934 - RNA, 18 nt, Chlamydophila pneumoniae CWL029
ucuuaugaaguccagacu

SEQ ID NO: 2520935 - RNA, 14 nt, Chlamydophila pneumoniae CWL029
ucuuaugaccaaga

SEQ ID NO: 2520936 - RNA, 16 nt, Chlamydophila pneumoniae CWL029
ucuuaugggagaagcu

SEQ ID NO: 2520937 - RNA, 17 nt, Chlamydophila pneumoniae CWL029
ucuuauggucagaagcu

SEQ ID NO: 2520938 - RNA, 18 nt, Chlamydophila pneumoniae CWL029
ucuuauguuaaaaauacc

SEQ ID NO: 2520939 - RNA, 16 nt, Chlamydophila pneumoniae CWL029
ucuuauucacuggaau

SEQ ID NO: 2520940 - RNA, 20 nt, Chlamydophila pneumoniae CWL029
ucuucaaaagaccgccuucu

SEQ ID NO: 2520941 - RNA, 22 nt, Chlamydophila pneumoniae CWL029
ucuucaaaagaccgccuucuaa

SEQ ID NO: 2520942 - RNA, 13 nt, Chlamydophila pneumoniae CWL029
ucuucaaagaacu

SEQ ID NO: 2520943 - RNA, 22 nt, Chlamydophila pneumoniae CWL029
ucuucaaagaacuuaaaauuca

SEQ ID NO: 2520944 - RNA, 11 nt, Chlamydophila pneumoniae CWL029
ucuucaagaaa

SEQ ID NO: 2520945 - RNA, 13 nt, Chlamydophila pneumoniae CWL029
ucuucaagaaaug

SEQ ID NO: 2520946 - RNA, 13 nt, Chlamydophila pneumoniae CWL029
ucuucaagagcuu

SEQ ID NO: 2520947 - RNA, 22 nt, Chlamydophila pneumoniae CWL029
ucuucaagagcuuuuacaaacc

SEQ ID NO: 2520948 - RNA, 22 nt, Chlamydophila pneumoniae CWL029
ucuucaagguacugcucaauga

SEQ ID NO: 2520949 - RNA, 20 nt, Chlamydophila pneumoniae CWL029
ucuucaauaggaauuagaga

SEQ ID NO: 2520950 - RNA, 21 nt, Chlamydophila pneumoniae CWL029
ucuucaauaggaauuagagaa

SEQ ID NO: 2520951 - RNA, 16 nt, Chlamydophila pneumoniae CWL029
ucuucaauaucuugaa

SEQ ID NO: 2520952 - RNA, 13 nt, Chlamydophila pneumoniae CWL029
ucuucaauuucuu

SEQ ID NO: 2520953 - RNA, 19 nt, Chlamydophila pneumoniae CWL029
ucuucacuuauaagcugcu

SEQ ID NO: 2520954 - RNA, 22 nt, Chlamydophila pneumoniae CWL029
ucuucagcccacuguuuugcuu

SEQ ID NO: 2520955 - RNA, 15 nt, Chlamydophila pneumoniae CWL029
ucuucaggaacagca

SEQ ID NO: 2520956 - RNA, 15 nt, Chlamydophila pneumoniae CWL029
ucuucaggugaagga

SEQ ID NO: 2520957 - RNA, 23 nt, Chlamydophila pneumoniae CWL029
ucuucagucauucuauggucucc

SEQ ID NO: 2520958 - RNA, 18 nt, Chlamydophila pneumoniae CWL029
ucuucauaugcucucccg

SEQ ID NO: 2520959 - RNA, 15 nt, Chlamydophila pneumoniae CWL029
ucuucaucaauacga

SEQ ID NO: 2520960 - RNA, 13 nt, Chlamydophila pneumoniae CWL029
ucuucauccgaag

SEQ ID NO: 2520961 - RNA, 15 nt, Chlamydophila pneumoniae CWL029
ucuucaugaaaaaag

SEQ ID NO: 2520962 - RNA, 16 nt, Chlamydophila pneumoniae CWL029
ucuucaugaaaaaaga

SEQ ID NO: 2520963 - RNA, 17 nt, Chlamydophila pneumoniae CWL029
ucuucaugaaaaaagaa

SEQ ID NO: 2520964 - RNA, 18 nt, Chlamydophila pneumoniae CWL029
ucuucauuauuaaacgaa

SEQ ID NO: 2520965 - RNA, 16 nt, Chlamydophila pneumoniae CWL029
ucuucauuccaggauu

SEQ ID NO: 2520966 - RNA, 19 nt, Chlamydophila pneumoniae CWL029
ucuucauugcaaaaaugaa

SEQ ID NO: 2520967 - RNA, 20 nt, Chlamydophila pneumoniae CWL029
ucuucauugcaaaaaugaaa

SEQ ID NO: 2520968 - RNA, 17 nt, Chlamydophila pneumoniae CWL029
ucuucauuuucuuuuaa

SEQ ID NO: 2520969 - RNA, 14 nt, Chlamydophila pneumoniae CWL029
ucuuccaaagacug

SEQ ID NO: 2520970 - RNA, 16 nt, Chlamydophila pneumoniae CWL029
ucuuccaaagacugag

SEQ ID NO: 2520971 - RNA, 13 nt, Chlamydophila pneumoniae CWL029
ucuuccauaagau

SEQ ID NO: 2520972 - RNA, 17 nt, Chlamydophila pneumoniae CWL029
ucuucccauuucuucuu

SEQ ID NO: 2520973 - RNA, 21 nt, Chlamydophila pneumoniae CWL029
ucuucccauuucuucuuagaa

SEQ ID NO: 2520974 - RNA, 16 nt, Chlamydophila pneumoniae CWL029
ucuuccccccucacaa

SEQ ID NO: 2520975 - RNA, 14 nt, Chlamydophila pneumoniae CWL029
ucuuccgauuaacu

SEQ ID NO: 2520976 - RNA, 22 nt, Chlamydophila pneumoniae CWL029
uucugauugagaauaaaacuuu

SEQ ID NO: 2520977 - RNA, 15 nt, Chlamydophila pneumoniae CWL029
uucugcaaucugaau

SEQ ID NO: 2520978 - RNA, 13 nt, Chlamydophila pneumoniae CWL029
uucugcaggauuu

SEQ ID NO: 2520979 - RNA, 16 nt, Chlamydophila pneumoniae CWL029
uucugccuuaugcuca

SEQ ID NO: 2520980 - RNA, 12 nt, Chlamydophila pneumoniae CWL029
uucugcuagagc

SEQ ID NO: 2520981 - RNA, 14 nt, Chlamydophila pneumoniae CWL029
uucugcuucuguaa

SEQ ID NO: 2520982 - RNA, 15 nt, Chlamydophila pneumoniae CWL029
uucugcuucuguaaa

SEQ ID NO: 2520983 - RNA, 15 nt, Chlamydophila pneumoniae CWL029
uucuggaauuuccca

SEQ ID NO: 2520984 - RNA, 19 nt, Chlamydophila pneumoniae CWL029
uucuggagaaaaaauaucu

SEQ ID NO: 2520985 - RNA, 13 nt, Chlamydophila pneumoniae CWL029
uucuggauucaaa

SEQ ID NO: 2520986 - RNA, 22 nt, Chlamydophila pneumoniae CWL029
uucuguaaagugaaauugaacu

SEQ ID NO: 2520987 - RNA, 13 nt, Chlamydophila pneumoniae CWL029
uucuguaacacuu

SEQ ID NO: 2520988 - RNA, 13 nt, Chlamydophila pneumoniae CWL029
uucuguaguucuu

SEQ ID NO: 2520989 - RNA, 17 nt, Chlamydophila pneumoniae CWL029
uucuguaguucuugcca

SEQ ID NO: 2520990 - RNA, 19 nt, Chlamydophila pneumoniae CWL029
uucuguaguuuguucacuu

SEQ ID NO: 2520991 - RNA, 23 nt, Chlamydophila pneumoniae CWL029
uucugucuauaagauagcucuug

SEQ ID NO: 2520992 - RNA, 14 nt, Chlamydophila pneumoniae CWL029
uucuuaacaauaua

SEQ ID NO: 2520993 - RNA, 22 nt, Chlamydophila pneumoniae CWL029
uucuuacuaaagaaagagucuc

SEQ ID NO: 2520994 - RNA, 23 nt, Chlamydophila pneumoniae CWL029
uucuuacuaaagaaagagucuca

SEQ ID NO: 2520995 - RNA, 22 nt, Chlamydophila pneumoniae CWL029
uucuuagaagagaaaguagaga

SEQ ID NO: 2520996 - RNA, 15 nt, Chlamydophila pneumoniae CWL029
uucuuagcgcaugua

SEQ ID NO: 2520997 - RNA, 19 nt, Chlamydophila pneumoniae CWL029
uucuuagcgcauguauugu

SEQ ID NO: 2520998 - RNA, 22 nt, Chlamydophila pneumoniae CWL029
uucuuagcgcauguauuguguu

SEQ ID NO: 2520999 - RNA, 14 nt, Chlamydophila pneumoniae CWL029
uucuuauaaaaaag

SEQ ID NO: 2521000 - RNA, 15 nt, Chlamydophila pneumoniae CWL029
uucuuauuacagaaa

SEQ ID NO: 2521001 - RNA, 21 nt, Chlamydophila pneumoniae CWL029
uucuucaaagaacuuaaaauu

SEQ ID NO: 2521002 - RNA, 23 nt, Chlamydophila pneumoniae CWL029
uucuucaaagucaaauacuucuc

SEQ ID NO: 2521003 - RNA, 14 nt, Chlamydophila pneumoniae CWL029
uucuucaacgagga

SEQ ID NO: 2521004 - RNA, 23 nt, Chlamydophila pneumoniae CWL029
uucuucaacgaggaaggcuccag

SEQ ID NO: 2521005 - RNA, 14 nt, Chlamydophila pneumoniae CWL029
uucuucaagaaaug

SEQ ID NO: 2521006 - RNA, 16 nt, Chlamydophila pneumoniae CWL029
uucuucaagaaaugcc

SEQ ID NO: 2521007 - RNA, 22 nt, Chlamydophila pneumoniae CWL029
uucuucaauaggaauuagagaa

SEQ ID NO: 2521008 - RNA, 21 nt, Chlamydophila pneumoniae CWL029
uucuucagaguugucaaguaa

SEQ ID NO: 2521009 - RNA, 14 nt, Chlamydophila pneumoniae CWL029
uucuuccaauaauu

SEQ ID NO: 2521010 - RNA, 20 nt, Chlamydophila pneumoniae CWL029
uucuuccuguuccauaucaa

SEQ ID NO: 2521011 - RNA, 17 nt, Chlamydophila pneumoniae CWL029
uucuucgguguagaucu

SEQ ID NO: 2521012 - RNA, 18 nt, Chlamydophila pneumoniae CWL029
uucuucguuagagaagag

SEQ ID NO: 2521013 - RNA, 19 nt, Chlamydophila pneumoniae CWL029
uucuucguuuauaacauca

SEQ ID NO: 2521014 - RNA, 19 nt, Chlamydophila pneumoniae CWL029
uucuucugaauagcucuuu

SEQ ID NO: 2521015 - RNA, 20 nt, Chlamydophila pneumoniae CWL029
uucuucugaauagcucuuuu

SEQ ID NO: 2521016 - RNA, 20 nt, Chlamydophila pneumoniae CWL029
uucuucuggcugagagaagc

SEQ ID NO: 2521017 - RNA, 18 nt, Chlamydophila pneumoniae CWL029
uucuucuucggaucugua

SEQ ID NO: 2521018 - RNA, 14 nt, Chlamydophila pneumoniae CWL029
uucuugaaaaaucc

SEQ ID NO: 2521019 - RNA, 19 nt, Chlamydophila pneumoniae CWL029
uucuugaagaucuccgaag

SEQ ID NO: 2521020 - RNA, 19 nt, Chlamydophila pneumoniae CWL029
uucuugaaguucuucaaga

SEQ ID NO: 2521021 - RNA, 20 nt, Chlamydophila pneumoniae CWL029
uucuugauccaucugcucuu

SEQ ID NO: 2521022 - RNA, 15 nt, Chlamydophila pneumoniae CWL029
uucuugcaaagauaa

SEQ ID NO: 2521023 - RNA, 22 nt, Chlamydophila pneumoniae CWL029
uucuugcgacauaaccaucgau

SEQ ID NO: 2521024 - RNA, 22 nt, Chlamydophila pneumoniae CWL029
uucuugcucugacaaguguguu

SEQ ID NO: 2521025 - RNA, 21 nt, Chlamydophila pneumoniae CWL029
uucuuggaauauagguuuaga

SEQ ID NO: 2521026 - RNA, 22 nt, Chlamydophila pneumoniae CWL029
uucuuggagaagagguaauaau

SEQ ID NO: 2521027 - RNA, 21 nt, Chlamydophila pneumoniae CWL029
uucuugguaggaugucgcuuu

SEQ ID NO: 2521028 - RNA, 22 nt, Chlamydophila pneumoniae CWL029
uucuuggucggaguuuuuuucu

SEQ ID NO: 2521029 - RNA, 17 nt, Chlamydophila pneumoniae CWL029
uucuuguugcaauagca

SEQ ID NO: 2521030 - RNA, 18 nt, Chlamydophila pneumoniae CWL029
uucuuguugcaauagcaa

SEQ ID NO: 2521031 - RNA, 15 nt, Chlamydophila pneumoniae CWL029
uucuuuaagauuucc

SEQ ID NO: 2521032 - RNA, 18 nt, Chlamydophila pneumoniae CWL029
uucuuuaggguaaagaaa

SEQ ID NO: 2521033 - RNA, 13 nt, Chlamydophila pneumoniae CWL029
uucuuucaaacca

SEQ ID NO: 2521034 - RNA, 16 nt, Chlamydophila pneumoniae CWL029
uucuuucaauaacaga

SEQ ID NO: 2521035 - RNA, 17 nt, Chlamydophila pneumoniae CWL029
uuuaaaaauagaaauaa

SEQ ID NO: 2521036 - RNA, 23 nt, Chlamydophila pneumoniae CWL029
uuuaaaagauuccuuaccuauau

SEQ ID NO: 2521037 - RNA, 15 nt, Chlamydophila pneumoniae CWL029
uuuaaaaugauagcc

SEQ ID NO: 2521038 - RNA, 19 nt, Chlamydophila pneumoniae CWL029
uuuaaaguguguaaauguu

SEQ ID NO: 2521039 - RNA, 21 nt, Chlamydophila pneumoniae CWL029
uuuaaauacagauucaccaag

SEQ ID NO: 2521040 - RNA, 22 nt, Chlamydophila pneumoniae CWL029
uuuaaauagcaucccuucuucu

SEQ ID NO: 2521041 - RNA, 18 nt, Chlamydophila pneumoniae CWL029
uuuaaaugagcaauguuu

SEQ ID NO: 2521042 - RNA, 13 nt, Chlamydophila pneumoniae CWL029
uuuaaaugccuua

SEQ ID NO: 2521043 - RNA, 17 nt, Chlamydophila pneumoniae CWL029
uuuaaaugccuuaaaug

SEQ ID NO: 2521044 - RNA, 19 nt, Chlamydophila pneumoniae CWL029
uuuaaaugccuuaaaugua

SEQ ID NO: 2521045 - RNA, 19 nt, Chlamydophila pneumoniae CWL029
uuuaacaugccaaaaguuu

SEQ ID NO: 2521046 - RNA, 23 nt, Chlamydophila pneumoniae CWL029
uuuaaccucuuuucuuaucauga

SEQ ID NO: 2521047 - RNA, 21 nt, Chlamydophila pneumoniae CWL029
uuuaacgcuaagcucuuaauu

SEQ ID NO: 2521048 - RNA, 15 nt, Chlamydophila pneumoniae CWL029
uuuaacuuaaagacu

SEQ ID NO: 2521049 - RNA, 17 nt, Chlamydophila pneumoniae CWL029
uuuaacuucuaaaagca

SEQ ID NO: 2521050 - RNA, 18 nt, Chlamydophila pneumoniae CWL029
uuuaagaaaugcaaacca

SEQ ID NO: 2521051 - RNA, 14 nt, Chlamydophila pneumoniae CWL029
uuuaagauuuccuu

SEQ ID NO: 2521052 - RNA, 17 nt, Chlamydophila pneumoniae CWL029
uuuaagucacuaaagau

SEQ ID NO: 2521053 - RNA, 16 nt, Chlamydophila pneumoniae CWL029
uuuaaguccuucuucc

SEQ ID NO: 2521054 - RNA, 19 nt, Chlamydophila pneumoniae CWL029
uuuaauaaaauuuaaaaaa

SEQ ID NO: 2521055 - RNA, 14 nt, Chlamydophila pneumoniae CWL029
uuuaauacaaaaaa

SEQ ID NO: 2521056 - RNA, 16 nt, Chlamydophila pneumoniae CWL029
uuuaauacaaaaaaua

SEQ ID NO: 2521057 - RNA, 13 nt, Chlamydophila pneumoniae CWL029
uuuaaucagagga

SEQ ID NO: 2521058 - RNA, 23 nt, Chlamydophila pneumoniae CWL029
uuuaauccaaaaacuucuaacug

SEQ ID NO: 2521059 - RNA, 21 nt, Chlamydophila pneumoniae CWL029
uuuaaucgauacgguuuuuau

SEQ ID NO: 2521060 - RNA, 16 nt, Chlamydophila pneumoniae CWL029
uuuacaaauaaaauga

SEQ ID NO: 2521061 - RNA, 16 nt, Chlamydophila pneumoniae CWL029
uuuacaaucucugcga

SEQ ID NO: 2521062 - RNA, 16 nt, Chlamydophila pneumoniae CWL029
uuuacaauuagagauu

SEQ ID NO: 2521063 - RNA, 20 nt, Chlamydophila pneumoniae CWL029
uuuacacugcuucaaaacau

SEQ ID NO: 2521064 - RNA, 13 nt, Chlamydophila pneumoniae CWL029
uuuacgaaaacau

SEQ ID NO: 2521065 - RNA, 17 nt, Chlamydophila pneumoniae CWL029
uuuacgaaucuuuuuca

SEQ ID NO: 2521066 - RNA, 16 nt, Chlamydophila pneumoniae CWL029
uuuacuaacaaaauuu

SEQ ID NO: 2521067 - RNA, 19 nt, Chlamydophila pneumoniae CWL029
uuuacuaacaaaauuucuu

SEQ ID NO: 2521068 - RNA, 20 nt, Chlamydophila pneumoniae CWL029
uuuacuaacaaaauuucuua

SEQ ID NO: 2521069 - RNA, 22 nt, Chlamydophila pneumoniae CWL029
uuuacuaacaaaauuucuuaua

SEQ ID NO: 2521070 - RNA, 22 nt, Chlamydophila pneumoniae CWL029
uuuacuaacucuguaauauuca

SEQ ID NO: 2521071 - RNA, 13 nt, Chlamydophila pneumoniae CWL029
uuuacugaaauua

SEQ ID NO: 2521072 - RNA, 22 nt, Chlamydophila pneumoniae CWL029
uuuacuuuuaauccuuucacaa

SEQ ID NO: 2521073 - RNA, 14 nt, Chlamydophila pneumoniae CWL029
uuuagaaaaagauc

SEQ ID NO: 2521074 - RNA, 19 nt, Chlamydophila pneumoniae CWL029
uuuagaaauguuuuuaaac

SEQ ID NO: 2521075 - RNA, 13 nt, Chlamydophila pneumoniae CWL029
uuuagaauaagag

SEQ ID NO: 2521076 - RNA, 14 nt, Chlamydophila pneumoniae CWL029
uuuagaauaagagc

SEQ ID NO: 2521077 - RNA, 15 nt, Chlamydophila pneumoniae CWL029
uuuagagagaaacau

SEQ ID NO: 2521078 - RNA, 17 nt, Chlamydophila pneumoniae CWL029
uuuagagccuuuucaga

SEQ ID NO: 2521079 - RNA, 21 nt, Chlamydophila pneumoniae CWL029
uuuagaguacacagcacaaga

SEQ ID NO: 2521080 - RNA, 18 nt, Chlamydophila pneumoniae CWL029
uuuagcaugacuuuuuca

SEQ ID NO: 2521081 - RNA, 16 nt, Chlamydophila pneumoniae CWL029
uuuagcuacagaaaga

SEQ ID NO: 2521082 - RNA, 17 nt, Chlamydophila pneumoniae CWL029
uuuagcuauuugaaaua

SEQ ID NO: 2521083 - RNA, 23 nt, Chlamydophila pneumoniae CWL029
uuuaggagcauagacucuuccuu

SEQ ID NO: 2521084 - RNA, 15 nt, Chlamydophila pneumoniae CWL029
uuuaguuucccacua

SEQ ID NO: 2521085 - RNA, 13 nt, Chlamydophila pneumoniae CWL029
uuuauaaacuucu

SEQ ID NO: 2521086 - RNA, 16 nt, Chlamydophila pneumoniae CWL029
uuuauauaaagaucuu

SEQ ID NO: 2521087 - RNA, 14 nt, Chlamydophila pneumoniae CWL029
uuuauauuaagaau

SEQ ID NO: 2521088 - RNA, 23 nt, Chlamydophila pneumoniae CWL029
uuuauauuuuuugagaaauauaa

SEQ ID NO: 2521089 - RNA, 14 nt, Chlamydophila pneumoniae CWL029
uuuaucaugagaau

SEQ ID NO: 2521090 - RNA, 16 nt, Chlamydophila pneumoniae CWL029
uuuaucgacucuucca

SEQ ID NO: 2521091 - RNA, 22 nt, Chlamydophila pneumoniae CWL029
uuuaucuccccauucacaaauc

SEQ ID NO: 2521092 - RNA, 16 nt, Chlamydophila pneumoniae CWL029
uuuaucugcguuucuu

SEQ ID NO: 2521093 - RNA, 21 nt, Chlamydophila pneumoniae CWL029
uuuaucuguuaaaaacaagau

SEQ ID NO: 2521094 - RNA, 22 nt, Chlamydophila pneumoniae CWL029
uuuaugacacagcuaaucaauc

SEQ ID NO: 2521095 - RNA, 14 nt, Chlamydophila pneumoniae CWL029
uuuauguuuucucg

SEQ ID NO: 2521096 - RNA, 16 nt, Chlamydophila pneumoniae CWL029
uuuauuuaaaauuucu

SEQ ID NO: 2521097 - RNA, 18 nt, Chlamydophila pneumoniae CWL029
uuuauuuaaauaaaacca

SEQ ID NO: 2521098 - RNA, 22 nt, Chlamydophila pneumoniae CWL029
uuuauuuuaggaagcuuaucaa

SEQ ID NO: 2521099 - RNA, 14 nt, Chlamydophila pneumoniae CWL029
uuucaaacaauagu

SEQ ID NO: 2521100 - RNA, 9 nt, Chlamydophila pneumoniae CWL029
uuucaaagg

SEQ ID NO: 2521101 - RNA, 14 nt, Chlamydophila pneumoniae CWL029
uuucaaauucugaa

SEQ ID NO: 2521102 - RNA, 16 nt, Chlamydophila pneumoniae CWL029
uuucaacaccucaaua

SEQ ID NO: 2521103 - RNA, 19 nt, Chlamydophila pneumoniae CWL029
uuucaagauugugcucaau

SEQ ID NO: 2521104 - RNA, 24 nt, Chlamydophila pneumoniae CWL029
uuucaagauugugcucaauacaga

SEQ ID NO: 2521105 - RNA, 11 nt, Chlamydophila pneumoniae CWL029
uuucaauaaua

SEQ ID NO: 2521106 - RNA, 21 nt, Chlamydophila pneumoniae CWL029
uuucaauagcaguaucuagaa

SEQ ID NO: 2521107 - RNA, 15 nt, Chlamydophila pneumoniae CWL029
uuucaauccuuccuu

SEQ ID NO: 2521108 - RNA, 20 nt, Chlamydophila pneumoniae CWL029
uuucacaagcauaaacuccu

SEQ ID NO: 2521109 - RNA, 21 nt, Chlamydophila pneumoniae CWL029
uuucaccaacuccucuaagga

SEQ ID NO: 2521110 - RNA, 19 nt, Chlamydophila pneumoniae CWL029
uuucacgagcucacaaccc

SEQ ID NO: 2521111 - RNA, 13 nt, Chlamydophila pneumoniae CWL029
uuucagaagaucu

SEQ ID NO: 2521112 - RNA, 24 nt, Chlamydophila pneumoniae CWL029
uuucagaagucacaaauuuuugca

SEQ ID NO: 2521113 - RNA, 22 nt, Chlamydophila pneumoniae CWL029
uuucagagccgcuagccauagu

SEQ ID NO: 2521114 - RNA, 14 nt, Chlamydophila pneumoniae CWL029
uuucagauguacaa

SEQ ID NO: 2521115 - RNA, 18 nt, Chlamydophila pneumoniae CWL029
uuucagcaugugcagaag

SEQ ID NO: 2521116 - RNA, 16 nt, Chlamydophila pneumoniae CWL029
uuucaggucagcaagg

SEQ ID NO: 2521117 - RNA, 14 nt, Chlamydophila pneumoniae CWL029
uuucagucuuccuu

SEQ ID NO: 2521118 - RNA, 16 nt, Chlamydophila pneumoniae CWL029
uuucagucuuccuuua

SEQ ID NO: 2521119 - RNA, 22 nt, Chlamydophila pneumoniae CWL029
uuucaguuguuucuagaaaauc

SEQ ID NO: 2521120 - RNA, 15 nt, Chlamydophila pneumoniae CWL029
uuucaucuucuuucu

SEQ ID NO: 2521121 - RNA, 12 nt, Chlamydophila pneumoniae CWL029
uuucauucccuu

SEQ ID NO: 2521122 - RNA, 18 nt, Chlamydophila pneumoniae CWL029
uuucauucccuuuuucca

SEQ ID NO: 2521123 - RNA, 19 nt, Chlamydophila pneumoniae CWL029
uuucauucccuuuuuccau

SEQ ID NO: 2521124 - RNA, 13 nt, Chlamydophila pneumoniae CWL029
uuuccaacuucaa

SEQ ID NO: 2521125 - RNA, 16 nt, Chlamydophila pneumoniae CWL029
uuuccaacuucaacuu

SEQ ID NO: 2521126 - RNA, 22 nt, Chlamydophila pneumoniae CWL029
uuuccaagacaacaccucccac

SEQ ID NO: 2521127 - RNA, 23 nt, Chlamydophila pneumoniae CWL029
uuuccaagugaucagaaaugaag

SEQ ID NO: 2521128 - RNA, 20 nt, Chlamydophila pneumoniae CWL029
uuuccacguacgagaucaga

SEQ ID NO: 2521129 - RNA, 13 nt, Chlamydophila pneumoniae CWL029
uuuccagcaaagc

SEQ ID NO: 2521130 - RNA, 15 nt, Chlamydophila pneumoniae CWL029
uuuccaggaccaaac

SEQ ID NO: 2521131 - RNA, 19 nt, Chlamydophila pneumoniae CWL029
uuuccauacccaaauuucu

SEQ ID NO: 2521132 - RNA, 20 nt, Chlamydophila pneumoniae CWL029
uuuccauacccaaauuucuu

SEQ ID NO: 2521133 - RNA, 14 nt, Chlamydophila pneumoniae CWL029
uuuccauaggaucu

SEQ ID NO: 2521134 - RNA, 18 nt, Chlamydophila pneumoniae CWL029
uuuccauaggaucugcau

SEQ ID NO: 2521135 - RNA, 22 nt, Chlamydophila pneumoniae CWL029
uuuccauuagggcauucuguaa

SEQ ID NO: 2521136 - RNA, 12 nt, Chlamydophila pneumoniae CWL029
uuucccacagcu

SEQ ID NO: 2521137 - RNA, 20 nt, Chlamydophila pneumoniae CWL029
uuucccaccauauucucagg

SEQ ID NO: 2521138 - RNA, 22 nt, Chlamydophila pneumoniae CWL029
uuucccccugaaugcaacagag

SEQ ID NO: 2521139 - RNA, 22 nt, Chlamydophila pneumoniae CWL029
uuucccgacauuuaacaucuuu

SEQ ID NO: 2521140 - RNA, 17 nt, Chlamydophila pneumoniae CWL029
uuucccuccaccagaag

SEQ ID NO: 2521141 - RNA, 14 nt, Chlamydophila pneumoniae CWL029
uuucccuuuaaaag

SEQ ID NO: 2521142 - RNA, 19 nt, Chlamydophila pneumoniae CWL029
uuuccggggagaacuucaa

SEQ ID NO: 2521143 - RNA, 14 nt, Chlamydophila pneumoniae CWL029
uuuccuaguccucu

SEQ ID NO: 2521144 - RNA, 15 nt, Chlamydophila pneumoniae CWL029
uuuccuaguccucua

SEQ ID NO: 2521145 - RNA, 22 nt, Chlamydophila pneumoniae CWL029
uuuccuccaaauacgaacugua

SEQ ID NO: 2521146 - RNA, 14 nt, Chlamydophila pneumoniae CWL029
uuuccuccucuucu

SEQ ID NO: 2521147 - RNA, 20 nt, Chlamydophila pneumoniae CWL029
uuuccugacuauaaaaugcc

SEQ ID NO: 2521148 - RNA, 21 nt, Chlamydophila pneumoniae CWL029
uuuccuucaggauuuuccauu

SEQ ID NO: 2521149 - RNA, 15 nt, Chlamydophila pneumoniae CWL029
uuuccuucuccagag

SEQ ID NO: 2521150 - RNA, 19 nt, Chlamydophila pneumoniae CWL029
uuuccuugguaucccaauc

SEQ ID NO: 2521151 - RNA, 22 nt, Chlamydophila pneumoniae CWL029
uuucgaacacgucgaacaugac

SEQ ID NO: 2521152 - RNA, 14 nt, Chlamydophila pneumoniae CWL029
uuucgaagcgcucu

SEQ ID NO: 2521153 - RNA, 22 nt, Chlamydophila pneumoniae CWL029
uuucgaagcgcucuacaaaugc

SEQ ID NO: 2521154 - RNA, 23 nt, Chlamydophila pneumoniae CWL029
uuucgaagcgcucuacaaaugcg

SEQ ID NO: 2521155 - RNA, 23 nt, Chlamydophila pneumoniae CWL029
uuucgaagcguuaacaacuucua

SEQ ID NO: 2521156 - RNA, 20 nt, Chlamydophila pneumoniae CWL029
uuucgacgcuguugaaaugc

SEQ ID NO: 2521157 - RNA, 20 nt, Chlamydophila pneumoniae CWL029
uuucgaugcuauuuuuccau

SEQ ID NO: 2521158 - RNA, 21 nt, Chlamydophila pneumoniae CWL029
uuucgcacgcaacaucucaca

SEQ ID NO: 2521159 - RNA, 16 nt, Chlamydophila pneumoniae CWL029
uuucgcagauacuucu

SEQ ID NO: 2521160 - RNA, 20 nt, Chlamydophila pneumoniae CWL029
uuucgcagauacuucuucca

SEQ ID NO: 2521161 - RNA, 14 nt, Chlamydophila pneumoniae CWL029
uuucgcuaacuuau

SEQ ID NO: 2521162 - RNA, 14 nt, Chlamydophila pneumoniae CWL029
uuucgucuaaaaua

SEQ ID NO: 2521163 - RNA, 14 nt, Chlamydophila pneumoniae CWL029
uuucguuuucuagc

SEQ ID NO: 2521164 - RNA, 14 nt, Chlamydophila pneumoniae CWL029
uuucguuuuuucuu

SEQ ID NO: 2521165 - RNA, 14 nt, Chlamydophila pneumoniae CWL029
uuucuaaauacuua

SEQ ID NO: 2521166 - RNA, 19 nt, Chlamydophila pneumoniae CWL029
uuucuaaauagaaaacaua

SEQ ID NO: 2521167 - RNA, 13 nt, Chlamydophila pneumoniae CWL029
uuucuaagaaagg

SEQ ID NO: 2521168 - RNA, 19 nt, Chlamydophila pneumoniae CWL029
uuucuaagagaucuacaaa

SEQ ID NO: 2521169 - RNA, 18 nt, Chlamydophila pneumoniae CWL029
uuucuaagauuccuaacu

SEQ ID NO: 2521170 - RNA, 22 nt, Chlamydophila pneumoniae CWL029
uuucuaagauuccuaacuucug

SEQ ID NO: 2521171 - RNA, 20 nt, Chlamydophila pneumoniae CWL029
uuucuaagcaauauuucugu

SEQ ID NO: 2521172 - RNA, 17 nt, Chlamydophila pneumoniae CWL029
uuucuaauccuccaaac

SEQ ID NO: 2521173 - RNA, 21 nt, Chlamydophila pneumoniae CWL029
uuucuacauuugcuauuuucc

SEQ ID NO: 2521174 - RNA, 17 nt, Chlamydophila pneumoniae CWL029
uuucuacugaaaccuuc

SEQ ID NO: 2521175 - RNA, 22 nt, Chlamydophila pneumoniae CWL029
uuucuagaaaacgccaacugua

SEQ ID NO: 2521176 - RNA, 21 nt, Chlamydophila pneumoniae CWL029
uuucuagaaaagauucuaaau

SEQ ID NO: 2521177 - RNA, 21 nt, Chlamydophila pneumoniae CWL029
uuucuagaaacugcuccugaa

SEQ ID NO: 2521178 - RNA, 18 nt, Chlamydophila pneumoniae CWL029
uuucuaggaaucuuuuag

SEQ ID NO: 2521179 - RNA, 16 nt, Chlamydophila pneumoniae CWL029
uuucuaggaauugcug

SEQ ID NO: 2521180 - RNA, 22 nt, Chlamydophila pneumoniae CWL029
uuucuaggccgggauuuuaauu

SEQ ID NO: 2521181 - RNA, 22 nt, Chlamydophila pneumoniae CWL029
uuucuauaauaaccuccauaga

SEQ ID NO: 2521182 - RNA, 21 nt, Chlamydophila pneumoniae CWL029
uuucuaucuaaucaauucgcu

SEQ ID NO: 2521183 - RNA, 17 nt, Chlamydophila pneumoniae CWL029
uuucuauuauuuuaaag

SEQ ID NO: 2521184 - RNA, 22 nt, Chlamydophila pneumoniae CWL029
uuucuauuucgucgucauccca

SEQ ID NO: 2521185 - RNA, 12 nt, Chlamydophila pneumoniae CWL029
uuucuauuuuca

SEQ ID NO: 2521186 - RNA, 22 nt, Chlamydophila pneumoniae CWL029
uuucucaccacggaagauaugu

SEQ ID NO: 2521187 - RNA, 19 nt, Chlamydophila pneumoniae CWL029
uuucucccgcaaaguuaaa

SEQ ID NO: 2521188 - RNA, 16 nt, Chlamydophila pneumoniae CWL029
uuucuccuucucccug

SEQ ID NO: 2521189 - RNA, 21 nt, Chlamydophila pneumoniae CWL029
uuucucggauccuccaagauc

SEQ ID NO: 2521190 - RNA, 20 nt, Chlamydophila pneumoniae CWL029
uuucucucuuuaucuuuaag

SEQ ID NO: 2521191 - RNA, 16 nt, Chlamydophila pneumoniae CWL029
uuucugaaacaaugca

SEQ ID NO: 2521192 - RNA, 13 nt, Chlamydophila pneumoniae CWL029
uuucugaagauuu

SEQ ID NO: 2521193 - RNA, 18 nt, Chlamydophila pneumoniae CWL029
uuucugauuuaaaagguu

SEQ ID NO: 2521194 - RNA, 13 nt, Chlamydophila pneumoniae CWL029
uuucuguuccuga

SEQ ID NO: 2521195 - RNA, 20 nt, Chlamydophila pneumoniae CWL029
uuucuguucugcuucuguaa

SEQ ID NO: 2521196 - RNA, 14 nt, Chlamydophila pneumoniae CWL029
uuucuuaauuuccu

SEQ ID NO: 2521197 - RNA, 15 nt, Chlamydophila pneumoniae CWL029
uuucuuaauuuccuu

SEQ ID NO: 2521198 - RNA, 20 nt, Chlamydophila pneumoniae CWL029
uuucuuauagcuuuggaacg

SEQ ID NO: 2521199 - RNA, 16 nt, Chlamydophila pneumoniae CWL029
uuucuucaacauacac

SEQ ID NO: 2521200 - RNA, 18 nt, Chlamydophila pneumoniae CWL029
uuucuucaggaacagcau

SEQ ID NO: 2521201 - RNA, 22 nt, Chlamydophila pneumoniae CWL029
uuucuuccaaagacugagcuuc

SEQ ID NO: 2521202 - RNA, 15 nt, Chlamydophila pneumoniae CWL029
uuucuuccauacagg

SEQ ID NO: 2521203 - RNA, 13 nt, Chlamydophila pneumoniae CWL029
uuucuugauuaga

SEQ ID NO: 2521204 - RNA, 20 nt, Chlamydophila pneumoniae CWL029
uuucuuguaagacuaaaaaa

SEQ ID NO: 2521205 - RNA, 22 nt, Chlamydophila pneumoniae CWL029
uuucuugugguuuuucuccucu

SEQ ID NO: 2521206 - RNA, 11 nt, Chlamydophila pneumoniae CWL029
uuucuuguucc

SEQ ID NO: 2521207 - RNA, 22 nt, Chlamydophila pneumoniae CWL029
uuucuuguuccaauagagucuc

SEQ ID NO: 2521208 - RNA, 13 nt, Chlamydophila pneumoniae CWL029
uuucuuuaaagaa

SEQ ID NO: 2521209 - RNA, 14 nt, Chlamydophila pneumoniae CWL029
uuucuuuaaagaau

SEQ ID NO: 2521210 - RNA, 16 nt, Chlamydophila pneumoniae CWL029
uuucuuucacaucuuu

SEQ ID NO: 2521211 - RNA, 13 nt, Chlamydophila pneumoniae CWL029
uuucuuucuaaga

SEQ ID NO: 2521212 - RNA, 21 nt, Chlamydophila pneumoniae CWL029
uuucuuuuagcuacuucuucu

SEQ ID NO: 2521213 - RNA, 15 nt, Chlamydophila pneumoniae CWL029
uuucuuuugcaaauc

SEQ ID NO: 2521214 - RNA, 14 nt, Chlamydophila pneumoniae CWL029
uuugaaaauauccu

SEQ ID NO: 2521215 - RNA, 17 nt, Chlamydophila pneumoniae CWL029
uuugaacaacuccuuaa

SEQ ID NO: 2521216 - RNA, 23 nt, Chlamydophila pneumoniae CWL029
uuugaagaacaaaaaaucaaucu

SEQ ID NO: 2521217 - RNA, 13 nt, Chlamydophila pneumoniae CWL029
uuugaagauguau

SEQ ID NO: 2521218 - RNA, 14 nt, Chlamydophila pneumoniae CWL029
uuugaagcuccuca

SEQ ID NO: 2521219 - RNA, 16 nt, Chlamydophila pneumoniae CWL029
uuugaauuaaaaguuc

SEQ ID NO: 2521220 - RNA, 15 nt, Chlamydophila pneumoniae CWL029
uuugaauucugauga

SEQ ID NO: 2521221 - RNA, 16 nt, Chlamydophila pneumoniae CWL029
uuugaauuuccaaagg

SEQ ID NO: 2521222 - RNA, 13 nt, Chlamydophila pneumoniae CWL029
uuugacaacacca

SEQ ID NO: 2521223 - RNA, 20 nt, Chlamydophila pneumoniae CWL029
uuugacaucuaauuuuaaau

SEQ ID NO: 2521224 - RNA, 18 nt, Chlamydophila pneumoniae CWL029
uuugacuuucauaugaau

SEQ ID NO: 2521225 - RNA, 13 nt, Chlamydophila pneumoniae CWL029
uuugagaaugaac

SEQ ID NO: 2521226 - RNA, 22 nt, Chlamydophila pneumoniae CWL029
uuugagauaaucgcacuucuau

SEQ ID NO: 2521227 - RNA, 14 nt, Chlamydophila pneumoniae CWL029
uuugaucgcuugug

SEQ ID NO: 2521228 - RNA, 14 nt, Chlamydophila pneumoniae CWL029
uuugaucuucucua

SEQ ID NO: 2521229 - RNA, 18 nt, Chlamydophila pneumoniae CWL029
uuugaugaucgaucccuu

SEQ ID NO: 2521230 - RNA, 17 nt, Chlamydophila pneumoniae CWL029
uuugaugcuucuuucaa

SEQ ID NO: 2521231 - RNA, 22 nt, Chlamydophila pneumoniae CWL029
uuugauucccggaggcaaagau

SEQ ID NO: 2521232 - RNA, 13 nt, Chlamydophila pneumoniae CWL029
uuugauuuuucaa

SEQ ID NO: 2521233 - RNA, 18 nt, Chlamydophila pneumoniae CWL029
uuugcaacaaucuuucuu

SEQ ID NO: 2521234 - RNA, 20 nt, Chlamydophila pneumoniae CWL029
uuugcaguuccgauaaagau

SEQ ID NO: 2521235 - RNA, 13 nt, Chlamydophila pneumoniae CWL029
uuugcaugaggag

SEQ ID NO: 2521236 - RNA, 19 nt, Chlamydophila pneumoniae CWL029
uuugccaguucuugaaacu

SEQ ID NO: 2521237 - RNA, 21 nt, Chlamydophila pneumoniae CWL029
uuugccuuuagggaaaaagua

SEQ ID NO: 2521238 - RNA, 19 nt, Chlamydophila pneumoniae CWL029
uuugcgauaucuauaaaug

SEQ ID NO: 2521239 - RNA, 20 nt, Chlamydophila pneumoniae CWL029
uuugcgcccgagcuuccaua

SEQ ID NO: 2521240 - RNA, 16 nt, Chlamydophila pneumoniae CWL029
uuugcuaaacaaugca

SEQ ID NO: 2521241 - RNA, 14 nt, Chlamydophila pneumoniae CWL029
uuugcuaagagcuc

SEQ ID NO: 2521242 - RNA, 12 nt, Chlamydophila pneumoniae CWL029
uuugcuauuuuc

SEQ ID NO: 2521243 - RNA, 16 nt, Chlamydophila pneumoniae CWL029
uuugcuccuccaaaag

SEQ ID NO: 2521244 - RNA, 14 nt, Chlamydophila pneumoniae CWL029
uuugcugaagauuu

SEQ ID NO: 2521245 - RNA, 18 nt, Chlamydophila pneumoniae CWL029
uuugcugaagauuuuuuc

SEQ ID NO: 2521246 - RNA, 18 nt, Chlamydophila pneumoniae CWL029
uuugcugcagcaaaacua

SEQ ID NO: 2521247 - RNA, 14 nt, Chlamydophila pneumoniae CWL029
uuugcugcucucca

SEQ ID NO: 2521248 - RNA, 14 nt, Chlamydophila pneumoniae CWL029
uuuggaaaugagag

SEQ ID NO: 2521249 - RNA, 20 nt, Chlamydophila pneumoniae CWL029
uuuggcacaauccucacuau

SEQ ID NO: 2521250 - RNA, 17 nt, Chlamydophila pneumoniae CWL029
uuuggcaguucacugag

SEQ ID NO: 2521251 - RNA, 23 nt, Chlamydophila pneumoniae CWL029
uuugggauaaaaaguuuuuguuc

SEQ ID NO: 2521252 - RNA, 13 nt, Chlamydophila pneumoniae CWL029
uuuguaaaugucg

SEQ ID NO: 2521253 - RNA, 15 nt, Chlamydophila pneumoniae CWL029
uuuguacacagagau

SEQ ID NO: 2521254 - RNA, 14 nt, Chlamydophila pneumoniae CWL029
uuuguagcauuucu

SEQ ID NO: 2521255 - RNA, 13 nt, Chlamydophila pneumoniae CWL029
uuugugaauuuua

SEQ ID NO: 2521256 - RNA, 14 nt, Chlamydophila pneumoniae CWL029
uuugugaauuuuau

SEQ ID NO: 2521257 - RNA, 19 nt, Chlamydophila pneumoniae CWL029
uuuuaaaaauauggggaaa

SEQ ID NO: 2521258 - RNA, 14 nt, Chlamydophila pneumoniae CWL029
uuuuaaaaugauag

SEQ ID NO: 2521259 - RNA, 16 nt, Chlamydophila pneumoniae CWL029
uuuuaaaaugugucuu

SEQ ID NO: 2521260 - RNA, 19 nt, Chlamydophila pneumoniae CWL029
uuuuaaagauaaggaccag

SEQ ID NO: 2521261 - RNA, 13 nt, Chlamydophila pneumoniae CWL029
uuuuaaagcaaaa

SEQ ID NO: 2521262 - RNA, 18 nt, Chlamydophila pneumoniae CWL029
uuuuaaagcaaaaauucu

SEQ ID NO: 2521263 - RNA, 20 nt, Chlamydophila pneumoniae CWL029
uuuuaaagcaaaaauucuag

SEQ ID NO: 2521264 - RNA, 22 nt, Chlamydophila pneumoniae CWL029
uuuuaaagccuccucaagauaa

SEQ ID NO: 2521265 - RNA, 22 nt, Chlamydophila pneumoniae CWL029
uuuuaagcuaauaagauccaaa

SEQ ID NO: 2521266 - RNA, 22 nt, Chlamydophila pneumoniae CWL029
uuuuaaguugguccaucgagaa

SEQ ID NO: 2521267 - RNA, 14 nt, Chlamydophila pneumoniae CWL029
uuuuaauaaaauuu

SEQ ID NO: 2521268 - RNA, 13 nt, Chlamydophila pneumoniae CWL029
uuuuaauucaaaa

SEQ ID NO: 2521269 - RNA, 13 nt, Chlamydophila pneumoniae CWL029
uuuuacaaugaag

SEQ ID NO: 2521270 - RNA, 15 nt, Chlamydophila pneumoniae CWL029
uuuuacgaaucuuuu

SEQ ID NO: 2521271 - RNA, 20 nt, Chlamydophila pneumoniae CWL029
uuuuacuugcccaaaaguuu

SEQ ID NO: 2521272 - RNA, 14 nt, Chlamydophila pneumoniae CWL029
uuuuagaacuucaa

SEQ ID NO: 2521273 - RNA, 23 nt, Chlamydophila pneumoniae CWL029
uuuuagacgugcucucuucuucu

SEQ ID NO: 2521274 - RNA, 22 nt, Chlamydophila pneumoniae CWL029
uuuuagcauaaucuuuaacaaa

SEQ ID NO: 2521275 - RNA, 20 nt, Chlamydophila pneumoniae CWL029
uuuuaggacgcuauccuauu

SEQ ID NO: 2521276 - RNA, 23 nt, Chlamydophila pneumoniae CWL029
uuuuaggaucuuuguugagaagg

SEQ ID NO: 2521277 - RNA, 15 nt, Chlamydophila pneumoniae CWL029
uuuuauagcaucgua

SEQ ID NO: 2521278 - RNA, 17 nt, Chlamydophila pneumoniae CWL029
uuuuauccaccaagacu

SEQ ID NO: 2521279 - RNA, 16 nt, Chlamydophila pneumoniae CWL029
uuuuaugacaaacucu

SEQ ID NO: 2521280 - RNA, 18 nt, Chlamydophila pneumoniae CWL029
uuuuaugaucucuucaug

SEQ ID NO: 2521281 - RNA, 18 nt, Chlamydophila pneumoniae CWL029
uuuuauuaguuuugaaau

SEQ ID NO: 2521282 - RNA, 14 nt, Chlamydophila pneumoniae CWL029
uuuuauugauaaug

SEQ ID NO: 2521283 - RNA, 13 nt, Chlamydophila pneumoniae CWL029
uuuuauuuaaaau

SEQ ID NO: 2521284 - RNA, 16 nt, Chlamydophila pneumoniae CWL029
uuuuauuuccuuaucc

SEQ ID NO: 2521285 - RNA, 14 nt, Chlamydophila pneumoniae CWL029
uuuuauuuuuaaau

SEQ ID NO: 2521286 - RNA, 22 nt, Chlamydophila pneumoniae CWL029
uuuucaaaucaucaaaaagauc

SEQ ID NO: 2521287 - RNA, 14 nt, Chlamydophila pneumoniae CWL029
uuuucaagucugua

SEQ ID NO: 2521288 - RNA, 18 nt, Chlamydophila pneumoniae CWL029
uuuucaagucuguaagga

SEQ ID NO: 2521289 - RNA, 13 nt, Chlamydophila pneumoniae CWL029
uuuucaauaacca

SEQ ID NO: 2521290 - RNA, 17 nt, Chlamydophila pneumoniae CWL029
uuuucaauaaccagaag

SEQ ID NO: 2521291 - RNA, 15 nt, Chlamydophila pneumoniae CWL029
uuuucaauccuuccu

SEQ ID NO: 2521292 - RNA, 22 nt, Chlamydophila pneumoniae CWL029
uuuucacgagcucacaacccuu

SEQ ID NO: 2521293 - RNA, 14 nt, Chlamydophila pneumoniae CWL029
uuuucagaaagcga

SEQ ID NO: 2521294 - RNA, 12 nt, Chlamydophila pneumoniae CWL029
uuuucagcacug

SEQ ID NO: 2521295 - RNA, 22 nt, Chlamydophila pneumoniae CWL029
uuuucaggaggcgcguagaucc

SEQ ID NO: 2521296 - RNA, 14 nt, Chlamydophila pneumoniae CWL029
uuuucauacuuauc

SEQ ID NO: 2521297 - RNA, 14 nt, Chlamydophila pneumoniae CWL029
uuuucauagggcag

SEQ ID NO: 2521298 - RNA, 21 nt, Chlamydophila pneumoniae CWL029
uuuuccaaaaacgauucgaaa

SEQ ID NO: 2521299 - RNA, 15 nt, Chlamydophila pneumoniae CWL029
uuuuccaaauuccuu

SEQ ID NO: 2521300 - RNA, 20 nt, Chlamydophila pneumoniae CWL029
uuuuccaggaccaaacuucg

SEQ ID NO: 2521301 - RNA, 16 nt, Chlamydophila pneumoniae CWL029
uuuucccacagcuugc

SEQ ID NO: 2521302 - RNA, 16 nt, Chlamydophila pneumoniae CWL029
uuuucccuuuuuagaa

SEQ ID NO: 2521303 - RNA, 23 nt, Chlamydophila pneumoniae CWL029
uuuuccgcaaaggaaaagauaug

SEQ ID NO: 2521304 - RNA, 21 nt, Chlamydophila pneumoniae CWL029
uuuuccugugugguuggaucc

SEQ ID NO: 2521305 - RNA, 18 nt, Chlamydophila pneumoniae CWL029
uuuucgaaucguuuuugg

SEQ ID NO: 2521306 - RNA, 15 nt, Chlamydophila pneumoniae CWL029
uuuucgacgcuguug

SEQ ID NO: 2521307 - RNA, 16 nt, Chlamydophila pneumoniae CWL029
uuuucguaaccacagu

SEQ ID NO: 2521308 - RNA, 12 nt, Chlamydophila pneumoniae CWL029
uuuucuaaaaug

SEQ ID NO: 2521309 - RNA, 22 nt, Chlamydophila pneumoniae CWL029
uuuucuaagauuccuaacuucu

SEQ ID NO: 2521310 - RNA, 22 nt, Chlamydophila pneumoniae CWL029
uuuucuacuucaggaaauaauu

SEQ ID NO: 2521311 - RNA, 11 nt, Chlamydophila pneumoniae CWL029
uuuucuagaaa

SEQ ID NO: 2521312 - RNA, 22 nt, Chlamydophila pneumoniae CWL029
uuuucuagucgugccaaugugc

SEQ ID NO: 2521313 - RNA, 17 nt, Chlamydophila pneumoniae CWL029
uuuucucauagcuuccu

SEQ ID NO: 2521314 - RNA, 16 nt, Chlamydophila pneumoniae CWL029
uuuucucgaauagaaa

SEQ ID NO: 2521315 - RNA, 13 nt, Chlamydophila pneumoniae CWL029
uuuucucugagca

SEQ ID NO: 2521316 - RNA, 12 nt, Chlamydophila pneumoniae CWL029
uuuucugaagau

SEQ ID NO: 2521317 - RNA, 21 nt, Chlamydophila pneumoniae CWL029
uuuucuuauagggaauuuuuu

SEQ ID NO: 2521318 - RNA, 16 nt, Chlamydophila pneumoniae CWL029
uuuucuucaacauaca

SEQ ID NO: 2521319 - RNA, 21 nt, Chlamydophila pneumoniae CWL029
uuuucuucaggaacagcauua

SEQ ID NO: 2521320 - RNA, 12 nt, Chlamydophila pneumoniae CWL029
uuuucuuccaaa

SEQ ID NO: 2521321 - RNA, 16 nt, Chlamydophila pneumoniae CWL029
uuuucuuccaaagacu

SEQ ID NO: 2521322 - RNA, 13 nt, Chlamydophila pneumoniae CWL029
uuuucuucucuaa

SEQ ID NO: 2521323 - RNA, 21 nt, Chlamydophila pneumoniae CWL029
uuuucuucugacauuccuuaa

SEQ ID NO: 2521324 - RNA, 20 nt, Chlamydophila pneumoniae CWL029
uuuucuucuucggaucugua

SEQ ID NO: 2521325 - RNA, 13 nt, Chlamydophila pneumoniae CWL029
uuuucuucuugca

SEQ ID NO: 2521326 - RNA, 13 nt, Chlamydophila pneumoniae CWL029
uuuucuucuuuag

SEQ ID NO: 2521327 - RNA, 16 nt, Chlamydophila pneumoniae CWL029
uuuucuugauuagaga

SEQ ID NO: 2521328 - RNA, 22 nt, Chlamydophila pneumoniae CWL029
uuuucuuuucugaagauuuuuu

SEQ ID NO: 2521329 - RNA, 22 nt, Chlamydophila pneumoniae CWL029
uuuucuuuugcagcaacuuccc

SEQ ID NO: 2521330 - RNA, 14 nt, Chlamydophila pneumoniae CWL029
uuuucuuuuuagaa

SEQ ID NO: 2521331 - RNA, 15 nt, Chlamydophila pneumoniae CWL029
uuuugagauucaaaa

SEQ ID NO: 2521332 - RNA, 13 nt, Chlamydophila pneumoniae CWL029
uuuugauaccucu

SEQ ID NO: 2521333 - RNA, 21 nt, Chlamydophila pneumoniae CWL029
uuuugauuaggcuucagagau

SEQ ID NO: 2521334 - RNA, 20 nt, Chlamydophila pneumoniae CWL029
uuuugcagugauaaaccaag

SEQ ID NO: 2521335 - RNA, 18 nt, Chlamydophila pneumoniae CWL029
uuuugccgugcucuuaug

SEQ ID NO: 2521336 - RNA, 14 nt, Chlamydophila pneumoniae CWL029
uuuugcgauuucag

SEQ ID NO: 2521337 - RNA, 16 nt, Chlamydophila pneumoniae CWL029
uuuugcuaaacaaugc

SEQ ID NO: 2521338 - RNA, 21 nt, Chlamydophila pneumoniae CWL029
uuuugcuaagagcucuuuccc

SEQ ID NO: 2521339 - RNA, 16 nt, Chlamydophila pneumoniae CWL029
uuuugcugaagauuuu

SEQ ID NO: 2521340 - RNA, 18 nt, Chlamydophila pneumoniae CWL029
uuuugcugaagauuuuuu

SEQ ID NO: 2521341 - RNA, 16 nt, Chlamydophila pneumoniae CWL029
uuuugcuuuucccaca

SEQ ID NO: 2521342 - RNA, 13 nt, Chlamydophila pneumoniae CWL029
uuuuggagacaca

SEQ ID NO: 2521343 - RNA, 20 nt, Chlamydophila pneumoniae CWL029
uuuuguaaucuaagaaucua

SEQ ID NO: 2521344 - RNA, 13 nt, Chlamydophila pneumoniae CWL029
uuuuguacacaga

SEQ ID NO: 2521345 - RNA, 16 nt, Chlamydophila pneumoniae CWL029
uuuugucgcaauaaca

SEQ ID NO: 2521346 - RNA, 13 nt, Chlamydophila pneumoniae CWL029
uuuugucuucauc

SEQ ID NO: 2521347 - RNA, 15 nt, Chlamydophila pneumoniae CWL029
uuuugugaauuuuau

SEQ ID NO: 2521348 - RNA, 16 nt, Chlamydophila pneumoniae CWL029
uuuuguggcuuuucua

SEQ ID NO: 2521349 - RNA, 17 nt, Chlamydophila pneumoniae CWL029
uuuuguucccuacuucc

SEQ ID NO: 2521350 - RNA, 21 nt, Chlamydophila pneumoniae CWL029
uuuuuaaccgagcuuuuugcu

SEQ ID NO: 2521351 - RNA, 21 nt, Chlamydophila pneumoniae CWL029
uuuuuagaagguguuuuggcu

SEQ ID NO: 2521352 - RNA, 14 nt, Chlamydophila pneumoniae CWL029
uuuuuaucuccuga

SEQ ID NO: 2521353 - RNA, 16 nt, Chlamydophila pneumoniae CWL029
uuuuucaagguucucu

SEQ ID NO: 2521354 - RNA, 20 nt, Chlamydophila pneumoniae CWL029
uuuuuccauuuuuccuccuc

SEQ ID NO: 2521355 - RNA, 19 nt, Chlamydophila pneumoniae CWL029
uuuuucccuuuaaaaguac

SEQ ID NO: 2521356 - RNA, 12 nt, Chlamydophila pneumoniae CWL029
uuuuucuaguuc

SEQ ID NO: 2521357 - RNA, 10 nt, Chlamydophila pneumoniae CWL029
uuuuucucuu

SEQ ID NO: 2521358 - RNA, 22 nt, Chlamydophila pneumoniae CWL029
uuuuucuguuccugaguacuuu

SEQ ID NO: 2521359 - RNA, 20 nt, Chlamydophila pneumoniae CWL029
uuuuucuugaaaaauccuga

SEQ ID NO: 2521360 - RNA, 12 nt, Chlamydophila pneumoniae CWL029
uuuuugaaaacu

SEQ ID NO: 2521361 - RNA, 12 nt, Chlamydophila pneumoniae CWL029
uuuuugaaugau

SEQ ID NO: 2521362 - RNA, 23 nt, Chlamydophila pneumoniae CWL029
uuuuugcuaagagcucuuucccu

SEQ ID NO: 2521363 - RNA, 17 nt, Chlamydophila pneumoniae CWL029
uuuuugcugaagauuuu

SEQ ID NO: 2521364 - RNA, 13 nt, Chlamydophila pneumoniae CWL029
uuuuuggaaaacc

SEQ ID NO: 2521365 - RNA, 16 nt, Chlamydophila pneumoniae CWL029
uuuuuggaaauccgua

SEQ ID NO: 2521366 - RNA, 17 nt, Chlamydophila pneumoniae CWL029
uuuuuggaaauccguaa

SEQ ID NO: 2521367 - RNA, 17 nt, Chlamydophila pneumoniae CWL029
uuuuuguuaaauuccca

SEQ ID NO: 2521368 - RNA, 14 nt, Chlamydophila pneumoniae CWL029
ucgucuuggaaugc

SEQ ID NO: 2521369 - RNA, 13 nt, Chlamydophila pneumoniae CWL029
ucgugaacaaaau

SEQ ID NO: 2521370 - RNA, 21 nt, Chlamydophila pneumoniae CWL029
ucgugacucuuaucuggagau

SEQ ID NO: 2521371 - RNA, 19 nt, Chlamydophila pneumoniae CWL029
ucgugagcgaguaccucau

SEQ ID NO: 2521372 - RNA, 21 nt, Chlamydophila pneumoniae CWL029
ucgugcuuagagccuucucau

SEQ ID NO: 2521373 - RNA, 19 nt, Chlamydophila pneumoniae CWL029
ucgugggaggaauccuacg

SEQ ID NO: 2521374 - RNA, 13 nt, Chlamydophila pneumoniae CWL029
ucguguuuuccug

SEQ ID NO: 2521375 - RNA, 22 nt, Chlamydophila pneumoniae CWL029
ucguuaaaaacuauccuauuuu

SEQ ID NO: 2521376 - RNA, 16 nt, Chlamydophila pneumoniae CWL029
ucguuagagaagaggu

SEQ ID NO: 2521377 - RNA, 21 nt, Chlamydophila pneumoniae CWL029
ucguuauccucgucuucaaua

SEQ ID NO: 2521378 - RNA, 20 nt, Chlamydophila pneumoniae CWL029
ucguugguucaaauccgacu

SEQ ID NO: 2521379 - RNA, 23 nt, Chlamydophila pneumoniae CWL029
ucguuucgcuuugauaauagucu

SEQ ID NO: 2521380 - RNA, 23 nt, Chlamydophila pneumoniae CWL029
ucguuucuuugaguuaagcaaua

SEQ ID NO: 2521381 - RNA, 17 nt, Chlamydophila pneumoniae CWL029
ucguuuucuagcauagu

SEQ ID NO: 2521382 - RNA, 17 nt, Chlamydophila pneumoniae CWL029
ucuaaaaaagauaaagc

SEQ ID NO: 2521383 - RNA, 18 nt, Chlamydophila pneumoniae CWL029
ucuaaaacagaaauugcu

SEQ ID NO: 2521384 - RNA, 20 nt, Chlamydophila pneumoniae CWL029
ucuaaaagcaaguuguugau

SEQ ID NO: 2521385 - RNA, 13 nt, Chlamydophila pneumoniae CWL029
aaaaaaaucuucu

SEQ ID NO: 2521386 - RNA, 13 nt, Chlamydophila pneumoniae CWL029
aaaaaacaguaga

SEQ ID NO: 2521387 - RNA, 11 nt, Chlamydophila pneumoniae CWL029
aaaaaagccaa

SEQ ID NO: 2521388 - RNA, 18 nt, Chlamydophila pneumoniae CWL029
aaaaaagcuagucuuucu

SEQ ID NO: 2521389 - RNA, 12 nt, Chlamydophila pneumoniae CWL029
aaaaaauaaaau

SEQ ID NO: 2521390 - RNA, 23 nt, Chlamydophila pneumoniae CWL029
aaaaaauaucuccguuaccaaaa

SEQ ID NO: 2521391 - RNA, 11 nt, Chlamydophila pneumoniae CWL029
aaaaaaucaau

SEQ ID NO: 2521392 - RNA, 22 nt, Chlamydophila pneumoniae CWL029
aaaaacacugcgcaaagaacuc

SEQ ID NO: 2521393 - RNA, 19 nt, Chlamydophila pneumoniae CWL029
aaaaaccagccaauaacau

SEQ ID NO: 2521394 - RNA, 16 nt, Chlamydophila pneumoniae CWL029
aaaaacccucaaagaa

SEQ ID NO: 2521395 - RNA, 16 nt, Chlamydophila pneumoniae CWL029
aaaaacgguaaauauc

SEQ ID NO: 2521396 - RNA, 17 nt, Chlamydophila pneumoniae CWL029
aaaaacucuucaucgau

SEQ ID NO: 2521397 - RNA, 18 nt, Chlamydophila pneumoniae CWL029
aaaaacuguguuuucuag

SEQ ID NO: 2521398 - RNA, 12 nt, Chlamydophila pneumoniae CWL029
aaaaagaaagag

SEQ ID NO: 2521399 - RNA, 11 nt, Chlamydophila pneumoniae CWL029
aaaaagaauaa

SEQ ID NO: 2521400 - RNA, 16 nt, Chlamydophila pneumoniae CWL029
aaaaagaauaaaaaua

SEQ ID NO: 2521401 - RNA, 14 nt, Chlamydophila pneumoniae CWL029
aaaaagagcccaaa

SEQ ID NO: 2521402 - RNA, 20 nt, Chlamydophila pneumoniae CWL029
aaaaagagcccaaaaacacu

SEQ ID NO: 2521403 - RNA, 17 nt, Chlamydophila pneumoniae CWL029
aaaaagccaagaaaaca

SEQ ID NO: 2521404 - RNA, 19 nt, Chlamydophila pneumoniae CWL029
aaaaagccuaugauaaagc

SEQ ID NO: 2521405 - RNA, 12 nt, Chlamydophila pneumoniae CWL029
aaaaagcuaaac

SEQ ID NO: 2521406 - RNA, 15 nt, Chlamydophila pneumoniae CWL029
aaaaagcuaaacaac

SEQ ID NO: 2521407 - RNA, 14 nt, Chlamydophila pneumoniae CWL029
aaaaagcuucuuuc

SEQ ID NO: 2521408 - RNA, 19 nt, Chlamydophila pneumoniae CWL029
aaaaagcuucuuucuuacu

SEQ ID NO: 2521409 - RNA, 18 nt, Chlamydophila pneumoniae CWL029
aaaaagcuuuuuucucuu

SEQ ID NO: 2521410 - RNA, 20 nt, Chlamydophila pneumoniae CWL029
aaaaagcuuuuuucucuugc

SEQ ID NO: 2521411 - RNA, 16 nt, Chlamydophila pneumoniae CWL029
aaaaagggaugaagau

SEQ ID NO: 2521412 - RNA, 21 nt, Chlamydophila pneumoniae CWL029
aaaaagggaugaagauaaaau

SEQ ID NO: 2521413 - RNA, 15 nt, Chlamydophila pneumoniae CWL029
aaaaaguaacuaucu

SEQ ID NO: 2521414 - RNA, 18 nt, Chlamydophila pneumoniae CWL029
aaaaaguugaggaaagga

SEQ ID NO: 2521415 - RNA, 17 nt, Chlamydophila pneumoniae CWL029
aaaaauaaacauauucu

SEQ ID NO: 2521416 - RNA, 20 nt, Chlamydophila pneumoniae CWL029
aaaaauaccaagaugucucc

SEQ ID NO: 2521417 - RNA, 15 nt, Chlamydophila pneumoniae CWL029
aaaaauaccaguaga

SEQ ID NO: 2521418 - RNA, 13 nt, Chlamydophila pneumoniae CWL029
aaaaauaucuccg

SEQ ID NO: 2521419 - RNA, 23 nt, Chlamydophila pneumoniae CWL029
aaaaaucccagauuacaagaggu

SEQ ID NO: 2521420 - RNA, 16 nt, Chlamydophila pneumoniae CWL029
aaaaaucccuguucua

SEQ ID NO: 2521421 - RNA, 16 nt, Chlamydophila pneumoniae CWL029
aaaaauccgauaagau

SEQ ID NO: 2521422 - RNA, 12 nt, Chlamydophila pneumoniae CWL029
aaaaaucugcua

SEQ ID NO: 2521423 - RNA, 18 nt, Chlamydophila pneumoniae CWL029
aaaaaucugcuauaacca

SEQ ID NO: 2521424 - RNA, 20 nt, Chlamydophila pneumoniae CWL029
aaaaaucuucuuagccaaaa

SEQ ID NO: 2521425 - RNA, 22 nt, Chlamydophila pneumoniae CWL029
aaaaaugccugaaaauucgaau

SEQ ID NO: 2521426 - RNA, 15 nt, Chlamydophila pneumoniae CWL029
aaaaaugcuccugca

SEQ ID NO: 2521427 - RNA, 22 nt, Chlamydophila pneumoniae CWL029
aaaaauggcacuugagcacauu

SEQ ID NO: 2521428 - RNA, 13 nt, Chlamydophila pneumoniae CWL029
aaaaauucccaua

SEQ ID NO: 2521429 - RNA, 13 nt, Chlamydophila pneumoniae CWL029
aaaaauucucaua

SEQ ID NO: 2521430 - RNA, 21 nt, Chlamydophila pneumoniae CWL029
aaaaauucucauaaccuaagg

SEQ ID NO: 2521431 - RNA, 22 nt, Chlamydophila pneumoniae CWL029
aaaaauucuucgagagcaugca

SEQ ID NO: 2521432 - RNA, 16 nt, Chlamydophila pneumoniae CWL029
aaaaauucuuuaggga

SEQ ID NO: 2521433 - RNA, 16 nt, Chlamydophila pneumoniae CWL029
aaaaauuucaugagga

SEQ ID NO: 2521434 - RNA, 21 nt, Chlamydophila pneumoniae CWL029
aaaaauuuuauaggaauaaca

SEQ ID NO: 2521435 - RNA, 22 nt, Chlamydophila pneumoniae CWL029
aaaaauuuuauaggaauaacac

SEQ ID NO: 2521436 - RNA, 17 nt, Chlamydophila pneumoniae CWL029
aaaaauuuucguaacca

SEQ ID NO: 2521437 - RNA, 15 nt, Chlamydophila pneumoniae CWL029
aaaacaaaccuccua

SEQ ID NO: 2521438 - RNA, 21 nt, Chlamydophila pneumoniae CWL029
aaaacaagcuuuuaauguguu

SEQ ID NO: 2521439 - RNA, 19 nt, Chlamydophila pneumoniae CWL029
aaaacaaucuaaagguuuu

SEQ ID NO: 2521440 - RNA, 20 nt, Chlamydophila pneumoniae CWL029
aaaaccaauuucuccgcuuu

SEQ ID NO: 2521441 - RNA, 18 nt, Chlamydophila pneumoniae CWL029
aaaaccacuucucuguau

SEQ ID NO: 2521442 - RNA, 15 nt, Chlamydophila pneumoniae CWL029
aaaacccauguuucu

SEQ ID NO: 2521443 - RNA, 17 nt, Chlamydophila pneumoniae CWL029
aaaacccucaaagaaua

SEQ ID NO: 2521444 - RNA, 14 nt, Chlamydophila pneumoniae CWL029
aaaaccuucuccaa

SEQ ID NO: 2521445 - RNA, 15 nt, Chlamydophila pneumoniae CWL029
aaaacgccauacuga

SEQ ID NO: 2521446 - RNA, 18 nt, Chlamydophila pneumoniae CWL029
aaaacgccauacugauau

SEQ ID NO: 2521447 - RNA, 13 nt, Chlamydophila pneumoniae CWL029
aaaacgcuauugu

SEQ ID NO: 2521448 - RNA, 15 nt, Chlamydophila pneumoniae CWL029
aaaacggauagggcu

SEQ ID NO: 2521449 - RNA, 20 nt, Chlamydophila pneumoniae CWL029
aaaacuauaaaagccagggc

SEQ ID NO: 2521450 - RNA, 19 nt, Chlamydophila pneumoniae CWL029
aaaacuccacgccaaagua

SEQ ID NO: 2521451 - RNA, 16 nt, Chlamydophila pneumoniae CWL029
aaaacugcaaaaagau

SEQ ID NO: 2521452 - RNA, 19 nt, Chlamydophila pneumoniae CWL029
aaaacugcgcuaucaucau

SEQ ID NO: 2521453 - RNA, 14 nt, Chlamydophila pneumoniae CWL029
aaaacuucaaaagu

SEQ ID NO: 2521454 - RNA, 13 nt, Chlamydophila pneumoniae CWL029
aaaacuucccauc

SEQ ID NO: 2521455 - RNA, 18 nt, Chlamydophila pneumoniae CWL029
aaaacuuucgaagcgcuc

SEQ ID NO: 2521456 - RNA, 21 nt, Chlamydophila pneumoniae CWL029
aaaagaaagaagccuuccuug

SEQ ID NO: 2521457 - RNA, 15 nt, Chlamydophila pneumoniae CWL029
aaaagaauaaaaaua

SEQ ID NO: 2521458 - RNA, 22 nt, Chlamydophila pneumoniae CWL029
aaaagaauuccuaaaacgagca

SEQ ID NO: 2521459 - RNA, 13 nt, Chlamydophila pneumoniae CWL029
aaaagaccaaaua

SEQ ID NO: 2521460 - RNA, 16 nt, Chlamydophila pneumoniae CWL029
aaaagacuuaccguuu

SEQ ID NO: 2521461 - RNA, 20 nt, Chlamydophila pneumoniae CWL029
aaaagagaacauguuucuaa

SEQ ID NO: 2521462 - RNA, 15 nt, Chlamydophila pneumoniae CWL029
aaaagagcaagaugg

SEQ ID NO: 2521463 - RNA, 13 nt, Chlamydophila pneumoniae CWL029
aaaagagcucaaa

SEQ ID NO: 2521464 - RNA, 20 nt, Chlamydophila pneumoniae CWL029
aaaagagcucaaaaaguucc

SEQ ID NO: 2521465 - RNA, 18 nt, Chlamydophila pneumoniae CWL029
aaaagauaaaacauucuc

SEQ ID NO: 2521466 - RNA, 14 nt, Chlamydophila pneumoniae CWL029
aaaagauaaagcua

SEQ ID NO: 2521467 - RNA, 12 nt, Chlamydophila pneumoniae CWL029
aaaagauaguga

SEQ ID NO: 2521468 - RNA, 21 nt, Chlamydophila pneumoniae CWL029
aaaagauaguuauuaauaaau

SEQ ID NO: 2521469 - RNA, 20 nt, Chlamydophila pneumoniae CWL029
aaaagaucggaguuaucaaa

SEQ ID NO: 2521470 - RNA, 23 nt, Chlamydophila pneumoniae CWL029
aaaagaucggaguuaucaaaagg

SEQ ID NO: 2521471 - RNA, 16 nt, Chlamydophila pneumoniae CWL029
aaaagauuuucccgug

SEQ ID NO: 2521472 - RNA, 18 nt, Chlamydophila pneumoniae CWL029
aaaagcaaccuuaaagau

SEQ ID NO: 2521473 - RNA, 23 nt, Chlamydophila pneumoniae CWL029
aaaagcaaucguguuuuccugag

SEQ ID NO: 2521474 - RNA, 22 nt, Chlamydophila pneumoniae CWL029
aaaagcacuuaaaaaacuuccu

SEQ ID NO: 2521475 - RNA, 12 nt, Chlamydophila pneumoniae CWL029
aaaagccuuucu

SEQ ID NO: 2521476 - RNA, 13 nt, Chlamydophila pneumoniae CWL029
aaaagccuuucuu

SEQ ID NO: 2521477 - RNA, 19 nt, Chlamydophila pneumoniae CWL029
aaaagcgcaaaucuuacau

SEQ ID NO: 2521478 - RNA, 12 nt, Chlamydophila pneumoniae CWL029
aaaagcuaaaca

SEQ ID NO: 2521479 - RNA, 15 nt, Chlamydophila pneumoniae CWL029
aaaagcuaaacaacu

SEQ ID NO: 2521480 - RNA, 22 nt, Chlamydophila pneumoniae CWL029
aaaagcuagucuuucuaagaag

SEQ ID NO: 2521481 - RNA, 16 nt, Chlamydophila pneumoniae CWL029
aaaagcugaauccagg

SEQ ID NO: 2521482 - RNA, 23 nt, Chlamydophila pneumoniae CWL029
aaaagcuuaucccauaaauguau

SEQ ID NO: 2521483 - RNA, 21 nt, Chlamydophila pneumoniae CWL029
aaaagcuucuuucuuacuaaa

SEQ ID NO: 2521484 - RNA, 17 nt, Chlamydophila pneumoniae CWL029
aaaagcuuuuuucucuu

SEQ ID NO: 2521485 - RNA, 23 nt, Chlamydophila pneumoniae CWL029
aaaaggaggaggagcacuaggca

SEQ ID NO: 2521486 - RNA, 17 nt, Chlamydophila pneumoniae CWL029
aaaaggaggauguuccu

SEQ ID NO: 2521487 - RNA, 21 nt, Chlamydophila pneumoniae CWL029
aaaaggaugcaucucuuaaaa

SEQ ID NO: 2521488 - RNA, 21 nt, Chlamydophila pneumoniae CWL029
aaaaggcccccuacagcagaa

SEQ ID NO: 2521489 - RNA, 13 nt, Chlamydophila pneumoniae CWL029
aaaagguuuugaa

SEQ ID NO: 2521490 - RNA, 21 nt, Chlamydophila pneumoniae CWL029
aaaaguacgaccaacuccuca

SEQ ID NO: 2521491 - RNA, 16 nt, Chlamydophila pneumoniae CWL029
aaaaguaguuuuaaga

SEQ ID NO: 2521492 - RNA, 20 nt, Chlamydophila pneumoniae CWL029
aaaaguaguuuuaagaaggu

SEQ ID NO: 2521493 - RNA, 15 nt, Chlamydophila pneumoniae CWL029
aaaagucaugaggac

SEQ ID NO: 2521494 - RNA, 18 nt, Chlamydophila pneumoniae CWL029
aaaagucaugaggacugu

SEQ ID NO: 2521495 - RNA, 18 nt, Chlamydophila pneumoniae CWL029
aaaaguugaggaaaggag

SEQ ID NO: 2521496 - RNA, 14 nt, Chlamydophila pneumoniae CWL029
aaaaguugucuuug

SEQ ID NO: 2521497 - RNA, 13 nt, Chlamydophila pneumoniae CWL029
aaaaguuucaauc

SEQ ID NO: 2521498 - RNA, 17 nt, Chlamydophila pneumoniae CWL029
aaaauaaacauauucuc

SEQ ID NO: 2521499 - RNA, 17 nt, Chlamydophila pneumoniae CWL029
aaaauacagccagcaga

SEQ ID NO: 2521500 - RNA, 18 nt, Chlamydophila pneumoniae CWL029
aaaauacagccagcagaa

SEQ ID NO: 2521501 - RNA, 21 nt, Chlamydophila pneumoniae CWL029
aaaauaccaguagagaauguu

SEQ ID NO: 2521502 - RNA, 23 nt, Chlamydophila pneumoniae CWL029
aaaauagaaauaagcaucuagaa

SEQ ID NO: 2521503 - RNA, 13 nt, Chlamydophila pneumoniae CWL029
aaaauagacauuc

SEQ ID NO: 2521504 - RNA, 13 nt, Chlamydophila pneumoniae CWL029
aaaauagauaagu

SEQ ID NO: 2521505 - RNA, 20 nt, Chlamydophila pneumoniae CWL029
aaaauaggugacuucuuugc

SEQ ID NO: 2521506 - RNA, 20 nt, Chlamydophila pneumoniae CWL029
aaaauaguacgcuuuuuacu

SEQ ID NO: 2521507 - RNA, 15 nt, Chlamydophila pneumoniae CWL029
aaaauaucacauucc

SEQ ID NO: 2521508 - RNA, 18 nt, Chlamydophila pneumoniae CWL029
aaaauaucaccuacauca

SEQ ID NO: 2521509 - RNA, 15 nt, Chlamydophila pneumoniae CWL029
aaaauauccuaaaua

SEQ ID NO: 2521510 - RNA, 22 nt, Chlamydophila pneumoniae CWL029
aaaauaucuccguuaccaaaaa

SEQ ID NO: 2521511 - RNA, 19 nt, Chlamydophila pneumoniae CWL029
aaaauauuaaauucaaaau

SEQ ID NO: 2521512 - RNA, 21 nt, Chlamydophila pneumoniae CWL029
aaaaucaaauagauuuuuacu

SEQ ID NO: 2521513 - RNA, 16 nt, Chlamydophila pneumoniae CWL029
aaaaucaacucuccau

SEQ ID NO: 2521514 - RNA, 24 nt, Chlamydophila pneumoniae CWL029
aaaaucaagaagagaaaagauagu

SEQ ID NO: 2521515 - RNA, 15 nt, Chlamydophila pneumoniae CWL029
aaaaucaaucuugau

SEQ ID NO: 2521516 - RNA, 22 nt, Chlamydophila pneumoniae CWL029
aaaaucacacuuucauccaaac

SEQ ID NO: 2521517 - RNA, 20 nt, Chlamydophila pneumoniae CWL029
aaaaucauaggcuauaauua

SEQ ID NO: 2521518 - RNA, 21 nt, Chlamydophila pneumoniae CWL029
aaaauccaggacuucgcaaau

SEQ ID NO: 2521519 - RNA, 18 nt, Chlamydophila pneumoniae CWL029
aaaaucgugcuuagagcc

SEQ ID NO: 2521520 - RNA, 16 nt, Chlamydophila pneumoniae CWL029
aaaaucuccucucuca

SEQ ID NO: 2521521 - RNA, 19 nt, Chlamydophila pneumoniae CWL029
aaaaucucuaagaaucuau

SEQ ID NO: 2521522 - RNA, 23 nt, Chlamydophila pneumoniae CWL029
aaaaucucuaugcgcucuaagag

SEQ ID NO: 2521523 - RNA, 19 nt, Chlamydophila pneumoniae CWL029
aaaaucugcagcagauacc

SEQ ID NO: 2521524 - RNA, 18 nt, Chlamydophila pneumoniae CWL029
aaaaucugcuauaaccaa

SEQ ID NO: 2521525 - RNA, 21 nt, Chlamydophila pneumoniae CWL029
aaaaucugcuauaaccaacuu

SEQ ID NO: 2521526 - RNA, 17 nt, Chlamydophila pneumoniae CWL029
aaaaucuuauuugaguu

SEQ ID NO: 2521527 - RNA, 18 nt, Chlamydophila pneumoniae CWL029
aaaaucuucuggagggag

SEQ ID NO: 2521528 - RNA, 13 nt, Chlamydophila pneumoniae CWL029
aaaaugaaagaaa

SEQ ID NO: 2521529 - RNA, 21 nt, Chlamydophila pneumoniae CWL029
aaaaugaggacacaacucuuu

SEQ ID NO: 2521530 - RNA, 19 nt, Chlamydophila pneumoniae CWL029
aaaaugauaccaccuaaaa

SEQ ID NO: 2521531 - RNA, 21 nt, Chlamydophila pneumoniae CWL029
aaaaugcacuuugaauaaugc

SEQ ID NO: 2521532 - RNA, 18 nt, Chlamydophila pneumoniae CWL029
aaaaugcuccugcaaaaa

SEQ ID NO: 2521533 - RNA, 19 nt, Chlamydophila pneumoniae CWL029
aaaaugcuccugcaaaaaa

SEQ ID NO: 2521534 - RNA, 17 nt, Chlamydophila pneumoniae CWL029
aaaaugggauccugcaa

SEQ ID NO: 2521535 - RNA, 22 nt, Chlamydophila pneumoniae CWL029
aaaauggugaagaauaauagca

SEQ ID NO: 2521536 - RNA, 20 nt, Chlamydophila pneumoniae CWL029
aaaauuaaagugaaagcaac

SEQ ID NO: 2521537 - RNA, 16 nt, Chlamydophila pneumoniae CWL029
aaaauuaagaacccga

SEQ ID NO: 2521538 - RNA, 20 nt, Chlamydophila pneumoniae CWL029
aaaauuaagaacccgauaca

SEQ ID NO: 2521539 - RNA, 19 nt, Chlamydophila pneumoniae CWL029
aaaauuaucuccaaagauc

SEQ ID NO: 2521540 - RNA, 15 nt, Chlamydophila pneumoniae CWL029
aaaauucaaaucccu

SEQ ID NO: 2521541 - RNA, 15 nt, Chlamydophila pneumoniae CWL029
aaaauucaugcaaaa

SEQ ID NO: 2521542 - RNA, 17 nt, Chlamydophila pneumoniae CWL029
aaaauucaugcaaaaca

SEQ ID NO: 2521543 - RNA, 23 nt, Chlamydophila pneumoniae CWL029
aaaauucgaauucucagaaagcc

SEQ ID NO: 2521544 - RNA, 19 nt, Chlamydophila pneumoniae CWL029
aaaauucuaaugguuuccc

SEQ ID NO: 2521545 - RNA, 17 nt, Chlamydophila pneumoniae CWL029
aaaauucuguaaaguga

SEQ ID NO: 2521546 - RNA, 14 nt, Chlamydophila pneumoniae CWL029
aaaauucuuaaaac

SEQ ID NO: 2521547 - RNA, 15 nt, Chlamydophila pneumoniae CWL029
aaaauucuuaaaacu

SEQ ID NO: 2521548 - RNA, 21 nt, Chlamydophila pneumoniae CWL029
aaaauugaacguagcuacaaa

SEQ ID NO: 2521549 - RNA, 18 nt, Chlamydophila pneumoniae CWL029
aaaauugcauuuaaacua

SEQ ID NO: 2521550 - RNA, 21 nt, Chlamydophila pneumoniae CWL029
aaaauugcauuuaaacuaaga

SEQ ID NO: 2521551 - RNA, 13 nt, Chlamydophila pneumoniae CWL029
aaaauuguuggaa

SEQ ID NO: 2521552 - RNA, 18 nt, Chlamydophila pneumoniae CWL029
aaaauuuaaauauagaaa

SEQ ID NO: 2521553 - RNA, 14 nt, Chlamydophila pneumoniae CWL029
aaaauuucuuauaa

SEQ ID NO: 2521554 - RNA, 18 nt, Chlamydophila pneumoniae CWL029
aaaauuucuuauaaaaaa

SEQ ID NO: 2521555 - RNA, 20 nt, Chlamydophila pneumoniae CWL029
aaaauuucuuauaaaaaagg

SEQ ID NO: 2521556 - RNA, 17 nt, Chlamydophila pneumoniae CWL029
aaaauuuucaggaacuu

SEQ ID NO: 2521557 - RNA, 17 nt, Chlamydophila pneumoniae CWL029
aaaauuuugauaccucu

SEQ ID NO: 2521558 - RNA, 15 nt, Chlamydophila pneumoniae CWL029
aaacaaaagccauuc

SEQ ID NO: 2521559 - RNA, 16 nt, Chlamydophila pneumoniae CWL029
aaacaaaagccauucc

SEQ ID NO: 2521560 - RNA, 12 nt, Chlamydophila pneumoniae CWL029
aaacaaaaucuu

SEQ ID NO: 2521561 - RNA, 15 nt, Chlamydophila pneumoniae CWL029
aaacaaaaucuuuua

SEQ ID NO: 2521562 - RNA, 14 nt, Chlamydophila pneumoniae CWL029
aaacaaaccuccua

SEQ ID NO: 2521563 - RNA, 14 nt, Chlamydophila pneumoniae CWL029
aaacaacaaacuac

SEQ ID NO: 2521564 - RNA, 15 nt, Chlamydophila pneumoniae CWL029
aaacaacagaaaugu

SEQ ID NO: 2521565 - RNA, 21 nt, Chlamydophila pneumoniae CWL029
aaacaacucccguuuuguugg

SEQ ID NO: 2521566 - RNA, 15 nt, Chlamydophila pneumoniae CWL029
aaacaagaaaaagca

SEQ ID NO: 2521567 - RNA, 16 nt, Chlamydophila pneumoniae CWL029
aaacaagcuuuuaaug

SEQ ID NO: 2521568 - RNA, 22 nt, Chlamydophila pneumoniae CWL029
aaacaaucuaaagguuuuaaau

SEQ ID NO: 2521569 - RNA, 22 nt, Chlamydophila pneumoniae CWL029
aaacaaucuuguaaguuacgga

SEQ ID NO: 2521570 - RNA, 12 nt, Chlamydophila pneumoniae CWL029
aaacaauuucaa

SEQ ID NO: 2521571 - RNA, 20 nt, Chlamydophila pneumoniae CWL029
aaacacaaauagcaagagcu

SEQ ID NO: 2521572 - RNA, 22 nt, Chlamydophila pneumoniae CWL029
aaacaccguuaauuuuugcuaa

SEQ ID NO: 2521573 - RNA, 16 nt, Chlamydophila pneumoniae CWL029
aaacacucaugaaagu

SEQ ID NO: 2521574 - RNA, 17 nt, Chlamydophila pneumoniae CWL029
aaacacugaacgccauc

SEQ ID NO: 2521575 - RNA, 18 nt, Chlamydophila pneumoniae CWL029
aaacacugcgcaaagaac

SEQ ID NO: 2521576 - RNA, 22 nt, Chlamydophila pneumoniae CWL029
aaacacuuuggauaggauagga

SEQ ID NO: 2521577 - RNA, 14 nt, Chlamydophila pneumoniae CWL029
aaacagaaauugcu

SEQ ID NO: 2521578 - RNA, 21 nt, Chlamydophila pneumoniae CWL029
aaacagauuuuucaagaacuc

SEQ ID NO: 2521579 - RNA, 14 nt, Chlamydophila pneumoniae CWL029
aaacagcaaaguaa

SEQ ID NO: 2521580 - RNA, 22 nt, Chlamydophila pneumoniae CWL029
aaacagcgguugccuuucucuu

SEQ ID NO: 2521581 - RNA, 17 nt, Chlamydophila pneumoniae CWL029
aaacaggaauaggcucu

SEQ ID NO: 2521582 - RNA, 16 nt, Chlamydophila pneumoniae CWL029
aaacagguaauacccu

SEQ ID NO: 2521583 - RNA, 15 nt, Chlamydophila pneumoniae CWL029
aaacaucagagaacu

SEQ ID NO: 2521584 - RNA, 15 nt, Chlamydophila pneumoniae CWL029
aaacaucagcaacau

SEQ ID NO: 2521585 - RNA, 16 nt, Chlamydophila pneumoniae CWL029
aaacaucgcagcagga

SEQ ID NO: 2521586 - RNA, 19 nt, Chlamydophila pneumoniae CWL029
aaacaucggagaacuuccu

SEQ ID NO: 2521587 - RNA, 20 nt, Chlamydophila pneumoniae CWL029
aaacaucggagaacuuccug

SEQ ID NO: 2521588 - RNA, 19 nt, Chlamydophila pneumoniae CWL029
aaacauuuuuaaggaaagu

SEQ ID NO: 2521589 - RNA, 18 nt, Chlamydophila pneumoniae CWL029
aaacauuuuuauuuccuu

SEQ ID NO: 2521590 - RNA, 17 nt, Chlamydophila pneumoniae CWL029
aaaccaaaaaaguaacu

SEQ ID NO: 2521591 - RNA, 19 nt, Chlamydophila pneumoniae CWL029
aaaccacggauuuucucua

SEQ ID NO: 2521592 - RNA, 14 nt, Chlamydophila pneumoniae CWL029
aaaccacuucucug

SEQ ID NO: 2521593 - RNA, 21 nt, Chlamydophila pneumoniae CWL029
aaaccauauugcaaagcaucu

SEQ ID NO: 2521594 - RNA, 15 nt, Chlamydophila pneumoniae CWL029
aaacccgcaacucuu

SEQ ID NO: 2521595 - RNA, 17 nt, Chlamydophila pneumoniae CWL029
aaacccucaaagaauac

SEQ ID NO: 2521596 - RNA, 22 nt, Chlamydophila pneumoniae CWL029
aaacccugggcucacucuaagc

SEQ ID NO: 2521597 - RNA, 23 nt, Chlamydophila pneumoniae CWL029
aaaccguaacugaggcaaagauu

SEQ ID NO: 2521598 - RNA, 15 nt, Chlamydophila pneumoniae CWL029
aaaccguaggauucu

SEQ ID NO: 2521599 - RNA, 22 nt, Chlamydophila pneumoniae CWL029
aaaccuccuagaagcgcuuuau

SEQ ID NO: 2521600 - RNA, 13 nt, Chlamydophila pneumoniae CWL029
aaaccucuaaaaa

SEQ ID NO: 2521601 - RNA, 19 nt, Chlamydophila pneumoniae CWL029
aaaccucuuagcuaucaac

SEQ ID NO: 2521602 - RNA, 12 nt, Chlamydophila pneumoniae CWL029
aaacgaaagcag

SEQ ID NO: 2521603 - RNA, 15 nt, Chlamydophila pneumoniae CWL029
aaacgaaagcagugu

SEQ ID NO: 2521604 - RNA, 14 nt, Chlamydophila pneumoniae CWL029
aaacgcaccuuagc

SEQ ID NO: 2521605 - RNA, 15 nt, Chlamydophila pneumoniae CWL029
aaacgcccuucagga

SEQ ID NO: 2521606 - RNA, 18 nt, Chlamydophila pneumoniae CWL029
aaacgcccuucaggacau

SEQ ID NO: 2521607 - RNA, 13 nt, Chlamydophila pneumoniae CWL029
aaacgcgagcuau

SEQ ID NO: 2521608 - RNA, 16 nt, Chlamydophila pneumoniae CWL029
aaacgcucuccuagac

SEQ ID NO: 2521609 - RNA, 19 nt, Chlamydophila pneumoniae CWL029
aaacggcuguacuucccca

SEQ ID NO: 2521610 - RNA, 17 nt, Chlamydophila pneumoniae CWL029
aaacgguaaauaucuua

SEQ ID NO: 2521611 - RNA, 22 nt, Chlamydophila pneumoniae CWL029
aaacuaaaucaacuacaucucc

SEQ ID NO: 2521612 - RNA, 15 nt, Chlamydophila pneumoniae CWL029
aaacuaagaauaccu

SEQ ID NO: 2521613 - RNA, 23 nt, Chlamydophila pneumoniae CWL029
aaacuagagaucuuuuuauuaaa

SEQ ID NO: 2521614 - RNA, 12 nt, Chlamydophila pneumoniae CWL029
aaacuaggaaaa

SEQ ID NO: 2521615 - RNA, 16 nt, Chlamydophila pneumoniae CWL029
aaacuaggaaaagcau

SEQ ID NO: 2521616 - RNA, 14 nt, Chlamydophila pneumoniae CWL029
aaacuaguucuucu

SEQ ID NO: 2521617 - RNA, 16 nt, Chlamydophila pneumoniae CWL029
aaacuaguucuucuuu

SEQ ID NO: 2521618 - RNA, 18 nt, Chlamydophila pneumoniae CWL029
aaacuaguucuucuuuac

SEQ ID NO: 2521619 - RNA, 14 nt, Chlamydophila pneumoniae CWL029
aaacuauaaaagcc

SEQ ID NO: 2521620 - RNA, 14 nt, Chlamydophila pneumoniae CWL029
aaacuauacucucu

SEQ ID NO: 2521621 - RNA, 16 nt, Chlamydophila pneumoniae CWL029
aaacucaaucucuuug

SEQ ID NO: 2521622 - RNA, 12 nt, Chlamydophila pneumoniae CWL029
aaacuccaaaau

SEQ ID NO: 2521623 - RNA, 20 nt, Chlamydophila pneumoniae CWL029
aaacuccaaaauauucuuuc

SEQ ID NO: 2521624 - RNA, 22 nt, Chlamydophila pneumoniae CWL029
aaacuccgcacuugcucuuuaa

SEQ ID NO: 2521625 - RNA, 17 nt, Chlamydophila pneumoniae CWL029
aaacuccggauucuuua

SEQ ID NO: 2521626 - RNA, 13 nt, Chlamydophila pneumoniae CWL029
aaacucuauuuuc

SEQ ID NO: 2521627 - RNA, 11 nt, Chlamydophila pneumoniae CWL029
aaacucucagg

SEQ ID NO: 2521628 - RNA, 13 nt, Chlamydophila pneumoniae CWL029
aaacucucuuccu

SEQ ID NO: 2521629 - RNA, 19 nt, Chlamydophila pneumoniae CWL029
aaacucucuuccuucuccu

SEQ ID NO: 2521630 - RNA, 20 nt, Chlamydophila pneumoniae CWL029
aaacucugacgucuccaaca

SEQ ID NO: 2521631 - RNA, 15 nt, Chlamydophila pneumoniae CWL029
aaacucuuugaggau

SEQ ID NO: 2521632 - RNA, 19 nt, Chlamydophila pneumoniae CWL029
aaacugaugccaagaaaua

SEQ ID NO: 2521633 - RNA, 22 nt, Chlamydophila pneumoniae CWL029
aaacugauuaguuuguuuuaau

SEQ ID NO: 2521634 - RNA, 15 nt, Chlamydophila pneumoniae CWL029
aaacugcgcuagcuc

SEQ ID NO: 2521635 - RNA, 13 nt, Chlamydophila pneumoniae CWL029
aaacugcuccuga

SEQ ID NO: 2521636 - RNA, 14 nt, Chlamydophila pneumoniae CWL029
aaacugcuccugaa

SEQ ID NO: 2521637 - RNA, 15 nt, Chlamydophila pneumoniae CWL029
aaacugucauguauc

SEQ ID NO: 2521638 - RNA, 16 nt, Chlamydophila pneumoniae CWL029
aaacuguguuuucuag

SEQ ID NO: 2521639 - RNA, 22 nt, Chlamydophila pneumoniae CWL029
aaacuguuaacaagauucucag

SEQ ID NO: 2521640 - RNA, 23 nt, Chlamydophila pneumoniae CWL029
aaacuguuaacaagauucucagc

SEQ ID NO: 2521641 - RNA, 19 nt, Chlamydophila pneumoniae CWL029
aaacuuaguuuugaaaaga

SEQ ID NO: 2521642 - RNA, 11 nt, Chlamydophila pneumoniae CWL029
aaacuucaaaa

SEQ ID NO: 2521643 - RNA, 16 nt, Chlamydophila pneumoniae CWL029
aaacuucaguuguugc

SEQ ID NO: 2521644 - RNA, 19 nt, Chlamydophila pneumoniae CWL029
aaacuucccaucuuguucu

SEQ ID NO: 2521645 - RNA, 17 nt, Chlamydophila pneumoniae CWL029
aaacuucuaacuguaca

SEQ ID NO: 2521646 - RNA, 12 nt, Chlamydophila pneumoniae CWL029
aaacuucucuag

SEQ ID NO: 2521647 - RNA, 17 nt, Chlamydophila pneumoniae CWL029
aaacuucuucucgguuu

SEQ ID NO: 2521648 - RNA, 22 nt, Chlamydophila pneumoniae CWL029
aaacuugcuuuuuugaaagcug

SEQ ID NO: 2521649 - RNA, 23 nt, Chlamydophila pneumoniae CWL029
aaacuuguuaggaaaauucuuaa

SEQ ID NO: 2521650 - RNA, 22 nt, Chlamydophila pneumoniae CWL029
aaacuuguuuucguaagagaau

SEQ ID NO: 2521651 - RNA, 15 nt, Chlamydophila pneumoniae CWL029
aaacuuuaaaagcau

SEQ ID NO: 2521652 - RNA, 21 nt, Chlamydophila pneumoniae CWL029
aaacuuucgaagcgcucuaca

SEQ ID NO: 2521653 - RNA, 14 nt, Chlamydophila pneumoniae CWL029
aaacuuucuucucu

SEQ ID NO: 2521654 - RNA, 22 nt, Chlamydophila pneumoniae CWL029
aaacuuucuucucuaggaagau

SEQ ID NO: 2521655 - RNA, 13 nt, Chlamydophila pneumoniae CWL029
aaacuuucuuuuu

SEQ ID NO: 2521656 - RNA, 20 nt, Chlamydophila pneumoniae CWL029
aaacuuucuuuuugagauaa

SEQ ID NO: 2521657 - RNA, 18 nt, Chlamydophila pneumoniae CWL029
aaacuuuuuuucuucucu

SEQ ID NO: 2521658 - RNA, 22 nt, Chlamydophila pneumoniae CWL029
aaagaaacuucugacccuguag

SEQ ID NO: 2521659 - RNA, 16 nt, Chlamydophila pneumoniae CWL029
aaagaaaucaaacauu

SEQ ID NO: 2521660 - RNA, 20 nt, Chlamydophila pneumoniae CWL029
aaagaacgauaaaauugaaa

SEQ ID NO: 2521661 - RNA, 19 nt, Chlamydophila pneumoniae CWL029
aaagaacuuaaaauucaaa

SEQ ID NO: 2521662 - RNA, 14 nt, Chlamydophila pneumoniae CWL029
aaagaagauucaag

SEQ ID NO: 2521663 - RNA, 22 nt, Chlamydophila pneumoniae CWL029
aaagaagauucaagcaaugccu

SEQ ID NO: 2521664 - RNA, 15 nt, Chlamydophila pneumoniae CWL029
aaagaagguccaugu

SEQ ID NO: 2521665 - RNA, 21 nt, Chlamydophila pneumoniae CWL029
aaagaaggucuuccaucucuu

SEQ ID NO: 2521666 - RNA, 22 nt, Chlamydophila pneumoniae CWL029
aaagaagguugagacguaacca

SEQ ID NO: 2521667 - RNA, 14 nt, Chlamydophila pneumoniae CWL029
aaagaaguccuagg

SEQ ID NO: 2521668 - RNA, 13 nt, Chlamydophila pneumoniae CWL029
aaagaaguuauaa

SEQ ID NO: 2521669 - RNA, 22 nt, Chlamydophila pneumoniae CWL029
aaagaaguuuacaaauaaaaug

SEQ ID NO: 2521670 - RNA, 18 nt, Chlamydophila pneumoniae CWL029
aaagaauaaaaauaccag

SEQ ID NO: 2521671 - RNA, 16 nt, Chlamydophila pneumoniae CWL029
aaagaauacucauauu

SEQ ID NO: 2521672 - RNA, 13 nt, Chlamydophila pneumoniae CWL029
aaagaaucucuga

SEQ ID NO: 2521673 - RNA, 13 nt, Chlamydophila pneumoniae CWL029
aaagaaugccauu

SEQ ID NO: 2521674 - RNA, 22 nt, Chlamydophila pneumoniae CWL029
aaagaaugccauucuuaucugc

SEQ ID NO: 2521675 - RNA, 17 nt, Chlamydophila pneumoniae CWL029
aaagaauuaagaagaag

SEQ ID NO: 2521676 - RNA, 21 nt, Chlamydophila pneumoniae CWL029
aaagaauuccuaaaacgagca

SEQ ID NO: 2521677 - RNA, 20 nt, Chlamydophila pneumoniae CWL029
aaagaauuuguaacucuuaa

SEQ ID NO: 2521678 - RNA, 20 nt, Chlamydophila pneumoniae CWL029
aaagacaaaaaaucugaucu

SEQ ID NO: 2521679 - RNA, 16 nt, Chlamydophila pneumoniae CWL029
aaagacauccuucuuu

SEQ ID NO: 2521680 - RNA, 18 nt, Chlamydophila pneumoniae CWL029
aaagacauccuucuuuac

SEQ ID NO: 2521681 - RNA, 21 nt, Chlamydophila pneumoniae CWL029
aaagacccuucuuuccauaaa

SEQ ID NO: 2521682 - RNA, 19 nt, Chlamydophila pneumoniae CWL029
aaagacucucuuccaaaag

SEQ ID NO: 2521683 - RNA, 19 nt, Chlamydophila pneumoniae CWL029
aaagacucuugaauauuua

SEQ ID NO: 2521684 - RNA, 18 nt, Chlamydophila pneumoniae CWL029
aaagacuucgaugucuuu

SEQ ID NO: 2521685 - RNA, 14 nt, Chlamydophila pneumoniae CWL029
aaagagcaaggaac

SEQ ID NO: 2521686 - RNA, 23 nt, Chlamydophila pneumoniae CWL029
aaagagcccaaaaacacucaaau

SEQ ID NO: 2521687 - RNA, 12 nt, Chlamydophila pneumoniae CWL029
aaagagcuaaag

SEQ ID NO: 2521688 - RNA, 23 nt, Chlamydophila pneumoniae CWL029
aaagagcuucuucuaaagcagaa

SEQ ID NO: 2521689 - RNA, 15 nt, Chlamydophila pneumoniae CWL029
aaagagcuuugauuc

SEQ ID NO: 2521690 - RNA, 14 nt, Chlamydophila pneumoniae CWL029
aaagaggaaugaag

SEQ ID NO: 2521691 - RNA, 13 nt, Chlamydophila pneumoniae CWL029
aaagaggggagcu

SEQ ID NO: 2521692 - RNA, 20 nt, Chlamydophila pneumoniae CWL029
aaagagucucacucuuuucu

SEQ ID NO: 2521693 - RNA, 23 nt, Chlamydophila pneumoniae CWL029
aaagagucucuugcuuuuguaga

SEQ ID NO: 2521694 - RNA, 14 nt, Chlamydophila pneumoniae CWL029
aaagagugccaaga

SEQ ID NO: 2521695 - RNA, 18 nt, Chlamydophila pneumoniae CWL029
aaagagugccaagagcau

SEQ ID NO: 2521696 - RNA, 23 nt, Chlamydophila pneumoniae CWL029
aaagagugccaagagcaucacaa

SEQ ID NO: 2521697 - RNA, 18 nt, Chlamydophila pneumoniae CWL029
aaagaguuuguucacauu

SEQ ID NO: 2521698 - RNA, 20 nt, Chlamydophila pneumoniae CWL029
aaagaguuuuuuagaggagc

SEQ ID NO: 2521699 - RNA, 14 nt, Chlamydophila pneumoniae CWL029
aaagauaaagaagu

SEQ ID NO: 2521700 - RNA, 20 nt, Chlamydophila pneumoniae CWL029
aaagauagcgacgucaucau

SEQ ID NO: 2521701 - RNA, 14 nt, Chlamydophila pneumoniae CWL029
aaagauaugucuug

SEQ ID NO: 2521702 - RNA, 13 nt, Chlamydophila pneumoniae CWL029
aaagaucacugag

SEQ ID NO: 2521703 - RNA, 18 nt, Chlamydophila pneumoniae CWL029
aaagaucaucuucacuaa

SEQ ID NO: 2521704 - RNA, 22 nt, Chlamydophila pneumoniae CWL029
aaagaucauggauucacaucuu

SEQ ID NO: 2521705 - RNA, 22 nt, Chlamydophila pneumoniae CWL029
aaagaucgggucuacaacaguu

SEQ ID NO: 2521706 - RNA, 14 nt, Chlamydophila pneumoniae CWL029
aaagauuccccaua

SEQ ID NO: 2521707 - RNA, 20 nt, Chlamydophila pneumoniae CWL029
aaagauuccuaagcuauaga

SEQ ID NO: 2521708 - RNA, 19 nt, Chlamydophila pneumoniae CWL029
aaagauuccuuaccuauau

SEQ ID NO: 2521709 - RNA, 17 nt, Chlamydophila pneumoniae CWL029
aaagauucuaaaucaac

SEQ ID NO: 2521710 - RNA, 14 nt, Chlamydophila pneumoniae CWL029
aaagcaaccuuaaa

SEQ ID NO: 2521711 - RNA, 18 nt, Chlamydophila pneumoniae CWL029
aaagcaauuucuccuagg

SEQ ID NO: 2521712 - RNA, 21 nt, Chlamydophila pneumoniae CWL029
aaagcaauuucuccuaggucu

SEQ ID NO: 2521713 - RNA, 21 nt, Chlamydophila pneumoniae CWL029
aaagcacauaagaugaaguuu

SEQ ID NO: 2521714 - RNA, 19 nt, Chlamydophila pneumoniae CWL029
aaagcacuuaaaaaacuuc

SEQ ID NO: 2521715 - RNA, 18 nt, Chlamydophila pneumoniae CWL029
aaagcaggagcaucauua

SEQ ID NO: 2521716 - RNA, 22 nt, Chlamydophila pneumoniae CWL029
aaagcauacuuauauuggcuuu

SEQ ID NO: 2521717 - RNA, 14 nt, Chlamydophila pneumoniae CWL029
aaagcauaguguau

SEQ ID NO: 2521718 - RNA, 18 nt, Chlamydophila pneumoniae CWL029
aaagcaucuuguauugcu

SEQ ID NO: 2521719 - RNA, 19 nt, Chlamydophila pneumoniae CWL029
aaagcaucuuucaucaaug

SEQ ID NO: 2521720 - RNA, 14 nt, Chlamydophila pneumoniae CWL029
aaagcauugcaaau

SEQ ID NO: 2521721 - RNA, 21 nt, Chlamydophila pneumoniae CWL029
aaagccacauucuucugauac

SEQ ID NO: 2521722 - RNA, 14 nt, Chlamydophila pneumoniae CWL029
aaagcccauuccug

SEQ ID NO: 2521723 - RNA, 22 nt, Chlamydophila pneumoniae CWL029
aaagcccccucccccaccaaag

SEQ ID NO: 2521724 - RNA, 23 nt, Chlamydophila pneumoniae CWL029
aaagcccucauccccucagaaag

SEQ ID NO: 2521725 - RNA, 23 nt, Chlamydophila pneumoniae CWL029
aaagccguguaccucucaucaaa

SEQ ID NO: 2521726 - RNA, 19 nt, Chlamydophila pneumoniae CWL029
aaagccuaugauaaagccu

SEQ ID NO: 2521727 - RNA, 16 nt, Chlamydophila pneumoniae CWL029
aaagccucgaaauuuu

SEQ ID NO: 2521728 - RNA, 18 nt, Chlamydophila pneumoniae CWL029
aaagcgaccugcaaauga

SEQ ID NO: 2521729 - RNA, 21 nt, Chlamydophila pneumoniae CWL029
aaagcgcaaaucuuacauaaa

SEQ ID NO: 2521730 - RNA, 19 nt, Chlamydophila pneumoniae CWL029
aaagcguuucgauaauuuu

SEQ ID NO: 2521731 - RNA, 21 nt, Chlamydophila pneumoniae CWL029
aaagcguuucgauaauuuuca

SEQ ID NO: 2521732 - RNA, 13 nt, Chlamydophila pneumoniae CWL029
aaagcuaaacaac

SEQ ID NO: 2521733 - RNA, 20 nt, Chlamydophila pneumoniae CWL029
aaagcuauuguuuuucaaua

SEQ ID NO: 2521734 - RNA, 22 nt, Chlamydophila pneumoniae CWL029
aaagcucuccuucagaguugau

SEQ ID NO: 2521735 - RNA, 16 nt, Chlamydophila pneumoniae CWL029
aaagcucuuucauaag

SEQ ID NO: 2521736 - RNA, 18 nt, Chlamydophila pneumoniae CWL029
aaagcucuuucauaagau

SEQ ID NO: 2521737 - RNA, 19 nt, Chlamydophila pneumoniae CWL029
aaagcugaauccagguugu

SEQ ID NO: 2521738 - RNA, 17 nt, Chlamydophila pneumoniae CWL029
aaagcuguauugggaau

SEQ ID NO: 2521739 - RNA, 23 nt, Chlamydophila pneumoniae CWL029
aaagcuuaucccauaaauguaua

SEQ ID NO: 2521740 - RNA, 14 nt, Chlamydophila pneumoniae CWL029
aaagcuucuuucuu

SEQ ID NO: 2521741 - RNA, 12 nt, Chlamydophila pneumoniae CWL029
aaagcuugagaa

SEQ ID NO: 2521742 - RNA, 13 nt, Chlamydophila pneumoniae CWL029
aaagcuuuugcua

SEQ ID NO: 2521743 - RNA, 16 nt, Chlamydophila pneumoniae CWL029
aaagcuuuuuucucuu

SEQ ID NO: 2521744 - RNA, 14 nt, Chlamydophila pneumoniae CWL029
aaaggaaaauaauc

SEQ ID NO: 2521745 - RNA, 20 nt, Chlamydophila pneumoniae CWL029
aaaggaacuucguuucgcuu

SEQ ID NO: 2521746 - RNA, 17 nt, Chlamydophila pneumoniae CWL029
aaaggaaucucgggaga

SEQ ID NO: 2521747 - RNA, 17 nt, Chlamydophila pneumoniae CWL029
aaaggaccacaauuccu

SEQ ID NO: 2521748 - RNA, 17 nt, Chlamydophila pneumoniae CWL029
aaaggaccauuaauuuc

SEQ ID NO: 2521749 - RNA, 17 nt, Chlamydophila pneumoniae CWL029
aaaggaccuguuuucuu

SEQ ID NO: 2521750 - RNA, 19 nt, Chlamydophila pneumoniae CWL029
aaaggcaacaacgccuaca

SEQ ID NO: 2521751 - RNA, 15 nt, Chlamydophila pneumoniae CWL029
aaaggcucuuuuaga

SEQ ID NO: 2521752 - RNA, 22 nt, Chlamydophila pneumoniae CWL029
aaaggcugauugaaagucagca

SEQ ID NO: 2521753 - RNA, 13 nt, Chlamydophila pneumoniae CWL029
aaaggcuuuucuu

SEQ ID NO: 2521754 - RNA, 17 nt, Chlamydophila pneumoniae CWL029
aaagggaauuuucucau

SEQ ID NO: 2521755 - RNA, 22 nt, Chlamydophila pneumoniae CWL029
aaaggggaacaacaucaugaaa

SEQ ID NO: 2521756 - RNA, 19 nt, Chlamydophila pneumoniae CWL029
aaaggggcuccuaaagcau

SEQ ID NO: 2521757 - RNA, 14 nt, Chlamydophila pneumoniae CWL029
aaagguauuucucu

SEQ ID NO: 2521758 - RNA, 23 nt, Chlamydophila pneumoniae CWL029
aaaggucagcccugccucacagc

SEQ ID NO: 2521759 - RNA, 16 nt, Chlamydophila pneumoniae CWL029
aaaggugaaaguacag

SEQ ID NO: 2521760 - RNA, 17 nt, Chlamydophila pneumoniae CWL029
aaagguugauuggaucu

SEQ ID NO: 2521761 - RNA, 14 nt, Chlamydophila pneumoniae CWL029
aaagguugcuaaga

SEQ ID NO: 2521762 - RNA, 14 nt, Chlamydophila pneumoniae CWL029
aaagguuuuaaauu

SEQ ID NO: 2521763 - RNA, 17 nt, Chlamydophila pneumoniae CWL029
aaagguuuuaaauuuag

SEQ ID NO: 2521764 - RNA, 14 nt, Chlamydophila pneumoniae CWL029
aaagguuuugaagc

SEQ ID NO: 2521765 - RNA, 16 nt, Chlamydophila pneumoniae CWL029
aaagguuuugaagcuc

SEQ ID NO: 2521766 - RNA, 14 nt, Chlamydophila pneumoniae CWL029
aaaguaaaaaauac

SEQ ID NO: 2521767 - RNA, 17 nt, Chlamydophila pneumoniae CWL029
aaaguaacgauaagaag

SEQ ID NO: 2521768 - RNA, 16 nt, Chlamydophila pneumoniae CWL029
aaaguaacuaucuaca

SEQ ID NO: 2521769 - RNA, 14 nt, Chlamydophila pneumoniae CWL029
aaaguaaucacuuc

SEQ ID NO: 2521770 - RNA, 17 nt, Chlamydophila pneumoniae CWL029
aaaguaccuaggaucua

SEQ ID NO: 2521771 - RNA, 21 nt, Chlamydophila pneumoniae CWL029
aaaguaccuauugugcuuuuc

SEQ ID NO: 2521772 - RNA, 23 nt, Chlamydophila pneumoniae CWL029
aaaguaccuuuaacccgcuugca

SEQ ID NO: 2521773 - RNA, 12 nt, Chlamydophila pneumoniae CWL029
aaaguacuacaa

SEQ ID NO: 2521774 - RNA, 14 nt, Chlamydophila pneumoniae CWL029
aaaguagaauccuu

SEQ ID NO: 2521775 - RNA, 16 nt, Chlamydophila pneumoniae CWL029
aaaguaggauugauaa

SEQ ID NO: 2521776 - RNA, 16 nt, Chlamydophila pneumoniae CWL029
aaaguaguuuuaagaa

SEQ ID NO: 2521777 - RNA, 13 nt, Chlamydophila pneumoniae CWL029
aaaguaucuucag

SEQ ID NO: 2521778 - RNA, 22 nt, Chlamydophila pneumoniae CWL029
aaagucaaauacuucuccugaa

SEQ ID NO: 2521779 - RNA, 18 nt, Chlamydophila pneumoniae CWL029
aaagucacggcgaaagcu

SEQ ID NO: 2521780 - RNA, 21 nt, Chlamydophila pneumoniae CWL029
aaaguccuccauguacaguuu

SEQ ID NO: 2521781 - RNA, 18 nt, Chlamydophila pneumoniae CWL029
aaagucucuagggaaagg

SEQ ID NO: 2521782 - RNA, 16 nt, Chlamydophila pneumoniae CWL029
aaagugaaaccauuua

SEQ ID NO: 2521783 - RNA, 23 nt, Chlamydophila pneumoniae CWL029
aaagugaaauugaacucucaguu

SEQ ID NO: 2521784 - RNA, 19 nt, Chlamydophila pneumoniae CWL029
aaagugaugccuggacugc

SEQ ID NO: 2521785 - RNA, 14 nt, Chlamydophila pneumoniae CWL029
aaagugugaggaga

SEQ ID NO: 2521786 - RNA, 21 nt, Chlamydophila pneumoniae CWL029
aaaguuaaugcaagcaacucu

SEQ ID NO: 2521787 - RNA, 23 nt, Chlamydophila pneumoniae CWL029
aaaguuagguagauagaaauucu

SEQ ID NO: 2521788 - RNA, 17 nt, Chlamydophila pneumoniae CWL029
aaaguucaguaaaaggu

SEQ ID NO: 2521789 - RNA, 15 nt, Chlamydophila pneumoniae CWL029
aaaguugaggaaagg

SEQ ID NO: 2521790 - RNA, 16 nt, Chlamydophila pneumoniae CWL029
aaaguugaggaaagga

SEQ ID NO: 2521791 - RNA, 18 nt, Chlamydophila pneumoniae CWL029
aaaguugaggaaaggagg

SEQ ID NO: 2521792 - RNA, 19 nt, Chlamydophila pneumoniae CWL029
aaaguugcaacucucuuua

SEQ ID NO: 2521793 - RNA, 15 nt, Chlamydophila pneumoniae CWL029
aaaguuuaugacaca

SEQ ID NO: 2521794 - RNA, 19 nt, Chlamydophila pneumoniae CWL029
aaaguuucaaucucuccuu

SEQ ID NO: 2521795 - RNA, 20 nt, Chlamydophila pneumoniae CWL029
aaaguuuguagcauuucuuu

SEQ ID NO: 2521796 - RNA, 18 nt, Chlamydophila pneumoniae CWL029
aaaguuuguuauaaggau

SEQ ID NO: 2521797 - RNA, 22 nt, Chlamydophila pneumoniae CWL029
aaaguuuugaggauuucuugca

SEQ ID NO: 2521798 - RNA, 22 nt, Chlamydophila pneumoniae CWL029
aaauaaaaaaacccucaaagaa

SEQ ID NO: 2521799 - RNA, 12 nt, Chlamydophila pneumoniae CWL029
aaauaaaaccac

SEQ ID NO: 2521800 - RNA, 21 nt, Chlamydophila pneumoniae CWL029
aaauaaagagcugauccagcu

SEQ ID NO: 2521801 - RNA, 17 nt, Chlamydophila pneumoniae CWL029
aaauaaaguccuccaug

SEQ ID NO: 2521802 - RNA, 14 nt, Chlamydophila pneumoniae CWL029
aaauaaccccucca

SEQ ID NO: 2521803 - RNA, 20 nt, Chlamydophila pneumoniae CWL029
aaauaaccuagaaggaggag

SEQ ID NO: 2521804 - RNA, 18 nt, Chlamydophila pneumoniae CWL029
aaauaagccaguacuaaa

SEQ ID NO: 2521805 - RNA, 20 nt, Chlamydophila pneumoniae CWL029
aaauaaguccuguuugaaaa

SEQ ID NO: 2521806 - RNA, 18 nt, Chlamydophila pneumoniae CWL029
aaauaaucuucaaaagac

SEQ ID NO: 2521807 - RNA, 22 nt, Chlamydophila pneumoniae CWL029
aaauaauuuuauuaguuacuga

SEQ ID NO: 2521808 - RNA, 22 nt, Chlamydophila pneumoniae CWL029
aaauaccacagcuguacagaac

SEQ ID NO: 2521809 - RNA, 21 nt, Chlamydophila pneumoniae CWL029
aaauaccccaucuaauccugu

SEQ ID NO: 2521810 - RNA, 22 nt, Chlamydophila pneumoniae CWL029
aaauacccucggagacucagag

SEQ ID NO: 2521811 - RNA, 14 nt, Chlamydophila pneumoniae CWL029
aaauacgcuuuucu

SEQ ID NO: 2521812 - RNA, 15 nt, Chlamydophila pneumoniae CWL029
aaauacgcuuuucuu

SEQ ID NO: 2521813 - RNA, 23 nt, Chlamydophila pneumoniae CWL029
aaauacguccagccugcaccaga

SEQ ID NO: 2521814 - RNA, 23 nt, Chlamydophila pneumoniae CWL029
aaauacgugcuugaauauuucca

SEQ ID NO: 2521815 - RNA, 16 nt, Chlamydophila pneumoniae CWL029
aaauacuucuccugaa

SEQ ID NO: 2521816 - RNA, 14 nt, Chlamydophila pneumoniae CWL029
aaauagaaaacaua

SEQ ID NO: 2521817 - RNA, 18 nt, Chlamydophila pneumoniae CWL029
aaauagaaaggaaucccu

SEQ ID NO: 2521818 - RNA, 12 nt, Chlamydophila pneumoniae CWL029
aaauagaagcca

SEQ ID NO: 2521819 - RNA, 15 nt, Chlamydophila pneumoniae CWL029
aaauagagaaacuuu

SEQ ID NO: 2521820 - RNA, 20 nt, Chlamydophila pneumoniae CWL029
aaauagauccugaaaguaca

SEQ ID NO: 2521821 - RNA, 19 nt, Chlamydophila pneumoniae CWL029
aaauagcaucccuucuucu

SEQ ID NO: 2521822 - RNA, 19 nt, Chlamydophila pneumoniae CWL029
aaauagccucuccuugaga

SEQ ID NO: 2521823 - RNA, 23 nt, Chlamydophila pneumoniae CWL029
aaauaggaaaguugcaacucucu

SEQ ID NO: 2521824 - RNA, 14 nt, Chlamydophila pneumoniae CWL029
aaauaggagagcac

SEQ ID NO: 2521825 - RNA, 20 nt, Chlamydophila pneumoniae CWL029
aaauaggagagcacuuuuaa

SEQ ID NO: 2521826 - RNA, 12 nt, Chlamydophila pneumoniae CWL029
aaauaggaucuc

SEQ ID NO: 2521827 - RNA, 18 nt, Chlamydophila pneumoniae CWL029
aaauaggaucucucuuuc

SEQ ID NO: 2521828 - RNA, 21 nt, Chlamydophila pneumoniae CWL029
aaauaggaucucucuuuccuu

SEQ ID NO: 2521829 - RNA, 16 nt, Chlamydophila pneumoniae CWL029
aaauauaaauuuauaa

SEQ ID NO: 2521830 - RNA, 13 nt, Chlamydophila pneumoniae CWL029
aaauauaacucuc

SEQ ID NO: 2521831 - RNA, 15 nt, Chlamydophila pneumoniae CWL029
aaauauagaaaauca

SEQ ID NO: 2521832 - RNA, 17 nt, Chlamydophila pneumoniae CWL029
aaauauagaaaaucauu

SEQ ID NO: 2521833 - RNA, 17 nt, Chlamydophila pneumoniae CWL029
aaauauaucgcguguaa

SEQ ID NO: 2521834 - RNA, 15 nt, Chlamydophila pneumoniae CWL029
aaauaucacauucca

SEQ ID NO: 2521835 - RNA, 18 nt, Chlamydophila pneumoniae CWL029
aaauaucacauuccaaug

SEQ ID NO: 2521836 - RNA, 21 nt, Chlamydophila pneumoniae CWL029
aaauaucaccuacaucagacu

SEQ ID NO: 2521837 - RNA, 14 nt, Chlamydophila pneumoniae CWL029
aaauaucauucacu

SEQ ID NO: 2521838 - RNA, 17 nt, Chlamydophila pneumoniae CWL029
aaauauccuaaauauau

SEQ ID NO: 2521839 - RNA, 22 nt, Chlamydophila pneumoniae CWL029
aaauaucuccguuaccaaaaac

SEQ ID NO: 2521840 - RNA, 21 nt, Chlamydophila pneumoniae CWL029
aaauaucucuggcauaauccu

SEQ ID NO: 2521841 - RNA, 12 nt, Chlamydophila pneumoniae CWL029
aaauaucuuaac

SEQ ID NO: 2521842 - RNA, 21 nt, Chlamydophila pneumoniae CWL029
aaauaugagaucgaaucuuua

SEQ ID NO: 2521843 - RNA, 22 nt, Chlamydophila pneumoniae CWL029
aaaucaaaguauauauuuuaca

SEQ ID NO: 2521844 - RNA, 16 nt, Chlamydophila pneumoniae CWL029
aaaucaacaucacaau

SEQ ID NO: 2521845 - RNA, 14 nt, Chlamydophila pneumoniae CWL029
aaaucaacuacacu

SEQ ID NO: 2521846 - RNA, 16 nt, Chlamydophila pneumoniae CWL029
aaaucaacucuccauc

SEQ ID NO: 2521847 - RNA, 21 nt, Chlamydophila pneumoniae CWL029
aaaucaacucuccauccucag

SEQ ID NO: 2521848 - RNA, 15 nt, Chlamydophila pneumoniae CWL029
aaaucaagaagagaa

SEQ ID NO: 2521849 - RNA, 16 nt, Chlamydophila pneumoniae CWL029
aaaucaaucuugaugg

SEQ ID NO: 2521850 - RNA, 19 nt, Chlamydophila pneumoniae CWL029
aaaucaccagcauuaagau

SEQ ID NO: 2521851 - RNA, 19 nt, Chlamydophila pneumoniae CWL029
aaaucaccauauccaugac

SEQ ID NO: 2521852 - RNA, 20 nt, Chlamydophila pneumoniae CWL029
aaaucaucgcaaucaaagag

SEQ ID NO: 2521853 - RNA, 21 nt, Chlamydophila pneumoniae CWL029
aaaucauguccuucaaaaugu

SEQ ID NO: 2521854 - RNA, 21 nt, Chlamydophila pneumoniae CWL029
aaaucauuggaaccauaggau

SEQ ID NO: 2521855 - RNA, 18 nt, Chlamydophila pneumoniae CWL029
aaaucauuuaaagcugaa

SEQ ID NO: 2521856 - RNA, 19 nt, Chlamydophila pneumoniae CWL029
aaauccaaaaaaugcuccu

SEQ ID NO: 2521857 - RNA, 23 nt, Chlamydophila pneumoniae CWL029
aaauccacauccuuguagaacuu

SEQ ID NO: 2521858 - RNA, 16 nt, Chlamydophila pneumoniae CWL029
aaauccaccaaugaua

SEQ ID NO: 2521859 - RNA, 20 nt, Chlamydophila pneumoniae CWL029
aaaucccgaacaaucaacac

SEQ ID NO: 2521860 - RNA, 20 nt, Chlamydophila pneumoniae CWL029
aaaucccgagauaugaagag

SEQ ID NO: 2521861 - RNA, 20 nt, Chlamydophila pneumoniae CWL029
aaaucccugaugcaguaauu

SEQ ID NO: 2521862 - RNA, 18 nt, Chlamydophila pneumoniae CWL029
aaaucccuguucuagcaa

SEQ ID NO: 2521863 - RNA, 16 nt, Chlamydophila pneumoniae CWL029
aaauccgauaagauaa

SEQ ID NO: 2521864 - RNA, 14 nt, Chlamydophila pneumoniae CWL029
aaauccuaaaaagg

SEQ ID NO: 2521865 - RNA, 23 nt, Chlamydophila pneumoniae CWL029
aaauccugggcaaugaucaaaaa

SEQ ID NO: 2521866 - RNA, 15 nt, Chlamydophila pneumoniae CWL029
aaaucgcauuacaaa

SEQ ID NO: 2521867 - RNA, 23 nt, Chlamydophila pneumoniae CWL029
aaaucgguaaccugugaaaauuu

SEQ ID NO: 2521868 - RNA, 17 nt, Chlamydophila pneumoniae CWL029
aaaucguacuucacuuc

SEQ ID NO: 2521869 - RNA, 19 nt, Chlamydophila pneumoniae CWL029
aaaucuaccgugaagauuu

SEQ ID NO: 2521870 - RNA, 20 nt, Chlamydophila pneumoniae CWL029
aaaucuacucuuuaaaaaua

SEQ ID NO: 2521871 - RNA, 20 nt, Chlamydophila pneumoniae CWL029
aaaucuaucugcacuuucuu

SEQ ID NO: 2521872 - RNA, 22 nt, Chlamydophila pneumoniae CWL029
aaaucucagugaacucuucaag

SEQ ID NO: 2521873 - RNA, 21 nt, Chlamydophila pneumoniae CWL029
aaaucucauuccagcaucuuc

SEQ ID NO: 2521874 - RNA, 12 nt, Chlamydophila pneumoniae CWL029
aaaucucauuuc

SEQ ID NO: 2521875 - RNA, 17 nt, Chlamydophila pneumoniae CWL029
aaaucucauuucguaga

SEQ ID NO: 2521876 - RNA, 20 nt, Chlamydophila pneumoniae CWL029
aaaucuccguuugucccuuu

SEQ ID NO: 2521877 - RNA, 23 nt, Chlamydophila pneumoniae CWL029
aaaucuccguuugucccuuucag

SEQ ID NO: 2521878 - RNA, 19 nt, Chlamydophila pneumoniae CWL029
aaaucucgagaagacccua

SEQ ID NO: 2521879 - RNA, 22 nt, Chlamydophila pneumoniae CWL029
aaaucucgagcuaccuaggguc

SEQ ID NO: 2521880 - RNA, 15 nt, Chlamydophila pneumoniae CWL029
aaaucucuaagaauc

SEQ ID NO: 2521881 - RNA, 23 nt, Chlamydophila pneumoniae CWL029
aaaucucuaguuuuuacauguaa

SEQ ID NO: 2521882 - RNA, 16 nt, Chlamydophila pneumoniae CWL029
aaaucugcuauaacca

SEQ ID NO: 2521883 - RNA, 14 nt, Chlamydophila pneumoniae CWL029
aaaucugcuuuuau

SEQ ID NO: 2521884 - RNA, 14 nt, Chlamydophila pneumoniae CWL029
aaaucuuacauaaa

SEQ ID NO: 2521885 - RNA, 16 nt, Chlamydophila pneumoniae CWL029
aaaucuuaguccauga

SEQ ID NO: 2521886 - RNA, 16 nt, Chlamydophila pneumoniae CWL029
aaaucuuccccuaaaa

SEQ ID NO: 2521887 - RNA, 19 nt, Chlamydophila pneumoniae CWL029
aaaucuuccccuaaaaauu

SEQ ID NO: 2521888 - RNA, 16 nt, Chlamydophila pneumoniae CWL029
aaaucuuucaauguaa

SEQ ID NO: 2521889 - RNA, 18 nt, Chlamydophila pneumoniae CWL029
aaaugaagagcuuccauu

SEQ ID NO: 2521890 - RNA, 13 nt, Chlamydophila pneumoniae CWL029
aaaugaagccaaa

SEQ ID NO: 2521891 - RNA, 17 nt, Chlamydophila pneumoniae CWL029
aaaugaauauaauucca

SEQ ID NO: 2521892 - RNA, 12 nt, Chlamydophila pneumoniae CWL029
aaaugagagacg

SEQ ID NO: 2521893 - RNA, 18 nt, Chlamydophila pneumoniae CWL029
aaaugaggacacaacucu

SEQ ID NO: 2521894 - RNA, 19 nt, Chlamydophila pneumoniae CWL029
aaaugaggacacaacucuu

SEQ ID NO: 2521895 - RNA, 16 nt, Chlamydophila pneumoniae CWL029
aaaugcauuugccccu

SEQ ID NO: 2521896 - RNA, 21 nt, Chlamydophila pneumoniae CWL029
aaaugccucuuucauacuaaa

SEQ ID NO: 2521897 - RNA, 13 nt, Chlamydophila pneumoniae CWL029
aaaugccugaaaa

SEQ ID NO: 2521898 - RNA, 17 nt, Chlamydophila pneumoniae CWL029
aaaugccuuaaauguau

SEQ ID NO: 2521899 - RNA, 15 nt, Chlamydophila pneumoniae CWL029
aaaugcgaggaaaaa

SEQ ID NO: 2521900 - RNA, 18 nt, Chlamydophila pneumoniae CWL029
aaaugcuauuuuccucua

SEQ ID NO: 2521901 - RNA, 22 nt, Chlamydophila pneumoniae CWL029
aaauggugaagaauaauagcaa

SEQ ID NO: 2521902 - RNA, 15 nt, Chlamydophila pneumoniae CWL029
aaauguaagaaggca

SEQ ID NO: 2521903 - RNA, 18 nt, Chlamydophila pneumoniae CWL029
aaaugugaaaucguaucu

SEQ ID NO: 2521904 - RNA, 14 nt, Chlamydophila pneumoniae CWL029
aaauguuuuuaaac

SEQ ID NO: 2521905 - RNA, 13 nt, Chlamydophila pneumoniae CWL029
aaauuaacaacac

SEQ ID NO: 2521906 - RNA, 17 nt, Chlamydophila pneumoniae CWL029
aaauuaagucacacuuu

SEQ ID NO: 2521907 - RNA, 13 nt, Chlamydophila pneumoniae CWL029
aaauuacuguggu

SEQ ID NO: 2521908 - RNA, 20 nt, Chlamydophila pneumoniae CWL029
aaauuaguaaaugccucuuu

SEQ ID NO: 2521909 - RNA, 22 nt, Chlamydophila pneumoniae CWL029
aaauucaagacuauagaaaagg

SEQ ID NO: 2521910 - RNA, 22 nt, Chlamydophila pneumoniae CWL029
aaauucaugccuuuggcaauca

SEQ ID NO: 2521911 - RNA, 14 nt, Chlamydophila pneumoniae CWL029
aaauucauuaagaa

SEQ ID NO: 2521912 - RNA, 16 nt, Chlamydophila pneumoniae CWL029
aaauucauuaagaaca

SEQ ID NO: 2521913 - RNA, 21 nt, Chlamydophila pneumoniae CWL029
aaauuccaauuuuugcauaga

SEQ ID NO: 2521914 - RNA, 11 nt, Chlamydophila pneumoniae CWL029
aaauucccaua

SEQ ID NO: 2521915 - RNA, 12 nt, Chlamydophila pneumoniae CWL029
aaauuccucuug

SEQ ID NO: 2521916 - RNA, 14 nt, Chlamydophila pneumoniae CWL029
aaauuccuucucag

SEQ ID NO: 2521917 - RNA, 17 nt, Chlamydophila pneumoniae CWL029
aaauuccuucucagaaa

SEQ ID NO: 2521918 - RNA, 22 nt, Chlamydophila pneumoniae CWL029
aaauuccuucucagaaagauau

SEQ ID NO: 2521919 - RNA, 23 nt, Chlamydophila pneumoniae CWL029
aaauucuagaccugccaagauac

SEQ ID NO: 2521920 - RNA, 20 nt, Chlamydophila pneumoniae CWL029
aaauucuggaauuucccaua

SEQ ID NO: 2521921 - RNA, 12 nt, Chlamydophila pneumoniae CWL029
aaauucuguaaa

SEQ ID NO: 2521922 - RNA, 18 nt, Chlamydophila pneumoniae CWL029
aaauucuguaaagugaaa

SEQ ID NO: 2521923 - RNA, 17 nt, Chlamydophila pneumoniae CWL029
aaauucuucgagagcau

SEQ ID NO: 2521924 - RNA, 16 nt, Chlamydophila pneumoniae CWL029
aaauucuuuucuacau

SEQ ID NO: 2521925 - RNA, 15 nt, Chlamydophila pneumoniae CWL029
aaauugaaaucuuua

SEQ ID NO: 2521926 - RNA, 17 nt, Chlamydophila pneumoniae CWL029
aaauugaauaucgaguu

SEQ ID NO: 2521927 - RNA, 20 nt, Chlamydophila pneumoniae CWL029
aaauugaugagcucuccauu

SEQ ID NO: 2521928 - RNA, 17 nt, Chlamydophila pneumoniae CWL029
aaauugaugauuuuuua

SEQ ID NO: 2521929 - RNA, 12 nt, Chlamydophila pneumoniae CWL029
aaauugcucuug

SEQ ID NO: 2521930 - RNA, 16 nt, Chlamydophila pneumoniae CWL029
aaauugugaaaaaaaa

SEQ ID NO: 2521931 - RNA, 14 nt, Chlamydophila pneumoniae CWL029
aaauuguuggaauu

SEQ ID NO: 2521932 - RNA, 20 nt, Chlamydophila pneumoniae CWL029
aaauuguuggaauugcauua

SEQ ID NO: 2521933 - RNA, 13 nt, Chlamydophila pneumoniae CWL029
aaauuguuuuugc

SEQ ID NO: 2521934 - RNA, 11 nt, Chlamydophila pneumoniae CWL029
aaauuuaaaua

SEQ ID NO: 2521935 - RNA, 13 nt, Chlamydophila pneumoniae CWL029
aaauuuaaauaua

SEQ ID NO: 2521936 - RNA, 18 nt, Chlamydophila pneumoniae CWL029
aaauuuaaauauagaaaa

SEQ ID NO: 2521937 - RNA, 21 nt, Chlamydophila pneumoniae CWL029
aaauuuaucggcuaaagaaaa

SEQ ID NO: 2521938 - RNA, 15 nt, Chlamydophila pneumoniae CWL029
aaauuucauuuagac

SEQ ID NO: 2521939 - RNA, 14 nt, Chlamydophila pneumoniae CWL029
aaauuucauuugaa

SEQ ID NO: 2521940 - RNA, 11 nt, Chlamydophila pneumoniae CWL029
aaauuucugaa

SEQ ID NO: 2521941 - RNA, 18 nt, Chlamydophila pneumoniae CWL029
aaauuucugaaacaaugc

SEQ ID NO: 2521942 - RNA, 13 nt, Chlamydophila pneumoniae CWL029
aaauuugucauca

SEQ ID NO: 2521943 - RNA, 19 nt, Chlamydophila pneumoniae CWL029
aaauuuucuugcgacauaa

SEQ ID NO: 2521944 - RNA, 12 nt, Chlamydophila pneumoniae CWL029
aaauuuuuccuu

SEQ ID NO: 2521945 - RNA, 17 nt, Chlamydophila pneumoniae CWL029
aaauuuuuuaggaucuu

SEQ ID NO: 2521946 - RNA, 14 nt, Chlamydophila pneumoniae CWL029
aacaaaaaaucaau

SEQ ID NO: 2521947 - RNA, 18 nt, Chlamydophila pneumoniae CWL029
aacaaaaaggacucuuuc

SEQ ID NO: 2521948 - RNA, 16 nt, Chlamydophila pneumoniae CWL029
aacaaauugaugauuu

SEQ ID NO: 2521949 - RNA, 14 nt, Chlamydophila pneumoniae CWL029
aacaacagaaaugu

SEQ ID NO: 2521950 - RNA, 15 nt, Chlamydophila pneumoniae CWL029
aacaacagaaauguu

SEQ ID NO: 2521951 - RNA, 14 nt, Chlamydophila pneumoniae CWL029
aacaacauaaagaa

SEQ ID NO: 2521952 - RNA, 15 nt, Chlamydophila pneumoniae CWL029
aacaacauaaagaag

SEQ ID NO: 2521953 - RNA, 16 nt, Chlamydophila pneumoniae CWL029
aacaacauaaagaagg

SEQ ID NO: 2521954 - RNA, 17 nt, Chlamydophila pneumoniae CWL029
aacaacauaaagaaggu

SEQ ID NO: 2521955 - RNA, 22 nt, Chlamydophila pneumoniae CWL029
aacaacaucacuuauauuuucu

SEQ ID NO: 2521956 - RNA, 22 nt, Chlamydophila pneumoniae CWL029
aacaacaugcgcguauaaggau

SEQ ID NO: 2521957 - RNA, 12 nt, Chlamydophila pneumoniae CWL029
aacaaccaaaag

SEQ ID NO: 2521958 - RNA, 19 nt, Chlamydophila pneumoniae CWL029
aacaaccaucccauaugga

SEQ ID NO: 2521959 - RNA, 21 nt, Chlamydophila pneumoniae CWL029
aacaacgcugcuucucuacua

SEQ ID NO: 2521960 - RNA, 14 nt, Chlamydophila pneumoniae CWL029
aacaacugaaaaac

SEQ ID NO: 2521961 - RNA, 14 nt, Chlamydophila pneumoniae CWL029
aacaagaagaucaa

SEQ ID NO: 2521962 - RNA, 16 nt, Chlamydophila pneumoniae CWL029
aacaagacgaaagcac

SEQ ID NO: 2521963 - RNA, 22 nt, Chlamydophila pneumoniae CWL029
aacaagagcgcauuuuacagcg

SEQ ID NO: 2521964 - RNA, 23 nt, Chlamydophila pneumoniae CWL029
aacaagcuuuuaauguguucuua

SEQ ID NO: 2521965 - RNA, 19 nt, Chlamydophila pneumoniae CWL029
aacaaguaccaagaaaaua

SEQ ID NO: 2521966 - RNA, 23 nt, Chlamydophila pneumoniae CWL029
aacaaguugacgcgcuucuucaa

SEQ ID NO: 2521967 - RNA, 23 nt, Chlamydophila pneumoniae CWL029
aacaauaaacgagacugcaaagg

SEQ ID NO: 2521968 - RNA, 16 nt, Chlamydophila pneumoniae CWL029
aacaauaguaaagcau

SEQ ID NO: 2521969 - RNA, 14 nt, Chlamydophila pneumoniae CWL029
aacaaucuuucuuc

SEQ ID NO: 2521970 - RNA, 16 nt, Chlamydophila pneumoniae CWL029
aacaaucuuucuucua

SEQ ID NO: 2521971 - RNA, 15 nt, Chlamydophila pneumoniae CWL029
aacaaugcaucccug

SEQ ID NO: 2521972 - RNA, 15 nt, Chlamydophila pneumoniae CWL029
aacacaaauagcaag

SEQ ID NO: 2521973 - RNA, 20 nt, Chlamydophila pneumoniae CWL029
aacacagauaggaaccacuu

SEQ ID NO: 2521974 - RNA, 15 nt, Chlamydophila pneumoniae CWL029
aacaccauaaaacaa

SEQ ID NO: 2521975 - RNA, 21 nt, Chlamydophila pneumoniae CWL029
aacaccaucacauccuguagu

SEQ ID NO: 2521976 - RNA, 19 nt, Chlamydophila pneumoniae CWL029
aacaccgaaggcacuggca

SEQ ID NO: 2521977 - RNA, 14 nt, Chlamydophila pneumoniae CWL029
aacaccucaauacg

SEQ ID NO: 2521978 - RNA, 16 nt, Chlamydophila pneumoniae CWL029
aacacgucgaacauga

SEQ ID NO: 2521979 - RNA, 17 nt, Chlamydophila pneumoniae CWL029
aacacgucgaacaugac

SEQ ID NO: 2521980 - RNA, 21 nt, Chlamydophila pneumoniae CWL029
aacacucucuaccaucaugaa

SEQ ID NO: 2521981 - RNA, 21 nt, Chlamydophila pneumoniae CWL029
aacacugaacgccaucuccac

SEQ ID NO: 2521982 - RNA, 13 nt, Chlamydophila pneumoniae CWL029
aacacuuuuaaag

SEQ ID NO: 2521983 - RNA, 14 nt, Chlamydophila pneumoniae CWL029
aacagaaauugcuu

SEQ ID NO: 2521984 - RNA, 16 nt, Chlamydophila pneumoniae CWL029
aacagaaauugcuucu

SEQ ID NO: 2521985 - RNA, 16 nt, Chlamydophila pneumoniae CWL029
aacagagcgccuccac

SEQ ID NO: 2521986 - RNA, 17 nt, Chlamydophila pneumoniae CWL029
aacagaucuuuaucauu

SEQ ID NO: 2521987 - RNA, 22 nt, Chlamydophila pneumoniae CWL029
aacagaucuuuaucauugcuau

SEQ ID NO: 2521988 - RNA, 20 nt, Chlamydophila pneumoniae CWL029
aacagauuuuucaagaacuc

SEQ ID NO: 2521989 - RNA, 20 nt, Chlamydophila pneumoniae CWL029
aacagcacucacgcucucgc

SEQ ID NO: 2521990 - RNA, 15 nt, Chlamydophila pneumoniae CWL029
aacagcacucucugc

SEQ ID NO: 2521991 - RNA, 19 nt, Chlamydophila pneumoniae CWL029
aacagcauggacuccaaga

SEQ ID NO: 2521992 - RNA, 21 nt, Chlamydophila pneumoniae CWL029
aacagcauggacuccaagaau

SEQ ID NO: 2521993 - RNA, 21 nt, Chlamydophila pneumoniae CWL029
aacagcgguugccuuucucuu

SEQ ID NO: 2521994 - RNA, 22 nt, Chlamydophila pneumoniae CWL029
aacagcuccuggauauugucaa

SEQ ID NO: 2521995 - RNA, 13 nt, Chlamydophila pneumoniae CWL029
aacagcuucagga

SEQ ID NO: 2521996 - RNA, 17 nt, Chlamydophila pneumoniae CWL029
aacaggaauagaaaauc

SEQ ID NO: 2521997 - RNA, 16 nt, Chlamydophila pneumoniae CWL029
aacaggaauaggcucu

SEQ ID NO: 2521998 - RNA, 22 nt, Chlamydophila pneumoniae CWL029
aacagugguaugcuuuuccuuc

SEQ ID NO: 2521999 - RNA, 22 nt, Chlamydophila pneumoniae CWL029
aacaguuccuauuuuuugugaa

SEQ ID NO: 2522000 - RNA, 20 nt, Chlamydophila pneumoniae CWL029
aacaguucgggcuaaucauu

SEQ ID NO: 2522001 - RNA, 15 nt, Chlamydophila pneumoniae CWL029
aacauaaagaagguu

SEQ ID NO: 2522002 - RNA, 16 nt, Chlamydophila pneumoniae CWL029
aacauaaagaagguuu

SEQ ID NO: 2522003 - RNA, 19 nt, Chlamydophila pneumoniae CWL029
aacauaaagacccuucuuu

SEQ ID NO: 2522004 - RNA, 15 nt, Chlamydophila pneumoniae CWL029
aacauaacaugagaa

SEQ ID NO: 2522005 - RNA, 19 nt, Chlamydophila pneumoniae CWL029
aacauaaccuccucuucuu

SEQ ID NO: 2522006 - RNA, 21 nt, Chlamydophila pneumoniae CWL029
aacauaaugauguaacuagua

SEQ ID NO: 2522007 - RNA, 18 nt, Chlamydophila pneumoniae CWL029
aacauacaccccaguuuc

SEQ ID NO: 2522008 - RNA, 19 nt, Chlamydophila pneumoniae CWL029
aacauacacgucuaagaau

SEQ ID NO: 2522009 - RNA, 16 nt, Chlamydophila pneumoniae CWL029
aacauaucgauaggau

SEQ ID NO: 2522010 - RNA, 15 nt, Chlamydophila pneumoniae CWL029
aacaucaagaauuuc

SEQ ID NO: 2522011 - RNA, 15 nt, Chlamydophila pneumoniae CWL029
aacaucacucaggau

SEQ ID NO: 2522012 - RNA, 17 nt, Chlamydophila pneumoniae CWL029
aacaucacucaggauau

SEQ ID NO: 2522013 - RNA, 18 nt, Chlamydophila pneumoniae CWL029
aacaucacuuauauuuuc

SEQ ID NO: 2522014 - RNA, 15 nt, Chlamydophila pneumoniae CWL029
aacaucagcaacaua

SEQ ID NO: 2522015 - RNA, 14 nt, Chlamydophila pneumoniae CWL029
aacaucagcuguug

SEQ ID NO: 2522016 - RNA, 14 nt, Chlamydophila pneumoniae CWL029
aacaucaugaaaua

SEQ ID NO: 2522017 - RNA, 15 nt, Chlamydophila pneumoniae CWL029
aacauccauagagaa

SEQ ID NO: 2522018 - RNA, 15 nt, Chlamydophila pneumoniae CWL029
aacaucgaaaccaca

SEQ ID NO: 2522019 - RNA, 22 nt, Chlamydophila pneumoniae CWL029
aacaucggagaacuuccugauu

SEQ ID NO: 2522020 - RNA, 15 nt, Chlamydophila pneumoniae CWL029
aacaucuccagcagc

SEQ ID NO: 2522021 - RNA, 12 nt, Chlamydophila pneumoniae CWL029
aacaucuuugug

SEQ ID NO: 2522022 - RNA, 14 nt, Chlamydophila pneumoniae CWL029
aacaugaaguuguu

SEQ ID NO: 2522023 - RNA, 20 nt, Chlamydophila pneumoniae CWL029
aacaugaccuuuaggaacuu

SEQ ID NO: 2522024 - RNA, 23 nt, Chlamydophila pneumoniae CWL029
aacaugacggugcuguuguaaua

SEQ ID NO: 2522025 - RNA, 14 nt, Chlamydophila pneumoniae CWL029
aacaugagauacgu

SEQ ID NO: 2522026 - RNA, 17 nt, Chlamydophila pneumoniae CWL029
aacaugccugaaaacaa

SEQ ID NO: 2522027 - RNA, 17 nt, Chlamydophila pneumoniae CWL029
aacaugcgcagaauaaa

SEQ ID NO: 2522028 - RNA, 23 nt, Chlamydophila pneumoniae CWL029
aacauggcgguguuuccuucgaa

SEQ ID NO: 2522029 - RNA, 17 nt, Chlamydophila pneumoniae CWL029
aacauucuucugucugu

SEQ ID NO: 2522030 - RNA, 19 nt, Chlamydophila pneumoniae CWL029
aacauuggagucuaaaaaa

SEQ ID NO: 2522031 - RNA, 20 nt, Chlamydophila pneumoniae CWL029
aacauuggagucuaaaaaau

SEQ ID NO: 2522032 - RNA, 23 nt, Chlamydophila pneumoniae CWL029
aacauuggagucuaaaaaauacc

SEQ ID NO: 2522033 - RNA, 20 nt, Chlamydophila pneumoniae CWL029
aacauuuuuaaggaaaguuc

SEQ ID NO: 2522034 - RNA, 17 nt, Chlamydophila pneumoniae CWL029
aacauuuuuauuuccuu

SEQ ID NO: 2522035 - RNA, 23 nt, Chlamydophila pneumoniae CWL029
aacauuuuucaauaaccagaaga

SEQ ID NO: 2522036 - RNA, 20 nt, Chlamydophila pneumoniae CWL029
aaccaaaagaauuaagaaga

SEQ ID NO: 2522037 - RNA, 13 nt, Chlamydophila pneumoniae CWL029
aaccaaaaugagu

SEQ ID NO: 2522038 - RNA, 13 nt, Chlamydophila pneumoniae CWL029
aaccaaaaugcau

SEQ ID NO: 2522039 - RNA, 13 nt, Chlamydophila pneumoniae CWL029
aaccaacaucaaa

SEQ ID NO: 2522040 - RNA, 16 nt, Chlamydophila pneumoniae CWL029
aaccaacaucaaagaa

SEQ ID NO: 2522041 - RNA, 16 nt, Chlamydophila pneumoniae CWL029
aaccaauaaacuuugu

SEQ ID NO: 2522042 - RNA, 23 nt, Chlamydophila pneumoniae CWL029
aaccaaucuugagcauccaaaau

SEQ ID NO: 2522043 - RNA, 15 nt, Chlamydophila pneumoniae CWL029
aaccaauugagcucu

SEQ ID NO: 2522044 - RNA, 17 nt, Chlamydophila pneumoniae CWL029
aaccaauuucuccgcuu

SEQ ID NO: 2522045 - RNA, 23 nt, Chlamydophila pneumoniae CWL029
aaccacacaggauuguuauugag

SEQ ID NO: 2522046 - RNA, 11 nt, Chlamydophila pneumoniae CWL029
aaccacagaau

SEQ ID NO: 2522047 - RNA, 22 nt, Chlamydophila pneumoniae CWL029
aaccacagugauuuagaaaucu

SEQ ID NO: 2522048 - RNA, 11 nt, Chlamydophila pneumoniae CWL029
aaccagagagc

SEQ ID NO: 2522049 - RNA, 13 nt, Chlamydophila pneumoniae CWL029
aaccagccaauaa

SEQ ID NO: 2522050 - RNA, 15 nt, Chlamydophila pneumoniae CWL029
aaccaggaacaaagg

SEQ ID NO: 2522051 - RNA, 13 nt, Chlamydophila pneumoniae CWL029
aaccauaaagaau

SEQ ID NO: 2522052 - RNA, 14 nt, Chlamydophila pneumoniae CWL029
aaccauagagagcc

SEQ ID NO: 2522053 - RNA, 15 nt, Chlamydophila pneumoniae CWL029
aaccauagagagccu

SEQ ID NO: 2522054 - RNA, 13 nt, Chlamydophila pneumoniae CWL029
aaccauagauuua

SEQ ID NO: 2522055 - RNA, 14 nt, Chlamydophila pneumoniae CWL029
aaccaugaugcaau

SEQ ID NO: 2522056 - RNA, 19 nt, Chlamydophila pneumoniae CWL029
aaccauucaucuaggggag

SEQ ID NO: 2522057 - RNA, 13 nt, Chlamydophila pneumoniae CWL029
aaccccuccaaaa

SEQ ID NO: 2522058 - RNA, 18 nt, Chlamydophila pneumoniae CWL029
aacccgauacauccucac

SEQ ID NO: 2522059 - RNA, 20 nt, Chlamydophila pneumoniae CWL029
aacccuaguucauuagcuaa

SEQ ID NO: 2522060 - RNA, 15 nt, Chlamydophila pneumoniae CWL029
aacccucaaagaaua

SEQ ID NO: 2522061 - RNA, 16 nt, Chlamydophila pneumoniae CWL029
aacccuuuaaugauca

SEQ ID NO: 2522062 - RNA, 22 nt, Chlamydophila pneumoniae CWL029
aacccuuuauacuguuuuucuu

SEQ ID NO: 2522063 - RNA, 17 nt, Chlamydophila pneumoniae CWL029
aaccgaaacuucucaga

SEQ ID NO: 2522064 - RNA, 21 nt, Chlamydophila pneumoniae CWL029
aaccgucacuguuuuccagaa

SEQ ID NO: 2522065 - RNA, 24 nt, Chlamydophila pneumoniae CWL029
aaccuagaaggaggaguccuucua

SEQ ID NO: 2522066 - RNA, 18 nt, Chlamydophila pneumoniae CWL029
aaccuccauagaauccuc

SEQ ID NO: 2522067 - RNA, 16 nt, Chlamydophila pneumoniae CWL029
aaccuccgcucuaagc

SEQ ID NO: 2522068 - RNA, 14 nt, Chlamydophila pneumoniae CWL029
aaccucuuuucuua

SEQ ID NO: 2522069 - RNA, 22 nt, Chlamydophila pneumoniae CWL029
aaccuggcauugccauaauaaa

SEQ ID NO: 2522070 - RNA, 17 nt, Chlamydophila pneumoniae CWL029
aaccugggcaauauuuu

SEQ ID NO: 2522071 - RNA, 18 nt, Chlamydophila pneumoniae CWL029
aaccugugaaaauuuucu

SEQ ID NO: 2522072 - RNA, 19 nt, Chlamydophila pneumoniae CWL029
aaccuucgauuccaggcuc

SEQ ID NO: 2522073 - RNA, 14 nt, Chlamydophila pneumoniae CWL029
aaccuucucucuua

SEQ ID NO: 2522074 - RNA, 16 nt, Chlamydophila pneumoniae CWL029
aaccuuuccuaaaaua

SEQ ID NO: 2522075 - RNA, 22 nt, Chlamydophila pneumoniae CWL029
aaccuuugguagaaagacaaaa

SEQ ID NO: 2522076 - RNA, 22 nt, Chlamydophila pneumoniae CWL029
aacgaagugaggagaauagcaa

SEQ ID NO: 2522077 - RNA, 12 nt, Chlamydophila pneumoniae CWL029
aacgaauuucaa

SEQ ID NO: 2522078 - RNA, 13 nt, Chlamydophila pneumoniae CWL029
aacgaauuucaac

SEQ ID NO: 2522079 - RNA, 15 nt, Chlamydophila pneumoniae CWL029
aacgacauugaagag

SEQ ID NO: 2522080 - RNA, 23 nt, Chlamydophila pneumoniae CWL029
aacgaucgucaguaaaacacaaa

SEQ ID NO: 2522081 - RNA, 23 nt, Chlamydophila pneumoniae CWL029
aacgauuguaauuucuagcuaau

SEQ ID NO: 2522082 - RNA, 14 nt, Chlamydophila pneumoniae CWL029
aacgauuucuucuu

SEQ ID NO: 2522083 - RNA, 17 nt, Chlamydophila pneumoniae CWL029
aacgauuucuugaagau

SEQ ID NO: 2522084 - RNA, 16 nt, Chlamydophila pneumoniae CWL029
aacgcaacauccauuc

SEQ ID NO: 2522085 - RNA, 15 nt, Chlamydophila pneumoniae CWL029
aacgcacgccaagag

SEQ ID NO: 2522086 - RNA, 16 nt, Chlamydophila pneumoniae CWL029
aacgcacgccaagaga

SEQ ID NO: 2522087 - RNA, 14 nt, Chlamydophila pneumoniae CWL029
aacgcagcuuuccu

SEQ ID NO: 2522088 - RNA, 22 nt, Chlamydophila pneumoniae CWL029
aacgcagcuuuccuuuugauaa

SEQ ID NO: 2522089 - RNA, 15 nt, Chlamydophila pneumoniae CWL029
aacgcaggaagaaca

SEQ ID NO: 2522090 - RNA, 21 nt, Chlamydophila pneumoniae CWL029
aacgcauaagagacauuucuu

SEQ ID NO: 2522091 - RNA, 23 nt, Chlamydophila pneumoniae CWL029
aacgcaugacgcuuuuccaaagc

SEQ ID NO: 2522092 - RNA, 18 nt, Chlamydophila pneumoniae CWL029
aacgccaacacgcacaaa

SEQ ID NO: 2522093 - RNA, 20 nt, Chlamydophila pneumoniae CWL029
aacgcccuucuuaguaaaga

SEQ ID NO: 2522094 - RNA, 14 nt, Chlamydophila pneumoniae CWL029
aacgccgcucuuga

SEQ ID NO: 2522095 - RNA, 22 nt, Chlamydophila pneumoniae CWL029
aacgcucucuagcaccuaauaa

SEQ ID NO: 2522096 - RNA, 15 nt, Chlamydophila pneumoniae CWL029
aacgcuuagagaauu

SEQ ID NO: 2522097 - RNA, 20 nt, Chlamydophila pneumoniae CWL029
aacggauaagacggauaaau

SEQ ID NO: 2522098 - RNA, 20 nt, Chlamydophila pneumoniae CWL029
aacggauuuuguuugcaugc

SEQ ID NO: 2522099 - RNA, 23 nt, Chlamydophila pneumoniae CWL029
aacgggagcguuuuuugaaaauu

SEQ ID NO: 2522100 - RNA, 22 nt, Chlamydophila pneumoniae CWL029
aacgguugucucgaaacucuuu

SEQ ID NO: 2522101 - RNA, 20 nt, Chlamydophila pneumoniae CWL029
aacguaagcuuuuuaccaau

SEQ ID NO: 2522102 - RNA, 22 nt, Chlamydophila pneumoniae CWL029
aacguaagcuuuuuaccaauaa

SEQ ID NO: 2522103 - RNA, 18 nt, Chlamydophila pneumoniae CWL029
aacguagcuacaaaauua

SEQ ID NO: 2522104 - RNA, 16 nt, Chlamydophila pneumoniae CWL029
aacguauccuugauuu

SEQ ID NO: 2522105 - RNA, 15 nt, Chlamydophila pneumoniae CWL029
aacgugcugcgaauu

SEQ ID NO: 2522106 - RNA, 15 nt, Chlamydophila pneumoniae CWL029
aacuaaaacagccua

SEQ ID NO: 2522107 - RNA, 17 nt, Chlamydophila pneumoniae CWL029
aacuaaaucaacuacau

SEQ ID NO: 2522108 - RNA, 19 nt, Chlamydophila pneumoniae CWL029
aacuaaauucuuaacaaua

SEQ ID NO: 2522109 - RNA, 20 nt, Chlamydophila pneumoniae CWL029
aacuaacauagauaagguaa

SEQ ID NO: 2522110 - RNA, 14 nt, Chlamydophila pneumoniae CWL029
aacuaccagaugcc

SEQ ID NO: 2522111 - RNA, 19 nt, Chlamydophila pneumoniae CWL029
aacuaccuaccuauuuaag

SEQ ID NO: 2522112 - RNA, 18 nt, Chlamydophila pneumoniae CWL029
aacuacucucauucaccu

SEQ ID NO: 2522113 - RNA, 18 nt, Chlamydophila pneumoniae CWL029
aacuacuuaaauccuaag

SEQ ID NO: 2522114 - RNA, 13 nt, Chlamydophila pneumoniae CWL029
aacuagaaaaaau

SEQ ID NO: 2522115 - RNA, 15 nt, Chlamydophila pneumoniae CWL029
aacuagaaucaccaa

SEQ ID NO: 2522116 - RNA, 13 nt, Chlamydophila pneumoniae CWL029
aacuagaccaaua

SEQ ID NO: 2522117 - RNA, 17 nt, Chlamydophila pneumoniae CWL029
aacuagagaucuuuuua

SEQ ID NO: 2522118 - RNA, 17 nt, Chlamydophila pneumoniae CWL029
aacuaggaaaagcauag

SEQ ID NO: 2522119 - RNA, 22 nt, Chlamydophila pneumoniae CWL029
aacuagguuauuaucaaaguga

SEQ ID NO: 2522120 - RNA, 23 nt, Chlamydophila pneumoniae CWL029
aacuaguucuucuuuacucaagu

SEQ ID NO: 2522121 - RNA, 20 nt, Chlamydophila pneumoniae CWL029
aacuauacucucuguagcac

SEQ ID NO: 2522122 - RNA, 20 nt, Chlamydophila pneumoniae CWL029
aacuauaggaagcucuucua

SEQ ID NO: 2522123 - RNA, 15 nt, Chlamydophila pneumoniae CWL029
aacuauccaaagccg

SEQ ID NO: 2522124 - RNA, 15 nt, Chlamydophila pneumoniae CWL029
aacucacaaacaaca

SEQ ID NO: 2522125 - RNA, 12 nt, Chlamydophila pneumoniae CWL029
aacucagagauu

SEQ ID NO: 2522126 - RNA, 17 nt, Chlamydophila pneumoniae CWL029
aacucagcgcaucacga

SEQ ID NO: 2522127 - RNA, 12 nt, Chlamydophila pneumoniae CWL029
aacuccaaaaua

SEQ ID NO: 2522128 - RNA, 13 nt, Chlamydophila pneumoniae CWL029
aacuccaaaauau

SEQ ID NO: 2522129 - RNA, 15 nt, Chlamydophila pneumoniae CWL029
aacuccaaaauauuc

SEQ ID NO: 2522130 - RNA, 16 nt, Chlamydophila pneumoniae CWL029
aacuccaaaauauucu

SEQ ID NO: 2522131 - RNA, 18 nt, Chlamydophila pneumoniae CWL029
aacuccacgaauucuuua

SEQ ID NO: 2522132 - RNA, 12 nt, Chlamydophila pneumoniae CWL029
aacuccacgcca

SEQ ID NO: 2522133 - RNA, 14 nt, Chlamydophila pneumoniae CWL029
aacuccacgccaaa

SEQ ID NO: 2522134 - RNA, 22 nt, Chlamydophila pneumoniae CWL029
aacuccaggggauaaaacuaua

SEQ ID NO: 2522135 - RNA, 18 nt, Chlamydophila pneumoniae CWL029
aacuccccaguuuuccau

SEQ ID NO: 2522136 - RNA, 15 nt, Chlamydophila pneumoniae CWL029
aacucccguuuuguu

SEQ ID NO: 2522137 - RNA, 23 nt, Chlamydophila pneumoniae CWL029
aacuccgcacuugcucuuuaaua

SEQ ID NO: 2522138 - RNA, 13 nt, Chlamydophila pneumoniae CWL029
aacuccuuuuaaa

SEQ ID NO: 2522139 - RNA, 14 nt, Chlamydophila pneumoniae CWL029
aacucuaaucugau

SEQ ID NO: 2522140 - RNA, 15 nt, Chlamydophila pneumoniae CWL029
aacucuagaucuuca

SEQ ID NO: 2522141 - RNA, 22 nt, Chlamydophila pneumoniae CWL029
aacucuauuuucauaucaaagu

SEQ ID NO: 2522142 - RNA, 20 nt, Chlamydophila pneumoniae CWL029
aacucucccauguaguaaau

SEQ ID NO: 2522143 - RNA, 18 nt, Chlamydophila pneumoniae CWL029
aacucugaaguacacuac

SEQ ID NO: 2522144 - RNA, 18 nt, Chlamydophila pneumoniae CWL029
aacucugcccgucuuaga

SEQ ID NO: 2522145 - RNA, 16 nt, Chlamydophila pneumoniae CWL029
aacucuuaagaauaaa

SEQ ID NO: 2522146 - RNA, 18 nt, Chlamydophila pneumoniae CWL029
aacucuuaagaauaaaau

SEQ ID NO: 2522147 - RNA, 19 nt, Chlamydophila pneumoniae CWL029
aacucuuuaauugugcucu

SEQ ID NO: 2522148 - RNA, 22 nt, Chlamydophila pneumoniae CWL029
aacucuuuaauugugcucucua

SEQ ID NO: 2522149 - RNA, 13 nt, Chlamydophila pneumoniae CWL029
aacucuuugagga

SEQ ID NO: 2522150 - RNA, 21 nt, Chlamydophila pneumoniae CWL029
aacugacguuuuucccuaccu

SEQ ID NO: 2522151 - RNA, 15 nt, Chlamydophila pneumoniae CWL029
aacugaugccaagaa

SEQ ID NO: 2522152 - RNA, 22 nt, Chlamydophila pneumoniae CWL029
aacugauuaguuuguuuuaauu

SEQ ID NO: 2522153 - RNA, 14 nt, Chlamydophila pneumoniae CWL029
aacugcauaaucuc

SEQ ID NO: 2522154 - RNA, 15 nt, Chlamydophila pneumoniae CWL029
aacugcauaaucuca

SEQ ID NO: 2522155 - RNA, 18 nt, Chlamydophila pneumoniae CWL029
aacugccugagaaaaguu

SEQ ID NO: 2522156 - RNA, 22 nt, Chlamydophila pneumoniae CWL029
aacugcuacuuuaaaguggcaa

SEQ ID NO: 2522157 - RNA, 16 nt, Chlamydophila pneumoniae CWL029
aacugcuccugaagcu

SEQ ID NO: 2522158 - RNA, 17 nt, Chlamydophila pneumoniae CWL029
aacugcuccugaagcug

SEQ ID NO: 2522159 - RNA, 22 nt, Chlamydophila pneumoniae CWL029
aacugcuccugaagcugagaau

SEQ ID NO: 2522160 - RNA, 19 nt, Chlamydophila pneumoniae CWL029
aacugcuuggucacaccaa

SEQ ID NO: 2522161 - RNA, 20 nt, Chlamydophila pneumoniae CWL029
aacugcuuggucacaccaaa

SEQ ID NO: 2522162 - RNA, 18 nt, Chlamydophila pneumoniae CWL029
aacuggcaaucuaaaauc

SEQ ID NO: 2522163 - RNA, 19 nt, Chlamydophila pneumoniae CWL029
aacuuaaagacuugcuucc

SEQ ID NO: 2522164 - RNA, 14 nt, Chlamydophila pneumoniae CWL029
aacuucaacaaagg

SEQ ID NO: 2522165 - RNA, 17 nt, Chlamydophila pneumoniae CWL029
aacuucaaugaagaaaa

SEQ ID NO: 2522166 - RNA, 18 nt, Chlamydophila pneumoniae CWL029
aacuucagcaagaaaaua

SEQ ID NO: 2522167 - RNA, 23 nt, Chlamydophila pneumoniae CWL029
aacuucccaucuuguucuaaaau

SEQ ID NO: 2522168 - RNA, 13 nt, Chlamydophila pneumoniae CWL029
aacuucuaacugu

SEQ ID NO: 2522169 - RNA, 20 nt, Chlamydophila pneumoniae CWL029
aacuucuaucuuacugaaga

SEQ ID NO: 2522170 - RNA, 12 nt, Chlamydophila pneumoniae CWL029
aacuucucuagg

SEQ ID NO: 2522171 - RNA, 14 nt, Chlamydophila pneumoniae CWL029
aacuucuucguuag

SEQ ID NO: 2522172 - RNA, 17 nt, Chlamydophila pneumoniae CWL029
aacuugaagaaguacaa

SEQ ID NO: 2522173 - RNA, 14 nt, Chlamydophila pneumoniae CWL029
aacuugagccaaca

SEQ ID NO: 2522174 - RNA, 20 nt, Chlamydophila pneumoniae CWL029
aacuugcuuuuuugaaagcu

SEQ ID NO: 2522175 - RNA, 17 nt, Chlamydophila pneumoniae CWL029
aacuuggugagcagcuu

SEQ ID NO: 2522176 - RNA, 20 nt, Chlamydophila pneumoniae CWL029
aacuuuccggguaaguacac

SEQ ID NO: 2522177 - RNA, 22 nt, Chlamydophila pneumoniae CWL029
aacuuucgaagcgcucuacaaa

SEQ ID NO: 2522178 - RNA, 12 nt, Chlamydophila pneumoniae CWL029
aacuuucuucuc

SEQ ID NO: 2522179 - RNA, 13 nt, Chlamydophila pneumoniae CWL029
aacuuucuucucu

SEQ ID NO: 2522180 - RNA, 13 nt, Chlamydophila pneumoniae CWL029
aacuuucuuuuug

SEQ ID NO: 2522181 - RNA, 20 nt, Chlamydophila pneumoniae CWL029
aacuuucuuuuugagauaau

SEQ ID NO: 2522182 - RNA, 19 nt, Chlamydophila pneumoniae CWL029
aacuuugaccagaugauuu

SEQ ID NO: 2522183 - RNA, 18 nt, Chlamydophila pneumoniae CWL029
aacuuugaggcaagucuc

SEQ ID NO: 2522184 - RNA, 19 nt, Chlamydophila pneumoniae CWL029
aacuuuugaagauccugag

SEQ ID NO: 2522185 - RNA, 14 nt, Chlamydophila pneumoniae CWL029
aacuuuugaauuaa

SEQ ID NO: 2522186 - RNA, 23 nt, Chlamydophila pneumoniae CWL029
aacuuuuuuucuucucuaagaaa

SEQ ID NO: 2522187 - RNA, 20 nt, Chlamydophila pneumoniae CWL029
aagaaaaaccccuagaacuu

SEQ ID NO: 2522188 - RNA, 15 nt, Chlamydophila pneumoniae CWL029
aagaaaaagcaucua

SEQ ID NO: 2522189 - RNA, 21 nt, Chlamydophila pneumoniae CWL029
aagaaaaagcaucuaugggcu

SEQ ID NO: 2522190 - RNA, 19 nt, Chlamydophila pneumoniae CWL029
aagaaaagugugaggagac

SEQ ID NO: 2522191 - RNA, 20 nt, Chlamydophila pneumoniae CWL029
aagaaaauccuaacaaaagg

SEQ ID NO: 2522192 - RNA, 23 nt, Chlamydophila pneumoniae CWL029
aagaaaaugaggacacaacucuu

SEQ ID NO: 2522193 - RNA, 18 nt, Chlamydophila pneumoniae CWL029
aagaaacccgcaacucuu

SEQ ID NO: 2522194 - RNA, 19 nt, Chlamydophila pneumoniae CWL029
aagaaagagucucacucuu

SEQ ID NO: 2522195 - RNA, 16 nt, Chlamydophila pneumoniae CWL029
aagaaagcuugucaua

SEQ ID NO: 2522196 - RNA, 24 nt, Chlamydophila pneumoniae CWL029
aagaaaggauuggaugagaauuuc

SEQ ID NO: 2522197 - RNA, 17 nt, Chlamydophila pneumoniae CWL029
aagaaagugaaaccauu

SEQ ID NO: 2522198 - RNA, 20 nt, Chlamydophila pneumoniae CWL029
aagaaauauacugccagcga

SEQ ID NO: 2522199 - RNA, 22 nt, Chlamydophila pneumoniae CWL029
aagaaauauuaacccaccagaa

SEQ ID NO: 2522200 - RNA, 23 nt, Chlamydophila pneumoniae CWL029
aagaaauauuaacccaccagaag

SEQ ID NO: 2522201 - RNA, 13 nt, Chlamydophila pneumoniae CWL029
aagaaaucaaaca

SEQ ID NO: 2522202 - RNA, 15 nt, Chlamydophila pneumoniae CWL029
aagaaaucaguccua

SEQ ID NO: 2522203 - RNA, 20 nt, Chlamydophila pneumoniae CWL029
aagaaaucuacucuuuaaaa

SEQ ID NO: 2522204 - RNA, 15 nt, Chlamydophila pneumoniae CWL029
aagaaaucucaguga

SEQ ID NO: 2522205 - RNA, 22 nt, Chlamydophila pneumoniae CWL029
aagaaaugcaaaccaaaaaagu

SEQ ID NO: 2522206 - RNA, 13 nt, Chlamydophila pneumoniae CWL029
aagaacagcagaa

SEQ ID NO: 2522207 - RNA, 17 nt, Chlamydophila pneumoniae CWL029
aagaacccauugaauuu

SEQ ID NO: 2522208 - RNA, 18 nt, Chlamydophila pneumoniae CWL029
aagaacgauaaaauugaa

SEQ ID NO: 2522209 - RNA, 18 nt, Chlamydophila pneumoniae CWL029
aagaacuacuuaaauccu

SEQ ID NO: 2522210 - RNA, 13 nt, Chlamydophila pneumoniae CWL029
aagaacuccuuug

SEQ ID NO: 2522211 - RNA, 22 nt, Chlamydophila pneumoniae CWL029
aagaacuccuuugagucuuuuu

SEQ ID NO: 2522212 - RNA, 19 nt, Chlamydophila pneumoniae CWL029
aagaacuuaaaauucaaau

SEQ ID NO: 2522213 - RNA, 20 nt, Chlamydophila pneumoniae CWL029
aagaacuuaaaauucaaauc

SEQ ID NO: 2522214 - RNA, 17 nt, Chlamydophila pneumoniae CWL029
aagaacuuagcaaugaa

SEQ ID NO: 2522215 - RNA, 15 nt, Chlamydophila pneumoniae CWL029
aagaagaaccucauu

SEQ ID NO: 2522216 - RNA, 15 nt, Chlamydophila pneumoniae CWL029
aagaagaaggacaac

SEQ ID NO: 2522217 - RNA, 15 nt, Chlamydophila pneumoniae CWL029
aagaagagaaaagau

SEQ ID NO: 2522218 - RNA, 21 nt, Chlamydophila pneumoniae CWL029
aagaagaucaaagauuccuaa

SEQ ID NO: 2522219 - RNA, 22 nt, Chlamydophila pneumoniae CWL029
aagaagcucacucuuuaaaaac

SEQ ID NO: 2522220 - RNA, 21 nt, Chlamydophila pneumoniae CWL029
aagaagguuuauuagaaguau

SEQ ID NO: 2522221 - RNA, 14 nt, Chlamydophila pneumoniae CWL029
aagaaguaggaaau

SEQ ID NO: 2522222 - RNA, 22 nt, Chlamydophila pneumoniae CWL029
aagaauaauagcaaguagcucu

SEQ ID NO: 2522223 - RNA, 18 nt, Chlamydophila pneumoniae CWL029
aagaauagcguagaggac

SEQ ID NO: 2522224 - RNA, 17 nt, Chlamydophila pneumoniae CWL029
aagaaucuauaaauuca

SEQ ID NO: 2522225 - RNA, 16 nt, Chlamydophila pneumoniae CWL029
aagaaugacacagaga

SEQ ID NO: 2522226 - RNA, 17 nt, Chlamydophila pneumoniae CWL029
aagaaugagaacgucua

SEQ ID NO: 2522227 - RNA, 17 nt, Chlamydophila pneumoniae CWL029
aagaauguagcuguucc

SEQ ID NO: 2522228 - RNA, 15 nt, Chlamydophila pneumoniae CWL029
aagaauucagagaaa

SEQ ID NO: 2522229 - RNA, 23 nt, Chlamydophila pneumoniae CWL029
aagaauuccuaaaacgagcaggg

SEQ ID NO: 2522230 - RNA, 22 nt, Chlamydophila pneumoniae CWL029
aagaauuuguaacucuuaagaa

SEQ ID NO: 2522231 - RNA, 13 nt, Chlamydophila pneumoniae CWL029
aagacaagagaag

SEQ ID NO: 2522232 - RNA, 16 nt, Chlamydophila pneumoniae CWL029
aagacaauaaaaaaga

SEQ ID NO: 2522233 - RNA, 18 nt, Chlamydophila pneumoniae CWL029
aagacaauaaaaaagaga

SEQ ID NO: 2522234 - RNA, 20 nt, Chlamydophila pneumoniae CWL029
aagacaauggaaauagagaa

SEQ ID NO: 2522235 - RNA, 20 nt, Chlamydophila pneumoniae CWL029
aagacaaugucgucucagaa

SEQ ID NO: 2522236 - RNA, 16 nt, Chlamydophila pneumoniae CWL029
aagacaccgaaagaaa

SEQ ID NO: 2522237 - RNA, 17 nt, Chlamydophila pneumoniae CWL029
aagacaccgaaagaaau

SEQ ID NO: 2522238 - RNA, 19 nt, Chlamydophila pneumoniae CWL029
aagacaggcucaugaaauu

SEQ ID NO: 2522239 - RNA, 22 nt, Chlamydophila pneumoniae CWL029
aagacauccuucuuuaccuaug

SEQ ID NO: 2522240 - RNA, 21 nt, Chlamydophila pneumoniae CWL029
aagacaugagggcaugccuau

SEQ ID NO: 2522241 - RNA, 16 nt, Chlamydophila pneumoniae CWL029
aagaccaccuucccca

SEQ ID NO: 2522242 - RNA, 14 nt, Chlamydophila pneumoniae CWL029
aagacccuucuuuc

SEQ ID NO: 2522243 - RNA, 20 nt, Chlamydophila pneumoniae CWL029
aagacccuucuuuccauaaa

SEQ ID NO: 2522244 - RNA, 20 nt, Chlamydophila pneumoniae CWL029
aagaccuaacgcaacaucca

SEQ ID NO: 2522245 - RNA, 16 nt, Chlamydophila pneumoniae CWL029
aagacgagaacaugac

SEQ ID NO: 2522246 - RNA, 17 nt, Chlamydophila pneumoniae CWL029
aagacgcggaacucucu

SEQ ID NO: 2522247 - RNA, 13 nt, Chlamydophila pneumoniae CWL029
aagacuaaaaaag

SEQ ID NO: 2522248 - RNA, 14 nt, Chlamydophila pneumoniae CWL029
aagacuaaaaaaga

SEQ ID NO: 2522249 - RNA, 15 nt, Chlamydophila pneumoniae CWL029
aagacuaaaaaagag

SEQ ID NO: 2522250 - RNA, 18 nt, Chlamydophila pneumoniae CWL029
aagacuacgacagaagua

SEQ ID NO: 2522251 - RNA, 15 nt, Chlamydophila pneumoniae CWL029
aagacucaaagaacu

SEQ ID NO: 2522252 - RNA, 21 nt, Chlamydophila pneumoniae CWL029
aagacuccaagucagccaaga

SEQ ID NO: 2522253 - RNA, 14 nt, Chlamydophila pneumoniae CWL029
aagacucucaucag

SEQ ID NO: 2522254 - RNA, 16 nt, Chlamydophila pneumoniae CWL029
aagacucucaucagca

SEQ ID NO: 2522255 - RNA, 17 nt, Chlamydophila pneumoniae CWL029
aagacucuugaauauuu

SEQ ID NO: 2522256 - RNA, 16 nt, Chlamydophila pneumoniae CWL029
aagacugaaaagaucg

SEQ ID NO: 2522257 - RNA, 14 nt, Chlamydophila pneumoniae CWL029
aagacugucuauga

SEQ ID NO: 2522258 - RNA, 15 nt, Chlamydophila pneumoniae CWL029
aagacugucuaugau

SEQ ID NO: 2522259 - RNA, 20 nt, Chlamydophila pneumoniae CWL029
aagacuucgaugucuuucca

SEQ ID NO: 2522260 - RNA, 13 nt, Chlamydophila pneumoniae CWL029
aagacuugcucug

SEQ ID NO: 2522261 - RNA, 19 nt, Chlamydophila pneumoniae CWL029
aagacuuguucuucauuau

SEQ ID NO: 2522262 - RNA, 23 nt, Chlamydophila pneumoniae CWL029
aagacuuuuuaguauacuaagac

SEQ ID NO: 2522263 - RNA, 11 nt, Chlamydophila pneumoniae CWL029
aagagaauuau

SEQ ID NO: 2522264 - RNA, 16 nt, Chlamydophila pneumoniae CWL029
aagagaauuauuauua

SEQ ID NO: 2522265 - RNA, 13 nt, Chlamydophila pneumoniae CWL029
aagagagcaagau

SEQ ID NO: 2522266 - RNA, 22 nt, Chlamydophila pneumoniae CWL029
aagagagcuugucacacugcga

SEQ ID NO: 2522267 - RNA, 15 nt, Chlamydophila pneumoniae CWL029
aagagauauagguau

SEQ ID NO: 2522268 - RNA, 17 nt, Chlamydophila pneumoniae CWL029
aagagaucacagggaca

SEQ ID NO: 2522269 - RNA, 23 nt, Chlamydophila pneumoniae CWL029
aagagauugauuucuugcuuuua

SEQ ID NO: 2522270 - RNA, 16 nt, Chlamydophila pneumoniae CWL029
aagagcaaacaucaaa

SEQ ID NO: 2522271 - RNA, 21 nt, Chlamydophila pneumoniae CWL029
aagagcaaacaucaaagagag

SEQ ID NO: 2522272 - RNA, 22 nt, Chlamydophila pneumoniae CWL029
aagagcaagguaacauccauag

SEQ ID NO: 2522273 - RNA, 16 nt, Chlamydophila pneumoniae CWL029
aagagcaucuuuggga

SEQ ID NO: 2522274 - RNA, 14 nt, Chlamydophila pneumoniae CWL029
aagagcgcauuuua

SEQ ID NO: 2522275 - RNA, 15 nt, Chlamydophila pneumoniae CWL029
aagagcuaaagaaac

SEQ ID NO: 2522276 - RNA, 17 nt, Chlamydophila pneumoniae CWL029
aagagcuaaagaaacuu

SEQ ID NO: 2522277 - RNA, 16 nt, Chlamydophila pneumoniae CWL029
aagagcuaugaugaga

SEQ ID NO: 2522278 - RNA, 17 nt, Chlamydophila pneumoniae CWL029
aagagcucguaauccuu

SEQ ID NO: 2522279 - RNA, 22 nt, Chlamydophila pneumoniae CWL029
aagagcucguaauccuucuuuc

SEQ ID NO: 2522280 - RNA, 16 nt, Chlamydophila pneumoniae CWL029
aagagcucuugagaaa

SEQ ID NO: 2522281 - RNA, 18 nt, Chlamydophila pneumoniae CWL029
aagagcucuugagaaagc

SEQ ID NO: 2522282 - RNA, 22 nt, Chlamydophila pneumoniae CWL029
aagagcuuccauuggaauccuu

SEQ ID NO: 2522283 - RNA, 14 nt, Chlamydophila pneumoniae CWL029
aagaggaagaugau

SEQ ID NO: 2522284 - RNA, 17 nt, Chlamydophila pneumoniae CWL029
aagaggaagaugauauu

SEQ ID NO: 2522285 - RNA, 20 nt, Chlamydophila pneumoniae CWL029
aagaggcucccaucgucccu

SEQ ID NO: 2522286 - RNA, 12 nt, Chlamydophila pneumoniae CWL029
aagaggggagcu

SEQ ID NO: 2522287 - RNA, 13 nt, Chlamydophila pneumoniae CWL029
aagaggucgaaga

SEQ ID NO: 2522288 - RNA, 18 nt, Chlamydophila pneumoniae CWL029
aagaguccgaagccuuca

SEQ ID NO: 2522289 - RNA, 15 nt, Chlamydophila pneumoniae CWL029
aagagucuuccuaga

SEQ ID NO: 2522290 - RNA, 12 nt, Chlamydophila pneumoniae CWL029
aagagucuugca

SEQ ID NO: 2522291 - RNA, 13 nt, Chlamydophila pneumoniae CWL029
aagagugccaaga

SEQ ID NO: 2522292 - RNA, 15 nt, Chlamydophila pneumoniae CWL029
aagagugucuaagau

SEQ ID NO: 2522293 - RNA, 20 nt, Chlamydophila pneumoniae CWL029
aagaguuccaagacaauaaa

SEQ ID NO: 2522294 - RNA, 22 nt, Chlamydophila pneumoniae CWL029
aagaguuguuguggaaucacgu

SEQ ID NO: 2522295 - RNA, 16 nt, Chlamydophila pneumoniae CWL029
aagaguuuuuuagagg

SEQ ID NO: 2522296 - RNA, 15 nt, Chlamydophila pneumoniae CWL029
aagauaaacagcaca

SEQ ID NO: 2522297 - RNA, 17 nt, Chlamydophila pneumoniae CWL029
aagauaaacagcacagg

SEQ ID NO: 2522298 - RNA, 13 nt, Chlamydophila pneumoniae CWL029
aagauaaacauac

SEQ ID NO: 2522299 - RNA, 19 nt, Chlamydophila pneumoniae CWL029
aagauaaacauuaagugau

SEQ ID NO: 2522300 - RNA, 12 nt, Chlamydophila pneumoniae CWL029
aagauaaagaag

SEQ ID NO: 2522301 - RNA, 15 nt, Chlamydophila pneumoniae CWL029
aagauaaagaauucu

SEQ ID NO: 2522302 - RNA, 14 nt, Chlamydophila pneumoniae CWL029
aagauaagaccaga

SEQ ID NO: 2522303 - RNA, 20 nt, Chlamydophila pneumoniae CWL029
aagauaaggaccagguguag

SEQ ID NO: 2522304 - RNA, 20 nt, Chlamydophila pneumoniae CWL029
aagauaaucauuaagacuca

SEQ ID NO: 2522305 - RNA, 18 nt, Chlamydophila pneumoniae CWL029
aagauaaucuguaagaaa

SEQ ID NO: 2522306 - RNA, 13 nt, Chlamydophila pneumoniae CWL029
aagauaguauuuu

SEQ ID NO: 2522307 - RNA, 18 nt, Chlamydophila pneumoniae CWL029
aagauauagauucaugaa

SEQ ID NO: 2522308 - RNA, 21 nt, Chlamydophila pneumoniae CWL029
aagauauauuuuuaaagagag

SEQ ID NO: 2522309 - RNA, 12 nt, Chlamydophila pneumoniae CWL029
aagauaucugcu

SEQ ID NO: 2522310 - RNA, 19 nt, Chlamydophila pneumoniae CWL029
aagaucaauauagagaacu

SEQ ID NO: 2522311 - RNA, 23 nt, Chlamydophila pneumoniae CWL029
aagaucaauauagagaacuccau

SEQ ID NO: 2522312 - RNA, 15 nt, Chlamydophila pneumoniae CWL029
aagaucaguuuuuuc

SEQ ID NO: 2522313 - RNA, 22 nt, Chlamydophila pneumoniae CWL029
aagaucauggauucacaucuua

SEQ ID NO: 2522314 - RNA, 23 nt, Chlamydophila pneumoniae CWL029
aagaucgucggaagacuuuuuaa

SEQ ID NO: 2522315 - RNA, 22 nt, Chlamydophila pneumoniae CWL029
aagaucuaacuucaccauauaa

SEQ ID NO: 2522316 - RNA, 14 nt, Chlamydophila pneumoniae CWL029
aagaucuccgaaga

SEQ ID NO: 2522317 - RNA, 18 nt, Chlamydophila pneumoniae CWL029
aagaucuccgaagacuac

SEQ ID NO: 2522318 - RNA, 19 nt, Chlamydophila pneumoniae CWL029
aagaucuccgccuacaaua

SEQ ID NO: 2522319 - RNA, 18 nt, Chlamydophila pneumoniae CWL029
aagaucucuuuuggaaga

SEQ ID NO: 2522320 - RNA, 18 nt, Chlamydophila pneumoniae CWL029
aagaucuugguuaugcua

SEQ ID NO: 2522321 - RNA, 15 nt, Chlamydophila pneumoniae CWL029
aagaugaauaccaga

SEQ ID NO: 2522322 - RNA, 16 nt, Chlamydophila pneumoniae CWL029
aagaugaauaccagaa

SEQ ID NO: 2522323 - RNA, 22 nt, Chlamydophila pneumoniae CWL029
aagaugaauaccagaagcaaag

SEQ ID NO: 2522324 - RNA, 20 nt, Chlamydophila pneumoniae CWL029
aagaugacgagcccuagaua

SEQ ID NO: 2522325 - RNA, 17 nt, Chlamydophila pneumoniae CWL029
aagaugcagauacuaaa

SEQ ID NO: 2522326 - RNA, 22 nt, Chlamydophila pneumoniae CWL029
aagaugcauucugauccgaaaa

SEQ ID NO: 2522327 - RNA, 22 nt, Chlamydophila pneumoniae CWL029
aagaugcugaaccuuugguaga

SEQ ID NO: 2522328 - RNA, 22 nt, Chlamydophila pneumoniae CWL029
aagaugugcucgacguauuugc

SEQ ID NO: 2522329 - RNA, 24 nt, Chlamydophila pneumoniae CWL029
aagauuauuuguuucuuccauaca

SEQ ID NO: 2522330 - RNA, 14 nt, Chlamydophila pneumoniae CWL029
aagauucaaagaag

SEQ ID NO: 2522331 - RNA, 16 nt, Chlamydophila pneumoniae CWL029
aagauucaaagaaguc

SEQ ID NO: 2522332 - RNA, 17 nt, Chlamydophila pneumoniae CWL029
aagauucaaagaagucg

SEQ ID NO: 2522333 - RNA, 11 nt, Chlamydophila pneumoniae CWL029
aagauuccuaa

SEQ ID NO: 2522334 - RNA, 22 nt, Chlamydophila pneumoniae CWL029
aagauucucagcuucaucagaa

SEQ ID NO: 2522335 - RNA, 21 nt, Chlamydophila pneumoniae CWL029
aagauugcagguagauccuau

SEQ ID NO: 2522336 - RNA, 18 nt, Chlamydophila pneumoniae CWL029
aagauugugcucaauaca

SEQ ID NO: 2522337 - RNA, 19 nt, Chlamydophila pneumoniae CWL029
aagauuuauuuugucuuuu

SEQ ID NO: 2522338 - RNA, 23 nt, Chlamydophila pneumoniae CWL029
aagauuuccaauccauucugaga

SEQ ID NO: 2522339 - RNA, 15 nt, Chlamydophila pneumoniae CWL029
aagauuuccccaaga

SEQ ID NO: 2522340 - RNA, 20 nt, Chlamydophila pneumoniae CWL029
aagauuuuaggggguuuuuc

SEQ ID NO: 2522341 - RNA, 23 nt, Chlamydophila pneumoniae CWL029
aagauuuuaggggguuuuucuau

SEQ ID NO: 2522342 - RNA, 21 nt, Chlamydophila pneumoniae CWL029
aagauuuuggugagaucaucu

SEQ ID NO: 2522343 - RNA, 18 nt, Chlamydophila pneumoniae CWL029
aagauuuuguaggaacau

SEQ ID NO: 2522344 - RNA, 13 nt, Chlamydophila pneumoniae CWL029
aagcaaaaacuuu

SEQ ID NO: 2522345 - RNA, 13 nt, Chlamydophila pneumoniae CWL029
aagcaaaagcaag

SEQ ID NO: 2522346 - RNA, 15 nt, Chlamydophila pneumoniae CWL029
aagcaaggaaaaaaa

SEQ ID NO: 2522347 - RNA, 22 nt, Chlamydophila pneumoniae CWL029
aagcaaggaaaaaaaaucugcu

SEQ ID NO: 2522348 - RNA, 20 nt, Chlamydophila pneumoniae CWL029
aagcaauaucuauagaaggc

SEQ ID NO: 2522349 - RNA, 13 nt, Chlamydophila pneumoniae CWL029
aagcaauaucugu

SEQ ID NO: 2522350 - RNA, 15 nt, Chlamydophila pneumoniae CWL029
aagcaauauuucugu

SEQ ID NO: 2522351 - RNA, 21 nt, Chlamydophila pneumoniae CWL029
aagcaaucccccagcauucac

SEQ ID NO: 2522352 - RNA, 22 nt, Chlamydophila pneumoniae CWL029
aagcaaucccccagcauucacu

SEQ ID NO: 2522353 - RNA, 13 nt, Chlamydophila pneumoniae CWL029
aagcaauuucucc

SEQ ID NO: 2522354 - RNA, 22 nt, Chlamydophila pneumoniae CWL029
aagcacauacaguacgcaaagu

SEQ ID NO: 2522355 - RNA, 17 nt, Chlamydophila pneumoniae CWL029
aagcaccacgaccuaua

SEQ ID NO: 2522356 - RNA, 18 nt, Chlamydophila pneumoniae CWL029
aagcacccucuucauccg

SEQ ID NO: 2522357 - RNA, 20 nt, Chlamydophila pneumoniae CWL029
aagcacccucuucauccgaa

SEQ ID NO: 2522358 - RNA, 21 nt, Chlamydophila pneumoniae CWL029
aagcacuaaaagggaagcuuc

SEQ ID NO: 2522359 - RNA, 22 nt, Chlamydophila pneumoniae CWL029
aagcacucuuaauuaaaaacug

SEQ ID NO: 2522360 - RNA, 14 nt, Chlamydophila pneumoniae CWL029
aagcacuuaaaaaa

SEQ ID NO: 2522361 - RNA, 19 nt, Chlamydophila pneumoniae CWL029
aagcacuuguuuuuucuuc

SEQ ID NO: 2522362 - RNA, 20 nt, Chlamydophila pneumoniae CWL029
aagcacuuguuuuuucuucu

SEQ ID NO: 2522363 - RNA, 13 nt, Chlamydophila pneumoniae CWL029
aagcagaaacuuu

SEQ ID NO: 2522364 - RNA, 19 nt, Chlamydophila pneumoniae CWL029
aagcagaaacuuuaaaagc

SEQ ID NO: 2522365 - RNA, 18 nt, Chlamydophila pneumoniae CWL029
aagcagaggguuccaaga

SEQ ID NO: 2522366 - RNA, 18 nt, Chlamydophila pneumoniae CWL029
aagcagauccugcuucua

SEQ ID NO: 2522367 - RNA, 13 nt, Chlamydophila pneumoniae CWL029
aagcagcgaagau

SEQ ID NO: 2522368 - RNA, 12 nt, Chlamydophila pneumoniae CWL029
aagcaggagcau

SEQ ID NO: 2522369 - RNA, 12 nt, Chlamydophila pneumoniae CWL029
aagcagggaaaa

SEQ ID NO: 2522370 - RNA, 21 nt, Chlamydophila pneumoniae CWL029
aagcaggugugugguaaaaau

SEQ ID NO: 2522371 - RNA, 20 nt, Chlamydophila pneumoniae CWL029
aagcaguaacugcaaagaga

SEQ ID NO: 2522372 - RNA, 13 nt, Chlamydophila pneumoniae CWL029
aagcauagcccga

SEQ ID NO: 2522373 - RNA, 22 nt, Chlamydophila pneumoniae CWL029
aagcauagucgucuuuuaaaga

SEQ ID NO: 2522374 - RNA, 17 nt, Chlamydophila pneumoniae CWL029
aagcauauuuaaauaua

SEQ ID NO: 2522375 - RNA, 15 nt, Chlamydophila pneumoniae CWL029
aagcaucauugaaac

SEQ ID NO: 2522376 - RNA, 21 nt, Chlamydophila pneumoniae CWL029
aagcauguuauauagacaaug

SEQ ID NO: 2522377 - RNA, 18 nt, Chlamydophila pneumoniae CWL029
aagcauucugcuagagcu

SEQ ID NO: 2522378 - RNA, 19 nt, Chlamydophila pneumoniae CWL029
aagcauucugcuagagcuu

SEQ ID NO: 2522379 - RNA, 20 nt, Chlamydophila pneumoniae CWL029
aagcauucugcuagagcuuu

SEQ ID NO: 2522380 - RNA, 21 nt, Chlamydophila pneumoniae CWL029
aagcauuuuugggaaaagaaa

SEQ ID NO: 2522381 - RNA, 23 nt, Chlamydophila pneumoniae CWL029
aagcauuuuugggaaaagaaaag

SEQ ID NO: 2522382 - RNA, 15 nt, Chlamydophila pneumoniae CWL029
aagccaaaaggcaca

SEQ ID NO: 2522383 - RNA, 14 nt, Chlamydophila pneumoniae CWL029
aagccaaauaccaa

SEQ ID NO: 2522384 - RNA, 15 nt, Chlamydophila pneumoniae CWL029
aagccaagaagaugu

SEQ ID NO: 2522385 - RNA, 15 nt, Chlamydophila pneumoniae CWL029
aagccaguacuaaau

SEQ ID NO: 2522386 - RNA, 18 nt, Chlamydophila pneumoniae CWL029
aagccagucuucauaaga

SEQ ID NO: 2522387 - RNA, 20 nt, Chlamydophila pneumoniae CWL029
aagccaugcaaugaaggcgu

SEQ ID NO: 2522388 - RNA, 15 nt, Chlamydophila pneumoniae CWL029
aagccauuccauauc

SEQ ID NO: 2522389 - RNA, 21 nt, Chlamydophila pneumoniae CWL029
aagccauuugguaguuuuuca

SEQ ID NO: 2522390 - RNA, 14 nt, Chlamydophila pneumoniae CWL029
aagccauuuucuaa

SEQ ID NO: 2522391 - RNA, 23 nt, Chlamydophila pneumoniae CWL029
aagccauuuucuaagagaucuac

SEQ ID NO: 2522392 - RNA, 20 nt, Chlamydophila pneumoniae CWL029
aagccccacccacuccagaa

SEQ ID NO: 2522393 - RNA, 15 nt, Chlamydophila pneumoniae CWL029
aagcccccuccccca

SEQ ID NO: 2522394 - RNA, 16 nt, Chlamydophila pneumoniae CWL029
aagccgauacccaucu

SEQ ID NO: 2522395 - RNA, 18 nt, Chlamydophila pneumoniae CWL029
aagccggcccacucaaaa

SEQ ID NO: 2522396 - RNA, 22 nt, Chlamydophila pneumoniae CWL029
aagccggcccacucaaaagaag

SEQ ID NO: 2522397 - RNA, 22 nt, Chlamydophila pneumoniae CWL029
aagccguguaccucucaucaaa

SEQ ID NO: 2522398 - RNA, 17 nt, Chlamydophila pneumoniae CWL029
aagccucgaaauuuuca

SEQ ID NO: 2522399 - RNA, 18 nt, Chlamydophila pneumoniae CWL029
aagccugucuuaucuaaa

SEQ ID NO: 2522400 - RNA, 23 nt, Chlamydophila pneumoniae CWL029
aagccugucuuaucuaaagaaau

SEQ ID NO: 2522401 - RNA, 13 nt, Chlamydophila pneumoniae CWL029
aagccuucauucc

SEQ ID NO: 2522402 - RNA, 13 nt, Chlamydophila pneumoniae CWL029
aagccuuccuugu

SEQ ID NO: 2522403 - RNA, 18 nt, Chlamydophila pneumoniae CWL029
aagccuuccuuguuguau

SEQ ID NO: 2522404 - RNA, 14 nt, Chlamydophila pneumoniae CWL029
aagccuuucuuauu

SEQ ID NO: 2522405 - RNA, 18 nt, Chlamydophila pneumoniae CWL029
aagcgauguuccuuuuuu

SEQ ID NO: 2522406 - RNA, 19 nt, Chlamydophila pneumoniae CWL029
aagcgauuucgacagcagc

SEQ ID NO: 2522407 - RNA, 15 nt, Chlamydophila pneumoniae CWL029
aagcgccgcauuaca

SEQ ID NO: 2522408 - RNA, 12 nt, Chlamydophila pneumoniae CWL029
aagcgcucuaca

SEQ ID NO: 2522409 - RNA, 14 nt, Chlamydophila pneumoniae CWL029
aagcggagcaucuu

SEQ ID NO: 2522410 - RNA, 16 nt, Chlamydophila pneumoniae CWL029
aagcggagcaucuuuu

SEQ ID NO: 2522411 - RNA, 17 nt, Chlamydophila pneumoniae CWL029
aagcguuaacaacuucu

SEQ ID NO: 2522412 - RNA, 19 nt, Chlamydophila pneumoniae CWL029
aagcguuucgacgagaagg

SEQ ID NO: 2522413 - RNA, 15 nt, Chlamydophila pneumoniae CWL029
aagcuaaaaaauuuu

SEQ ID NO: 2522414 - RNA, 17 nt, Chlamydophila pneumoniae CWL029
aagcuaacaccucuuca

SEQ ID NO: 2522415 - RNA, 20 nt, Chlamydophila pneumoniae CWL029
aagcuaauaagauccaaaaa

SEQ ID NO: 2522416 - RNA, 16 nt, Chlamydophila pneumoniae CWL029
aagcuagucuucuuag

SEQ ID NO: 2522417 - RNA, 23 nt, Chlamydophila pneumoniae CWL029
aagcuauagauuuuggagacaca

SEQ ID NO: 2522418 - RNA, 18 nt, Chlamydophila pneumoniae CWL029
aagcucaagagcaugcuu

SEQ ID NO: 2522419 - RNA, 14 nt, Chlamydophila pneumoniae CWL029
aagcucauaagaaa

SEQ ID NO: 2522420 - RNA, 12 nt, Chlamydophila pneumoniae CWL029
aagcucaucagc

SEQ ID NO: 2522421 - RNA, 22 nt, Chlamydophila pneumoniae CWL029
aagcucccaacaagggaaagaa

SEQ ID NO: 2522422 - RNA, 16 nt, Chlamydophila pneumoniae CWL029
aagcucgaccucuagc

SEQ ID NO: 2522423 - RNA, 19 nt, Chlamydophila pneumoniae CWL029
aagcucgaccucuagcuca

SEQ ID NO: 2522424 - RNA, 17 nt, Chlamydophila pneumoniae CWL029
aagcucgcguauuuucg

SEQ ID NO: 2522425 - RNA, 16 nt, Chlamydophila pneumoniae CWL029
aagcucguacuguucc

SEQ ID NO: 2522426 - RNA, 15 nt, Chlamydophila pneumoniae CWL029
aagcucuacaagcuc

SEQ ID NO: 2522427 - RNA, 14 nt, Chlamydophila pneumoniae CWL029
aagcucuccuucag

SEQ ID NO: 2522428 - RNA, 14 nt, Chlamydophila pneumoniae CWL029
aagcucuuaauuuc

SEQ ID NO: 2522429 - RNA, 22 nt, Chlamydophila pneumoniae CWL029
aagcugagaauacaacccuuua

SEQ ID NO: 2522430 - RNA, 22 nt, Chlamydophila pneumoniae CWL029
aagcugagguagcaucucucuc

SEQ ID NO: 2522431 - RNA, 17 nt, Chlamydophila pneumoniae CWL029
aagcugcaaacugaucu

SEQ ID NO: 2522432 - RNA, 14 nt, Chlamydophila pneumoniae CWL029
aagcugcuuuuucu

SEQ ID NO: 2522433 - RNA, 16 nt, Chlamydophila pneumoniae CWL029
aagcugcuuuuucuac

SEQ ID NO: 2522434 - RNA, 19 nt, Chlamydophila pneumoniae CWL029
aagcuggauucugucuaua

SEQ ID NO: 2522435 - RNA, 20 nt, Chlamydophila pneumoniae CWL029
aagcuguaaccaacaucaaa

SEQ ID NO: 2522436 - RNA, 14 nt, Chlamydophila pneumoniae CWL029
aagcuguacuugau

SEQ ID NO: 2522437 - RNA, 19 nt, Chlamydophila pneumoniae CWL029
aagcuguauugggaaugga

SEQ ID NO: 2522438 - RNA, 17 nt, Chlamydophila pneumoniae CWL029
aagcugucgcaaaugca

SEQ ID NO: 2522439 - RNA, 21 nt, Chlamydophila pneumoniae CWL029
aagcugucguccuaauuuucc

SEQ ID NO: 2522440 - RNA, 11 nt, Chlamydophila pneumoniae CWL029
aagcugugcau

SEQ ID NO: 2522441 - RNA, 19 nt, Chlamydophila pneumoniae CWL029
aagcugugcauuuucuucu

SEQ ID NO: 2522442 - RNA, 19 nt, Chlamydophila pneumoniae CWL029
aagcuuaucccauaaaugu

SEQ ID NO: 2522443 - RNA, 15 nt, Chlamydophila pneumoniae CWL029
aagcuucaaugaugu

SEQ ID NO: 2522444 - RNA, 17 nt, Chlamydophila pneumoniae CWL029
aagcuucaucaaaacau

SEQ ID NO: 2522445 - RNA, 20 nt, Chlamydophila pneumoniae CWL029
aagcuuccaucguuagauuu

SEQ ID NO: 2522446 - RNA, 23 nt, Chlamydophila pneumoniae CWL029
aagcuuccggcuuguaggaucug

SEQ ID NO: 2522447 - RNA, 21 nt, Chlamydophila pneumoniae CWL029
aagcuucguccugacacaacu

SEQ ID NO: 2522448 - RNA, 22 nt, Chlamydophila pneumoniae CWL029
aagcuucguccugacacaacuc

SEQ ID NO: 2522449 - RNA, 14 nt, Chlamydophila pneumoniae CWL029
aagcuucuucugcg

SEQ ID NO: 2522450 - RNA, 17 nt, Chlamydophila pneumoniae CWL029
aagcuucuuuaauucca

SEQ ID NO: 2522451 - RNA, 18 nt, Chlamydophila pneumoniae CWL029
aagcuucuuuaauuccaa

SEQ ID NO: 2522452 - RNA, 20 nt, Chlamydophila pneumoniae CWL029
aagcuucuuuaauuccaacu

SEQ ID NO: 2522453 - RNA, 15 nt, Chlamydophila pneumoniae CWL029
aagcuugccagcaga

SEQ ID NO: 2522454 - RNA, 17 nt, Chlamydophila pneumoniae CWL029
aagcuuuuaauguguuc

SEQ ID NO: 2522455 - RNA, 23 nt, Chlamydophila pneumoniae CWL029
aagcuuuucuuccaaagacugag

SEQ ID NO: 2522456 - RNA, 14 nt, Chlamydophila pneumoniae CWL029
aagcuuuuuucucu

SEQ ID NO: 2522457 - RNA, 14 nt, Chlamydophila pneumoniae CWL029
aaggaaaaacaaac

SEQ ID NO: 2522458 - RNA, 14 nt, Chlamydophila pneumoniae CWL029
aaggaacugugcca

SEQ ID NO: 2522459 - RNA, 18 nt, Chlamydophila pneumoniae CWL029
aaggaagaagaagaagga

SEQ ID NO: 2522460 - RNA, 21 nt, Chlamydophila pneumoniae CWL029
aaggaauaugcucuccuugua

SEQ ID NO: 2522461 - RNA, 18 nt, Chlamydophila pneumoniae CWL029
aaggaaucccaagggaga

SEQ ID NO: 2522462 - RNA, 15 nt, Chlamydophila pneumoniae CWL029
aaggacaaaucuccc

SEQ ID NO: 2522463 - RNA, 16 nt, Chlamydophila pneumoniae CWL029
aaggacaaaucuccca

SEQ ID NO: 2522464 - RNA, 16 nt, Chlamydophila pneumoniae CWL029
aaggacaaucaacauu

SEQ ID NO: 2522465 - RNA, 13 nt, Chlamydophila pneumoniae CWL029
aaggacauagacu

SEQ ID NO: 2522466 - RNA, 21 nt, Chlamydophila pneumoniae CWL029
aaggaccuccucacauguuuc

SEQ ID NO: 2522467 - RNA, 14 nt, Chlamydophila pneumoniae CWL029
aaggacucuuucua

SEQ ID NO: 2522468 - RNA, 14 nt, Chlamydophila pneumoniae CWL029
aaggagagcuucuu

SEQ ID NO: 2522469 - RNA, 16 nt, Chlamydophila pneumoniae CWL029
aaggagguccuuggca

SEQ ID NO: 2522470 - RNA, 18 nt, Chlamydophila pneumoniae CWL029
aaggagucgugcaggaga

SEQ ID NO: 2522471 - RNA, 21 nt, Chlamydophila pneumoniae CWL029
aaggauaucaugcaauacuuu

SEQ ID NO: 2522472 - RNA, 23 nt, Chlamydophila pneumoniae CWL029
aaggaucccaucaucgagcugau

SEQ ID NO: 2522473 - RNA, 12 nt, Chlamydophila pneumoniae CWL029
aaggaucugaua

SEQ ID NO: 2522474 - RNA, 18 nt, Chlamydophila pneumoniae CWL029
aaggaucugauagaacag

SEQ ID NO: 2522475 - RNA, 16 nt, Chlamydophila pneumoniae CWL029
aaggauuggaugagaa

SEQ ID NO: 2522476 - RNA, 14 nt, Chlamydophila pneumoniae CWL029
aaggcaaaaaguug

SEQ ID NO: 2522477 - RNA, 23 nt, Chlamydophila pneumoniae CWL029
aaggcaaaaaguugaggaaagga

SEQ ID NO: 2522478 - RNA, 15 nt, Chlamydophila pneumoniae CWL029
aaggcaccaacacuu

SEQ ID NO: 2522479 - RNA, 16 nt, Chlamydophila pneumoniae CWL029
aaggcaccaacacuuu

SEQ ID NO: 2522480 - RNA, 22 nt, Chlamydophila pneumoniae CWL029
aaggcagagaacuuucgucuuu

SEQ ID NO: 2522481 - RNA, 19 nt, Chlamydophila pneumoniae CWL029
aaggcccccuacagcagaa

SEQ ID NO: 2522482 - RNA, 14 nt, Chlamydophila pneumoniae CWL029
aaggccuauagauu

SEQ ID NO: 2522483 - RNA, 21 nt, Chlamydophila pneumoniae CWL029
aaggcgaaaucuucaccacaa

SEQ ID NO: 2522484 - RNA, 17 nt, Chlamydophila pneumoniae CWL029
aaggcugauugaaaguc

SEQ ID NO: 2522485 - RNA, 14 nt, Chlamydophila pneumoniae CWL029
aaggcugcuugaga

SEQ ID NO: 2522486 - RNA, 19 nt, Chlamydophila pneumoniae CWL029
aaggcuuguuucuguuuuc

SEQ ID NO: 2522487 - RNA, 13 nt, Chlamydophila pneumoniae CWL029
aaggcuuugccuu

SEQ ID NO: 2522488 - RNA, 23 nt, Chlamydophila pneumoniae CWL029
aaggcuuuucuuuuucuagggau

SEQ ID NO: 2522489 - RNA, 14 nt, Chlamydophila pneumoniae CWL029
aagggaagagaaaa

SEQ ID NO: 2522490 - RNA, 18 nt, Chlamydophila pneumoniae CWL029
aagggacuuguuguuuca

SEQ ID NO: 2522491 - RNA, 13 nt, Chlamydophila pneumoniae CWL029
aagggaggagaac

SEQ ID NO: 2522492 - RNA, 15 nt, Chlamydophila pneumoniae CWL029
aagggaucuccuuca

SEQ ID NO: 2522493 - RNA, 20 nt, Chlamydophila pneumoniae CWL029
aagggaugcucuagaaaacg

SEQ ID NO: 2522494 - RNA, 23 nt, Chlamydophila pneumoniae CWL029
aagggaugggaucggucuuuucu

SEQ ID NO: 2522495 - RNA, 22 nt, Chlamydophila pneumoniae CWL029
aagggauguuuaauacaaaaaa

SEQ ID NO: 2522496 - RNA, 17 nt, Chlamydophila pneumoniae CWL029
aaggggcguucuugaaa

SEQ ID NO: 2522497 - RNA, 16 nt, Chlamydophila pneumoniae CWL029
aagguaaaacuacagg

SEQ ID NO: 2522498 - RNA, 17 nt, Chlamydophila pneumoniae CWL029
aagguaaauuuuuaaaa

SEQ ID NO: 2522499 - RNA, 22 nt, Chlamydophila pneumoniae CWL029
aagguacugcucaaugacacgg

SEQ ID NO: 2522500 - RNA, 16 nt, Chlamydophila pneumoniae CWL029
aagguagcuagcguuu

SEQ ID NO: 2522501 - RNA, 20 nt, Chlamydophila pneumoniae CWL029
aagguaguuuucuucuuuaa

SEQ ID NO: 2522502 - RNA, 16 nt, Chlamydophila pneumoniae CWL029
aagguauuaggaagua

SEQ ID NO: 2522503 - RNA, 16 nt, Chlamydophila pneumoniae CWL029
aagguauuucucucca

SEQ ID NO: 2522504 - RNA, 18 nt, Chlamydophila pneumoniae CWL029
aagguauuucucuccaca

SEQ ID NO: 2522505 - RNA, 19 nt, Chlamydophila pneumoniae CWL029
aagguauuucucuccacag

SEQ ID NO: 2522506 - RNA, 14 nt, Chlamydophila pneumoniae CWL029
aaggucacagcauu

SEQ ID NO: 2522507 - RNA, 17 nt, Chlamydophila pneumoniae CWL029
aaggucacagcauuuuc

SEQ ID NO: 2522508 - RNA, 20 nt, Chlamydophila pneumoniae CWL029
aagguccaugucuaaagauu

SEQ ID NO: 2522509 - RNA, 16 nt, Chlamydophila pneumoniae CWL029
aaggucugcgucuuua

SEQ ID NO: 2522510 - RNA, 22 nt, Chlamydophila pneumoniae CWL029
aaggucugcgucuuuaauuaaa

SEQ ID NO: 2522511 - RNA, 19 nt, Chlamydophila pneumoniae CWL029
aagguuacaccuaaaguuu

SEQ ID NO: 2522512 - RNA, 22 nt, Chlamydophila pneumoniae CWL029
aagguugcuaagaucuuuagaa

SEQ ID NO: 2522513 - RNA, 17 nt, Chlamydophila pneumoniae CWL029
aagguuuccaugagaau

SEQ ID NO: 2522514 - RNA, 15 nt, Chlamydophila pneumoniae CWL029
aagguuuugaagcuc

SEQ ID NO: 2522515 - RNA, 15 nt, Chlamydophila pneumoniae CWL029
aaguaaagaaauucu

SEQ ID NO: 2522516 - RNA, 21 nt, Chlamydophila pneumoniae CWL029
aaguaaaucagacuuaaagua

SEQ ID NO: 2522517 - RNA, 14 nt, Chlamydophila pneumoniae CWL029
aaguaacgauaaga

SEQ ID NO: 2522518 - RNA, 17 nt, Chlamydophila pneumoniae CWL029
aaguaagguuccaaaaa

SEQ ID NO: 2522519 - RNA, 18 nt, Chlamydophila pneumoniae CWL029
aaguaaucaugauaaaaa

SEQ ID NO: 2522520 - RNA, 21 nt, Chlamydophila pneumoniae CWL029
aaguacaagugaagacaagua

SEQ ID NO: 2522521 - RNA, 15 nt, Chlamydophila pneumoniae CWL029
aaguacacauugucu

SEQ ID NO: 2522522 - RNA, 20 nt, Chlamydophila pneumoniae CWL029
aaguaccuucucgucauucu

SEQ ID NO: 2522523 - RNA, 19 nt, Chlamydophila pneumoniae CWL029
aaguacgaccaacuccuca

SEQ ID NO: 2522524 - RNA, 22 nt, Chlamydophila pneumoniae CWL029
aaguacgcaguaucguaacuuc

SEQ ID NO: 2522525 - RNA, 15 nt, Chlamydophila pneumoniae CWL029
aaguaggauugauaa

SEQ ID NO: 2522526 - RNA, 22 nt, Chlamydophila pneumoniae CWL029
aaguaggauugauaaauuugcu

SEQ ID NO: 2522527 - RNA, 18 nt, Chlamydophila pneumoniae CWL029
aaguagggaacaaaaaag

SEQ ID NO: 2522528 - RNA, 17 nt, Chlamydophila pneumoniae CWL029
aaguauauauuuuacaa

SEQ ID NO: 2522529 - RNA, 23 nt, Chlamydophila pneumoniae CWL029
aaguauauauuuuacaaugaagu

SEQ ID NO: 2522530 - RNA, 16 nt, Chlamydophila pneumoniae CWL029
aaguaucucaucacgu

SEQ ID NO: 2522531 - RNA, 21 nt, Chlamydophila pneumoniae CWL029
aaguauuccucuuaggagagc

SEQ ID NO: 2522532 - RNA, 23 nt, Chlamydophila pneumoniae CWL029
aagucaaacaucacucaggauau

SEQ ID NO: 2522533 - RNA, 18 nt, Chlamydophila pneumoniae CWL029
aagucaaauacuucuccu

SEQ ID NO: 2522534 - RNA, 14 nt, Chlamydophila pneumoniae CWL029
aagucacaaauuuu

SEQ ID NO: 2522535 - RNA, 16 nt, Chlamydophila pneumoniae CWL029
aagucacaaauuuuug

SEQ ID NO: 2522536 - RNA, 17 nt, Chlamydophila pneumoniae CWL029
aagucaccuuacaucca

SEQ ID NO: 2522537 - RNA, 23 nt, Chlamydophila pneumoniae CWL029
aagucacggcgaaagcuacagcu

SEQ ID NO: 2522538 - RNA, 21 nt, Chlamydophila pneumoniae CWL029
aagucacucaaacccucucca

SEQ ID NO: 2522539 - RNA, 21 nt, Chlamydophila pneumoniae CWL029
aagucagccaagacaaaaaag

SEQ ID NO: 2522540 - RNA, 13 nt, Chlamydophila pneumoniae CWL029
aagucaugaggac

SEQ ID NO: 2522541 - RNA, 16 nt, Chlamydophila pneumoniae CWL029
aaguccaacaucagcu

SEQ ID NO: 2522542 - RNA, 16 nt, Chlamydophila pneumoniae CWL029
aaguccagacuuuccu

SEQ ID NO: 2522543 - RNA, 17 nt, Chlamydophila pneumoniae CWL029
aaguccagacuuuccuc

SEQ ID NO: 2522544 - RNA, 17 nt, Chlamydophila pneumoniae CWL029
aagucgaaucuaaaaac

SEQ ID NO: 2522545 - RNA, 19 nt, Chlamydophila pneumoniae CWL029
aagucgauacccaaagagg

SEQ ID NO: 2522546 - RNA, 13 nt, Chlamydophila pneumoniae CWL029
aagucuccauaau

SEQ ID NO: 2522547 - RNA, 17 nt, Chlamydophila pneumoniae CWL029
aagucuccauaauucug

SEQ ID NO: 2522548 - RNA, 21 nt, Chlamydophila pneumoniae CWL029
aagucuucaaugacuucugga

SEQ ID NO: 2522549 - RNA, 19 nt, Chlamydophila pneumoniae CWL029
aagucuucccucuccuuga

SEQ ID NO: 2522550 - RNA, 22 nt, Chlamydophila pneumoniae CWL029
aagucuuggacguuccuuucuc

SEQ ID NO: 2522551 - RNA, 15 nt, Chlamydophila pneumoniae CWL029
aagugacuuccucca

SEQ ID NO: 2522552 - RNA, 16 nt, Chlamydophila pneumoniae CWL029
aagugacuuccuccaa

SEQ ID NO: 2522553 - RNA, 20 nt, Chlamydophila pneumoniae CWL029
aagugacuuccuccaaaauu

SEQ ID NO: 2522554 - RNA, 19 nt, Chlamydophila pneumoniae CWL029
aagugaggagaauagcaag

SEQ ID NO: 2522555 - RNA, 14 nt, Chlamydophila pneumoniae CWL029
aagugaucagaaau

SEQ ID NO: 2522556 - RNA, 22 nt, Chlamydophila pneumoniae CWL029
aagugcgagguaugaauaggaa

SEQ ID NO: 2522557 - RNA, 16 nt, Chlamydophila pneumoniae CWL029
aagugcucaguaaaua

SEQ ID NO: 2522558 - RNA, 20 nt, Chlamydophila pneumoniae CWL029
aagugcuuucaggaguucuu

SEQ ID NO: 2522559 - RNA, 15 nt, Chlamydophila pneumoniae CWL029
aaguguauuuaaauu

SEQ ID NO: 2522560 - RNA, 18 nt, Chlamydophila pneumoniae CWL029
aaguguguaaauguuuug

SEQ ID NO: 2522561 - RNA, 14 nt, Chlamydophila pneumoniae CWL029
aaguuacuuucuga

SEQ ID NO: 2522562 - RNA, 20 nt, Chlamydophila pneumoniae CWL029
aaguuagcuaacucggaaaa

SEQ ID NO: 2522563 - RNA, 16 nt, Chlamydophila pneumoniae CWL029
aaguuagguagauaga

SEQ ID NO: 2522564 - RNA, 22 nt, Chlamydophila pneumoniae CWL029
aaguuauacggccgacucuaca

SEQ ID NO: 2522565 - RNA, 13 nt, Chlamydophila pneumoniae CWL029
aaguucaguaaaa

SEQ ID NO: 2522566 - RNA, 15 nt, Chlamydophila pneumoniae CWL029
aaguucaucaaauaa

SEQ ID NO: 2522567 - RNA, 17 nt, Chlamydophila pneumoniae CWL029
aaguuccaaaucucaau

SEQ ID NO: 2522568 - RNA, 18 nt, Chlamydophila pneumoniae CWL029
aaguuccauagaguaucu

SEQ ID NO: 2522569 - RNA, 19 nt, Chlamydophila pneumoniae CWL029
aaguucggcgccuucaaaa

SEQ ID NO: 2522570 - RNA, 21 nt, Chlamydophila pneumoniae CWL029
aaguucgggucgauguucucg

SEQ ID NO: 2522571 - RNA, 17 nt, Chlamydophila pneumoniae CWL029
aaguucuuggaaaaaag

SEQ ID NO: 2522572 - RNA, 16 nt, Chlamydophila pneumoniae CWL029
aaguugaccuuuuuca

SEQ ID NO: 2522573 - RNA, 17 nt, Chlamydophila pneumoniae CWL029
aaguugaccuuuuucau

SEQ ID NO: 2522574 - RNA, 15 nt, Chlamydophila pneumoniae CWL029
aaguugaguugcgua

SEQ ID NO: 2522575 - RNA, 15 nt, Chlamydophila pneumoniae CWL029
aaguugauacuugua

SEQ ID NO: 2522576 - RNA, 17 nt, Chlamydophila pneumoniae CWL029
aaguuguagugaaugag

SEQ ID NO: 2522577 - RNA, 17 nt, Chlamydophila pneumoniae CWL029
aaguuguugauaauuac

SEQ ID NO: 2522578 - RNA, 14 nt, Chlamydophila pneumoniae CWL029
aaguuuaggcagga

SEQ ID NO: 2522579 - RNA, 16 nt, Chlamydophila pneumoniae CWL029
aaguuucaaucucucc

SEQ ID NO: 2522580 - RNA, 19 nt, Chlamydophila pneumoniae CWL029
aaguuugauaagcuaacac

SEQ ID NO: 2522581 - RNA, 15 nt, Chlamydophila pneumoniae CWL029
aaguuuguauuuucu

SEQ ID NO: 2522582 - RNA, 19 nt, Chlamydophila pneumoniae CWL029
aaguuugucguaauugcug

SEQ ID NO: 2522583 - RNA, 23 nt, Chlamydophila pneumoniae CWL029
aaguuuugaggauuucuugcaag

SEQ ID NO: 2522584 - RNA, 12 nt, Chlamydophila pneumoniae CWL029
aaguuuugcucu

SEQ ID NO: 2522585 - RNA, 22 nt, Chlamydophila pneumoniae CWL029
aaguuuugguuuuagaaauguu

SEQ ID NO: 2522586 - RNA, 21 nt, Chlamydophila pneumoniae CWL029
aaguuuuuuaagugcuuuuag

SEQ ID NO: 2522587 - RNA, 16 nt, Chlamydophila pneumoniae CWL029
aaguuuuuuauuuucu

SEQ ID NO: 2522588 - RNA, 16 nt, Chlamydophila pneumoniae CWL029
aaguuuuuucaauccu

SEQ ID NO: 2522589 - RNA, 20 nt, Chlamydophila pneumoniae CWL029
aaguuuuuucucucuuuauc

SEQ ID NO: 2522590 - RNA, 22 nt, Chlamydophila pneumoniae CWL029
aauaaaaaaacccucaaagaau

SEQ ID NO: 2522591 - RNA, 16 nt, Chlamydophila pneumoniae CWL029
aauaaaacuuucuuuu

SEQ ID NO: 2522592 - RNA, 12 nt, Chlamydophila pneumoniae CWL029
aauaaaagaaag

SEQ ID NO: 2522593 - RNA, 13 nt, Chlamydophila pneumoniae CWL029
aauaaaagcaccc

SEQ ID NO: 2522594 - RNA, 12 nt, Chlamydophila pneumoniae CWL029
aauaaaaugauu

SEQ ID NO: 2522595 - RNA, 12 nt, Chlamydophila pneumoniae CWL029
aauaaaauuuaa

SEQ ID NO: 2522596 - RNA, 15 nt, Chlamydophila pneumoniae CWL029
aauaaaauuuaaaaa

SEQ ID NO: 2522597 - RNA, 15 nt, Chlamydophila pneumoniae CWL029
aauaaacaucaugau

SEQ ID NO: 2522598 - RNA, 15 nt, Chlamydophila pneumoniae CWL029
aauaaaccacgaauu

SEQ ID NO: 2522599 - RNA, 20 nt, Chlamydophila pneumoniae CWL029
aauaaacugacguuuuuccc

SEQ ID NO: 2522600 - RNA, 14 nt, Chlamydophila pneumoniae CWL029
aauaaaguccucca

SEQ ID NO: 2522601 - RNA, 16 nt, Chlamydophila pneumoniae CWL029
aauaaauccaaaaaau

SEQ ID NO: 2522602 - RNA, 13 nt, Chlamydophila pneumoniae CWL029
aauaaauuuaucu

SEQ ID NO: 2522603 - RNA, 17 nt, Chlamydophila pneumoniae CWL029
aauaacaccaaaagaau

SEQ ID NO: 2522604 - RNA, 13 nt, Chlamydophila pneumoniae CWL029
aauaaccagaaga

SEQ ID NO: 2522605 - RNA, 13 nt, Chlamydophila pneumoniae CWL029
aauaagauccaaa

SEQ ID NO: 2522606 - RNA, 17 nt, Chlamydophila pneumoniae CWL029
aauaagauccaaaaauu

SEQ ID NO: 2522607 - RNA, 15 nt, Chlamydophila pneumoniae CWL029
aauaagauuuugaaa

SEQ ID NO: 2522608 - RNA, 16 nt, Chlamydophila pneumoniae CWL029
aauaagcaggaaaagc

SEQ ID NO: 2522609 - RNA, 17 nt, Chlamydophila pneumoniae CWL029
aauaagcauauuuaaau

SEQ ID NO: 2522610 - RNA, 18 nt, Chlamydophila pneumoniae CWL029
aauaagcauauuuaaaua

SEQ ID NO: 2522611 - RNA, 22 nt, Chlamydophila pneumoniae CWL029
aauaagcauauuuaaauauaaa

SEQ ID NO: 2522612 - RNA, 18 nt, Chlamydophila pneumoniae CWL029
aauaagccaguacuaaau

SEQ ID NO: 2522613 - RNA, 14 nt, Chlamydophila pneumoniae CWL029
aauaaguccuguuu

SEQ ID NO: 2522614 - RNA, 23 nt, Chlamydophila pneumoniae CWL029
aauaauagcaaguagcucucucc

SEQ ID NO: 2522615 - RNA, 15 nt, Chlamydophila pneumoniae CWL029
aauaauaggauaaga

SEQ ID NO: 2522616 - RNA, 19 nt, Chlamydophila pneumoniae CWL029
aauaauaggauaagaaauu

SEQ ID NO: 2522617 - RNA, 15 nt, Chlamydophila pneumoniae CWL029
aauaaucaaccaaaa

SEQ ID NO: 2522618 - RNA, 19 nt, Chlamydophila pneumoniae CWL029
aauaaucaaccaaaaugca

SEQ ID NO: 2522619 - RNA, 12 nt, Chlamydophila pneumoniae CWL029
aauaaucuucaa

SEQ ID NO: 2522620 - RNA, 14 nt, Chlamydophila pneumoniae CWL029
aauaauguuuuaau

SEQ ID NO: 2522621 - RNA, 20 nt, Chlamydophila pneumoniae CWL029
aauaauguuuuaauagcuaa

SEQ ID NO: 2522622 - RNA, 12 nt, Chlamydophila pneumoniae CWL029
aauaauuaaaua

SEQ ID NO: 2522623 - RNA, 13 nt, Chlamydophila pneumoniae CWL029
aauaauuaaauau

SEQ ID NO: 2522624 - RNA, 14 nt, Chlamydophila pneumoniae CWL029
aauaauuaaaucgu

SEQ ID NO: 2522625 - RNA, 14 nt, Chlamydophila pneumoniae CWL029
aauaauuacuugga

SEQ ID NO: 2522626 - RNA, 22 nt, Chlamydophila pneumoniae CWL029
aauaauuuguuuagaaaaagau

SEQ ID NO: 2522627 - RNA, 12 nt, Chlamydophila pneumoniae CWL029
aauacaaaaaau

SEQ ID NO: 2522628 - RNA, 14 nt, Chlamydophila pneumoniae CWL029
aauacaaaaaauaa

SEQ ID NO: 2522629 - RNA, 20 nt, Chlamydophila pneumoniae CWL029
aauacaaaaaauaaaaucaa

SEQ ID NO: 2522630 - RNA, 17 nt, Chlamydophila pneumoniae CWL029
aauacagacagaugcuu

SEQ ID NO: 2522631 - RNA, 15 nt, Chlamydophila pneumoniae CWL029
aauacagccagcaga

SEQ ID NO: 2522632 - RNA, 17 nt, Chlamydophila pneumoniae CWL029
aauacagccagcagaag

SEQ ID NO: 2522633 - RNA, 17 nt, Chlamydophila pneumoniae CWL029
aauacaggaaucuccuc

SEQ ID NO: 2522634 - RNA, 13 nt, Chlamydophila pneumoniae CWL029
aauacaggagaau

SEQ ID NO: 2522635 - RNA, 22 nt, Chlamydophila pneumoniae CWL029
aauacauagguaaaaccagcau

SEQ ID NO: 2522636 - RNA, 20 nt, Chlamydophila pneumoniae CWL029
aauacaucuuaagagcaaac

SEQ ID NO: 2522637 - RNA, 13 nt, Chlamydophila pneumoniae CWL029
aauacauuccuag

SEQ ID NO: 2522638 - RNA, 13 nt, Chlamydophila pneumoniae CWL029
aauaccagaagca

SEQ ID NO: 2522639 - RNA, 19 nt, Chlamydophila pneumoniae CWL029
aauaccagaagcaaaggua

SEQ ID NO: 2522640 - RNA, 13 nt, Chlamydophila pneumoniae CWL029
aauaccagauaaa

SEQ ID NO: 2522641 - RNA, 17 nt, Chlamydophila pneumoniae CWL029
aauaccagauaaagcaa

SEQ ID NO: 2522642 - RNA, 20 nt, Chlamydophila pneumoniae CWL029
aauaccaguagagaauguuc

SEQ ID NO: 2522643 - RNA, 15 nt, Chlamydophila pneumoniae CWL029
aauaccaucucuuuc

SEQ ID NO: 2522644 - RNA, 18 nt, Chlamydophila pneumoniae CWL029
aauaccucagaaauuccu

SEQ ID NO: 2522645 - RNA, 21 nt, Chlamydophila pneumoniae CWL029
aauaccuguacgguaaaucca

SEQ ID NO: 2522646 - RNA, 21 nt, Chlamydophila pneumoniae CWL029
aauaccuuucuaagaauucuu

SEQ ID NO: 2522647 - RNA, 15 nt, Chlamydophila pneumoniae CWL029
aauacgaucugcuuu

SEQ ID NO: 2522648 - RNA, 15 nt, Chlamydophila pneumoniae CWL029
aauacgcuuuucuuc

SEQ ID NO: 2522649 - RNA, 19 nt, Chlamydophila pneumoniae CWL029
aauacgcuuuucuucuuua

SEQ ID NO: 2522650 - RNA, 16 nt, Chlamydophila pneumoniae CWL029
aauacggacauaccua

SEQ ID NO: 2522651 - RNA, 19 nt, Chlamydophila pneumoniae CWL029
aauacguaccguauccucu

SEQ ID NO: 2522652 - RNA, 15 nt, Chlamydophila pneumoniae CWL029
aauacguccagccug

SEQ ID NO: 2522653 - RNA, 17 nt, Chlamydophila pneumoniae CWL029
aauacguuuuuaggguu

SEQ ID NO: 2522654 - RNA, 22 nt, Chlamydophila pneumoniae CWL029
aauacuaagaagcucacucuuu

SEQ ID NO: 2522655 - RNA, 16 nt, Chlamydophila pneumoniae CWL029
aauacuccacuuuuuu

SEQ ID NO: 2522656 - RNA, 19 nt, Chlamydophila pneumoniae CWL029
aauacuccacuuuuuuccc

SEQ ID NO: 2522657 - RNA, 18 nt, Chlamydophila pneumoniae CWL029
aauacucuagguuuucuc

SEQ ID NO: 2522658 - RNA, 21 nt, Chlamydophila pneumoniae CWL029
aauacucuagguuuucucuuc

SEQ ID NO: 2522659 - RNA, 12 nt, Chlamydophila pneumoniae CWL029
aauacucuguuu

SEQ ID NO: 2522660 - RNA, 15 nt, Chlamydophila pneumoniae CWL029
aauacugcgcaggga

SEQ ID NO: 2522661 - RNA, 22 nt, Chlamydophila pneumoniae CWL029
aauacuggagagguaaccagag

SEQ ID NO: 2522662 - RNA, 19 nt, Chlamydophila pneumoniae CWL029
aauacuguucgauaagaac

SEQ ID NO: 2522663 - RNA, 18 nt, Chlamydophila pneumoniae CWL029
aauacuuaggaauuuuuc

SEQ ID NO: 2522664 - RNA, 19 nt, Chlamydophila pneumoniae CWL029
aauacuuaggaauuuuucu

SEQ ID NO: 2522665 - RNA, 13 nt, Chlamydophila pneumoniae CWL029
aauacuucuccuc

SEQ ID NO: 2522666 - RNA, 15 nt, Chlamydophila pneumoniae CWL029
aauacuucuccugaa

SEQ ID NO: 2522667 - RNA, 14 nt, Chlamydophila pneumoniae CWL029
aauagaaauaagca

SEQ ID NO: 2522668 - RNA, 21 nt, Chlamydophila pneumoniae CWL029
aauagaacgaauuucaacagc

SEQ ID NO: 2522669 - RNA, 20 nt, Chlamydophila pneumoniae CWL029
aauagaagccaccaucuguu

SEQ ID NO: 2522670 - RNA, 13 nt, Chlamydophila pneumoniae CWL029
aauagagaaacuu

SEQ ID NO: 2522671 - RNA, 21 nt, Chlamydophila pneumoniae CWL029
aauagagaagaagcaaaagau

SEQ ID NO: 2522672 - RNA, 20 nt, Chlamydophila pneumoniae CWL029
aauagaggaccgaaaaaccu

SEQ ID NO: 2522673 - RNA, 18 nt, Chlamydophila pneumoniae CWL029
aauagauucguuauccuc

SEQ ID NO: 2522674 - RNA, 21 nt, Chlamydophila pneumoniae CWL029
aauagauuuuuacuugcccaa

SEQ ID NO: 2522675 - RNA, 17 nt, Chlamydophila pneumoniae CWL029
aauagcaguauagagaa

SEQ ID NO: 2522676 - RNA, 21 nt, Chlamydophila pneumoniae CWL029
aauagcaucccuucuucuuuu

SEQ ID NO: 2522677 - RNA, 20 nt, Chlamydophila pneumoniae CWL029
aauagccauaauuagaacag

SEQ ID NO: 2522678 - RNA, 20 nt, Chlamydophila pneumoniae CWL029
aauagcgacaugagaaaucu

SEQ ID NO: 2522679 - RNA, 23 nt, Chlamydophila pneumoniae CWL029
aauagcgacaugagaaaucuuuu

SEQ ID NO: 2522680 - RNA, 14 nt, Chlamydophila pneumoniae CWL029
aauagcuaaaguga

SEQ ID NO: 2522681 - RNA, 15 nt, Chlamydophila pneumoniae CWL029
aauagcucuggagau

SEQ ID NO: 2522682 - RNA, 16 nt, Chlamydophila pneumoniae CWL029
aauaggaacaaagcuc

SEQ ID NO: 2522683 - RNA, 21 nt, Chlamydophila pneumoniae CWL029
aauaggaauuagagaaauuuu

SEQ ID NO: 2522684 - RNA, 15 nt, Chlamydophila pneumoniae CWL029
aauaggauaagaaau

SEQ ID NO: 2522685 - RNA, 18 nt, Chlamydophila pneumoniae CWL029
aauaggcacccaaacuga

SEQ ID NO: 2522686 - RNA, 17 nt, Chlamydophila pneumoniae CWL029
aauaggcucuuuagcaa

SEQ ID NO: 2522687 - RNA, 14 nt, Chlamydophila pneumoniae CWL029
aauaggucucuugc

SEQ ID NO: 2522688 - RNA, 15 nt, Chlamydophila pneumoniae CWL029
aauagguuucaauag

SEQ ID NO: 2522689 - RNA, 20 nt, Chlamydophila pneumoniae CWL029
aauagucucuguaagaacgu

SEQ ID NO: 2522690 - RNA, 15 nt, Chlamydophila pneumoniae CWL029
aauauaaaagaagac

SEQ ID NO: 2522691 - RNA, 18 nt, Chlamydophila pneumoniae CWL029
aauauaaauuuauaaacu

SEQ ID NO: 2522692 - RNA, 21 nt, Chlamydophila pneumoniae CWL029
aauauaauuccaauugccaug

SEQ ID NO: 2522693 - RNA, 16 nt, Chlamydophila pneumoniae CWL029
aauauacucuugcuug

SEQ ID NO: 2522694 - RNA, 17 nt, Chlamydophila pneumoniae CWL029
aauauacucuugcuugc

SEQ ID NO: 2522695 - RNA, 18 nt, Chlamydophila pneumoniae CWL029
aauauagagaacuccauu

SEQ ID NO: 2522696 - RNA, 19 nt, Chlamydophila pneumoniae CWL029
aauauagguuaagccaauc

SEQ ID NO: 2522697 - RNA, 20 nt, Chlamydophila pneumoniae CWL029
aauauaguuuucauaaucca

SEQ ID NO: 2522698 - RNA, 21 nt, Chlamydophila pneumoniae CWL029
aauauauccaggaucugugug

SEQ ID NO: 2522699 - RNA, 22 nt, Chlamydophila pneumoniae CWL029
aauauaucgcguguaaaagcuu

SEQ ID NO: 2522700 - RNA, 13 nt, Chlamydophila pneumoniae CWL029
aauaucacauucc

SEQ ID NO: 2522701 - RNA, 20 nt, Chlamydophila pneumoniae CWL029
aauaucaccuacaucagacu

SEQ ID NO: 2522702 - RNA, 20 nt, Chlamydophila pneumoniae CWL029
aauaucaggacaaugaagaa

SEQ ID NO: 2522703 - RNA, 16 nt, Chlamydophila pneumoniae CWL029
aauauccuaaauauau

SEQ ID NO: 2522704 - RNA, 18 nt, Chlamydophila pneumoniae CWL029
aauaucgaguucuuuuug

SEQ ID NO: 2522705 - RNA, 21 nt, Chlamydophila pneumoniae CWL029
aauaucuccgccauaacacuu

SEQ ID NO: 2522706 - RNA, 22 nt, Chlamydophila pneumoniae CWL029
aauaucuccguuaccaaaaacu

SEQ ID NO: 2522707 - RNA, 14 nt, Chlamydophila pneumoniae CWL029
aauaucucuggcau

SEQ ID NO: 2522708 - RNA, 22 nt, Chlamydophila pneumoniae CWL029
aauaucuguggcguaagcaaua

SEQ ID NO: 2522709 - RNA, 12 nt, Chlamydophila pneumoniae CWL029
aauaucuugaau

SEQ ID NO: 2522710 - RNA, 18 nt, Chlamydophila pneumoniae CWL029
aauauguacugaugugaa

SEQ ID NO: 2522711 - RNA, 18 nt, Chlamydophila pneumoniae CWL029
aauauugaucuuuccucu

SEQ ID NO: 2522712 - RNA, 18 nt, Chlamydophila pneumoniae CWL029
aauauuugagaagauaug

SEQ ID NO: 2522713 - RNA, 23 nt, Chlamydophila pneumoniae CWL029
aauauuuuaccauugagauccau

SEQ ID NO: 2522714 - RNA, 11 nt, Chlamydophila pneumoniae CWL029
aaucaaauuca

SEQ ID NO: 2522715 - RNA, 12 nt, Chlamydophila pneumoniae CWL029
aaucaaauucaa

SEQ ID NO: 2522716 - RNA, 14 nt, Chlamydophila pneumoniae CWL029
aaucaacaucacaa

SEQ ID NO: 2522717 - RNA, 17 nt, Chlamydophila pneumoniae CWL029
aaucaagaguuucgaau

SEQ ID NO: 2522718 - RNA, 13 nt, Chlamydophila pneumoniae CWL029
aaucaagauaaag

SEQ ID NO: 2522719 - RNA, 16 nt, Chlamydophila pneumoniae CWL029
aaucaagccacagaga

SEQ ID NO: 2522720 - RNA, 17 nt, Chlamydophila pneumoniae CWL029
aaucaagccacagagaa

SEQ ID NO: 2522721 - RNA, 13 nt, Chlamydophila pneumoniae CWL029
aaucaauccaaga

SEQ ID NO: 2522722 - RNA, 13 nt, Chlamydophila pneumoniae CWL029
aaucaauccacaa

SEQ ID NO: 2522723 - RNA, 15 nt, Chlamydophila pneumoniae CWL029
aaucacauaaaauaa

SEQ ID NO: 2522724 - RNA, 16 nt, Chlamydophila pneumoniae CWL029
aaucaccaauuuuuuc

SEQ ID NO: 2522725 - RNA, 19 nt, Chlamydophila pneumoniae CWL029
aaucaccaauuuuuucccc

SEQ ID NO: 2522726 - RNA, 18 nt, Chlamydophila pneumoniae CWL029
aaucacgacgucaucacc

SEQ ID NO: 2522727 - RNA, 21 nt, Chlamydophila pneumoniae CWL029
aaucacucuaugaucuacaga

SEQ ID NO: 2522728 - RNA, 17 nt, Chlamydophila pneumoniae CWL029
aaucacuuaauaauguu

SEQ ID NO: 2522729 - RNA, 20 nt, Chlamydophila pneumoniae CWL029
aaucacuuaauaauguuuua

SEQ ID NO: 2522730 - RNA, 14 nt, Chlamydophila pneumoniae CWL029
aaucagaagugauc

SEQ ID NO: 2522731 - RNA, 13 nt, Chlamydophila pneumoniae CWL029
aaucagaggagcc

SEQ ID NO: 2522732 - RNA, 14 nt, Chlamydophila pneumoniae CWL029
aaucagaggagccu

SEQ ID NO: 2522733 - RNA, 20 nt, Chlamydophila pneumoniae CWL029
aaucagaggagccuccauaa

SEQ ID NO: 2522734 - RNA, 23 nt, Chlamydophila pneumoniae CWL029
aaucagcaacaucguuaauauaa

SEQ ID NO: 2522735 - RNA, 13 nt, Chlamydophila pneumoniae CWL029
aaucaguccuaaa

SEQ ID NO: 2522736 - RNA, 15 nt, Chlamydophila pneumoniae CWL029
aaucagugcugccau

SEQ ID NO: 2522737 - RNA, 12 nt, Chlamydophila pneumoniae CWL029
aaucauaaccaa

SEQ ID NO: 2522738 - RNA, 20 nt, Chlamydophila pneumoniae CWL029
aaucauaaccaaaagaauua

SEQ ID NO: 2522739 - RNA, 21 nt, Chlamydophila pneumoniae CWL029
aaucauagccaucauagcaaa

SEQ ID NO: 2522740 - RNA, 20 nt, Chlamydophila pneumoniae CWL029
aaucaugccgagauuuuuac

SEQ ID NO: 2522741 - RNA, 19 nt, Chlamydophila pneumoniae CWL029
aaucauuagaguuugguuu

SEQ ID NO: 2522742 - RNA, 16 nt, Chlamydophila pneumoniae CWL029
aaucauucaaauauau

SEQ ID NO: 2522743 - RNA, 23 nt, Chlamydophila pneumoniae CWL029
aaucauuggaaccauaggauagg

SEQ ID NO: 2522744 - RNA, 19 nt, Chlamydophila pneumoniae CWL029
aauccaaaaacuucuaacu

SEQ ID NO: 2522745 - RNA, 17 nt, Chlamydophila pneumoniae CWL029
aauccaaagacuuuuua

SEQ ID NO: 2522746 - RNA, 15 nt, Chlamydophila pneumoniae CWL029
aauccaacaaagaug

SEQ ID NO: 2522747 - RNA, 17 nt, Chlamydophila pneumoniae CWL029
aauccaacaaagaugac

SEQ ID NO: 2522748 - RNA, 13 nt, Chlamydophila pneumoniae CWL029
aauccaagaauag

SEQ ID NO: 2522749 - RNA, 12 nt, Chlamydophila pneumoniae CWL029
aauccacauccu

SEQ ID NO: 2522750 - RNA, 14 nt, Chlamydophila pneumoniae CWL029
aauccaccaaugau

SEQ ID NO: 2522751 - RNA, 19 nt, Chlamydophila pneumoniae CWL029
aauccagaauuuucugcga

SEQ ID NO: 2522752 - RNA, 19 nt, Chlamydophila pneumoniae CWL029
aauccagauuguucaaaaa

SEQ ID NO: 2522753 - RNA, 23 nt, Chlamydophila pneumoniae CWL029
aauccagauuguucaaaaauaga

SEQ ID NO: 2522754 - RNA, 18 nt, Chlamydophila pneumoniae CWL029
aauccagcaacaaccaaa

SEQ ID NO: 2522755 - RNA, 21 nt, Chlamydophila pneumoniae CWL029
aauccagcaacaaccaaaaga

SEQ ID NO: 2522756 - RNA, 21 nt, Chlamydophila pneumoniae CWL029
aauccagccacccccacuucu

SEQ ID NO: 2522757 - RNA, 14 nt, Chlamydophila pneumoniae CWL029
aauccauaguccua

SEQ ID NO: 2522758 - RNA, 18 nt, Chlamydophila pneumoniae CWL029
aauccauucugagaaaga

SEQ ID NO: 2522759 - RNA, 20 nt, Chlamydophila pneumoniae CWL029
aauccauucugagaaagaag

SEQ ID NO: 2522760 - RNA, 22 nt, Chlamydophila pneumoniae CWL029
aauccauuuugcccacuucuac

SEQ ID NO: 2522761 - RNA, 22 nt, Chlamydophila pneumoniae CWL029
aaucccacuaucuguaauuccc

SEQ ID NO: 2522762 - RNA, 17 nt, Chlamydophila pneumoniae CWL029
aaucccccagcauucac

SEQ ID NO: 2522763 - RNA, 19 nt, Chlamydophila pneumoniae CWL029
aauccccgggauuguucuu

SEQ ID NO: 2522764 - RNA, 22 nt, Chlamydophila pneumoniae CWL029
aauccccgggauuguucuuuac

SEQ ID NO: 2522765 - RNA, 17 nt, Chlamydophila pneumoniae CWL029
aaucccgugcuaggaag

SEQ ID NO: 2522766 - RNA, 18 nt, Chlamydophila pneumoniae CWL029
aaucccgugcuaggaaga

SEQ ID NO: 2522767 - RNA, 20 nt, Chlamydophila pneumoniae CWL029
aaucccugcacucuuucaga

SEQ ID NO: 2522768 - RNA, 22 nt, Chlamydophila pneumoniae CWL029
aaucccuguucuagcaaaucua

SEQ ID NO: 2522769 - RNA, 23 nt, Chlamydophila pneumoniae CWL029
aaucccuguucuagcaaaucuaa

SEQ ID NO: 2522770 - RNA, 22 nt, Chlamydophila pneumoniae CWL029
aauccuaaaaaggguuccucuu

SEQ ID NO: 2522771 - RNA, 14 nt, Chlamydophila pneumoniae CWL029
aauccuaauuccuu

SEQ ID NO: 2522772 - RNA, 20 nt, Chlamydophila pneumoniae CWL029
aauccucugaaggauuugcu

SEQ ID NO: 2522773 - RNA, 23 nt, Chlamydophila pneumoniae CWL029
aauccugcucguaaaucuggaau

SEQ ID NO: 2522774 - RNA, 22 nt, Chlamydophila pneumoniae CWL029
aauccugggcaaugaucaaaaa

SEQ ID NO: 2522775 - RNA, 21 nt, Chlamydophila pneumoniae CWL029
aauccuguaacacccucccuc

SEQ ID NO: 2522776 - RNA, 16 nt, Chlamydophila pneumoniae CWL029
aauccuucuauagcaa

SEQ ID NO: 2522777 - RNA, 14 nt, Chlamydophila pneumoniae CWL029
aauccuucucccuc

SEQ ID NO: 2522778 - RNA, 12 nt, Chlamydophila pneumoniae CWL029
aauccuucuuuc

SEQ ID NO: 2522779 - RNA, 19 nt, Chlamydophila pneumoniae CWL029
aauccuucuuucugcucuu

SEQ ID NO: 2522780 - RNA, 18 nt, Chlamydophila pneumoniae CWL029
aauccuuucacaaagaau

SEQ ID NO: 2522781 - RNA, 15 nt, Chlamydophila pneumoniae CWL029
aauccuuuggaagcu

SEQ ID NO: 2522782 - RNA, 18 nt, Chlamydophila pneumoniae CWL029
aauccuuuggaagcuauc

SEQ ID NO: 2522783 - RNA, 21 nt, Chlamydophila pneumoniae CWL029
aauccuuuuuaggaaaggaua

SEQ ID NO: 2522784 - RNA, 23 nt, Chlamydophila pneumoniae CWL029
aaucgaauagcucuggagauugc

SEQ ID NO: 2522785 - RNA, 18 nt, Chlamydophila pneumoniae CWL029
aaucgcacuucuauuucu

SEQ ID NO: 2522786 - RNA, 16 nt, Chlamydophila pneumoniae CWL029
aaucgcaucaaaaaau

SEQ ID NO: 2522787 - RNA, 21 nt, Chlamydophila pneumoniae CWL029
aaucgcuguuuuagcauagca

SEQ ID NO: 2522788 - RNA, 22 nt, Chlamydophila pneumoniae CWL029
aaucguucccaucacauaaauc

SEQ ID NO: 2522789 - RNA, 23 nt, Chlamydophila pneumoniae CWL029
aaucguuucucuggcaaugacuu

SEQ ID NO: 2522790 - RNA, 14 nt, Chlamydophila pneumoniae CWL029
aaucuaaaaucaca

SEQ ID NO: 2522791 - RNA, 13 nt, Chlamydophila pneumoniae CWL029
aaucuaagaacua

SEQ ID NO: 2522792 - RNA, 13 nt, Chlamydophila pneumoniae CWL029
aaucuaagaaucu

SEQ ID NO: 2522793 - RNA, 21 nt, Chlamydophila pneumoniae CWL029
aaucuaaguaaaacugcgcua

SEQ ID NO: 2522794 - RNA, 19 nt, Chlamydophila pneumoniae CWL029
aaucuaauuuuagaacuuc

SEQ ID NO: 2522795 - RNA, 14 nt, Chlamydophila pneumoniae CWL029
aaucuauaaauuca

SEQ ID NO: 2522796 - RNA, 16 nt, Chlamydophila pneumoniae CWL029
aaucuauaggauuugc

SEQ ID NO: 2522797 - RNA, 16 nt, Chlamydophila pneumoniae CWL029
aaucuauagucuguuu

SEQ ID NO: 2522798 - RNA, 13 nt, Chlamydophila pneumoniae CWL029
aaucuaugaauac

SEQ ID NO: 2522799 - RNA, 11 nt, Chlamydophila pneumoniae CWL029
aaucuaugaga

SEQ ID NO: 2522800 - RNA, 14 nt, Chlamydophila pneumoniae CWL029
aaucuauuccccuc

SEQ ID NO: 2522801 - RNA, 20 nt, Chlamydophila pneumoniae CWL029
aaucucaccagaagcaacua

SEQ ID NO: 2522802 - RNA, 17 nt, Chlamydophila pneumoniae CWL029
aaucucacuggcuccua

SEQ ID NO: 2522803 - RNA, 19 nt, Chlamydophila pneumoniae CWL029
aaucucagugaacucuuca

SEQ ID NO: 2522804 - RNA, 14 nt, Chlamydophila pneumoniae CWL029
aaucucgcuauucc

SEQ ID NO: 2522805 - RNA, 13 nt, Chlamydophila pneumoniae CWL029
aaucucuaagaau

SEQ ID NO: 2522806 - RNA, 23 nt, Chlamydophila pneumoniae CWL029
aaucucuagggauaauuaaacuc

SEQ ID NO: 2522807 - RNA, 13 nt, Chlamydophila pneumoniae CWL029
aaucucuccuuga

SEQ ID NO: 2522808 - RNA, 20 nt, Chlamydophila pneumoniae CWL029
aaucucuucuguaggaacaa

SEQ ID NO: 2522809 - RNA, 19 nt, Chlamydophila pneumoniae CWL029
aaucucuuucauaaauuca

SEQ ID NO: 2522810 - RNA, 20 nt, Chlamydophila pneumoniae CWL029
aaucucuuucauaaauucag

SEQ ID NO: 2522811 - RNA, 13 nt, Chlamydophila pneumoniae CWL029
aaucugaaucuca

SEQ ID NO: 2522812 - RNA, 16 nt, Chlamydophila pneumoniae CWL029
aaucugaaucucauaa

SEQ ID NO: 2522813 - RNA, 22 nt, Chlamydophila pneumoniae CWL029
aaucugacgugcauugaauccu

SEQ ID NO: 2522814 - RNA, 11 nt, Chlamydophila pneumoniae CWL029
aaucugauuca

SEQ ID NO: 2522815 - RNA, 17 nt, Chlamydophila pneumoniae CWL029
aaucugauucaauugag

SEQ ID NO: 2522816 - RNA, 15 nt, Chlamydophila pneumoniae CWL029
aaucugcuauaacca

SEQ ID NO: 2522817 - RNA, 14 nt, Chlamydophila pneumoniae CWL029
aaucugcucucuga

SEQ ID NO: 2522818 - RNA, 12 nt, Chlamydophila pneumoniae CWL029
aaucuggaagca

SEQ ID NO: 2522819 - RNA, 14 nt, Chlamydophila pneumoniae CWL029
aaucuggggcuucc

SEQ ID NO: 2522820 - RNA, 15 nt, Chlamydophila pneumoniae CWL029
aaucuguaagaaaau

SEQ ID NO: 2522821 - RNA, 21 nt, Chlamydophila pneumoniae CWL029
aaucuguauccgacucuguuu

SEQ ID NO: 2522822 - RNA, 23 nt, Chlamydophila pneumoniae CWL029
aaucugugaguacccagucaucg

SEQ ID NO: 2522823 - RNA, 15 nt, Chlamydophila pneumoniae CWL029
aaucuuacauaaacc

SEQ ID NO: 2522824 - RNA, 23 nt, Chlamydophila pneumoniae CWL029
aaucuuacauaaaccuuugguuu

SEQ ID NO: 2522825 - RNA, 18 nt, Chlamydophila pneumoniae CWL029
aaucuuaugggagaagcu

SEQ ID NO: 2522826 - RNA, 13 nt, Chlamydophila pneumoniae CWL029
aaucuuccccuaa

SEQ ID NO: 2522827 - RNA, 17 nt, Chlamydophila pneumoniae CWL029
aaucuuccccuaaaaau

SEQ ID NO: 2522828 - RNA, 20 nt, Chlamydophila pneumoniae CWL029
aaucuuccuuaaccuccuca

SEQ ID NO: 2522829 - RNA, 15 nt, Chlamydophila pneumoniae CWL029
aaucuucgaauuuuu

SEQ ID NO: 2522830 - RNA, 18 nt, Chlamydophila pneumoniae CWL029
aaucuugaucagcaauca

SEQ ID NO: 2522831 - RNA, 14 nt, Chlamydophila pneumoniae CWL029
aaucuuguaaguua

SEQ ID NO: 2522832 - RNA, 15 nt, Chlamydophila pneumoniae CWL029
aaucuuucaauguaa

SEQ ID NO: 2522833 - RNA, 17 nt, Chlamydophila pneumoniae CWL029
aaucuuugaacaaaaag

SEQ ID NO: 2522834 - RNA, 14 nt, Chlamydophila pneumoniae CWL029
aaucuuugaagcuc

SEQ ID NO: 2522835 - RNA, 20 nt, Chlamydophila pneumoniae CWL029
aaucuuugaagcucgaccuc

SEQ ID NO: 2522836 - RNA, 18 nt, Chlamydophila pneumoniae CWL029
aaucuuuuagaguacaca

SEQ ID NO: 2522837 - RNA, 14 nt, Chlamydophila pneumoniae CWL029
aaucuuuucuugua

SEQ ID NO: 2522838 - RNA, 16 nt, Chlamydophila pneumoniae CWL029
aaugaaacgaaagcag

SEQ ID NO: 2522839 - RNA, 15 nt, Chlamydophila pneumoniae CWL029
aaugaagccaaaagg

SEQ ID NO: 2522840 - RNA, 18 nt, Chlamydophila pneumoniae CWL029
aaugaaggccaagauucu

SEQ ID NO: 2522841 - RNA, 19 nt, Chlamydophila pneumoniae CWL029
aaugaagucuucuuucccc

SEQ ID NO: 2522842 - RNA, 20 nt, Chlamydophila pneumoniae CWL029
aaugaagucuucuuucccca

SEQ ID NO: 2522843 - RNA, 17 nt, Chlamydophila pneumoniae CWL029
aaugaauggguuuuguu

SEQ ID NO: 2522844 - RNA, 14 nt, Chlamydophila pneumoniae CWL029
aaugacacagagaa

SEQ ID NO: 2522845 - RNA, 21 nt, Chlamydophila pneumoniae CWL029
aaugacagcugagaaauuccu

SEQ ID NO: 2522846 - RNA, 17 nt, Chlamydophila pneumoniae CWL029
aaugacuuuagaaauuc

SEQ ID NO: 2522847 - RNA, 17 nt, Chlamydophila pneumoniae CWL029
aaugacuuuuuuguuaa

SEQ ID NO: 2522848 - RNA, 14 nt, Chlamydophila pneumoniae CWL029
aaugagaucugcaa

SEQ ID NO: 2522849 - RNA, 21 nt, Chlamydophila pneumoniae CWL029
aaugagcaucugagucauaag

SEQ ID NO: 2522850 - RNA, 15 nt, Chlamydophila pneumoniae CWL029
aaugagcucuauuuc

SEQ ID NO: 2522851 - RNA, 22 nt, Chlamydophila pneumoniae CWL029
aaugaggguggaacuauccugu

SEQ ID NO: 2522852 - RNA, 12 nt, Chlamydophila pneumoniae CWL029
aaugauaagaaa

SEQ ID NO: 2522853 - RNA, 16 nt, Chlamydophila pneumoniae CWL029
aaugauacgugcagug

SEQ ID NO: 2522854 - RNA, 13 nt, Chlamydophila pneumoniae CWL029
aaugauagggaau

SEQ ID NO: 2522855 - RNA, 17 nt, Chlamydophila pneumoniae CWL029
aaugaucaaaaaugaua

SEQ ID NO: 2522856 - RNA, 14 nt, Chlamydophila pneumoniae CWL029
aaugauuucucuaa

SEQ ID NO: 2522857 - RNA, 23 nt, Chlamydophila pneumoniae CWL029
aaugcaaaccaaaaaaguaacua

SEQ ID NO: 2522858 - RNA, 15 nt, Chlamydophila pneumoniae CWL029
aaugcaugaaucucu

SEQ ID NO: 2522859 - RNA, 16 nt, Chlamydophila pneumoniae CWL029
aaugccaauaugguag

SEQ ID NO: 2522860 - RNA, 13 nt, Chlamydophila pneumoniae CWL029
aaugccagcagcg

SEQ ID NO: 2522861 - RNA, 23 nt, Chlamydophila pneumoniae CWL029
aaugcccuuuagggaauccccaa

SEQ ID NO: 2522862 - RNA, 17 nt, Chlamydophila pneumoniae CWL029
aaugccgaguaguccug

SEQ ID NO: 2522863 - RNA, 22 nt, Chlamydophila pneumoniae CWL029
aaugccucuuucauacuaaaau

SEQ ID NO: 2522864 - RNA, 17 nt, Chlamydophila pneumoniae CWL029
aaugccuuaaauguauu

SEQ ID NO: 2522865 - RNA, 16 nt, Chlamydophila pneumoniae CWL029
aaugcgauaaccacua

SEQ ID NO: 2522866 - RNA, 19 nt, Chlamydophila pneumoniae CWL029
aaugcggaccuuaagauga

SEQ ID NO: 2522867 - RNA, 23 nt, Chlamydophila pneumoniae CWL029
aaugcggaccuuaagaugaggua

SEQ ID NO: 2522868 - RNA, 13 nt, Chlamydophila pneumoniae CWL029
aaugcuagaguuu

SEQ ID NO: 2522869 - RNA, 22 nt, Chlamydophila pneumoniae CWL029
aaugcuccuugggucuuuuuau

SEQ ID NO: 2522870 - RNA, 15 nt, Chlamydophila pneumoniae CWL029
aaugcucuucugcag

SEQ ID NO: 2522871 - RNA, 20 nt, Chlamydophila pneumoniae CWL029
aauggaaacauagaaucauu

SEQ ID NO: 2522872 - RNA, 16 nt, Chlamydophila pneumoniae CWL029
aauggaaacuuuucca

SEQ ID NO: 2522873 - RNA, 21 nt, Chlamydophila pneumoniae CWL029
aauggcagcuuggaugggaau

SEQ ID NO: 2522874 - RNA, 15 nt, Chlamydophila pneumoniae CWL029
aauggcgauaaaugc

SEQ ID NO: 2522875 - RNA, 21 nt, Chlamydophila pneumoniae CWL029
aauggguuuuguuucaucuuc

SEQ ID NO: 2522876 - RNA, 15 nt, Chlamydophila pneumoniae CWL029
aaugguuccugaagc

SEQ ID NO: 2522877 - RNA, 16 nt, Chlamydophila pneumoniae CWL029
aauguaagaaggcaga

SEQ ID NO: 2522878 - RNA, 22 nt, Chlamydophila pneumoniae CWL029
aauguagucaugauuuuucaau

SEQ ID NO: 2522879 - RNA, 18 nt, Chlamydophila pneumoniae CWL029
aauguauccuucuacaau

SEQ ID NO: 2522880 - RNA, 21 nt, Chlamydophila pneumoniae CWL029
aauguauccuucuacaaugau

SEQ ID NO: 2522881 - RNA, 15 nt, Chlamydophila pneumoniae CWL029
aauguauugcaaaua

SEQ ID NO: 2522882 - RNA, 18 nt, Chlamydophila pneumoniae CWL029
aauguccaacucagcuuu

SEQ ID NO: 2522883 - RNA, 22 nt, Chlamydophila pneumoniae CWL029
aaugucgguuuguuaaacccaa

SEQ ID NO: 2522884 - RNA, 18 nt, Chlamydophila pneumoniae CWL029
aaugucgucucagaaaaa

SEQ ID NO: 2522885 - RNA, 18 nt, Chlamydophila pneumoniae CWL029
aaugugcucggacagaaa

SEQ ID NO: 2522886 - RNA, 15 nt, Chlamydophila pneumoniae CWL029
aaugugcuuuugguu

SEQ ID NO: 2522887 - RNA, 17 nt, Chlamydophila pneumoniae CWL029
aaugugcuuuugguucu

SEQ ID NO: 2522888 - RNA, 15 nt, Chlamydophila pneumoniae CWL029
aauguggugauuucu

SEQ ID NO: 2522889 - RNA, 22 nt, Chlamydophila pneumoniae CWL029
aauguuaacgaauugcuuuccc

SEQ ID NO: 2522890 - RNA, 20 nt, Chlamydophila pneumoniae CWL029
aauguucccaaauagaaaau

SEQ ID NO: 2522891 - RNA, 22 nt, Chlamydophila pneumoniae CWL029
aauguugcuaagcgaaccaaag

SEQ ID NO: 2522892 - RNA, 20 nt, Chlamydophila pneumoniae CWL029
aauguuuaucgacucuucca

SEQ ID NO: 2522893 - RNA, 18 nt, Chlamydophila pneumoniae CWL029
aauguuuggccaacagcu

SEQ ID NO: 2522894 - RNA, 23 nt, Chlamydophila pneumoniae CWL029
aauguuuuccucgaguauggcaa

SEQ ID NO: 2522895 - RNA, 14 nt, Chlamydophila pneumoniae CWL029
aauguuuuuaaacc

SEQ ID NO: 2522896 - RNA, 12 nt, Chlamydophila pneumoniae CWL029
aauuaaaaguuc

SEQ ID NO: 2522897 - RNA, 23 nt, Chlamydophila pneumoniae CWL029
aauuaaaaguucagcaaagaagu

SEQ ID NO: 2522898 - RNA, 14 nt, Chlamydophila pneumoniae CWL029
aauuaaacuuucuu

SEQ ID NO: 2522899 - RNA, 15 nt, Chlamydophila pneumoniae CWL029
aauuaaauauauaaa

SEQ ID NO: 2522900 - RNA, 13 nt, Chlamydophila pneumoniae CWL029
aauuaaauaucua

SEQ ID NO: 2522901 - RNA, 13 nt, Chlamydophila pneumoniae CWL029
aauuaagaaacua

SEQ ID NO: 2522902 - RNA, 15 nt, Chlamydophila pneumoniae CWL029
aauuaccauuuugca

SEQ ID NO: 2522903 - RNA, 21 nt, Chlamydophila pneumoniae CWL029
aauuacgcucuccauggcuuc

SEQ ID NO: 2522904 - RNA, 23 nt, Chlamydophila pneumoniae CWL029
aauuacuuggauaacacgaguuu

SEQ ID NO: 2522905 - RNA, 15 nt, Chlamydophila pneumoniae CWL029
aauuagaaucagagg

SEQ ID NO: 2522906 - RNA, 17 nt, Chlamydophila pneumoniae CWL029
aauuagagaaauuuuua

SEQ ID NO: 2522907 - RNA, 17 nt, Chlamydophila pneumoniae CWL029
aauuagagggauuugua

SEQ ID NO: 2522908 - RNA, 15 nt, Chlamydophila pneumoniae CWL029
aauuagaguaugagg

SEQ ID NO: 2522909 - RNA, 15 nt, Chlamydophila pneumoniae CWL029
aauuaguaaaugccu

SEQ ID NO: 2522910 - RNA, 22 nt, Chlamydophila pneumoniae CWL029
aauuaguaaaugccucuuucau

SEQ ID NO: 2522911 - RNA, 22 nt, Chlamydophila pneumoniae CWL029
aauuaguuucacauaguuuaau

SEQ ID NO: 2522912 - RNA, 13 nt, Chlamydophila pneumoniae CWL029
aauuauccagaaa

SEQ ID NO: 2522913 - RNA, 17 nt, Chlamydophila pneumoniae CWL029
aauuauccagaaagauu

SEQ ID NO: 2522914 - RNA, 19 nt, Chlamydophila pneumoniae CWL029
aauuaucuccaaagaucau

SEQ ID NO: 2522915 - RNA, 12 nt, Chlamydophila pneumoniae CWL029
aauuauuuggau

SEQ ID NO: 2522916 - RNA, 13 nt, Chlamydophila pneumoniae CWL029
aauucaaaaagag

SEQ ID NO: 2522917 - RNA, 12 nt, Chlamydophila pneumoniae CWL029
aauucaaaauca

SEQ ID NO: 2522918 - RNA, 23 nt, Chlamydophila pneumoniae CWL029
aauucaaaaucaaaguauauauu

SEQ ID NO: 2522919 - RNA, 13 nt, Chlamydophila pneumoniae CWL029
aauuccaaaauaa

SEQ ID NO: 2522920 - RNA, 15 nt, Chlamydophila pneumoniae CWL029
aauuccaauuuuugc

SEQ ID NO: 2522921 - RNA, 22 nt, Chlamydophila pneumoniae CWL029
aauuccauagguuagaaaugaa

SEQ ID NO: 2522922 - RNA, 15 nt, Chlamydophila pneumoniae CWL029
aauuccgaagaagaa

SEQ ID NO: 2522923 - RNA, 17 nt, Chlamydophila pneumoniae CWL029
aauuccuaaaacaagaa

SEQ ID NO: 2522924 - RNA, 20 nt, Chlamydophila pneumoniae CWL029
aauuccuaaaacaagaagau

SEQ ID NO: 2522925 - RNA, 17 nt, Chlamydophila pneumoniae CWL029
aauuccuucucagaaag

SEQ ID NO: 2522926 - RNA, 18 nt, Chlamydophila pneumoniae CWL029
aauuccuucucagaaaga

SEQ ID NO: 2522927 - RNA, 14 nt, Chlamydophila pneumoniae CWL029
aauuccuuggauuc

SEQ ID NO: 2522928 - RNA, 12 nt, Chlamydophila pneumoniae CWL029
aauuccuuucuc

SEQ ID NO: 2522929 - RNA, 22 nt, Chlamydophila pneumoniae CWL029
aauuccuuucuccagcauuuuu

SEQ ID NO: 2522930 - RNA, 13 nt, Chlamydophila pneumoniae CWL029
aauucgcauuuuu

SEQ ID NO: 2522931 - RNA, 15 nt, Chlamydophila pneumoniae CWL029
aauucgcauuuuugg

SEQ ID NO: 2522932 - RNA, 20 nt, Chlamydophila pneumoniae CWL029
aauucgcucagaaaauguaa

SEQ ID NO: 2522933 - RNA, 15 nt, Chlamydophila pneumoniae CWL029
aauucggcagaaggc

SEQ ID NO: 2522934 - RNA, 19 nt, Chlamydophila pneumoniae CWL029
aauucggcagaaggcuugu

SEQ ID NO: 2522935 - RNA, 15 nt, Chlamydophila pneumoniae CWL029
aauucgguagagcua

SEQ ID NO: 2522936 - RNA, 17 nt, Chlamydophila pneumoniae CWL029
aauucuagaccugccaa

SEQ ID NO: 2522937 - RNA, 23 nt, Chlamydophila pneumoniae CWL029
aauucuauuuauuuuauuaguuu

SEQ ID NO: 2522938 - RNA, 14 nt, Chlamydophila pneumoniae CWL029
aauucucagaaagc

SEQ ID NO: 2522939 - RNA, 19 nt, Chlamydophila pneumoniae CWL029
aauucucgagcagcugcac

SEQ ID NO: 2522940 - RNA, 19 nt, Chlamydophila pneumoniae CWL029
aauucucugacacuccuca

SEQ ID NO: 2522941 - RNA, 21 nt, Chlamydophila pneumoniae CWL029
aauucuucuacagaauaggaa

SEQ ID NO: 2522942 - RNA, 22 nt, Chlamydophila pneumoniae CWL029
aauucuucuacagaauaggaac

SEQ ID NO: 2522943 - RNA, 23 nt, Chlamydophila pneumoniae CWL029
aauucuuuaugagagagcucuuc

SEQ ID NO: 2522944 - RNA, 16 nt, Chlamydophila pneumoniae CWL029
aauucuuugccaagga

SEQ ID NO: 2522945 - RNA, 12 nt, Chlamydophila pneumoniae CWL029
aauucuuuuccu

SEQ ID NO: 2522946 - RNA, 23 nt, Chlamydophila pneumoniae CWL029
aauugaacguagcuacaaaauua

SEQ ID NO: 2522947 - RNA, 22 nt, Chlamydophila pneumoniae CWL029
aauugacugcuagaguccaagg

SEQ ID NO: 2522948 - RNA, 14 nt, Chlamydophila pneumoniae CWL029
aauugacuggaggc

SEQ ID NO: 2522949 - RNA, 23 nt, Chlamydophila pneumoniae CWL029
aauugagaaauauaacucucuag

SEQ ID NO: 2522950 - RNA, 16 nt, Chlamydophila pneumoniae CWL029
aauugagcucucuagc

SEQ ID NO: 2522951 - RNA, 20 nt, Chlamydophila pneumoniae CWL029
aauugagcucucuagcuguu

SEQ ID NO: 2522952 - RNA, 15 nt, Chlamydophila pneumoniae CWL029
aauugcaaaguacua

SEQ ID NO: 2522953 - RNA, 22 nt, Chlamydophila pneumoniae CWL029
aauugcagucacuacuguucua

SEQ ID NO: 2522954 - RNA, 18 nt, Chlamydophila pneumoniae CWL029
aauugcauuaagauaaac

SEQ ID NO: 2522955 - RNA, 15 nt, Chlamydophila pneumoniae CWL029
aauugcucuugcucu

SEQ ID NO: 2522956 - RNA, 13 nt, Chlamydophila pneumoniae CWL029
aauugguggagcu

SEQ ID NO: 2522957 - RNA, 15 nt, Chlamydophila pneumoniae CWL029
aauugucaucucaua

SEQ ID NO: 2522958 - RNA, 22 nt, Chlamydophila pneumoniae CWL029
aauugucugaggacaguauucc

SEQ ID NO: 2522959 - RNA, 16 nt, Chlamydophila pneumoniae CWL029
aauuguucuugaaguu

SEQ ID NO: 2522960 - RNA, 12 nt, Chlamydophila pneumoniae CWL029
aauuuaaauaua

SEQ ID NO: 2522961 - RNA, 13 nt, Chlamydophila pneumoniae CWL029
aauuuaaauauag

SEQ ID NO: 2522962 - RNA, 15 nt, Chlamydophila pneumoniae CWL029
aauuuaaauauagaa

SEQ ID NO: 2522963 - RNA, 14 nt, Chlamydophila pneumoniae CWL029
aauuuaaaucugca

SEQ ID NO: 2522964 - RNA, 20 nt, Chlamydophila pneumoniae CWL029
aauuuaucggcuaaagaaaa

SEQ ID NO: 2522965 - RNA, 17 nt, Chlamydophila pneumoniae CWL029
aauuucaggagcuccug

SEQ ID NO: 2522966 - RNA, 17 nt, Chlamydophila pneumoniae CWL029
aauuucauguccuccau

SEQ ID NO: 2522967 - RNA, 11 nt, Chlamydophila pneumoniae CWL029
aauuuccaaag

SEQ ID NO: 2522968 - RNA, 14 nt, Chlamydophila pneumoniae CWL029
aauuuccaaaggaa

SEQ ID NO: 2522969 - RNA, 19 nt, Chlamydophila pneumoniae CWL029
aauuuccaaucacacuaca

SEQ ID NO: 2522970 - RNA, 16 nt, Chlamydophila pneumoniae CWL029
aauuuccugcauggcu

SEQ ID NO: 2522971 - RNA, 14 nt, Chlamydophila pneumoniae CWL029
aauuuccuuagaag

SEQ ID NO: 2522972 - RNA, 20 nt, Chlamydophila pneumoniae CWL029
aauuucggacgauauuuaga

SEQ ID NO: 2522973 - RNA, 15 nt, Chlamydophila pneumoniae CWL029
aauuucuaggacagc

SEQ ID NO: 2522974 - RNA, 14 nt, Chlamydophila pneumoniae CWL029
aauuucugaaacaa

SEQ ID NO: 2522975 - RNA, 18 nt, Chlamydophila pneumoniae CWL029
aauuucugaaacaaugca

SEQ ID NO: 2522976 - RNA, 17 nt, Chlamydophila pneumoniae CWL029
aauuucuuauaaaaaag

SEQ ID NO: 2522977 - RNA, 22 nt, Chlamydophila pneumoniae CWL029
aauuucuugacuuguuucuccu

SEQ ID NO: 2522978 - RNA, 21 nt, Chlamydophila pneumoniae CWL029
aauuucuuuuugccaauuuuc

SEQ ID NO: 2522979 - RNA, 14 nt, Chlamydophila pneumoniae CWL029
aauuugauuuuuca

SEQ ID NO: 2522980 - RNA, 15 nt, Chlamydophila pneumoniae CWL029
aauuugccugaaauc

SEQ ID NO: 2522981 - RNA, 18 nt, Chlamydophila pneumoniae CWL029
aauuugccugaaauccug

SEQ ID NO: 2522982 - RNA, 16 nt, Chlamydophila pneumoniae CWL029
aauuugcuaugucugu

SEQ ID NO: 2522983 - RNA, 14 nt, Chlamydophila pneumoniae CWL029
aauuugcuccucca

SEQ ID NO: 2522984 - RNA, 15 nt, Chlamydophila pneumoniae CWL029
aauuuguuuagaaaa

SEQ ID NO: 2522985 - RNA, 23 nt, Chlamydophila pneumoniae CWL029
aauuuucagccugucuauaaaau

SEQ ID NO: 2522986 - RNA, 12 nt, Chlamydophila pneumoniae CWL029
aauuuucccauu

SEQ ID NO: 2522987 - RNA, 15 nt, Chlamydophila pneumoniae CWL029
aauuuucccauuaca

SEQ ID NO: 2522988 - RNA, 16 nt, Chlamydophila pneumoniae CWL029
aauuuucguaaccaca

SEQ ID NO: 2522989 - RNA, 14 nt, Chlamydophila pneumoniae CWL029
aauuuucuaaagau

SEQ ID NO: 2522990 - RNA, 16 nt, Chlamydophila pneumoniae CWL029
aauuuucuaaagauuu

SEQ ID NO: 2522991 - RNA, 23 nt, Chlamydophila pneumoniae CWL029
aauuuucuugcgacauaaccauc

SEQ ID NO: 2522992 - RNA, 19 nt, Chlamydophila pneumoniae CWL029
aauuuuuccuucaacacac

SEQ ID NO: 2522993 - RNA, 15 nt, Chlamydophila pneumoniae CWL029
aauuuuucgagaaua

SEQ ID NO: 2522994 - RNA, 17 nt, Chlamydophila pneumoniae CWL029
aauuuuugcuaaacaau

SEQ ID NO: 2522995 - RNA, 20 nt, Chlamydophila pneumoniae CWL029
aauuuuugcuaaacaaugca

SEQ ID NO: 2522996 - RNA, 17 nt, Chlamydophila pneumoniae CWL029
aauuuuuguagacaaua

SEQ ID NO: 2522997 - RNA, 19 nt, Chlamydophila pneumoniae CWL029
aauuuuuuguuaaauuccc

SEQ ID NO: 2522998 - RNA, 17 nt, Chlamydophila pneumoniae CWL029
aauuuuuuucaaaggag

SEQ ID NO: 2522999 - RNA, 19 nt, Chlamydophila pneumoniae CWL029
acaaaaaagggaucuccuu

SEQ ID NO: 2523000 - RNA, 21 nt, Chlamydophila pneumoniae CWL029
acaaaaacugcgcuagcucca

SEQ ID NO: 2523001 - RNA, 12 nt, Chlamydophila pneumoniae CWL029
acaaaaaugccu

SEQ ID NO: 2523002 - RNA, 18 nt, Chlamydophila pneumoniae CWL029
acaaaaccuggauugauc

SEQ ID NO: 2523003 - RNA, 23 nt, Chlamydophila pneumoniae CWL029
acaaaagguauugcaaauuucau

SEQ ID NO: 2523004 - RNA, 18 nt, Chlamydophila pneumoniae CWL029
acaaaagucucuagggaa

SEQ ID NO: 2523005 - RNA, 23 nt, Chlamydophila pneumoniae CWL029
acaaaagucucuagggaaaggag

SEQ ID NO: 2523006 - RNA, 17 nt, Chlamydophila pneumoniae CWL029
acaaaauuucuuauaaa

SEQ ID NO: 2523007 - RNA, 15 nt, Chlamydophila pneumoniae CWL029
acaaacaacagaaau

SEQ ID NO: 2523008 - RNA, 17 nt, Chlamydophila pneumoniae CWL029
acaaacaacagaaaugu

SEQ ID NO: 2523009 - RNA, 13 nt, Chlamydophila pneumoniae CWL029
acaaacagauuuu
